United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 121

SEQ ID NO: 234840 - DNA, 765 bp, Artificial Sequence
  Description of Artificial Sequence: Synthetic coding sequence
atggcggcttacaaactggtccttattcgacatggcgagtccgcctggaacctggagaatagattctctggatggtatgacgctgatctctctccagcaggccacgaggaggcgaagcggggaggtcaagccttacgggatgccggttatgagtttgacatctgtttcacatccgtgcagaagcgagcaatccgcacactatggaccgtcctggacgcaattgaccagatgtggctgccggtggttcgtacttggcgattgaatgaaaggcattatggaggcttaactggtttaaataaagcagaaactgccgcaaagcatggcgaagcccaggtaaaaatctggcgacgcagttacgatgtaccacccccacctatggagccagaccatccattttattcaaatataagcaaagaccggagatatgccgacctgacagaagatcagctgccctcatgtgaaagtcttaaggataccattgccagggcactgccattctggaatgaagaaattgtaccacagattaaggagggcaaacgagttctgatcgcggcacacggcaatagtctgaggggtattgtgaagcaccttgagggtctttccgaagaggctattatggagttaaacttacctaccggaatcccaatcgtctacgagctggacaaaaacctgaagcctataaagcctatgcagttcctgggggatgaagagacggtcaggaaagccatggaagcagtagccgcacaggggaaggctaagaaatag

SEQ ID NO: 234841 - DNA, 435 bp, Artificial Sequence
  Description of Artificial Sequence: Synthetic coding sequence
atgcctcttataagatgcggatgccatgatgtgccacctccgcctatggagcccgaccaccccttttattccaatatctctaaggatcgccgatacgcggatctgacggaagaccagctaccaagttgcgagagcctaaaggatacgatcgcacgtgccctgccgttctggaatgaggagatcgtgccccagatcaaagaggggaaaagggtactgatcgctgcgcatggaaacagtctcagaggtatcgtcaagcatctggaaggactttctgaagaggcaataatggagcttaatctacctacaggcatccccattgtgtacgagctggacaagaacctgaagcccatcaaaccaatgcaatttcttggagatgaagagactgtgcgcaaggccatggaggcagtcgccgctcaggggaaggcgaagaaatag

SEQ ID NO: 234842 - DNA, 762 bp, Artificial Sequence
  Description of Artificial Sequence: Synthetic coding sequence
atggcgactcaccgcctcgtgatggtccggcatggggaaagcacctggaaccaggagaaccgattctgcgggtggtttgatgccgaactgagcgagaaaggaaccgaggaggctaaacgcggtgctaaagcgatcaaggatgctaaaatggagttcgacatctgctatacctccgtgctaaaacgggcaattcgaacactgtgggccattttggatgggaccgatcagatgtggctccccgtcgtgagaacttggaggctgaacgaacggcactatggcggactgacaggcttaaataaagccgaaacagcagctaaacacggtgaggaacaagttaagatatggcggcgttcattcgatatacctccgcctcccatggacgagaagcatccatattacaactccattagcaaggaacggcgttatgccggactaaagcccggagaacttcctacctgcgagtccctgaaagacaccatcgcacgtgccctcccgttctggaatgaggaaattgttccacagatcaaggctgggaaaagggtactcatcgctgctcatggaaactctctcagaggcattgtcaagcacctggagggcatgtctgatcaagccatcatggaactcaatctgccaaccggcattccaattgtgtacgagctgaataaggagcttaagcccaccaagcctatgcagtttctgggcgacgaggagaccgttcggaaggccatggaggctgtcgccgctcaaggcaaggccaagtag

SEQ ID NO: 234843 - DNA, 765 bp, Artificial Sequence
  Description of Artificial Sequence: Synthetic coding sequence
atggcagcatacaagctcgtgctcattaggcatggtgaatcaacatggaatctcgagaatcggttctcctgctggtacgacgccgacttgagcccggcaggacacgaggaagcaaagagagggggtcaggcattaagagacgctggttatgaattcgacatttgcctaacatccgttcagaagagggtgatacggaccctgtggacagtgctggatgcaatcgatcaaatgtggttacctgtcgtgagaacatggaggctgaacgagcgccactatggcggtcttactggtctgaataaggccgagactgcggctaaacacggggaagctcaggtcaagatttggcggagaagctatgacgtcccccctccgcctatggagccagaccacccattttatagcaacatatcaaaggatagacgctatgctgacctgaccgaggatcagctgcctagctacgagagtcccaaggatacaatcgccagagctctgccgttttggaacgaagagatagttcctcagattaaagagggaaaaagagttttgatcgctgcacacgggaatagtcttcagggcatagcaaagcatgtggaggggttgtcagaagaggctatcatggagctaaacttaccaaccgggattcccatcgtatacgaactagataaaaatctcaagccgataaagcctatgcaatttttaggggatgaagagaccgtgtgtaaagccatcgaagctgttgctgctcagggcaaggccaagaaatag

SEQ ID NO: 234844 - DNA, 966 bp, Artificial Sequence
  Description of Artificial Sequence: Synthetic coding sequence
atggccgctgccgaggccggtggcgacgacgcgagatgtgtgcgcctctctgccgagagggcacaagctctgctggctgacgtggacacactacttttcgattgcgatggagtgttgtggcgaggcgagaccgccgtccccggtgctcctgaagctctccgtgcacttagagcccgagggaagaggctcggatttattactaataattcatccaagacaagagctgcctacgccgagaaactgcggagacttggttttggaggtccggctggccctggggctagcctggaggtatttggaactgcatactgtacagccttgtatctgcgccaaagattggctggcgcaccagctcccaaagcctatgtgctgggctctccagccctggctgccgaactggaggccgtgggcgtggccagcgtcggcgttgggcctgagccgctgcagggcgaggggcctggcgattggctgcatgcacctctcgagcccgacgttcgcgcagtggtggtgggatttgatccccacttctcctatatgaaacttaccaaggcgttacgctatctgcagcagccaggttgtctcctcgtcggtacgaacatggataataggttaccattagaaaacggacgctttatagccggaacaggttgtctagttagagctgtggagatggctgcccagaggcaggcggatattattgggaagccaagcagatttatctttgactgcgtgagccaagagtatgggatcaaccccgagaggacagtgatggtgggggaccggctggatacagacattctgctcggcgctacgtgcggcctgaaaaccatccttaccctgaccggggtcagcacattaggcgatgtaaaaaataatcaggaatccgattgcgtgagcaaaaagaaaatggtccctgacttctatgtggatagtatcgctgatctgctcccagccctgcagggctag

SEQ ID NO: 234845 - DNA, 378 bp, Artificial Sequence
  Description of Artificial Sequence: Synthetic coding sequence
atggccgtggccgatctggcactgatacctgatgtggacatcgacagtgacggcgtttttaagtacgttttgatcagagtccactccgcaccgcgaagcggagcccctgcagccgagagcaaagaaattgtgcggggatacaaatgggctgagtaccacgctgacatctacgacaaggtatctggcgatatgcaaaaacaggggtgcgactgtgaatgccttgggggtggcaggatctcccaccagtcacaggacaaaaagatacacgtgtacggctattcaatggcctacggtcccgcacagcatgccatcagcactgaaaagatcaaagccaaatatccggattatgaggtgacctgggcgaacgacggctattag

SEQ ID NO: 234846 - DNA, 375 bp, Artificial Sequence
  Description of Artificial Sequence: Synthetic coding sequence
atggccgtagctgatcttgcccttatccctgatgtagacatcgacagtgatggcgtgttcaagtacgtgttgatccgagtacactccgcacccagaagcggggctcccgctgccgaaagcaaagaaatagtacggggatataagtgggcagagtatcatgccgacatctacgacaaagtgtcaggagatatgcaaaagcaaggctgcgattgtgaatgtctcgggggaggaaggattagccaccagtcacaggacaaaaaaatccatgtgtacgggtattctatgatgaggcccacttgcgtgcccttgggggctagtggaccacggattcaccaccagggactgtggtcctgtccagcgagacactttaactag

SEQ ID NO: 234847 - DNA, 375 bp, Artificial Sequence
  Description of Artificial Sequence: Synthetic coding sequence
atggcggtggcggatcttgctctgatccccgacgttgacatagatagtgacggggttttcaagtatgtgctgatccgcgtgcatagcgccccaaggtccggcgcacctgcggcagagagcaaggagattgtgaggggatataagtgggccgagtatcacgctgacatctacgacaaggttagcggggacatgcagaaacaggggtgtgactgcgagtgtctgggcggaggaagaatttcccatcaatcacaggataaaaaaatacacgtatatggctactctatgatgcgcccaacatgcgtgcccttgggcgcaagcgggccaagaattcaccatcagggcctgtggtcctgtcctgccaggcactttaattag

SEQ ID NO: 234848 - DNA, 1356 bp, Artificial Sequence
  Description of Artificial Sequence: Synthetic coding sequence
atggctaccgacgataagacctctcccacactagattcagctaacgatctgcctcgcagtcccactagcccaagccacctcactcacttcaaacctttgaccccagatcaagatgaacctcctttcaagtccgcctattcctcctttgttaacctttttagatttaataaagaaagggccgagggcggtcagggggaacagcagcctctgtctggcagttggacaagcccacagcttccgagcaggacccagtcagtgaggagcccaacaccatacaagaaacagctcaatgaagagctacaacgccgttccagcgcgctcggggatctccgggcatgtacatactgtcgaaaaatcgccctgtcctacgcacattcgacggattcaaacagcattggggaagatctcaacgcgttgagcgattccgcctgttctgtgtcggtccttgacccatctgagccacggacgcccgttggtagccggaaggccagtaggaatatctttttggaggatgatctcgcatggcaatcacttattcatcctgacagttcgaacacccccctgtctacaagattagtctcagtccaggaagatgcaggtaagtcgcccgctagaaaccggtcggcctccattaccaatctgtctctggatcgctccggcagccctatggtgccttcctatgaaactagcgtatcccctcaggcgaaccggacatacgttcggacagagactaccgaggacgaacgcaagatactcctcgactccgttcagttgaaagacctgtggaaaaagatctgccatcactcctctggaatggaattccaggaccacaggtattggctccgcactcatcccaattgcattgtgggcaaagaacttgtcaattggctgattaggaatggacacatagccacaagagcacaggccatcgcgatcggccaggccatggtggacggcagatggttagactgcgtcagccaccacgatcaactgttcagagacgagtacgccctgtacaggcctcttcagtccacagaattctcggagacccccagccccgacagcgactctgtcaatagtgttgaggggcatagtgaaccatcctggttcaaggatatcaagttcgacgactccgacaccgaacagatcgccgaagagggcgacgataatctcgccaactctgcaagtccatctaaaagaacaagcgtgtctagctttcaatccaccgtggatagcgactctgcggctagtatttcattgaacgttgagctcgacaatgttaatttccatatcaagaagccctcaaagtaccctcacgtgccccctcatcctgcggaccaaaaaggcagacgatag

SEQ ID NO: 234849 - DNA, 1647 bp, Artificial Sequence
  Description of Artificial Sequence: Synthetic coding sequence
atggcaacagatgataaaacgtcaccaacgctcgattcagctaacgatctccctcggagccccacctcccccagccatctgacccactttaaaccattaacgccagatcaagatgagccgccttttaagtctgcctattcctcatttgtgaatctgtttcgctttaataaagaaagagccgagggtgggcagggagagcaacagcccctgtctggatcatggacttctccccaattaccaagccggacccagtctgtccggtctcccaccccctacaagaaacagttgaacgaggaactgcagaggcgatctagcgctttagatactcggaggaaggctgagccaacgtttggcggacacgatcctagaaccgctgtgcagctcagaagcttgtcaactgtgctcaaaaggctcaaggagatcatggagggaaagtcccaggactccgacctgaaacagtattggatgcccgatagccagtgtaaagagtgctatgactgcagcgagaaatttacgacattccgcagacgacatcactgtagactgtgtggacaaattttttgtagtcgctgctgcaaccaagagattcctgggaagtttatgggatataccggggatctccgggcatgcacatactgtagaaagatagccctctcatacgcacactcaactgatagtaactccatcggtgaggatctcaatgcactcagcgattcagcttgtagcgtttctgtgctagatccttctgagcctcggaccccagtggggtctaggaaagcctccaggaacatctttctcgaggacgatttagcttggcagtcgttaatccatcccgatagcagcaacaccccgctatcgacccggctggtcagcgtccaggaggatgcgggaaaatctcccgctagaaatcggtcggcttcaatcaccaacctgagcttggacagatctggatccccaatggtcccctcctatgagacaagcgtctcgcctcaggctaaccggacatacgtgagaaccgagacaactgaggacgagaggaagattcttttggactccgttcagctcaaagatttgtggaaaaaaatatgtcaccacagtagtggcatggagttccaagaccaccggtattggctgaggacccatcctaactgcatcgtagggaaggagcttgtcaactggctgataagaaacgggcacatagccactagggcacaggcaatcgcgatcggccaagctatggtggatggcagatggctcgattgtgtgtcccatcatgatcaactgtttagggacgaatacgctttatatcgccctctgcagtctaccgaatttagcgagaccccatcccctgatagtgactccgtgaattcagtagaagggcactccgagccttcctggttcaaagacattaagttcgatgattctgatacagagcagatcgcagaggaaggtgacgacaatctggcgaacagcgcctcccccagcaagcgaacgtcagtgtcatcgtttcaaagtacagttgattctgactcggccgcatctatcagccttaacgtggagcttgataacgttaatttccacattaaaaagccaagcaagtatccacatgtccccccacatcccgcagatcagaaggggcgacgatag

SEQ ID NO: 234850 - DNA, 6297 bp, Artificial Sequence
  Description of Artificial Sequence: Synthetic coding sequence
atggctaccgacgataagacttctccaactcttgatagcgccaacgatctgccccgaagtccaacctccccgagccacctgactcacttcaaacctcttacacccgaccaggatgagcctccatttaagagtgcttacagctcatttgtcaacctcttcaggtttaacaaagaaagagccgaagggggacagggcgaacaacaaccactctccggttcgtggacaagccctcaactgcccagtcgaacacagagcgtgagaagccctacaccctacaagaagcaactcaacgaggaactgcagcgtcgttcatctgccctggacacgcgcaggaaggcggagcctacttttgggggtcacgatcccagaactgccgttcagcttcgcagtttatctacagtgctgaaaagacttaaagaaattatggaggggaaatcccaggacagcgacctgaagcagtactggatgcccgattcccagtgcaaggaatgctatgattgttccgagaagttcacaacatttagaaggaggcatcattgccgcctgtgcgggcagatcttctgtagcagatgctgtaatcaggagatccctggtaagtttatggggtatactggggacctccgggcatgtacttattgccgaaagatagcgctgagctacgctcatagcactgactccaacagtattggtgaagacttaaacgcgctgtctgattctgcgtgttctgtcagcgtgctcgatcctagcgaacctaggaccccggtcggttcgaggaaggcatctcggaacatattcctcgaggacgatctggcttggcagagccttattcatcccgattctagtaatacccccctgtccacacgattggtaagtgtgcaggaggacgccggaaagtcaccagcccgaaaccgctccgcaagcattactaacctgagcctagatcggtccggctcccccatggttccatcctatgaaacctctgtcagcccccaggccaaccgtacatacgtcaggaccgagaccaccgaagatgaacggaaaattctattagacagcgttcaactaaaggacctgtggaagaagatctgccaccactcttccggaatggagtttcaggatcaccgctattggttacgaacccatccaaattgcatcgttggaaaagaattagtaaattggctaattagaaacggccacattgccacccgcgctcaggctattgccattgggcaggcaatggtggatgggcgatggctggattgtgtcagccaccacgaccaactgtttagagatgagtatgctctgtatcgtcctttgcagtctacagagttctcggaaacgccctcacctgacagcgactcagtaaactccgtggaggggcactccgagccgtcctggttcaaagatattaaatttgacgactcagataccgaacaaatcgcggaagagggagatgataacctcgcaaatagtgcaagcccatcgaaacgcactagcgtctcaagcttccagtctacggtcgactccgattccgccgctagtatatccctcaatgtggagcttgacaatgtgaacttccacattaaaaaaccatcaaagtacccccacgttccaccccacccggcagatcaaaaagagtacctcattagcgataccggcggacagcagctctccatctcggacgcctttatcaaggagtccctgtttaatcgaagggtggaagaaaaaagcaaggagctgccatttacccctctggggtggcatcacaacaacctggagctgctgagggaagagaacggagagaagcaagcgatggagagactgctgagcgccaaccataaccatatgatggccctgcttcagcaactgctgcattctgattccctgagctcgagctggagagacattattgtgtcgctggtctgccaggtggtgcagacagtcaggcccgatgttaaaaatcaggacgatgatatggatatccgccaattcgtccacatcaagaaaataccaggcggaaagaagttcgactctgtggtagtgaacgggttcgtttgtaccaagaatatcgctcacaagaaaatgtcttcttgtatcaagaatcccaagatactcctgctaaagtgttctattgaatacctctatagggaagagacaaagtttacttgcatagatccgatagtgctacaagagcgggagtttctaaagaactatgtccagcgcatagtggatgtccgccctactctggtgctggtggagaaaaccgtcagtaggatcgctcaggacatgctgcttgagcacggcattaccctcgttatcaatgtcaaaagccaagtgctcgaaagaattagccgcatgacacaaggcgatttggtcatgtcaatggatcagctcctgaccaaaccacatctcggaacctgccataaattttatatgcaaatcttccagctgccaaatgaacaaacaaagacactgatgttcttcgagggttgccctcagcacctgggctgcaccatcaagctccgcggaggctcagactacgagctggcaagggtcaaagaaatcctaatatttatgatctgtgttgcttaccactctcagctggagatttctttcttgatggacgaattcgcaatgcccccaactctcatgcaaaaccccagctttcactctctgattgagggcagaggccatgaaggggcagtccaggagcagtacggcggaggatcaattccctgggatcctgatataccaccagagagcctgccatgtgatgacagcagtctgctggagctcaggatcgtcttcgagaaaggggaacaggaaaataagaatctgccccaggctgtggcttctgtaaaacaccaggaacattccacgaccgcatgtccagccggactcccctgtgccttttttgcacctgtgccagagtctttgcttcctcttcccgttgacgaccagcaggacgccttgggaagcgagcaacccgaaactttgcagcagaccgttgttctgcaggaccccaagtcacagattagggcttttcgggatccgctccaggacgatacaggactctacgttactgaagaagtcaccagttccgaggacaaaaggaaaacttactcgctcgcatttaaacaggaacttaaagacgtaattctttgtatctcccccgtcattacctttcgggaaccattccttctgacagaaaagggcatgcggtgtagcactcgggactatttcgctgagcaggtgtactggtcccccctcctaaacaaagagttcaaggagatggaaaatcgtcgcaaaaaacagctcttgagagatctttctggacttcaaggcatgaatggtagcattcaggctaagagtatacaggtactaccatctcatgaattggtttccacaagaatcgctgaacacctgggcgattcacagtcccttggcaggatgcttgccgactaccgcgcacggggaggcagaattcagccaaagaattcggaccctttcgcccattcaaaagacgccagctccacctcctctggtcagtctggctctaagaacgagggagatgaagagcgcggacttattctgtcggacgccgtctggtccacgaaggttgactgtttgaatccgattaaccaccagcggctgtgcgtgctgttttcctcttcctccgctcagtctagcaacgccccaagtgcctgcgtttccccctggattgtcaccatggagttttatgggaagaatgatttaacgctgggaatcttcctggagcgctactgctttaggcctagttaccagtgtccttcgatgttctgcgacacaccgatggttcaccacatcagacgattcgtccatgggcagggatgtgtgcagattattctcaaagagttagactctccagtccccggatatcagcatacgatcctaacttacagttggtgcagaatctgtaagcaggttactcctgttgtagccctgtcgaatgaaagctggtctatgtccttcgcgaaatatcttgagctccggttctatggtcaccaatatacaaggcgtgccaatgcggaaccgtgtggccacagcatccatcacgattatcatcaatatttttcctacaaccagatggtcgcctcattttcctactctccaattcgcctgctggaagtgtgtgtccccctgcctaagattttcatcaagcgacaagctccactgaaagtatccctgttacaggatttgaaagattttttccagaaggtcagccaagtgtatgtcgctatcgatgagcgcctagcctcactgaagacggacactttttcaaagacacgcgaagagaagatggaggatatctttgctcagaaagaaatggaagagggcgagttcaagaactggatagagaagatgcaggctcgattaatgagctcttctgtggacacccctcaacagctccagtctgtgttcgagagcctgatagctaagaagcagtccttatgtgaagttctgcaggcatggaataacagactgcaagatctcttccagcaggagaagggtcgtaaaagaccctcagtgcctccttcaccgggtcggctgcggcagggcgaagaatcgaagatctctgctatggacgcaagcccacgtaacatttcccccggtctgcagaatggcgaaaaggaagacaggtttcttactaccctgtcgtctcagagttcgacgtccagcacacatctgcaattgccaacaccgcctgaagttatgtccgagcagtcggtgggaggtcctcctgaactggatactgcatcttcctccgaagacgtctttgacgggcatctgctggggagcaccgactctcaagtgaaggaaaaaagcaccatgaaagcgatatttgccaatctcctgccaggcaacagttataatcccatcccctttccctttgaccccgataagcactacctgatgtacgagcacgaacgcgtaccaattgccgtctgcgaaaaggagccaagtagtattattgcatttgcactaagttgtaaggagtatcggaacgctcttgaggaactgagtaaggcaactcagtggaacagtgccgaagagggccttcctaccaattccacatcagatagtagaccaaagagctcctccccgattagactacctgaaatgagcggagggcagaccaacaggacgaccgaaactgaaccgcagcctaccaagaaggcgtccggaatgttatcatttttcaggggcacggcgggtaaaagtcctgacctaagctctcagaagcgcgagactctgcggggagcagactctgcgtattaccaggtcggtcagacagggaaagagggcaccgagaaccaaggggttgagccacaggatgaggtggatggcggtgacacccaaaagaaacagttaataaacccccatgtggaactgcagttctccgacgcgaacgcgaagttttactgccgcctttactatgcgggagagttccacaaaatgcgcgaggtgatactagattctagcgaagaagatttcattcgaagcctttctcattcaagcccttggcaggccaggggtggaaaatctggtgccgcattctacgcaacggaagacgacaggttcattctaaaacaaatgccaagacttgaggtacagtcctttctcgatttcgcacctcactactttaattacatcacaaacgccgttcaacagaaacgtccaacagccctggccaagatactgggggtttacaggatcgggtacaaaaattcgcagaataataccgagaagaagctagacctcctggttatggagaatttgttctacggccgtaagatggcccaggtgttcgatctgaaaggtagcctacggaaccgcaacgtgaaaaccgacactggtaaggaatcctgtgacgtggtgctgcttgatgagaatctactgaagatggtgcgagacaatcccctctatattcgttctcacagtaaagccgtcctccgtacaagcattcactccgattctcattttttgagtagtcacctgatcatcgactactctctcttggtggggagagatgatacctctaacgagctcgtggtaggcatcatagattatattcgcacctttacttgggacaaaaagctcgaaatggtggtgaagagcaccggtattttgggcggacagggcaaaatgcctaccgtggtgagccctgagctgtataggacacggttctgcgaagccatggacaaatacttcctaatggtcccagatcactggacggggctcggactcaattgttag

SEQ ID NO: 234851 - DNA, 3051 bp, Artificial Sequence
  Description of Artificial Sequence: Synthetic coding sequence
atggagtttcaggatcaccgctactggctgagaacccaccctaattgcattgttggcaaggagctggtgaactggctgatcaggaatggccacatcgcaacgcgtgctcaggccatcgcaattggtcaggctatggttgatgggaggtggctggactgcgtaagccaccacgaccagctcttcagggatgagtacgcattgtaccgccctctgcagtccaccgaattcagtgagacacccagccctgactcagacagcgtcaactctgtcgaggggcacagcgagccatcttggtttaaagacattaagtttgacgacagcgacactgaacagatcgctgaggaaggcgacgacaacctcgccaagtatctgatctctgacacaggcggacagcagctatctattagcgatgcttttatcaaagagtcgctctttaatagaagggtagaagaaaagtcgaaggagctgcccttcacaccgttgggctggcaccataacaatctggaactgctgcgagaggaaaatggagagaagcaggcaatggagagactgttaagcgcgaatcataatcatatgatggcactgctgcagcagctgctgcactctgactcactgagttcatcttggcgcgacatcattgtgtcactcgtctgtcaggttgtccagaccgtcagaccagatgtgaaaaatcaggacgatgatatggatatccgtcaattcgtacatatcaaaaaaatccccggaggaaaaaaatttgattccgtggtggtcaatgggttcgtgtgtacgaaaaacatcgctcacaaaaagatgtcctcttgcatcaagaaccccaagatcctactgctcaagtgctctattgagtacttgtacagagaagagaccaagttcacgtgcatagaccctatcgtgctgcaggaacgcgagtttctgaaaaactatgtccagcggattgtcgacgtaaggcccaccttagtgctggtagagaaaactgtgagccggattgcccaagatatgctgctcgaacacgggattacgttagtaattaatgtcaagagtcaggtacttgaacgcatttcccgcatgacccagggcgatctggtgatgagcatggatcagttgttaaccaaaccacatctgggcacctgtcataaattctacatgcagatttttcagctccccaacgaacagactaaaacccttatgtttttcgagggatgcccgcagcatctcggctgtaccatcaagctgaggggcggatcagactacgaactcgctagggtgaaggagatcctgatctttatgatctgtgttgcctatcactcccagctcgagatatcctttctgatggacgagtttgccatgccgccaacgctgatgcagaatccaagtttccactcccttattgaggggagaggccacgagggcgctgtccaggagcagtacggaggcggaagcattccttgggaccccgacatccccccagagagcctgccatgcgacgactctagcctgctggaactgaggattgtgtttgaaaagggcgaacaggaaaacaaaaacctgccccaggcagtggccagcgtcaaacaccaagagcacagcaccactgcctgcccggctggcctgccatgtgctttctttgctccagttcctgaatcactgcttccgttgcccgtagacgaccagcaagacgcactgggatctgaacagccggagactttgcagcagacagtcgtattgcaggatcccaaatctcaaataagggcgtttcgtgaccccttgcaggatgataccggactgtacgttacagaagaggtgacatcttcggaggataagagaaagacatactccctcgcattcaaacaggaattaaaggacgtgattctgtgcattagccccgtgattacatttcgtgagcccttcctcctgactgaaaaagggatgcggtgttcaactcgtgattactttgccgaacaggtgtattggtctccgttactcaataaagagtttaaggaaatggagaatcgaagaaaaaagcaactgctcagagacctgagcggtctgcaggggatgaatggtagcatccaggcaaaatccattcaggtgctgccttctcacgaattggtgagtactagaatcgctgaacacttgggggattcacaaagtctgggacggatgttggctgactaccgcgcacgagggggacggatccaacccaagaatagtgacccgtttgcccattccaaggatgcgagttccacgtcttccggccagtccggcagcaaaaacgagggagatgaagagaggggcttgattctttcagatgccgtgtggtccaccaaggttgactgcctcaatcctatcaatcaccagcggctttgcgttttattttcctcctcttctgcacagagttcaaacgccccatctgcgtgcgtttctccttggattgttacgatggaattttacggcaagaatgacctgactctcgggattttcctagagcgatattgcttccggccaagctatcagtgtcctagcatgttttgtgatacgccaatggtccaccatattcggagattcgtgcacggccagggctgcgtacagatcatccttaaggagctcgacagccccgtaccaggttatcagcacactattcttacctacagctggtgcagaatctgcaaacaagtgaccccagtcgttgctctcagcaacgagagttggtccatgtcattcgctaaatacctcgagttaaggttctatggccaccagtacactcgcagggcaaatgcagagccatgtggccattcgattcaccatgactatcaccagtatttctcctacaatcagatggtcgcctccttctcctactcccccataaggctgctggaggtgtgtgtgcccctgcctaaaatttttatcaaacggcaggctccgttaaaggtctccctgctgcaggaccttaaggatttttttcagaaggtgtctcaggtatatgtagccatcgatgagagactcgctagcctgaagaccgatactttctcctag

SEQ ID NO: 234852 - DNA, 522 bp, Artificial Sequence
  Description of Artificial Sequence: Synthetic coding sequence
atgaggccttggtcctctccagcccaactggttgcaggcgctcagcccgctggccgaggggatcctttaggtcctaggcctatcccccctccgaggtttcggagggcttcttcacagcgggaaccaccgtatccacgacccgcagagccggctttggagctggctggctcaaaatgtcagcctgacactcccgcagcaagtctttgccccgctgacagcccaagtcagcacagggtcatgcctccaggaccggcttcgtgggcgaatgtgggctcacgccctcatacagttgccaatggacacgaacttttcgaagtgagtgaggagagagatgaagaggtggccgctttctgtcacatgttggacatcctgcggagtggatccgatattcaggactatttcttaacaggttacgtatggagtgccgtgacgcccagccccgagcacctcggagatgaggttaacttaaaagtgaccgtcctttgcgacaggctgcaggaagccctgactttcacctgctag

SEQ ID NO: 234853 - DNA, 4904 bp, Artificial Sequence
  Description of Artificial Sequence: Synthetic coding sequence
atgagcagcactcagggaaacggagagcattggaagtcactcgaaagcgtaggcatctcccgtaaagagctggctatggccgaagccctccagatggagtacgatgccctgagtaggctcaggcacgacaaagaggaaaatcgcgctaagcagaatgcagatccttctctgattagttgggatgagccgggagtggatttctattctaaaccagctggaagaagaaccgatttgaagctgcttcgaggactgtccggcagcgacccaactctcaattacaatagcctctctccccaagagggccctcctaatcattccacatctcagggaccacagccagggtccgatccttggccaaagggcagcctttccggagactatctttacatatttgacgggtccgatggtggtgtgtcaagtagtcccggacctggagacatcgagggttcatgcaagaagctgagccctccgcctttaccaccacgcgcatcgatctgggatacgcccccattgccacctcgtaaaggttctccctcatcctcaaaaattagtcagccatccgacattaacactttctccctcgttgagcaattgccaggtaagctgctggagcataggatcctcgaggaggaggaagtgttgggcggaggaggtcagggcaggctgctcggctccgtggactatgatggcataaatgacgccataactcgcttaaatttgaaatccacatatgatgcagaaatgctcagagacgcaactcggggatggaaggagggacggggtcctcttgacttcagcaaggacacgtctgggaagcccgtggccagaagtaaaacaatgccaccgcaagtgcccccaagaacgtatgcttccagatacggcaaccgcaaaaatgccacccccggaaagaaccggaggatatccgcagcccctgtgggatcacgaccacatacagtagctaacggccacgaactctttgaagtcagtgaagagcgggacgaggaggtggccgctttttgtcatatgctggatatcctgaggtccggcagcgacattcaggattacttcctgaccggatacgtttggtccgccgtgacccccagcccggagcacctgggtgacgaggtgaatcttaaagtcacagtattgtgtgaccgcctgcaggaggctcttacattcacatgtaattgttcctccaccgtggacttgctgatctatcagacactatgctatactcacgatgacctccgtaacgtcgatgtgggagacttcgtgttgaaaccatgcggcctggaggagtttctccagaacaagcatgccttagggagccatgaatatattcagtactgtcggaagttcgatatcgatattcggctgcagctgatggagcagaaagtcgttcggtctgaccttgctcgtacagtaaacgacgatcagtctccctcgacactgaactatcttgtacacctgcaggagcgaccagtaaaacagacaataagcaggcaggcgctgtctctgctgtttgacacatatcacaatgaggtggatgcttttctgctcgctgacggagacttccctctgaaggctgacagggtagtgcagagtgtcaaggccatatgtaacgcattggccgcagtggagacaccagagattacgagcgccctgaatcaactccctccctgccccagcagaatgcagcccaagatccaaaaagacccatccgtgctagcagtccgcgagaacagggaaaaagttgtcgaagcactaacagccgctatccttgacctggtggaactttactgtaatacctttaatgccgattttcaaaccgccgtgccaggttcgcgtaagcacgatctggtgcaggaggcctgtcattttgccagatcactagccttcacagtctacgccacacatagaattcccataatttgggctacttcttatgaggatttttatctctcatgctcactcagccacggcggaaaggagctgtgttcccccttgcagactcggcgagctcatttcagcaagtacctctttcatttaatcgtgtgggatcagcaaatctgttttcctgtgcaggtcaatcgactccctagagaaaccttgctctgcgcgacactttacgcactacctatcccgcctcccggtagcagctctgaggcgaacaaacagcggagagtcccagaagctctgggctgggtgacaactcctctgttcaattttcgccaggtgttgacttgtggaagaaaactgctcggactttggccggctactcaagagaacccatccgctaggtggtcagcccctaattttcaccagcccgattctgtaatcctgcaaatagacttccccacctccgccttcgacataaaattcacatccccccctggcgataagttcagtccacgttatgagtttgggagtctgagagaggaagaccagagaaaactcaaggatatcatgcagaaagaaagcctctactggctgacggatgctgataaaaagaggctgtgggaaaagcgatattattgtcacagcgaggtatcttcacttcccctcgtgctcgcctccgcaccaagctgggagtgggcgtgtctgccggatatctatgttctcttgaaacaatggacacatatgaatcatcaggacgcattgggccttttacacgccacattccccgatcaggaggttcgacggatggcggttcagtggatcgggagcctatcagacgcggagctgctggattacctgcctcagctggtgcaggcattaaagtatgagtgctatctagacagcccactggtgcgattcctgctaaaacgcgcagtgtccgacctgcgagtgactcactactttttttggctacttaaagacgggctgaaggattcacagttttccataaggtaccagtacctgttggccgcactgctgtgctgttgcggcaaagggctgcgcgaggaatttaaccgacagtgttggcttgttaatgctctggcaaagttggcccagcaagttagagaagcagcacccagtgccaggcagggcatactacgaaccggcctggaggaggtgaaacagttctttgccctcaatggctcatgcagattgccacttagcccctcacttttggtgaaaggtattgtccccagggactgcagttatttcaatagcaatgccgttccactgaagttgtcgttccagaacgtggaccctctgggagaaaacattcgcgttatctttaagtgcggggacgacctgcgccaggatatgctgaccctccaaatgataagaatcatgagcaaaatctgggtgcaagagggcctggatatgaggatggtgatttttcggtgcttctccactggtaggggccgtggcatggtcgagatgataccaaatgctgaaactctgcgcaagatccaggtggagcacggagttaccggatcattcaaagacagaccacttgccgactggttgcagaaacataatcctggggaggatgagtatgaaaaagcggtcgagaatttcatttatagttgtgctgggtgctgcgtcgcaacgtatgtattgggcatttgcgacagacacaatgataatatcatgcttaagaccaccggtcatatgtttcacatcgacttcggtagattcttgggccacgctcagatgtttgggaatataaaacgtgatagagctccttttgtcttcaccagtgatatggcctacgtcatcaacgggggagataagccatctagccgcttccatgacttcgtcgatttgtgttgccaggcttacaacctcattcgtaagcacacacatcttttcctaaatcttctcggactcatgctcagctgcggcatcccagaactgtctgacttggaagacctaaagtacgtgtacgatgcacttcggccacaggacactgaggccaacgcaactacttacttcacaagattgattgagtcaagtttgggttctgtggcaacaaagctcaacttctttatacacaatctggcccaaatgaagtttactggatcagacgatagactcacacttagtttcgctagcagaacacataccctgaaaagctccgggaggatcagtgacgttttcctttgcaggcatgaaaagattttccaccccaacaaagggtacatttacgtggtcaaggtcatgagggagaacacccatgaggctacctacatccagcgaacattcgaggagttccaagaactacacaataagctccggctgctgttcccctcctctcatctgccctcatttcctagccgattcgtgattggcaggtctcgtggagaagccgtggctgagcgccgtagagaagagcttaacggctacatctggcacctgatccatgccccacctgaggtcgctgagtgtgacctggtctacacgttttttcaccccctgcctagagacgaaaaggctatgggtacttctcccgcacccaagtcctccgatggtacctgggctaggcccgtgggaaaagtgggcggagaagtcaaactaagtatctcctacaagaacaacaaactgtttattatggtgatgcatattcggggtctacagttactgcaggacggcaatgatcctgatccctacgtgaagatctacctcctccccgacccacaaaagacaaccaagcgtaaaaccaaggtcgcccgaaaaacgtgcaacccaacttacaatgaaatgctggtgtatgacggaatccccaaaggcgatctgcagcagagagagctacaactgagcgtgctgtctgagcagggattctgggagaacgtactactgggcgaggttaatatccggttacgggagctcgatctagctcaggaaaaaaccggatggttcgcactggggtcaaggagccatggaacgctcta

SEQ ID NO: 234854 - DNA, 360 bp, Artificial Sequence
  Description of Artificial Sequence: Synthetic coding sequence
atgtttggcaacatcaaacgcgacagagcgcctttcgtgtttacaagcgatatggcgtatgtaattaacggtggtgacaagccttcctctagattccacgatttcgtggacctttgttgccaggcctacaacttaattcgcaaacacactcacttgttcttaaacttgttaggtttgatgctgtcctgtggtatacccgagctgagtgacctagaagacctgaaatatgtttacgatgctcttcggccacaggatacagaggccaatgccacaacttactttacacgcgtgatccttgcaagtgtagtgggaggacgagaatccaagacatgcagcgcagtgagctcctccggagattag

SEQ ID NO: 234855 - DNA, 396 bp, Artificial Sequence
  Description of Artificial Sequence: Synthetic coding sequence
atgtcaagtacacaaggcaacggagagcactggaaatcactcgagtccgtagggataagcaggaaggagctggctatggcagaggccctgcaaatggaatatgacgctttatctagactgaggcacgataaggaagagaatagggccaaacagaatgccgatcctagtctgatatcttgggacgagcccggagtcgatttctatagcaagccagctggacgccgtacagacctgaaactattgcggggacttagtgggtcagacccgacgctgaattacaactcactcagtccgcaggagggtcctccaaaccactcaacatcacagggccctcagccaggcagtgacccctggcccaaaggctcactgtctggagactacttatatatattctag

SEQ ID NO: 234856 - DNA, 4820 bp, Artificial Sequence
  Description of Artificial Sequence: Synthetic coding sequence
atgagtagcacccagggtaatggcgagcactggaagagtctggaatcggttgggatctctcgcaaggagctggcaatggcagaagcgcttcagatggaatatgacgcactatcacgcctgaggcatgataaggaagaaaatcgtgccaaacagaacgcagacccctcacttatctcctgggatgaacccggtgtcgatttttactcaaaacctgcgggaaggagaacagacctcaaactattaagggggttaagtggttccgatccgacactgaattacaatagtctctctccccaagaaggccctcctaatcacagcacctcccagggacctcagccaggatccgacccgtggcctaagggcagtttatcaggcgactacctttacattttcgacggctccgatggaggggtgagtagctcgccagggcctggcgatatcgaggggtcatgcaaaaaattatcacctccgccactgccaccgcgtgcttctatctgggacacgccgcctctgcctcctagaaagggctcccctagtagcagcaagatctcccagccaagcgacatcaacactttcagcctcgttgagcagctgcccggtaagttgttggagcaccggatcctcgaagaagaagaggtgctgggtggcggaggtcaagggagattactgggatccgtggactatgacggcataaatgatgccataacgcgccttaacctgaagagcacatacgatgctgaaatgttacgggatgctacccggggttggaaagagggaaggggaccgctggactttagcaaggacacttcaggtaaaccagtggcgcgatccaagacaatgccaccacaggtgccgcctagaacatacgcatcgagatatggaaatcggaagaacgccactcctgggaagaaccgtcggattagtgcggcacccgtaggcagccggcctcacaccgttgccaacggtcatgagttgttcgaggtgagcgaggaacgggacgaagaggtggctgcattttgccacatgctggacatcctccggtcagggtcggatatccaggattacttcttgaccggctacgtgtggagcgctgtaacaccctctcccgagcatctgggtgatgaagtcaatttgaaagtgactgtgctctgtgacaggctccaagaagctctcaccttcacatgtaattgcagctccaccgtcgatcttctgatataccaaactctgtgctacacccacgatgatctgagaaacgtggacgtaggcgactttgtcctcaagccttgtggtctggaggaatttctgcagaataagcacgctttgggcagtcatgaatacatacaatattgcaggaagttcgacattgatatcaggctgcagcttatggaacagaaggtcgtgaggagtgatctggccaggacagtgaacgacgatcagtcccccagcacactcaactacctggtccacttgcaggagagacctgtgaagcagacgatttctcggcaggcgctcagcttgttattcgacacttaccacaatgaggtagacgcctttcttctggctgatggcgattttcccctgaaggctgatagggtagtgcagtcagtgaaggctatttgtaatgccctggccgcagtggagacaccagagattacgtctgcacttaaccaacttcccccttgtccatcgcggatgcaaccaaaaatccaaaaggatccatcagtattggccgtgcgggagaaccgggagaaggtggtggaggcactgactgccgctattcttgatctagtggagctatattgtaacacctttaacgccgattttcaaaccgctgtccctggtagccgcaagcatgacctggtgcaggaagcatgtcatttcgcaaggagcttggcctttacagtctatgccacacacaggattccaatcatctgggccactagttacgaagatttttacctctcctgttctttatctcatggagggaaggaactttgttctcctctgcagactagaagagctcactttagtaaatatttgttccacctcattgtgtgggaccaacaaatctgcttccctgtacaggtgaataggctgcctagagaaactctgctatgcgcaactttgtacgcactcccaattcctcccccaggctcctccagcgaggcaaataaacagagacgcgttcctgaagctcttgggtgggtgaccacccccctgttcaacttcagacaggttctgacctgcggtcgcaagctgttaggactatggcccgctacacaggaaaatccgtctgccaggtggtctgcaccaaatttccatcagcccgattctgtaatcctgcaaattgattttcccacaagcgcatttgatatcaagttcaccagtcctcctggggacaaattcagccctcgctacgagttcgggtctctgcgcgaggaggaccagcggaaactgaaggacatcatgcaaaaggagtctttatactggctgaccgacgccgacaaaaagcgcctttgggagaagagatattactgtcatagcgaatggacacacatgaaccatcaagacgccctgggactgctccacgccactttcccagatcaggaagttcgccgaatggccgtgcagtggatcggctcactgagcgacgctgagctactggattatctgcctcaacttgttcaagccctcaaatatgaatgttaccttgactcgccactggttcgatttctgctaaagcgcgctgtgtcagaccttcgggtgactcattactttttctggcttcttaaggatggactgaaggactcacaattcagcataaggtaccaatatctgctggcggctttattgtgttgttgcggcaaagggctccgtgaggagtttaatcgacagtgttggcttgtgaatgccctcgcgaaattggcccaacaggtgcgtgaggccgcaccctcagccaggcaggggatcctgcggaccggactggaagaggtaaagcagttttttgccctgaatggatcatgtagactgccactttctccttctctgcttgtgaagggcatcgttcccagagactgctcctatttcaattcgaatgcagtccctttgaagctgtcctttcagaacgttgatcctcttggggaaaacattcgagtgatttttaagtgtggtgatgacctgcggcaggacatgttgaccttgcaaatgatccgaattatgtcgaagatctgggtccaagaaggacttgacatgcgtatggtgatctttaggtgtttttctacaggccgtggcaggggcatggtggagatgattccaaatgcagagactctgagaaaaatccaggtggagcatggggttaccggttcgttcaaagataggcctctggcagactggttacagaagcacaacccaggtgaagatgagtatgaaaaagcggtcgagaattttatttattcttgcgccggatgttgtgtggccacttatgtgctgggtatctgtgatcggcacaacgataacattatgctcaagaccacgggccacatgtttcatatcgattttggcaggtttctggggcatgcccaaatgttcggcaacattaagagggatcgggcaccctttgtctttacatctgatatggcatatgtcatcaacggcggagacaagccatcatccagatttcacgacttcgttgacttatgctgccaggcgtataatctaatacgcaaacatacccacttgttccttaatctgttgggtctgatgctctcttgtggtatcccagaactctcggacctggaagacttgaagtatgtttatgacgcgctccgccctcaggacacagaagcgaatgccaccacatattttacaaggttgattgaatcaagcctggggtcagtcgcaactaagttaaatttttttatccataacctggcacagatgaagtttacggggtccgacgaccgactgacactaagcttcgctagccgcacacacacattaaaatccagcggacgaatttcggatgtgtttctctgtaggcacgaaaaaatatttcacccaaacaaaggatatatctacgtcgttaaggttatgcgtgaaaatacccacgaggcaacgtacattcagaggacctttgaagaatttcaagagctccataacaaactaaggctgctgtttcccagcagccaccttccctcattcccgagccgtttcgtgattggcagaagcaggggtgaggccgtggccgaacggcgtagagaggagctgaacggctacatttggcacctgatccacgctcctcccgaagttgcggagtgcgacctggtctacaccttctttcacccactgccgcgagacgagaaagctatggggacatcgcccgcacctaagagcagtgatggaacctgggccagacctgttgggaaggttggcggagaagttaagttgtcgatctcttacaaaaacaataaactttttataatggtgatgcacattagagggctacagctccttcaggacgggaacgatccagacccatatgttaagatttatctgctgcctgacccgcagaaaaccaccaagaggaaaactaaagtagctaggaaaacatgcaaccctacatataacgagatgctggtttatgacgggataccgaagggagaccttcagcagcgagaactccaactctccgtgctttccgaacagggattttgggagaacgtgctactcggagaagtcaatatccgtcttcgtgaactcgatctggctcaggaaaaaactgggtggttcgccctgggctcccggtctcacggaaccttgta

SEQ ID NO: 234857 - DNA, 183 bp, Artificial Sequence
  Description of Artificial Sequence: Synthetic coding sequence
atgtcatcaacccagggcaacggggagcactggaagagtctcgaatccgtaggcatctcacgcaaagaactggcgatggcagaggcactgcagatggaatatgacgccctgtcacggttacgccacgataaagaagagaacagagccaaacagaatgctgatccctccttgatcagttggtag

SEQ ID NO: 234858 - DNA, 522 bp, Artificial Sequence
  Description of Artificial Sequence: Synthetic coding sequence
atgcggccttggtcttcacctgcacagcttgtggctggggctcaacccgcagggagaggagatccactgggcccacgccctattccaccaccgcgattcaggcgcgcttcctcacaaagggagcccccttatcctcggccagctgagcccgcactggaactcgccggaagcaagtgtcagccagatacaccagcggcatctctgtgccccgcagactctcccagtcagcatagagtcatgccgcctggcccagcctcttgggccaacgtgggctctcggccacatactgtcgctaacgggcacgagctcttcgaggtgtctgaagaaagagacgaagaagtagcagccttttgccacatgttggacatactgaggtcgggatctgacatacaggattatttcctgacgggctacgtgtggagcgccgtgaccccttcacctgaacatctgggagatgaggtgaacctgaaggtgacagtgctctgtgatcggctgcaggaagctttgacattcacttgttag

SEQ ID NO: 234859 - DNA, 4338 bp, Artificial Sequence
  Description of Artificial Sequence: Synthetic coding sequence
atggcctatagctggcagacagacccgaaccctaatgaatcccatgagaagcagtatgaacaccaggagtttctcttcgttaatcagccacactcgtcatctcaggtgtcactgggatttgatcagatcgtggatgagatttccggaaaaatcccacattatgaaagcgaaatagatgaaaacacattttttgtgccaacagctcctaaatgggatagcacaggacacagcctgaacgaggcgcaccagatatctctgaacgagtttacgtcaaagtcccgtgagctctcctggcaccaagtaagcaaggcgccagcaatcgggtttagcccctctgttctgcctaagccacagaatacaaacaaggaatgctcatgggggagcccaattgggaaacatcacggagcagatgatagcagattctcgatattagctccctcattcacgtccttggataaaattaatctagaaaaggaacttgagaacgagaaccataattaccacattgggtttgagagctcaatccccccaacaaacagctcattcagctctgatttcatgcctaaagaggagaataagaggtccgggcacgttaacatcgtggaaccctctctgatgctgctgaagggtagcctccaacccggtatgtgggaaagtacatggcagaaaaacattgaatccattggttgctctatccagcttgtcgaggtccctcagtcgtccaacacctccctggcttcgttctgtaataaagtgaaaaaaatcagggagcgctaccacgcggctgacgtcaacttcaacagtggaaagatttggtccacgaccactgctttcccatatcagcttttttctaagactaagtttaacattcatatcttcattgacaatagcactcagcccttgcattttatgccgtgcgccaattatctggtgaaagacctgatcgctgaaatcctgcatttttgcacaaacgaccagttgctccccaaggatcatattcttagtgtgtgcggctctgaggaatttctacagaacgatcactgtcttgggagtcacaaaatgttccagaaagacaaaagtgtgatccaattgcacctgcaaaagagccgggaggcacctgggaagctgtctcgaaagcatgaggaggaccacagccaattttacctgaaccagcttctggagttcatgcatatctggaaagtctcccgacagtgccttcttacactgatccggaagtacgattttcacctcaaatatcttctgaagacccaggaaaacgtgtacaacattattgaagaggtgaagaaaatttgcagtgtcctgggatgcgtggagaccaagcaaatcaccgacgccgtcaacgagctgagcctgatattgcagaggaaaggggagaatttctaccaaagcagcgaaacctctgcaaaagggctcatcgaaaaggtgaccaccgagctgagcacctccatttatcagttaattaatgtatattgcaactctttttacgcagacttccagcctgtgaacgtccctcgctgtaccagctatctcaaccctgggttgccctcccatctgtctttcactgtatatgccgcacacaacattccagagacgtgggtgcatcggatcaatttcccactggaaattaagagcttgcccagggagagtatgcttaccgtaaaactgttcggcatagcctgtgctactaacaacgctaatctgctggcatggacttgcctaccccttttccccaaggagaaatccattctcgggtcaatgttattttcaatgacactgcagtcagaaccacccgtggagatgatcacacccggagtgtgggacgttagccaaccttcacctgttaccttgcagatcgacttcccggcaactgggtgggaatacatgaagcccgactccgaggagaatcggtcaaacctggaggagccactgaaggagtgcatcaaacacatcgcacgcctcagccaaaaacagacccccttactgttatcagaagagaaaaagcgatacctgtggttttaccggttttactgcaacaacgagaactgctcactccccctggttctgggcagcgccccaggctgggacgaaaggacggtgtccgaaatgcacactatcttgcggaggtggaccttcagccaacctttagaggctttaggccttcttacaagcagtttccccgaccaggagattagaaaggtcgctgtgcaacagctggacaacttattgaacgacgaacttctcgaatatctgccacagctggtacaggctgtaaaattcgagtggaacctcgagagtccacttgtgcagcttttacttcatcggtcgttgcagtctattcaggtggctcaccgcctctactggttgctcaagaatgcagaaaacgaggcctactttaagagctggtatcagaaactgcttgccgcactccaattttgtgctggtaaagccttgaacgacgaattttccaaggaacagaaactgattaaaatcctgggggacataggtgaacgcgtcaaatcggccagcgaccatcagaggcaggaggtgctaaaaaaagaaattggacggctggaagagtttttccaggacgtgaacacttgtcacctgcccctgaatccagccttatgtattaagggcattgatcacgacgcgtgtagttactttacttccaatgccctcccgcttaagatcaccttcatcaacgcaaatccgatgggcaaaaacatctccattatctttaaagccggtgacgacttgagacaagatatgttggttctccagttgatccaggttatggataacatttggctccaggagggactcgacatgcagatgataatttaccggtgtctaagcaccggtaaggaccaagggctcgtacagatggtgcccgacgcggtcacccttgccaaaatccatcgccattcaggtctgatcggacctctgaaggagaacaccatcaagaagtggttctctcagcataatcatttgaaggcagattatgagaaagcccttcgcaacttcttttattcgtgcgcgggatggtgtgtggtaaccttcattctcggtgtttgtgatcgtcacaatgacaacattatgttgacaaagagtggccatatgttccatattgacttcggcaaatttttgggccatgcacagacgttcggcggaataaaacgcgatcgtgccccatttatttttaccagcgaaatggagtactttatcactgaagggggaaaaaacccacagcacttccaagacttcgtggaactgtgttgccgcgcttacaacattatccgtaaacattcccaactccttctgaacttgctcgagatgatgctctatgccggactgcccgaactaagcggcatacaggatctcaagtatgtctacaataacctgcgtcctcaggacacggacctggaggccaccagccacttcaccaagaagattaaggaaagcctggagtgtttcccagtcaagttaaataacctcatacataccctagctcagatgtcagccataagccccgcaaaaagcacctcccagactttcccgcaggagtcgtgtctcctgtcaaccactaggtccattgagagagccaccatccttggatttagcaagaagtcttctaacttgtacctgatccaggtcacccattcgaacaatgaaacctctcttactgaaaaaagttttgagcagttctctaaactgcacagtcagttgcagaagcagtttgcttccctgaccctgcctgagtttccccattggtggcacctgccatttactaattccgaccataggaggtttagagacttgaatcactacatggagcagattctaaacgtatcgcatgaagtgaccaactctgactgcgtgcttagcttttttctttccgaagctgtccagcagactgtggaagagagctcacccgtgtacctgggggagaagttccctgataaaaaacccaaggtccagctcgtgatcagttacgaggatgtgaaacttaccatcctcgtaaaacacatgaagaatattcacttacccgatggaagcgcgccatctgctcacgtggaattttacctgctcccctacccgtctgaggtccgccgacgtaaaaccaaatccgtgccaaagtgtaccgaccctacctacaacgaaatcgtggtgtatgatgaggtgaccgagttacagggtcacgtgctgatgctaattgtgaaatctaagaccgtttttgtcggcgcaataaatatccggctgtgctccgtacccctggacaaggagaaatggtaccccttgggtaacagtataatctag

SEQ ID NO: 234860 - DNA, 4338 bp, Artificial Sequence
  Description of Artificial Sequence: Synthetic coding sequence
atggcgtattcgtggcagaccgacccaaaccctaatgaatcacatgagaagcaatacgagcatcaggagtttttgttcgtcaaccagccccactcatcctctcaggtgtctctgggcttcgatcagatcgtcgatgagatcagtggcaagataccacattacgagagcgagattgacgagaacaccttctttgttccaaccgcacccaaatgggattctacgggccatagccttaatgaagcgcatcagattagtctgaacgagttcacctcgaagagtcgcgagctgtcctggcatcaggtgagtaaagcaccggctattggctttagtccgagtgtcctgccaaagccccagaatacaaacaaggagtgttcttggggtagccctattggtaaacatcacggcgcagacgactcacgcttttccattttggctccgagtttcaccagtctggacaaaattaacctggagaaggaactggagaatgaaaaccacaattatcacattggctttgaaagttctatccccccaactaattcatcgttcagttctgatttcatgcctaaagaagaaaacaaaaggtccgggcacgttaatattgtagagccttctctaatgctgctcaaaggatccctgcagccaggaatgtgggagagcacatggcagaaaaacattgaatcgatcggttgctccattcagcttgtggaggtccctcaatcaagtaatacatctcttgcgagcttctgcaataaggtgaaaaagatccgggaaagatatcatgctgcagacgtgaacttcaacagcggaaagatttggagtactacaactgctttcccttatcaactgttcagcaaaaccaaatttaacattcacatatttatcgacaatagtacccagcccttgcactttatgccatgcgccaactacctagttaaggaccttatcgcagagatcttgcatttttgcacaaatgaccaattgttgccaaaagatcacatactttccgtgtgcggctccgaagagttccttcagaatgaccactgcttggggtcacataaaatgttccagaaggataagagcgtgatacaactccaccttcagaagagtcgcgaggctccagggaaactgtctcgcaaacatgaagaggatcactcgcagttttatttgaaccagctgctcgaatttatgcatatctggaaagtctccagacagtgcctgctgaccctgatccgaaaatacgattttcatttaaagtatctcctcaaaacccaggaaaatgtgtataacatcatcgaggaagtcaagaaaatatgcagtgtcctcggctgtgtggaaacaaaacaaatcaccgacgccgtgaacgaactgtcactgatacttcagagaaagggcgagaacttttatcagtctagcgaaaccagcgcgaaggggctaatcgagaaggtaaccacagagctttccacttctatctaccagcttatcaatgtatactgcaactcattttatgccgacttccagcctgtgaacgtgccaaggtgcacttcatatcttaatcctggtctccccagccacctctcgtttacagtctacgcggcacacaatataccagaaacctgggtgcaccgcataaatttccctttagaaatcaaaagtctgccaagagagtccatgctgaccgtcaagctgtttgggattgcatgcgccactaataacgcaaacctgctggcctggacttgtctgccgttattccccaaggagaagagtatcttagggagtatgcttttcagcatgaccctgcagtcagagccacctgtggagatgataactccaggtgtgtgggacgtctcacagcccagtcccgttactctacagatcgacttccccgctactggttgggagtatatgaaacccgattccgaagaaaacagatctaatttggaagagccgctcaaggaatgtatcaaacacatcgctagactgagtcagaaacagactccacttctgctgagtgaggaaaaaaaacgttatctttggttctacaggttctactgcaataatgaaaattgctcactccctctagtcctgggttcagcccctggatgggatgaacgcacagtaagtgaaatgcatacaatcctcagacgatggacattttctcagccccttgaagccctcggtcttctgaccagctcctttcccgaccaggagatcaggaaggttgctgttcagcagctcgataacctcctcaacgatgagctgttggaataccttccccagcttgtccaggcagtcaagttcgagtggaatctggagagcccattggtccagctgctgctgcaccgttcactccaatcaatccaagtggcgcatcgactctactggctattgaagaacgcggaaaacgaggcctacttcaaatcctggtaccagaaactgctagctgccctccaattttgtgcaggtaaagcattaaacgatgagtttagtaaggagcagaagctcatcaagatcctaggagacatcggcgaacgcgtaaaatctgcttccgatcatcagcgccaggaagtactgaagaaagaaatcggcaggcttgaagagttctttcaggatgtgaatacatgtcatctcccactcaatcccgctctctgtatcaagggcatcgaccacgatgcctgttcttacttcacttccaatgcccttccactgaagatcacatttattaacgccaatcctatgggaaagaacatctccattatcttcaaagctggtgacgacctcagacaagacatgctcgtgctgcagctcattcaggttatggataatatctggctccaggaaggactggacatgcagatgatcatctataggtgccttagtaccggaaaggatcaaggtctcgtgcaaatggtaccagatgctgtgacactagcaaagattcatagacatagtggtttaattggaccactgaaggaaaacaccatcaagaagtggttttcccagcataaccatttgaaggcagactatgagaaagccttgagaaatttcttctatagttgcgcagggtggtgtgtcgtgacattcatcctcggtgtgtgcgaccgccacaacgataatataatgctcaccaagtcagggcatatgtttcacattgatttcgggaaatttttagggcatgctcagaccttcggagggattaaaagggacagagcacctttcattttcactagcgaaatggagtattttattaccgaaggaggcaaaaatccacaacacttccaggacttcgtggagctgtgctgccgcgcttataacattatacggaagcacagccagctactgttaaaccttctggagatgatgctctatgctggattgcccgaattaagcggcattcaggatcttaagtatgtgtataacaatctgcggccacaggacaccgacctggaagcgaccagccacttcacgaagaagatcaaggaaagtctagagtgtttccctgtcaagcttaataacctgatacacacccttgcgcaaatgtcagccatttcccccgcaaaaagtacttcccagacttttccgcaggagtcgtgcttgctttcgacaacacggtctatagagagggcaacaattttggggttcagcaagaaatcctcgaatctgtacctcattcaggtaacacacagtaacaacgagactagcctcacagagaagtcgtttgagcagttcagtaagctgcattcgcagctgcagaagcaattcgccagcctcaccctccccgaattcccgcattggtggcaccttcctttcacaaactcggaccacagaaggttcagagacctgaatcattatatggagcagatcttgaacgtttcccatgaagtgacaaattctgattgcgttctgagcttcttcttgagcgaggccgttcagcagactgtcgaagaaagcagtcccgtatatctgggggaaaagttcccagacaagaagccgaaggtacaactggtcattagctatgaagacgtgaagctgacaattctcgtgaaacatatgaaaaacattcacctccccgacggatcggcccctagtgcacatgtggagttctacctcctcccatatcccagtgaggtgcgccgtcggaaaactaaatctgttccgaagtgcacagatcccacctacaacgagatagtcgtctatgacgaggttacagaattgcagggtcacgtgctcatgttaattgtcaaatccaaaaccgtcttcgtgggtgcaataaacatcagactatgcagtgtgcccctcgacaaggaaaagtggtacccattgggtaactctatcatctag

SEQ ID NO: 234861 - DNA, 4461 bp, Artificial Sequence
  Description of Artificial Sequence: Synthetic coding sequence
atggcttattcctggcaaactgaccccaatccaaacgagtcacacgagaaacagtacgaacaccaggagttcctttttgtcaatcagccgcatagcagcagccaagtcagtctaggcttcgatcagattgtagacgagattagtggcaagatcccacattatgagagtgaaatcgacgagaacaccttctttgtaccaacagcccctaagtgggacagtaccggccacagcctgaacgaggcacaccaaattagcctgaatgagttcactagcaaaagccgggagctcagctggcatcaggttagcaaggctcctgccatcgggttcagtccttctgtgctcccaaagcctcagaacactaacaaggaatgctcttggggatcacctataggaaaacaccatggagctgatgactctcggttcagtatcctggcaccgtcctttacctctcttgataagatcaatctcgaaaaagagctagaaaacgaaaatcacaattatcacataggattcgaatcgtccattccacctaccaatagctccttctccagcgacttcatgcctaaggaggagaacaaacgcagtggtcacgttaatatcgtggagccatctctgatgctgttgaaggggtctctccaaccgggaatgtgggagtcaacctggcaaaagaatatcgagagcattggctgctccatccagctcgtcgaggtcccccagagtagtaacacttcactggcttcattttgcaacaaagtgaaaaagatcagggagaggtaccacgcagccgatgttaactttaactcaggcaagatctggagtaccacgactgcattcccctaccagttattttccaagaccaaatttaatatccacatcttcattgacaatagcacccagccccttcacttcatgccatgcgccaattacctggtgaaggacctcatcgcagaaatcctccacttttgtaccaatgaccagctgctgccaaaagaccacattctcagcgtatgtggctccgaggagttcctgcagaatgaccactgtctgggcagccacaaaatgttccaaaaggataaaagcgtgatccaactgcatttgcagaaatccagggaagcacctggcaagctcagtcgaaaacacgaagaggatcactcccaattctacctcaaccagctgctggagtttatgcacatctggaaggtaagccggcaatgcctattgactcttattcgcaagtacgatttccatctgaagtacctgctgaagactcaggaaaatgtctacaacataatcgaagaagtgaaaaagatctgtagcgtccttggatgtgtagaaacaaaacaaataacagacgccgtgaacgaactttcactgatcctccaacggaaaggcgagaatttttatcagtcatctgagacctcagctaaaggtctgattgaaaaggtaacaacagaattgagtactagcatttatcaactgatcaatgtttactgcaatagcttttatgccgacttccaaccggtaaacgtccctaggtgcacctcctatttaaatcccggtcttccttcccatctttcatttaccgtgtacgccgcacataacattcctgagacttgggttcactcttacaaagcattctccttcacctgttggttaacatacgccggtaagaagctgtgtcaggtgaggaactacaggaatatccctgacaaaaaattgttcttttttttagtcaattggaacgaaactatcaatttcccacttgagatcaaatccctccccagggagagcatgctgacagtgaaactatttgggatcgcatgtgccacaaacaatgctaacttgttggcatggacttgcctgcctctgtttcccaaggagaagtccattctgggatctatgctgtttagcatgaccctgcaatccgaaccccctgtggaaatgatcacccccggagtgtgggacgtctcccaaccttctcccgttacacttcagatcgattttcccgcaactgggtgggaatacatgaaacctgacagcgaagaaaatcgctctaacctcgaggagcccctgaaggaatgcattaagcatatcgcccgacttagtcaaaagcagacccctctgctcctgagtgaggaaaaaaaacggtatctctggttttaccgcttttattgcaacaacgagaactgctccctgcctcttgtgctgggctctgcgcctgggtgggacgagcggacggtgtctgagatgcatactatcctgcgcaggtggacttttagccaacctctggaggcattaggtctccttaccagcagttttcccgaccaggaaattcgcaaggtggcggtacaacagttggataatctcctcaatgatgaactgttagagtacttgccacaactggtgcaggctgtgaaatttgagtggaatcttgaatctcccctggttcagctgctgctacatcggagcctacagtcaattcaggttgcccatagattgtactggttattaaagaatgctgagaacgaagcctactttaagtcgtggtaccagaaactgctggccgctcttcagttttgcgctggtaaggcacttaatgatgaattttctaaagagcagaagctgattaagatcttgggtgatatcggcgagcgcgtaaagagcgcttccgatcaccagcgacaggaagtgctgaagaaggagatcggcagacttgaagaattctttcaggacgtcaacacatgccacctgccactgaacccagcactttgtataaaaggcattgatcacgacgcctgcagctacttcacatcaaacgcactacctctgaaaatcacctttattaacgccaaccccatgggaaaaaacatttcgatcatatttaaagctggggatgatttgcgccaggatatgctggttctgcagctgatacaggtgatggacaatatatggctacaagagggtctggacatgcagatgatcatatatcggtgcctcagtacaggcaaggatcaaggacttgttcaaatggtgccagatgcagtcacacttgccaaaatccatcgccattcaggactgattgggcctctgaaagaaaatacaatcaaaaagtggtttagccagcacaatcatctcaaggctgactacgagaaagcactgcggaactttttctactcttgcgccggttggtgcgtggtaacctttattcttggcgtctgcgatagacataacgataatatcatgctgacaaaatcaggccatatgttccacatcgattttggcaaatttctggggcatgcgcagaccttcgggggaataaagagagatagagcaccctttattttcacatccgaaatggagtacttcataactgaggggggaaagaatccacagcatttccaggattttgtcgagctctgctgtcgggcttataacataatacggaagcactcgcaactcttactgaatttgctcgagatgatgctgtacgccggtctgcctgaattgagcggcattcaggacctcaagtatgtctacaacaacctcaggccacaggatactgatctcgaagcgacttcccatttcactaagaagatcaaggagagcctggagtgttttccagtaaaattgaacaatctgatccataccctggcccaaatgtccgctatttcaccggcaaagtcaacctcacagacctttccccaggagagttgcctgctctccacaactagatctattgagcgagcgactatcctgggcttctccaagaaatcctccaacctgtacctgatccaggtgacacactctaacaacgagacatccctgactgagaagagcttcgagcagttttccaaactgcacagccagctccagaagcagttcgcctcactgactctgcccgaattcccgcactggtggcacttaccattcaccaattcggatcatcgtcgctttagagacctgaaccactacatggagcagatactgaacgtgtcccatgaggttacaaattccgactgcgtactgtcttttttcctcagcgaagctgtgcagcagacagtggaagagagcagtcctgtgtatctgggtgaaaagttccctgacaaaaagcccaaagtgcagttggtcatatcctatgaagatgtcaagctcaccattctggtgaagcatatgaaaaacatacatctgcccgatggttcagccccatcggcccacgtggaattctacctattgccttacccaagcgaagttagacgtcgaaagactaagtctgtccccaaatgcacagatcctacttacaacgagatcgtcgtttacgacgaggtcaccgagcttcagggccacgtgctcatgctgattgtgaaaagcaaaaccgtctttgtcggcgctataaacatcagactctgttctgtacctctggataaagaaaaatggtatccccttggcaattccattatctag

SEQ ID NO: 234862 - DNA, 414 bp, Artificial Sequence
  Description of Artificial Sequence: Synthetic coding sequence
atgactatggaaacgctccccaaggttctcgaagtagacgaaaaatcacccgaggctaaggatctgttgcccagccagacagccagtagcctctgtatctctagcagatctgagtccgtctggactacgacgccgcgaagcaattgggaaatttacagaaaacccattgtgattatgtcagtcggcggagcaatcctgctcttcggagtggtaatcacatgcttggcatacacccttaagctcagcgataaatcactaagtatcttaaaaatggtaggccctgggttcctgagtctgggactgatgatgttagtgtgcggacttgtatgggttcctatcataaaaaaaaagcagaagcacaggcagaagtcaaatttcctgcgcagtctgaaatcattctttttaacacggtag

SEQ ID NO: 234863 - DNA, 414 bp, Artificial Sequence
  Description of Artificial Sequence: Synthetic coding sequence
atgactatggaaacactgcccaaggtgctagaagtcgacgagaaatctcccgaagcaaaggatctgttaccctcacaaacagcctcttctctctgtatttcatcccgatcagagtcagtatggacaacgaccccaagatctaactgggaaatttatagaaagccgatagttattatgtcagttgggggagccattctgctgtttggagttgtcatcacttgcttggcatatacgttaaagctgagtgataagagtctgtctatccttaagatggtgggtcccggatttctatctctgggcctcatgatgctggtgtgcggcctagtgtgggtgcctatcattaagaaaaagcaaaagcacaggcaaaagagcaactttctccggagcctaaaatcatttttcctcacgaggtag

SEQ ID NO: 234864 - DNA, 159 bp, Artificial Sequence
  Description of Artificial Sequence: Synthetic coding sequence
atggagaaagtgcagtatttgacgcggtccgcgattagacgcgcttcaaccatcgagatgccgcagcaggcgagacagaagttgcagaacctgtttattaatttctgtctaatccttatttgtctgctgcttatttgtattatcgtgatgctgctctag

SEQ ID NO: 234865 - DNA, 1371 bp, Artificial Sequence
  Description of Artificial Sequence: Synthetic coding sequence
atgcccccaggaccctgggaatcctgcttctgggtgggtggtcttatactatggttgtctgtcgggtcatcaggcgacgcgcctcccacaccccaaccgaagtgtgccgatttccagagcgcaaacttattcgaggggactgatctcaaagtccagtttctccttttcgtaccatctaatccgtcatgtggtcagctggttgaggggagtagtgacctgcagaacagcggttttaatgccacattgggaaccaagttgattattcacggttttcgtgtgctgggcacaaaaccaagctggattgacacgtttataaggactctactgcgggctactaatgcaaacgtgatagcagtcgactggatttacgggagcaccggagtgtattttagcgcagtcaagaacgtaatcaaattgtctttggaaatctctcttttcctcaacaaactgctggttctcggtgtctctgagtccagcatacatataatcggtgtatccctcggggctcacgtgggcggaatggtgggccagctgttcggaggccaactgggccaaattacagggctcgaccctgctggccctgagtatacccgcgctagtgtggaggagcggttagatgcaggagatgcactgttcgtcgaagcaatccacacagatacagataatctgggtatcagaattccagtagggcatgtggactacttcgtaaatgggggacaagaccaacccggatgccccacttttttctacgccggatatagctacttgatttgcgaccatatgagagcagtgcatctctacattagcgccctcgagaactcgtgtcctctgatggctttcccatgcgcttcttacaaggcgttcctcgccggtagatgtctggattgttttaacccatttttactttcctgcccccgtatcgggctggtggaacagggaggagttaagatcgagccactcccaaaagaggtaaaggtgtacctgctcaccacttcaagcgctccgtattgtatgcaccactctctggtagagtttcatcttaaagagcttcgaaataaggacactaacattgaagtgacctttctgtcctctaacattacctccagttctaaaatcacaatacctaaacagcaacggtacggtaagggtatcatcgcacacgctacgccccagtgccagatcaaccaggtaaaattcaaatttcagtccagcaatcgagtgtggaagaaggatagaacaaccatcatagggaaattttgtaccgctcttctcccagtcaacgaccgcgagaagatggtttgtcttcccgagcccgtaaaccttcaggcttcagtcacggtgtcatgcgacttgaagattgcctgcgtgtag

SEQ ID NO: 234866 - DNA, 1323 bp, Artificial Sequence
  Description of Artificial Sequence: Synthetic coding sequence
atgccaccagggccttgggaaagttgcttctgggtcggcggactaatcctgtggttatccgtagggagcagcggcgatgccccacctaccccacagccaaaatgcgctgactttcagagtgcaaacctgttcgagggcaccgatctcaaagtgcagttccttctgttcgtcccaagtaatccctcttgtggacagctcgttgaagggagcagcgatctgcagaatagtgggtttaacgccactctcggaaccaaactgatcattcatggattcagggtactgggaacaaaacccagctggatcgacacttttattagaacacttctgagggccacaaacgctaatgtgatcgccgtcgactggatctatggctccacaggagtatactttagcgctgtaaaaaatgtgttgggtgtcagcgaaagctcaatccatattatcggcgtgagtcttggggctcacgttgggggtatggtaggccagctcttcggtggccagctaggccagattaccggcctggatcccgctggcccagagtacacgcgtgcgtccgtggaggaacgtcttgatgctggagacgctctgtttgtggaagccatacacacagataccgacaacctcgggatacgtatccctgtgggtcatgtggattatttcgtaaacggagggcaggaccagccagggtgtcctacatttttctatgccggatactcgtatttgatatgcgaccatatgcgcgctgttcacctgtatatcagcgcactcgaaaactcttgcccactgatggcttttccatgtgcctcctacaaggcctttttagcaggcagatgtctcgactgtttcaacccgtttcttctcagctgtcctaggatcgggcttgttgaacagggcggtgtcaagatcgagcctctccccaaagaggttaaggtttacctgctgactaccagttccgccccatactgtatgcaccatagtttggtggaatttcacctgaaagaactgcggaacaaagacaccaacatcgaagtgacttttctgtcatccaacattacgagttctagtaaaattaccattcccaagcagcagcggtatggtaaaggcatcatagcccatgcaacacctcaatgccaaatcaaccaggttaagtttaagtttcaaagctccaaccgcgtatggaagaaagacaggacaaccatcatcggcaagttctgtactgccctgctccctgtcaatgatcgcgagaagatggtgtgtcttccagaacctgtgaatttgcaagccagcgtgacagtttcttgtgatctaaaaattgcctgcgtgtag

SEQ ID NO: 234867 - DNA, 852 bp, Artificial Sequence
  Description of Artificial Sequence: Synthetic coding sequence
atggtggggcagctgtttggcggtcagcttggtcagattaccggcctggacccagctggcccagagtataccagggccagtgtggaggaacgtctggacgctggcgatgccctgttcgtggaagccatacacaccgacaccgataacttggggatacgaatccccgtagggcatgtggattatttcgtcaatggtgggcaagatcaacctggatgcccgacttttttttatgctgggtattcatatctgatttgtgatcacatgcgagctgtgcatctatacatatccgcacttgaaaactcatgcccattgatggcctttccctgcgcctcctacaaggccttcctggccggacggtgtctggactgttttaatccttttctgctgagctgcccccgtataggcctggttgagcagggaggagtgaagattgagccgctgccgaaggaggtgaaggtatatctgctcacaacctctagcgctccttactgtatgcaccacagtctcgttgagttccaccttaaagaattacgaaataaagacaccaacatagaagtcacatttttgagttcaaacattacctccagtagcaagattactatcccaaagcagcagaggtacggcaaaggcataattgcccacgccacgccacagtgccaaatcaaccaggtaaagttcaaattccagagcagcaacagggtgtggaagaaagatagaacaactatcattggcaagttctgcactgcattactgccggtcaatgatagggaaaaaatggtgtgtctgcctgaacccgtgaatctgcaggccagcgttacagtgagctgtgaccttaagattgcgtgtgtctag

SEQ ID NO: 234868 - DNA, 1656 bp, Artificial Sequence
  Description of Artificial Sequence: Synthetic coding sequence
atgcgtacacgaccccgaccccgtctgcggagaacagaaaacttcttaactgccgtccatcacggtaagaaggaagagaaggcggctgtggaacgaaggcgcctccacgtcctgaaggcactgaaaaaactccgtattgaagcagatgaggcccctgtagtggccgttctgggctccggcggagggctgagggcccacattgcctgccttggcgtattgtccgaaatgaaagaacagggtctgctggacgcagttacatatctagctggagttagcggttccacatgggctatcagttccctgtacacaaacgatggagacatggaggcattagaagctgatctcaagcataggtttaccagacaggagtgggacttggccaaaagcctgcagaagaccattcaggccgctcgatcagagaactattccctgactgacttttgggcctatatggtgatttcaaagcagacccgggagctgccagaatcccatctcagcaacatgaaaaaacctgtagaagagggcaccctaccttaccccatcttcgccgctatcgacaacgacctccagccctcttggcaagaggcacgcgcacccgagacttggttcgagtttacgcctcatcacgccggtttctctgcactgggcgcatttgtgagcattacccattttggtagcaagtttaaaaagggacgcctggtgcggacacatccggaacgggacctgacgtttctcagagggctgtggggctccgcactcggcaacacagaggttatccgtgaatacatatttgaccagctacgtaacctcactctcaaaggtctgtggaggcgcgcagtggcaaacgctaagtcaattggccatctgattttcgctcggttgttaagactccaggaatcctcgcagggcgaacatccgccacccgaggatgaagggggtgagcccgagcatacctggctcacagaaatgctggagaactggactcggacctcgctcgaaaaacaggagcagccccacgaggatccagagcggaagggctctctcagcaacctgatggatttcgtgaagaagactggaatttgcgccagtaagtgggagtgggggaccactcacaattttctttacaagcacggcggaattagggacaagatcatgagttccagaaagcacctgcatttagtcgacgctggccttgctatcaacacacccttcccattagtgctgcctcccacccgggaagtccatctgatcctttcctttgacttctcagctggcgacccatttgagaccattagggccaccacggattattgccgccgtcacaagatcccctttccccaggttgaagaagccgaactcgacctctggtctaaggctcctgcctcctgctatatcctcaaaggcgagactggccctgtggtcatgcattttccactgtttaacattgatgcatgcggaggggacattgaggcctggagtgatacttatgacacctttaagttggctgacacatatacacttgatgttgtcgtgctacttctggctctggcaaagaagaatgtacgcgagaacaagaagaaaatcttaagagaactgatgaacgtggctgggctgtactatccaaaagacagcgcacgcagttgctgcctggcttag

SEQ ID NO: 234869 - DNA, 4392 bp, Artificial Sequence
  Description of Artificial Sequence: Synthetic coding sequence
atgctcctgtcgcccagcctgttgctgctgttgttgttaggagcacccaggggctgcgccgagggcgtcgctgcagcgctcactcctgagagacttctggaatggcaggacaaggggatctttgtcatacagagtgagtccctgaaaaagtgtatccaagccggaaagagtgtccttactttagaaaattgcaaacaggctaacaagcacatgttatggaaatgggtctccaatcacgggctgttcaacatcggaggctcaggatgcttaggcctgaacttctccgcaccggagcagccactgtccctgtacgagtgtgactctaccctggtttccctgagatggcgctgcaacaggaagatgatcactggaccgttacagtacagcgtgcaagtcgcgcatgacaatactgtggtggcatcgcgtaagtatatccataaatggatttcttacggcagtggcggaggcgacatttgtgaatatcttcataaggatctgcacactattaaagggaatacccatggaatgccttgcatgttccccttccagtataaccaccagtggcaccacgaatgcacaagggagggcagagaagatgacctgctttggtgcgccaccacctctcggtacgaaagagatgaaaagtggggattttgccccgatcccacaagtgcggaggtggggtgtgacacaatttgggagaaagacctgaactcccatatctgttaccagtttaacctgctatcctcactgtcctggtctgaggctcatagttcttgtcagatgcaaggaggcaccctcctgtcaatcacggacgagacagaggagaacttcatccgggaacacatgtcctccaagaccgtcgaggtctggatgggacttaatcagctggatgagcacgctggctggcagtggtctgatggaacacccttaaattacctgaactggtctcctgaagttaatttcgagccattcgtggaagatcactgtgggacattcagcagcttcatgccatctgcctggcgctcccgcgattgcgagagcacacttccctatatctgtaaaaaatatctcaaccatatcgatcacgagatagtggagaaggatgcctggaaatactacgccactcactgcgagccgggttggaacccttataaccgaaactgttacaagctgcagaaagaggagaaaacatggcacgaggccctgcgatcttgtcaggccgataattcagctctgatagacatcacaagtctggcagaggtcgaatttcttgtgactctcctgggagacgaaaacgcttcagaaacgtggatcggactctcatctaacaagattcccgtaagttttgaatggtctaatgattcttccgtgatattcacaaactggcataccctcgagcctcacattttcccgaaccggtcccagctatgcgtatcggcggaacagagtgaaggacactggaaagttaagaattgtgaggaacgcctgttttatatttgcaaaaaagccggtcacgtcctgtcagacgcagagtccggatgccaggaaggctgggaacggcacggcggattctgctacaagatcgataccgtccttaggtcttttgatcaggccagttctggttattattgtcctcccgcattggtgactatcaccaacagattcgaacaggcttttatcacttcactcatcagtagtgtcgtcaagatgaaggattcctatttttggattgctctgcaggatcagaatgataccggagaatacacatggaaacccgtggggcaaaagcctgagcccgtacaatatacccactggaacactcaccagcccagatactctgggggatgcgtggccatgaggggaagacatcctctgggacggtgggaagtaaagcactgcagacatttcaaagcgatgtcactctgcaagcagcctgttgaaaatcaggaaaaagctgagtacgaggagagatggcctttccacccttgttacttggattgggaaagcgaacccggactggcctcctgcttcaaggtgtttcacagtgagaaggtacttatgaaaagaacctggagggaggcggaagccttctgcgaagaattcggagcccacttggcatcttttgctcacattgaggaagaaaattttgttaacgaacttctgcattctaagttcaactggaccgaggaacgtcagttctggatcggatttaataagcgtaaccccctcaatgctgggtcctgggagtggagtgacaggacccccgtggtatccagctttctcgacaatacctatttcggcgaggacgccaggaattgcgccgtctacaaggcgaacaaaactttactgcctttgcactgcggatctaaaagggagtggatttgtaagataccccgagacgtcaagccgaagatccccttctggtaccagtacgatgtgccctggctgttttaccaggacgccgaatatttgtttcacacatttgcttccgagtggctcaactttgagtttgtttgctcctggctccatagcgacctgctaactatccattccgctcatgaacaagaattcatacatagcaaaatcaaagccctgtccaaatatggagcctcttggtggatagggctgcaggaggagagggccaatgatgaatttagatggcgagatgggacacctgtgatatatcaaaattgggatacggggcgagagcgcacagtgaacaaccaaagccagaggtgcggttttatctcctccatcactggtctgtggggcagcgaggaatgttctgtgagtatgcccagcatttgtaagaggaagaaggtgtggcttatcgaaaagaagaaggatacccctaaacagcatggaacctgccctaaaggttggctctacttcaattacaagtgcttactgctgaatataccaaaggatccctctagctggaaaaattggacccatgcacagcatttctgcgcagaggaggggggaacactggtggctatcgaatcagaggtggagcaggccttcataaccatgaacctgttcggccaaaccactagtgtctggatcggcttacagaatgatgattacgagacttggctgaacgggaagcccgtagtttattctaactggagcccctttgacatcattaacatcccatctcacaataccaccgaggttcagaagcacattcccctgtgcgccctattgtcatcgaaccccaacttccactttaccggcaaatggtactttgaagattgtgggaaggaaggatatgggtttgtgtgcgaaaaaatgcaggacacctcaggccacggagtgaacaccagcgatatgtatccgatgccaaacaccctcgagtatggtaaccgcacttacaagattataaacgctaatatgacttggtacgctgcgattaagacctgtctaatgcataaggcacaactggtctccatcaccgaccagtaccaccagtcttttttgaccgtggtgcttaataggctgggatacgctcactggattggcctgtttacaacagacaatggcctcaattttgactggtccgatggaaccaagtccagctttacgttttggaaagacgaggagagtagccttctaggggactgcgtgtttgcggactcgaacggtagatggcacagcacggcttgtgaatcattcctacagggagcaatttgccatgtcccacccgagaccagacagtcagaacaccccgaactctgctctgaaacttcaatcccctggattaaatttaaatctaactgctattcattcagtaccgtgctggactctatgtcattcgaggctgcacacgagttttgcaaaaaagagggtagtaatctgcttacaataaaagacgaagccgagaacgcgttcctcctcgaggaactgtttgcctttgggagttctgttcagatggtgtggcttaacgcgcagtttgacggaaataatgagacgatcaaatggttcgacggcacccctaccgaccagtcaaattgggggattcgaaagcccgacactgactatttcaagccccatcactgtgtggctctgcgcattccagaagggctttggcagttatccccgtgccaggaaaagaaaggcttcatttgcaagatggaagcggacatccataccgctgaagcgctacccgaaaagggtcccagtcactccataattcccctggctgtggtactcacattaatcgtgatcgtagcgatatgcacgctgagcttttgcatctacaaacataatgggggattcttccggagactggcaggtttccggaatccgtattatcccgcaactaatttctcaaccgtctatctggaagaaaacatcctcattagcgacctggagaagagtgaccagtag

SEQ ID NO: 234870 - DNA, 3975 bp, Artificial Sequence
  Description of Artificial Sequence: Synthetic coding sequence
atgctgctttctccaagcctgctcctgctgttgctgctgggtgcccctcggggatgtgccgagggtgtggccgctgccctgactccagagcgactgctcgagtggcaggataagggcattttcgtgatccagtcagaatcactcaagaaatgcatccaagccggaaagtctgtgctgacactggagaattgtaagcaggccaacaaacatatgctgtggaagtgggtgagtaatcacggcctttttaacataggaggcagcggctgtcttggcctcaacttcagcgcccctgagcagccgctgagtctatacgaatgcgacagcaccttggtttcactgagatggagatgtaaccgtaagatgataaccggaccactacagtactccgtgcaagttgcccacgacaacacagtagttgcttctagaaagtacatacacaagtggatttcctatggaagcggcggtggggacatctgcgagtatcttcacaaggaccttcacaccattaagggtaacacacatggcatgccttgtatgtttcccttccagtacaatcaccagtggcatcacgaatgcacaagggaaggtagggaagatgatctgctgtggtgtgccacgacctcccgctatgagcgcgatgaaaagtgggggttttgtcccgacccgacctcagcagaggttggatgcgacaccatctgggagaaggaccttaacagtcatatatgttaccaattcaatctcttgtcaagcctgtcatggagtgaggcccacagctcgtgtcagatgcaaggaggaaccctgctttctatcacagacgagacagaagagaatttcattcgggagcacatgtccagtaagactgtggaggtgtggatggggttgaatcagctcgacgaacacgccggatggcagtggagcgatggtactcccttaaactatttaaattggagcccggaagtgaattttgagccctttgtggaggaccactgtgggacattttcgtcctttatgccctccgcctggcgctcacgggactgcgagtctactctaccctatatttgcaagaagtacttgaatcatatcgaccatgaaatcgtggaaaaggacgcatggaaatattatgccacgcactgtgaaccaggctggaatccttacaaccgtaactgctacaagcttcaaaaagaggaaaagacttggcacgaggccttgcggagctgccaagcagataacagtgcactgatcgatataaccagcttggcagaagtggaattccttgtgacactgctgggggatgagaatgcctcagaaacctggattgggctcagctcaaacaaaattccagtgagcttcgagtggtcaaatgactcgtccgtcatcttcacaaactggcacacccttgaacctcacatctttccgaatagaagtcagctgtgcgtaagtgcagagcagagcgaaggacactggaaagtcaagaactgtgaagaacggctcttttacatctgtaagaaggcgggacacgtcttgtcagatgccgagtctggctgtcaggagggttgggaacgccacggcggattttgttacaaaatagacaccgtgctgcgcagttttgaccaggcaagttctggttattactgtcctcctgctctggtgacgattactaacagatttgaacaggcgtttatcaccagcctgatctcttcggtcgtgaagatgaaggacagctacttctggattgctcttcaggaccaaaatgatacaggagaatatacatggaagccagtgggacagaagccagagcctgtgcagtatacacactggaacacccatcaacctcggtactcaggtggctgcgtggccatgcgaggcaggcatccattggggagatgggaggtcaagcattgccgccattttaaggctatgtccctttgtaagcaacctgttgaaaaccaagaaaaagcagaatatgaggagcgatggccctttcatccctgttacctggattgggaaagcgaacctggattggccagttgcttcaaggtgtttcattcagagaaagtcctcatgaagcggacatggagggaggcagaggctttttgtgaggagtttggggcacacctggcttcatttgcgcacatagaagaagagaactttgtgaacgagctgctccattctaagttcaactggacagaggagagacagttttggattggatttaataagcggaaccccctgaacgcgggttcgtgggagtggtctgatcgcacccccgtggtttcatccttcctggacaacacctatttcggagaagacgccagaaactgcgcagtttacaaggctaataaaactctcctccccctccactgcggctctaagcgcgaatggatttgtaaaatccctagagatgtcaaacccaagattcctttttggtatcaatatgacgtaccttggctattttaccaggacgcagagtatctgtttcatactttcgcctctgaatggttgaactttgagtttgtctgttcctggctccactccgacctgctgaccatccattcagcgcacgaacaggaatttatccatagcaaaatcaaagctctgtctaagtacggagcctcttggtggattggcttacaggaagaaagggccaacgatgagttccgttggagggatgggacaccagtgatttaccagaactgggataccggtcgggaacggacggtgaacaatcagtcccagaggtgcggctttatttcaagtatcaccgggctgtggggatctgaagagtgtagtgtgtccatgccctccatttgcaagcggaaaaaggtctggttgatcgaaaaaaagaaggacactcctaaacagcacggaacgtgcccaaagggatggttgtacttcaactataagtgcctgctcctgaatatccctaaagacccatcatcctggaagaactggactcatgctcagcacttttgtgccgaagaaggcggaaccctcgttgccatagagtcagaggtggagcaagcttttattacgatgaatctgtttggtcaaacaacgagcgtgtggattgggcttcagaatgacgactacgaaacctggctgaacgggaagcccgtcgtgtacagcaattggtctccgttcgatataatcaacataccctcacacaatacaactgaagtccaaaagcacattccactgtgcgccctcctgagttctaatcctaacttccatttcactggcaaatggtactttgaggactgcgggaaggaaggttacggtttcgtgtgcgagaaaatgcaggacacaagtgggcatggggtgaatacctccgatatgtaccccatgccaaacacccttgaatatgggaatcgtacctataaaattatcaacgcaaatatgacgtggtatgccgctatcaagacatgcctgatgcacaaagcccagctggtgagtatcactgatcaataccaccagtcattcctgacggttgtgctcaatcggctgggctacgcccattggatcgggttgtttacaacagataacgggctaaacttcgactggagcgacgggactaaatcttccttcaccttttggaaggatgaggagtcttccttactaggggactgtgtgttcgcggactccaacggcaggtggcactccactgcatgcgagagctttctgcaaggagcaatctgtcatgttccaccagagacacgtcaatccgagcatcctgaactgtgttcagaaacatccatcccatggataaagttcaagtcgaactgctactccttctctacggtgctggactctatgagcttcgaggccgctcacgagttctgtaagaaagagggtagcaatctgctcactatcaaagatgaagctgagaacgcctttcttctggaggaactgttcgcttttggttcatctgtccagatggtctggttaaatgcacagtttgacggaaactctaaatag

SEQ ID NO: 234871 - DNA, 1584 bp, Artificial Sequence
  Description of Artificial Sequence: Synthetic coding sequence
atgggctcttcagaggtgtctattattcctggcctgcagaaggaagagaaagccgcagtggagaggcgaaggttgcacgtgctaaaggccctgaagaaactccgcatcgaggcagatgaggccccagttgtagccgtcctcggatcaggcggtggactcagagcccacatagcctgccttggtgtcctctccgagatgaaggagcagggtctgctggacgcggtgacctacctggctggcgtgtccgggagcacttgggctatctccagcctgtatactaatgacggtgacatggaggccctagaagcagacttgaagcataggtttacccggcaggaatgggatctggcaaaaagtctgcaaaaaaccatccaggctgccagaagcgaaaactactcactgaccgacttctgggcttatatggttatctcaaaacagacgcgcgaactgcctgaatctcatctgagcaatatgaaaaagcccgtagaagaaggaacactcccataccccattttcgcagccattgataacgatctgcagccatcctggcaagaagctcgggcacccgagacttggtttgaatttacacctcaccacgctggcttctccgcactcggggcatttgtttcgattacacacttcgggagcaagtttaagaagggacgactggtcaggactcatccagagagggatctgacatttctgcgagggctatggggatcagctctcgggaacacagaagtgatccgggaatatattttcgatcagcttaggaatttgacattgaagggcttatggcgtcgcgctgtcgccaacgctaagagtattggacacttaatttttgcacgtctcctgcgactccaggaaagtagccaaggggagcacccccctcctgaagacgaaggcggagaacccgaacatacatggttaaccgaaatgctggagaattggacccggactagcctggaaaaacaagagcagccccatgaagatccggagcgtaaaggatccctatctaatttaatggacttcgttaagaagactgggatttgcgcttccaaatgggagtggggtactacccataattttttgtataagcatgggggaatacgtgacaaaataatgtcgtcgcgaaagcacctgcacttggtagatgcgggtctcgctatcaataccccgttcccgctcgtgcttccccctacaagggaggtgcatttgattctgtcgtttgacttttccgcaggtgatccctttgagaccatacgtgccaccaccgactactgtagaaggcataagattccttttcctcaggttgaggaagctgagttggatttatggtccaaggcgccagcgagctgttacatcctcaaaggcgagacaggccctgtcgtgatgcacttccccctctttaacatcgatgcctgtggaggagatatagaggcttggtcagatacatacgacactttcaaactagccgatacctacaccctggatgtagtggtgctgttgctagccctggccaaaaagaatgtgcgtgagaataagaaaaagatattgcgcgaactcatgaatgtggcgggatag

SEQ ID NO: 234872 - DNA, 1626 bp, Artificial Sequence
  Description of Artificial Sequence: Synthetic coding sequence
atggggtcgtctgaggtatctattatacccggactgcagaaggaggaaaaagccgcagttgagcgacggcgactccatgtcttgaaggctcttaaaaagctgaggatcgaggctgacgaggcacctgtggtggcagtactcgggtccggtggaggcctaagggctcatatcgcgtgcctgggtgtcctgtcggagatgaaggaacaggggcttttggatgcggtgacttatctggccggagtgtcaggttctacgtgggcaatttcatccttgtacacaaatgacggggatatggaggccctggaagccgatctgaaacacaggtttacgcgccaggaatgggacctggcaaagtcactgcagaaaacaatccaggccgctagatccgagaactatagcctcacagatttctgggcttacatggtgatttctaaacaaactagagaattgccagagtcccacctgtctaatatgaaaaaaccagtggaagaggggaccctgccttaccccatctttgcagctatcgataatgaccttcagccttcgtggcaggaggccagagcccctgaaacttggtttgagttcacgccccatcacgcgggattctccgccctgggcgcttttgtgagcattacccacttcggatcaaaattcaagaagggacgcctagtcagaactcatcctgagagggatcttacgttcctgagaggactgtggggaagtgctcttggcaacacggaggtgatcagagaatacattttcgaccagcttcggaatctgacacttaagggcttgtggcggagggccgtcgctaatgccaagtccattgggcacctcattttcgcaaggctgctccgtctccaagagtccagccagggtgaacaccccccacccgaagacgagggcggagagccagagcacacatggttaacagaaatgttagaaaattggactagaactagtctggaaaaacaggaacagccgcatgaagaccccgaacgtaagggtagcctgagcaatctcatggattttgttaagaagaccgggatttgcgctagcaagtgggagtggggcaccacccacaatttcctgtataaacatggtggaattcgcgacaagatcatgtcttctagaaagcatttgcacttggtggatgccggtcttgccatcaacactccattcccgctggtactcccacctactcgggaggtgcatctaatcctgagttttgatttctccgcaggggatccctttgaaacaatacgcgctacgactgattactgtagaagacataagattccattcccccaggtagaagaagccgaactggatctctggagcaaagccccagccagctgctatatcctcaagggcgagaccgggccagttgtgatgcactttccactgttcaatattgacgcttgcgggggagacattgaagcctggagcgatacatacgacacctttaaactcgccgatacctacacactggacgtcgtggttctgttactggccctggccaagaaaaacgtgcgcgaaaacaagaagaaaatactccgcgagctcatgaatgtggcagggctgtattaccctaaagatagtgccagatcatgctgtctggcttag

SEQ ID NO: 234873 - DNA, 2457 bp, Artificial Sequence
  Description of Artificial Sequence: Synthetic coding sequence
atggaatccttgagtcccggtggacccccaggtcatccttatcagggagaagcatccacttgttggcagttgaccgtccgagtgctagaagccagaaacctgcgttgggcagatctgttgtctgaggccgacccgtatgtgatactccagctgagcaccgcacccggaatgaagttcaagactaagacattgacagatacatcgcaccccgtgtggaacgaggcctttcggtttcttattcagagccaggttaagaacgtgttagaactctcaatctatgacgaggactctgtgacagaagatgacatttgttttaaagtgctgtatgacatctcagaggtgctgccaggaaagttactgagaaaaactttcagccaaagcccacaaggggaagaggaactggacgtggagtttctaatggaagagacttccgatcgtccagagaatctgattactaataaggtgatagttgcacgggagctgtcctgtctggacgtgcacctcgactcaacaggatctacggctgtggtggctgatcaggataagctggagctggagctggtgcttaagggctcatatgaagatacacaaacctcattccttggaacagctagcgcctttcgatttcattacatggctgcacttgagacagagctgagcggccgattgcggtctagcaggagcaatggatggaatggggacaattctgctggctacctcactgttcccctacggcctctgacaattggcaaggaggtgacaatggacgtccccgctcccaacgctccaggggtgagattgcagcttaaggccgagggttgtcccgaggagctggccgtccacctaggcttcaatctctgcgccgaggagcaggcatttctttccaggagaaagcaggttgttgcaaaggcactgaaacaggctcttcagctggaccgagacctccaggaggacgaagtcccagtagtgggcataatggccacagggggaggggcacgggctatgacttctctctacggccatctcctggctcttcagaaactgggcttactggactgcgtgacctatttctctgggatctccggtagtacttggacgatggcccatctttacggcgacccagagtggtcccagcgggatttagaggggccaattcgctacgcccgagaacaccttgctaaatccaaactggaagtgttttcgcctgaacggctcgcaagctataggcgggagctggaactacgcgctgagcagggtcacccaaccaccttcgtggacctgtgggccctcgtgctggaatctatgctccatggacaagtcatggaccagaaactgtctggacagcgcgcagccctcgaacggggtcagaatcccctgcccctgtacctgtcactgaatgtgaaggaaaataacttagagacactcgattttaaagagtgggtggagtttagcccttatgaagttgggttcctgaaatacggcgcttttgtgccgcctgagttattcggttccgaattctttatgggaagactaatgcgacggatccccgagcctagaatatgcttcctggaggctatttggagcaacattttctcactgaacctcttagatgcctggtacgatttgacctcctctggcgaaagctggaaacagcacatcaaagacaagacgcgaagcctggagaaggagccccttacaacttcggggacgtctagcaggttggaggcctcctggttacagcccggtacagccttagcacaggccttcaaaggctttctgacaggaaggcctcttcatcagaggtctcctaatttcctgcagggacttcagcttcatcaagattattgttctcacaaggatttttctacctgggctgattatcaactagactcgatgccgagccagctgacaccaaaggagcccaggctgtgtcttgtggacgctgcttattttatcaatacttcctccccatccatgttcagacccggtaggaggctggacctgatattgtcattcgactactcattatctgctccattcgaagccctgcagcagactgaactgtattgccgggctagagggctgccctttcccagagtagagcccagtccccaggaccaacatcagcctcgtgaatgccatctctttagtgaccccgcttgtccagaggcacctattctcctgcatttccctttggtcaatgctagcttcaaggaccatagcgcccctggcgtgcaacggtcccccgcagagctgcagggcggacaggtggacttgaccggcgcaacttgcccttataccttaagcaacatgacgtataaagaggaagatttcgagagattgctgaggttgagcgactacaacgttcagacttctcagggcgcaattctccaggcattacgcaccgctctgaagcaccgcacgttagaggccaggcctccccgagctcagacctag

SEQ ID NO: 234874 - DNA, 1326 bp, Artificial Sequence
  Description of Artificial Sequence: Synthetic coding sequence
atggtccctccgaagctgcacgttctcttttgtttatgcggatgcctcgctgtagtctacccttttgactggcagtacataaacccagtggcgcatatgaaatcaagcgcctgggtgaacaagatacaggtgttaatggcagcggcatccttcggccagacaaagatccccagaggaaatgggccttactctgttggctgtacggatctgatgtttgaccataccaataagggaacctttcttagactttactacccctcccaggataatgataggctggacaccttatggattcctaacaaagagtacttctggggcctatccaagtttctcggcactcactggctgatggggaacatcctgcgtctcttgttcggctctatgactaccccagctaattggaacagtcctctgcggcctggtgagaaataccccctcgtggtcttctcccacggccttggagcctttcgaaccctctattcagccattggaattgatttagcctcccacgggtttattgtagcagccgtcgaacatagagatcgctcagcatcagcaacctactattttaaagatcaaagtgctgctgaaataggcgacaagagttggctatatttgagaaccctgaagcaggaggaagaaacccatatacgcaacgaacaagtacgacagcgcgcaaaggagtgcagtcaagccctgagccttattttggatatcgaccacggcaaacctgtgaaaaacgccctcgatctgaagtttgacatggaacaactgaaagactcaatcgacagagaaaagattgctgttattgggcacagttttgggggtgccacggtgatccaaacactcagcgaggatcagcggtttcggtgtggtattgccttggatgcctggatgttccccctcggggacgaggtctatagcagaatacctcagcccctgttttttatcaacagcgagtattttcaataccccgcaaacattatcaagatgaagaagtgttactcgcccgataaggaaaggaaaatgatcaccatccggggaagcgtgcaccagaacttcgccgactttacattcgccaccggcaagattatcggccacatgttaaagctgaagggtgacattgactcaaatgtggcaatagacttgagtaacaaagcttccttagccttcctgcagaaacaccttggcctgcataaggattttgaccagtgggactgtttgatagagggcgacgatgagaatctgataccgggtaccaacataaataccactaaccaacacattatgttacagaatagcagcggaattgaaaaatacaactag

SEQ ID NO: 234875 - DNA, 1326 bp, Artificial Sequence
  Description of Artificial Sequence: Synthetic coding sequence
atggtgcccccaaagctacacgtgctgttctgcctgtgtggatgccttgcagtggtgtatccttttgactggcagtatatcaatcccgtggcccacatgaagtcctccgcctgggttaacaaaatacaggtcctcatggctgcagccagcttcggacagacaaaaatcccccgaggtaatggcccatattctgtcggttgtacagacctcatgtttgatcataccaataaggggacatttctgcgactgtactacccatcacaagacaatgatagactagacaccctgtggatcccaaataaggagtacttttggggtttgtctaaatttttagggacacattggctgatgggcaacatcctgaggctgctctttggaagcatgaccaccccagcaaattggaattcaccgctgcgtccaggtgagaaataccccttagtagtgtttagtcatggactgggcgctttcaggaccctctatagtgccatcggaatcgacttggcctctcatggtttcattgtggcagctgtggagcatcgcgataggtcagctagtgccacatactatttcaaagaccagagcgctgccgaaatcggtgacaagtcatggctttacctaagaaccctgaagcaggaggaggaaacccatattaggaacgagcaagtgaggcagagagcaaaagagtgtagccaggctctgtccctgatcctggacatcgaccatggtaaaccagtcaaaaatgccctggatctcaaatttgatatggagcagttgaaagattccattgacagagagaagatcgcagtgatcgggcacagttttggcggagctaccgttatccagactctgagtgaggaccagcgttttaggtgcggaatagcgcttgacgcgtggatgttccctctgggcgatgaggtctacagcaggattccacagccgctatttttcattaactccgagtatttccagtatccggctaacataattaaaatgaaaaagtgttactccccagacaaagaaagaaaaatgatcacaataagaggatctgtgcaccaaaacttcgctgacttcacgtttgccaccggcaaaatcattggccacatgctgaaacttaagggcgatatcgactcaaacgtggccatcgatctatcgaacaaagcttctctcgcctttctgcaaaaacacctgggcttgcacaaagattttgaccagtgggattgcttaatcgaaggggacgatgagaacctcatccccggaacaaatatcaatacaactaatcaacatataatgctgcagaattcaagcggaatcgaaaaatacaactag

SEQ ID NO: 234876 - DNA, 660 bp, Artificial Sequence
  Description of Artificial Sequence: Synthetic coding sequence
atggcggctgccagttttggacaaactaagataccacggggaaacggcccatatagcgtgggatgtacagatctgatgttcgatcacaccaacaaagggacctttctaaggctgtactacccatcccaggataatgataggttggatactttatggatccctaacaaagaatatttctggggactgagcaagtttctgggtactcattggttgatggggaatatccttagactactctttggctcaatgacaacccccgcaaactggaattcccccctgcgcccaggcgaaaaatatccgttggtggtgttcagtcatggtctgggagccttccgaactctctactctgccatcgggattgacctggccagccatgggttcatcgtcgccgctgtcgaacatcgggacagaagtgcttcagcgacatactattttaaagaccaaagtgccgcagagattggcgataaatcatggctatatcttaggacacttaagcaggaagaggaaactcacatccggaacgagcaggtgcgccagagagctaaagaatgtagtcaggctctcagcttgatcttggacatcgaccacggcaaacccgtgaaaaacgcactggatctcaaattcgatatggagcagctgaaggtgagttacaaaaagtag

SEQ ID NO: 234877 - DNA, 414 bp, Artificial Sequence
  Description of Artificial Sequence: Synthetic coding sequence
atgacgacccctgccaactggaatagcccactacgccctggcgaaaaatatcctctggtcgtcttctcacacgggctcggagccttcaggacactatacagcgctataggcatcgacctggccagccatggatttattgtagctgcagtggaacatcgcgataggagcgctagcgctacgtattacttcaaagaccaaagtgctgctgagattggtgataagtcatggctctacctgaggaccctgaaacaggaggaggagactcatattagaaacgaacaagtgcggcagagagccaaggagtgcagccaggccctgtccctgatcctggacatcgaccacggcaagcctgtgaagaacgctctagacctgaagtttgacatggaacagctgaaagtgtcttacaaaaagtag

SEQ ID NO: 234878 - DNA, 489 bp, Artificial Sequence
  Description of Artificial Sequence: Synthetic coding sequence
atgcgggctcctatcccagaacccaagcctggagacctgatcgagatctttaggccgttttatcgacattgggctatatacgtgggtgacggatacgttgtgcacctcgcaccaccgtcagaggtggcaggcgctggagctgcttctgtgatgtctgccctcacagacaaggcaatcgtgaagaaagaactgctgtatgatgttgcaggtagcgacaaataccaggtcaacaacaaacatgatgataagtactctccgctgccttgtagcaagattatccagcgcgcagaggaactcgtggggcaggaggtgctgtataagttaacgtcagagaactgcgagcacttcgtaaacgagctacggtatggtgtggcgcgtagcgaccaagtccgagacgtgatcattgcggctagcgtggcgggaatggggctcgcggctatgtcactgatcggtgtgatgtttagcagaaacaaaagacagaagcagtag

SEQ ID NO: 234879 - DNA, 489 bp, Artificial Sequence
  Description of Artificial Sequence: Synthetic coding sequence
atgagagcccctatcccggagccgaagcctggtgatctgatcgagatttttcgacccttctatagacattgggccatttatgttggggacggctatgtggtccacctggctccaccatctgaagtcgcaggcgcaggggctgcatccgtcatgagcgctctcactgacaaagctatagttaaaaaggaactgctgtacgacgtcgccggtagcgataagtatcaggtgaataataagcacgacgataagtatagccctttgccgtgctccaaaattatacagcgagccgaagagctggtaggacaggaagtgctgtataagttgacgtccgagaattgcgagcacttcgtgaatgaactccggtacggggtcgcacggtccgatcaggttcgggacgtgattattgcagcttccgtggctggaatggggcttgccgcaatgagcctgattggcgtgatgttctcccgcaacaagcgtcagaaacagtag

SEQ ID NO: 234880 - DNA, 4377 bp, Artificial Sequence
  Description of Artificial Sequence: Synthetic coding sequence
atgggtttaagacctggaatcttcctcctcgaattactgctactacttggacagggcacaccacaaattcacacctcccctcgcaaaagtacactggagggacagctttggcccgaaacacttaagaattctcccttcccttgcaatccgaacaagctaggcgtgaacatgccatctaagtcagtacatagtctcaagccgtccgatatcaaatttgtcgccgctattggaaatctggaaattccgccagacccaggcaccggtgacctggaaaagcaggactggaccgaacgaccacagcaggtctgcatgggggtgatgacagtactttctgacattatccgttactttagcccgtcggtgccgatgcccgtatgtcacacaggaaaacgcgtgattccccacgatggcgcagaagatctttggatccaagcacaagaactggtgagaaatatgaaggagaacctccaactcgattttcagttcgactggaaacttattaatgtcttcttctctaatgcatcccaatgctacctctgcccatccgcacagcaaaacggcctcgccgctggcggtgtcgacgaactgatgggagtgcttgattatttgcagcaggaagttcccagggccttcgtgaacctggtggatctcagcgaggtggcggaggtgtcacgccagtatcatggtacgtggctgtcaccagcaccggaaccttgcaactgttctgaagaaacaactcgtctggcaaaggtggtgatgcagtggagctaccaggaagcctggaacagccttctagcgtcgagcagatattcagagcaggaaagctttactgttgtgtttcaacctttcttctacgaaaccacccccagtctccacagcgaagacccaagactgcaggattcaaccactctggcgtggcatctgtggaacaggatgatggaacccgctggtgagaaggacgaacctctctcggttaagcacggtaggccgatgaaatgcccttcccaggagtccccctacctgttctcctaccgcaactccaactacttgacccgcttgcaaaagccacaggataaacttgaggttcgggagggcgcagagatccgatgtccggacaaagaccctagcgacacggtgcccaccagtgttcacagactgaagcctgctgacattaacgtgattggcgctctcggggattcattgaccgcaggtaacggggctgggtccaccccaggcaatgtgctggatgtactgacacagtatcggggactgtcctggagcgtggggggagacgagaacatcggcacagtaactaccctggccaacatactgcgcgaatttaatccgtccttgaagggctttagcgttggtaccggtaaggaaacttccccaaatgcatttctcaatcaagcggtggcgggtggaagagccgaggacctgccagtccaggccaggcgcctggttgatctgatgaagaatgacacgagaattcactttcaagaagattggaagattatcacactctttatcggcggaaacgatctctgtgatttttgcaacgatctggtgcactactcaccacagaactttaccgataatatcggtaaggcccttgacattctgcatgccgaggtgcccagagccttcgtcaatctggtgaccgtgctggagatcgtcaatcttcgcgaactgtaccaggaaaagaaagtgtattgtcctagaatgatcctcagatccctgtgtccttgcgtcctgaagttcgacgacaactccactgagttggcgacgttgatcgaatttaacaaaaagtttcaggaaaagactcatcagttgattgaaagtggaaggtatgatacccgtgaggactttacggttgtggttcaacccttttttgagaacgtagacatgcctaagacaagtgaaggactgccggataatagtttttttgccccagactgttttcactttagctccaagtctcattcacgagctgcatcagctctgtggaacaatatgctcgaaccagtgggacagaaaacaacgcgacataaattcgagaacaaaattaacatcacatgcccaaatcaagttcagccattcctgagaacatataagaactcaatgcaggggcatggcacatggctgccttgcagagatcgggctccatccgcgttgcatcctaccagtgtgcacgccctccggccagctgacatccaagtggtggccgcacttggggatagcctgacagctggcaacggcattggatctaaacccgacgacctgcccgacgtcaccacacagtacagaggtctttcctactcagcaggtggggacggttccctggagaatgtcaccactctgccgaatatcctgcgcgagtttaaccggaacttaacaggctatgctgtcgggacaggggatgccaatgacactaacgcttttctaaatcaagctgtgccaggcgcaaaggccgaggacctaatgtcacaggtacagacactcatgcagaagatgaaggatgatcacagagtgaattttcacgaggactggaaagtcataaccgttctaatcggcggttccgacctgtgcgactattgtactgattccaacctgtacagcgctgccaattttgtccaccacctgcggaacgctctcgacgtactccatcgcgaggtgcccagggttctcgttaatttggtggactttcttaatcctacgataatgagacaagttttcctgggtaatccagacaagtgccctgtccagcaggcttctgtgctgtgcaattgtgtactcacgctgcgggagaattcgcaagagctagctagactggaagctttctcacgcgcatacagatccagcatgagggagctggttggtagcggcaggtacgacacgcaggaggacttcagtgtcgtgctgcagccgtttttccagaacattcagctccctgtactggccgacggtttgccggacacctccttctttgcccctgattgcatccatccaaatcagaagttccactcccagctggctagggccctctggaccaacatgctagagccgctggggagcaaaacagaaacactggaccttagggctgagatgcccataacttgcccaacacagaacgaaccttttttgcggacacctagaaattcaaactatacatacccaatcaagcccgcaattgaaaattggggcagtgatttcctttgtacggagtggaaagcttctaatagcgtccccacttccgtgcaccagcttcgacctgccgacatcaaagttgtcgccgctcttggcgattccttgactactgccgtaggggcaaggccaaacaactctagtgatctaccgacgagttggcggggactttcatggtcgatcggtggggatggcaatcttgagacccataccaccctccctaacattctgaaaaagtttaacccataccttttgggtttctccacatccacctgggaaggcaccgccggtctgaacgtggcagccgagggcgctagagccagagatatgccagcccaagcttgggatctcgtagaaaggatgaaaaacagccctgacattaatcttgagaaagattggaagttggtgacccttttcattggcgtgaatgatctgtgccactattgcgaaaacccagaagctcacctagccaccgaatacgtgcagcacatacagcaggctctcgacatacttagcgaggagctgccaagggcattcgtcaacgtcgtcgaagtgatggagctggcaagcttgtaccaagggcaagggggtaagtgtgcgatgctagccgcacagaacaattgcacctgtttgagacactctcagtcaagtctggagaaacaggaattgaagaaggtcaactggaatttacaacacggcattagctcattttcttattggcatcagtacacccaacgggaagactttgccgtggtcgtgcagcctttcttccagaacacactaacccccctgaacgaacgaggcgataccgatctcaccttcttctccgaggactgttttcacttcagcgatagaggccatgccgaaatggccattgccctctggaacaacatgttggaacctgtcgggagaaaaaccaccagcaacaatttcacccactcacgggcaaagctgaagtgcccatcacccgagagcccatacctgtatactctgcggaactctaggttgctacccgaccaggcagaagaagcccctgaagttctgtactgggccgtccctgttgctgcaggtgtggggctggtcgtagggattatcggcacagtggtttggagatgtcgcagaggcggaaggagggaagaccccccaatgagcttgagaaccgtggccctttag

SEQ ID NO: 234881 - DNA, 1467 bp, Artificial Sequence
  Description of Artificial Sequence: Synthetic coding sequence
atggaacccgctggggaaaaagatgagccattatctgtcaagcacggaaggcccatgaagtgcccttctcaggagagcccgtatctgttctcttaccgcaattccaactatctaacccggctccaaaaacctcaggacaaactggaagtgagggaaggtgcggagataaggtgccccgataaagatccatctgataccgttcccaccagcgtgcacagactgaaacccgctgacatcaatgtaattggtgccctgggcgactcattaactgcaggcaacggcgcagggagcacgcctggtaatgtcctggacgtgttaacccagtaccgcggtctgagctggagcgttgggggagatgaaaatattggcacggtgactactctagccaacatcctcagagagtttaatccaagtctgaaaggcttctccgtcgggacaggaaaagaaaccagccctaatgcatttcttaaccaagccgtcgccggaggacgagcagaggatctgcctgttcaagcacgcagactcgtcgacctcatgaagaatgatacgagaattcactttcaagaggattggaagattataaccctgtttatcgggggtaacgatctttgtgacttctgcaacgatctggtccattactcaccccagaatttcaccgataacataggcaaggcgttagatatcctccacgccgaggttcccagggcatttgtgaacctggtgactgtcctggaaattgtgaacctacgtgagttataccaagaaaagaaagtctactgtcctcgaatgatcctgcgatcactgtgcccctgtgttctgaagttcgacgataatagtacagaactagctactttgattgagtttaacaaaaagttccaggagaaaactcaccagctgatcgagtccggaagatatgacacacgcgaagattttacagtcgttgtccaacccttttttgagaatgtagacatgcccaagacatccgagggtctgcctgataatagcttttttgctcccgactgctttcacttttccagtaaatctcattctcgagccgcttccgcactgtggaacaacatgctggagccagtagggcagaaaaccacccgacataagttcgagaacaaaatcaatattacctgtcctaatcaggtccagccatttctgaggacatataagaacagcatgcaggggcacggcacgtggctgccttgccgggacagagccccaagcgcgcttcacccaactagtgtccacgcactgcgacccgcagatattcaggttgtggcggcacttggcgacagtcttactgcaggaaacgggattggcagcaagccagatgaccttcccgacgttacgacacaataccgaggcctgtcatacagggaatccaagccgggttttttatctgatagttgggtctccaagtccaacagaaaatgtaccagaaaagcccctaatccgtag

SEQ ID NO: 234882 - DNA, 4344 bp, Artificial Sequence
  Description of Artificial Sequence: Synthetic coding sequence
atggggctgcgtccgggaatatttctgcttgagctgctcttgcttctgggtcaaggaacaccacagatccatacaagcccacggaagtctacgctggaagggcagctttggccagaaactttgaagaattcaccattcccttgcaaccccaacaagcttggcgtgaatatgccgtctaagtcggtgcactccctaaagccgagcgatatcaagtttgtggctgccatcggaaatctggaaatcccaccagaccctggtacaggtgacctcgagaaacaggattggaccgaaaggcctcagcaggtgtgcatgggtgtcatgacagtgctgagtgacattatccggtacttctccccctccgtgccgatgcctgtgtgccacactgggaaacgagtcattccgcacgatggggcagaggatctgtggatccaagctcaagagcttgtgcgtaatatgaaggagaacctgcagctggattttcaatttgattggaaattgatcaatgtcttttttagcaacgcctcccaatgttacctgtgtccctcagctcagcaggcgcctagcctctccaccgttcttctgtcacagaacggccttgcggcaggaggggtcgatgagctgatgggagttctggactacctgcaacaagaggtgcctcgggcatttgttaacctggtcgacttatccgaggttgctgaggtgtcaaggcagtatcatggaacctggcttagtcctgccccagaaccttgcaattgttccgaggagacgacaagactggctaaagttgtcatgcagtggtcctatcaggaagcttggaactccctgctggcttcctctcggtattctgagcaggaatcgtttacagtggtgtttcagccttttttctatgagaccacgccctcactgcatagcgaggatcctaggctccaggattcaacgaccctcgcttggcacctttggaataggatgatggagccagcaggagagaaggacgagccactctccgtgaagcatggaagaccgatgaagtgtccttcacaggagtcaccgtacctgtttagctatcgaaattccaactatctaacccgtctccagaaacctcaagataaactcgaagtccgggagggagctgagatccgatgtcccgataaggatccttcagatacagtaccaacctcagtgcatcggttgaagcccgcagacatcaatgtcatcggcgctctcggagactcgttaaccgcaggtaatggcgcaggatctacacctggcaacgtgctcgatgtgcttacacagtacaggggactgagttggtctgttggcggagatgaaaatatcggcacagtgacgacgcttgctaacatactgagagagtttaatccttctctgaagggtttctctgttggcactggcaaagagacttccccaaatgcttttctgaatcaggccgtggctggcggacgggcagaggatcttccagttcaggcaaggcgactagtagacctgatgaagaacgacactaggattcacttccaagaagattggaagatcattactctgtttatcgggggtaacgacctgtgtgatttctgtaacgacttggttccccgtgcattcgtgaatctggtgacagttctcgagatcgtgaatttacgggagttgtatcaggaaaaaaaggtctactgcccacgcatgattctgcggagcctgtgcccatgcgtattgaagtttgatgataattccaccgaactggccacgctcattgaatttaataagaaattccaagagaagacgcaccaactgatcgaatccggacgatatgacacccgggaggatttcactgtggttgtacagcccttcttcgagaatgtcgatatgcccaaaacatctgaaggtctcccggacaacagtttcttcgcacccgattgttttcacttttctagcaaatctcactcacgcgctgcctctgctctatggaacaatatgctcgagccagtcggtcaaaagaccacccggcacaaattcgaaaataagattaacataacttgtccaaatcaggtacagccattcctcaggacgtacaagaacagcatgcaagggcatggaacctggctgccttgccgagacagagcgccttctgcccttcatcccacaagcgtgcacgccttgcgccctgctgatattcaggtggttgctgccctgggcgattccctgaccgctggcaacggcatcggatcaaaaccagacgacctaccagacgtgaccacacagtatcgcggtctgtcatattccgcagggggtgatggttctctggaaaacgtgacaacactgcctaatatccttagggaatttaatcgcaatctgaccggatacgctgtgggaacaggtgatgccaatgacacaaatgccttcctaaaccaggccgtgcccggagccaaagctgaggatcttatgtcacaggtacagaccctgatgcagaaaatgaaggacgatcatcgcgtgaatttccatgaagattggaaagttattaccgtgctaatagggggatcggacctctgtgattattgcactgattctaacctgtattcagcggcaaattttgttcatcatctgcgaaacgccctggacgttctgcacagggaagtccctcgggtactggtgaacctggtagatttcttaaatccaaccatcatgaggcaggtatttcttggaaatcctgataagtgtcctgtgcaacaggctagcgtcctgtgcaattgtgtgctgacactgagggagaactctcaagagctggctcggctggaagccttttcccgcgcatatagaagtagcatgcgagaactggtgggctcgggtcgttatgatactcaagaggacttctctgtggtgctccagccctttttccagaacatacagctgcctgttctggcagatgggcttcctgatacctctttctttgcccctgattgcatacacccaaatcagaagttccactctcagctggcccgagccctgtggactaacatgctggagcctctgggttcaaaaactgaaacgctggacctacgcgctgagatgcccatcacttgcccgacgcaaaacgagcccttcctgaggactccaaggaacagtaattacacctacccaatcaaacctgccattgaaaattggggaagtgactttttgtgtacggagtggaaggcctccaactctgtgcccaccagtgtacaccagctgcggccagcagacattaaagtggtggcagccctcggagattccctgaccaccgctgtgggcgcacgccctaacaactcatctgatctgcccactagctggcgagggctgtcctggtctatcggcggagatggaaaccttgaaacgcacacgacgttacctaacattcttaaaaagttcaatccttacctgctaggcttcagcacatctacttgggagggcacagctgggctcaacgtcgccgctgagggggcaagggctcgagatatgccggctcaagcatgggatcttgttgaacgaatgaagaatagtccagacataaatcttgaaaaagactggaagctcgtcactcttttcatcggcgtgaatgatctgtgtcattactgcgaaaacccagaggctcatctcgctaccgagtatgtgcaacatatccagcaggccttagatattctgagtgaggaacttccaagggccttcgttaacgtggtcgaagtaatggagctagcatctctctaccaaggccagggtgggaagtgcgctatgctcgctgctcagaacaattgcacgtgcctgaggcatagccagagctcactggaaaagcaggagttgaaaaaggttaactggaacttgcagcacggcatctcctcattttcatattggcatcagtacactcagcgggaggattttgccgttgtggtgcagccttttttccagaacactctgaccccattgaatgagcgaggcgacaccgacctcaccttcttttctgaggactgttttcacttctctgaccggggtcatgctgagatggctattgcactgtggaataacatgctagagcctgtggggcgtaagaccacttccaacaatttcactcactcacgcgctaaactcaagtgtccatcccccgagagtccctacctgtataccctaaggaactcgaggcttcttccggaccaagccgaagaagcccctgaggtgctgtattgggctgtgccggtggccgctggcgtcggcctagtcgtaggcatcataggcaccgtggtgtggcggtgtcgtcgaggtggcaggcgtgaggaccctcccatgagcttacgcactgtggccctctag

SEQ ID NO: 234883 - DNA, 1272 bp, Artificial Sequence
  Description of Artificial Sequence: Synthetic coding sequence
atgcccatcacctgccctacgcagaacgagcctttccttaggacgccgaggaactcaaactacacctatccaattaagcccgctatcgagaattggggaagtgatttcctctgcacagaatggaaagcaagcaattccgtgccgacatccgtgcaccagctgcgcccagctgatattaaggtggtcgccgcactgggtgatagcctcaccacagccgtgggcgctcggccaaataactctagcgacctgcccacaagctggcggggtctctcttggagcatcggcggtgatggcaatctggaaactcacacaactcttccaaatatacttaaaaaattcaatccctatctgctcggattttccactagcacatgggaaggcacagccggtctgaacgtagctgccgagggggcaagagcccgagatatgcctgcacaggcgtgggatctggtcgagagaatgaagaattctcctgatatcaatttggaaaaagattggaagctagtaacattattcatcggtgtgaatgacctgtgccactactgtgagaacccagaagcccacctcgctaccgagtatgtgcaacatatccagcaggccctggacattctatctgaagaactgcctagggcattcgtgaatgtggtagaggtaatggaacttgcctctctgtaccagggacagggcggaaagtgtgccatgctcgccgcacagaacaattgcacttgtctcaggcacagccagtcatccttagaaaagcaagagctcaaaaaagtcaactggaacttgcagcacgggatcagtagtttctcctactggcatcagtacactcagagagaggattttgctgtggtggtccaacccttctttcagaacaccctgactccactgaatgaacggggagacacggacctgacattcttttctgaggactgttttcacttctccgacagggggcatgctgaaatggcgatcgctctatggaacaacatgctggagccagtgggcaggaaaaccacttccaataatttcacacattcaagggctaaattgaagtgtcctagtccggaatcaccatacctctacaccctccggaatagtcgcctcctgccagaccaggccgaggaagctcccgaagtgctctattgggctgtgcctgtggctgccggtgtcgggctagtggtgggaattatcggtacagtcgtctggagatgccgaaggggcggtcgcagagaggatcccccaatgtcactgcggaccgtggcactctag

SEQ ID NO: 234884 - DNA, 3504 bp, Artificial Sequence
  Description of Artificial Sequence: Synthetic coding sequence
atggcgggtgctcagcctggcgtgcacgcattacagctggagccacccacagtggtcgagacacttcgccgaggtagcaagtttatcaagtgggatgaagaaaaactgatgacagtagtctctggcccagaccctgtgaacacggtgtttctaaactttatggccgtccaagatgataccgctaaagtttggtcagaagaactgtttaaactggctatgaatatactagcccagaacgcctcccgcaatacatttctgagaaaagcttatacgaagctgaaattacaggtcaaccaagacggtcggatccccgtgaaaaacatactcaaaatgttttctgctgacaagaagcgagttgaaacagctttagagtcttgtgggctgaagttcaataggagcgagagtatccgcccagacgaattcagtctggagatttttgagagattcttaaacaaactctgcttacggccagatatcgataaaatcttactggaaattggtgctaagggaaagccctacttaactctggaacaactcatggactttataaatcagaaacagcgggaccctcgcctgaacgaagtcctttatccccctcttcgaccgagtcaggcacggctgctcatcgagaagtacgaaccgaaccaacagtttttggagcgtgatcagatgagcatggagggctttagcagatatctcggcggtgaggaaaacggcatcctgccccttgaagccctggatttgtctacagatatgacccaacctctgtctgcatattttatcaactcttctcacaacacgtaccttacggcaggtcaactggctgggacttcttccgtggagatgtatcgacaagccttactgtggggttgtcggtgtgttgagctggacgtctggaaaggacgtccgcctgaagaagaaccgttcattacgcacggtttcacaatgaccaccgaggtcccacttagggacgtgctggaggctatcgcggagacagcatttaaaaccagtccttaccctgtgattctatcctttgagaaccacgtggactcagcaaagcagcaggctaagatggcagagtactgtcgttctattttcggagacgcattactaattgagcccctggataagtaccccttggctcctggagttccactgccttccccccaagatctgatgggacggatactggtcaagaataagaagcgccatcgtccatccgctggagggcctgattctgccggacggaaacggcctttggaacaaagcaactcggcgttgtctgaaagttctgccgctaccgaaccgtcaagtccccagctaggctcaccaagttccgatagttgcccaggtctgtcaaatggagaagaagtgggtcttgagaaacctagtctggagccacaaaaaagtctaggcgacgaaggactgaaccgtggcccttacgttctgggcccagcagatagagaagatgaagaagaggacgaggaagaggaagagcaaactgatccaaaaaaaccaacgaccgatgaaggaaccgccagtagcgaggtgaacgccactgaggaaatgagtacgctcgtgaattacattgagccagtcaagtttaaatccttcgaagctgcacgcaagcgcaataagtgttttgagatgagctcttttgtcgagacgaaggcgatggaacaactgacaaagtctcctatggaattcgtcgagtacaataagcagcagctatccagaatttatcccaaaggcacaagagttgattccagcaactatatgccccagctgttttggaacgtcgggtgccagttggtagctcttaactttcaaactcttgacgtggcgatgcagttgaacgcaggagtgttcgagtataatggcagatcagggtacctgctgaagccggaatttatgcgacgtccggacaagtccttcgaccccttcacagaggtgatcgtcgacggcattgtggctaacgctctgagagtgaaagtgatcagtggccagttcctgtcagacagaaaagtcggcatctacgtagaggtcgacatgttcgggcttccagttgatactcggaggaagtatcgtacccgcacttcacaggggaactccttcaatccggtttgggatgaagagccgtttgacttccccaaggtcgtgctccctactcttgcgagcctgaggattgccgcttttgaagaagggggtaagtttgtggggcatcgaatcctccccgttagtgctattaggtcaggttaccattacgtctgcctccgcaatgaggcaaaccagcctctgtgcctgcctgcccttctgatctacaccgaagccagtgattacatacctgacgatcatcaggattatgcagaggcgttaatcaatcccattaagcatgttagcctgatggaccagagagcacgtcaactggcggctctgattggtgaatccgaggctcaggcagggcaggaaacgtgtcaggacacccagtctcagcagctagggagtcaacctagcagcaaccccacccctagccctctcgacgcctctccccgtcggccacccggacctacgacctcacctgcttcaacaagcttgagttccccaggccagcgagacgacctcattgcatccatcttaagcgaagttgctcctacccccttagacgaactacgtggccacaaggcccttgttaaactgaggagtcgacaggagcgggacctgcgcgagctgcgtaaaaaacatcagcggaaggcagtgactttgacaaggcggctgttggacggactcgctcaggctcaagccgaaggtcggtgtagacttcgcccaggagcgctaggaggagccgctgatgttgaggataccaaggaaggcgaagatgaagccaaaaggtatcaagaatttcaaaatcggcaggtgcagtccctgttagagctccgcgaggcccaggtggatgccgaggctcagcggaggctcgaacacctgcggcaggccttgcagaggctgagagaggtggttcttgatgcaaatacaacgcagtttaaacgcctgaaagaaatgaacgaacgagagaagaaagagctgcagaagatactcgaccgaaagcggcacaattccatatcggaggctaagatgagggacaagcacaaaaaggaggctgagctgactgaaataaacaggaggcacattacagagtccgtcaactcaattcgaagattggaggaagctcagaagcagcgccatgatcgactcgtcgcaggtcaacagcaggtgctgcagcaattggccgaggaagagccaaagctgctggcccagctggcccaggaatgccaagagcagcgagcaaggctaccccaggagattcggaggtcgctcctgggagaaatgccagaggggttaggagatggacctttggtcgcatgtgctagtaatggacatgctcccggatcgagtggccacctcagcggggcagacagcgagagccaggaagagaacactcagttatag

SEQ ID NO: 234885 - DNA, 3651 bp, Artificial Sequence
  Description of Artificial Sequence: Synthetic coding sequence
atggcaggggcacagcccggagtgcacgcccttcagttgaagccagtgtgtgtgagcgattctctcaaaaaggggacaaaattcgtcaagtgggacgacgattccacgattgtgacccctatcatcctgcgcaccgatcctcagggcttttttttctactggacagatcagaacaaggagacagagcttttggatctctcactcgtgaaagatgctaggtgcggaagacatgccaaagctcccaaagatcccaagctgcgtgagctactcgacgtcggcaatattggacgcctcgaacagcgaatgatcaccgtggtgtacggtcccgatctggttaacatttcccacttaaatctcgtggcctttcaggaagaagtggcaaaagaatggactaatgaagttttctccctggccacaaacctcctggcccagaacatgtccagggatgcattcttagagaaagcatatacaaaactgaagctacaggtgacgcccgagggacgcatcccccttaaaaatatttaccgcctgttttcggctgatcgcaagagagtcgagaccgctttggaagcttgcagtctgccatctagccgcaatgactccattcctcaggaagacttcacaccagaagtctatagagtattcctgaacaacctctgtccacggcctgagatagacaacattttcagtgagtttggtgccaagagcaagccctacctgaccgttgatcaaatgatggacttcatcaacctcaaacagcgcgacccgcgactgaacgaaattctgtatcctcccctgaagcaggaacaagtgcaggttctaatcgagaagtacgaacccaataactctctcgccagaaaggggcagatctcagtcgacgggtttatgaggtaccttagcggtgaggagaatggagtcgtgtcaccggaaaagttggacctgaacgaagacatgtctcagccactcagccactacttcatcaattccagtcacaatacctacttgacggccggacagctggcaggcaatagcagcgtagagatgtatcgccaggtgctgctttcaggttgccgttgcgtcgaattggattgttggaaggggaggacagctgaggaggagcccgtgattacgcacggttttaccatgactaccgagatttcgtttaaagaggtcattgaggccatcgcagagtgcgctttcaagacatccccatttccaatactcttgtcatttgagaaccacgtggacagccccaaacagcaggcaaaaatggccgaatattgccgcctgatttttggggacgctctgctcatggagcccctcgagaagtatccacttgaaagcggggttccacttccctcccccatggacttaatgtataaaatcctggtaaaaaataagaaaaaaagccacaagtcaagcgaaggctccgggaaaaagaaacttagcgagcaggccagtaatacctactcagactcatcttccatgttcgaacccagctcacccggtgccggtgaagcggatactgagtctgatgacgacgacgatgatgatgactgtaaaaagagttcaatggacgagggaactgcaggaagtgaggccatggctaccgaggagatgtccaacctggtgaactacatccagccagttaaattcgagtctttcgagattagcaagaagcgcaacaagtcctttgagatgagctcgttcgtcgaaacaaaggggttggaacagttgacgaaaagcccagtggaattcgtggaatacaataaaatgcagctttcacgtatttaccctaaaggcaccagagtggactcatcaaactatatgcctcaactgttctggaatgctgggtgtcagatggtcgcgctgaactttcagactatggatcttgctatgcaaattaacatgggcatgtacgagtacaacggaaagagcggttatcggttaaaacccgagtttatgagacggcctgacaaacattttgatccttttacagaaggaatcgtggacgggatcgtggccaataccctgagcgttaaaataattagtggacagttcctgtcggataaaaaggtcggaacttacgtagaggtcgacatgttcggcttgcccgtcgacaccaggagaaaagccttcaagacaaaaaccagtcagggaaacgccgtgaatcccgtttgggaggaggagcctatcgtatttaagaaagtggtactgcctacactcgcctgtctgagaatcgcagtttacgaagaggggggtaagttcatcggccaccgcatactgcccgtacaagccattcggccaggataccactacatttgcttgcgtaacgagaggaatcagccgctgaccctccctgctgtattcgtttacatcgaagtcaaggattatgtccccgatacctacgccgacgtgattgaagccctcagtaatccgattcgatacgtaaatctgatggagcaaagagcgaaacaactggcagcactgacattggaagatgaggaagaggtgaagaaagaggctgaccccggtgagacaccctccgaagccccttctgaagctcggacaacaccggcagagaatggggttaaccacaccaccacgctgacacccaaacccccttctcaggcacttcactctcagcccgctcctggcagcgttaaggcccctgctaagaccgaggatctaatccagtccgttctcacagaggtggaggcccagacaatcgaagaactaaaacaacagaagtccttcgtcaaactgcagaaaaaacactataaggaaatgaaagacctggtcaagcgacatcataaaaagacaaccgaccttatcaaggagcataccaccaagtacaacgagatacagaacgactacctgcgtagaagagccgctctcgaaaagtcagcaaagaaggactcaaagaagaagtcggaaccttccagccccgatcatggtagttctaccattgagcaggatctggcagcattggacgcagaaatgacccagaaactgatagatctgaaagacaagcagcagcagcagctgctgaacctccgccaggaacagtattactcggagaaatatcaaaagcgcgagcacattaagctcctcatacagaagcttacagatgttgcagaagagtgtcagaacaaccaactgaagaagttaaaggagatctgcgagaaggagaaaaaagagttaaagaaaaagatggataaaaaacgccaagaaaagattaccgaggcgaagagtaaggacaagtcccagatggaagaggaaaaaaccgaaatgattaggtcatatatccaggaggtggtgcagtatatcaagagactcgaagaagcccagtctaagagacaggaaaaactggtggaaaagcataaggagatccgccagcagattttagatgagaagcccaagttgcaggtggagcttgaacaggagtatcaggataagttcaaaaggcttccactcgaaattctcgagttcgtgcaggaagcaatgaagggaaaaataagtgaagatagcaatcacggctccgcccctctatctttgagctcagacccgggaaaggttaatcacaagacgccgagtagtgaggagttgggcggtgatatccctggcaaggagtttgacactcccctttag

SEQ ID NO: 234886 - DNA, 672 bp, Artificial Sequence
  Description of Artificial Sequence: Synthetic coding sequence
atgcggcgaccagataaacactttgacccctttactgagggcatcgtcgatgggattgtggccaacaccctatccgtgaaaatcatctcaggtcagtttttatccgacaagaaagtggggacatatgtagaggtggatatgtttggcctgcccgttgatacccgtaggaaggctttcaagaccaaaacgtcccaaggaaacgcagttaaccccgtatgggaggaggagccaatagtctttaaaaaagttgtgttgccgaccttggcgtgtcttcggatcgccgtctacgaggaagggggaaagtttatcggccatcgcattctgcccgtgcaagctatacggccaggctaccactatatttgcctccgtaacgaacgcaatcagccgcttacgttgccagctgtattcgtctacatcgaggtgaaagactacgtgccagacacatatgcagatgtgattgaagctctctcaaatcctatccgctacgtgaatctcatggaacagagggccaagcaactagcggcactaaccctggaggatgaggaggaggtaaagaaagaggggggatttctgcatgacgaaattatgaggcttactcgcaatactttagagaaacttatggcccttcccctgacccatgtggtgcctattcaatcgaagatgctgtcttag

SEQ ID NO: 234887 - DNA, 3522 bp, Artificial Sequence
  Description of Artificial Sequence: Synthetic coding sequence
atggccggagctcagccaggggtacatgccctgcagttaaagcctgtttgcgtgagcgattctttgaagaaggggaccaagtttgtgaaatgggatgatgacagcaccatcgtgacacctatcattctgagaacggatcctcagggatttttcttttactggacagaccagaacaaggaaaccgaacttctggatctttcgctggtgaaagatgcccgatgcggaaggcatgccaaggctcccaaggatcctaaattgcgcgagctcttagacgtcggcaacatcgggaggttagagcagaggatgatcactgtggtttatggtcccgacctggttaacattagccacctgaatctggtcgcttttcaggaggaagttgcaaaggaatggaccaacgaagtgttttccctcgccaccaacctgctggctcaaaacatgagcagagatgcttttctggaaaaggcctacactaaactcaagctgcaagtaactcctgagggaagaattcccctgaaaaacatttatcgactgttttctgccgaccggaaacgggttgaaactgctttggaagcctgttcactgccctcatcaagaaatgattctatcccacaggaagatttcaccccggaagtctatcgcgtgtttcttaacaatctgtgtcctcggcctgagatcgacaatattttcagtgagtttggcgctaagtccaagccctacctgacagtagatcagatgatggacttcattaatcttaaacagcgggatcccagactgaatgagatcctgtatccacccctgaaacaggaacaggtccaagttctgattgaaaagtatgagccaaataatagcctggccagaaagggccagatctctgtagatggttttatgagatacctatcaggggaggagaacggggtcgtctcaccagaaaagctggatttaaatgaggacatgagccaaccattatctcactattttatcaattccagtcataacacttatctgactgcgggtcagttagccggaaactcttctgtggagatgtatagacaagtcctcctgtcagggtgtcggtgtgtggaactggactgttggaagggaaggaccgccgaggaggagcccgtgatcacacacggcttcacaatgaccaccgagatcagcttcaaagaggtgatcgaagctattgctgaatgcgcttttaagactagcccgtttcccatcttgctcagcttcgagaaccatgtggacagtccgaagcagcaggcaaagatggctgagtactgtagactcatcttcggcgacgcacttttgatggaaccactcgaaaagtacccacttgaaagcggggtgcctctcccctctcctatggatttaatgtacaagatactcgtgaagaacaagaagaaatcccataagagcagtgagggcagcggaaagaagaaactgtcagagcaggcaagcaatacatactcagactcttcctctatgttcgaaccttcatcaccgggtgccggagaggccgacactgaatcagacgacgatgacgatgatgacgattgcaagaaatcaagtatggacgaaggcaccgctggatctgaggccatggcaacagaggaaatgagtaacctggtgaattatattcagcccgtgaaatttgaatcctttgagatcagtaagaaacgtaataaatctttcgagatgtcaagcttcgtggaaactaagggactcgaacagctaaccaaaagccctgtggagttcgtcgagtataataagatgcagctgagccgtatctaccccaaaggcactagggtggacagttccaattacatgccacaacttttttggaatgctgggtgtcagatggtggcccttaatttccagacgatggacctagctatgcaaatcaatatgggtatgtatgagtacaacggcaagtcagggtaccgattaaagccggagttcatgcgcaggcccgacaaacatttcgatccgtttacagagggcattgtcgacggcattgttgctaatacccttagcgttaagattatttctgggcagttcctcagcgacaagaaggtgggtacctacgtagaagtggatatgtttgggctgccagtcgatacaaggaggaaggcctttaagacgaagacctctcaaggcaatgcggttaatcccgtttgggaagaagagcctattgtattcaagaaggtagtgctccccacgctggcttgcctgaggatcgccgtctacgaagagggtggcaaattcatcggccatagaatcctgcccgttcaggcgattcgacctggataccattacatctgtctccgaaacgagagaaatcagcccctcaccctgcccgcagttttcgtctatatcgaagtaaaagattacgttccagacacatacgcagatgtcatcgaggctctcagcaaccctatcagatacgtgaaccttatggagcagagggccaagcagctagcagccctcactttggaggacgaggaggaagtcaagaaagaggccgatcctggggagaccccttctgaagctccttcagaagccaggaccacacccgctgaaaacggagtgaaccacaccaccacacttactccaaagccacctagtcaggccctgcactctcagccagccccaggatccgtgaaggccccagccaagactgaggacttgatccaaagtgtgttaaccgaggttgaagcacagaccattgaggagctgaaacagcagaagtctttcgtcaaattacagaagaaacattacaaggagatgaaggacctggtgaaacgacaccataagaagacgacagacttaattaaggagcacactaccaaatataatgagatacagaatgattacctgagacgcagggcggctttggagaagtcggcaaagaaagactcgaagaagaagagcgagccctccagtcccgaccacggaagttccacaatagagcaggacctcgctgctctcgatgcagagatgactcaaaaattgatcgatttgaaggacaaacagcagcagcaactgttaaatctgcgccaagagcagtattactccgaaaaataccagaaaagggagcacattaaactcttgatccagaagctaactgacgtcgcagaggaatgccagaacaatcagcttaagaagctgaaagaaatctgcgagaaggaaaaaaaggagctgaaaaaaaagatggacaagaaaagacaggagaaaatcacagaggcaaagagtaaggacaaaagtcagatggaggaggaaaaaactgaaatgatccggtcttacattcaggaagtggtacagtacataaaacggctcgaggaagcccagtccaaacgccaggaaaagctggtggagaagcacaaggaaataaggcagcagatcttggatgagaaacccaaaggtgaaggtagtagtagttttctcagcgagacatgccatgaagatccatccgtctcacccaattttacgccgccaaatccgcaggctcttaagtggtag

SEQ ID NO: 234888 - DNA, 3522 bp, Artificial Sequence
  Description of Artificial Sequence: Synthetic coding sequence
atggccggagcccagccgggtgtacatgcactccagttgaaaccagtgtgcgtctctgactctctgaaaaaaggaacgaaattcgtcaagtgggacgatgacagtactattgtgacgccaatcattctgagaaccgatccacagggtttcttcttctattggacggatcagaacaaggaaacagagctcctggatctgagtctcgtgaaagacgcacgctgcggacggcatgctaaggcccctaaggatccaaaactccgtgagctgctagacgtgggaaatattggaaggctcgagcagcgtatgattacggttgtgtacggcccagacttggtaaacatctcccatctcaatcttgtcgctttccaggaagaggtcgccaaagaatggacgaatgaggttttctcactggctactaatctattggcccagaacatgagccgggatgcatttctcgaaaaggcttatacaaagctcaaactccaggtgacccctgagggcagaatacccctcaaaaacatctatcggctgttttccgcagatagaaagcgggtggaaacagcccttgaggcttgttcactgccttccagtcgaaatgatagcatccctcaagaggacttcacccccgaggtgtatagggtgtttttaaacaatctgtgcccgaggcccgagattgataatattttttcagagtttggggctaagtccaagccctacttgacggttgaccagatgatggattttatcaacctgaagcagcgtgacccccgtctcaacgaaatcctttatcctccacttaagcaagagcaagttcaggtcctgattgaaaaatatgagccaaacaactctttggccagaaaaggccagatttcagtggatggctttatgcgctatctgtcaggcgaagagaacggagttgtgtctcctgaaaaactggacctcaatgaagatatgagccaacccttatcccattatttcatcaactcctcccacaacacatatctcaccgcaggtcagttagccggtaacagcagcgtggaaatgtataggcaagtacttttatctggctgtcgctgcgtggagctggattgctggaaagggaggaccgcagaggaggaacctgtgattacacatgggtttaccatgaccaccgagatcagcttcaaggaggttatcgaggcgatcgctgaatgcgccttcaaaaccagcccatttccgatcctcctgagctttgaaaaccatgtggactctcctaaacaacaggccaaaatggctgagtactgcagactaatcttcggcgatgcactgctgatggaaccacttgaaaaatatcctctcgaatctggcgttccattacctagccccatggacttgatgtataaaatcctggttaaaaacaagaaaaagagccacaaatcgtcagaaggttccggcaaaaagaagctcagcgaacaggctagtaacacctacagcgactccagttcaatgttcgaaccgtcctctcccggagcgggtgaagcagacacggagtccgacgacgatgatgatgatgatgattgcaagaaatcgtccatggatgagggaacagcaggttcagaggccatggccacagaggagatgtccaaccttgtaaattatatacagcctgtgaagttcgagagctttgagatcagtaagaagcgcaataaaagtttcgaaatgtcttccttcgttgaaactaagggcttagagcagctgaccaagtcacctgtggagttcgttgagtacaacaaaatgcagctctctcggatctatcctaaaggaacccgtgtcgattccagtaactatatgccccagctgttctggaacgccggttgccagatggtggcactcaacttccagacaatggatctggctatgcagattaacatgggtatgtatgaatacaacggcaaatctggctaccgcctgaagcccgaattcatgcgcaggccagacaagcacttcgatcccttcacagagggcatcgtggacgggattgtggctaacacactctcagtcaaaattatctctgggcaattcctgtccgataagaaggttggcacttacgttgaggtcgacatgtttgggcttcccgttgacacaagaagaaaagccttcaaaaccaagacctcccagggtaacgccgtgaacccggtctgggaggaggaaccaattgtcttcaaaaaggtcgtgttgcccaccctggcttgtctcagaatagccgtatatgaagaggggggaaaattcatcggtcatcggatactcccagtgcaggcaattaggccagggtaccattatatctgcctgcggaacgaacgcaaccaaccattgacattaccggcagtgttcgtgtacatcgaagtgaaagactacgtccctgatacttatgctgatgttatcgaagcgctttctaacccgatccggtacgtgaatttgatggagcagcgggcaaaacaactagccgctctgaccctcgaggacgaggaggaagtcaagaaagaagcagaccctggcgagaccccatcagaggccccttccgaggctcgtaccaccccagccgaaaatggcgtgaaccacacaaccactcttacccctaagccaccttcccaggcactgcattcacagccagctcccggatctgtgaaggcaccagcaaaaaccgaggatctgatacagagtgtgttgacagaggtcgaagcccagaccatcgaggaacttaagcagcagaagtcttttgtgaagcttcaaaagaaacactacaaagagatgaaggatcttgttaaacgtcatcacaaaaaaaccactgacctaatcaaggagcataccaccaagtacaacgagatccagaatgactacttgcggagaagggcggcactcgagaagagcgctaagaaggacagcaaaaaaaagagcgagccttcctccccggaccacgggtcgtcaaccatagaacaggacctggctgctctggatgcagaaatgacccaaaagctgatcgacctcaaagataaacagcagcagcaattgctcaacttaagacaggagcagtactattctgaaaaataccaaaaacgggagcatataaaactccttatccagaagctgactgacgtcgcagaggagtgccagaataatcaactgaaaaagctcaaagagatttgcgaaaaggagaaaaaggagttgaaaaagaaaatggataagaaaagacaagaaaagatcaccgaggccaaatctaaagacaagtctcaaatggaggaggaaaaaacagagatgattcgcagttacatccaagaggtcgtgcagtatattaagagattggaggaggcccagagcaaacgccaagagaagctggtagaaaagcataaggagattcgccagcagatcttggacgagaagccgaaaggtgaaggatcgagcagctttctgtcagagacttgtcatgaagatccatcagttagtcccaatttcacaccccctaaccctcaggccctgaagtggtag

SEQ ID NO: 234889 - DNA, 699 bp, Artificial Sequence
  Description of Artificial Sequence: Synthetic coding sequence
gcaggagcccagccaggtgtgcacgcccttcagttgaagcctgtgtgcgttagcgattctcttaaaaaaggaaccaagttcgtcaagtgggacgacgatagtaccattgttacccctatcatcctccgcaccgacccccaagggttcttcttctattggaccgaccagaataaggaaactgagctacttgatctcagtctggtgaaagatgctagatgcgggaggcacgcgaaggcccctaaggatccgaaactccgggagctattagacgtgggcaatattgggaggctggagcagaggatgattaccgttgtatatggcccagatctggtaaacatctcacacctgaatttggtagcattccaggaagaggtggccaaagagtggactaacgaggtgttttctctcgcgactaatcttttagcacaaaatatgagtcgtgacgcgttcctcgagaaggcttatacaaagctaaaacttcaagtaaccccagaagggaggattcctctaaaaaatatctatagactgttcagtgccgataggaaacgtgtcgaaactgcactcgaggcatgtagcctgccatcttcgagagtggagaaggccaatgaggctgccaaatcagagcagtcctgcggtaaagcccctccaaaacactttcatctgcacttcattaaacagaataagatgttagaaccctag

SEQ ID NO: 234890 - DNA, 93 bp, Artificial Sequence
  Description of Artificial Sequence: Synthetic coding sequence
gaggaagcgcagagcaagcgccaggaaaaactcgtcgaaaaacacaaagagatccggcagcagatactggacgaaaaacccaaagtcccgtag

SEQ ID NO: 234891 - DNA, 591 bp, Artificial Sequence
  Description of Artificial Sequence: Synthetic coding sequence
attatctccggtcagttcctctctgataaaaaggtgggaacgtatgtcgaggtcgatatgttcggcctcccagtggacacccgtaggaaagcttttaaaacgaagacatcacaaggaaatgcggtcaaccctgtctgggaagaggagcccatcgtcttcaagaaggtggtccttcccactctggcttgcctacgcatcgcagtgtacgaggaaggcggaaagttcattggtcatcgcattctgcctgttcaggccatccggccaggttaccattacatatgcctcaggaatgagcggaatcagccgttaacgctgccagcagttttcgtttatatcgaggttaaagattacgttccagatacttacgctgatgtaatcgaagctttaagcaatcccattcgttatgtgaatctgatggaacagcgtgcaaaacagctggctgctctaacactggaggacgaggaagaagtgaagaaagaggggggattcctgcacgacgagatcatgcggttgacaagaaacaccctggagaaactcatggccctgcctcttacccatgtggtaccaattcagtccaagatgctttcatag

SEQ ID NO: 234892 - DNA, 3411 bp, Artificial Sequence
  Description of Artificial Sequence: Synthetic coding sequence
acccaggatccaaaacttcgggagcttctagatgtgggaaacattggacgcctggagcagagaatgatcaccgttgtatacggacctgacttggtaaacatttcacaccttaacctcgttgccttccaggaagaagttgcaaaggagtggactaacgaggtattttccctcgccacaaacctgcttgcccagaacatgtcacgcgatgccttcctcgaaaaggcctataccaagctcaaactccaggtgactcctgagggcaggattcccctcaagaatatctaccgtctattttctgcggataggaaaagggtggaaaccgcactggaagcttgcagtctgcccagctccaggaacgactccatccctcaggaggactttacacccgaggtgtatagagtgtttctgaacaatctctgccccaggccagagattgacaacatcttttctgagtttggcgcaaagtcaaagccctatctgacagtcgatcagatgatggattttatcaatctcaaacaaagagatcctagactgaacgagattctgtatccgcctctaaagcaagagcaagtgcaagtgctgattgaaaaatatgagcccaacaactctctggccaggaaaggacagatctccgtggacgggttcatgagatatctatccggcgaggaaaatggtgtggtttctccagagaagctggacctgaatgaagatatgtcccaaccattaagccactactttatcaacagctcacataacacgtacttgacggccggacagttggctgggaactcatcagtggagatgtaccgccaagtgctattgagcggttgtcgctgcgtggagctggattgctggaagggtagaaccgctgaggaagagcctgtgattacacatggcttcaccatgaccacagaaatcagctttaaggaggtgattgaggcgatagccgagtgcgcattcaagacttcccccttcccgatcctattgagcttcgaaaaccacgtggattcacccaagcagcaagcgaagatggctgagtactgccgactgattttcggagatgctttactcatggagcctctggaaaagtatcctctggagtcaggggtgccattgccttcgcccatggacctgatgtacaaaatccttgtgaaaaacaagaaaaaatcccacaaatcatctgaaggcagcggtaagaagaaactgagtgaacaagcctctaacacatacagtgactcatcaagcatgtttgaacctagctctcccggagccggtgaggccgacacggaatcagacgacgacgatgacgatgatgactgtaagaaaagctcgatggatgaaggaaccgccggttcggaagcaatggcaacagaggagatgagcaatctggtgaattacatccagccggtgaagtttgagtcctttgaaatcagtaagaagcgcaacaagagcttcgagatgagcagcttcgtggagacaaagggcttagaacagctgaccaagtctccggtcgagtttgtggagtataacaagatgcagctgtcgcgcatatatccaaaaggcacccgcgtggactcctcaaattacatgccacagctattttggaacgcaggctgtcaaatggtcgctttgaatttccaaactatggatctcgccatgcagatcaatatggggatgtacgagtacaacggcaagagcggctatagattaaaaccggagtttatgcgtaggcctgacaagcatttcgatcctttcactgaggggattgttgatggaatagtggccaatacattgagtgtgaaaataattagtggacaattcctgtcggataagaaagtcggcacctacgtcgaggtcgatatgtttggcctgcctgttgataccaggcgcaaggctttcaaaaccaagaccagtcagggcaacgccgtcaatccggtgtgggaggaagagcctattgtctttaagaaggtggtgctgccaacactggcttgtctgcgcatcgccgtctatgaggagggaggcaaatttatcggacatcgcattcttcccgttcaggctatcaggccgggatatcattacatctgtctgcgaaacgaaagaaaccaacccctcacactccccgctgtgttcgtttatatcgaggtgaaggattatgtacccgatacctacgcagacgtgatagaagccctgtcgaaccccattcgatatgtcaatctcatggaacagcgcgctaagcaattagcagccctgaccctggaggatgaagaagaggtgaagaaagaagcagatccgggtgaaaccccatcagaagccccttctgaggcgaggaccacccccgctgagaacggggtgaaccacaccactactctcaccccaaagcctccatcacaagcactgcattcccagcccgctcctggttccgtgaaggctcctgctaaaacagaggatttgatccagtccgttcttacggaagtcgaagcccagactatagaagaactgaagcaacaaaaaagctttgtgaagctgcagaagaaacattacaaagaaatgaaggacctggtcaagagacaccacaaaaaaacaacggacctcattaaggagcatactacaaagtataatgagatccagaacgactatcttcgcagacgcgcagcgctcgagaagagcgccaagaaagattccaagaaaaagagcgaaccatcttcccctgatcacggctcttctacgattgaacaagacctggctgcgctagatgctgagatgacacagaagttaatcgacttaaaggataagcagcaacaacagcttcttaatttgcggcaagagcagtattattcagagaagtaccagaaacgggagcacatcaaactgctaatccagaagctgaccgatgtcgccgaggagtgtcaaaataaccagctcaagaaactgaaagagatctgcgagaaagagaagaaggaattgaaaaagaagatggataaaaagaggcaggaaaaaatcactgaagctaagtccaaggacaaatcccagatggaggaggagaagacagaaatgatcagatcttacatacaggaggtggttcagtatatcaaaaggctcgaagaggcgcaatccaagcggcaggaaaagctcgttgagaaacacaaggaaattaggcaacagattttagatgaaaaacctaagttgcaggttgagttagagcaggagtatcaggacaagtttaagagacttcctcttgaaatactagagtttgtgcaggaagctatgaaggggaaaatttcggaggattcaaaccatggatccgctccactctctctgtctagcgatcccggaaaagtgaaccacaaaacacccagctcggaggaactgggtggtgacatcccgggaaaagagttcgacactcccctctag

SEQ ID NO: 234893 - DNA, 3282 bp, Artificial Sequence
  Description of Artificial Sequence: Synthetic coding sequence
acacaggaccctaagcttagagaattgctggatgtgggaaatataggacggttggagcagagaatgattacagttgtatatgggcctgatctcgtaaatatttctcacctcaacttagtcgcattccaggaagaggtggccaaagagtggacaaatgaggtgttctcattggccacaaatctcctggctcagaacatgtccagggatgcttttctagagaaggcctatactaaactgaaattgcaggtgactcccgagggcaggattcctttgaaaaatatctataggctgttcagcgccgacagaaagcgagtagagactgccctagaagcctgttcactgcccagctctcgtaacgactctattccacaggaggattttacccctgaagtgtaccgtgtgtttcttaataacctgtgtcctaggcccgagatcgacaatatcttctcagagttcggcgcaaagagcaagccgtatctgacagtcgaccagatgatggacttcatcaacctgaagcagagagatcccaggttgaatgaaatcctctacccgcctctgaagcaagaacaggtgcaagtcctgattgagaagtatgaaccaaataattcactggccaggaaaggccagatcagtgtggatggtttcatgaggtacctcagcggggaggaaaatggcgttgtgtcccctgagaaactggatttgaacgaggatatgtcccagcctctgtctcactattttattaactcctcgcataacacctaccttactgcagggcagttagccggaaactcctctgtagaaatgtatagacaagttctgctctccggttgcaggtgcgtggagctggattgttggaagggacgcacagccgaagaggagccagttataacccatgggtttactatgacaaccgaaatatctttcaaggaagtaatcgaagcaattgctgaatgtgctttcaaaacgagcccatttcccatcctgctctcttttgaaaatcacgtcgacagccctaaacagcaagccaagatggccgaatattgtaggttaatctttggcgacgcacttttgatggagccacttgagaagtatcccctggagtcaggcgtgccgttgccctctcccatggatctcatgtataaaatccttgtgaagaacaaaaagaagtcccataagagtagcgaaggaagcgggaagaagaaactctcggaacaggcctctaatacgtacagcgactcttcctccatgttcgagccaagttcacccggtgctggcgaagctgataccgagtccgacgacgatgacgatgatgacgattgtaagaaatcatcgatggacgaagggactgccggatctgaggcaatggccaccgaggaaatgtccaacctggtgaattatatacaaccggtaaagtttgagtccttcgagatctctaagaagaggaataaaagttttgaaatgtccagttttgtagagaccaaaggactagagcagctgactaagtctcctgtggaattcgtagaatacaataagatgcaacttagcagaatttatcccaagggaacgagggtggattcctctaactatatgccccagctcttctggaatgccggatgtcaaatggtcgccttaaattttcagaccatggacctggcaatgcagatcaatatgggcatgtacgagtacaacggaaagagcgggtaccgcctgaagcctgagtttatgagacggccagataagcattttgacccctttactgaggggattgtcgacggcatcgttgccaacacactgtctgtcaaaattatctccggtcaattcctgtccgataagaaggtggggacttatgtggaggtggatatgtttggcctgccggtcgacacaaggcggaaggcttttaagactaaaaccagtcaggggaacgctgtaaatcctgtttgggaggaagagccaattgtgtttaaaaaagtcgtgctgccaaccctggcctgtttacggattgcagtgtacgaggagggcggaaagtttattggccaccgcatcctacccgtccaagccattcggcctgggtatcactatatatgtcttcgaaacgagcgtaatcaaccgctgaccctccctgcagtatttgtgtacatcgaagtcaaggactatgtgcctgacacttatgctgacgtgatcgaagcactgagcaaccctatcaggtacgtgaatctaatggagcagcgcgctaaacaactagccgcattaacattggaggacgaggaagaggtcaagaaggaagcggaccctggtgaaactccgtccgaagctccttccgaagccagaacgacccccgctgagaatggggtaaaccacaccacaacactgacccctaaaccaccttcccaggccctgcacagtcagccagccccagggtccgtcaaggcacccgctaaaacagaggatctgatccaatccgtgctgacagaggtggaggcgcagaccatcgaggagctgaagcagcagaagagcttcgttaaactacaaaagaagcactataaggagatgaaggatttggtgaagcggcatcataagaaaactacggacctcatcaaggagcatactaccaagtacaatgagatccagaatgattatctgcgcagaagggcagccctagaaaaatctgctaaaaaagactctaagaagaagagcgagccttcctctcctgatcatggatcaagcaccattgagcaggacctcgccgcactggacgccgaaatgacccagaagctcatcgacttaaaggataagcagcagcaacagctgctcaatttacggcaagagcagtattattcagagaagtatcagaagcgggagcacatcaaactcctcattcagaaactcaccgacgtggcggaagaatgtcagaataaccagcttaaaaagctaaaggaaatttgcgagaaagagaaaaaggagctaaagaaaaagatggacaagaaacgacaggaaaagattacggaggcaaagtccaaggataaaagtcaaatggaagaagaaaagacagaaatgataaggtcctatatccaggaggttgtgcagtacattaagaggctggaagaggcacaatcaaagaggcaggagaagctggttgaaaaacataaggagattcgccaacagattcttgacgaaaagccgaagggtgaaggtagtagcagcttcttgtctgagacgtgtcacgaggacccctccgtcagtcccaacttcactccccctaatcctcaagccctgaagtggtag

SEQ ID NO: 234894 - DNA, 3558 bp, Artificial Sequence
  Description of Artificial Sequence: Synthetic coding sequence
atgtctctactaaatcctgttctgctgccgccaaaggtgaaagcttacctatctcagggggaacgcttcattaaatgggatgacgagaccacggtcgccagcccggtaatcctgagggtggatcctaagggttactatttgtactggacatatcagagcaaagagatggaatttctggatattacaagtataagagatacccgattcggcaaattcgctaagatgccgaagtcccagaagctacgagacgtctttaacatggacttcccagataatagctttctgttgaagacattgacagtggtgtccggacccgacatggttgacctaacgttccacaactttgtgtcttataaggagaatgtaggcaaagcttgggcagaggatgtgttggcccttgtgaagcaccctctaaccgccaacgctagcaggtccacctttctggacaagattttggtgaagctgaaaatgcagctcaactcggaggggaagatccccgtgaagaatttttttcaaatgttccccgcagacagaaaacgggttgaggcagccctaagtgcgtgtcacctgccaaaaggcaaaaatgacgcgataaacccggaggactttccggagcctgtgtataaaagctttctcatgtctctatgcccaagaccagagatcgacgaaatctttacctcttatcacgctaaggcaaaaccatatatgaccaaggaacatttgacgaaatttattaatcagaagcagagggattccagactgaattcccttctgttcccacccgctagaccagaccaggtccagggcctgattgacaaatacgagccatccggtattaatgcacaacgcggacaactgtcccccgaaggcatggtatggtttctttgcggcccagagaacagcgtgcttgctcaggacaaactcctcctccatcacgacatgacccagcctctaaatcactattttataaattcttcacacaacacatacttgaccgcgggtcagtttagcggactgtcctctgcagagatgtaccgacaagtgctcctttccgggtgcaggtgtgtggagctcgattgctggaaaggcaaacccccagacgaagagccaatcatcactcacggattcaccatgactactgacattttctttaaagaggcaatcgaagcgattgccgagagcgcatttaagacatccccttacccaatcattctcagcttcgaaaaccacgtagactcccccaggcagcaggcgaagatggccgagtactgtcgcacgatcttcggcgacatgctgctgactgagcctctggagaagttccccctcaagccgggtgttccattgcctagtcccgaagaccttagaggcaaaatcctcattaaaaacaagaaaaaccagtttagcggcccaaccagttcttcaaaagacacaggcggagaagcagaaggctctagcccccctagcgccccagcaggagaaggaactgtgtgggcaggagaagaggggaccgagctggaggaggaggaggttgaggaagaggaggaagaggagtcaggcaatctggatgaagaggaaattaagaaaatgcagtccgacgagggcacagcgggactggaggtgaccgcctatgaggagatgtccagccttgtgaattacattcagccgaccaagtttgtgagtttcgaatttagtgcacaaaaaaacagaagctacgtcatttcttcatttactgagttaaaggcctacgatctgcttagcaaagccagcgtgcaattcgtagattacaacaaacggcaaatgagtcggatatatccaaaagggacgaggatggactcgtcaaattacatgccacagatgttctggaacgcaggttgtcagatggtggccctgaacttccaaacaatggatctgcccatgcagcagaacatggcagtattcgagttcaatgggcaatctggctatctcctcaagcacgagttcatgcgcaggcctgacaaacagttcaaccctttctcagtggatagaatcgacgttgtggtggcaacgactctatcaatcaccgtcatctctggccagttcctttctgagaggtccgtgaggacatatgtagaggtggagctgttcggtctcccgggtgacccaaagagacggtataggacaaagctcagccctagcactaattccatcaaccctgtatggaaagaggagccgtttgtcttcgaaaagatcctgatgcctgagttagcgagccttcgcgtcgctgtgatggaggaaggcaacaagtttctggggcaccggatcatacctattaacgccctgaactcagggtatcatcatctgtgtctacactcagagagcaacatgccgctgaccatgcccgcactgtttatttttctggagatgaaagattacatcccgggtgcgtgggccgacctgacagtcgctctggccaatcctataaagtttttctccgcgcacgatacgaagagtgtcaagttaaaggaagcgatggggggtcttcctgaaaagccttttcccctggcatcacctgtggcctcacaagtgaacggcgctttagcccctactagcaacggcagccccgcagctcgcgctggcgctcgggaggaagccatgaaggaggcagcggagccacgaacagcaagcctcgaggaactgagggaactaaagggagtcgtaaaactacagcgtcggcatgaaaaagaattgagggagcttgagcggagaggcgctcggaggtgggaggagctactccagaggggcgctgcacagctggcggagttagggccacctggggtcggcggtgtgggcgcttgtaagttaggtccagggaagggctctagaaagaagagatctctgcctcgggaggaaagcgcaggagcagcgcctggggaggggccagagggcgtcgatgggagggtgcgagaattaaaagacaggcttgaactggagctgctccggcaaggggaggaacaatacgaatgtgtgttgaagagaaaggagcagcacgtcgccgaacagatctccaagatgatggagcttgcaagggaaaaacaggccgcagaactgaaggccctgaaagaaacatcagagaacgatacgaaggaaatgaagaagaagcttgagaccaaacggctcgaacggatacagggtatgacaaaggtaacgacagacaaaatggcccaggaaagactgaaacgcgagataaacaactcccacattcaggaagtcgtacaggttataaagcaaatgaccgagaacctcgaacgacatcaggagaagctggaggagaagcaggcagcctgcctggaacaaataagagagatggagaagcagttccagaaggaggccctcgctgagtatgaggctagaatgaagggactggaagccgaagtgaaagaaagtgtgcgcgcatgtctgcgaacatgtttcccaagcgaagccaaggacaagccagagcgggcttgcgagtgtcctcccgaattatgcgaacaagatccgctgattgcgaaggcagacgcacaggagtccaggctgtag

SEQ ID NO: 234895 - DNA, 3546 bp, Artificial Sequence
  Description of Artificial Sequence: Synthetic coding sequence
atgagcctcctcaaccctgtgttacttccacccaaggtgaaagcttatttgtctcagggggagagatttatcaagtgggacgatgagactacagtagcctcccctgtgatcctccgcgtcgaccctaaaggctattacctctattggacgtaccagtcaaaagaaatggagtttcttgatataactagcatcagagacactcgattcgggaagtttgcaaagatgccaaagtctcaaaaactgcgggatgtgttcaatatggactttccagataactcttttttgctcaagacacttaccgtagttagcggtcccgatatggtcgatctgacatttcataatttcgtgagctacaaagagaatgtcgggaaagcttgggctgaagatgttctggcccttgttaagcacccactcacggcaaatgcttctagaagcacatttttggacaaaatattggtgaagttgaaaatgcagcttaattctgaagggaaaatcccagtgaaaaatttcttccagatgtttcctgcagaccgcaagcgggtggaagccgcattgtctgcatgtcacctgcccaaaggaaaaaacgacgctattaatcccgaggacttcccggagcccgtctataagagcttcctcatgagcttgtgcccacggccagagattgacgagatctttacaagctatcacgctaaagccaagccctatatgacaaaagaacatctgacgaagttcattaaccagaagcagcgggattcacgtctaaactcccttctgttccctccagcgaggcccgaccaagtccagggcctgattgataaatacgaaccttctggtataaatgctcagcgcggacagttatcacccgaggggatggtctggttcctgtgcggaccagaaaacagcgtcctcgctcaggacaagctgttgctgcaccacgatatgacgcagccgctgaatcactacttcataaactctagtcacaatacttacctcaccgccggtcagttttccggcctgtcgagcgccgaaatgtatcggcaagtgctactgtctggctgtcgatgcgtagaactggattgctggaaaggtaagccacccgacgaagaaccaattattacccacggcttcacaatgactaccgacatttttttcaaggaggctatagaggccatcgcagagtcagcctttaagacatccccgtatccaatcatcctatccttcgaaaaccacgtggattctccaaggcagcaagccaagatggccgagtattgtaggactatttttggagatatgcttctcactgagcccctggaaaaattcccccttaagccaggtgtgcctctgcctagcccggaggacctgagaggcaaaatcctgatcaagaataagaagaaccaatttagcggtccaaccagctcctcaaaagatacaggtggcgaggccgaggggagctctcccccatctgccccagcggtatgggccggtgaggaaggaaccgagctcgaagaagaagaggtggaggaggaggaggaagaggaaagcggcaatctggatgaagaggaaattaagaaaatgcagagtgacgaaggcaccgccggtctcgaggtgacagcttatgaagagatgtcctccctcgtgaactacatacaacccacaaaattcgtctcatttgaattctccgcccagaagaacagatcctacgtgatctcaagttttacagaacttaaagcctacgaccttttatccaaggcctcggtgcagttcgtagattacaataagcggcagatgagccggatttatccaaaaggaacaagaatggattcttccaattacatgccccaaatgttttggaacgccggttgtcagatggtagcacttaattttcagacaatggaccttcctatgcagcagaatatggcggtgttcgaattcaatgggcagagcggatacttgttaaagcacgaattcatgcggaggccagataagcagtttaacccattcagcgtagacagaatagacgtagtcgttgctactaccttgtccatcaccgtaatctctggacagttcttgagtgaacgttccgttcgaacatatgtagaggtggaactgtttgggttgccgggtgatccaaaacgaagatataggacaaagctgtccccttctaccaatagtattaaccccgtgtggaaagaggagcctttcgtcttcgagaagattttaatgccggaactcgctagcctgagagttgccgttatggaggagggcaataagttcttgggacaccggatcattccaattaacgccctgaacagcggataccaccatctgtgtctacattcagagtctaacatgccactgaccatgcccgcactgtttatcttcctcgaaatgaaggattatatacctggggcttgggccgacctgactgtggctcttgcaaatcccatcaaattcttctccgcgcacgatactaaatccgtgaagctgaaggaggccatgggaggattgccagaaaagcctttcccactagccagcccagtagcttctcaagttaacggagcacttgctcctacatctaacgggagccccgctgctcgggcaggcgctagggaggaagcgatgaaggaagccgcagagcccagaaccgcatctctcgaagaactgagagagttaaaaggggtggtgaaactccaaagacgccacgagaaagaacttcgggaactggaaaggagaggggctagacgttgggaggagctcctacagagaggtgcggctcagctcgctgaattgggtccacccggagtgggaggtgtaggcgcttgtaagctagggccaggtaaagggtcccgaaagaagcgatctctccccagagaagagagtgccggagcggctcccggtgagggccctgaaggggtcgacggtagagtgcgcgaactgaaggatcgtcttgagcttgagctcctgaggcagggtgaggagcagtacgaatgtgtgctgaagagaaaagagcagcacgtggcggagcagataagcaaaatgatggaacttgctcgagaaaagcaagctgccgagttaaaagccctgaaagaaacgtctgagaatgacaccaaggagatgaagaaaaaactggagaccaagcgcctggaacggatccagggaatgactaaagttaccaccgacaaaatggctcaagagcggctgaagcgcgagataaacaatagccacattcaggaggtcgtgcaggttattaagcagatgaccgaaaatttagaacgccaccaggagaagctggaagagaagcaggccgcttgtctggaacaaatcagggagatggagaagcagttccagaaggaggcattggctgagtacgaggctcgtatgaagggacttgaggcagaagtgaaagagtctgtcagagcctgccttaggacttgcttccccagtgaggccaaggataagcctgagcgcgcttgtgagtgccccccagagctgtgcgagcaggaccccctgatagcaaaagccgatgcacaagaatcacggttgtag

SEQ ID NO: 234896 - DNA, 3705 bp, Artificial Sequence
  Description of Artificial Sequence: Synthetic coding sequence
atggccggagctcagccaggtgtccatgctctccaactggaaccccctaccgttgtagagaccctgagaaggggatccaagttcatcaagtgggatgaggagacctcgtcgcgcaatcttgtgacattacgtgtcgacccaaacggtttcttcctgtattggacgggaccgaacatggaggttgataccctggatatcagttccatccgagacactcggacaggcaggtacgcaaggctacctaaagaccctaagatccgggaggtgctaggcttcggcggaccagatgcacgacttgaggagaagctcatgacagtcgtgtccggccctgatcctgtgaatactgtgtttttaaactttatggcggtgcaggatgacactgccaaggtgtggagcgaggagctattcaagttggctatgaacattctggcccaaaatgcttccagaaacacatttctgcggaaagcttacacaaaactgaagctacaggtcaatcaagacggcagaatccccgtgaagaatattttgaaaatgttcagcgcagataagaaacgagtggagacagccctcgaaagctgcgggctcaaattcaatagaagcgagagcattagaccagacgaattctccttggaaatttttgaacgcttcctgaacaaattatgcttacggcctgacatcgataagatcttactcgagattggtgccaagggtaagccctatctcactctcgaacagttgatggattttatcaaccagaagcaacgcgatcccagactcaacgaagtgctgtaccctcctctgcgcccttctcaggcacggctactcatcgagaaatatgaacctaaccaacagttccttgagagggaccagatgtcgatggagggtttttcccggtatttggggggagaggagaatggaattctgcctctcgaggcactggatctctctactgacatgacccagccgctatcagcttacttcataaattctagtcataatacatacttgacggccggacagctggccggaaccagcagcgttgaaatgtaccgacaagcgctgctctgggggtgcagatgcgttgaactagatgtgtggaagggtagacctccggaagaagagccttttatcactcacgggtttaccatgacgacagaggtcccgctgcgtgatgtgctggaggcaattgcagaaactgcctttaaaacctctccctatcccgttattctctccttcgagaaccacgtggacagcgcaaaacagcaggcaaagatggcggaatactgcagatccatttttggtgatgcacttcttatagaaccattggataaatatcccctggcaccaggggtccccctgccctcgccacaggacctcatgggaaggatcctggttaaaaacaaaaagcgacatcggccatctgctgggggtcccgactcagccggtaggaagagaccacttgagcaaagcaatagcgcgctttcggaaagctcagcggctacggagccaagttcccctcaactgggttctccaagctcagatagctgtccaggactgagtaatggggaggaagttgggctggagaaaccgagtttggagccccagaagagcttgggtgacgagggattaaacagaggaccatacgtcctaggacctgctgatcgcgaagatgaggaggaggatgaggaggaagaagagcagaccgaccctaaaaaacccaccaccgatgagggtacagctagctctgaagttaacgctaccgaagagatgagcaccctggtgaactatatagagcccgtaaagttcaagtccttcgaagccgctcgcaagcgcaataagtgttttgaaatgagctccttcgtggagactaaggccatggaacagttgactaagtctccgatggagtttgtggagtataataaacagcagctgtcccgaatctacccaaagggaacaagagtagactcatcgaattatatgccgcaactgttctggaacgtgggctgtcagttagtggcactgaacttccagacactggacgtggcgatgcagcttaacgccggagtcttcgaatataatgggaggtcaggctatctgctgaaacccgaatttatgcgcaggccagacaagagctttgatcccttcactgaggtcatagtggatggcatcgtagccaacgcgctccgggtgaaagtgataagtggccaattcctgtctgatcgcaaggtaggaatctacgttgaggtggacatgttcgggctgcccgtcgacaccaggcgcaaatatcggactcggacatcccaaggtaacagctttaacccagtctgggacgaagagcccttcgatttccccaaagtggtgctgcctactctcgctagcctaaggatagcagcttttgaagagggtggtaagtttgtgggccatagaatcctgcccgtcagcgctatccggagcggctatcactacgtctgtttaagaaacgaggcgaatcagcccctgtgcctgccagcactcctcatctataccgaagctagcgattacatccccgacgaccaccaggattatgccgaagccctaatcaatcccattaagcacgtgtctttgatggatcagcgagcaaggcagctcgccgctttgatcggagagtccgaagcacaagcgggacaggagacctgccaagacactcaatcccagcagctcggcagccagccgagctctaatcccacccccagtcctctggacgcaagtccacgcagacctcctggtccaactacgagccccgcatctacgagcctgtcaagtcccggacagagggacgatcttatcgcttcaatactctctgaagtcgccccaacaccacttgatgagctccgcggtcacaaggcgctcgtgaaactccggagtcggcaagaacgggatctgagggaactgaggaagaagcaccagaggaaggctgtgaccctcacaagaagactgcttgacggcctagcacaagctcaggctgagggtagatgtcggctgcgacctggcgctctcgggggagcagccgatgtcgaggatactaaagaaggagaagacgaagccaagaggtaccaggaatttcagaacagacaggtccagtcgcttctcgagctccgtgaggcccaggtggacgcagaggctcaaaggagactggagcatcttaggcaagcattgcagcggctcagggaagttgtgctcgatgctaacaccacccagtttaaaagactgaaggaaatgaacgaaagagaaaagaaagaactgcagaagattctcgatcgcaagaggcacaattcaattagcgaggccaagatgagggacaaacacaaaaaagaagctgagttaaccgagatcaataggagacatatcacagagagtgtcaactctatccgccgactcgaggaggcccagaaacagcgccacgacagactagttgcaggccagcaacaggtgctccaacagctcgccgaagaggagccaaaactgctggcacagttagcccaggagtgccaggagcagcgggctcgactgccacaggagattcggaggagccttctgggcgaaatgccagaaggccttggcgatggaccactcgttgcgtgcgcctctaatgggcatgctcccggatcgtccggccatctttccggagccgacagcgagagccaagaggaaaatacccaattatag

SEQ ID NO: 234897 - DNA, 3705 bp, Artificial Sequence
  Description of Artificial Sequence: Synthetic coding sequence
atggccggagctcagccgggtgttcacgccctgcagcttgaaccaccgactgtcgttgagacactccggagaggcagtaagttcatcaagtgggacgaggaaacctcatcgaggaatttagtcacccttagggtggatcccaatggatttttcttgtattggacgggtcccaatatggaagtcgacacactcgacataagctccattcgagacacgcgcaccggccgttatgcacggcttcccaaggacccaaaaatcagggaagtgctgggattcgggggtcccgatgccagactggaggagaaattaatgaccgtggtcagtggccctgaccccgtcaatactgttttcctgaacttcatggccgtccaggacgacaccgctaaggtctggagtgaagaacttttcaagttggcaatgaacatcttagcacaaaatgctagcagaaacacgttcctaagaaaagcatacacaaagctcaagctacaggtaaaccaggacggtaggatccccgttaaaaatatactcaaaatgttcagtgcggacaagaagcgagtggagactgctctggagagttgtggcttgaagttcaaccggtctgagtcgatccgccctgacgaattctccctggagatattcgagagattcttgaataaactgtgtctgagaccagatatagacaagatcctacttgagatcggcgcaaagggaaagccttatttaaccctagagcaacttatggacttcattaaccagaagcaaagagatcccagattaaatgaagtgctgtatccacctctccgtccctcccaggctcgactgctgatagagaagtatgaacctaaccagcaatttctggagcgggatcaaatgtctatggagggattttctcggtatctgggaggcgaagagaatggaatactgccgttagaagcactcgacctttctacagatatgacgcagccattgtccgcttatttcattaacagttcgcacaatacgtacttaactgccggacaacttgccggtacatccagcgtggaaatgtacaggcaggctttactgtgggggtgtcgttgcgtggagcttgacgtgtggaaaggcagaccgccagaagaggagccatttattacacatggctttacgatgactactgaggttcctctgagggatgtcctggaggccatcgccgaaactgcgtttaaaacaagtccataccctgtgatactcagttttgagaaccatgtggactccgcaaagcagcaggcaaaaatggccgagtattgccggagcatctttggagacgccttgctcatagagccactggataagtaccctcttgctcccggtgtgcctttgccgagtccccaggatctgatgggccgaattcttgtcaagaacaaaaagcgacaccgccctagcgctggcggtcctgattctgctggcagaaaacggcctctggaacagagtaattccgcgctgagcgagtcctctgccgcaacagagccaagtagccctcagctgggctccccatcaagtgacagctgccctggcctgagcaacggagaggaagtcggcctggaaaagccctcactggagcctcagaaatctctcggtgacgaaggtctgaaccggggaccgtatgtgctgggaccagcagatagggaagacgaagaggaggacgaagaggaggaagaacagaccgacccaaaaaaacctacaacagacgagggcacagctagctccgaggtgaacgctaccgaagaaatgtctacacttgtgaactatatcgagccagtgaagttcaaatctttcgaggcggctcgtaagcggaacaagtgctttgagatgagcagttttgtggaaacaaaggctatggagcagctgaccaaatcgccaatggaatttgtggaatataataaacagcaattatcgcgtatataccctaaaggaacccgggtggattccagcaactacatgcctcagcttttctggaacgttggatgccagctcgttgcactcaactttcagactctggatgtcgccatgcagctgaacgctggagtcttcgagtacaacggtaggtcaggctatctcctgaagccagaatttatgcgacgccctgataaaagtttcgacccattcacggaagtgatcgtggatgggatagtcgcaaacgccttacgcgtgaaggtaatcagtggacagttcctgtcagaccgtaaggttgggatatacgtggaggtggacatgtttggtcttcctgtcgatactaggagaaaatatcgaactagaacctctcagggcaattcattcaaccccgtctgggacgaagagccgtttgatttccccaaagttgtcctcccaacgctggctagcctcaggattgcagcattcgaagagggcggtaaatttgtgggccatcgaatccttcctgtttcagctattcgcagcgggtaccactatgtatgtctgcgcaatgaagccaatcagccactgtgtctacctgccttgttaatctatacagaggcaagtgactacattccagatgatcaccaggactatgctgaagccctgattaatccgattaaacacgttagtttgatggatcagagggcacggcaactcgccgcactgatcggcgaatccgaggcccaggcgggacaggagacatgccaggacactcagagccagcaacttgggtcccagcccagctcaaatccaactccctcacccctggatgcctccccacgcaggccaccaggcccaacgacctcccccgcttccaccagcctttcatcacccggacagagagacgaccttatagcatccatactgtccgaggtcgcaccgactcccctggacgaactgaggggacacaaagcattggtcaaactgcgctcacgccaggaacgggacctgcgcgaactgaggaagaagcaccagagaaaagcagtgacgttgacgagacgcttgcttgacggcttagcgcaagctcaggccgagggcagatgtaggctccggccaggcgcactgggcggagccgctgatgtggaggatacaaaagagggggaggatgaggccaaacggtatcaagaattccagaatcgccaggtccagtctctactcgagttgagagaagcccaggtcgacgcagaggcgcagcgacgtttagagcatctgcgtcaggccctgcagcgactaagggaagtggttctggatgcaaacacaactcagttcaaacggttgaaggaaatgaacgagcgggagaaaaaggaattgcagaagattttagatcgcaaaaggcacaattccatcagcgaagcgaagatgcgagacaaacacaaaaaagaggccgaactgacagaaatcaatagaagacacatcacagaatcagtcaatagcataagaaggcttgaggaggcacagaaacagcggcacgaccgtctggtcgctggacagcaacaggtcttgcagcagctggccgaagaggaaccaaagctactcgcacaactggcccaagagtgccaagagcagcgcgcacgccttcctcaagagatccggaggagtcttcttggggaaatgccagaaggtctgggagatggccctctcgtggcatgtgcgtctaatggccatgccccaggatccagcgggcatctttccggcgctgacagcgagtcacaggaagaaaatacccaactgtag

SEQ ID NO: 234898 - DNA, 3528 bp, Artificial Sequence
  Description of Artificial Sequence: Synthetic coding sequence
atggcaaagccatacgaatttaactggcagaaagaggtgccaagcttccttcaagaaggcgcagtgttcgatcgctacgaagaggagtccttcgtgttcgaaccaaactgtctgtttaaagtggacgagtttggctttttcttgacctggcgaagcgagggaaaggaagggcaggtactggagtgctccctgataaattcaatacgaagcggcgcaatccctaaagacccaaagattttagctgccctggaagccgtcggcaaaagtgaaaatgacctcgagggcaggattgtgtgcgtctgctccgggactgacctggttaatattagtttcacgtacatggtggctgaaaacccagaagtaaccaagcaatgggttgaggggcttaggagtatcatacacaattttcgggctaacaatgtaagtcccatgacctgtttaaaaaagcactggatgaagctcgcattcatgacgaatactaatgggaagatacccgtaagatcaattacccggacgttcgcatccggaaagacagaaaaggtaatttttcaggcccttaaggagctggggttgccatctgggaaaaacgatgagatcgagcccacagccttctcttatgagaagttttacgagcttactcagaagatatgtcccagaaccgacatcgaggatcttttcaaaaaaataaacggtgacaagacagattacctgactgtggatcaattggtaagtttcttaaacgaacatcaacgtgatccacgattaaacgaaatactgttccccttttatgacgccaaaagggcaatgcagatcattgaaatgtacgagccagatgaggaccttaaaaagaaaggactcatttccagtgatggcttctgtcggtatcttatgtccgatgagaacgctcccgtttttctggacagactggagttgtatcaggagatggaccaccctttggcgcattactttatttcgtccagtcacaatacatacctcacaggtcgccaatttggcggaaagtcttccgtcgagatgtacagacaggtccttcttgcaggatgccggtgcgtggagctggactgctgggacggcaaaggagaagaccaagagccgatcatcacacacggcaaggcaatgtgtacggatatcttgttcaaggatgtcatccaggcaatcaaagagactgcattcgttacctccgaatatcccgtcatcctgtcattcgagaaccattgttcaaagtaccagcagtacaaaatgtcaaagtattgtgaagatctgttcggggatctcctcttaaagcaggctctggaatcccacccgctggagcctggacgggctctgccctcccccaacgacctgaagcgcaaaatacttatcaaaaacaagcggctcaagcctgaagtggagaaaaagcagctggaggccttgcgctcaatgatggaagctggcgaaagcgccagccccgctaatatccttgaggacgataacgaggaggaaatagagtcagcagatcaagaggaagaggcacacccagaattcaagttcgggaatgagctgagtgcagatgacttaggacataaagaggccgtcgccaatagtgtgaaaaagggactcgtcaccgtagaagatgagcaggcctggatggcatcatataagtacgtgggggctactacaaacattcatccctatttgagcactatgatcaactatgcccagcccgttaagttccagggatttcacgtggctgaggagagaaacatccactacaacatgtcaagttttaatgagtccgtgggtctcggctacctaaagacgcacgctatcgagtttgtcaattataataagaggcagatgtcaaggatttacccgaagggaggacgcgtagacagctctaattatatgccccagatattctggaacgccggatgtcagatggtctcgctgaattaccaaacacctgaccttgcaatgcagctgaatcaggggaagtttgagtacaatgggtcctgtggctatttgctcaaaccagacttcatgcgcagacctgaccgcacattcgatcctttttcagaaacccccgtggatggggtgatagccgctacctgtagcgtgcaggtgatttccggccaatttttaagcgacaagaagattggcacctatgtggaggtcgacatgtacggactgcccactgataccatccgaaaagaatttcggacaaggatggtgatgaacaacggtttgaatcctgtgtataatgaggagtcattcgtttttagaaaggtgatcctcccagaccttgcagtgctacgtatcgccgtgtatgacgataataacaaactgatcggccagcggatactccccctcgacggactccaggcaggttacagacacattagcctgaggaatgaagggaacaagccgctgagtcttccaacaattttctgtaacattgttttaaagacttacgtgcccgacggattcggggatattgtggatgctctgtcggatcctaaaaagtttctttccattacggagaaacgggcagaccagatgcgggctatgggaattgagacgagcgacatcgcggacgtgccttccgatacttcaaaaaatgataagaaggggaaggctaacaccgctaaagcaaatgtaacaccacagtcttccagtgaactgcgacctaccacaactgcggctctggcctcaggagttgaggccaaaaaaggcatagagctcatcccccaggtgcgtatcgaggatctgaagcagatgaaagcctatctcaagcacctgaagaagcagcagaaagagctcaacagtttgaagaaaaaacacgctaaagagcatagtacaatgcagaaactgcactgcactcaggtggacaagattgtggcccagtacgataaagaaaaatctacacacgagaagatactcgaaaaagcaatgaaaaagaaggggggaagcaactgccttgagatgaaaaaggaaaccgaaatcaaaattcagactctcacttctgaccacaaatctaaagtaaaagagatcgtggcccagcataccaaagaatggagtgaaatgattaatacccattctgcagaggagcaagaaattcgcgaccttcacctgtctcagcagtgcgagctcctcaagaagctgctgataaacgcacacgaacaacagacccagcagctgaaactcagccacgatagagagtcaaaggaaatgcgggctcaccaagctaagatctcaatggagaattctaaggccatttcacaggacaaaagcataaagaacaaagctgagcgagagaggagggtgcgggagctgaacagttccaatacaaagaagtttttggaggaacgcaaacgccttgccatgaaacagtccaaagaaatggatcaacttaaaaaggttcagctcgagcatctggaatttctggagaagcagaacgaacaggctaaggagatgcaacaaatggttaaactggaagccgaaatggatcgccgacctgctacggttgtttag

SEQ ID NO: 234899 - DNA, 3585 bp, Artificial Sequence
  Description of Artificial Sequence: Synthetic coding sequence
atggccaagccttatgagttcaactggcagaaagaggtgccttcttttcttcaggagggtgccgtgtttgacagatatgaggaggagagcttcgtcttcgagccaaattgtctctttaaggttgacgaatttggcttttttctcacttggcggtctgaaggcaaagaaggacaggtcctggagtgtagcctcattaactccatacgctctggtgctatcccaaaggatcctaagattcttgccgcattggaggccgtggggaagtctgagaatgatttggaggggagaattgtttgcgtctgctcaggtacagatctcgtcaacatttcgtttacctacatggtggctgaaaatccagaggtaacgaagcagtgggttgaaggtctgaggagtataatccataattttagagcgaataatgtcagtcctatgacctgcctaaaaaaacattggatgaagctcgccttcatgaccaacactaacggcaagattcctgtgcggtccatcaccagaactttcgcctctggaaaaactgaaaaagtgatctttcaggcactcaaagagctaggattacctagcggaaaaaatgatgagatcgagcctaccgccttttcctatgagaaattttacgagctcactcagaaaatctgtcctaggaccgacattgaagatctgtttaagaagattaacggcgacaagaccgactatctgaccgtggaccagcttgtttcattcttgaatgagcaccagagagaccccaggcttaatgagatacttttccctttctatgacgcaaaaagggcgatgcaaattatcgaaatgtatgagccagatgaagacctcaagaaaaaaggcctgatttcatccgacgggttttgcaggtatttgatgtctgatgagaacgcccctgtgtttctcgaccgactcgagttatatcaggaaatggatcacccactggcacattactttatttcgtcaagtcacaacacatacctgacaggcaggcagtttggcggaaaaagctccgtggaaatgtatagacaggttcttctcgcaggttgccggtgcgtggaactcgactgctgggatgggaagggcgaggatcaggaaccaattatcacccatggtaaagccatgtgtaccgacattctttttaaggatgttattcaggctataaaagaaactgctttcgtgactagtgagtatcctgtaatcttgtcttttgagaatcactgctccaaatatcaacagtacaagatgagcaagtattgcgaagatctgttcggtgatctcctgctgaaacaggctctggaaagtcatcccctggagcctggcagagccctgccttctcctaacgacttaaaacgcaaaattcttatcaaaaataagcggcttaaacctgaagtcgaaaaaaagcagctggaggctctcaggagtatgatggaggccggtgagtccgcctcccccgctaacatcctggaggatgacaacgaagaggaaattgaatctgctgaccaagaggaggaagctcacccagaatttaagttcggcaacgagctgtccgccgatgacctgggccacaaggaagccgtagctaattctgttaaaaaaggccttgtgaccgtcgaagatgagcaggcatggatggcatcatacaagtatgtgggtgcaactacaaatatacacccttacctgtctacaatgattaactatgctcaacccgtgaaattccaaggctttcatgtcgccgaggaacgcaatatacactataacatgtcctcatttaacgagtccgttggcctgggctatttgaagacacatgccatagagttcgtcaactacaataaacgacagatgagcagaatttatcccaagggaggcagagtggacagctcaaattacatgcctcagattttctggaacgctgggtgtcaaatggtcagtctgaattaccagactccagatcttgcaatgcagctgaatcaggggaagtttgaatacaacggtagttgcggttatctgctcaaaccggactttatgagacggccagatcgcactttcgaccctttttccgaaactccagtggatggcgtgattgccgcaacctgttcagtgcaggtgatctctggacagtttctgtcggacaaaaagataggaacctatgtggaagtagatatgtacggactacccaccgacactatcagaaaggagttccgaacccgaatggtgatgaacaacggcttgaacccagtgtataatgaggaaagcttcgtgtttagaaaagtgattctccctgatcttgcagtccttagaatcgctgtctacgacgataacaataaattgatcggacagcggattctacctctcgacgggctgcaggctgggtatcggcatatcagtctgcgaaatgaagggaacaagccgctctcgctaccaacgattttttgtaacattgtgctgaaaacttacgtcccagatggctttggtgacatagtggatgccctatccgaccctaaaaaattcctgtctatcactgagaagcgcgctgaccaaatgcgggctatgggaatagagaccagcgacattgctgacgttccctcagatacatctaaaaatgataagaagggcaaagccaacactgcgaaggcaaacgtcaccccccagtcaagctccgagctgcgcccaacaactaccgcagcactggcttctggagtcgaagctaagaaaggtatcgagctcatcccacaggtgcgcattgaggatctgaaacagatgaaggcttacttgaagcatcttaagaagcagcagaaggagctcaattcactgaagaaaaagcacgccaaagaacatagtaccatgcagaaattgcactgtacacaggtggacaaaatagtggcccagtacgacaaggaaaagtcgacacatgaaaaaatcctggagaaggctatgaaaaagaaagggggatccaactgtctggagatgaagaaggaaaccgaaatcaaaatacagacgctcacctccgaccacaaatcaaaggttaaagagatcgtggctcagcatacaaaagaatggtctgaaatgattaacactcattccgccgaagagcaagaaattcgggatctgcatctatcacaacagtgcgaactgctgaagaaactgctaatcaacgctcacgagcaacaaacacagcagcttaaattatcccatgatcgggaatccaaagagatgcgggctcaccaggccaaaatatctatggagaactctaaagctattagccaggacaaaagcatcaagaacaaagctgagagggagaggagggtccgggagcttaactcttcaaataccaaaaaattcctggaggaaagaaaacggcttgcaatgaaacagagtaaagaaatggaccagctgaaaaaagtgcagctggaacatctggagttcttggagaagcaaaatgaacaactgctaaagtcctgtcatgccgttagtcagacccagggagaaggggacgctgccgacggcgaaatcggcagtcgagatggcccacaaacttctaactcctccatgaaactgcaaaatgctaattag

SEQ ID NO: 234900 - DNA, 3564 bp, Artificial Sequence
  Description of Artificial Sequence: Synthetic coding sequence
atggccaagccttatgagtttaactggcagaaagaggtgccgtctttcctccaggagggggcagtgttcgatcgatatgaagaggagtccttcgtgttcgagcctaattgtctcttcaaagtggacgaattcggattcttcctaacctggaggagcgaaggaaaagagggtcaagtactggaatgcagtctcatcaattcaatccgatcaggagccatccccaaagatcccaagattttggccgcactagaggctgtcggtaagagtgagaacgacctggagggcagaatcgtctgcgtatgcagtggcaccgacctggtgaatatatccttcacgtatatggtcgcagagaacccagaagttacaaagcagtgggttgaaggcctcagaagtattatacataacttccgtgccaacaacgtgagccctatgacgtgtctcaagaagcactggatgaagctcgccttcatgacaaataccaatggaaagataccagtgcgctcgattactcgcacctttgccagtggtaaaacagaaaaagtaatcttccaggctctgaaggagttggggctgccctctgggaagaacgacgagatcgagccaaccgcattctcatacgagaagttttacgagctcacccagaaaatctgccctcgcactgacattgaggatctcttcaagaaaattaacggagacaaaactgattatcttaccgtcgatcaacttgtttccttcctgaatgagcaccaacgggaccctcgcctgaacgaaattctgttcccattctatgacgctaagcgcgcaatgcagataatcgagatgtatgagcccgatgaggatctcaaaaaaaagggcctgatcagctctgacggtttttgtcggtacctaatgtccgatgaaaatgcaccagttttcctcgatcggctcgaactctaccaggagatggaccaccccctggctcattattttatcagttcaagtcacaatacgtacttgacagggagacagttcgggggaaagagcagcgtagagatgtaccgccaggtcctgctggctggttgccgctgcgtagagctagactgctgggacggaaagggcgaagaccaagaacccatcatcacccacgggaaagcaatgtgcactgatatcctgttcaaggatgtgattcaggccatcaaagagaccgcttttgttacctcagaatacccagtcatcttgagctttgagaatcattgttcaaagtaccagcagtataaaatgtccaagtattgtgaggatttgttcggggacctattgcttaaacaggccctagagtcccatcccttggaacccggtcgggctttgccctctccaaatgacttaaagagaaagatcctgattaaaaataaacgactgaaacctgaggtcgagaagaaacagctcgaggctctgaggagtatgatggaagcaggcgaatccgcttcccctgctaacatcttagaggacgacaacgaagaggaaattgaatctgcagatcaagaggaggaagctcatccagagttcaaattcggcaacgaactgtccgccgatgacctgggtcacaaggaggccgtggctaactccgtaaagaaggccagtgatgatctggagcatgaaaacaacaagaaaggtctggtgactgtggaggatgaacaggcctggatggcttcctacaaatatgtgggggcaaccactaatattcatccatacctcagcactatgattaattacgcccagcccgtgaagtttcagggtttccatgtggccgaagagcgtaatattcactataatatgtcaagcttcaatgaatcagtggggttggggtacctcaaaacacacgcaattgaatttgtcaattataacaagcgacaaatgagccgcatctatcccaaaggagggagggtggactcatctaactacatgcctcaaatcttttggaacgctggatgtcaaatggttagcctgaattatcagactccagatcttgcgatgcagctgaaccagggaaagtttgaatacaacggatcctgtgggtatctgctgaaaccagacttcatgagaagaccagatagaacgttcgaccccttcagtgagacaccagtggatggagtcatcgctgcaacttgctccgtgcaagtgattagtggccagtttctgagcgacaagaaaatcgggacatacgtcgaagtggatatgtatggcctccctacagacacgatacgcaaggagttcagaactcgaatggtcatgaacaacggattgaatccagtttataacgaggagagctttgtgttccgcaaagtgatcctgcctgatttggctgttctgagaatcgctgtatatgatgataataataagcttatcggtcaaagaatcctccctctggacggcctgcaggccggttaccggcatatctctcttaggaatgaaggtaataagcccctctctttgcccactatcttctgcaatattgtgctcaagacctatgtgccagatggattcggagatatcgtcgacgcgctgagcgatccaaagaagtttctcagcataaccgaaaaaagagctgaccagatgagggccatgggtattgaaacctctgacattgccgacgtaccctcagatacctccaaaaatgataaaaaggggaaggcgaacacggctaaggccaacgtcacaccacaatcgagttccgagctcaggcctaccacaacggccgctcttgcctccggtgtcgaagccaagaagggcatagaactgattccgcaggtacggatcgaagacctgaagcagatgaaggcgtacttaaaacacctcaaaaaacaacagaaagaactgaactccctgaaaaagaagcacgctaaagaacattccaccatgcaaaagctccactgcacccaggtggacaagattgtggctcagtacgataaggagaagagcacacatgagaaaatccttgagaaggcgatgaaaaaaaaaggcggatctaactgtctcgaaatgaagaaagaaacagaaattaagattcagactctgacgagcgaccataaatccaaggtgaaagagatagttgcccagcacacaaaggagtggtcagagatgattaatacgcacagcgcagaggagcaggagatcagggacctgcatttatcccagcaatgcgaactgctgaaaaagctgttgattaacgctcatgagcagcagactcagcagctcaagctaagtcacgatcgggaaagcaaggagatgcgtgctcatcaggccaagattagtatggaaaatagtaaagcaataagtcaggataagtctatcaaaaataaggccgaaagagagcggagggtgcgagaactcaatagcagtaatactaaaaagttcctggaagagagaaagagattggccatgaagcagtcaaaagagatggaccagctgaaaaaagttcaattagagcacttggagtttttggaaaaacagaatgagcaggcaaaggagatgcagcagatggtcaagctggaagcggaaatggaccgcagacccgctaccgtggtctag

SEQ ID NO: 234901 - DNA, 3528 bp, Artificial Sequence
  Description of Artificial Sequence: Synthetic coding sequence
atggccaagccctacgagtttaattggcagaaagaggtgccttcttttctccaggagggtgccgtgtttgaccgctatgaagaggaatcttttgtgttcgaacctaactgcctatttaaggtggatgagttcggattctttctcacatggaggtccgagggaaaggaaggccaggtcctggaatgcagcctgatcaattcaatcagatcaggtgctatccctaaggacccaaaaatcctcgcggctctggaggcagtggggaagagcgaaaatgatctggagggaagaattgtctgtgtgtgcagcggcacagatctcgtcaacatatcctttacatacatggtggcagaaaatcctgaagtgactaagcaatgggtggagggccttaggtccattattcataattttagggcgaacaacgtctctcctatgacttgtcttaaaaaacattggatgaaacttgccttcatgaccaatacaaacgggaaaattccagttagatccatcaccaggacttttgcttccggtaagaccgagaaagtgatttttcaggctctgaaagaacttggactgcccagcggtaagaatgacgaaatcgagccaacagctttcagttatgaaaagttctacgaactgacacagaaaatctgtcctcggaccgacatcgaggatctgtttaagaaaatcaacggcgataagaccgattacctgacagtcgatcaactggtgtcattcttgaacgagcaccagagggatccacgactcaatgagattctatttccattctacgacgccaaaagggccatgcaaattattgaaatgtacgaaccagacgaagatctgaaaaaaaagggactgattagcagcgacgggttttgcagatatctgatgtcagatgaaaacgctcccgtgttcttagacagattggagctttaccaagagatggaccacccactggctcactacttcatctccagcagtcataatacctacctgacagggcgacagtttggcggaaagtcctcagtggagatgtaccggcaggtactcctggctggctgcagatgtgtcgaactcgattgttgggatggaaagggggaggatcaggaaccaatcataacacacggcaaggctatgtgtactgatatcctattcaaggacgtcattcaggcaataaaggaaacagctttcgtgacctcagaatatccagtaatactttcttttgagaaccattgttcaaagtaccagcagtataaaatgtctaaatattgtgaagacctctttggcgacttgctgctaaaacaggccctcgagtcacacccactggaacccggtcgggcactaccttctcccaatgatctcaaaaggaaaatcctgatcaagaataaaagactaaagcctgaagttgagaagaagcagctcgaagccttgcggtccatgatggaagccggtgagtcagcctctccggctaatatcctggaggatgataacgaagaagagatcgaatccgcagatcaagaggaggaagcccatcctgaatttaagttcgggaacgagctaagtgctgacgacctggggcacaaagaagccgtcgcaaactctgtgaagaagggcctggttacagtggaggatgagcaggcttggatggcctcttacaagtatgttggcgctaccacaaatattcatccttacctatccaccatgattaattacgcccagcctgtgaagtttcaaggctttcacgtggccgaggaacggaacatccattataatatgtcctcatttaacgaatcagtggggctaggctacttaaaaacacatgcaatcgagtttgttaattacaacaaaaggcagatgtcccggatctatcccaaaggcggtagagtggactccagcaactatatgcctcaaatcttttggaatgcaggatgtcagatggtatcactgaactaccagaccccggacctggcgatgcaactaaatcagggaaaatttgagtataatgggtcctgtggatatcttctgaagccagattttatgcggaggcccgaccggactttcgatcccttttcggaaactccggtggacggggtcatagccgcaacgtgtagtgtgcaggtcatttccggccagtttctgagcgataaaaagatagggacgtatgtagaggtggatatgtacggcctgcccacagacaccatcaggaaagaattccggactcgcatggtgatgaacaacgggctcaatcctgtatataacgaagagtcattcgtgtttcgtaaggtcattctacccgacttggctgtattgcgcatcgcggtgtacgatgacaataacaagctcattggacagcggattctgccgcttgacggactgcaggctggataccgtcacatctccttacgtaacgaggggaataagcctctgtcccttcctaccatcttctgcaacattgtactgaagacctacgttccagacggtttcggtgacattgtggacgcgctgagcgatcccaagaaattcctctccattaccgagaagagggctgatcagatgcgcgctatgggcatcgaaacctcagatattgcagatgtgccatccgataccagcaaaaacgataagaaggggaaggctaatacagcgaaagccaacgtgaccccacagagttcaagtgagcttcggccaaccaccaccgcagcgctagctagtggagtggaagccaaaaaaggcatagaacttattccacaggtacgcattgaggacctgaaacagatgaaggcttacttaaagcacctcaaaaagcagcagaaggagctgaattctcttaagaagaagcacgccaaagaacactccactatgcaaaaactgcattgtactcaggtggataaaattgtggcccagtatgacaaagaaaagtccacccatgagaagattcttgagaaagccatgaaaaagaaaggcggatcaaattgcctcgagatgaagaaagagacagaaatcaagatacagacattgacctcagaccacaagtctaaggttaaagagatcgtggcgcagcacacgaaggaatggagcgaaatgatcaatacccacagtgccgaagaacaggagattagggatcttcatctcagtcagcaatgcgaacttctcaagaagttgctcattaacgctcacgaacagcagactcagcagctcaaactcagtcacgacagagaaagcaaggagatgcgggcacaccaggccaagattagtatggagaattccaaagcaatctctcaggataagagcataaagaacaaagccgagagagagcgcagagtgagggaactgaattcttctaatactaagaagtttttggaagaacgaaagcgcctggctatgaaacagagtaaggagatggatcagctgaagaaagtgcagcttgaacatttagagtttttggagaagcagaatgagcaggcaaaagaaatgcagcagatggtgaagttggaagccgagatggacagacgacccgcaaccgtggtgtag

SEQ ID NO: 234902 - DNA, 3585 bp, Artificial Sequence
  Description of Artificial Sequence: Synthetic coding sequence
atggcgaaaccttatgagttcaactggcaaaaggaggtcccgtcttttcttcaggaaggagcagtgtttgatcggtatgaagaagaatctttcgtgtttgaacctaactgcctcttcaaagtggatgaatttgggttctttctgacttggcggagcgagggaaaggaggggcaggtgctggagtgctccctgataaattctattcgcagcggtgcaattcctaaggaccctaaaattctggccgctctggaggctgtcggaaagtcagagaatgatctggaggggaggattgtgtgcgtgtgcagtggaacggacctggtaaacatcagttttacatatatggtggcagagaaccccgaggttacaaagcagtgggttgaaggtctgcgatccataatccataactttcgcgctaacaatgtgagccccatgacatgtttgaagaagcattggatgaaactcgcgttcatgaccaacactaacgggaaaattcctgttcgcagtatcacgaggactttcgcctccggaaagaccgaaaaagtgatcttccaagccctgaaggagcttggactgcccagcgggaaaaatgacgagatcgagcctaccgccttttcttacgaaaagttctatgagcttactcagaagatctgccccaggacagatattgaagacctctttaaaaagatcaatggcgataaaaccgactacctcacagtggatcagctcgtgagctttctcaacgagcatcagcgggaccctaggctaaacgaaatactgtttcccttttatgacgccaagagagccatgcaaataatcgaaatgtatgagccagacgaggacctgaagaagaaggggcttatttccagtgacggtttttgcaggtacctcatgtcagatgagaatgctccggttttcctggacaggctcgagttataccaagagatggatcacccactcgcacattacttcatctcttcttcacacaacacgtaccttacaggacggcaattcgggggtaaatcttcagttgagatgtacaggcaggtgctgcttgctggatgcagatgcgtagaactggactgctgggatgggaagggtgaggatcaggaaccgattattacacatgggaaagccatgtgcactgacattctcttcaaggatgtgatccaggcaattaaagaaaccgcattcgttacaagcgagtatcccgtgatactgtcgttcgaaaaccactgcagtaaataccagcagtacaaaatgagtaagtactgcgaggacttgtttggcgatctcttacttaagcaagctttggagtcgcatccactggagcctggaagagccttaccctctcctaatgatctcaaaaggaagattctgattaaaaacaagagactgaaacccgaagtagaaaaaaagcagcttgaagccctgcggtccatgatggaagccggagagagcgcaagcccagcgaatatcttggaggatgataatgaggaagagattgaaagcgctgaccaggaagaggaggctcaccctgaattcaagtttggaaatgaactgagcgccgatgacttgggtcacaaggaagccgtcgcgaactctgtaaagaagggcttagttacagtggaagacgagcaggcatggatggcctcatacaaatacgtgggggcaactactaatatccatccctatttatctactatgattaattatgcacaaccggtgaaattccagggcttccatgttgccgaagaacggaatatccactacaatatgtcttcctttaatgaaagcgtgggcctgggctaccttaagacccacgcgattgagttcgtcaactataacaaacggcagatgtctaggatctacccaaagggcggacgagtggacagctccaactacatgccccagatcttttggaatgcaggatgtcagatggtaagcctgaactaccagaccccagacctggctatgcagctgaatcagggcaagtttgaatataacggatcctgcggatacctactgaaaccagatttcatgcgcaggcccgatcgaacattcgacccattctcagagacccccgtcgatggggtgattgccgctacatgttctgttcaggtcatctcgggccagttccttagtgacaagaagatcgggacgtatgtcgaggtggacatgtatggactcccaaccgatacaatacggaaggagttccgcacaagaatggttatgaacaacggactcaatcccgtttacaatgaagagagctttgttttcagaaaagtcattcttccagatttagctgtgttgcggatagccgtgtatgatgataataacaagctaattgggcaacgcattttacccctggacggccttcaggctggttatcgccacatttccctgcggaacgaggggaacaagcccttaagcttgcctacgatcttttgtaatatcgtccttaagacatacgtccccgatggcttcggggacattgtagacgctctctcggaccccaaaaaattcctctcgataaccgagaagcgcgcagatcaaatgagagcaatgggaatcgagacatcagatatagccgatgttcctagcgacacaagtaaaaacgacaagaaggggaaggccaatacggccaaggccaatgttaccccgcagtcttcctctgagcttcgaccaacgaccacagctgcccttgcctctggggtggaagccaagaagggtattgagttgataccacaggttcggattgaagatctcaaacaaatgaaggcctacctgaagcacctgaaaaagcaacagaaggagttgaattccttgaagaaaaaacatgccaaggagcattccactatgcagaagctgcattgcactcaggtcgacaagatagttgcccagtatgataaggaaaagtccacccatgagaagatcttggaaaaggcgatgaaaaaaaaaggcggttccaactgtctggagatgaaaaaagaaaccgagatcaaaattcagacactgacatcagaccataaaagcaaggtgaaggagattgttgcccagcacactaaagagtggtccgaaatgataaacacacacagcgccgaagagcaggagatacgtgaccttcatctgagccagcaatgcgagttgctcaagaagcttcttataaacgcccacgagcagcagactcaacagctgaagttgtcgcatgatcgagagagtaaggagatgagagcacatcaggccaaaatcagcatggaaaacagtaaggccatctcccaggataaatctatcaaaaacaaggcggaacgagaaagacgcgtgagggaactgaacagctcaaataccaagaaatttctagaggagaggaagagactggcgatgaaacagtcgaaggagatggaccagcttaaaaaggtccaactagagcatttagagtttctcgaaaagcagaacgaacagctgctgaagtcctgccatgccgtgagccagacccagggtgagggagatgctgcagacggggagataggttcgcgagatgggcctcagacctctaattccagtatgaagttacagaatgctaattag

SEQ ID NO: 234903 - DNA, 342 bp, Artificial Sequence
  Description of Artificial Sequence: Synthetic coding sequence
atggccaagccctatgagtttaattggcagaaggaagtgccaagctttctacaagagggagctgtcttcgacagatatgaagaggaatccttcgttttcgagccaaattgcctatttaaagtggacgaattcggtttcttcctgacatggcggtcagaagggaaagagggccaggttctggaatgctctcttataaactccatccggtcaggggcaattcccaaggacccaaaaattctggccgcactagaagctgtgggcaagtctgaaaatgacctggaaggccgtattgtctgtgtctgttctggaactgatctagttaacatttccttcacgtattag

SEQ ID NO: 234904 - DNA, 3072 bp, Artificial Sequence
  Description of Artificial Sequence: Synthetic coding sequence
cctgtacgatcgatcactagaacttttgcttcagggaaaacggagaaagttatctttcaggcgttgaaggagttggggctcccctccgggaagaatgacgaaattgaaccaactgctttctcttatgagaagttttatgagctcacacagaaaatatgccctagaacagacatcgaggacctgtttaagaagattaacggggacaaaactgattatctgaccgtcgaccagctggtcagctttcttaacgaacaccagcgagacccccgtctcaatgaaattctcttccccttctatgatgctaagagagccatgcagattattgaaatgtacgaacccgatgaagatttgaaaaagaaagggctcatatcttctgacggattctgtcgttatttaatgagtgatgagaacgcgcctgtcttcctcgacagacttgagctgtaccaggagatggatcaccctttagcccactacttcatttcatcttctcacaatacctacctgaccggacggcagttcggcggaaagagcagcgtagagatgtatcgccaggtgctactggcgggatgccggtgcgtcgaattggattgctgggacggcaagggtgaggatcaagaaccaatcattacacacggcaaggcgatgtgcactgatattttgttcaaggatgttatccaggccatcaaggagacggccttcgtgacctccgagtatcccgtgatcttgtccttcgagaaccactgtagcaaataccagcagtataaaatgagtaaatattgcgaagacctgtttggggatttgctgctcaaacaagctcttgaaagccatccattagaaccaggtagagcgctcccatcccccaacgatctcaaacgaaagattctaatcaagaataaaaggttgaagccagaggttgaaaagaaacagctggaagcattaaggagtatgatggaggccggagagtctgccagcccagcgaatatactcgaggacgacaatgaagaagagattgagagtgccgaccaggaggaagaggctcatcccgagttcaagttcgggaacgagctttccgcggatgaccttggccataaggaagctgtggccaactccgtgaagaaagccagcgacgatctggagcacgaaaataacaagaaagggctggtgaccgtcgaggatgagcaggcttggatggcgagctacaagtatgtcggtgcaacaacgaacatccacccttatctgtccactatgattaactacgctcagcccgtgaaattccagggctttcatgtcgcagaggagagaaacatccactataacatgtctagcttcaatgaaagtgtcgggttaggatacttaaagactcatgccatcgagttcgtaaactacaataaaagacaaatgtcaaggatataccccaagggcggtcgggttgatagcagcaactacatgccacagattttttggaacgctggctgtcagatggtctccctgaactaccagacacctgatctcgccatgcaattaaaccagggaaagttcgaatacaatgggagttgcggctatctgctgaagcccgattttatgcgacgtccggatcggacatttgatcctttttcagaaacgcctgtcgacggagttatcgcagctacatgttccgtacaggtgatttcaggccagttccttagcgataagaagattggtacatacgtggaagtcgatatgtacgggttgcctactgacaccattcgtaaggaattcaggacaagaatggttatgaataatggactgaaccctgtgtataacgaagagagcttcgtgttccgaaaggtgatacttcctgatttggcagtcctgcgaatagcagtatacgatgataacaacaagctcatcgggcagaggattctgcccttggatggcctgcaggctgggtacaggcacatctcacttcggaatgaaggaaacaagcctttgtcactcccaaccattttctgcaacatcgttcttaaaacttatgtacccgacggctttggggacattgttgacgcactgagcgaccctaaaaagttcctgtccatcactgaaaaaagagctgatcaaatgcgcgcaatggggatagaaacaagtgacattgcagatgtgccctccgacaccagcaagaatgacaaaaagggcaaagccaataccgctaaggccaatgtgactccgcagtcttccagcgagctccggccaaccacaaccgcagcactcgcctccggggttgaggccaaaaagggcatagaactcatacctcaagtgagaattgaggacctcaaacagatgaaggcgtacctgaagcatctcaaaaaacaacagaaggaactgaattcattgaaaaagaagcatgccaaagaacattcaaccatgcagaagctgcactgcacccaggtggataagatcgtggcgcagtatgacaaggagaaaagtacacacgagaagatattagagaaggccatgaaaaagaagggcggatcaaattgcctagaaatgaagaaggagacggaaataaagatacagactctaacgtccgaccacaaaagtaaggttaaggaaattgtggcccagcatacaaaggagtggtctgagatgatcaacactcactctgcagaggaacaagagattcgtgatcttcacctgtcacaacagtgcgaacttttgaaaaagttgttgatcaacgcccacgaacagcagacacagcagttgaaactgtctcacgaccgagaatcaaaggagatgcgggctcatcaggccaaaatttccatggaaaactcgaaagctatttctcaagataaatcaatcaaaaacaaagcagaaagggaacggcgtgttagagagttaaactcatccaataccaagaagttcttggaggaacggaagcgtcttgcgatgaaacagagtaaggaaatggatcaactcaaaaaggtacagctagagcatctggagttccttgagaagcagaacgaacaggctaaagaaatgcagcagatggttaagctcgaggctgagatggatcggcgaccggctactgtagtctag

SEQ ID NO: 234905 - DNA, 183 bp, Artificial Sequence
  Description of Artificial Sequence: Synthetic coding sequence
atggccaaaccatatgaatttaactggcagaaggaagttccaagttttctccaggagggtgccgtgttcgacagatatgaggaagagagcttcgtctttgaaccaaattgcttgtttaaggtcgatgagttcggattctttctgacctggcgatcagaaggcaaggaagggcaagttctttag

SEQ ID NO: 234906 - DNA, 246 bp, Artificial Sequence
  Description of Artificial Sequence: Synthetic coding sequence
atggcaaagccctatgaattcaattggcaaaaggaggtgccttcatttcttcaagagggagccgtgtttgacaggtacgaggaggaatccttcgtgttcgagccaaattgtctatttaaagtggatgagtttggcttcttccttacctggcggagcgaggggaaagagggtcaggtgctcgagtgttccctcatcaattccattagatccggtgccataccaaaagaccctaagatactggcctag

SEQ ID NO: 234907 - DNA, 333 bp, Artificial Sequence
  Description of Artificial Sequence: Synthetic coding sequence
atggcaaaaccttatgaatttaactggcagaaggaggtgcctagctttttacaggaaggggctgtgttcgacaggtacgaggaagagagcttcgtcttcgaacccaactgtctcttcaaagtggacgaattcggctttttcctgacatggagatcagagggtaaggaagggcaagtcctagagtgcagcctgatcaactcaattcggagcggcgctataccgaaggatcccaaaatactggccgctcttgaagccgtcggtaagagcgagaacgatctcgaaggaaggatcgtttgcgtgtgctcagggacagaccttgtgaacatctcttag

SEQ ID NO: 234908 - DNA, 2271 bp, Artificial Sequence
  Description of Artificial Sequence: Synthetic coding sequence
atggattcggggagggacttcctgacactacatggtctacaagatgacgaggacttgcaggcgcttctcaagggttcacagctgctaaaagtcaagtctagctcctggaggcgagaacgcttctacaagttgcaggaggactgtaagactatttggcaagaatcacggaaagtgatgaggacaccagagtctcagttgttttcaatcgaggacatacaggaagtgcggatggggcacagaacggaggggcttgagaagttcgccagggacgtccccgaagacaggtgtttctcaatcgtatttaaggaccagcgtaataccctggaccttatagccccatcgccagcagatgcacagcattgggtgctgggactccataaaatcattcatcatagcggcagcatggaccagagacagaaacttcaacactggatccactcctgtctccgcaaagcggataaaaataaggataacaaaatgagttttaaggaactgcaaaactttctgaaggaactgaatatccaagtggacgattcgtacgctaggaaaatctttcgggagtgcgaccactcacagacagattcactggaggatgaagaaattgaagccttctacaagatgctgactcagcgcgtggagatcgacaggaccttcgcagaggctgccggatcaggcgaaaccctgtctgtggatcagctcgtgacttttctgcaacatcagcagagagaggaggccgcaggtcccgcactggccctctctctcatcgaaaggtatgagccctctgagaccgctaaggcccaacgacaaatgactaaagacgggtttctcatgtacctgttgtcagcagatgggtcggcgttttcactggcccaccggagggtttaccaagacatggggcagcctttaagccactacctggtgagctcatcccacaacacgtacttactggaggaccagctggctggcccttcatctacggaagcatacatccgggcactctgcaagggctgtaggtgtctggagcttgactgctgggatgggcctaatcaggagccaataatataccacggctacacctttacctcgaagattctgttctgtgatgtgctccgggcaatccgggattatgcatttaaggcttccccataccccgttatactgtccttggaaaatcattgcacgttggagcagcagagggtaatggcacgccatctgcacgcaatccttgggccaatgctcctaaacaggccgttggatggagtcacaaactccctgccgtcccccgagcagctgaaaggaaagatcttgttgaagggtaagaagctggggggactactcccccctggaggcgagggaggccctgaggccaccgtggtctcagacgaggacgaagctgccgagatggaggatgaggcggtacggagtcgtgtgcagcacaagcctaaggaggataagttaaggctcgctcaggagctaagcgatatggtaatttattgtaagagcgtgcatttcggagggttctcatcccccggaacgccagggcaggccttctatgagatggcttctttcagcgagaacagagcactcaggctcctgcaagaaagtggaaacggtttcgtgcggcacaatgttggccacctgtctcgaatatacccagctggctggagaacagattcatccaactactccccggtggagatgtggaatggcggatgtcaaattgtggcgctgaacttccagactccaggacccgagatggacgtgtaccaaggtaggttccaggataatggcgcatgcggatatgttttaaagcctgctttcctgcgagatcccaacggaactttcaatccccgagcactcgcacagggcccttggtgggcaagaaagaggctcaatataagggtgatctcgggccaacagcttcccaaggtgaataagaataagaacagcatcgtggaccctaaggtcaccgtcgaaatccacggtgtatcgcgggacgttgcttcccgacagactgctgtcattacaaataatggattcaatccttggtgggacacagagtttgcctttgaggtggttgttcctgaccttgcgctgatccgatttcttgtggaggattatgacgcaagttctaagaatgacttcattggtcagagtactattccacttaatagtttgaagcagggttacaggcatgtccatctgatgtctaagaacggcgaccagcatccttccgctacactctttgtgaagatctcacttcaggattag

SEQ ID NO: 234909 - DNA, 2334 bp, Artificial Sequence
  Description of Artificial Sequence: Synthetic coding sequence
atgcagtgtctggggatacgtagtaggtctagatctagggagctctatctgcaggagagatccctgaaagtcgccgctttaaatggtcggaggctgggactgcaagacgatgaagacctgcaggctttgctcaaagggagtcaactgctgaaggtaaagtcttcctcatggcggcgtgaacgcttctacaaattgcaggaggactgcaagaccatttggcaggaaagccggaaggttatgcggaccccagagagccaactgttctcaattgaggatatacaggaggtgaggatgggacacagaaccgaaggactcgagaaatttgccagagacgttcccgaagacagatgcttcagcatagtcttcaaagaccaacgcaatacattagatttaatcgccccttctccggcagacgcccagcattgggtgctgggattacacaaaattattcaccacagcgggagcatggaccaaaggcagaaactgcagcactggatccacagttgtcttagaaaagcagacaaaaataaggacaataagatgtcctttaaggaactgcaaaatttcctgaaagagttgaatatccaggtcgatgactcatacgccagaaagatattcagggagtgtgaccattctcaaacggacagcctagaggatgaagagatagaggcattctacaagatgctgacacaaagagttgagatagacaggacattcgccgaggctgccggatccggtgagaccctctcagtagatcagcttgtaactttcctgcaacatcagcagcgcgaggaggcagccggtccggctctggctttaagcctgatcgaacgttacgaaccatcagaaaccgctaaagcccagaggcagatgaccaaagacggatttctcatgtatctgctcagcgccgatggctccgcattttcactggcccaccgccgtgtctatcaggacatgggccaacctctcagtcattacctggtaagctcatcccataacacttatctgctcgaggatcagctggccggaccctccagtacagaagcttacatcagagcactgtgcaagggttgcaggtgtctggagctggactgttgggatggcccaaaccaggagcctataatttaccacggttatacttttacgtcaaaaatccttttttgcgatgtccttcgcgcaattcgggattacgcctttaaagcatctccctatccagtgatcctctccttggagaatcactgcaccctggaacagcagcgggtgatggcccgtcatttacacgctattttaggtcccatgctcctaaaccgccctctcgatggcgtaaccaatagtttgccatctccagagcagctgaagggaaagatcctcctgaaaggcaagaagttgggaggccttttaccacccggaggcgagggcggacctgaggccacagtggtttccgacgaggacgaagccgcagagatggaagatgaagccgtacggagtcgagtgcagcacaaacctaaggaggataaactgcggctcgcacaggagctttccgacatggtcatatactgcaaatctgtacatttcgggggtttttcttcaccaggaacgccagggcaggcattttatgaaatggcttccttctccgaaaatcgtgcactgagactcttgcaggaatctggaaatgggtttgtgaggcataatgttggccacttgagcagaatctaccctgcaggatggagaacagactcatctaattattctcctgtggagatgtggaatggaggatgtcagatcgtagcactcaacttccaaacacccggtcccgagatggatgtttatcagggcaggtttcaggacaacggcgcatgtgggtatgttttaaaaccagcctttctgcgcgacccgaatggcaccttcaatcccagagccctggcccaagggccttggtgggccagaaaacgcctcaatatccgagtgatctctgggcagcagctgcctaaagtcaacaagaataagaattcgatcgtggatccgaaggtgactgtcgaaatccacggagtgagtagggacgtggcaagcagacagaccgcggtgattaccaacaacggatttaacccatggtgggatacagagttcgccttcgaagtggttgtccctgacctggccctaatccggttcctggtagaagactacgacgcgtcctctaagaatgatttcattggacagtctaccatccctctaaacagtctgaagcagggctaccggcacgtacacctcatgagcaaaaacggcgatcagcacccctccgccacgctgtttgttaagatctccttgcaggattag

SEQ ID NO: 234910 - DNA, 6909 bp, Artificial Sequence
  Description of Artificial Sequence: Synthetic coding sequence
atgactagtgaggaaatgacggcatcagttcttataccagtgacccagagaaaggttgtttcagctcagtctgctgcagatgaatccagcgagaaagtgtctgacatcaatatatcgaaagcacatacagtgcgacggtccggggaaactagtcataccatcagtcagctaaacaagcttaaggaggagccttctgggtctaacctccccaaaatcctatccatcgcgagggaaaagattgtctccgacgagaacagcaatgaaaagtgttgggagaaaattatgccagactcagccaagaatctgaacattaattgcaataacattctgcggaaccaccagcacggacttccacagcggcagttctacgaaatgtacaacagcgtggctgaagaagacctctgcctggagactggaatccccagtcccctcgaacgcaaagtgtttccaggtattcagctggagctggatcgcccttcaatgggtatttcccccttaggaaaccagagcgtgattatcgagacagggagagcacaccctgactcacggcgagccgttttccatttccactatgaggtggatcgaagaatgtccgatactttttgcacactcagcgagaacttgatactggacgactgcgggaactgcgtccccctgcccggtggcgaagaaaagcagaagaagaattatgtggcctatacctgtaagctgatggaactggcaaagaactgtgacaataaaaacgaacagcttcagtgcgaccattgcgatacactgaatgataaatacttttgttttgagggctcttgtgagaaggttgacatggtatatagtggcgattctttctgccgaaaggattttacagattcacaggctgccaaaacttttctttctcactttgaggatttccccgataattgtgatgatgtcgaggaggatgcctttaaatctaaaaaggaaaggtccactttgctcgttcgacggttttgtaaaaacgaccgtgaagtcaagaagtctgtctatacgggcactcgcgctatagtccggacattaccgagtggccacatagggttaacggcatggagttacatcgaccagaaaagaaacggcccactgctgccgtgtgggcgtgtgatggagcccccatcaaccgtcgaaatccgccaggacggcagccagcgattatccgaagcccaatggtaccccatctacaatgccgtgcgaagggaagaaactgagaacaccgtgggaagcttgttacactttctgactaagctgcccgcatctgagacagcacacgggaggatttctgtgggcccatgcctgaagcaatgcgtgcgcgacacagtatgtgagtatagagcgacacttcaaagaactagtatctcacaatatattacaggttctttgttagaagccactacttccctcggagccagatcaggcctgctttctacttttggcggaagcacaggaaggatgatgctgaaggaacgccagcccggtccgagtgtggctaattcaaacgctttgccctctagcagtgctggcattagcaaagagctgatcgatctgcagcccctgatccaatttcccgaagaggtcgcatctatactgatggagcaggaacaaactatttaccgcagagtgctcccagtggactatctgtgtttccttactcgggatctggggacaccagagtgccaatctagcctgccttgcttgaaggcttcaatctcagcatctatcctgacaacccagaacggagagcataatgcgttagaagatctggtcatgcgatttaatgaagtgtcgagttgggtcacctggctgatactgacagccggttcaatggaggagaagagagaagtttttagctatttggtacatgtggccaagtgctgctggaacatggggaactacaatgccgtgatggaattcctggctggcctcaggagccgtaaggtcctcaagatgtggcaattcatggaccagtctgacatcgagacgatgcggtctctgaaagacgctatggcacagcatgagagctcctgcgaatataggaaagtggtaacacgggctctccacatacccggatgtaaggtggtgcccttttgtggagtttttttgaaggagctgtgcgaggtgctagatggcgcatcaggtctcatgaagctgtgtcccaggtacaatagtcaagaagagacactcgaattcgttgccgattattcagggcaggataatttcttacagagggtgggccaaaacggcctaaagaacagtgagaaggagagcacagttaactccattttccaggtaatccgtagctgtaatcgtagcctggagacggacgaagaggactcaccatctgaagggaattccagtaggaaatcctccctgaaagacaaaagccgctggcagtttattattggggatctgctggattccgataacgacattttcgagcaatcaaaagaatacgacagtcacggcagcgaagattcccagaaagccttcgatcacggcaccgagctaattccctggtatgtgctatcgattcaggccgatgtgcaccagtttttgctgcagggcgctactgttattcattatgaccaagacactcacctgtctgccagatgcttcctgcagctacagcctgataatagcactctcacctgggtaaaacccaccactgcaagccctgcaagtagcaaagctaaactgggtgtccttaataatactgccgaacccggaaagtttccactcctggggaatgccggattaagctctctgactgaaggtgttttagacctgtttgccgtgaaggcagtgtacatgggacacccaggcatcgatattcataccgtgtgcgtgcaaaacaagctgggctccatgtttctgagtgagacaggtgtgactctgctgtatggccttcagactactgacaatcgtttgttgcatttcgtcgcacccaaacatacagccaaaatgctctttagtggattactcgagctcacaagagcagttagaaagatgcgaaagtttccagaccaacggcagcagtggctgcggaagcaatatgtgtcactctatcaggaagacggcaggtatgagggccctactcttgcccacgccgttgagctattcggagggaggaggtggagcgcgagaaacccatcaccaggcacctccgctaagaatgccgagaaacctaacatgcagaggaacaatactctgggaatcagtaccactaaaaagaaaaagaagattttgatgagaggagaatcgggagaagttacagatgacgaaatggccacacgcaaagccaagatgcacaaggagtgtcgcagccggagcggtagcgatccccaggacattaatgaacaggaagagtctgaggtaaatgctattgccaacccccctaacccgctgccaagtcgtcgggctcattccctgacgacggctgggagtcccaatctagctgccggtacaagcagcccaattcgacccgtttcgtctccggtactgagtagctccaacaaaagtccctccagcgcttggagctcctcctcctggcacggacgcatcaaaggtgggatgaaaggatttcaatctttcatggtgtctgactcgaacatgtcctttgtggagttcgtagagctttttaagtccttttccgtgcgttcacggaaggatctcaaagatctgttcgatgtttacgccgtcccctgtaataggagtggatcagagagcgcccctctgtatactaatctgactatcgacgaaaacacatcagatctgcagccagacctggacctgcttacaagaaacgtaagcgatctaggcctgttcatcaagtccaagcagcagctctccgacaaccagcgccagatcagcgatgctatcgctgccgcatctatcgtgacgaatgggaccggcatagagtctacctcactgggaatctttggcgtgggtatcctgcagctcaatgacttcctagtgaattgccagggggaacattgtacctacgatgagattctctccatcattcagaagttcgagccatcaatcagtatgtgtcatcaggggctcatgagcttcgagggcttcgccagatttttgatggacaaagagaactttgccagtaaaaacgacgaaagccaagaaaatattaaagagctgcagctccctttgtcctactactacattgagtcaagtcacaatacatacctcacaggtcatcaactgaaaggggaatcatccgtggagctctacagccaggtgctgctgcaaggctgccgctcagtcgaactggattgctgggacggagacgacggcatgccgatcatttatcatggtcacaccctgaccacaaagattcccttcaaggaggttgttgaggcaattgatcgcagtgctttcatcaacagcgacttaccgatcattattagcatcgagaaccattgtagcctccctcagcaacgcaagatggcagaaatatttaagacagtgttcggggagaagctggtaacgaagtttctttttgagacagatttcagtgacgatcccatgctgcccagtcccgatcagttgcgcaagaaggtcctgctcaagaataaaaaactcaaagctcaccagactccagtagacattctgaaacaaaaagctcaccaactcgcctctatgcaagtccaggcgtataacggcggaaatgcaaacccgaggcctgccaacaacgaggaggaggaggacgaagaagatgaatacgactacgactacgagtctctgtccgacgacaacattctggaagacagacccgaaaataagtcctgtaatgacaagctccaatttgaatacaacgaggagatccctaagcgaatcaaaaaggcggataactctgcctgtaataaaggcaaggtttatgatatggagttgggggaagaattctatttggaccagaacaagaaagaaagccgccagatcgccccagaattaagcgatttggtgatttactgtcaagccgtcaaattccctggcttgagcacccttaacgcctctggcagtagccgagggaaggagcggaaatctaggaaatctatattcggcaataaccctggtcggatgagtcccggagagacagcctcctttaacaagacctctggcaagtcttcttgtgaaggtattcggcaaacgtgggaagagtcctcaagcccattgaacccaacaaccagccttagcgctatcattcgaacgccgaaatgctaccatatatcatcactgaatgaaaacgccgcaaaacggctgtgccgcaggtactcacagaagctgacacagcacaccgcatgtcagctcctccgtacctatccagccgcaacaaggattgactccagcaacccaaatccactcatgttttggctccacggcattcagctggtcgccctgaattatcaaaccgacgacctccccctccatttgaatgcagccatgttcgaggccaatgggggttgtggctacgtgctgaagccccctgtcctatgggacaagaactgccctatgtaccagaagttttctcccctggaaagggatctggactccatggatcccgcagtttattccctaaccattgtcagcgggcagaacgtgtgcccttcaaattctatgggctctccctgcattgaagtggacgtgctcgggatgcctctggactcatgccatttccgcaccaagcccattcataggaacaccttaaaccctatgtggaatgaacagtttcttttccacgtgcactttgaagatcttgtgttcctgcggttcgccgtagtcgaaaataactcaagcgcagttactgcccagagaatcatccctctgaaggcactgaagagagggtataggcatctgcaactgcggaacctgcacaatgaggttctggagatttcttcgttgttcatcaactcaaggcgaatggaggagaactccagcgggaacaccatgtctgccagctccatgttcaacaccgaagagagaaaatgtctgcagacccacagggtgacagtccacggagtgcccggacctgagccatttaccgtgttcaccattaatggcggaactaaggccaagcaattgttgcaacagatattgaccaacgaacaagatatcaagccagtcactacagattacttcctcatggaggagaagtatttcataagtaaggagaaaaatgagtgtcggaagcagccatttcaaagggctataggtccagaagaggagattatgcaaattttgtcctcctggttccccgaggaagggtatatgggacggatagtccttaagacccagcaggagaacctcgaagaaaaaaatatagtgcaggatgacaaagaggtcatcctgtccagtgaggaggagagttttttcgttcaggtgcatgatgtgtcccctgagcagccacgaaccgtgataaaagcccctcgggtgagcactgctcaagacgttatccagcagacactgtgcaaggccaagtactcatattcaatactgtccaatcctaacccgtccgattatgtgcttttggaggaagtcgtcaaagatacaacgaacaagaaaaccacgactcccaagtcttctcagcgggtcctgctggaccaggaatgtgtgttccaagctcagtcgaagtggaagggcgctggaaagttcatcctcaagctcaaggagcaagtgcaggcatctcgggaagataagaagaaagggatcagctttgcttcggagctcaagaagcttacaaaatcaactaaacaacctagaggcctgacttctccatcccagctgctcacatctgagtccatccagaccaaggaggagaagccagtggggggtttgtctagctctgataccatggattaccgacagtac

SEQ ID NO: 234911 - DNA, 5985 bp, Artificial Sequence
  Description of Artificial Sequence: Synthetic coding sequence
atggtgagcgaaggctctgctgccggacgtgactttgcaggcatggaagaagtgaggcaactccatgtgaggttctgtaaaggtattaaaatatggcaccaggcctggtttctgtgctctctgctggggagagagcctcaagagcgggaggccggttgccagttgtggctttgtacactgtccgctgtgctgaaggtggggtggctgttccccctgagtgaggttcccaattttacccttctcaaagatgggtgcggctgctggaggctgaaggaagatcaaatttacaatgcagtgcggagggaagagactgagaatacggtgggaagtttgctgcatttccttaccaaactcccagcaagtgagaccgcgcacggcaggatatcagtcgggccttgtctgaagcagtgcgtcagagatacggtatgcgagtatagagcgacacttcagcgcacatcgatcagccaatacattacaggcagtctgctggaggcaacaacttcgttgggagctaggtccgggctgctgtcgacttttggaggctctaccggcaggatgatgttaaaggagagacagcctggacccagtgtggcgaacagcaatgccctcccaagtagctctgccggtatcagtaaggaactgatcgacttgcagccactcatccagtttccggaagaagtcgctagtatactgatggagcaagaacagacaatttatcggagggtccttccagtggactacctctgtttcttaacccgcgacttagggacacctgagtgccagagctctcttccctgcctgaaggcctcaatctccgccagcattctcactacacagaacggggagcataacgccctggaagacctagtcatgcggtttaacgaggtcagcagctgggtgacatggctcatcctcaccgcaggatccatggaggaaaaacgcgaagtattcagttacctggtacacgtcgcgaagtgttgttggaacatgggcaattacaatgcagtgatggagttcttggccggtttgcgctcaaggaaagttctgaagatgtggcaattcatggatcagtctgatatcgagacaatgagaagtcttaaagatgccatggctcagcacgaaagtagctgtgagtaccggaaggtcgtgacacgcgctttgcatattccaggctgcaaagtggtgcctttctgtggagtatttcttaaggagctttgtgaagtgttggatggcgcttctggccttatgaagctctgtcctagatataactcccaggaggagacacttgaattcgtcgcggattacagcggccaagacaacttcctgcagcgggtgggtcagaacggacttaaaaatagcgaaaaggaatctactgtgaatagcatctttcaggtcatccgcagctgcaaccggtcccttgagaccgacgaggaggattccccctccgagggcaactcctccaggaagagtagcctgaaagacaagagcagatggcagtttattattggggatcttctggactccgataatgatattttcgaacagagtaaagagtacgacagccacggctctgaggacagccagaaggcgttcgatcacgggactgagctaattccatggtacgtgctgagcatccaggctgatgtacaccagttcttactgcagggagcaactgttattcactatgaccaggatacccacctgagcgcgagatgctttcttcagctgcagccggataacagtactctgacgtgggtaaaacctaccacagcatcccccgcttcttctaaggcaaagctaggcgtacttaataacaccgcagagccaggaaagttcccgctcctggggaatgccggattgtcctcacttacagagggggtactggacttatttgccgtgaaggcagtctatatgggccaccctgggattgacatccacactgtctgcgttcagaataaattgggctcaatgtttttgtccgagacaggtgtgacactgctttatggattacaaacaactgataatagactgctgcacttcgtggcacccaaacacaccgccaagatgctgttctccggcctgttggaactaacgcgggcagtacgcaagatgcggaagtttcccgatcagcgtcagcagtggcttaggaaacagtacgtctccctgtatcaggaggacggcaggtatgagggtccaaccctggcccacgctgtagagcttttcgggggacgtagatggtcagccaggaacccaagcccgggaacaagtgcaaagaacgcggagaaacccaacatgcagcgaaataacaccctcggtatttcgactacaaagaaaaagaaaaagattctgatgagaggggagagcggggaggtaactgacgacgaaatggccactcggaaagctaagatgcataaagaatgcaggtcccggtcggggagtgacccacaggacattaatgaacaggaggagtcagaggtgaatgcgatcgccaacccaccaaatcccctgcccagccggcgtgcacactccttaacaaccgctggctctcctaacctagccgcaggcacctctagccctatcagacctgtgtcctcacctgtccttagctctagcaataagagtccctcatccgcttggagcagctccagctggcacggtcggatcaagggaggcatgaagggattccagtccttcatggtgtcggattccaatatgagtttcgtcgagttcgtggagttgtttaagtctttctcggtgaggtctcggaaagatctgaaggatctcttcgatgtctatgcagtgccctgcaacagaagcggctccgagtctgctcctctctacacaaatctgactatcgatgaaaatacttccgacttgcaacctgatttggacctgctgacgagaaacgtttcagacctaggcctctttatcaagagcaagcagcaactctcagataaccagcgccagatctcagacgctattgctgccgcatcaatcgtcactaatggaactggtatcgagtccacatctctggggatattcggggtcgggatccttcagcttaacgattttctggtcaactgccaaggtgaacactgcacctacgacgaaatactgtccataatccagaagttcgaaccttcaataagcatgtgtcaccaaggactgatgtcatttgaggggttcgccagattcctgatggacaaagagaattttgcttcaaagaatgatgaaagccaggagaacataaaagaacttcaactgcccctgtcctactactatattgagagctcacacaatacatatctcaccgggcatcagctcaagggtgagtcttccgtcgaattgtattcacaggtgctgcttcagggatgtcgctcagtggaattagattgctgggacggcgatgatggcatgcctatcatctaccacggccatactttgactactaagatcccctttaaagaggtggttgaggcaatcgaccgctcagcatttattaactccgacctgccaataatcatttccatcgagaatcattgctcacttccgcagcagcggaaaatggccgaaatattcaagaccgtattcggtgagaagctggttaccaagttcttatttgaaacagatttctccgatgatcccatgcttccttcacccgatcagttaagaaagaaagtgttgcttaaaaacaaaaagttaaaagcccaccagacgccagttgacatactgaaacagaaggcacatcagctcgccagcatgcaagtccaggcttacaacgggggaaatgcaaacccgagaccagctaataacgaagaggaggaagacgaggaagatgagtacgattatgattacgagagccttagcgatgacaatattctggaggatcgtccagagaacaagtcttgtaacgataagctacagttcgagtataacgaggaaattccaaagcggataaagaaagctgataattctgcctgtaataagggcaaggtctacgacatggaactcggggaagagttttaccttgaccagaacaagaaagagagccgtcaaatcgccccagaattgtctgacctggtcatctattgccaggcagtcaaatttcccggtttatccacactgaatgcatcgggcagcagtcggggaaaggaacggaagtctagaaagagtatattcggaaacaatccgggtcgaatgtcccccggtgagacagccagtttcaataaaaccagtggcaaatcaagttgcgaggggattcggcagacgtgggaggagtcttcttcaccgctcaaccctactactagcttatctgccatcattagaactcccaagtgttaccacattagctctcttaacgaaaacgccgcaaagaggctctgccgtcgttacagtcagaagttaacccagcacactgcttgccaactgctgcggacatatcctgcagcgacgcggatcgatagttcaaaccctaaccccttaatgttctggttgcacggcattcaactcgtggctttgaactaccagacggacgacttgccgctgcaccttaacgctgccatgttcgaagcaaacggcggatgcggatacgtacttaagcccccagtcctctgggataagaattgtcctatgtaccaaaagttttcccccctggaacgcgacctggactctatggacccggctgtttactctttaacaatagtgtccggccagaacgtttgcccatcaaacagtatgggaagtccttgcattgaagtggacgtattaggaatgccccttgacagttgtcactttaggaccaagcctattcataggaatacactcaaccctatgtggaacgagcagttcttatttcacgtacacttcgaagatctggtttttcttagatttgccgtggtggaaaataactcctctgcagtgaccgcacagagaatcatccccctgaaggctctgaaacgaggatacagacatttgcaacttagaaacctccataacgaagtgctcgagatctcgagcctgttcattaattccagacggatggaagaaaatagttccggcaacaccatgtctgcctccagcatgtttaataccgaagagcgcaagtgtttgcaaactcacagggtgacggtccatggcgttccaggccctgaaccgttcaccgtgttcactattaatgggggaaccaaagccaagcagctgttacagcagatattaaccaatgagcaggacattaagccagtgaccaccgactactttctgatggaggagaagtatttcatttccaaggagaaaaacgagtgcagaaaacagccattccagcgggctattggccctgaggaggaaatcatgcagatcctgtcttcctggttccctgaagagggctacatggggagaattgtcttgaagacccaacaagagaacctggaggaaaagaatatcgtgcaggatgacaaagaggttatactgtcgtccgaagaggagagctttttcgtgcaggtgcatgacgtcagccccgaacaaccgaggacagtcataaaggcgccaagagttagcactgcccaggatgttattcagcagactctgtgtaaagccaaatattcatacagcatactgagcaatcctaatccgtccgattatgtgctactagaagaagtcgtgaaggacacgaccaataaaaagacaacaacacccaaaagtagtcagcgagtgctgctggatcaggaatgcgtcttccaagctcaatccaagtggaaaggtgctggcaaatttattctgaaattgaaggaacaggtgcaggccagtcgggaggacaagaaaaagggaatctcgttcgcgagtgagctgaagaaactcactaaaagtactaagcaaccccgtggactgacttccccttcccagctgctgacttccgaatccattcaaactaaggaagaaaagcctgtaggcggtctgagtagctctgatacaatggactaccggcaatac

SEQ ID NO: 234912 - DNA, 6938 bp, Artificial Sequence
  Description of Artificial Sequence: Synthetic coding sequence
atgactagcgaagagatgaccgccagtgtgctcatccctgttactcagcgaaaggtcgtgagcgcccaatctgccgcagatgagtcttccgaaaaggttagcgatattaacattagcaaggctcacacagtgcggagatcaggggagacgtcccatacaatatctcagttaaacaagttgaaggaagagccgagcggatccaatctgcccaagatcttaagcatcgcgagagaaaagattgtatcagatgagaacagcaacgaaaaatgctgggagaagattatgcccgattctgcaaagaatctgaacatcaactgtaacaatatcctaagaaaccaccagcatgggttacctcagagacagttttacgaaatgtacaactctgtcgccgaagaggacctctgcctcgagactgggatcccgtctcccctagagagaaaagtttttccaggtatccagctggaactggacagaccttcgatggggatttccccacttgggaaccagagcgtgatcatcgaaaccggtcgggctcaccccgattcccggagagcagtttttcattttcactatgaggtggaccgtaggatgagcgatacattttgtacactgtcagagaaccttatcctcgatgactgtggtaattgtgtgcctcttcccggtggcgaagaaaagcaaaagaaaaactacgtcgcctacacctgcaaactgatggaactggcaaaaaactgtgacaataaaaatgaacagctccaatgtgaccactgcgatactttaaacgacaaatatttctgttttgaagggtcttgtgaaaaggttgacatggtctatagcggagactccttctgccgaaaggacttcaccgattctcaggcagccaagaccttcctgtcacattttgaggattttcccgataactgtgatgacgtggaggaggacgcttttaagagcaaaaaagagaggtccaccctcctggtgcgtcgtttttgcaagaacgatcgggaggtcaaaaaatctgtgtacacaggcactcgggctatcgtgcggacgttgccatccggtcacattggtctgactgcatggtcttacatcgaccagaaacgcaacggcccattgctgccgtgcggtcgcgtgatggagcccccatccaccgtcgagatccgtcaggacggcagccagcgactgtcagaggcccaatggtatcccatctacaatgcagtcaggcgcgaggagaccgagaataccgtcggaagcttgctgcattttctgacaaaactacctgcttcagagaccgcccatggacgaatctctgttggcccttgcctgaagcagtgcgtcagagacaccgtttgcgagtaccgtgctaccctgcaacgaacttcgatttctcagtatatcacaggctctttattagaggcaacgacatccttaggcgctagaagcggcctgctcagtacattcgggggaagtactgggagaatgatgctcaaagaacgccagcccggaccctccgttgccaattcgaacgccctccccagctcttcagcgggaatcagcaaagaactgatcgacctccaacccctgatccagttcccagaggaggttgctagcatactgatggaacaggaacagaccatataccggagagttctgccagttgactacctatgtttcctgacaagagatctaggaacaccggaatgccagtcatcacttccatgtttaaaggcgtccatttcagcctctatcctgaccacccagaatggtgaacacaacgccctcgaggacttagtcatgagatttaatgaggtgtctagttgggtgacttggctgatcctaactgccggtagcatggaagagaagagagaggtgttttcttatctcgtccatgttgctaaatgttgctggaacatgggaaattataatgccgtgatggagttccttgccggtttaagatcgaggaaggtcctgaaaatgtggcagtttatggatcaatctgacattgagacaatgaggtctcttaaagacgctatggcccagcacgaaagttcctgtgaatatcggaaggtggtgactcgggctcttcatatcccaggatgcaaggtggttcctttttgtggagtgtttctgaaggagctctgtgaggtgctggacggagctagcgggctgatgaagttgtgtcctcggtacaattcacaggaggaaactttggaattcgtcgccgattactccggccaggacaattttcttcagcgcgtgggccagaatggcctaaaaaatagcgaaaaggagtccacagttaatagcatttttcaggtgataagatcctgcaataggtccctcgagacagacgaagaggacagtcctagcgagggtaacagtagccgaaagtcttccttgaaggacaaatcgcggtggcagttcataataggcgatctcctggactctgacaatgatatcttcgaacaatcaaaagagtatgactctcacggctccgaggattctcagaaggcctttgatcacggcactgagctgattccttggtatgttctgagcattcaagcagatgttcatcagtttctactgcagggtgctaccgtgatccactacgaccaagatactcacctatccgctcggtgtttcctgcagctgcagccagataattctactttgacatgggttaagccgaccacagcaagtcctgcctcctctaaagccaagctcggcgtgctgaacaataccgcggagcccggaaaattccccctgttgggaaacgctggcctgtctagtctgacagaaggcgttttggatctgtttgctgtcaaggccgtgtatatggggcatccaggtattgatatccacacagtgtgtgtgcagaataagctgggctcaatgttccttagcgagaccggagtgactctgctgtacggcttgcagaccactgacaaccgcctgctgcactttgtggctccaaaacataccgctaagatgctgttttccgggctgctggaactgactcgggctgttagaaaaatgcggaagttccctgatcagagacagcagtggctccgcaaacagtatgtctctctgtaccaggaggacgggcgatacgaaggtccaactctggcacacgcggttgagctgttcggcggaaggcgctggtctgcccgaaatccctcccctggtacgagcgcaaaaaacgccgaaaaaccgaacatgcagagaaataacaccctggggatatcgacaactaagaagaagaagaagatcctgatgaggggcgagagcggggaagtgacagacgatgagatggcaacaaggaaggcaaagatgcacaaagagtgcagatcacgaagcggcagtgatccccaggacatcaacgagcaggaagagagcgaagtgaacgctatcgccaaccccccaaaccctcttccttccaggagagctcacagtctgactacagctggctctccaaatttagccgcaggaactagctctcccattagacctgtatcatccccagtcctgtccagctctaacaaatccccgagtagtgcgtggtcatcgtcatcttggcacggcaggatcaaagggggtatgaaagggttccagagcttcatggtgagtgactccaatatgtcctttgttgagttcgttgaactctttaagagcttctcggtaagatcaagaaaggacctgaaggacctatttgacgtttatgccgttccttgcaaccgatctggctcggagtctgccccattgtacactaatctcacaatcgatgaaaacacgtctgatctgcaacccgatctcgacctccttacccgtaacgtatcagatctcgggttgttcatcaagtctaagcaacagctgtcggacaatcagagacagatctccgacgccatcgccgctgcatctatcgtgactaatggtacgggaattgaatctacgtctctgggcatcttcggcgttggcatcctgcagctcaatgactttttagtaaattgccagggtgagcactgtacctacgacgaaatcctctccattatccagaaattcgagccatccatttccatgtgtcaccaaggactgatgagcttcgaaggttttgcacggtttcttatggataaggagaattttgcctctaaaaacgatgagagccaggagaacatcaaagaactgcaactccccctgagctactactatatcgagagcagtcacaacacgtatctgacaggacaccagctgaagggtgagagcagcgtcgaactctatagccaggtattgctccaagggtgccgatcagtcgaattggattgttgggatggcgatgatggaatgcccattatttaccacgggcatacattgacgacaaaaatcccgtttaaagaagtagtggaagccatcgatcgctcggcattcatcaattcagatctccccatcataattagtatcgagaatcactgctctctgccccaacagagaaagatggccgagattttcaaaacagtgttcggcgagaagctggtcaccaagttcctgttcgagactgacttcagcgacgatcctatgcttccttcacctgaccaactccgaaagaaagtgttgttgaaaaataaaaagctgaaggcccatcagactcctgttgacatactcaagcagaaggcacaccagttagcaagcatgcaggtgcaggcctataatggtggaaatgccaatccacgacccgcaaataacgaggaggaagaagacgaggaggatgagtacgattacgattatgaatccctttccgatgacaacatccttgaggaccggccagagaacaaatcctgcaatgacaagctccagttcgagtacaacgaggaaattcctaagaggattaaaaaagcggacaacagcgcctgtaataaaggtaaagtgtatgacatggagctgggcgaggaattttacctggatcaaaacaaaaaggaatccagacagatcgcccctgaactgtcggacctcgtcatttactgccaggcagtaaagtttccaggcctgtccaccctcaatgcttcaggcagctcccgcggaaaggagaggaaatctcgcaagagcatattcgggaacaatcctgggaggatgtcacccggtgaaaccgcatcctttaacaagacgagtggaaaaagctcttgcgaaggcatccgccagacatgggaggaatcctcctctcctctgaatccaaccacctccctgagtgctatcattcgcacccctaagtgttaccatatttcctccctgaacgagaacgccgctaagaggctgtgtcgtagatattcacaaaagctcactcagcatacagcgtgtcaattgcttcgcacctaccctgctgccactcgaatcgatagcagcaatccaaatcctctgatgttctggctgcacggcatacagctagtcgccttaaactatcaaacagatgatctgccactccacctgaacgctgcaatgtttgaggctaatggaggatgtgggtacgttctgaaaccccctgtgctatgggacaagaattgcccaatgtaccagaagttctcccctctggaacgcgacctagacagtatggatcccgcagtgtacagccttactattgtgagcggccaaaacgtttgcccctcaaactcaatgggatctccttgtattgaagtcgacgtgctgggcatgcccctcgattcatgtcacttcagaactaagccgattcacagaaacacactgaacccaatgtggaacgaacagtttctgtttcatgtgcactttgaggacctggttttcctgaggtttgctgtagtcgaaaataacagctctgcggtgaccgctcagcgaataataccgctgaaggccctgaagcggggttacagacaccttcagctgcgaaatctccacaatgaagttctcgagattagttccctatttattaattcccgcaggatggaagaaaattcatccgggaatacaatgagtgcaagctctatgttcaatactgaagaacgtaagtgtctgcaaacccatcgcgttactgtccatggggtaccaggtcccgaaccatttacagtgttcactatcaatggagggacgaaagcaaagcaactgctgcagcagatactcacaaacgaacaggatataaagcccgtgactacagactacttcctaatggaggaaaaatattttatctccaaagaaaagaacgaatgccggaagcagcctttccaacgcgctatcggccctgaagaggagatcatgcaaatcttgtctagctggttccccgaggagggctacatgggaagaatagtgttaaagacccagcaggagaatctcgaagaaaaaaacatcgtgcaggatgacaaagaggtgattcttagttccgaagaggagtcctttttcgtccaggttcacgacgtgtccccagagcagccccgaacagtgatcaaagccccaagggtgtctacggctcaggatgtgattcagcagaccctctgtaaagcaaaatatagctactcaattttaagcaacccaaacccaagtgattacgtgctgcttgaagaggttgtgaaggataccactaataaaaagaccaccacacctaaatcttcccaaagagtgttactggaccaggagtgcgtgtttcaggcgcagagcaaatggaagggcgctgggaagttcatactgaagctgaaagaacaagttcaggcttctagggaggataagaaaaaaggaatcagctttgcctccgagttgaaaaagcttacaaagtctaccaaacaaccaagagggctcaccagccccagccaacttctaactagtgaaagcatccagacgaaagaggagaagcctgtgggcggtctcagctctagcgacaccatggattaccgccaggttaagatcttcaaacaagaagtaaaggagta

SEQ ID NO: 234913 - DNA, 5985 bp, Artificial Sequence
  Description of Artificial Sequence: Synthetic coding sequence
atggtctccgaaggcagtgccgcaggtcgtgatttcgccggtatggaggaagtgagacagttgcacgtgcgtttttgcaagggtatcaagatttggcaccaggcatggtttctatgtagtctgctgggcagagagccacaggaacgagaagcaggctgtcagctgtggctgtgcacactgtccgccgtgctcaaggtcggatggctgttcccactttccgaagtgcccaacttcacacttctgaaggacgggtgtggctgttggaggctgaaagaggaccagatatacaacgcagtgagacgcgaagaaacggagaacaccgtgggctctctattacacttcctgaccaaactgcccgcttcagagacggcacacgggagaatcagcgtcggcccatgccttaaacagtgcgttagagacacggtgtgcgaataccgagctactctgcaaaggaccagtatttcccaatacatcaccggctccctgctcgaggcaacgacttccttaggggctcggtcagggctactgagcactttcggagggtcaactgggaggatgatgctcaaagaaaggcagccaggtccttcagtggcgaattctaatgccttgccttcttctagtgccggaatttccaaagagctaatagacctgcagcccctcattcagttcccagaagaggtggcctctatcctgatggagcaagagcagactatctatagacgagtgttgcccgtggattatctttgctttctgacacgggacctcggcacccctgagtgccagtcgtcactgccatgtctgaaggcctccatcagtgcctctattctcactacgcagaacggagaacacaacgcccttgaggatttggtaatgaggtttaacgaggttagctcttgggtgacttggctgatcctgacagcgggaagtatggaggaaaaaagggaggttttcagctaccttgtccatgtggcaaaatgttgctggaacatgggcaactataacgccgtgatggaatttcttgctggcctgcgctccaggaaagttcttaaaatgtggcagttcatggatcagtcggacatcgagactatgcgttccctgaaggatgcaatggctcagcatgaatccagctgtgagtatagaaaggtggttacacgagctttgcacataccaggctgcaaagtagttcccttttgtggggtcttcctcaaagagctgtgtgaagtgctggatggagcctcaggcttaatgaaactgtgcccacgctacaacagccaggaagaaaccctggagttcgttgcagattacagcggacaagataatttcctccagagggtgggccagaacggccttaagaatagcgagaaggagtccacagtgaattctattttccaggtgatcagatcttgtaataggtcactcgagacagatgaagaggatagcccatctgagggaaattcgtcgcgcaagagctcactcaaagacaaaagccgctggcagttcatcatcggcgatctgctggattccgacaatgacatattcgagcagagtaaagaatatgatagccacggtagcgaggacagtcagaaggcattcgaccacggcaccgagttaataccgtggtacgttctttcgattcaggctgacgtccaccaatttctgctacaaggagccaccgttatccactatgatcaggatacccacctaagtgcaagatgctttcttcaacttcagccagataactcaaccctgacatgggtgaaacctacgacagcctcaccagcatcgagcaaggctaaattgggagttctgaacaacaccgccgaacccggaaaatttcccctcttaggaaacgccggactgtcctcgctgacggagggagtcctggacctcttcgccgtgaaggcggtgtatatgggccacccgggaatcgatattcacaccgtatgtgtgcaaaataagctagggtcgatgttcctcagtgagacaggagtgaccttgctgtatggtctgcagacgaccgataaccggctgttacacttcgtggcgccaaaacacacggccaaaatgctcttttcaggcctgctagagttaactcgagcggtaaggaaaatgagaaagtttcctgaccagcgccagcaatggctgcgtaagcaatacgtctcactatatcaggaggacggtagatatgaaggaccgactctcgcccacgcagtggagctgtttggaggacggaggtggagcgccagaaaccccagccccggtacgtcagctaagaacgcggagaaaccaaatatgcaaagaaacaacacactgggaatttctactactaagaaaaagaagaagattctgatgcgcggtgaatccggcgaggtgactgacgatgagatggccactagaaaggcaaaaatgcacaaggaatgcaggtctcgctctggaagtgacccacaggacattaatgaacaagaggagagtgaggtgaatgccatagctaatccacccaacccgctcccctcaaggcgcgcacactctctcacaacagctggctcgcccaatcttgctgccggaacttcatcccccatcaggccagttagcagtcccgtcctaagttcttctaacaagtctccgtcttctgcctggtcttcctcgtcttggcacgggagaattaaaggaggcatgaaggggtttcagtcctttatggtaagcgatagcaacatgtcgttcgtcgaattcgtggaattatttaagtctttctcagtgaggagtagaaaagatctgaaggatttgttcgacgtgtatgcggttccttgtaaccgatctggctctgagagtgccccactgtataccaatttgacaatcgacgagaacacctccgacctccagccggaccttgatctgttgacaaggaacgtgagcgacctgggtctttttatcaaatcgaagcaacagctcagcgataatcagaggcagatctccgatgctatagccgctgcttccattgtaacaaatgggacaggtatcgagagcacatccctcggaattttcggcgttggtatcctccagctcaacgatttcctggtcaattgtcagggggaacactgcacatacgacgagatcctgtccattatccagaagttcgagccttctatatctatgtgtcaccagggactgatgtcctttgagggtttcgcaagattcctgatggacaaagagaacttcgcatccaaaaacgacgagagccaggaaaatataaaagagctacagttgccacttagctactactacattgaatcgtcccacaacacctacctaacaggtcaccagctgaaaggggagtctagcgtggagctttattcccaagtccttctgcaggggtgtcgatcagtagagctagattgctgggatggagatgatggcatgccgatcatataccacggacacactctgactacgaagatcccgtttaaggaagtagtagaggcgatcgacagatctgcttttataaactctgatctccctattatcatatctatcgagaaccactgcagcctaccacagcaacgcaagatggccgaaatctttaagacagttttcggggagaaattagtcacgaaatttttgtttgaaactgatttcagtgatgatcctatgctccccagccctgaccagctgagaaaaaaggtattgctaaagaacaagaagttaaaggcacaccagacaccggtggacatcctcaagcagaaggctcatcagctcgccagcatgcaggtgcaggcatataacggaggcaacgcgaacccaagaccagctaacaacgaggaggaagaagatgaagaggatgagtacgactatgactatgagtccctgtctgatgacaatattttggaagacagaccagaaaacaagagttgtaacgacaagctccagtttgagtacaatgaggagattcccaagcgtattaaaaaagctgacaacagcgcttgtaacaagggtaaagtgtatgatatggaattgggcgaggagttctatctggatcagaacaagaaagagtcacggcagattgcacccgagttaagcgatctggttatctactgccaagcagtaaaattcccagggctgtccactctcaacgccagcggctcaagccgtggcaaggagaggaaatctcgaaaatctatcttcgggaacaacccgggtagaatgagcccaggcgaaacagcttcctttaacaaaactagcggcaagagctcttgcgagggcatccgccagacctgggaggaatctagttcgcccctcaatcctaccacaagtttgtctgctataattagaacccctaaatgctaccatatatccagcctgaatgagaacgcagctaagcggctctgcaggcgatactcccagaagcttactcagcatacagcatgtcagctcctgcggacatatcccgcagccacccgtatcgattcatctaatcccaacccactcatgttttggctgcacgggatccagcttgtggcgctcaactaccaaacagacgacctgccactccacctaaacgcagccatgttcgaggccaacggcggttgcgggtatgtgctaaagccccctgtgctgtgggacaagaattgtccgatgtaccagaaattttcaccacttgagcgagatctcgattcaatggacccagctgtgtactccctgaccatcgtgtccggacagaatgtgtgtcccagcaactctatggggtccccgtgtatcgaagtggatgtcttggggatgcctctagactcgtgccacttccgcaccaagccaatccataggaacaccctcaacccaatgtggaacgagcagtttctgttccacgtccatttcgaagatctggttttccttcggtttgctgtggtcgaaaacaatagctcggccgtcactgctcagaggatcatccccctaaaagccctcaagcgcggttatagacacttacagctccgcaacctgcacaacgaggtattggaaatcagctctcttttcattaactccaggaggatggaagaaaactcatcaggaaacaccatgagcgcttcttcgatgttcaacactgaagaacgcaagtgtctccagactcacagagttactgtacatggggtgcctggcccagagccattcacggtcttcaccataaacgggggaaccaaggctaaacagctcttgcagcagatcctcacaaatgagcaagatattaagcccgtgacaactgattacttcctgatggaggaaaagtacttcatcagtaaggaaaagaatgaatgtcgaaaacagcccttccagcgcgcaattggcccagaagaggagataatgcagatcctatcttcttggttccctgaagaaggctacatgggtcgcatcgtccttaagacccagcaggagaaccttgaggaaaaaaacattgtccaggatgataaggaagtgatcctgtcctccgaagaagagtccttctttgtgcaggtacatgatgtcagtcccgagcagccacgcactgtgattaaagctccacgcgtgtctacggctcaagacgtcattcagcagactttgtgcaaagctaaatactcatacagcatcctctccaaccctaacccgagcgactacgttcttctggaggaagttgtcaaagatactaccaataaaaaaaccacaactcctaaaagttcacaacgtgtcttgctggatcaggagtgcgtctttcaggcacaatctaagtggaaaggggctggaaagttcatcctgaaactcaaggaacaggtgcaggcaagcagggaagataagaagaaaggcataagcttcgctagcgaattaaagaaattaaccaaaagtactaaacagccacgcggtcttacttccccttctcaattgctgacgtcagaaagtatccagacaaaggaggaaaagcccgtggggggtctttcaagcagcgataccatggattatcgacaatat

SEQ ID NO: 234914 - DNA, 4968 bp, Artificial Sequence
  Description of Artificial Sequence: Synthetic coding sequence
atgtctgttatgcagagcggaacgcagatgatcaagcttaaacggggtacgaaggggctggtcagattgttctacctagatgagcacagaactcggctacgttggcggccatcacgaaaatctgaaaaagctaaaattcttattgacagcatctataaggtgacggaggggcgtcagtcagaaatatttcaccgtcaggccgaaggcaattttgatccatcgtgttgtttcactatataccacgggaatcatatggagtccctggacctaattacatccaatccagaggaagcacgaacctggatcacgggtttaaagtatttaatggctggcatcagcgatgaggattccttagccaagaggcagcgaactcacgaccagtgggttaagcagactttcgaagaagccgataaaaatggcgacggtcttctgaacatcgaggaaattcaccagttgatgcacaagctaaacgttaacctacccagaaggaaggtccgtcagatgtttcaggaggcagatactgatgagaaccagggaactctgacttttgaagagttctgtgtcttttacaaaatgatgtctttgagacgcgacctgtatctgctccttctgtcttacagcgacaagaaggaccatcttacggtcgaagagctggcccagtttcttaaagtcgagcaaaagatgaataatgtgactacagactactgtctcgacattattaagaagttcgaggtgtcagaggagaacaaggtcaagaatgtactgggtatcgaagggttcaccaacttcatgaggagtccagcctgtgacatatttaacccacttcatcacgaggtataccaagacatggatcaacctctctgcaattactacatcgcttcttcgcacaacacatacctgacgggggaccagctgctaagccagtccaaagttgatatgtacgctcgagtcctccaagaaggttgcaggtgcgttgaggttgactgctgggatgggcctgacggggagccggtggttcaccacggatatactctaaccagtaagattctgtttagagatgtggtggaaacaattaacaagcacgcattcgttaagaatgagtttccagttatactgagtattgaaaaccattgctccatccagcagcagcgcaagatcgcccaatatctgaaagggatcttcggcgacaagttggatctgagctcggtggacacgggagagtgtaagcaactcccatcgccgcagtctctgaaggggaaaatcctggtgaaaggcaagaaattgccttaccaccttggcgacgatgctgaggagggtgaagtttcagatgaggattccgctgatgagattgaggacgagtgcaaattcaaactacattacagcaacggcacgaccgagcaccaagtggagagcttcattcggaagaagctcgaatcattactgaaggaatcacaaatccgtgacaaggaggaccccgactcatttactgtgagagccctcttaaaggctacacatgaaggactgaatgctcacctcaaacagtctccagatgtgaaagagagcggcaaaaaatcccatggcagatctttaatgactaatttcggtaagcacaaaaaaacaactaaatcaaggagcaaatcttattctacagacgacgaggaggatacccagcagtcaacgggtaaggaaggcggtcagctgtaccggctgggacgacggaggaaaaccatgaaattgtgtagggaactgtccgatttagtcgtgtataccaattccgtggctgctcaagacattgtggatgatgggaccacaggaaatgtgctctccttttcagagacaagggctcatcaggtggtgcagcagaagtcagagcagttcatgatctataatcagaagcagctcactaggatttatccttcagcataccggattgatagctctaactttaacccacttccctactggaacgctggatgccagctggtggcgttgaattatcagagcgaagggagaatgatgcaacttaaccgagctaagttcaaggctaatgggaattgcggctacgtgttgaagccccaacagatgtgtaaaggcaccttcaatcccttcagcggcgaccccctgcctgctaatcctaagaagcaacttatactgaaagtgatatccggccaacaactgcctaagccaccagattctatgttcggcgaccgaggtgagattatcgatccattcgtcgaggttgaaattattggactgccagtggactgttgcaaagatcagacacgagtcgtggacgataatggctttaatcctgtctgggaggagaccttgacattcacagtgcatatgcccgagatcgcgcttgtccgctttttagtgtgggaccatgaccccataggcagggactttgtaggacagaggactgttacattctccagtctcgttccagggtatagacatgtgtacttggaaggcttaaccgaggcgtccatctttgtgcacatcacaattaacgagatatacggcaaaaatcgacagttacagggcctgaaaggactgtttaacaagaacccaaggcactctagctcggagaataatagccattatgttaggaagcgctctatcggcgatagaattctgaggaggactgccagtgcacccgctaaggggcgaaagaagtccaagatgggattccaggagatggtggaaattaaggacagtgtgtctgaggccacccgagatcaggacggtgtcctgagacgtactacaaggtccttgcaggcccgacccgtttcaatgcctgtggataggaacctcctaggtgccttgagtctgccagtgagtgagaccgcaaaggacatcgaaggcaaggaaaattcattggctgaagataaggacggaaggagaaaaggcaaagcgtccatcaaggaccctcattttttgaacttcaataaaaaattatcctcctcatcaagcgccctgttacacaaggacaccagccagggcgataccattgtttcgactgcccacatgagcgtaacgggggaacagctgggcatgtcttcgccaagaggtggcagaactacgtccaacgcaaccagcaattgccaagagaatccttgccctagcaagagtttgagccctaagcaacatttggcgcctgaccccgtggtgaacccaacccaggatttgcatggcgtaaagattaaggaaaaaggcaatcctgaagattttgtggaagggaaatctatactcagtggctcagtgttgtcacattctaacctggagataaaaaacctggaggggaatagaggcaagggtagggccgcaacgtcgttctccctgagtgatgtctcgatgctgtgtagtgatattccagatctgcattctactgccattttgcaggagtcggttattagccaccttattgataatgttaccctcaccaacgagaacgaaccaggatcctctatttcggcgctcataggacagttcgatgagaccaataatcaagcactgactgtggtgtcccatttacataacacaagtgtcatgtctggacattgtcctctgccctccctggggttgaagatgcctatcaagcatggcttctgcaaaggtaagtccaagtcctcatttctctgtagctctccagagctgatcgctctgagctcttcggagaccactaagcatgcaaccaacacggtgtacgagacgacatgcacacctatcagcaagaccaagccagatgacgatctttcctccaaagccaagactgcggctctcgagtcaaaccttccgggttccccaaacacctcacgcggttggttgcccaaaagccctactaaaggcgaagactgggagaccctcaaatcttgcagccccgcaagcagtcccgacctgaccttggaggatgtgattgccgatccaaccctctgtttcaattctggggagtcgtctctcgtcgagattgatggggagtccgaaaacttgtccctcaccacctgcgagtatcggagagaaggaaccagccagctggctagtccattaaaactgaagtacaatcaaggagtcgtggaacactttcagcgaggtctccgtaacggatattgcaaggagacattacgcccaagtgtgcccgagatcttcaataatatccaggacgttaaaacacaaagcatttcctacctcgcatatcagggggctggcttcgtgcacaaccatttcagcgattccgacgctaaaatgtttcagacctgtgtgcctcagcagtcatctgcacaggacatgcatgtgcccgtaccaaaacaactcgcacacctgcccctgcccgcattaaagctgcccagcccgtgcaagtctaaaagcctgggtgacctgactagcgaggatattgcatgcaactttgaaagtaaataccagtgtatttccaaatcattcgtgacaacaggcattagagacaagaaaggcgtcaccgtgaagactaaatcactagagcccattgatgctttgacggagcagttgcgcaaattggtgagttttgaccaagaggataattgtcaggtgctctattcgaagcaagacgcgaaccaattacccagggccctggtccggaaattgtccagcagatcacaatcacgagtgcgtaatattgcatcacgcgctaaggaaaaacaggaggcgaacaaacaaaaggtccctaacccaagcaatggtgcgggagtcgtcctgcgtaataagccgagtgccccaactcctgctgtaaatagacacagcacgggatcctatatagccggatacttgaagaataccaagggcggaggattagaaggacggggtattcccgaaggtgcttgcacagcattgcattatggtcatgtcgatcagttttgcagcgataattctgttcttcagacagaacctagctcagacgacaagccggagatatacttcttattgcgcctgtag

SEQ ID NO: 234915 - DNA, 5081 bp, Artificial Sequence
  Description of Artificial Sequence: Synthetic coding sequence
atggcagacctggaggtctacaagaatctgtcgcccgagaaggttgagagatgcatgtcagttatgcaatctggaactcaaatgattaaactcaaaaggggtaccaagggccttgtgcggctgttttaccttgatgagcatcgaacaagactcagatggaggccttctagaaagtctgagaaagccaagatcctgattgattcaatttacaaggtcacagaaggacgtcaatcggaaatctttcatcgacaggccgagggcaattttgatccaagctgttgttttacaatttatcacggcaatcacatggaatcattggatcttatcacttcaaacccagaggaagccaggacctggattactggcctaaagtatctcatggctggaatttcagatgaagattccctggctaaacgccagagaacccatgaccagtgggtgaaacagacctttgaagaagcagacaaaaatggcgatggcctcctaaatatcgaagagatccaccagctgatgcacaaactgaatgttaacctgccacggagaaaggttcgccagatgttccaagaggcagacacagacgagaaccagggtactctcacttttgaggagttctgtgtgttctacaaaatgatgtcactacgcagagacctgtacttacttttactttcctactcagataaaaaagatcatctcaccgtggaggaacttgcccaatttctaaaggtagaacagaagatgaacaatgttaccacagactattgtctggatatcatcaagaaattcgaggtgagcgaagagaacaaggtcaaaaacgtcctaggtatcgaagggttcactaacttcatgcgctcacccgcttgcgatatatttaatcctctgcatcacgaggtctaccaggacatggaccaaccattgtgcaactactacatcgcttcctcccataatacttacctcacgggcgaccaactgttgtctcagagtaaggtggatatgtatgcacgcgttttgcaagaaggctgccgttgtgtagaagtggactgttgggacggcccagatggggagcctgtcgtgcatcacggctacaccctgactagcaagattctgtttcgtgacgtagtggagactattaataaacacgcttttgtcaagaacgaattccctgttattctgagcatcgagaatcactgtagtattcaacagcagagaaaaattgcacaatacctgaaggggatcttcggcgacaagctggatctctcttcggtggacacaggcgaatgtaagcagttgccatccccacagagtctaaagggcaagattctggtcaaaggaaagaagctgccttaccacctcggcgatgatgccgaggagggtgaggtttcagatgaggactctgccgacgaaattgaggatgaatgcaagttcaagttgcactactcaaacggtaccaccgaacaccaggttgaaagctttattcggaaaaagctcgaaagtctgttgaaggagtcccaaatcagagataaagaagatccagactccttcactgttagggccctgctaaaagctacgcatgagggcttgaatgcccacctcaaacagagtcctgacgtgaaagagtctggcaaaaaaagccacgggaggagtttgatgactaattttggaaagcacaaaaagaccaccaagagcagaagtaagagttattccaccgatgacgaggaagacactcagcaatctacaggaaaggagggagggcagctgtacaggctcggccgacggaggaaaacaatgaaactgtgccgggagctgagcgatttggtagtatataccaatagcgtggcggctcaggacatcgtcgacgatggcacaaccggtaacgttctgtccttcagtgagacaagagctcaccaggtggtgcaacaaaagtccgagcagtttatgatatataaccagaaacaactcacccggatatatccttccgcctacaggatcgattccagcaacttcaaccccttaccttactggaacgcaggttgccagttagtcgctctgaactaccagtcggaaggaaggatgatgcagctaaatagggctaagttcaaagccaatggcaactgcggctacgtgctaaaacctcagcagatgtgtaaaggtaccttcaacccgttctctggagatcccctgcccgcaaatcctaaaaaacagttaattctgaaagtgatttctggccagcaactgccgaagcctccggacagcatgttcggagatagaggcgaaatcatcgatccattcgttgaggtcgagatcatcggtctgcccgtggattgctgtaaagaccagaccagggtagttgacgacaacggttttaaccccgtctgggaagaaacactaaccttcacagttcacatgccggaaatcgccctagtgagatttctggtctgggaccatgatcccatcggtagagactttgttggacaacgaacggttaccttttcctcactggttccaggatataggcatgtttatctagaagggctcacagaggctagtatttttgtgcatattaccatcaacgagatctatggcaaatggagccctcttattctcaatccaagctacaccatcctgcatttcctgggtgcaactaaaaatcgccagcttcaagggctcaagggcctgtttaataaaaatcctaggcactcgtcatctgaaaacaacagccactatgtacgaaaacgaagcattggggatagaatcctgcgaaggactgccagcgccccagcaaaggggcgaaaaaaatccaagatggggttccaggaaatggtagagatcaaggattctgtatcagaagcaacccgcgaccaagacggagtactgcggcgtaccaccaggagccttcaggcgagaccggtgtcaatgcccgtagacagaaatctgctgggagccctttcactcccagtgagcgaaaccgcgaaagatattgaagggaaagagaattcactagctgaggacaaggacggtcgccgtaaaggcaaagcaagtatcaaggacccgcacttcctgaactttaacaagaagttaagctccagcagctctgcccttttacacaaggatacttcccagggagacaccattgtgagcaccgcccacatgagcgtcacaggggagcagcttggcatgtcatcgcctcggggaggcagaactacgtctaacgccacaagtaattgccaggaaaacccatgtccctccaagtctctgagccctaagcagcatttggcacctgaccccgtggtgaacccaactcaagatctgcacggcgtgaagattaaggagaagggcaatcccgaagactttgtggaggggaagtctatcctgagcggctctgtcctgtctcacagcaatttggagattaagaacttagaggggaacagggggaagggtcgagccgctacatcatttagcctctcagatgtgagtatgctgtgctctgacatcccagaccttcattctactgccatcctgcaggagtccgtcatctcccacctgatagacaatgtgacactgaccaacgaaaacgagccaggaagttccatttctgcgttaattgggcagttcgacgagacgaacaatcaagcgctgaccgtggtgagccacttacataacacatcagtcatgtccggccattgcccactgcccagtttgggccttaaaatgccgatcaagcacggattctgcaaaggaaagtcgaagtcttcattcctctgttcatcaccagaactgatcgcgttgtcgtcttcagaaaccacaaagcatgctaccaacacagtttatgaaaccacttgtacccctattagtaagactaaaccggatgacgacctctcatctaaagctaagactgcggcacttgaatcaaatctgccaggatcaccaaacacctcccgaggctggttacctaagtctcctaccaaaggcgaggattgggagacactgaagagttgttcccccgcttcaagccctgatctgacactcgaggacgtgattgcagacccaacgctgtgtttcaattctggagaatctagtctggtggagatcgatggggagtcagaaaacctttcattgaccacttgtgaataccgcagggaggggacctcacagctggcttcgccactgaaattgaaatacaatcagggcgtggtcgagcatttccagagaggcttgcggaacggatattgtaaggagactcttcggccatctgtcccagagatttttaacaatatccaagacgttaagacacagtcaatctcatatctggcttatcagggagccggttttgtgcataaccacttcagcgacagcgatgcaaaaatgtttcaaacgtgcgtcccccaacagtccagcgcccaggatatgcatgttccagtcccgaagcaacttgcccaccttcccctgcccgctctcaagcttccctcgccttgtaagagcaagagcttgggcgatctcacctctgaggacatcgcctgtaattttgaatcaaaatatcaatgcattagcaagtcattcgtcacaacaggcattcgcgataagaaaggggtaaccgtgaaaaccaagtcacttgaacccatcgacgctttgactgagcaattgaggaaactggtcagtttcgatcaggaagacaactgtcaagtgctttattccaaacaggatgcgaaccaactccctagggcattggtacggaagctgtcgtcccggtcccagagtagagtgcggaatatcgcatcccgcgcaaaggaaaaacaggaagcgaataaacaaaaggtgcctaacccctccaacggcgcaggcgtggtccttcgcaataaacccagtgcacccactccagcggtcaaccgccactctactggctcgtacattgcaggttacctcaagaataccaagggcggaggcctcgagggaaggggtattcctgagggggcttgtaccgcactgcactacggccacgtagatcaattttgctccgataactctgtgctgcagaccgagcctagttccgacgataagcctgagatttacttcttgctgcgcctgta

SEQ ID NO: 234916 - DNA, 4967 bp, Artificial Sequence
  Description of Artificial Sequence: Synthetic coding sequence
atgtcggtcatgcagagcgggacgcagatgatcaagttaaagcggggaaccaagggactcgtacggctgttctaccttgacgaacatcggactagactgcgatggcggcctagtcggaaaagtgagaaggcaaaaatcctcatcgatagcatctacaaagtgacagaaggcaggcaatcggaaattttccaccgacaggccgagggtaacttcgacccgagctgctgctttacgatctaccacgggaatcacatggagtcgctggatctcattacctcgaatcctgaggaagctcggacctggatcaccggtttgaaatacctgatggcgggtatatccgacgaagacagcctcgcaaagagacagcgaacgcacgaccagtgggtgaagcagacattcgaggaggctgataagaatggggacggcctcctgaacattgaggaaatacaccaactgatgcataagctgaacgttaacttacctaggagaaaggtgaggcaaatgttccaggaagccgacacggacgaaaaccagggaacacttacgttcgaagaattctgtgtgttttataaaatgatgagtctgcggagggacctgtacttgctgctgctgtcctacagcgacaaaaaagatcacctgaccgtggaggaactcgcccaattcctgaaggtggagcaaaagatgaacaacgtcaccacagattattgccttgacatcatcaaaaaatttgaggtgagtgaagaaaacaaggtgaagaacgtgttgggcatcgagggcttcaccaatttcatgcgatctccagcctgcgacattttcaaccccctgcaccacgaggtgtaccaggatatggatcaacccttgtgcaattactacattgccagtagccataacacatatctgacaggcgatcagctgctctctcagagcaaagtggacatgtacgcgagagtccttcaggaaggatgtagatgcgtcgaagtggactgctgggatggacccgatggcgaacctgtggttcatcacggttacacactgacttcaaaaatcctattcagggacgtggtcgagacaataaataagcatgctttcgtcaagaatgaattccctgtcattcttagcatagaaaatcactgttctatccagcagcagagaaaaattgcgcagtatttgaaaggcattttcggcgacaagctagacctgtcgtccgtggataccggagagtgcaagcaattgcccagcccgcagtccctgaagggcaaaattctggtcaagggcaagaagctgccctatcatttaggtgacgacgcggaggaaggcgaggtgtcagacgaggactctgctgacgagatagaggacgagtgtaaattcaaactacactactctaacggaaccaccgagcatcaggtcgaatcttttatcagaaagaaacttgagtccttgctgaaggagagtcagatcagagacaaagaagacccggattcattcacagtgagagcgttgctcaaagctactcatgagggtctcaacgctcatttgaagcagagcccggacgtcaaggaatcaggaaaaaagagccacgggaggagtcttatgaccaatttcggaaagcacaagaagactaccaagagccgcagcaaaagctattccaccgatgacgaagaggacacccaacagtctacaggaaaggaaggaggccagctgtacaggctgggtcggagacgtaagacgatgaagctttgccgcgaactgtccgatctggtcgtttacacgaacagcgtcgcagctcaggacatcgtagatgatggcactacggggaatgtgctgagcttttccgaaacgcgggcacatcaggtcgttcagcagaaatcagaacaattcatgatttacaatcagaagcagcttacaagaatttaccctagcgcctaccgaattgactcctccaacttcaaccccctaccctactggaacgcaggatgccagctggtcgccctgaactaccagtctgaaggcagaatgatgcaactgaaccgggcaaagttcaaggcaaacggtaactgtggatatgttctgaagcctcagcagatgtgtaagggaacctttaacccattttctggagatcctctcccagccaacccaaaaaagcaattaatattgaaagtgatctccggccagcagttgcctaagccaccggattctatgtttggagatcgaggggagatcattgatccttttgtggaggttgagattatcgggctacccgtggactgttgtaaggatcagactcgcgttgtcgacgataatgggtttaacccggtatgggaagagacactgacttttacagttcacatgcccgagattgctttagtgcggttcctagtgtgggatcacgacccgatcggaagagatttcgtgggccaaagaaccgtgactttctctagtctggttccaggttacagacacgtctatctggaaggcctgactgaagcgagcatctttgttcacatcaccatcaatgagatctacgggaagaacaggcagttacaggggctgaaaggactcttcaacaagaacccgcgacattccagttccgaaaataactcccactatgtgaggaagcggtccattggcgacaggattcttcgaagaaccgctagtgcccctgctaagggccgtaaaaaatccaagatgggtttccaagagatggtggaaataaaggatagtgtatccgaggcaacaagggaccaggacggggttctcagacgtactacacggtccctgcaggctcggcctgtttccatgcctgtcgacagaaatctgttgggggctctctcattacctgtgtcggagacagcgaaggacattgaaggaaaggaaaactccctggcagaggataaagatggacggcgtaagggcaaagcctctattaaggacccacatttccttaatttcaataagaaactgtcttccagttctagcgccctgttgcacaaggacacctcccaaggcgacacaatcgttagtaccgctcacatgtctgtaacaggcgagcaacttggcatgtcctctcctagggggggacggaccacgtcaaacgctaccagtaactgccaggagaacccgtgtccaagtaaaagcctctcacctaagcagcatctggcgccagatccagtcgtgaatcccacccaggacctgcacggtgtcaagatcaaagagaagggtaacccagaggactttgtcgagggcaagagtatccttagtggctccgttctttctcactcaaatctagagatcaagaacctggaaggaaaccgcggtaaaggacgggcagccacgagcttttctctgtccgatgtgtctatgttgtgttctgacattcctgatctgcactccaccgccatcctgcaggagagtgtcatctcacatctgattgataatgttacattaacaaatgaaaatgagcccggtagctctatcagcgcactaatcggtcagtttgacgagacgaacaaccaggcgttaactgtcgtatctcatctccacaacaccagcgtcatgtccggccattgtccgctccccagtctggggcttaagatgcccattaaacacgggttttgcaagggaaagtccaagtcctcgtttctgtgtagcagtcctgaacttattgcactgtcctcctctgagacgaccaagcacgccacaaacactgtatatgaaacaacttgtactcctatctctaagactaagcccgacgacgacctgtcctccaaagctaaaactgccgcattggaaagcaacctacctggtagccccaatacgagccgaggctggctgcctaaaagccccaccaagggcgaggattgggaaacactcaagtcatgtagcccagcatctagtccagacttaacactagaggacgtcattgctgatccaactctttgtttcaattccggggagagcagtctcgtggaaattgatggcgaaagtgaaaacctttcactcactacatgcgaatataggagggaggggaccagccaattagctagccctttgaaactaaaatacaatcagggcgtcgtggagcacttccagcgagggctcagaaatggctattgcaaagagacgctcagacctagtgtaccagagatttttaacaatatccaagacgtcaaaactcagtccataagctacctcgcgtaccaaggagctggttttgtgcataaccactttagcgacagcgatgcaaaaatgttccagacttgtgtccctcaacagtcctccgctcaggacatgcatgtgcctgtaccgaaacagctcgcccacctgcctctgccagctctcaagctcccatctccctgtaagtcaaaatccttaggagaccttactagcgaggatatcgcttgcaacttcgagagcaaatatcaatgtatctcaaaatcatttgtcacaaccggaatccgtgataaaaaaggggtcacggtgaagactaagtcgcttgaaccaatcgatgccctcactgagcagctgcggaaattggtgagttttgaccaggaggacaattgccaggttttgtactcaaaacaggacgcgaaccagctgccaagagccctggtgcggaagttgtcatcccgctctcagtcccgggttcgcaacattgcatcacgggctaaggagaagcaggaggctaacaagcagaaggtgccaaacccgagcaatggggctggcgtggtcctgcggaataaacctagcgcacctacacctgcagttaatcggcacagtacagggtcatatatagcgggttaccttaagaatactaaaggtgggggtctggagggtaggggtatccccgagggcgcttgtactgcactgcactatggtcacgtggatcagttctgctccgacaattctgtcctccagaccgaacccagtagtgatgacaagcctgagatttactttctgcttcggctgta

SEQ ID NO: 234917 - DNA, 3009 bp, Artificial Sequence
  Description of Artificial Sequence: Synthetic coding sequence
atggccgacctggaagtatataagaaccttagcccggaaaaagtggaacggtgcatgagcgtgatgcaaagcggaacccaaatgatcaaacttaagcggggtactaagggcctggtcagactgttctatctggacgaacatagaactaggctgaggtggaggccatcccgcaaaagtgaaaaggcaaaaatcctgattgatagcatatataaggttactgagggtcgccaaagcgagatttttcacagacaagctgaaggaaactttgacccgtcgtgctgttttactatttaccacggtaaccatatggagtctctggatctgatcacatccaatcctgaggaagcgaggacatggataaccggcctcaagtatcttatggcaggtatctctgatgaagactcactggccaaaagacagaggacacacgaccaatgggtgaaacaaacgtttgaagaggcagacaagaatggggatggactcctgaacatcgaagagattcaccagctgatgcataagcttaacgtgaacctgccgcgaagaaaggtgcggcaaatgttccaggaagccgacaccgatgagaaccaaggcacacttacttttgaggaattttgtgtgttctataaaatgatgagtctgcggagggatctctacttgctcttgctctcgtatagcgacaaaaaggatcatctcacagtggaagagctggcccagttccttaaggttgagcaaaagatgaacaatgtgaccacagactactgtctggatattattaagaagtttgaagtaagcgaagagaacaaagtgaaaaacgtgctgggaatagaggggtttaccaactttatgcgttcaccagcctgtgacatatttaacccgctgcatcatgaggtgtatcaggacatggaccagcctttgtgcaattactatatcgcatcatctcacaacacttatctgacaggcgaccagctgctgtctcaaagtaaagttgacatgtatgccagagtcttacaggaagggtgtcggtgcgtagaggtcgactgctgggatggacccgatggtgagcctgtggtgcatcatggctacactctgacatcgaagatactttttagggatgtggtggaaaccataaacaaacatgcttttgtgaagaacgaattcccagtcatattgagcatagaaaatcactgctcaattcagcaacagagaaagatcgcccagtacctgaagggaatcttcggcgacaagctggatctgagctccgtggataccggggaatgtaagcagctcccctctccccagtccctcaaagggaagattttggtgaaaggtaaaaaactgccgtatcatctgggagatgatgccgaagagggtgaagtctccgatgaggactcagcggatgagattgaggatgagtgcaagtttaagctgcactatagcaatgggacaaccgaacaccaggtggaatccttcatccggaagaagctcgaaagcttactgaaagagtctcagatacgcgataaagaagaccctgattccttcaccgtacgggctctgctcaaggcgacacatgagggactcaatgcacatctgaaacagagcccggatgtcaaggaaagtggtaaaaagtcccacggaaggagtcttatgacaaattttgggaagcacaagaaaactacaaagtcccggtccaaaagctatagcaccgatgatgaggaggatacacagcagtcaacagggaaggaaggcggacaactgtacaggcttggaaggagacggaaaacgatgaagctgtgcagagaactctcagacctcgtggtgtataccaattcggtggcggcacaagacatcgtggacgatggaactaccggtaacgtgctgtctttcagcgagaccagggctcaccaggtagtacagcagaaaagtgaacagttcatgatctataaccagaaacagcttacccggatttacccgtcagcatacaggatcgatagtagcaacttcaaccctctgccttactggaatgcaggctgccagctcgtcgcactcaattaccaatccgaaggccgaatgatgcagctgaacagagcgaagtttaaagccaacggtaattgcggttacgtccttaaacctcagcagatgtgtaagggaacattcaaccccttctctggggaccctttacccgcaaatcctaagaagcaactgatcctaaaagtgatttcagggcagcaattgcctaaacccccagatagcatgttcggcgacaggggcgaaatcattgacccgttcgtcgaggtcgagatcataggccttccggtggactgttgcaaggaccagacaagggtagtcgatgataatggctttaaccccgtgtgggaagagactctcacattcactgtccacatgcctgagattgctctggtccgcttcttagtctgggaccatgatcctatcgggagggatttcgtcggccagagaactgttaccttcagcagcctcgttccaggctaccgtcacgtgtatcttgaaggactgaccgaagcctctatctttgtgcacataaccatcaacgagatctacggcaaatggtctcccctcattcttaacccgtcctatacaattttgcatttcttgggcgcaaccaaaaatcgacagctgcagggcctgaagggccttttcaataagaatcctcggcattcgtcgtctgagaataatagccactacgtaagaaaaaggagcataggggaccgaattttacggagaaccgccagcgcccctgccaagggtcgtaaaaaaagcaaaatgggctttcaggagatggtagaaatcaaagattccgtttctgaggctacacgggaccaggatggcgtcttacgcagaactacacgatctcttcaggcccgacctgtgtcaatgccggttgatcgtaacctccttggcgcactgtccctccccgtcagtgaaaccgctaaggatattgaaggcaaagaaaacagcttggttcagatatag

SEQ ID NO: 234918 - DNA, 4967 bp, Artificial Sequence
  Description of Artificial Sequence: Synthetic coding sequence
atgagcgtgatgcagtctggaacacaaatgattaagttgaaacgaggcacgaagggacttgttaggctgttttacctcgacgagcaccggactaggctgcgatggcgcccatcacgaaagagcgagaaagctaagattctgatcgatagtatttataaggttacagaaggccgacagagtgaaatattccaccgccaggctgaggggaattttgatcctagctgttgtttcactatctatcacggaaatcacatggagtccttggatctgatcacctcaaatcccgaagaggctaggacctggattaccggcctgaaatacctgatggccggaatttctgacgaggattcattagccaaaaggcagaggacccacgatcagtgggttaagcagaccttcgaagaagctgataaaaacggcgacggcctgcttaacattgaagagatccatcagctcatgcataagcttaatgttaacctccctagacggaaggtgaggcagatgttccaggaagcggacaccgacgagaaccagggaaccctgaccttcgaggaattttgcgtgttttacaagatgatgtccctccgtagagacctgtacctgctccttctttcctattcagataagaaagaccacctgacagtagaggagttagcccagtttctgaaagtggagcagaagatgaataacgtgaccactgattattgcctagacatcatcaaaaagtttgaggtgtctgaagaaaacaaggtgaaaaatgttctcgggattgaaggattcacaaacttcatgaggagccctgcttgcgatatcttcaacccactccaccacgaagtgtaccaggatatggatcagcctttatgtaactattacattgcatcatcgcataatacttacctgactggcgatcagctgctctcccagtccaaggttgacatgtacgccagggtgctccaggaaggatgtcgctgcgtggaagtggactgttgggacggccctgatggggagcccgtggtacatcacggatacacgctgacttcaaaaatactttttagggacgtcgtggagacaataaataaacacgccttcgtcaagaatgagttcccagtgatactttctatcgagaaccactgctccatccaacagcagagaaagatcgcccaatatctgaagggcatcttcggtgataagctcgacctgtcgtcagtcgacaccggagaatgtaagcagctcccaagtccccaaagtctgaagggtaagattctggtgaaagggaaaaaactgccctaccacctgggcgacgacgccgaagaaggagaagtttctgatgaggatagtgcagatgagatcgaggatgagtgcaaatttaagctccactatagtaacggcaccacggagcatcaagtagaaagctttatccgaaaaaaattggaaagccttctgaaggagtcccagatacgtgataaagaggaccctgactcttttacagttagggcactgcttaaggccactcatgaaggactgaatgcacacttgaagcagagcccagacgtgaaggagtctggtaaaaaatcacatgggcgttcactgatgacaaacttcggcaagcacaagaagaccacaaaatctaggtcaaaatcttactctaccgatgatgaggaggatacccagcagtccacaggtaaagagggtggccagctgtaccggttggggagacgtcgcaaaaccatgaagctgtgtcgtgagttgtctgacctggtcgtgtataccaactccgtcgcagctcaggatattgtggacgacggaacgacgggaaatgtgctctcattctcggagacccgggcacaccaagtagttcaacaaaaatctgagcagttcatgatctacaaccaaaagcaactgacaaggatttacccatcggcataccggatcgacagttccaacttcaatccattgccctactggaacgcgggatgccaactggtggcacttaattaccaatcagaagggcgaatgatgcagctgaaccgagccaagttcaaggccaatggaaattgcggctacgtgttgaagccccagcagatgtgtaagggcacgtttaaccccttctctggggaccccctgcccgctaaccccaagaaacagcttatcctgaaagtgatttcaggtcagcagctgccaaaacctccggattctatgttcggcgacagaggtgagatcattgatcccttcgtggaggtggaaatcattggactgcccgtggattgctgcaaagaccagacacgagtggtggatgacaacggtttcaaccccgtctgggaagaaacactgacgtttacggtgcacatgcccgagattgcacttgtgagattcctcgtatgggaccacgacccaattggacgggactttgttggccagcgaaccgttacattctcctcattggtgccgggttatcgccatgtttacctcgaggggctaaccgaagcatctatcttcgtgcacatcaccattaatgaaatttacggcaagaatcgccagctgcaaggacttaaaggtctgttcaacaaaaacccccgtcattcttcttctgaaaataactcacactacgtacgcaaacgatcaattggcgatcggatcctgcggcgaactgcttctgcacctgccaagggaaggaagaaatcaaagatgggatttcaggaaatggtggagattaaagacagtgtcagtgaagccactagagatcaggacggtgtgctgcgcagaactactcgatctctgcaggcacgccctgtctccatgccagtggacagaaacctactcggcgcattaagtctccctgtcagcgagaccgccaaggacatcgaaggtaaggagaactccctcgctgaggacaaagacggtaggagaaaggggaaggcctccattaaagacccacacttcctaaattttaataagaagctgtccagttcttcaagtgccctgctgcacaaagatacatcacagggagacaccattgtgagcaccgctcatatgtccgtcacaggggagcagctgggtatgagttcacccagaggcggacggaccacgagcaatgccacgagcaactgtcaagaaaacccctgtccctccaaaagtctctctccgaaacagcacctagcgcctgaccccgtggtaaacccgactcaggatctgcacggggttaagatcaaggaaaagggaaaccccgaggacttcgtggaagggaagtccattctgtcaggctccgttttgtcacatagtaacctggagatcaagaacctggagggtaacagaggtaaaggacgcgctgctacctccttttcgctgtccgatgtctccatgctgtgttccgatatccccgatttacacagcaccgctatcctccaggagagtgttatttcccatttgatagacaatgttactctgaccaatgagaatgagcccggatcttctatctccgccctgattggccaattcgacgagacaaacaaccaggcactgactgtggtgtcgcacctgcataatacctccgtgatgagtggtcactgcccattgccttcactgggcctcaagatgcccattaaacacggcttctgtaaggggaaaagtaaatcctctttcctttgctcatcacctgagctgatagctctttcttctagtgagacgaccaaacacgccactaataccgtttacgaaaccacctgtacgccaatctcaaaaacaaagccggatgacgacctgagctccaaggccaagactgcagccctggaatctaacctgcccggatctccaaatacgtctcgaggttggctcccaaagtctccaaccaagggagaggactgggaaaccctcaagagttgttcgccagcctcaagccccgacctgactctggaggacgtgatcgccgatcccacattatgtttcaattccggtgagagctccctggtggaaattgatggagagtcagagaacctatcgctgaccacgtgtgaataccggcgtgagggcacctcccagctcgcctctcctctgaagctcaaatacaatcagggagtggtggagcactttcagagaggcctacggaatgggtattgtaaagagaccctgagacccagtgtgccggagatcttcaataatatacaggatgtcaaaactcagtcaatcagttatctggcctatcagggggctggcttcgtacataaccacttttccgatagcgacgctaagatgtttcagacctgtgtcccccaacaatcctcagcccaggatatgcatgtgcccgtgcccaagcagttggcacatctgcccctaccagcccttaagctaccttctccatgcaagtcgaaatctttaggggatcttacgtccgaggacattgcatgcaattttgagagcaagtatcagtgtattagcaaatcttttgtgactactggaatacgcgataagaagggggtcacagttaagactaagtcactggagccaatcgatgccctgacagagcagctgagaaaactggtctcgttcgaccaagaagataactgccaggtactgtattccaagcaggacgctaaccaactgccaagggcactggtcagaaaactgtcctcaaggtcacagagccgggtaaggaatattgcttctagagcaaaggagaagcaagaggccaataagcagaaggtgccgaatccaagcaatggtgccggtgttgtgctgagaaataagccttctgcgcctacaccagctgtgaataggcactctaccggcagctacattgcgggatatttgaaaaacactaaaggaggcggtctggaaggtcgcggtataccagagggcgcatgtacggctttacattatggccacgtggaccaattttgtagcgacaattccgttctgcagacagagccctcttcggacgacaagccagagatatatttcctgctaagactgta

SEQ ID NO: 234919 - DNA, 3045 bp, Artificial Sequence
  Description of Artificial Sequence: Synthetic coding sequence
atggccgacctggaggtgtacaagaacctatcccccgaaaaagttgagcgatgcatgtcagtgatgcagagcggcactcagatgataaaactcaaacgcggaacaaaaggcctggtccgcctcttctaccttgatgaacatagaactagattgaggtggcgtcccagccggaaatctgaaaaagctaagatcttgatcgacagtatttacaaggtaacagaagggaggcagagtgaaattttccaccggcaggcagagggcaacttcgatccctcatgttgcttcacaatctatcatgggaaccacatggagtctctggacttaatcacctccaaccctgaagaggctaggacttggataactgggttgaagtatttgatggccggtatttctgacgaggacagcttagcgaagaggcagcggacccatgaccagtgggtgaagcaaacctttgaagaagccgacaaaaacggtgatggcctcttaaacattgaggagattcaccagctcatgcataagctgaacgtcaatctccctcgaagaaaggtccgccagatgtttcaggaggccgatacggatgagaaccagggaaccctcaccttcgaagaattctgcgtattctataaaatgatgtccctgagacgcgatctatacttactcctgttgtcctactccgataaaaaggatcaccttacggtggaagagctcgcacagttcctgaaagtggagcagaagatgaacaatgtcactactgattattgtctggatattataaagaaatttgaggtttcagaagagaataaagtgaagaacgtgctgggtatagagggtttcacgaacttcatgcggtcccccgcatgcgatatatttaatcctctgcaccacgaggtttatcaagacatggatcaacctctgtgtaattactacatcgcgagctcccataatacgtatttaactggtgatcagctgctgtctcagagcaaagtcgacatgtatgctcgcgtgttgcaggaggggtgtcgatgtgtggaggtcgattgctgggatggccctgacggcgaaccagtggtgcatcacggctacactttgactagtaagatactgttcagggatgtggtggagacgatcaacaaacatgcgtttgtgaagaatgaattcccggtaatactaagcattgaaaatcactgctcaattcagcagcaacgcaagattgctcagtatttaaaaggtatctttggagacaaacttgacctgtcttcggttgacaccggcgagtgcaaacagttaccttctccccagagtttgaaggggaaaattcttgtgaaaggtaaaaagctgccctaccatctgggtgatgacgccgaagaaggagaggtttcggacgaagactctgccgacgaaatcgaagacgaatgcaagttcaagttacattacagtaatggcacgactgaacaccaggtagaatctttcattcggaaaaagctggagagtcttctgaaagagagtcagattcgggacaaggaggatcctgactccttcactgttagggctcttctgaaggccacccatgaggggctcaatgctcacctgaaacaaagtccagacgtcaaagagagcgggaaaaaatcccatggtagatcgctcatgaccaatttcggaaaacacaagaaaacaacgaagtcacggtctaagagttattcaaccgatgacgaagaagacacacagcagtccactgggaaagaagggggacagctgtatagactgggtagacggaggaagacaatgaaactctgtagagaactttccgatctcgtggtctacaccaattctgtagctgcccaagacattgtagacgatggcaccacgggaaacgtcctatccttcagtgaaacacgtgcccatcaggtcgttcagcaaaagtcagaacagttcatgatatataatcagaagcagctcacccgaatataccccagcgcctacaggatagactcgtcgaattttaatcccctcccctactggaacgcaggttgtcagttagtggcactgaattaccagagtgagggaagaatgatgcagctaaaccgcgcaaagttcaaggccaacggtaattgcggttacgtactgaagccacagcagatgtgtaagggaacctttaatccgttctccggtgatccactccccgcaaaccccaaaaaacaactaatcttaaaggtgatctccggccaacagctgccaaagccccctgattctatgtttggggacagaggggagattatagatccgtttgtcgaagtagagattatcggcctcccagtggactgctgcaaggatcagacacgagtggtggacgataacgggtttaatccagtttgggaggaaaccttaacatttacagtccacatgccagaaatcgccctcgtgcgctttctcgtatgggatcacgatcccatcggccgagactttgttggtcaacggactgtcacattttctagtctcgtgccaggataccgccacgtctatctcgagggtctgacagaggcttccatcttcgtacacattactattaacgagatttatggaaaaaatcggcagctgcaaggtctgaaaggcttatttaataaaaacccccgacactcctcatctgaaaacaacagccactacgtccgcaagaggagcatcggcgaccgcattttgaggaggactgcttccgctcccgcaaaaggcagaaagaaaagtaaaatggggttccaggagatggtcgaaattaaggattcagtgagcgaggccaccagagatcaggacggcgtgctgcggcgaacaacgcgttctctgcaggccagaccggtcagcatgcctgttgacagaaatctgttgggtgctctgtctcttcccgtctccgaaacggccaaggatatcgaaggaaaagaaaattccctggacagcagcttctgccggcctaccgagcaggcaaaggccgaaatgtgcaaggtgccgtttccgcgtcagctcgagtgcgtgatgaaaatggagatctccgaaacatag

SEQ ID NO: 234920 - DNA, 3507 bp, Artificial Sequence
  Description of Artificial Sequence: Synthetic coding sequence
atgtttcgagaggctgacaccgatgatcaccaggggacattggggttcgaagagttttgcgcattttacaagatgatgagcacgcgtagagacctgtatctgctcatgcttacctactctaaccacaaggaccatttggacgctgcatccctccagcgctttttgcaagtggagcagaagatggcgggagtcaccctggaaagctgtcaagatatcatcgagcaattcgagccctgtcccgagaataagtccaagggattactcggtatcgatggcttcaccaactatacacgaagccctgctggagacatctttaatcccgagcaccatcacgtccaccaggacatgacccagcctctgagccattacttcatcacctccagccacaacacatatctggtgggcgatcagctgatgtcacagtccagggtcgacatgtacgcgtgggtgctgcaggctggctgccgctgcgtagaagtcgactgttgggacggccctgacggagagcccatcgtgcaccacgggtatacactaacttcaaagatcctcttcaaggacgtgatagagacgatcaacaaatacgctttcattaagaacgagtacccggtaattctgtcgatcgaaaaccactgctcagttattcaacagaagaagatggcccaatacctgacagatatacttggtgacaagctggatctgtcttcagtgtcctcagaagatgcgactacactccccagcccacagatgctgaaaggtaagattctcgtgaaagggaaaaaactcccggcaaacatctctgaggatgccgaggagggagaggtatcagatgaagattctgccgacgaaatcgacgatgattgtaaactgctgaacggagatgcttccaccaaccgcaagcgtgtcgagaatacagctaagcggaagctcgactctcttatcaaggagtccaagatcagggactgtgaggacccgaacaactttagcgtgtccaccctgtcaccatccggaaagcttggcagaaagagtaaggccgaggaggacgtggaaagcggcgaggatgccggtgctagccggaggaacgggcgtttggtggtgggctcctttagtcggaggaagaagaagggcagtaaactaaagaaagctgcgtccgtagaagagggagacgaaggacaagatagcccaggcggtcaatcccgaggtgcgacaaggcagaagaagacaatgaagctgtctcgtgcactgtcggatcttgtcaagtatacaaagagtgtcgcgactcatgacatcgagatggaggctgcaagctcttggcaggtcagctctttttcggagacaaaggcccaccagatcctgcaacagaagccagcccagtatctgcgcttcaaccaacagcagctgtctcgtatctacccttcatcataccgcgtcgatagctcaaactacaaccctcagcccttctggaatgccggatgccagatgggggtgtttaatcccaatagtgaagacccactcccaggacagctaaagaagcagctggttctccggataattagcggtcagcagcttcctaagcccagggacagtatgttgggcgatcggggagagattatcgaccccttcgtggaggttgaaataatcggcttgcccgttgattgcagtagggagcagacaagggtggtcgacgacaatggctttaatcccacttgggaagagacactggtgtttatggtccatatgccggagatcgccctcgtgcgatttctggtgtgggaccatgacccaatagggagggatttcattggacagagaacattggctttttcatccatgatgcctggttaccgacacgtgtatcttgaaggtatggaagaagcatctatattcgtccatgtggccgtgtccgacatcagcgggaaagttaaacaggccctgggcctgaaagggctctttctgagagggcctaaacccggtagcttggatagccacgccgctggccgaccgccagccaggccttcagtgagccaaaggattctccgcaggacggcctccgctcccactaagagccagaaaccaggcaggagaggattcccagaattggttctgggtacacgcgataccggaagtaaaggtgtggcagacgacgtcgtccctccaggtcctggacctgccccagaggccccagcccaggaggggcctggttctggcagtcccagggacaccaggcctctgtcaacacagaggccactgccgcctctgtgctcccttgagaccatcgccgaggaacccgcaccaggcccaggcccaccccctccagcggctgtgcccacctctagttcacagggtcgcccaccttacccaacggggccaggtgctaacgtcgcatcgccactggaggacaccgaagaaccaagggacagccggcctcgaccttgtaacggggagggtgcaggaggggcatacgagcgcgctcctggcagtcagactgatggtaggagccagcccaggactctcgggcacctgccagtcattagaagggtgaaaagcgaggggcaggtcccgaccgaaccactggggggatggcggccacttgccgctccctttcctgccccagccgtctacagtgacgcaacaggctcagaccctctgtggcaacggcttgagccatgtggccaccgggacagcgtgtcctcctcctccagtatgtcctcgagcgacaccgttatcgacctttcccttccttcgctgggcctgggtcgcagtagggagaatctcgctggggcacacatgggcagactgccaccacgcccacatagcgctagcgccgcacgtcctgacctgccgcctgttacaaagtccaagtcgaaccccaacctccgagcaacaggtcagaggcccccaattcctgatgaactgcaacctaggagcctggctccacgaatggcgggtctgccgttcaggccaccttggggctgtctgtctcttgtgggagtacaagactgcccggtcgccgcaaaatccaagtcacttggggatctgacagcagacgatttcgcccctagctttgagggaggatccagaagactaagccattccctcggactccctggcggtacgcggcgagtgtccggccctggggttcgtcgggataccctcacggagcagctacgttggctcacagtctttcagcaagctggcgacattacgtcacctacctcattgggcccagccggagaaggagtggcaggcggacccggatttgtgcgacggtcttcatcacgttcccatagcagagtacgggcaatcgcctctagggcaagacaggctcaagagaggcagcagagattacagggtctaggaaggcagggacctcccgaggaggaacggggtactcctgaaggagcttgctccgtaggccacgagggaagcgtggacgccccagcaccaagcaaaggggctctcgggccagcctccgctgccgcagaaaacctagtcctactcaggttgtag

SEQ ID NO: 234921 - DNA, 1500 bp, Artificial Sequence
  Description of Artificial Sequence: Synthetic coding sequence
atgggtgccatgcaggagggcatgcagatggtgaagttaagggggggatccaaggggctggtcaggttttactacctcgacgaacaccgtagttgtataaggtggcgaccttcacgcaaaaatgaaaaggccaagataagtatagactcaattcaggaggtgtctgaggggaggcagtcggaggtcttccagcgttacccagacggatcttttatcatagatccgtttgtggaggtcgagatcattggcttaccagtggactgcagtagagagcaaacgagggtggtggacgataatggattcaatcccacctgggaagagacactggtgtttatggtgcatatgcccgaaatagccttagtgcgcttcttagtttgggaccacgatccaattggccgagatttcatcgggcagcgcactctggccttttcttcaatgatgcctggctaccgccacgtgtatctggagggtatggaggaggctagcatattcgtccacgtggctgtgtcggatatttctggaaaggtgaaacaggccctggggctgaagggactgtttcttcgcggtcccaagccaggtagtctggactcccatgcggctggtcgaccacccgctaggccaagcgtttcccaacgaatactacgtaggacagcctctgcacccacaaagagtcagaaacctggccgtagaggttttccggaactggtgctgggcaccagagacaccggcagtaagggcgttgcagacgatgtagtaccccctggccctggccctgctccagaggctccagcccaggagggacctggcagcggctctcctcgcggaaaggctcccgctgccgtggcagaaaaatctcctgttcgtgtaaggcctcctcgagtgctcgacggacctggcccagcaggaatggccgctacatgtatgaagtgtgtcgtcggctcttgcgcaggcgtcaataccgggggactccagcgcgaacgaccaccgtcgccaggtccagcctcgaggcaggctgccatcagacagcagcctcgcgctagggcagactcactgggagcgccttgctgtgggctggaccctcacgctatccctggaagaagccgagaggctccaaaggggcctggggcttggcggcagggccctgggggaagtggctctatgtcttcagatagttcttctcctgattctccaggcataccggaacgcagtccaaggtggccggagggggcttgtcggcagccaggcgcactccagggagaaatgagcgcactgtttgctcagaagctggaggagattagatccaagtctccaatgttttctgcaggtaaaccactgctgccctgtgtagttcttccacacgccccagggatggctggccctggatcacctgcggctgcgtccgcctggactgtgtctcctcgcgtcctggtcctggttgccctgtacccatggcattgcttgagggggacgctcttaccatggctcgcttgcggcccttag

SEQ ID NO: 234922 - DNA, 3177 bp, Artificial Sequence
  Description of Artificial Sequence: Synthetic coding sequence
atggctggtatcagcgacgaagactctttggctcggaggcagcgaactcgcgaccagtggctgaaacaaacattcgacgaagctgataagaatggggacggttccctgagcattggggaggttttacagttgctgcacaagttgaacgtgaatctgcccaggcagcgtgtgaaacagatgtttagggaggccgacactgacgaccaccaggggaccttgggttttgaagagttctgcgccttctacaaaatgatgtctacacgtcgtgacctgtatctccttatgctcacctacagtaatcacaaagatcatctagatgccgcatcacttcagcggttccttcaggtagaacagaaaatggccggagtgactctggagtcgtgccaggatatcatcgagcaattcgagccttgccctgagaataaatccaagggactcctggggatagacggtttcacgaattatacacgctctccggctggggacatcttcaatccggagcatcaccacgtgcatcaggatatgacacagccgctgtcccattatttcatcactagctctcacaatacttatctggtgggtgatcagctgatgagtcagagccgagtggacatgtacgcgtgggtgctccaggcagggtgtagatgcgtggaagtcgattgctgggatggccctgacggggaaccaatcgtccaccacgggtacactctgacaagcaaaatcctgttcaaagacgtgattgagaccataaacaagtatgctttcatcaagaacgaataccctgtaatcctatccattgaaaatcactgttccgtgatacaacagaagaaaatggcacagtacttgacagacattttaggggacaagctagatctgtctagcgtgtcatccgaagacgctactaccctgccaagcccacaaatgctgaagggcaaaatactcgtcaaaggaaagaaactccccgctaatatttctgaagatgccgaggagggcgaggtgtcagacgaagatagtgctgacgaaattgatgacgattgcaagctgctcaatggggacgcatctactaaccgcaaacgtgtggagaacacagcgaagagaaagcttgactctctgatcaaagaaagtaaaatccgggactgcgaggatcctaacaacttttcggtttccaccctctccccgagcggaaaattaggccgaaaatccaaagctgaagaagatgtagagagcggcgaggatgccggtgctagtcgacgaaatggcaggctcgttgtgggatcatttagccggcgtaaaaagaaggggtccaagctgaagaaggccgctagtgtggaagagggagatgaaggacaggactccccgggaggccagagtcgcggagctactcgccaaaagaaaaccatgaagctgagtcgagccctgtccgatctagtcaagtacacaaaatccgtcgcaacgcacgacatcgagatggaggccgcatccagctggcaggttagctctttttcagagacaaaagctcatcagattctgcagcaaaaaccagctcagtacctgagatttaatcagcagcaactcagccgaatctacccatctagctatcgcgtggacagtagtaactataatcctcagcccttctggaacgctggatgccagatggtcgcgctaaactatcaatccgaggggagaatgctgcaattgaaccgggcaaaattctcagctaatggaggttgcggttacgtgttgaaaccaggctgtatgtgccagggggtgttcaacccaaacagcgaagatcctctgccaggccaactcaagaaacagctggtgctccgcatcatttccggccagcaactccctaaaccgcgagattctatgttgggagaccggggagaaatcattgaccccttcgtcgaagttgagataataggtctgcccgtggactgctcccgtgagcagacgcgtgtggtggacgacaatggctttaacccaacgtgggaggaaactctcgtgttcatggtgcacatgccggaaatcgccctggtccgcttcctagtgtgggatcatgaccccattggcagagattttattggccagcgcacccttgccttctcgagcatgatgcccggataccgccacgtgtacctggagggcatggaagaggcctcaatcttcgtgcatgtcgcggtgtccgatatcagtggcaaagtgaaacaggccctgggactgaaaggcctctttctgaggggccctaaaccaggctcactcgactcacacgcagctggacgtcctccagccaggccttcggtctcccagagaattctcaggcggacggcctctgctccaaccaaaagccagaaaccaggcagacggggattccctgagctcgtcttaggcactcgggacacagggtccaagggcgtggcagatgacgtggtccctccgggaccgggaccagcaccagaggcacctgctcaggaaggcccaggctccgggagccccagggggaaggccccagctgccgttgctgagaaatctccagttagagtgcggcctccccgtgtgctagacggccctgggcctgctggtatggccgctacatgcatgaaatgtgtggtcggttcttgcgctggtgttaatacgggaggcttacagagggaaaggccccctagcccaggacccgctagtagacaggccgcaatcaggcaacagcccagggccagggctgattcactgggggctccctgttgcggcctggatccccacgccatacccggaaggtcaagagaggcgccaaaagggcctggagcctggcgtcagggtccaggaggctcggggtctatgagttctgactccagcagtccagacagccccggtattcccgagcggtctcctaggtggccagagggcgcatgccgccaacccggagctcttcagggggagatgagtgccctgtttgcacaaaagctggaggaaatcaggtcgaaatccccaatgttctccgctggaaaacctctgctcccctgcgtcgtactgccacatgcccctgggatggcgggacccggttcaccagcggcagcctctgcttggaccgtatctcctcgcgttctggtgctggtggccctgtacccgtggcactgtttgcgcggaacactgttgccttggctggcttgcggaccttag

SEQ ID NO: 234923 - DNA, 1494 bp, Artificial Sequence
  Description of Artificial Sequence: Synthetic coding sequence
atgggagctatgcaggagggaatgcagatggttaaactgcgaggtggcagcaaaggactggtgcggttttactacctggatgaacataggagctgcatcagatggcggccttctaggaagaatgagaaggctaaaatctccatagattctatacaggaggtgagcgaaggcagacagagtgaggtcttccagcgctacccggacggcagctttgacccctttgtcgaagtagaaatcattggtcttccagtcgattgtagccgagagcagactcgcgttgttgacgacaacggcttcaatcccacttgggaggaaacacttgtttttatggttcacatgccggagatcgccctcgtgaggtttctggtgtgggaccatgaccccatcggaagggatttcattgggcagagaacactggccttttcttctatgatgccaggctatagacacgtgtatctggaggggatggaagaggcttcaatctttgtccacgtcgcagtcagcgatataagcgggaaagtcaaacaagcgctcggtctgaaggggctgtttcttagaggacctaaacctggatccctggatagccacgcagcaggcagaccaccagcacgcccttcagtgtcccagagaatcctaaggcgtacagcctcggctcctaccaagtcccaaaagcctggcaggcgtggtttcccggagctggtgctggggaccagagacactggctctaagggggtggccgacgatgtcgtaccccctggcccagggcctgcccctgaagctcccgctcaggaagggcctggatccgggtcccctcgcggtaaggcccctgcggcagtggcagaaaaaagccccgtgagagtcagacccccaagggtcttggatggaccgggacctgccggtatggctgccacttgcatgaagtgcgtcgtaggctcatgcgctggagtcaatacagggggacttcagcgcgagagacctccgagtccaggccctgcctcgagacaggcagcgatacgacagcaacctagggcacgcgctgattcactaggcgctccttgctgcgggctcgaccctcatgccattcctggtagatctcgagaagcccctaagggacccggagcttggagacaaggccctggcggttctggatcaatgagcagtgacagttcctctcccgactctcctgggatcccagagcgatcgcctaggtggccagagggggcttgccgacaacctggcgctctgcagggagagatgagcgcgctgttcgctcagaaactagaagagatccgtagtaagtccccgatgttttctgctggcaagcctctgctgccatgtgtcgttctccctcacgctccagggatggctggcccaggcagcccggctgccgcttcggcttggacagtctctcctagggttctggtgctggtggcactctacccttggcattgtctccgaggcacgttacttccttggctggcctgcggcccttag

SEQ ID NO: 234924 - DNA, 4251 bp, Artificial Sequence
  Description of Artificial Sequence: Synthetic coding sequence
atgagcgggccatggccctcaccagactctcgcaccaaaggcacagtcgcatggctggccgaggtgttactgtgggtcggcggatccgtcgtgttgagcagtgaatggcagctgggcccacttgttgaaagatgtatgggcgctatgcaggagggaatgcagatggtgaaactgaggggcggtagtaagggcctggtgaggttctactatctcgacgaacaccgctcttgtatccggtggcgaccttcaaggaaaaatgaaaaggctaaaatctctattgattccatacaggaagtttccgaggggcgacagagcgaggtgtttcagaggtaccccgatggttcctttgaccctaactgttgctttagcatataccatggcagtcaccgggaaagtctggacctggtgagcacatcaagcgaggtggctagaacatgggtcactggtctgcggtacctgatggctggcatctcagacgaagattcgctggccaggagacagaggactagggaccagtggctgaagcagacattcgacgaggccgataagaacggcgatggatcattgagcataggtgaagttttgcagctgctgcataagttgaatgtgaatctccccaggcaaagagtgaaacaaatgtttagagaagctgacacagacgatcaccagggtactctcgggtttgaggagttctgcgctttttacaaaatgatgtccactcgacgcgacctatacctcctgatgctgacctacagcaatcacaaggatcacttggacgcagcctcactgcagcgattcctgcaggtagaacaaaagatggctggagtgactctcgaaagctgccaggatattattgaacagtttgagccatgtcctgagaataaatccaagggacttctggggatagatgggttcacgaattatacaagatcaccggcaggggatatttttaatcctgagcaccaccacgtccaccaggatatgacccaacctctctcacactactttattacctccagtcacaacacatacctcgtgggggaccagctgatgagccagtccagggttgatatgtacgcttgggttttgcaagccggatgcagatgtgtggaagtggattgctgggatggcccagatggagaacccatagtgcaccacggatataccctgacaagcaagatcttattcaaagacgtgatcgagacaatcaataagtacgctttcattaagaatgagtaccccgtcattctatcaattgagaatcactgcagtgtgattcagcagaagaagatggcccagtacctgacagatattttaggcgataagttggatctctcaagcgtttcctctgaagatgcgaccacacttccatctccacagatgcttaaaggaaagatccttgtcaagggaaagaaactccccgcaaacatctctgaggacgcagaggagggcgaggttagcgacgaggatagcgcagacgagatagacgatgactgcaagctgttgaacggagacgcctccaccaacagaaagcgtgtagagaacacggccaagaggaaactcgattctctgatcaaagaatccaaaattagagattgcgaggaccctaacaattttagtgtttcaaccctgagcccctccgggaaattagggagaaagagtaaggcggaagaggacgtcgagtctggcgaggatgctggggcttctagacggaacgggagactggtcgtgggatcattctcccgacgcaagaagaaaggcagtaagctaaagaaagctgcctccgtggaggagggtgacgaaggtcaggactcgcccggtggtcagtcacggggagctactcgccagaaaaagactatgaagctatccagagccctctccgacctggtcaagtatactaagagcgtcgcaactcatgacatcgagatggaggctgcttcgtcctggcaggtgtccagtttctcagagaccaaggctcaccaaatcttgcagcagaaaccggcacagtatctgcgcttcaatcaacagcagctgtccaggatctatccgtcgagctatcgggtggattctagcaactacaatcctcagcctttctggaatgccggttgccagatggtagcactcaactaccagagcgaagggaggatgcttcaactgaatagagcaaagtttagtgcgaatggcggttgtgggtacgtgttaaagccaggatgcatgtgccagggagtgtttaacccaaattctgaagacccccttcccggacagctcaaaaagcagctcgtgctgcggatcatttcgggccagcaactgccaaaacctagagattccatgctcggcgatcggggagaaatcatcgacccttttgtagaggtggagatcattggccttcccgtggactgctctcgagaacagactagagtggtggacgataacgggtttaatcctacttgggaggagaccctggtgttcatggtgcacatgccggagatcgctctagtccggttcctcgtatgggaccacgaccccataggaagggacttcatcggccagagaacgctggcattttctagcatgatgcctggctaccggcatgtttacctcgaggggatggaagaggccagcatctttgtgcacgtggctgtgtcagacatctccggaaaagttaaacaggctttaggcttgaaaggattattcttgagaggtccgaagcctggcagcctggactctcacgctgcagggaggccgccagcaagaccttcagtgtcccaaagaattctccggcgaaccgccagcgctccaacgaaaagtcagaagcccggaaggagaggatttcccgagctggttctgggcaccagggacaccggatccaagggcgttgcggatgatgtggttcctccaggtcccggaccggcaccagaggcacctgcccaggagggcccaggctcaggctctcccagggatacacgcccattgagcacccagcggcctcttcccccactatgctcactggagacgatcgctgaagagcccgcaccagggccagggccaccccctcctgctgccgtccctacaagcagcagccaagggaggccaccctaccccacggggccaggcgctaatgtagcatcccctctggaggataccgaagaaccacgcgactcccgcccacggccttgtaacggtgaaggcgctggcggagcctacgaaagagcacccggttcacagacagatgggagatcccagcctagaaccctgggacatctccctgtgataagaagggtcaagtccgagggccaggtgcccaccgagcccttggggggatggcgccctctcgcggctccattccccgcacctgccgtctactccgatgccaccggttcagaccctctgtggcagcgtctcgagccatgcggccaccgagactcagtgagctcatccagctcaatgagtagttccgacaccgtgatcgacctttcgctaccctctctcggcttagggagatccagagaaaatctagctggagctcatatggggaggctcccaccgaggccacatagcgcttccgcagcaaggcctgaccttcccccagtgaccaagagtaaatctaatcccaacctgcgagccaccggtcagcgtcccccaatcccggacgagctccaacctcggagcctcgcccctcgcatggctgggcttccgttccgccctccatggggatgtctctccctggttggagttcaggactgcccggtggccgcaaagtctaaatcactaggcgatctcaccgccgatgatttcgccccatccttcgagggcggatcacgtaggctgtcacattcccttggattgccagggggtacacggagggtctccgggccaggagtgagacgcgacacattgactgaacagcttcggtggctaacggtgtttcaacaggctggtgatatcacgagccccacctccctgggtcccgcaggggagggggtggctgggggaccgggttttgtgaggcgttcaagctctcgcagccacagtcgggtgcgcgcaattgcatcaagagcacggcaggctcaggagcgccagcagcgcctccaggggctggggagacagggccctcctgaggaggagaggggaacacccgaaggtgcctgctcagtgggtcacgagggaagcgtggatgctccggcacccagcaaaggagctctggggccagcttcagcagcagccgaaaaccttgtgctcctcaggctgtag

SEQ ID NO: 234925 - DNA, 4143 bp, Artificial Sequence
  Description of Artificial Sequence: Synthetic coding sequence
atgtccgggccttggccgtcccccgactcgaggaccaaaggcacggtcgcatggttggcagaggttttgttgtgggtcgggggaagcgttgtgcttagttcagaatggcaacttggaccactggtcgagcgctgtatgggcgcaatgcaggaaggcatgcagatggtgaagttaaggggcggaagcaagggtctggttaggttttactacttggacgaacaccgctcatgcattcggtggcgcccatctaggaagaacgagaaggctaagattagcatagattctatccaggaggtcagtgagggaagacagtctgaagtgttccagcggtatcctgacggatctttcgatcccaactgctgttttagcatctaccacggatctcaccgcgaatctctggacctagtctccacctcttccgaagtggctagaacctgggtaacgggcctgcgctacttgatggctggtatctccgacgaagattcgcttgccaggaggcaaaggaccagggaccagtggttgaaacagaccttcgacgaggccgataaaaatggcgatgggtctctttcaatcggggaagtgctacaacttcttcacaagctaaacgttaatcttcctcgccagcgcgtcaagcagatgttcagagaggcagatactgacgaccaccagggcacattgggcttcgaggagttttgcgccttttacaagatgatgtccactagacgggacttgtatctgctgatgctgacctacagcaaccacaaagaccacctcgatgccgcaagtctgcaacgatttctgcaggttgaacagaaaatggccggtgtgacgctggagtcctgtcaggacataatcgagcaatttgagccttgtccagaaaataaaagcaagggcttacttggaatcgacggctttacgaactacaccaggtcacccgctggcgacatcttcaacccagaacaccatcacgtgcaccaggatatgactcaaccactctcccattacttcataacatcatcccacaacacatatctcgttggagatcagctgatgtcccagagtcgagtggatatgtatgcctgggtgctgcaagccggatgtaggtgtgtagaagtcgactgttgggacggcccagacggcgaacccattgtccaccacgggtacactcttaccagcaaaatcttgttcaaggacgtcatagagacaataaacaaatatgcattcataaagaatgaataccctgtcattctgtccattgagaatcactgttcggtgattcagcagaagaaaatggcgcaatatctgactgatattttgggagataagctggatttaagctcagtgtcctctgaagatgcaacaacattgccttctccgcagatgctgaaaggaaagatactggttaaaggcaagaaactgcccgctaacattagtgaagatgccgaggaaggcgaggttagcgatgaggactcggccgacgaaattgacgatgattgtaagctcctcaatggcgacgccagtacaaatcggaagcgggtagagaacacagctaagcggaagctggattcactgattaaggagtcgaagataagggactgcgaggatccaaataacttttctgtgtctaccctgtctccgtctggcaaattaggaaggaagagcaaagccgaggaagacgtcgagtctggagaagacgcaggggcttcccgaaggaacggaaggctggtggtcggaagcttctcaaggaggaaaaaaaaaggatctaagctcaaaaaggcagcctctgtggaggaaggagatgaaggacaagatagccctggaggccagagtaggggggctaccagacagaaaaaaacaatgaaactgagtcgcgcactctctgacctcgtgaagtatacaaaatccgtggccacccatgacatagagatggaggcagccagcagttggcaggtgagttctttcagcgaaacgaaagcccatcaaattctgcaacagaagcccgctcagtacctccgcttcaatcagcaacagctgtcacggatctacccctcaagctaccgcgtggacagtagtaactataatcctcagccattttggaacgctgggtgtcagatgggcgtattcaaccctaactccgaggatccgttgccgggacaactaaagaagcagctggtgcttagaattatctcaggtcagcagctgcctaaacctcgggattctatgcttggggatcgtggtgagattattgacccgttcgtggaagttgagattatcggcctgccagtcgattgtagcagggagcagactcgggtcgtagatgacaacggattcaaccccacatgggaggagaccctcgtctttatggttcacatgccggagatcgcccttgtccggttccttgtatgggatcatgaccccatcggacgggacttcatcggtcagcggacactagccttctcatctatgatgccaggctatcgccacgtgtacttggaaggcatggaagaagccagcatctttgtgcacgttgcggtttcagacatctctggcaaagtgaagcaggcactgggtctaaaggggctgttcctccgcggacccaagccagggtcactcgacagccacgcagccggtagacctccagctcgaccatccgtgtcccagagaatccttagacgcaccgcctctgctcctactaaaagtcagaagcctggaaggagaggtttccccgagttggtcctgggaacacgggataccggatccaaaggagtcgcggacgacgtggtgccacccggacctggaccagcaccagaggcaccagcacaggaggggccaggcagtggctcacccagagacacgaggccactgtcgacccaacgtccattacctcctctatgctcactcgagaccattgccgaagagcctgcgcctgggcctgggcctccccctcccgcagcagtgcccacgtcaagctcccagggtcgacctccctatcctacgggaccgggtgcgaacgtggcgtcccctctggaagatactgaggagcctagagactcccgtccacgaccatgcaacggggaaggagcaggcggtgcctatgaaagggcccctggcagtcaaacagacgggcgttctcagccccgaacactagggcatttgcctgttatcagaagagtgaaatctgaaggtcaagtgcctaccgaaccattgggtgggtggaggccactggcagccccttttcctgcccctgccgtgtactcggacgccactggtagcgacccgctgtggcagcgactagaaccctgcggccaccgggacagtgtatcatctagctcgagcatgtcttcttccgacaccgtgattgacttaagcctgccttcactcggcctcggacgaagcagggagaatctggcaggagcacacatggggaggctgccgcctagaccccactctgcctccgccgcaaggccagatttgccaccagttacaaagagcaagtctaatcctaacttaagagctactggtcagcgccctcccattcccgacgagttacagcccaggtcactcgcaccccgtatggcaggccttcccttccgacctccttggggctgcctgagtctggtgggagtgcaggattgtcctgtggccgcaaagtccaaatccctgggggatttaactgctgatgactttgccccatccttcgagggtggaagtcgcaggctctcacatagtttaggccttccaggcggaacaagacgggtctctggcccaggcgtgcggagagacaccctgacagagcagctgcgatggctcacagtgtttcaacaggccggtgatatcacctctcccacatccctcgggcctgcaggtgagggggtcgcaggcggacctgggttcgtgcgacggtcgtctagtcgctctcacagcagggtcagagctatcgcctcgcgcgctcgccaagcacaggagagacaacagcgtctgcagggactgggcagacaggggccaccggaggaagagcgtggtactcctgagggagcctgctctgtgggtcatgagggttccgtggacgctccagcaccttcgaagggagcgctgggtccagcttcagcagccgctgagaacctggtactgcttaggttgtag

SEQ ID NO: 234926 - DNA, 2136 bp, Artificial Sequence
  Description of Artificial Sequence: Synthetic coding sequence
taggccctgaactaccagtctgaggggaggatgctacagctgaatagggctaagtttagcgcaaacggcggttgtggctacgtgctgaaacccggatgcatgtgccagggggtgtttaaccccaacagcgaagatcccctgcctggtcagctaaagaagcaactagtgctgagaatcatttccggtcagcagctgcccaaaccccgagactccatgctgggggacaggggcgagataatcgatccctttgttgaggttgaaataattggattacctgtggactgcagtcgtgagcagacgcgggtcgtcgacgacaatggattcaaccccacatgggaggaaactttggtgtttatggtgcacatgccagagattgcactcgttaggttcctcgtgtgggatcacgatccgataggcagagatttcataggacagcgcactctggcctttagttctatgatgccgggataccgccacgtatatctcgaaggcatggaagaagccagtatatttgtgcatgtcgccgtcagtgacatttcggggaaagtgaaacaagcactggggctcaagggcctgtttttgaggggtcccaagccaggatccctggattcacacgcggcaggcagacctccagccaggccatccgtgtcacagaggatccttcgtagaacagcctctgcccctacaaagtctcagaaacccggtaggcgtggcttcccggaactggtgctggggacgagggacacagggagcaagggagtggccgacgacgtggtgccccctggtcccggacccgcacctgaagcacccgctcaggaaggccctgggtcaggatctcccagagacacccggccactgagcacacaacgcccacttccgcctctttgcagtctggagacaattgctgaagaacccgcacccggacccggaccacctcctccagccgctgtaccaacctcttctagccagggcagacctccctatcccactgggccaggagccaacgtggcttctcctcttgaagatacggaagaacctcgcgattcccggccacgcccatgcaatggtgagggcgcaggaggcgcatacgagcgagcccctggatcccagaccgacggacgatcacagcccagaacattaggccatctgcctgtgattaggcgcgtcaaatcagagggccaagtccctaccgagcctctcgggggatggagacccctagccgctccatttcctgcccctgctgtttatagcgacgctaccgggagcgaccctttgtggcagagactggaaccatgcggccatagagactctgttagtagcagtagcagtatgagttctagtgataccgtgattgacctgtctttgcctagcctgggcctcggtcgctctcgcgagaatctcgccggtgcgcatatgggtcggctgcctccaaggccgcattctgcatccgctgcaaggccggatctgccccctgtaactaaaagcaaaagtaatcctaacctccgtgccaccggccagagaccacccatacctgatgagctgcagcccaggtccttggctccacgcatggctggcctcccattccggccaccctggggatgcctgagtctggtgggggttcaagattgccctgtcgcggctaagtcaaagagcctgggcgatctcactgccgatgatttcgctccatcatttgagggtggctcgagaagactgtcccacagcctgggactacctggcggaacacgtcgcgtcagtggtccaggggtgcgcagggacacactcactgagcaactgaggtggctcacagtctttcagcaagccggagacatcaccagccctacctcacttggaccagccggtgagggtgtcgccggtgggccaggatttgtgagacgctcctcttctagatctcattccagagtgagagcaatcgccagtagggctaggcaagctcaggagaggcagcagcgcctgcagggtctcgggaggcaagggccacctgaagaggagcggggaacccccgaaggcgcatgctccgttgggcatgaggggtccgtggatgcccctgccccttccaagggggcactgggcccagcctcagcagccgctgagaatttagtactcctccgtctttag

SEQ ID NO: 234927 - DNA, 3390 bp, Artificial Sequence
  Description of Artificial Sequence: Synthetic coding sequence
atggaggaacccggaccaccaggaggactgagtcaggaccaagtcgagcgatgtatgggagcaatgcaagaaggcatgcagatggtgaaactgcggggaggctctaaaggattggtgcgcttctattatctggacgagcacaggtcatgtatccgctggagacccagccgcaaaaatgagaaagccaagattagcatcgacagtatccaggaggtgtccgaaggacgtcagagcgaggtgttccagcggtacccagacggctcatttgatcccaattgttgcttttcaatctaccatggttcacaccgggaatctctcgacctggtaagcacttcctctgaagtggcccgtacttgggtcaccggacttaggtacctaatggccggaatctcagacgaggattctctggctcggaggcaacgcacacgggaccaatggctgaaacagacttttgatgaagctgataagaacggcgacggatctttatcgattggggaagtgcttcagctgttgcataaattaaatgtcaacctcccgaggcagcgggtgaagcagatgttccgtgaagccgataccgacgaccatcagggaaccctgggattcgaagagttttgcgcattttataaaatgatgagtacacgaagagacctgtaccttttgatgcttacctattcaaatcataaagaccacctcgacgcagccagcttgcaaaggttcctacaggtcgaacagaagatggcaggcgtgacactggaaagttgccaggacatcattgaacaatttgagccgtgtcccgaaaataagtcaaaggggctcctgggcatcgatgggtttaccaattatactagatctccagccggagatatcttcaaccctgaacaccatcacgtgcatcaagacatgacccagcccttgagccactacttcattacatctagtcacaacacctacctcgtgggtgaccagctgatgtcacagtcccgcgtggatatgtatgcctgggtgctacaagccggatgtagatgtgtggaggtagattgttgggatggtcccgacggcgagcccatcgtgcatcacgggtatactctaacctctaagatactgtttaaggacgtcattgaaaccattaataagtatgcattcataaaaaatgaatatccggtcattttgtcgatagagaaccattgttccgtgatccagcaaaaaaagatggcacagtaccttacggatattcttggagataagctagatcttagttccgtgagcagcgaagacgccaccaccctaccaagcccccagatgctgaaaggcaaaatcttggttaagggcaaaaaactccccgcaaatattagtgaggacgctgaagaaggcgaggtgtccgacgaggattctgccgatgagattgatgatgattgtaagctccttaatggggatgcatcaacaaataggaagcgggtcgagaatacggctaagaggaaactggacagtcttatcaaagaatccaaaattagagactgcgaggatcctaacaacttctcagtttcaactctgtctccaagcgggaagctcggacgcaagtcaaaggctgaggaggacgtggagagcggagaggacgctggagcatctcgcagaaatggccgactggtggtgggctcatttagccggagaaagaagaagggatccaagctaaagaaggccgcaagcgtagaggagggggacgagggccaagattctcctggcggtcagtcaaggggggctacacgtcagaaaaaaacgatgaagctctccagggccctgtctgacctagtcaagtacaccaaaagtgtggcaactcacgatattgaaatggaagccgcatcttcgtggcaggtgtcgagtttttcagagaccaaggctcatcagatcctgcaacagaaaccagctcagtatcttcggttcaaccaacagcaattgtctcgcatttatccttcttcctacagagtggattcctctaattacaacccgcaaccgttctggaacgcaggttgccagatggtggccttaaactaccagtcagaggggagaatgctgcaacttaatcgtgcgaaattcagcgctaatgggggatgtggctacgtgctgaagcctggatgtatgtgtcagggggtattcaacccaaattctgaagaccctctgcccggacagctgaagaaacagttagtgctgagaataatcagtgggcagcagcttccaaaacccagggacagcatgttaggtgaccggggagaaatcatcgacccatttgtggaggtcgagataataggcttaccagtggactgttcccgagagcaaacaagggtggtcgacgataacggatttaaccccacatgggaagaaacccttgtatttatggtgcatatgcctgaaattgccctcgtacgattccttgtatgggatcacgacccgattgggcgagacttcatcggacagagaactttggctttttcaagtatgatgcccggatacaggcacgtatacttggaaggcatggaagaggctagcatctttgtgcacgtggccgtctcagacatttcagggaaggtgaagcaggcgttagggctcaagggactctttctcaggggacccaaacctggtagtctggactcccacgcagccggtcgccctcccgctaggcctagcgtctcccagagaattttacggagaaccgctagcgctccaaccaaatctcagaagcccggtcgaagaggctttcccgagctggtgttgggcactcgggacacaggctccaaaggagttgccgatgacgttgtgcccccaggtcccggtcccgcacccgaagctccagcacaggaggggcctggttccggtagccccagggggaaagccccagccgcagtggccgaaaagtcccccgtcagagtcagacctccaagagtcctggacggtccaggtcctgccggaatggctgccacttgtatgaaatgcgttgttgggagttgcgctggcgttaatactgggggtctgcagcgcgagcggccaccgagccctggtcctgccagcaggcaggctgcgatcagacagcagccaagggcacgcgcagatagcctcggagccccatgttgcggactcgatccccacgcgattccaggacgaagccgggaggcgcctaaaggccctggtgcgtggcggcagggcccaggaggctcaggctccatgagctcagacagctcgtcgcctgattcacccggtattcccgagcggagtcctaggtggcccgaaggggcatgcaggcagcccggtgccttacagggggaaatgagcgcacttttcgcccagaaattggaggaaattaggtcaaaatcacccatgttttcagccgtaagaaactag

SEQ ID NO: 234928 - DNA, 1827 bp, Artificial Sequence
  Description of Artificial Sequence: Synthetic coding sequence
atggaaatgcgctggttccttagcaaaatccaagacgactttcggggaggaaagatcaatcttgagaaaacgcagaggctactggaaaagttggatattaggtgttcttatattcacgttaagcagatttttaaggacaacgatcggctgaaacaaggtaggatcacaatagaggaattccgggcaatataccggatcattacccatagagaagagattattgaaatatttaatacgtatagtgagaaccgcaaaatcctcctagcctcaaacctcgctcagtttttgactcaggaacagtacgctgcagagatgtccaaggcaatagcctttgagatcatccaaaagtatgagcctatcgaagaggtacggaaggctcaccaaatgtctctagaaggttttacaagatacatggattcaagagagtgtttgttgtttaagaatgagtgcagaaaggtgtaccaagatatgacacaccctctgaatgattacttcatatcatccagccataacacatatttggtgtccgatcaattgcttggtccttctgatctctggggctatgtcagcgctctcgtgaagggctgtcgttgtctggagatcgactgctgggacggcgctcaaaatgaacctgtggtgtaccatggatatactctgacctctaagctgctcttcaagacagtcatacaagccatccataaatacgcattcatgacttctgactacccggtcgtgctgagcctggagaatcactgcagtacagcacagcaggaggtgatggccgacaacctccaggctacgttcggggaatcattactcagtgatatgcttgatgacttccccgacaccctgccttctccagaggctctcaagttcaagattttagttaagaacaaaaaaatcggaacgctgaaggagacacacgagcgcaagggatctgacaaaagaggagataatcaagataaggaaacaggtgttaaaaagctacctggggttatgctgtttaaaaaaaaaaaaacccggaagctcaagatcgcgttagctttgtctgatctggtgatttatactaaagctgaaaagttcaaatccttccaacacagcaggctgtaccagcagttcaatgaaaataattcgattggggagacccaagcacggaaactgtccaagctcagagtacacgaattcatcttccatactcggaaatttatcacacgaatttaccccaaggcgacgcgagcggactcgagtaactttaacccacaagaattctggaatatcggatgtcaaatggtggcgttaaactttcaaacccctggcctccccatggatttacagaatggcaagttcttggacaacggcggttcagggtatatacttaaaccacacttcctgagagaaagtaaatcgtactttaacccatctaatatcaaagagggcatgccaattaccttgaccattaggttgataagtgggatccaacttccactcacccatagctcttctaacaagggcgactcactggttataatcgaagtctttggcgtacccaacgatcagatgaaacagcagacacgagtcattaagaagaacgcttttagcccgagatggaacgagacctttacctttattatccatgtgcccgagctcgcacttattcgtttcgtggtggaggggcaggggctgatagctgggaatgaattcctgggacagtacaccctgccactgctgtgtatgaacaaaggatacagaaggatccccctgttcagccgaatgggcgagtctttggagccagcgtcacttttcgtgtacgtgtggtacgtgcgttag

SEQ ID NO: 234929 - DNA, 1242 bp, Artificial Sequence
  Description of Artificial Sequence: Synthetic coding sequence
atgcggtggtttctatccaaaattcaggatgatttccgcggaggtaaaattaacctcgaaaagacccagaggttattggagaaactggacataagatgttcttatatccacgtgaagcagatcttcaaaacaagcgattacccagtcgttctatcccttgagaaccattgttctacggctcagcaggaggttatggcagacaatctgcaagcaaccttcggggaatcattactctctgatatgctggacgattttcctgacacactgccatctccagaggctctgaagttcaaaattctcgttaaaaataagaagatcgggacactgaaggaaacgcatgaaaggaagggctccgacaagaggggggacaaccaggataaggagacaggagtgaagaaacttcccggtgtgatgctttttaaaaagaagaagacacgcaaattgaagattgctctggcacttagcgacttggtgatatatacaaaggctgaaaaattcaagagctttcagcactcaagattatatcaacagttcaacgaaaataactccatcggggaaactcaggccaggaaactgagcaagctgagggtccatgagtttatcttccatacgaggaagttcattacacgaatataccccaaagctacaagagcggattcctcgaatttcaacccccaggagttttggaatattggatgccagatggtggcgctgaatttccagacacccggactgcctatggatctccagaatgggaagttcttggacaacgggggatcgggctatatcctgaagccacacttcttaagggaaagcaaatcctactttaatcccagtaatatcaaggagggaatgcctatcaccctgacaattagactcatttccggtatccagctgcccttaactcacagcagttccaataaaggcgatagcctagtcatcatcgaggtgtttggggttcccaacgaccaaatgaaacagcagacaagagttataaaaaaaaacgcttttagtccacgctggaatgaaactttcacctttataatacacgttcccgagctggcattgattagattcgttgtggagggccaggggcttatagcaggaaatgagtttcttggccagtataccttgcccttgttgtgtatgaataaaggataccgacgaatccctttgtttagtcgaatgggcgagtcattggagcctgcatccctgtttgtctacgtttggtatgttcggtag

SEQ ID NO: 234930 - DNA, 1821 bp, Artificial Sequence
  Description of Artificial Sequence: Synthetic coding sequence
atgaggtggtttctcagcaagatccaggatgattttaggggtggcaaaatcaacttggagaagactcaaaggctgctagagaaattggatataagatgtagctatatccacgtgaaacagatcttcaaggataacgatagactgaaacaggggcgaatcaccatcgaggaatttcgggcaatctatcgcatcatcacccacagagaagagattattgagatcttcaatacatactctgaaaatcggaagatccttctagctagcaacctcgcccagttcttgacccaggagcagtatgccgctgagatgagcaaagcaattgctttcgaaatcatccagaaatacgagcccatcgaggaagtgaggaaggcccatcagatgagcctcgagggcttcacccgatacatggattcccgggaatgcctgctgttcaagaatgagtgcagaaaagtctaccaagacatgacacatccgttaaacgattattttatctcctcctcacacaacacttatctggtgagtgatcaacttctcggtccctctgacttgtggggatacgtgagtgccctagtaaagggatgtcgctgtctggagattgactgctgggatggggctcagaatgaacccgtcgtttatcatggatataccctaacatcaaagcttctattcaaaacagtgattcaggccattcacaagtacgccttcatgacttcagactatccagtcgttctgagccttgagaatcattgctcaaccgcgcaacaagaggttatggcggacaacctgcaagcgacattcggagagtcgctcctgagcgatatgttggacgattttccagacaccctcccaagtccggaggccctgaaattcaagatccttgtgaagaataagaaaatcggaaccctcaaagagacacatgaacggaaggggtcagacaagcggggtgataatcaggataaggagaccggcgtgaagaagcttcctggtgtcatgctttttaagaagaagaaaacccggaaactgaaaatcgccttggcactctcagatttggttatttacacaaaagcagaaaaattcaaatcgttccagcattctaggctctatcagcagtttaacgaaaacaactcaatcggcgaaacacaggcacgaaaactgtctaagctgagggtgcacgagttcatttttcatacacgcaaatttattacacgcatctatccgaaggccacacgggcagactcgtcaaacttcaacccacaggagttctggaatattggatgtcagatggtggctctgaatttccagactcctggcctgcctatggatctgcagaatgggaaatttctggacaacggcggaagtggatacatcctgaagcctcactttttacgggagagcaagtcctatttcaatcctagtaacatcaaagagggcatgcctattactcttaccatccgccttatctcaggcatacagctaccgcttactcatagcagcagtaataaaggagattctctggttattatcgaggtgtttggggtccccaatgaccagatgaaacaacaaactagagtgatcaagaagaatgcctttagccctcgttggaacgagacctttactttcattattcacgtgcccgagctcgccttaattcggttcgtcgtggaggggcaaggcctgatcgccggaaacgagttcttgggccagtatactctgccactactgtgcatgaacaaaggatataggcgtatccccctgttcagtaggatgggtgagtcactggagcccgcaagtctgtttgtctatgtatggtacgtgcgctag

SEQ ID NO: 234931 - DNA, 1248 bp, Artificial Sequence
  Description of Artificial Sequence: Synthetic coding sequence
atggagatgcgctggtttctctcaaagatccaggacgatttcagggggggaaagattaatctggaaaaaacacagcgtctattggaaaagctggacatcaggtgcagctacattcacgttaagcagatcttcaaaaccagcgattatccagtggtgttgagccttgaaaaccactgctccactgcacagcaagaggttatggcggacaacctccaggctaccttcggcgagtcgttactgtccgatatgctagacgacttccccgatactcttcccagccccgaagccctgaaatttaagatcctggttaagaacaagaagatcggcaccctgaaggaaactcacgaaaggaaggggagcgacaaaaggggggacaatcaggacaaagagaccggcgtgaagaagctcccaggcgtgatgctcttcaaaaagaagaaaacccgtaaactgaagatcgcactggcactctcagatttggttatctataccaaggcagagaagtttaaaagtttccagcacagcaggttgtatcaacaattcaacgagaacaattctatcggggagacccaagcacgaaaactaagcaaactgcgagtgcatgagtttatattccacacacgtaagttcatcacaagaatttatcccaaagcaacaagggccgactccagcaatttcaatccacaagagttctggaacatcggatgtcagatggtggcgcttaactttcagacccccggtcttcccatggatctgcagaacggaaagttcctcgacaacggcggatcaggctatatcctaaaacctcactttcttagggagtctaagagttattttaacccttcaaacattaaggagggcatgcccatcacacttaccattcgcctgatctcaggaatccagctgcctctcacccactcttcctccaataagggtgactctttggtcattatcgaggtttttggagtgccaaacgatcagatgaagcagcagaccagagtgatcaaaaagaacgccttctctcccaggtggaacgaaacattcacgttcatcatacatgttccagaactggctctgatacggttcgtggtcgagggtcagggcttgatcgctggcaatgagttcttgggccaatacacgctgccactcttgtgtatgaacaaagggtatagacgtatacctctgttttcaaggatgggtgagtctcttgagccagcaagcttgtttgtgtatgtgtggtacgtgcgttag

SEQ ID NO: 234932 - DNA, 1212 bp, Artificial Sequence
  Description of Artificial Sequence: Synthetic coding sequence
atggatagcagggaatgtctgctgttcaaaaatgagtgcaggaaggtgtatcaggacatgacccaccccttgaacgactatttcatcagcagctcccataatacatatttagtgagtgatcaactgctcggaccttccgatctctggggctacgtatccgccttggtcaaagggtgtcgctgcctcgagatcgattgttgggatggcgctcagaacgagcccgtcgtctatcacggatacacactgacttcaaaacttctgttcaaaaccgtaatacaggctatacacaaatacgctttcatgacaagcgattacccagtcgtcctaagccttgagaaccattgctccacggcccagcaggaggtgatggccgataatttacaggcaaccttcggtgagtctctgctgtccgatatgttagatgatttccccgatacactgccgtccccagaggccctcaagttcaagattctggtcaaaaataagaagataggaactttaaaggaaacgcacgagaggaaggggtccgacaaacgcggtgacaaccaggataaggaaaccggagtcaagaaactgcccggtgtcatgttattcaagaagaagaagacacggaagcttaaaattgccctggccctgtctgatctggtaatttacacgaaagcggagaagtttaagagttttcaacattcccgcctgtatcagcagttcaatgagaataattcgattggcgaaacccaggccaggaagctctcgaaattgcgcgtgcacgagttcatctttcacacacggaagtttatcactaggatctatcccaaggcaaccagagctgatagttcaaactttaatccacaagaattctggaatattggatgtcaaatggtggcgctcaacttccaaacccccggactgccaatggatctgcagaatggcaaattccttgacaacgggggaagcggttacatcctgaagccacattttctgcgagagtcaaaatcttacttcaaccctagcaacatcaaggagggcatgccaattaccttgaccataaggttaatttccgggattcagctgcctcttacacacagctccagcaataagggcgatagcctggttattatcgaggtgtttggcgtccctaatgaccagatgaagcagcagacccgggttattaaaaagaacggtcaagggaacatggtgattatcccagcgtag

SEQ ID NO: 234933 - DNA, 3387 bp, Artificial Sequence
  Description of Artificial Sequence: Synthetic coding sequence
atggcagattgcgtgcggggatgggcagctgtgggtggagccctccccaccagcccgggtccatcactgggggctaagggcgcactcaaagccggtgtgggtgaagatggcgttggcggaggtcgcctggtacatgggagggccaggtacgattcagggggtgtaagtaatggcgactgttcccttggcgtgtctggggatgaagcacgagcctcacccacccggggtccaagaggggtggccctggctcctactccaagcgccgtggtgtgtacactgccaagagaatcgaaacccggtggcctcccacggcgatcctccatcattaaagacggtaccaaacagaaacgcgagcgcaaaaaaaccgtgagcttcagttctatgcctaccgaaaagaagatatcctcagcatccgattgcatcaattccatggttgaaggcagtgagctgaagaaagttcggtcaaattctcgaatctatcatcgatactttctgctagatgcggacatgcagagtctgcggtgggaaccctccaagaaagattccgagaaggccaagattgacatcaaatccataaaggaggtgagaacaggaaagaataccgatatattccgatccaacgggatcagtgatcagatcagcgaagactgcgctttttccgttatttacggtgagaactacgaatcccttgatctggtagcaaacagcgcggatgtggccaatatttgggtgacaggtctgcgttatcttatttcttacggaaaacatacattagatatgcttgagtcatcacaagacaacatgagaacgagttgggtgagccagatgttctctgagatcgatgtcgataatctgggtcatatcactctgtgcaatgcagtgcagtgcatacggaacctgaatccaggattgaaaacttctaagattgaattgaagtttaaggagctacataagtctaaggataaagccggaacagaggttactaaggaagagtttattgaagtgtttcacgagctgtgtactcgaccagagatttattttctgctagtgcagttctcgagcaacaaggagttcctggacacaaaggacctgatgatgttcctcgaggcggaacagggcgtggcccacatcaatgaagaaatttccctggagattatccacaaatacgaaccgtcaaaggaaggtcaggaaaaaggttggctcagcattgacggtttcactaactatctaatgagccctgactgctatattttcgacccagagcataagaaagtctgccaggatatgaaacagccactttcccactacttcattaattcatctcataatacatatctaattgaggatcagtttcgtggaccctctgacattaccggttatatccgtgccctgaagatggggtgccgtagcgttgaactagatgtttgggacggacccgacaatgagcccgtgatctatactggacacactatgacgtctcaaatcgtatttagatccgtcatcgacattatcaataagtatgccttttttgcaagcgagtatccactcattctgtgcctagagaatcactgcagcattaaacagcagaaggtgatggtgcagcacatgaagaagctccttggggataagctctacacaacctccccgaatgtggaggagtcttacctaccatccccggacgtgctgaaaggcaagatattgataaaagccaagaagctgagcagcaattgctccggagtcgagggagacgtgaccgacgaagacgaaggggcagagatgtcacagcggatgggaaaagagaatatggagcaaccaaataacgttcccgttaaacggttccagctgtgtaaagagctctcagagctggtctccatttgtaaaagcgtacaattcaaggagtttcaggtttcatttcaagttcagaagtactgggaggtgtgtagctttaatgaggtactcgcatcgaaatacgcaaatgagaacccaggagatttcgtgaactataacaaacgttttctggctagagtgttcccaagccctatgcggatagactctagcaatatgaacccgcaggatttctggaagtgtggttgccagattgtcgccatgaattttcaaacccctggtctgatgatggacctcaacatcggatggtttagacagaacggtaactgtgggtacgtgctcagacccgctattatgcgggaggaggtgtccttcttcagtgctaacacaaaggatagtgtgccgggagtaagccctcaactgctacacatcaagattatctctggccagaacttccctaagcctaaaggctcgggcgctaagggggacgtcgtggatccctatgtgtatgttgagatccacggaattccagctgactgcgccgagcagcgaacaaaaaccgtgcaccagaacggcgatgcacccatcttcgatgaatcatttgagttccagatcaacctccctgaactggctatggtccgctttgtcgtcctggatgacgattatatcggcgacgagtttattggacagtacaccatcccgttcgagtgtctgcagaccgggtacagacacgtgccactgcaatccttaaccggcgaggtgcttgcacacgcctcattgttcgtgcacgttgctataaccaaccgaagaggtggcggaaaaccccataagcggggtctgtccgtgaggaagggtaagaaaagcagggaatatgcctccctgcgcacactgtggataaagacagttgacgaggtgtttaaaaatgcacagcctcctattagagatgccactgacctgagggaaaacatgcagaatgcagtggtgtcctttaaagagctgtgtggattgtcgtctgtggcaaacctgatgcagtgtatgctcgccgttagccctaggtttctggggccagataacactcctctcgttgtgttgaacctgagcgagcagtacccaactatggagttgcagggcattgtgcccgaagtcctaaagaagatcgtgactacatatgatatgatgatccagagcctgaaggctcttattgagaacgcagacgcggtgtacgagaaaatcgtacactgtcagaaagccgctatggagttccatgagcatctccactccatcgggaccaaggagggactgaaagagcgtaagttgcagaaagcggtagagtcgtttacatggaatatcacaatccttaaggggcaggccgacttattgaagtacgctaagaacgagaccctcgagaatctaaagcagatccattttgccgctgtctcctgtggactgaataagccgggtaccgagaatgcagacgtgcagaaaccacgaaggtccctggaggtcatcccagaaaaggctaatgacgaaaccggagaatag

SEQ ID NO: 234934 - DNA, 2883 bp, Artificial Sequence
  Description of Artificial Sequence: Synthetic coding sequence
atgccaactgagaaaaagatctcttcagcctctgattgcatcaacagcatggtggagggatccgagcttaagaaggttaggagcaacagccgcatctaccatagatacttcctgctggatgccgacatgcaatcgctccggtgggagccctccaaaaaagacagcgagaaggctaaaattgatataaagtcaattaaggaagtacgcactgggaagaacactgatatctttaggagcaatggcatctcagatcaaatatccgaggactgtgcttttagcgtcatctatggggagaactatgagagccttgatttagttgcgaacagcgcagatgtggctaacatttgggtgactgggctgaggtaccttatttcatatggtaagcataccttagacatgctggaatcgagccaggataacatgagaacctcttgggtctcccaaatgtttagcgaaatcgatgttgataacctggggcacatcaccttatgcaacgccgtacagtgtatccgcaacctgaacccagggctgaagactagtaagatcgaattgaagtttaaggaattgcacaaatccaaagacaaggccggaacagaggtgacaaaggaagaatttatcgaggtgttccacgagctctgcacacgcccagaaatatattttcttctagtgcaattttcctctaacaaggaatttctcgatacaaaagatcttatgatgttcttagaggccgagcaaggcgtcgcccacatcaacgaggaaataagtctggagatcatccataagtacgagcccagcaaggaaggtcaggagaaaggatggctttcaatcgatggtttcaccaattatctgatgagcccagattgctatatattcgatcccgaacataaaaaagtgtgccaggacatgaagcagcccctttctcattattttatcaactccagtcataatacctacctcatagaggatcagtttaggggaccatctgatattaccggatacatccgggctctgaaaatggggtgccgctctgtggagttggacgtttgggacgggccagataacgaaccagtgatatacacgggacacacaatgacatcgcagattgtgttcagatcagtgattgacattatcaacaaatatgctttcttcgcaagtgagtatcccctgatactgtgtttagaaaatcattgttctattaagcaacagaaagtcatggttcagcacatgaaaaaacttctgggagataaactgtatactactagccctaatgttgaggagagttacttgccctctcccgacgtgttaaaggggaaaatcctgatcaaagccaaaaaactcagttctaactgttctggtgtcgagggtgacgttaccgacgaagacgaaggggctgagatgtctcagcggatgggcaaagagaatatggagcaacccaataatgtgcccgtgaagcgcttccagctgtgcaaggaactctcagagctggtctccatttgtaagagtgtacaatttaaagagttccaggtgtcttttcaagtccagaaatactgggaggtttgttcctttaatgaagtgctggccagcaaatacgccaacgaaaaccccggtgactttgtgaactataataagcgcttcctggcccgtgtgtttccgtcacctatgagaatcgatagcagcaacatgaacccccaggacttttggaagtgcggatgtcagatcgttgcaatgaacttccagacccctgggctgatgatggatctgaacattgggtggtttcgacagaacggcaattgcggctacgtcctgcggccagccatcatgagggaggaggtgtctttcttttccgccaataccaaggatagcgtgccaggggtgtctccccagctgcttcacataaaaataatatctggccagaattttcccaagcccaaggggagcggcgctaagggcgacgtggtggatccctatgtgtacgttgaaatccacgggatccccgctgactgtgcagagcagcgtaccaagactgtgcatcagaacggcgatgctccaattttcgatgagtctttcgaattccagatcaatctgccagagcttgctatggtgcgattcgtggttctggacgacgactacattggtgacgagtttataggccagtacacgattcctttcgaatgtctccagactggctacaggcacgttcctctgcaatctcttacaggcgaagtgctggctcacgctagcctgttcgtacacgtggctattactaaccggcgtggaggtggaaaaccccataagcgaggtttaagcgtccggaaaggaaaaaaatcacgggaatacgctagtctgaggacactgtggatcaagaccgtggacgaagttttcaagaatgctcagccccctatacgcgatgcaacagatttgcgagagaacatgcagaacgctgtcgttagcttcaaggagctgtgcggtttgtcaagtgtggcaaatctgatgcaatgtatgctcgcagtctcaccaagatttctgggacccgataataccccgttagtggttctcaaccttagcgaacaatacccaactatggaacttcaaggcatcgtgccagaggtgctaaaaaaaatagtaactacgtatgatatgatgattcagagcctgaaagccttgattgagaatgccgacgccgtgtacgagaagatcgtgcactgtcagaaagccgcaatggaattccacgaacacctgcactcaatcgggacaaaggagggcttgaaggagcgaaaactgcagaaggcagttgaaagcttcacttggaacattacaattctgaagatcaggaaaaccggacgacgaagcatttttgtgccacagaccccaatcatggtgtag

SEQ ID NO: 234935 - DNA, 3006 bp, Artificial Sequence
  Description of Artificial Sequence: Synthetic coding sequence
atgccaaccgaaaagaagatctctagcgcctctgattgcatcaatagcatggtcgaaggcagcgaactcaagaaggtgcggagcaacagtcggatctaccatcgctacttcctcctcgacgctgacatgcagtcactacgttgggagcccagtaaaaaggactcagagaaggcgaagatcgatattaagagtatcaaagaggtgaggacgggcaagaacaccgatatatttcgatccaacgggatctccgaccagatcagtgaagattgcgccttttcagttatttatggggaaaactacgaaagcctggatctcgtggccaacagcgctgacgtggccaacatctgggtgaccggacttcgatacctgatttcgtacggcaaacacacactggacatgctggaatcgagtcaggataatatgcgcacctcttgggtcagtcagatgttcagcgagatcgatgtggacaaccttggccatatcaccctgtgcaacgctgtacagtgcattcgcaatttaaatcctggcctcaaaacatcgaaaattgagctgaagttcaaggagctgcataagagcaaggacaaggccggtaccgaggtgactaaggaggagttcatagaggtttttcatgagttatgcaccaggccggagatttactttctattggtgcagttttccagcaacaaggagtttctcgacactaaggacctcatgatgtttctcgaagccgagcagggggtagcccatataaatgaggaaatctctctggaaattatccacaagtatgagccctccaaggaggggcaggaaaaagggtggcttagcatcgacgggtttactaattacttaatgagccccgattgctatattttcgatcctgagcataaaaaagtgtgccaggatatgaagcagcccctctcacactacttcatcaactcttctcataacacatacctgattgaagatcagtttcggggaccgagcgacattaccggctacattagagccctcaaaatgggctgccggtcagtcgagcttgacgtatgggatggcccagataacgaaccagtgatctatactggccacaccatgacaagtcaaattgtgttcaggagtgtgattgacataattaacaaatacgcattctttgcctcggagtaccctctcatcttgtgcctcgaaaaccactgtagcatcaagcagcagaaggttatggtgcagcacatgaagaaacttctcggcgataagctgtatactacgagcccaaatgtcgaggaatcctatcttccttcccctgacgtgcttaagggaaagatcctcatcaaagctaagaagctgtcatctaactgcagcggtgtggagggtgacgtgacagatgaggatgaaggggctgaaatgtcccagagaatggggaaggagaatatggaacaaccaaataatgtcccagtgaaacgatttcagctgtgcaaggaactgtctgagttagtatccatttgtaagtccgtccagtttaaagaattccaggtttcattccaggtccagaagtactgggaagtttgctcctttaatgaagtcctggctagcaaatatgcaaatgaaaatcctggagattttgtgaactacaacaagagatttctggcaagggtattcccctctcctatgagaattgattcctcaaatatgaacccccaggatttctggaagtgtggctgtcagattgtggcaatgaactttcagactcctggcttaatgatggacctcaatataggctggttccgtcagaatgggaattgtggctatgtactgcgcccagctatcatgcgagaggaagtctcttttttctccgccaatactaaagatagtgtgcccggagtttctcctcaactactgcacataaagatcattagcggccagaatttccccaaaccgaaaggatcaggcgcaaagggagacgtcgtagatccatacgtctatgtggaaatacatggaattcctgcagattgcgcagaacagcgaaccaagaccgtgcatcaaaacggagatgccccaatcttcgacgaaagtttcgagtttcaaatcaatttgccagaactcgcaatggttcgcttcgtagtgctggacgacgattatatcggtgacgagttcattgggcagtacaccattcctttcgaatgcctgcaaactggataccgacacgtgccactccagtccctcactggtgaagtgctggctcacgcctctctttttgtccatgttgcaatcactaacagacggggaggcggaaagccccataagcgcggattgtccgtgcggaaaggcaagaaatctagggagtatgccagcctgcgcacgttatggattaagaccgttgatgaagtcttcaagaatgcccagccgccaattagagatgccactgacctgagggagaacatgcagaatgctgtggtgtctttcaaggagctgtgtggcttaagctctgtcgctaacctgatgcagtgcatgctggccgtgtctcccaggttcctaggaccagataacacacctctcgtggtactcaatctgtcagagcaataccctacaatggagctgcaaggtattgttcctgaagtgttaaaaaaaattgtgactacctacgatatgatgattcagagccttaaagcccttatcgagaatgcagatgccgtctacgaaaaaatagtgcactgtcagaaagccgcaatggaattccatgagcaccttcatagtataggtactaaggaaggcctgaaagagcgcaagttgcagaaggccgttgagtcctttacatggaacataaccattctgaagggccaagcagatctcctaaaatatgcaaaaaacgagaccctagaaaacctcaagcagatccactttgctgccgtctcctgcggactgaataaacccggtactgagaacgcggacgtgcagaaaccccgtcgcagtctggaagttatcccagagaaggccaatgacgaaactggggaatag

SEQ ID NO: 234936 - DNA, 3006 bp, Artificial Sequence
  Description of Artificial Sequence: Synthetic coding sequence
atgccaacagagaaaaagatcagctctgccagtgactgtatcaattctatggtcgaagggtcagaactcaaaaaggtgcggtctaattcacgaatatatcacagatatttcctgctcgacgctgatatgcagagtctacggtgggaaccatctaaaaaagacagtgagaaggcaaagatcgatatcaagtcgattaaggaggtgcgaaccggaaaaaacactgatatcttcaggtccaatgggatcagcgaccagatcagtgaagattgcgcttttagcgtgatctatggtgagaactacgagagcttagacttggtcgcaaacagtgctgacgtagccaacatatgggtcactggccttaggtacctcataagctacggaaaacacactctcgacatgttggaatcctcgcaggataacatgcggaccagctgggtaagccagatgttttccgagatagatgtagataatctgggccatataacactgtgcaacgccgtgcagtgtataagaaatttaaacccagggctgaaaacatccaagatcgaacttaaatttaaggaactgcacaaatcaaaagacaaggccggaacagaagtgacaaaggaggaattcattgaagtttttcacgaactctgcaccaggcctgaaatctactttctgctggtacagttctcgtctaacaaagagtttcttgatactaaggacctgatgatgtttctggaggccgagcaaggggtagctcatattaacgaggaaatcagcctcgagattattcacaaatacgagccttcaaaagaaggccaggagaaaggctggctcagcattgacggctttactaattatttaatgagcccagactgttacatttttgaccctgagcacaagaaggtctgccaggacatgaagcaacccctgagtcactattttatcaatagcagtcataatacatacctgatcgaggatcaatttagggggccttctgacattacgggatatatacgcgcattaaaaatgggctgccgcagcgtcgagctggatgtctgggacggacctgataacgagcccgtgatctacaccggtcacacaatgactagccagattgtcttcaggagtgtaatcgatataatcaacaaatacgccttttttgcgtccgaataccctctgatcctgtgccttgagaatcactgctctatcaagcaacaaaaggtgatggtgcagcatatgaaaaagctccttggcgataagctgtatacaaccagccctaacgttgaagagtcctacttgccttcccccgacgttctgaagggcaaaatcctgataaaggccaaaaagctcagcagtaattgcagcggagtggaaggagatgtcactgatgaggatgagggtgctgaaatgtctcagagaatggggaaagagaacatggagcaacccaataatgtgccagtgaagaggtttcaactgtgcaaagagctatcagagcttgtgagcatctgtaagagtgttcagttcaaagaatttcaggtttccttccaggtccagaagtattgggaagtctgctccttcaatgaagtgctggccagcaaatacgcaaacgagaatcctggcgactttgtaaactacaacaagcggtttctggccagggtattcccgagccctatgagaatcgacagctcaaatatgaatccacaggacttctggaagtgtggatgtcagatcgtcgcaatgaatttccaaactcctggacttatgatggacctgaacatcggttggtttagacagaacggtaattgcgggtatgttcttcggccagccatcatgagggaggaggtttcattcttttccgcgaataccaaagatagcgtgccaggagtcagtccacagctcctccacataaagatcatcagcggccaaaattttccaaaacccaaaggcagtggggcaaagggagacgtcgttgacccttacgtctatgtcgaaattcacggtattcccgcagactgcgcagagcaaagaacaaagacggtgcatcaaaatggagacgcccctatctttgacgaatcctttgaattccaaattaatctcccggaattggctatggtgcggtttgtggtgctggacgatgattatataggtgacgaattcataggacagtacactatccccttcgagtgtctgcagacaggctatagacatgtccctctgcagtcactcactggcgaggtgctagcccacgcatctctcttcgtgcacgtggctattaccaacagaagaggaggtggcaaaccacacaaacgcggtctgagtgtccgtaaaggaaaaaagtcccgggagtacgcttccctgcggactctgtggataaaaacagtcgatgaggtgttcaagaatgcccagccccctattcgggatgcaaccgacctcagagaaaatatgcagaatgccgtggtgtcatttaaagaactgtgcggcctgagctctgtagccaaccttatgcaatgcatgctggccgtttctcctcgattcctgggtcctgataacaccccacttgttgttctaaacctctccgagcagtaccctacaatggagttgcagggtattgttcccgaggtgctgaaaaagatagttaccacatacgacatgatgatccaaagcctcaaagctctaattgaaaacgctgatgctgtgtatgagaagatcgtgcattgccagaaagcagctatggaatttcatgaacacctgcattctatcggcactaaggagggccttaaggagcggaagctacagaaggcagtcgagtcattcacctggaacattactattttgaagggccaggctgacctgctgaagtacgctaagaacgagactctcgagaaccttaagcaaatccattttgcagctgtgtcttgcggcctcaacaagcccggaaccgagaacgccgatgtccaaaaacccaggcggtcattagaggtgattcctgagaaggcaaatgacgagaccggtgaatag

SEQ ID NO: 234937 - DNA, 2802 bp, Artificial Sequence
  Description of Artificial Sequence: Synthetic coding sequence
atgacagctacacccgagtctctgtttcctacaggggacgaactggacagctcccagttacaaatggaatctgatgaagtcgatactctcaaggaaggtgaggacccagccgaccggatgcacccttttttagcaatttatgaactgcaatccttaaaggtgcatccactggtgttcgctcctggcgtgcctgtcactgcgcaagtggtcggcacagaaagatatacaagcggatctaaagtaggcacttgtaccttatattccgtgcgcctgacacacggagatttctcctggacgactaaaaagaagtataggcatttccaggagctgcatcgtgatctcctcagacacaaggttctgatgtccctccttccactagcacggttcgccgttgcgtattcacctgctagggatgccggaaatcgcgagatgccttccttgcctagagccggacccgaggggtctacccggcatgctgcaagcaaacaaaaatacttggaaaactacctgaataggcttttgaccatgtcattctaccggaactatcatgctatgaccgagttcttggaggttagtcagctgagtttcatccctgacctgggccgaaaaggtctcgaaggcatgatacggaagcgatccgggggacaccgggtgcctggtcttacttgttgcggtcgggatcaggtgtgttacagatggtctaaaagatggctggtcgtgaaggattcctttctcctgtatatgtgtctggaaactggcgcaatatcttttgtccagctttttgaccctggtttcgaagtgcaagttggcaagaggtcgaccgaggcccgacatggcgtgcgtatagatacaagccaccgctcactgatcctcaagtgttcatcatacaggcaagcgagatggtgggcccaggaaatcacggagctggctcagggacccggaagagattttctccagctccataggcacgacagttacgctcccccaaggcctgggacacttgcaagatggttcgtaaacggcgcaggctatttcgccgcagtggcagatgccatcctgagggcccaggaggaaattttcatcacggactggtggctgtcaccggaagtgtatctcaaacgacctgcacacagcgacgactggcggctggatataatgctcaaaagaaaggcagaagaaggggtgcgcgtgtcaatcctattgtttaaggaagtggagttggcgttgggcattaacagcgggtattcgaagagagccctgatgctgcttcatcctaacattaaagtgatgcggcaccctgaccaggtgaccctgtgggcccaccacgaaaaactgctggtcgtggatcaggtggtggcctttctcggcggactcgatctggcctacggacggtgggacgatctacactaccggcttaccgaccttggcgattccagcgaatctgctgccagtcagcctccaaccccaagaccagattcacctgctacccccgatctgagtcacaaccagtttttttggctgggaaaagactattcaaacctgatcaccaaagattgggtgcagctggatcggccttttgaggacttcattgatcgagagactacccctaggatgccctggagagatgtgggagttgtcgtccatggactgcctgctcgggacctggcccgacactttattcagaggtggaattttacaaagaccacaaaggctaagtataagactcccacgtatccctaccttctgcctaaaagcacctcaaccgctaaccagttaccatttacactgcccggagggcagtgcacaactgtgcaggtgttacgcagcgtggatcgctggtccgccggtacactggagaattccatcctcaacgcttaccttcataccatccgcgagagccaacactttctgtacatcgagaaccagttctttattagctgctcagacgggaggaccgtgctgaataaagtcggggacgagatcgttgataggatcctcaaggctcataagcagggctggtgttacagggtgtacgtactgctgcctcttcttcccggtttcgaaggagacatttccaccgggggtggcaacagcatccaggcgatcctgcactttacttaccgaacactgtgtagaggcgagtacagtatcttgcacagattgaaagcagctatgggtaccgcttggcgagactacatttctatatgtggactgcgtacccatggggagctgggagggcacccagtcagcgagctcatctacatccactcaaaagtgttgattgccgacgacaggaccgttataattgggagtgccaacatcaacgatcgaagtctgctgggaaagagggactcagagctggcggtgctcattgaggataccgaaactgaaccctccttaatgaacggagcggaataccaagccggtagattcgctttgtcgctgcggaagcactgctttggagtgatcttgggcgctaatactcgtcctgatctggatctgcgggacccaatttgtgacgatttcttccagctatggcaggacatggctgagtcaaacgccaacatctatgaacaaatcttccgatgcttgccttcaaatgccacccgatcactgcgcactttacgggagtacgtcgcagtggaaccattagcaactgtctctccgccattagcaagatcagaacttacacaggtgcaggggcatctggtccacttccctttaaagtttcttgaggacgagtccctactgccaccgttggggtcaaaggaagggatgatacctcttgaggtctggacctag

SEQ ID NO: 234938 - DNA, 2769 bp, Artificial Sequence
  Description of Artificial Sequence: Synthetic coding sequence
atgacggcaactcccgaatctctgttccctactggcgatgagttggatagctcccagctgcagatggaatcagatgaagtggataccctgaaggaaggggaggacccggcagatcggatgcatccttttctagcgatttatgagctacaatccttgaaggtgcaccctttagtcttcgcccctggcgttccagttacagcacaggtcgtgggaaccgaacggtatacgagcgggtctaaggtagggacctgtaccttgtactcggtccgcttgacgcatggagacttcagttggaccactaagaagaagtaccggcatttccaggagttacatcgagacctgctgagacataaggtccttatgtcacttctgccattggccagattcgcggtcgcttattcacccgcaagagatgctggcaatagagagatgccatccctgccgagagccggacccgaggggagtaccagacacgccgctagcaagcagaagtacctagagaattacctcaataggctgctaaccatgtccttttaccgcaactatcatgcaatgactgagtttctggaggtcagccagctcagttttatcccagacttaggcaggaagggactagaaggaatgattcggaagcgatcaggaggacatagagtgccaggtctaacatgttgcggcagggaccaagtgtgttataggtggagcaagaggtggctcgtggttaaggactctttcctcttatacatgtgcctggagactggggctatttcctttgtgcagctgttcgatccaggattcgaggtgcaggtgggcaagcgctccaccgaagccaggcacggagtccggattgatacctctcacaggagccttatcctgaaatgcagttcctacaggcaggcccgatggtgggctcaggagatcaccgagctggcgcagggccctggcagggactttctgcagttgcatagacacgattcgtatgcccctcctcgccctggaaccctggcccgatggtttgtaaatggggcaggatattttgccgcagtagcagacgcaatccttcgcgcacaggaggaaatctttataaccgactggtggttgagtccagaggtgtatctcaagagacccgctcattccgatgattggcggttagacatcatgctaaagagaaaagctgaggagggcgtacgggtgtccattctcttgtttaaggaggtggagttagccctgggcattaactccggatactctaaaagggcactcatgctgcttcatcctaacatcaaagttatgaggcaccctgatcaagttactctttgggcacatcacgaaaagttactagttgtggaccaggttgtagcgtttctcggtgggcttgatctggcgtacggtcggtgggatgacttacattacagactgacggacctgggagattctagcgagtctgcggcttcacagcccccaaccccccgacccgattccccagctacaccggatctttcgcacaaccagtttttctggctgggtaaggactactccaatctcattaccaaagattgggtccagttagataggcccttcgaagacttcatagacagagagacaaccccacgaatgccttggcgcgacgtgggcgtcgttgtccacgggctgccggctcgcgacctggccaggcattttatccagaggtggaactttacgaagaccactaaggctaagtacaaaacacccacttatccctatctgctgcctaaaagcaccagcaccgctaatcaattgccctttacattacctgggggtcaatgcacgacagttcaggtgctgcggtctgttgacaggtggtccgctggcaccctggagaatagtatcctgaacgcctacttgcatactatccgggaatcacagcatttcctgtatatcgagaatcaattttttatatcatgctcagacgggagaaccgtcctgaacaaggttggagatgaaatagtagatcgaatcctgaaagcgcataagcaaggctggtgctacagagtgtatgtgctgcttcctctcttgccaggattcgaaggagacatttcaacaggcggtggaaattctattcaagcaatcctgcatttcacttacagaactctgtgccgtggtgaatactccatcctccacaggctgaaggccgcaatgggaaccgcctggagggattatattagcatctgcggcctccgcacacatggagaactaggagggcatcccgtcagtgagcttatttatattcacagcaaagttctcatagccgatgaccgcaccgttatcatcggtagcgctaacattaacgaccggtctctccttggcaaacgcgattcagagttagcagtgctaatcgaggatactgaaacggaaccttcgcttatgaatggcgcagagtatcaggctggcagcgttatcctgggagcaaacacgcggcctgacctggacctgcgggatccaatttgtgacgattttttccagctctggcaagacatggccgagagcaatgccaacatttatgaacagatattccgctgtcttcctagtaacgctacccggtctctgagaactcttagggagtacgtggcagtggagccactcgccacggtaagtcctcctctggccaggtcggaactcactcaagtccagggccacctggtgcacttcccgttgaagtttctggaggatgagtccctcttgccacctctggggtctaaagagggtatgattcccctggaggtctggacatag

SEQ ID NO: 234939 - DNA, 957 bp, Artificial Sequence
  Description of Artificial Sequence: Synthetic coding sequence
atggataaacaaaactctcagatgaacgccagtcaccctgagaccaatctccccgtgggatacccaccccagtatccacccaccgcttttcagggaccccctggttattcggggtacccaggcccacaagtgtcatatccccctcctcccgctggtcacagcggcccagggccagctggcttcccagtgcccaaccaacctgtgtataaccagccagtatacaatcaaccggtgggagcggctggcgtgccatggatgccagcgcctcagccccctctgaattgtcctccgggacttgaatacctcagccagatcgaccaaatcctgatccatcagcagattgaactgctggaggtgctgactggattcgaaaccaacaacaagtatgaaatcaagaacagcttcggacagagagtctacttcgcggcagaagacacagattgctgtacaaggaactgctgtggcccatcgcgcccattcactctcagaatcattgacaatatgggccaagaggtcatcacccttgagagacccctcaggtgtagcagctgttgctgtccgtgttgtctgcaagagattgagatccaagctccccctggagtccccataggttacgtaatccagacctggcacccttgcttgccaaaattcaccattcaaaacgagaaacgagaagatgtgctcaagatttctggtccatgtgtcgtctgctcctgctgcggcgatgtggatttcgagatcaagagcctagacgagcagtgtgtggtgggaaaaattagcaaacactggaccggcattttgcgcgaagcctttaccgacgctgataactttgggatacagtttccactagacctggacgtcaaaatgaaggccgttatgatcggcgcttgcttcttaattgatttcatgtttttcgaatccaccgggtctcaagaacagaagtccggggtttggtag

SEQ ID NO: 234940 - DNA, 93 bp, Artificial Sequence
  Description of Artificial Sequence: Synthetic coding sequence
atgaaagcagtcatgatcggcgcttgcttcctgatagatttcatgttcttcgagagcaccggcagtcaagaacaaaagtctggggtgtggtag

SEQ ID NO: 234941 - DNA, 750 bp, Artificial Sequence
  Description of Artificial Sequence: Synthetic coding sequence
atggataagcagaactcccaaatgaacgcttcccaccccgaaacaaacttgccggtgggttatccccctcagtatcctccaacagcatttcaggggccacccggttacagcggataccccggtccgcaagtgtcttacccccctccacccgctgggcacagtggacctggacctgcaggtttccccgtgccgaatcagcccgtgtataaccaacctgtatataaccaacctgtgggcgctgctggggttccgtggatgccagccccacagcctcccctgaattgcccccctggcctggaatatctttcccagatcgaccagatcctcatacatcagcagattgagttactcgaggtgctgaccggttttgagacgaataacaaatacgagattaagaactccttcggacagcgtgtatattttgctgcggaggacaccgattgttgtacacggaattgctgtggccctagtaggcctttcacactccgcataattgataatatgggacaagaagttattacactcgagcgacctttacggtgttccagctgttgctgcccgtgttgtcttcaggagatagagattcaggcccctccaggcgtgcccattggctacgttatccagacctggcacccctgcctgccaaagttcacgattcagaacgagaaacgcgaggacgttcttaagatcagcggaccttgtgttgtctgcagctgctgtggagacgttgattttgagataaagtcgtag

SEQ ID NO: 234942 - DNA, 675 bp, Artificial Sequence
  Description of Artificial Sequence: Synthetic coding sequence
atgccagctccccctcccccactcaattgcccgccagggttggagtacctgtcgcaaatcgacatgattcttattcatcagcagatcgaactgctggaggtactgttcagtttcgagtcgtctaatatgtatgagataaagaattcattcgggcagcggatctacttcgccgcagaggatacaaatttctgcatcaggaactgctgcggaaggtcacgtccatttacattacggatcacagacaacgtgggaagggaagtgataactctggagcggcctcttaggtgcaattgctgttgttgcccgtgctgcttgcaagagatagaaatccaagccccaccgggtgtgccggtggggtacgttacacaaacatggcacccatgcctgaccaaatttaccattaagaatcagaagagagaagacgtgttaaagatttcaggcccttgtatcgtctgctcgtgcattgcaggggtggacttcgagatcacatcattggatgagcaaatcgtagttggtagaatctccaagcattggtctggctttttgcgcgaagcgtttacagacgctgataattttgggattcagtttccacgcgatctggacgtaaaaatgaaggccgtcatgataggggcttgctttctgatcgattacatgtttttcgagcgcacacgatag

SEQ ID NO: 234943 - DNA, 486 bp, Artificial Sequence
  Description of Artificial Sequence: Synthetic coding sequence
atgcccgctccccctccgcctttgaattgcccccctgggctggagtatctgtctcagatcgatatgatactgatccaccaacagatcgaactgcttgaggttctcttttcttttgagagctctaacatgtacgagatcaagaacagcttcggccaacggatatacttcgcagctgaagacaccaacttctgtattaggaattgttgtggtagaagccggcctttcacacttcggattaccgataacgtaggacgggaagttatcactcttgagaggcccctgcgctgcaactgctgctgttgtccctgctgccttcaggaaattgagatccaggcacccccaggtgtcccagttggatacgtgacccagacttggcacccttgcctcaccaaatttaccattaaaaatcagaagagggaggacgtcctgaagatctcggggccatgcatcgtctgtagctgtatcgcaggcgtggattttgagtag

SEQ ID NO: 234944 - DNA, 894 bp, Artificial Sequence
  Description of Artificial Sequence: Synthetic coding sequence
atgcgttcctggaactcactattttgtcttaattcctcgagacccccaggacacatcgtctaccccaaacaccaggctggtcacacaggcaagcaggccgaccacctaggctcccaagctttttatcccggacgccagcatgattatctcgtacctcccgcaggcaccgcgggtattccagtccagaatcagcccggaagaccagagggagtgccttggatgcctgccccacccccacctctgaactgccctcccggattagaatatttatcacaaatcgatatgatactgattcaccagcaaatcgaactcttggaagtccttttctccttcgaaagctccaatatgtatgagatcaaaaactcgttcggtcagaggatttattttgccgcagaggacactaacttctgcatccgaaactgctgcggccgatcacgacccttcactctccggatcacagataatgtcggtcgagaggttatcactctcgaaaggcctctaagatgcaattgctgttgttgcccttgctgccttcaggaaattgagatacaggcgccacccggagtgcctgtggggtacgtaacgcagacctggcacccatgcctgaccaagtttaccatcaagaaccagaagcgggaagatgtgttgaagatctcaggaccttgcatcgtatgcagctgtattgccggagtggattttgaaatcacctcactcgacgaacagatcgttgttggccgaattagcaagcattggtccggctttttacgggaagccttcacagacgctgacaatttcggtatccagtttccgagagatcttgatgtcaaaatgaaggccgtgatgatcggtgcctgtttcctgattgattacatgttttttgaaaggacacgatag

SEQ ID NO: 234945 - DNA, 951 bp, Artificial Sequence
  Description of Artificial Sequence: Synthetic coding sequence
gtctcggcccatcttaggttttttttggctataatcttaagagattccggcctgtgggctgaatggagaatgaagccctttcagatacatcttcccggaccacccggtcatattgtctatccaaaacatcaggccggtcacacaggaaagcaagccgatcatctcggctcccaagctttctatcccggaaggcagcatgattatttggttcctccagcaggcacggctgggattcctgtgcagaaccagcccggtcgcccagagggcgtgccatggatgcctgcgccacctccacctctcaattgcccgcctggtttggagtacctaagccagattgatatgattcttattcatcaacagattgaactcttggaggtgttgttttcgttcgaaagcagtaatatgtatgaaataaagaatagctttggtcagcggatctactttgctgcagaagatacaaatttctgcattcggaactgttgcggcaggtctagacccttcactcttcgcatcactgacaatgtggggagggaagtcataactttggagcgcccactgcgatgtaactgctgctgttgcccttgttgtctgcaagagatcgagattcaagctccgcctggagtacctgttggctacgtaacccagacatggcacccgtgtctaaccaagttcactataaagaaccagaaaagggaggacgtattgaaaatctcaggaccatgtatagtgtgcagttgtattgctggggtggacttcgagatcactagcttagacgaacagatcgttgtgggacgaatatccaagcactggtctggttttctgcgggaagcatttacggatgctgataacttcgggattcaatttcctcgggatctggacgtcaagatgaaggcggtgatgatcggagcttgcttcctgatagattatatgtttttcgagagaactagatag

SEQ ID NO: 234946 - DNA, 888 bp, Artificial Sequence
  Description of Artificial Sequence: Synthetic coding sequence
atggccggatatttgcccccaaaaggatacgccccatcgccaccgccaccctacccagtgactcccggatacccagaacccgctctgcaccctggtccagggcaggctccggtgcccgcacaggtacccgcaccggcacccggttttgcgctattccccagtccaggccctgtggcactgggatctgccgcaccattcctccccctacccggagtccccagtgggctggagttcctggtacagatcgatcagattctgatccaccagaaggcagagcgtgtcgagacttttctggggtgggagacctgtaaccgttatgagttacgatctggagccggtcagccgctgggccaggcagccgaggagagcaattgttgcgcaaggctctgctgtggagcacgccgacctttaagagtgcgccttgccgatccgggagatagggaagtcctaaggctgctccgaccactccactgtggatgttcttgctgtccatgcggactgcaggaaatggaggttcaggcccctcccggtaccacaattggtcatgtactgcaaacatggcacccttttctgccgaaattttcaatccaagacgccgaccgccagactgtgctaagggtggtcggcccttgttggacatgtggctgcggcaccgacacaaattttgaggttaagacccgcgatgaaagtagatccgtaggaaggattagcaaacagtggggcggtcttgtaagagaagccctgaccgatgcagacgactttgggttgcagtttccgctcgacctcgatgtccgagtgaaggcagtgctgcttggcgctacattcttgattgattatatgttcttcgagaagagggggggagccggtccgagtgcagtgacgtcatag

SEQ ID NO: 234947 - DNA, 672 bp, Artificial Sequence
  Description of Artificial Sequence: Synthetic coding sequence
atggccggttacttgccccctaagggttacgcgcctagcccaccgccaccttaccccgtgacgcctggatatcccgagccagctcttcacccaggacccggacaagcgcctgtgccggctcaagtgccagctccagccccaggcttcgcactgttcccaagcccaggtcctgtggccctcggtagtgccgcaccctttctccctctgccaggcgtcccctccggtctggaattcttggttcaaattgaccagatccttattcatcagaaagccgaaagagtcgagactttcttgggatggcggcctgtgatcgggatgaattgcgctctgggccctggaagcccctgggtccgccgtcctaggcgtgctaccgccgcacccgtttgcgctgtggcacccgcaggcaggtgtgttagcgcttggcctacacccggaactgtgcggtgctgcgtatgcagtgcacgatgcactgtcgcagcggcagcagctccagttgcttccaggcgctggaagtacagactacaccaggcacccccactcgccacctgctatcgtcccggtataccttcctcaccgagctcccccagccggatgccaattgcacgtcagagctgcgaatggtgggggccagccggtccagtcgccgtggcccaaacccccacactccgttag

SEQ ID NO: 234948 - DNA, 888 bp, Artificial Sequence
  Description of Artificial Sequence: Synthetic coding sequence
atggctggatacttaccaccgaagggatacgctccaagtcctccacctccatatcccgtcacaccaggctaccctgaacctgcattacacccgggtcccggtcaagcacccgttcccgctcaggtgcccgcacctgcccctggattcgcgctgttcccgagtcctggacccgttgctctcggcagcgccgcaccattcctgccgctcccaggcgtgccgagtggcctcgagttcttggtgcagatcgatcaaattctgattcaccagaaggccgagcgggttgagacattcttgggctgggagacatgcaatagatacgagctgcggtcaggcgctggccagcctctgggacaagctgccgaggagtccaactgctgtgcaaggctgtgttgcggcgctcgccgaccacttcgggtgagattggcggacccaggagaccgagaggttctcaggctgttacggcctcttcactgcggctgttcctgttgtccttgtggcttgcaggagatggaagttcaggccccacccggtacgactatcggccacgtcctgcagacatggcacccctttttgccaaaattttccatccaggacgctgaccggcagacagttctgcgggtcgtaggtccctgttggacctgcgggtgcggaacagacacaaatttcgaggtaaagactagggatgagagccggagcgtgggccgtatctctaagcagtggggcggattggtcagagaggccttaacagacgccgatgattttggactgcaattcccactcgatctggacgtgcgcgtcaaagctgtcctcctgggagctacgttcttgatagactacatgttttttgaaaaacggggaggcgctgggccttctgcggtcacttcgtag

SEQ ID NO: 234949 - DNA, 888 bp, Artificial Sequence
  Description of Artificial Sequence: Synthetic coding sequence
atggcaggctatctcccacctaaaggttatgcccctagcccaccgccaccctatccggttactcctggttatcctgagccagccctgcaccctggccctggccaggcccctgtccctgcacaggttccagccccagctcccggatttgctttgtttccctctcccggacctgtagcccttgggtccgcggcaccattcttacccctccctggcgtgcctagcggtctcgagtttctagtgcagattgaccagatcctgatccaccagaaggcagagcgcgtggaaacatttttaggatgggagacttgtaatcggtacgaactgcgctcgggggctggacaacctcttggtcaagccgcagaagagtcaaattgttgtgccaggttgtgctgcggagcaaggagaccactacgggtccgcctagccgaccctggcgatcgggaggtgctgcgccttctgcgccctctccattgcggctgctcctgctgtccgtgcggtctgcaggaaatggaggtgcaagccccacctggaactacgatcgggcatgtgcttcagacctggcaccccttcctgcccaagttctccatccaggacgccgatcgacagaccgtactgcgtgttgtcggcccttgttggacatgcggttgtggaactgacaccaactttgaggttaagacccgcgacgaatccagaagcgtggggaggatttccaagcaatgggggggactggttcgcgaggccctgacagacgcggacgactttgggctgcaattccctttggacctggacgttagagttaaagctgttctattaggggcaacatttctgatcgattatatgttttttgagaaacggggtggtgcaggacccagtgctgtgacatcctag

SEQ ID NO: 234950 - DNA, 990 bp, Artificial Sequence
  Description of Artificial Sequence: Synthetic coding sequence
atgagcggcgtggtgcccacagctccagagcagcccgcaggcgagatggagaaccagactaaacccccagaccctaggcctgacgcaccaccagaatataactcacacttccttcctggccctcccggaaccgccgtgcctccccctaccggttaccccggagggttaccaatgggttactattcaccccaacaaccgagcacctttcctctctaccaaccagtcgggggaatccatccagttcgatatcagccaggtaaataccccatgcccaaccaatccgtgcccattacctggatgcctggtcctactccgatggctaattgtcctccaggattagagtatctcgtgcagctggacaatattcatgttcttcagcacttcgagcctcttgagatgatgacgtgcttcgagaccaataatcgctacgatattaagaataatagcgaccagatggtgtacatcgtgacggaagacaccgacgactttactcgcaatgcctataggaccctaaggcccttcgttctgagagtcacggactgtatgggtcgggagatcatgaccatgcaacgtccattccggtgcacctgctgctgtttctgttgcccctcagcaagacaggaattggaagtacaatgcccgcctggtgtaaccatcggatttgtcgccgaacattggaatctctgtcgggctgtatatagtatccagaacgagaaaaaagaaaatgtaatgagggtacgcggaccttgcagcacctatggctgcggaagtgactctgtgtttgaagttaagtcactggatggcatttcaaatatcggatctattattaggaagtggaatgggcttctttccgcaatggccgacgctgaccacttcgacatccatttccccctggacttagatgtgaagatgaaggctatgatctttggtgcgtgctttctgattgatttcatgtattttgagcggtctcctccacagcggtccaggtag

SEQ ID NO: 234951 - DNA, 720 bp, Artificial Sequence
  Description of Artificial Sequence: Synthetic coding sequence
atgagtggcgttgttcccaccgctccagaacagccggcaggggaaatggaaaaccagacaaagccaccagaccctcgtcccgatgctccaccagaatataattcccattttttacccggaccgccaggtacagctgtccctcctcctaccggctatcccggtggcctgcccatgggctactatagtcctcagcaaccatccacctttcctctgtatcaaccagtcgggggtatccatccagttcgctatcagccgggaaagtatcctatgcccaaccagagtgttccaattacatggatgcctggacccacaccgatggcgaattgcccacctggtcttgagtacctcgttcagctggaggttcagtgccccccaggggtcactattggctttgtggcggagcactggaatttgtgcagggccgtatattccattcagaatgaaaagaaggagaatgtgatgagggtacgcggtccgtgctccacttacggatgcggctcagatagcgtgtttgaagtcaaaagtctagatgggatctcaaatatcggctctatcattcgaaagtggaatggcttgctttctgcaatggctgacgctgaccattttgatatccatttcccccttgacctggatgtgaagatgaaggctatgatctttggcgcttgttttctgattgacttcatgtacttcgagcgcagccctccccagcgatcaagatag

SEQ ID NO: 234952 - DNA, 990 bp, Artificial Sequence
  Description of Artificial Sequence: Synthetic coding sequence
atgtccggcgttgttcctaccgccccagagcagcccgctggtgagatggagaatcagacaaagccaccagatccacgacctgatgccccaccggaatacaactctcatttcctgccagggccacccggtaccgccgtgccaccaccaacgggttatccaggtgggctcccaatgggatattattcgccccagcagccctcgactttcccactctaccaaccagtgggaggcatccaccctgtgaggtaccaacctggcaaataccctatgcctaaccagagtgtgcccatcacatggatgcctggtccaacccccatggcgaactgcccacctggactcgaatatctcgtgcaactggataatatacatgtgctgcagcatttcgaaccactggaaatgatgacctgcttcgagactaacaatcgctacgatataaaaaataacagtgaccagatggtttacatagtgactgaggacaccgatgactttactagaaacgcttatcggacactccggccatttgttcttcgagtgaccgactgcatggggagagagatcatgactatgcagagacccttcaggtgcacctgttgctgtttctgttgccccagtgccaggcaggagctggaggtgcaatgcccacctggagtgacaattggattcgttgctgagcattggaacctctgcagggcggtgtattcaatccagaacgagaaaaaggaaaatgtcatgcgggttcgtgggccttgcagcacctacgggtgcggatctgacagtgtattcgaggtgaaatccctagatggcataagtaacatcggaagcattattcggaagtggaacgggctgctctcggctatggcagacgccgaccacttcgatatccatttccctctcgatctggacgtgaaaatgaaagccatgattttcggagcttgttttctgatcgatttcatgtactttgagcgatcaccgcctcaaaggtcgcgctag

SEQ ID NO: 234953 - DNA, 789 bp, Artificial Sequence
  Description of Artificial Sequence: Synthetic coding sequence
atgagcggagtggttccaaccgcaccggaacaacctgccggagagatggagaaccagacaaagccgcctgaccccaggccagatgcaccaccggagtacaattctcactttctgccgggaccacctggtaccgctgtcccgccaccaaccggttacccagggggtttgcccatggggtattactctcctcaacagccatcaactttcccgttatatcagccggtgggtgggatccaccctgtgagataccaaccgggaaaatacccaatgccgaaccagtctgtcccaattacatggatgccgggacccacccctatggctaactgcccgccaggacttgaatatcttgtgcagttggacaatatacacgtccttcagcatttcgagcccctggagatgatgacttgcttcgagaccaacaaccgttatgacatcaaaaacaactccgatcaaatggtttacatcgtgactgaagacacggatgacttcacacggaatgcatacaggaccctacgtccatttgtgctccgggttactgattgtatgggtcgcgaaatcatgaccatgcaacgtccctttcgatgcacgtgttgttgtttttgttgtccaagcgccagacaggaactagaagttcagtgccctcccggagttactataggattcgtcgccgagcattggaacttgtgtcgggctgtctattctattcagaatgaaaagaaagaaaacgtgatgagggtgcggggaccctgttctacctatgggtgcggcagcgactccgtgtttgagtag

SEQ ID NO: 234954 - DNA, 627 bp, Artificial Sequence
  Description of Artificial Sequence: Synthetic coding sequence
atgagcggtgtggtcccaacagcgcctgagcagcccgctggggagatggaaaatcagaccaagcctcctgatccacgacctgatgcaccgccagaatacaattctcatttcctgcctgggccacctggcaccgctgtgccgcctcctacaggttacccaggtgggttgccaatgggctattacagtccacagcaaccaagcaccttccccttgtatcagcctgttggcggtatacacccagtgcggtaccagcctggcaagtacccaatgcccaatcaatcagttcctatcacatggatgcccggtccaacaccaatggctaactgtcctcccggactagagtaccttgtgcaacttgacaacatccatgtgctgcaacattttgagccgctcgagatgatgacgtgcttcgaaacaaataatcgctatgatattaaaaataacagtgatcaaatggtgtacatagtaacagaggataccgacgatttcaccaggaacgcctacaggactctgaggccctttgtactgcgggtcactgattgtatgggccgtgagataatgaccatgcagcgcccatttcggtgtacttgttgttgcttctgttgcccctccgccaggcaagaatag

SEQ ID NO: 234955 - DNA, 429 bp, Artificial Sequence
  Description of Artificial Sequence: Synthetic coding sequence
atgtcaggcgtggttcccacagcgcctgagcagcccgctggcgaaatggaaaaccagaccaagcctccagatcctcgacctgacgcgcctccagaatataacagccacttcctgcctggccctccagggacagctgtgccgcctccaacgggataccctggcggactccccatgggctattattcaccccaacagcctagcacctttcccctataccaaccagtgggcggaatccatccagtgcggtatcagccgggtaaatacccgatgcccaaccagtccgtgcccattacttggatgcctgggccaacgccaatggcaaattgcccaccaggcttggaatatctggttcagttagacaatattcacgtactgcagcacttcgaacctttagagatgatgacctgtttcgaaacaaataacaggtag

SEQ ID NO: 234956 - DNA, 990 bp, Artificial Sequence
  Description of Artificial Sequence: Synthetic coding sequence
atgtccggtgtggtccctactgccccagagcagcccgcaggcgaaatggagaatcagaccaaacctcctgacccaagacccgatgctcctcccgagtataatagccactttctccccggacctcctggaaccgctgtacctcctcctaccgggtaccctgggggactgccaatgggttattattcgcctcaacagcctagcacattccccctgtatcagccagtgggtgggattcaccctgtgagataccaacccggaaagtatcccatgccaaatcaatcggtgcctataacgtggatgcccggtcccacgcccatggctaactgtccacccggtctggagtacctggtgcagctagataatatccacgtcctccagcactttgagcccctagagatgatgacttgtttcgagaccaataacagatacgatattaaaaacaacagcgaccagatggtttacattgtgacagaggatactgacgatttcaccagaaatgcttacagaaccctgcgccctttcgtattgagagtgactgactgcatgggaagggagattatgaccatgcaacggccattcaggtgcacttgttgttgcttttgttgtccctctgctagacaggaattggaggtacagtgtcctccaggcgtgacaatcggattcgtcgccgagcattggaacctgtgccgggctgtttactcaatacagaacgagaagaaggaaaatgtgatgcgggtgaggggcccatgctccacctacggatgcggctctgattctgtatttgaggtgaaatccctcgatggaattagtaacatcgggagcattatccggaaatggaatggcttgctctcagccatggcagacgctgaccattttgacattcactttcctctggacctggatgtgaagatgaaagccatgatcttcggcgcatgcttcttgatcgatttcatgtattttgaacggagccctccccagagatccagatag

SEQ ID NO: 234957 - DNA, 297 bp, Artificial Sequence
  Description of Artificial Sequence: Synthetic coding sequence
atgtcaggggtggtgccaaccgccccagagcaacccgcaggggaaatggagaatcagactaaaccacctgatcctcgcccagatgcccctcctgagtataattctcacttcctgccgggacctccgggtacagccgtgcctccccctacaggataccccggtggattgcctatgggctattattctccccagcagccctcaaccttcccattgtatcagcctgtggggggaatccatcccgtacgctaccagcccggtaaatatcccatgcctaatcagagtgtacctattacctag

SEQ ID NO: 234958 - DNA, 675 bp, Artificial Sequence
  Description of Artificial Sequence: Synthetic coding sequence
atggagaatcaaacgaagccgccagacccacggccagatgcccctcccgaatataacagccacttcctccccggaccgccaggcacagctgtgcctcccccaactggataccccggaggcttacccatgggctattacagtccccagcaacccagcacattcccgctgtaccagccagtgggcggaattcaccctgtgcgataccagcctggaaagtaccctatgcccaatcagtccgtgccaataacttggatgcctgggccaactccgatggcaaattgcccccctggtttagaatacttggtgcagttagaggtgcagtgtcccccaggcgttaccataggatttgttgctgaacactggaacctgtgtcgagcagtgtactccatccagaatgaaaagaaagaaaatgtgatgagagtaagagggccatgttcaacttatggatgcggctcggacagtgtattcgaggtgaaatctctggatggcatcagtaacataggttctatcataaggaagtggaatgggctcctctccgccatggccgatgcggatcactttgatattcatttccctctcgaccttgacgtaaagatgaaagctatgatctttggcgcatgtttcctgattgattttatgtattttgagcgctcgcctccccagaggtctagatag

SEQ ID NO: 234959 - DNA, 1326 bp, Artificial Sequence
  Description of Artificial Sequence: Synthetic coding sequence
atggctctgtttggcgctctcttcttggctctgctggccggagctcacgcagaattccccggttgcaaaatccgggtgacatccaaagcactcgaactggtaaagcaggaggggctacgctttctcgaacaggagctggaaacaataaccattcctgatctccgcggtaaggaagggcacttctattacaatatcagcgaagtcaaggtaaccgagcttcagttaacaagttcagagttggattttcagcctcagcaagagctcatgttacagatcaccaacgcttctctgggcctgaggtttagaagacaattgttatactggtttctaaaggtatacgacttcctgtcaacgtttatcacgagcggcatgcgcttcttgcttaaccagcaaatatgccccgtgctttaccacgcgggaactgtcctgttaaactcccttttagatacagtgccggtccggagttcagttgatgaacttgtcggcatcgactactcattgatgaaagatcctgtggcttcaacttctaatctcgatatggacttccggggtgcattctttcccctgactgagagaaattggagccttcctaaccgggcagtggaaccacagctccaagaggaagagaggatggtttatgtagcctttagtgagtttttcttcgacagcgcaatggaatcttatttccgagctggagctctgcagctgttgctagtgggtgataaagtacctcatgacctggacatgcttctgcgggctacctactttggctctatcgtcctgttgtcacctgccgtcatcgacagtcccctcaaactggagttacgtgtcctggctcccccacggtgcacaatcaaaccttccgggaccaccatctcagttacagcctccgtaacaatcgctctggttcccccagaccagccggaggttcaattgtcatctatgactatggacgccagactgtctgccaaaatggcactccggggaaaggctttaagaacacagctagacctcaggcgatttcggatttactctaatcacagtgcactagagtcactggccctgatccctttgcaggcaccgctgaaaacaatgctccagatcggggtgatgcccatgctgaacgagcgaacctggcgcggtgtgcaaattccacttcccgaaggaattaacttcgtgcacgaagtagtcaccaatcacgcaggcttcctcaccattggggcagacttgcactttgccaaagggctgagagaagtgatagaaaaaaaccgtcccgctgacgtgcgcgcttcaacagcacccacacctagtactgccgcagtgtag

SEQ ID NO: 234960 - DNA, 1482 bp, Artificial Sequence
  Description of Artificial Sequence: Synthetic coding sequence
atggcactgttcggggcattgttcttggccctattggcaggggctcatgcagagtttccagggtgtaagatcagagtcaccagcaaggcactcgaactggtgaaacaggagggcttacgtttcctcgaacaggagctggaaaccattacaattcccgatcttaggggtaaagagggccacttctactacaatatcagcgaagtgaaggtgacagagctgcaactgacatcctccgagcttgactttcagcctcaacaggagctaatgctccagataactaatgctagtcttggccttcgttttcggcgacagttactgtactggttcttctatgacgggggatatataaacgcctcagcagagggcgtgagcatccggactggcctggaactatctcgcgaccccgcaggtcggatgaaggtgtctaacgtgagttgtcaggcgagcgtcagccgtatgcacgccgcattcggcggaaccttcaagaaagtgtacgattttctgtctacctttatcacgtccggaatgaggttcctgttgaaccaacagatttgtccggtcctctaccatgcaggtacagtcctactcaattccttactggatacagtcccagtacgctctagtgtggacgaactggtcggaatagactattctcttatgaaggatccagtagcttcaactagtaatctggacatggattttaggggcgctttctttccactgactgagcgcaattggagtctgccaaatagggccgtggagcctcagctgcaggaggaagagagaatggtctacgtggccttctccgaattcttcttcgacagcgcaatggagtcctatttcagagctggagctctgcaactactgctggtgggtgacaaagtaccgcacgacctcgacatgttgctgagggcaacttacttcggatcgatcgtgctgctgagccctgcggtgattgatagccccctgaagctcgagctccgcgtactcgcaccgccaagatgcaccatcaaaccctcaggtacgaccatttccgttacagcgtctgtaactattgcactggtgcccccagaccagcccgaggttcagctgagctctatgaccatggatgctcgcttgtcggctaaaatggccctccggggtaaagccctgaggacccagctggacctgcgcaggttccggatttactcgaaccattcagcccttgagtcgctcgctctgattcccctacaagcccctctgaagaccatgttgcagataggggttatgccaatgttaaatgagcgcacttggcgtggggtgcagatacccctccccgagggcatcaactttgttcacgaggtggtgacaaatcatgcgggattcctaacaattggagccgaccttcactttgctaaggggctgagagaagtcattgagaagaacaggcccgcagatgtgagggcttctactgcccctacaccgagtaccgccgctgtctag

SEQ ID NO: 234961 - DNA, 1482 bp, Artificial Sequence
  Description of Artificial Sequence: Synthetic coding sequence
atggccctgtttggcgcactctttctggcactcctggcgggtgcccatgccgagttcccgggttgtaagatcagagttacctccaaagccctcgaactggtgaaacaggaggggttgcggtttctagagcaggaactggagactattactattcccgacctgcgtggtaaagagggccatttctattacaacataagcgaggtgaaagtgacagaactgcagctaaccagttctgaactggatttccaaccgcagcaagagcttatgttgcagattaccaacgcttccctggggctgagattccgcagacagctgctttattggttcttctacgatggcggttatattaacgcaagtgctgaaggcgtgtcgattcgtacaggattagaactctcccgcgaccctgcagggaggatgaaagtcagcaatgtaagttgccaggctagcgtttccaggatgcacgccgcattcgggggaacattcaaaaaagtgtatgactttcttagtacgtttatcacttctggcatgaggttccttctgaaccagcagatctgccccgttctttaccacgctggtactgtcctgctgaactccttacttgatactgtgccggtgcgctcctctgtggacgaattagtagggatagactactctttaatgaaggatcctgtggcctctactagcaacctagatatggactttcggggagccttcttccccctgactgaaaggaattggtccttacctaatcgcgctgttgaaccacaattacaggaggaagaacgtatggtgtacgttgccttttccgaattcttctttgactctgcaatggaatcttacttcagggctggggctctccagttgcttctggtgggagacaaggtgccacacgatctggatatgcttctgcgcgctacgtactttggatccatcgttcttctgtcacccgctgtgattgactctcctctcaaactggagttgcgagtgctggctcctcccaggtgtactatcaaaccatccggtacgacgatcagcgtgaccgcgtctgtgacgatcgccctcgtgccaccggatcagccagaagtgcagctgtctagtatgactatggatgccaggttgtctgcaaagatggctctgcgcggaaaggcccttcgaacgcaactcgatctccggcgatttagaatctactcaaatcattcagctctggagtcacttgccttaatcccactccaagcccctttgaagaccatgttgcagatcggagttatgccaatgcttaacgaacgcacatggaggggggtgcagattcccctacccgagggaattaatttcgtccacgaagtggtcactaaccacgcgggatttcttacaattggggcagatttgcatttcgccaaagggctcagagaggtcatcgagaaaaatagacccgcagatgtccgggcaagcactgctccaacgccgtccacagcagcagtctag

SEQ ID NO: 234962 - DNA, 1542 bp, Artificial Sequence
  Description of Artificial Sequence: Synthetic coding sequence
atgggcctgtctggcagtgataatagctgcgatcctacacctccgccaggcccactggcgatggccctgtttggggcactattcctagctctgctggccggtgcacatgccgagttccccggatgcaagattagagtgacgagtaaggccctcgagctggttaaacaggagggcctgcgattcctggagcaggagttggagaccatcaccatccccgacttaagaggaaaggagggccacttctattacaatatctccgaagtgaaagtaactgaactgcagctaacctcttctgaactggattttcagcctcagcaggagttgatgctgcaaataactaatgcatctctggggttgagatttcgacgacagctgctttattggtttttttatgatgggggatacattaatgcctccgccgaaggcgtttccattcgtaccggtctcgaactcagcagggaccccgctggccgaatgaaggtatctaatgttagctgccaggcttccgtaagtcggatgcacgctgctttcggaggcactttcaagaaggtttacgactttctgtctaccttcattacctccggcatgcggtttctcctgaatcaacagatctgcccagtcctgtaccatgccggtacagtgctactcaactccctgctagacactgtccccgtcaggtcctctgtcgacgagctagtcgggattgactacagccttatgaaagatcccgtggcctctacatctaacctggacatggactttcgaggtgcatttttccccctcactgagcgtaattggtctcttcctaatcgcgctgttgagccacagctgcaagaagaggaacggatggtatatgttgcgttttcggaattcttcttcgattccgcaatggaaagctacttccgggctggcgctctccagctgttgctcgttggcgataaggtgcctcatgatctggacatgctgttacgcgctacctatttcggctctatcgtgctattatcccccgcagtgatcgattctccattaaaattggaactgagagttctggcacctcctcggtgtaccatcaaacccagcggcacaactatatctgtgactgctagtgttacaattgcactggtcccacccgatcaaccagaggtacagctgagttcaatgaccatggatgccaggctatcagctaagatggctttaagaggcaaggctttgagaacacagttagaccttcgtaggttcaggatttatagcaaccatagcgctcttgagagcctggccctgatacctctccaggccccactgaagactatgctgcaaatcggagttatgccaatgcttaacgaaagaacgtggagaggcgtgcagattcctctgccagaggggataaacttcgtacatgaagtcgtcaccaatcacgcagggttcctgaccatcggggcagaccttcattttgctaaagggcttcgggaagtaatcgagaaaaacagaccagccgacgttagggcttctacggccccaacccccagcacagcggcagtttag

SEQ ID NO: 234963 - DNA, 1218 bp, Artificial Sequence
  Description of Artificial Sequence: Synthetic coding sequence
atgctgcaaatcaccaatgctagtctaggccttcgctttcgtcgccaactgctgtattggttcttttatgacggaggctatataaacgccagcgctgagggtgtaagcatcagaacggggctcgagctgtcccgagatccagccggaagaatgaaggtcagcaacgtaagttgccaggcatccgtcagccgcatgcacgccgcattcggcggaacctttaagaaggtatatgactttctctcaacatttatcacctcaggtatgcgctttttgctgaatcagcagatttgtccagtgctgtaccacgctggcaccgtattactgaatagcctcctggatactgtgcctgtccggtcctccgtagatgagcttgtgggcattgactattcactgatgaaggatcccgttgcaagtacatctaatctggatatggacttcaggggtgctttttttccattgacagaacgcaactggagcttacccaatcgagcagtagagccacagctgcaggaagaagaacgaatggtgtatgtggctttctctgagttcttcttcgatagcgcaatggaatcttactttcgtgcgggtgccctgcagctcctgttggtgggcgataaggtgccgcacgatctggacatgctgctgcgtgccacctacttcggctccattgtgctgctgtcccctgccgtgattgatagccccctgaaactcgaactccgcgtgctggcacctccacggtgcactatcaagcctagcggcacgactatctcggtcacagctagcgtgaccatcgctctggtgcctccagaccagccagaagttcaactctccagcatgactatggacgctcgactgagcgccaagatggctcttcgtgggaaagctcttaggactcaacttgatttgagacgcttcaggatatactccaaccatagcgcactggagtctctggcactgatccctctgcaggccccactcaaaactatgctgcagatcggggtgatgcccatgctgaacgaacggacctggcgaggcgtgcaaatcccgttgcctgagggcattaactttgtgcatgaagttgttacaaatcatgctgggtttctaaccattggcgcagaccttcattttgccaagggattaagagaagtgatcgagaagaatagaccagcggatgtgcgcgcaagcacagcacctacaccctctactgcagccgtgtag

SEQ ID NO: 234964 - DNA, 1197 bp, Artificial Sequence
  Description of Artificial Sequence: Synthetic coding sequence
atggctctgtttggggcactgtttctggccttgctcgccggtgcgcatgccgagtttcctgggtgtaagattagagttacttccaaggccctggagcttgtcaagcaggagggtcttaggttcctcgagcaggaactagagaccataacaattcccgacctgcgaggaaaggaaggacacttttactataacatcagtgagaaggtctacgacttcctgagcaccttcataacatcaggcatgcgatttctgctcaaccagcagatctgccctgtcctgtatcatgctggcaccgttctgctgaattctttactggacaccgtgcccgttcgcagctccgttgacgaactcgtcggcattgattacagtctgatgaaggacccagttgctagcacaagtaatctggatatggatttcaggggtgctttttttcccttaacagaacgtaattggtctttgcccaaccgggcagtcgagccacagctgcaagaggaggagcgcatggtttatgtggccttctccgagttttttttcgattcggctatggagagctactttcgcgctggtgcactgcagttgctgcttgtcggagacaaagtgcctcatgatttagacatgctgttgagagcgacctacttcggcagcatagtgctgctctcgccagccgtgatcgacagtcccctgaagctagaattacgagtgctcgctcctccgaggtgcactattaagccctctggaactaccatttctgtgactgcaagcgtgaccattgcactcgtccctccggaccagcccgaggtccagcttagttccatgactatggacgcaaggctgagtgctaagatggcgctacgtgggaaagccctgcggacccaattggatcttcgcaggttccgcatatatagcaatcacagcgctctggagtctctggctttgattccactacaggctccattgaagacgatgctgcagataggagtaatgcccatgcttaatgagcggacatggagaggggtgcagattcctcttcccgagggcatcaattttgtccacgaggtagtcaccaaccatgctggttttttaacaatcggggcagacttgcacttcgccaagggactgagagaagtcatagagaaaaatagacctgccgatgtaagagcctccacggcacccacaccgtctaccgctgcagtgtag

SEQ ID NO: 234965 - DNA, 2343 bp, Artificial Sequence
  Description of Artificial Sequence: Synthetic coding sequence
atggcgccatacagcttgcttgtgacccggcttcagaaagccctgggcgtccgacagtaccacgtcgcctccgtgttgtgccaacgtgccaaagtggccatgtcacactttgaaccaaacgagtacatacattacgatctactcgaaaaaaacattaacattgttcgcaagagactcaataggccgctgacactctctgaaaaaatcgtgtatgggcacctcgacgatcctgccagtcaggagatcgagcggggtaagagttacctgagactcagaccagatcgggtggccatgcaagacgccactgctcagatggcgatgctgcagtttatcagcagtggcctaagcaaggtggccgtgccgtccacaatacattgtgatcacttgatcgaggcacaggtgggtggcgagaaagaccttcgtagagccaaagacattaaccaagaggtgtacaatttcctggcaactgccggtgctaagtacggtgttggcttctggaagcccggttctggaataattcaccagataatacttgagaattacgcgtacccgggtgttctgctgattggcaccgattctcacacccctaacggaggcggactggggggtatctgtattggtgtgggtggggctgatgccgtagatgtgatggcgggaatcccatgggagctgaagtgccctaaagtgattggcgtgaagctgaccggatcactgtctggctggtcttcgccgaaggatgtgatcctgaaggtggctggaattcttaccgtgaagggaggaaccggggctatcgttgaataccatggaccgggtgtggattcaataagctgtacaggcatggccaccatatgtaacatgggcgctgagattggggctactacgagcgtgtttccgtacaaccacagaatgaagaagtatttgtctaagaccggtcgggaggatatagcgaacctggcagatgagtttaaggaccatctcgtgcctgatcctggatgtcactacgaccagctcatcgagattaatctcagtgaactgaagcctcatattaacgggccatttacaccagatctggcccaccccgtggccgaagtcggcaaagtcgctgaaaaagagggctggcctttagatatccgggtcggtctgattgggagttgtaccaacagttcttacgaagacatgggtaggagcgctgcagtggcaaagcaggctttggcacacggtctaaaatgcaaatcacagttcacaatcaccccaggatctgaacagattcgcgctacgattgaaagggacgggtacgcccagattcttagagacttgggtggaatcgtgttagcgaatgcttgcggaccatgcataggccagtgggatagaaaagacatcaagaagggtgaaaagaacactattgtcacatcgtacaataggaacttcacgggcagaaatgatgccaacccagagacgcatgccttcgtgacttcaccagaaatcgtgactgcgctggccattgccggtactctgaagtttaatccagagaccgactatctgaccggcacagacggcaagaagttccgcctggaggcaccggacgccgatgaactccccaaaggtgaatttgacccaggccaagatacatatcagcacccaccgaaagatagcagtggacagcatgttgacgttagccccacctcacagcgcttgcagctgctcgaaccgtttgacaagtgggatgggaaagatctcgaagacttacagattttgattaaggtgaagggaaagtgcaccacagaccacatctctgccgcaggcccttggctgaaatttcggggacacctggacaacataagcaataacctgctcattggcgcaatcaacattgagaacgggaaagctaactccgtgcgcaatgcagtgacacaggaatttggacccgtgcctgacacggctcgctactataaaaagcatgggatcagatgggtggtgattggcgacgaaaactatggcgaaggttcatctagggagcacgccgctctagagcctagacacctgggaggacgggcaattattaccaaatcgttcgctcggatccatgagacgaacctgaagaagcaaggcctcctgcccctaaccttcgccgaccccgctgattacaataagatccatcccgtggataaactgaccatccaaggattaaaggattttactcctggcaaacccctgaaatgcatcattaagcaccctaacggcacccaagagaccattctactgaatcataccttcaacgagacccagattgaatggtttagagccggttctgccctgaatcggatgaaggagctgcagcaatag

SEQ ID NO: 234966 - DNA, 741 bp, Artificial Sequence
  Description of Artificial Sequence: Synthetic coding sequence
atggccgctccaggaccggctctgtgcttattcgatgttgacgggacattaaccgctccacgtcagaagatcacaaaagagatggatgacttcctccagaaactcagacaaaaaattaaaataggggtcgtgggtggatccgactttgagaaggttcaggaacaactcggtaacgacgtagttgaaaagtacgattacgtttttccagaaaacggcctcgttgcgtacaaagacggaaagctgctgtgcagacaaaacatccagagccacctcggagaggccctcattcaagacttgatcaattactgcctcagttacattgccaaaatcaagttgccgaaaaagcggggtaccttcatcgaattcaggaatggtatgctgaatgtgagcccaatcggacgctcatgcagccaggaagagcggatcgagttctatgaactagataagaaggaaaacattcggcagaagtttgtggccgatcttagaaaggaatttgcaggcaaggggctgactttttccataggaggccagattagttttgatgtgttccccgacgggtgggacaagaggtactgtcttaggcacgtggagaacgacgggtacaagacaatctatttcttcggtgataagaccatgcccggtgggaatgatcatgaaatctttacagaccccagaacaatgggctattctgttacagcaccagaggacacgcgtagaatatgcgaattgctcttttcttag

SEQ ID NO: 234967 - DNA, 366 bp, Artificial Sequence
  Description of Artificial Sequence: Synthetic coding sequence
atgctgaatgtgtctccaatcggcaggtcctgcagccaggaggagcgtatcgagttctatgaactggacaaaaaagagaacatcagacagaaatttgtggccgaccttcgcaaagagttcgctggaaaaggattgacgttttccatcggcggtcagatctcgtttgacgtgtttccagacgggtgggataaacgatactgcctgcggcatgttgagaacgatggttacaagacaatttatttttttggagataagaccatgccagggggaaatgaccatgaaatctttaccgatccacggacaatggggtactcagtgaccgccccagaagatacccgcagaatttgcgagctactgttctcttag

SEQ ID NO: 234968 - DNA, 492 bp, Artificial Sequence
  Description of Artificial Sequence: Synthetic coding sequence
atgatgaacattcagtcacatttgggtgaagcactcatccaggatttgatcaactattgtctgagctatatcgccaagatcaaactgcctaagaagcggggtacctttatcgagtttcgcaatgggatgctcaatgtgagccctatcggtcggagttgctcgcaggaagaaaggattgagttctacgagctggataagaaggaaaacattagacagaagttcgttgctgaccttcgcaaggagtttgccggtaagggtctaactttttccatcgggggacagatcagctttgatgtctttcctgatgggtgggataagcgctactgcctgagacatgttgagaatgatgggtacaaaaccatctacttcttcggcgacaaaaccatgccaggaggcaatgatcacgagatcttcacagacccacgaactatgggctattctgtgaccgctccagaggacacccgcagaatctgcgagctgctgttttcttag

SEQ ID NO: 234969 - DNA, 579 bp, Artificial Sequence
  Description of Artificial Sequence: Synthetic coding sequence
atggccccacttggcggtgcaccaaggctggtgctgctgtttagtggtaagaggaaatccggtaaggactttgtgaccgaggcactccaatcccgtctgggagcagacgtctgcgctgtattacggttatcaggccctctgaaagagcagtacgcccaggaacacgggctgaactttcagcggctgctggatacatctacttataaagaggcgtttagaaaagacatgatcaggtggggagaggagaagcgccaggccgaccccggatttttctgtcgtaagatagtggagggcattagccagcccatttggctggtttctgacaccaggagagtatcagatatccagtggtttagagaagcctacggtgccgttactcaaacggtgcgtgtcgtagcgctggagcagtctagacaacaacggggatgggtgttcaccccaggtgtggacgacgcggagtcggaatgtggcctggataacttcggggacttcgattgggtgattgagaaccatggggtggagcagagattggaggagcagctggaaaatctcatcgagtttatccggtcacggctttag

SEQ ID NO: 234970 - DNA, 615 bp, Artificial Sequence
  Description of Artificial Sequence: Synthetic coding sequence
atggagccaaaggcctcatgccccgctgccgctcccctcatggagagaaaattccatgtcctcgtcggcgtgacagggagtgtagcagctctcaaactgcctctcctggtaagcaagctcctggatataccaggattagaagtcgccgtcgtgacaaccgagcgggctaagcatttctactctcctcaggatattcctgtaaccctctacagcgacgccgacgaatgggaaatctggaaaagtagatccgacccagtccttcacatagacctacgcaggtgggccgacctgttactggtagctcccttggacgcgaacacattaggaaaggttgcatctggtatttgtgataatttactaacttgcgtcatgagagcctgggaccggtcaaagccattgctcttctgtcctgccatgaacacagccatgtgggagcatccaatcaccgcccagcaggtggaccagctcaaggcgttcggatacgtcgaaatcccttgcgtggcaaagaaattagtttgtggcgacgaaggtctaggcgctatggcagaagtcggaaccatcgtcgacaaagtcaaggaagtgctctttcaacattccggatttcaacaatcatag

SEQ ID NO: 234971 - DNA, 171 bp, Artificial Sequence
  Description of Artificial Sequence: Synthetic coding sequence
atggcagaaatggacccggtggcggaattcccccaacccccaggagctgcccgttgggctgaggctctactgagatgtttcacatggctccgactttgtcagatttccatgtttctctcattgaaatgcttaaatactagatcatcccatttgggagcacactgcaggtag

SEQ ID NO: 234972 - DNA, 642 bp, Artificial Sequence
  Description of Artificial Sequence: Synthetic coding sequence
atggcagagatggatccagtcgccgagtttccacagccaccaggggctgcccgttgggccgaggtgatggcccgatttgcagcacgcctgggtgctcagggccgtagggtggtactggtcacaagcggcggtacaaaggttccccttgaggcgagaccggtgaggtttctggacaacttctcctcaggaagaagaggagcaacctcggctgaggcttttttggccgcagggtacggggttctctttctgtacagagctcggtccgcttttccatacgctcatcgctttcctccccagacctggctgtcagccttacgacccagtggtccagctctgagcggcctgctgtcactagaggctgaagagaacgctcttcctgggttcgctgaggcgctgagatcataccaggaggctgctgctgcaggcaccttccttgccgtggagtttacaactctagccgattaccttcacctgttacaagccgctgcccaggccctcaaccccctcgggccaagcgctatgttttatctggcagccgctgtgagtgatttttatgtgccagtttccgaaatgcctgagcataagattcagagctctggagggccattacaggtgatgggcgcttccctgcctgaaatctag

SEQ ID NO: 234973 - DNA, 936 bp, Artificial Sequence
  Description of Artificial Sequence: Synthetic coding sequence
atggcagaaatggacccagtcgccgagttccctcagcctccaggtgcagcgcgttgggccgaggtgatggcaaggtttgcagctaggcttggggctcagggcagaagggtggtgctggtgaccagcgggggtaccaaggtgcccctggaggcaaggcctgtgcgctttctggacaattttagctccggtagaagaggggctacgagcgctgaggcctttcttgctgctggctatggagttcttttcctctacagagcacggagcgcattcccctacgcccatcgcttccccccacagacctggctgtctgctctgaggccatcaggtcccgcactgtcgggattgctgagtcttgaagcagaggagaatgccctccctgggttcgcagaggccctacgatcttatcaggaggcagctgctgctgggacatttctggctgttgagttcacgacactggcagactatttacacctcctgcaggctgcggcacaggccctgaatccgctgggccctagcgccatgttctaccttgctgcagcagtttccgacttttacgtgcctgtaagtgagatgcccgaacataaaattcagtcttccggaggccctttgcagatcacgatgaaaatggtgcctaagctgctgagccccctggtcaaagactgggctccaaaggcatttatcatctcatttaagttggagacagaccccgctattgtaatcaatagggcacgtaaagcgctggaaatttatcagcatcaggtcgtggttgctaatattttggagtcaagacaatcctttgtttttatcgttacaaaggactcagagactaagctgttgctgtctgaagaggagatagagaagggggtggagatcgaggagaaaattgtcgacaacctgcagagccgccacactgcgtttataggagatcgcaactag

SEQ ID NO: 234974 - DNA, 417 bp, Artificial Sequence
  Description of Artificial Sequence: Synthetic coding sequence
atgttttatctggctgctgctgtgagcgacttctatgtaccagtctccgaaatgcccgaacataaaattcagtcgtccgggggaccactgcagattaccatgaaaatggtgccaaagttgctttcccctctcgtcaaggactgggccccaaaagcctttattatcagttttaagttagaaactgatcccgcaatcgtaattaaccgagctcgtaaggccctcgagatatatcaacaccaagtagtcgtggctaacatcctagaatcgcgacagagcttcgtgttcatcgtgacgaaggattcagagacaaaactcctgctgtctgaagaagaaattgagaagggcgttgaaatcgaggagaaaattgttgacaatctccaatctcgccatacggccttcatcggcgacaggaactag

SEQ ID NO: 234975 - DNA, 417 bp, Artificial Sequence
  Description of Artificial Sequence: Synthetic coding sequence
atgttttacctggccgcagcagttagcgatttttacgtccctgtatcagaaatgcccgagcacaaaatccagagcagcggtggtcctctgcagatcacgatgaaaatggttcctaaactgctgagtccactcgtaaaagattgggccccaaaggcttttattatcagcttcaagctcgagacagatccagccattgtgattaacagggcacgaaaggctctcgagatttatcagcaccaagtggtggttgcaaacattcttgagagtaggcagtcctttgtgttcattgtaaccaaggactcagaaactaaactcctcctttctgaagaagaaatcgagaaaggcgtggagatagaggagaagatcgttgacaatctccagagccggcataccgcctttatcggggacaggaactag

SEQ ID NO: 234976 - DNA, 393 bp, Artificial Sequence
  Description of Artificial Sequence: Synthetic coding sequence
atggctgagtacgggacgttgttgcaggacctgacgaataacattacactggaggatctcgagcagttaaagagcgcttgcaaggaggacatcccgagcgaaaagtcagaagaaataactaccggatcagcttggttttccttcctcgagtcccacaataagttagataaggacaatctatcctacattgaacatattttcgaaatctcccggcgtcctgatctgcttacaatggtggtggactacaggactcgcgtgctcaaaatctctgaggaggacgaactcgacacaaaactgacccgcatccccagcgccaagaagtataaagacataattaggcagccctctgaagaggagatcattaagcttgcaccacctcccaaaaaagcgtag

SEQ ID NO: 234977 - DNA, 456 bp, Artificial Sequence
  Description of Artificial Sequence: Synthetic coding sequence
atggaggacgaggggaacaagctttgtcaggccccaccgtggcccggacaaaccagtcccgtcatggcagagtacggtaccttgctgcaggatttaacgaataatattaccttagaagaccttgagcagctgaagtctgcctgtaaagaggacatcccttcagagaaaagtgaagaaatcacgaccggatcagcatggttcagctttcttgagtcgcacaataagctggacaaggacaatctttcctacattgagcacatctttgagattagccgcaggccagacctgctgaccatggtggtcgactaccggacgagggttctaaaaatttcagaagaagatgagctcgatactaaactgacacgtattcccagcgccaagaagtacaaggatatcatccgtcagccgtctgaggaggagatcattaaactcgccccaccgccaaaaaaggcctag

SEQ ID NO: 234978 - DNA, 327 bp, Artificial Sequence
  Description of Artificial Sequence: Synthetic coding sequence
atggccgagtacggcacgctgttacaggatctcaccaataacatcactttggaagacctggaacaacttaaatcagcctgtaaggaagacatcccttctgagaagaacaatctttcctatatcgagcatattttcgagatctctaggagacccgacctgcttacaatggtcgtggactatcggaccagagttcttaaaatcagtgaggaggacgagttggataccaagctcaccaggattccatccgccaagaaatataaagatataatccggcaaccttctgaggaagagattatcaagttggcaccaccgcctaagaaagcctag

SEQ ID NO: 234979 - DNA, 1554 bp, Artificial Sequence
  Description of Artificial Sequence: Synthetic coding sequence
atggagctcgaggagctaggaatccgggaggagtgcggggttttcggatgtattgctagtggagagtggcctacccagttagacgtaccacatgtgattaccctcggtctggtaggcttacagcacaggggccaggagtcagctggaattgtgactagcgacggatcttctgtgccgactttcaagagtcataagggcatgggattagtgaatcacgtattcacagaggataatcttaagaagctgtatgtgtcaaatcttgggatcggacatacacggtatgcaactactggcaagtgcgagttagagaattgccagccctttgtcgtagaaacattacacggcaaaatagccgtagcccataatggcgaactcgtcaacgctgcgagactgaggaagaagttactgcgccatggtatcggtctgtctacctcaagtgattctgaaatgatcacccagctgctggcttacacgccaccccaggagcaggacgatacccccgattgggtcgcacgtataaaaaacctgatgaaagaagctcccacagcctattcacttcttattatgcacagagatgtgatttacgccgttcgggatccttacggaaaccgcccactgtgtataggtcgtctcataccagtcagcgacattaacgataaggagaagaagacatctgaaactgaggggtgggtggtatcctcagagagttgtagcttcctctctatcggtgcgaggtactacagggaggtactgcctggagagattgttgaaatttcccggcacaacgtgcagactctcgacataatcagtcgctctgagggaaatcctgtggcattttgcatctttgagtacgtgtactttgccaggccagactctatgtttgaggaccagatggtttacactgtgcgatatagatgcggccagcagcttgccattgaggccccagttgatgccgacttggtgtcaaccgttccagaatctgcaactccagcagccctggcctacgccggtaagtgtggtctcccgtacgtcgaggttctgtgcaagaatagatacgttgggagaacctttattcagccaaacatgaggcttaggcagctgggcgtcgctaagaagtttggggtcctctctgacaattttaagggaaaaaggattgtcctggtggacgatagcatcgttaggggaaacacgatctcccccattatcaaactactcaaggagtctggtgctaaggaggtgcatatcagagtagcctctcctcctattaagtatccctgttttatggggatcaatatccccaccaaagaggagcttattgccaataagcctgagttcgaccacctggcagagtacctcggagccaatagcgtggtgtatctgtcggttgagggcctggtaagtagcgtgcaggaaggcataaaattcaagaagcagaaggagaagaagcacgatatcatgattcaggagaatggtaatggcttggaatgcttcgaaaagtctggtcactgcaccgcctgtcttaccgggaagtatccagtggaattggagtggtag

SEQ ID NO: 234980 - DNA, 657 bp, Artificial Sequence
  Description of Artificial Sequence: Synthetic coding sequence
atggaattattaattatgataaatgcctgcaaaatcgcatccgcaagccgcgtgacagctgtaatcccttgctttccatacgctaggcaagacaaaaaggataagggattcttcgatattccagtggataacctctacgcagaacccgcagtgctgaagtggatcagagaaaacatttctgaatggcgcaattgcaccatcgtgtcccctgatgctggtggagccaagcgcgtgactagcatcgcagataggcttaatgttgatttcgccttgatacataaggaaaggaaaaaagctaacgaggtggatcgcatggtcctcgttggggatgtcaaagatagggttgcgatcctggtcgacgacatggctgatacctgcgggaccatctgtcatgcagcggataagctgttgagcgccggagccacacgagtttacgccatccttacccacgggatattttctggaccagcgatcagtaggataaacaacgcatgtttcgaagctgtggtagtgaccaataccatcccccaggaggataaaatgaaacactgttccaagattcaggtgatcgacatctcgatgatactggctgaagcaataaggcggacacacaatggtgagtctgtcagctacctgttctcccacgtgccactctag

SEQ ID NO: 234981 - DNA, 507 bp, Artificial Sequence
  Description of Artificial Sequence: Synthetic coding sequence
atgcccaacattaagatttttagtggcagctcccatcaagacctatcccagaaaatagctgataggttagggcttgagctgggaaaagtggtgacaaagaagtttagtaaccaggaaacatgcgtggagatcggcgagtcggtacgtggcgaggacgtctatattgtccaatcaggctgtggggaaatcaacgataacctgatggagctcttgataatgattaatgcctgtaagattgctagtgcaagccgagtgacggcagtgatcccttgttttccctatgccaggcaggacaaaaaagataagagtagagccccaataagtgccaaacttgttgcaaacatgctgagtgtagcgggagccgaccatatcatcactatggaccttcacgcgtcacaaatacaggtgtcagttgaggccaagtactggtgtctgaagggcggtcgcaaaggtctcatgatgctgaaaactgctgagaagcctaaaattatgcccaagtatatttag

SEQ ID NO: 234982 - DNA, 756 bp, Artificial Sequence
  Description of Artificial Sequence: Synthetic coding sequence
atggagctgctaattatgatcaacgcatgtaagatagcttccgctagtagagttacagcggtgataccatgtttcccctatgctcggcaagacaagaaagataaatcgagggcaccgattagtgccaagctggtagccaatatgttgtctgtcgccggagctgatcatattattaccatggatctgcacgccagtcagatccaggggttttttgacattcctgtggataatttatacgcagagccggcagtgctgaagtggattcgggagaacatctccgaatggcgtaactgcacaatcgtgtctcccgatgcaggcggtgctaagcgagtcacatccatagctgataggctgaatgttgattttgcgctgatccacaaagaaaggaaaaaagccaatgaggttgatagaatggtgctcgtgggggacgtgaaggatagggtggccatcctcgtggatgatatggccgacacctgtgggacgatttgccacgccgctgataaattactcagcgcgggtgctactagggtgtatgccattctcacccatggtatcttttcaggtcccgctatctccagaatcaacaatgcttgcttcgaggcagtggtcgtgacaaacacaatcccccaggaggataaaatgaagcactgtagcaagattcaagtgatcgatatctctatgatccttgcagaggcgattagacgtactcataatggagaaagcgtttcttacctattttcacatgtgccgctgtag

SEQ ID NO: 234983 - DNA, 957 bp, Artificial Sequence
  Description of Artificial Sequence: Synthetic coding sequence
atgccaaacatcaaaatattttctgggtcgagtcatcaggacttgagtcaaaagatagctgacaggctcggcctcgagctaggaaaagtggtgactaaaaaattttccaaccaggagacatgcgtggaaattggcgagagtgtacgtggagaagacgtgtatatagtgcagagcggttgcggtgagatcaatgataatctgatggagctgctcataatgatcaatgcttgtaagatcgccagtgctagtcgggtcactgccgtgatcccctgctttccctatgccagacaggataaaaaagacaagtcacgcgctcctatcagtgccaagctagttgcaaacatgctgagcgtcgccggagccgatcatatcattacaatggatctccatgcctctcagatccagggctttttcgacataccagtggacaacctctacgccgaacctgctgtactcaaatggattcgcgagaacatctctgagtggcggaattgtaccatcgtgtcgccagatgccggaggcgcaaagagagtaacctctatagctgaccgcctgaacgtcgactttgccttaatccacaaggagaggaaaaaagcgaatgaagtcgacaggatggtgttggtcggagatgtgaaagatagggttgcgatcctcgtagatgatatggctgatacctgtggtacaatctgtcatgcagccgacaaacttttgtccgcaggggctaccagggtttatgccattttgactcatgggatctttagcggacctgcaatcagcaggattaacaacgcctgctttgaagctgtggtagttaccaacaccattccacaggaggataagatgaagcattgtagtaaaattcaagtgattgacatctctatgatccttgccgaagctattaggaggactcataatggggagtccgtctcctatctgttttcccacgtgccattgtag

SEQ ID NO: 234984 - DNA, 957 bp, Artificial Sequence
  Description of Artificial Sequence: Synthetic coding sequence
atgccgaatatcaaaattttctcaggctcatcgcaccaagacctgtcacagaagatcgcagacagacttggactggagctcggcaaagtggtgacaaaaaagttctcaaaccaggagacctgcgtcgagatcggagaaagcgttcgcggtgaggacgtctacattgtgcagagcgggtgcggagaaatcaacgacaacctgatggagctcctgataatgattaatgcttgtaagattgcctccgcctcaagggtgacagcggtaattccttgctttccttatgctcgccaggataagaaagataaatccagagctccaataagcgcaaaactcgtggctaatatgctctcagtcgctggcgctgaccatatcataacaatggacctacacgcctcccagatacaaggcttctttgatatacctgtggataacctgtatgcagagccagcagtgctaaagtggatcagggagaacatcagcgaatggcggaattgcactatagtttctcccgacgccggtggcgcaaaacgggtgacttctatagcggatcggttaaacgttgacttcgcgcttattcacaaggagagaaaaaaggccaatgaggttgataggatggtcctcgtcggagatgtcaaagacagggtcgccattcttgtggacgacatggcggatacttgcggcaccatctgtcacgccgctgacaagctgctctcagcaggggcaacacgcgtgtatgccattttgacccacggcattttttctggtccagccatcagtcgcatcaacaatgcctgctttgaagccgtggtcgtgactaataccatcccgcaggaagataagatgaagcattgcagcaagatccaggtgattgacatttctatgattctggcagaagctattcggagaacacacaacggcgagtcagtgagttacctgtttagtcatgtgccactctag

SEQ ID NO: 234985 - DNA, 957 bp, Artificial Sequence
  Description of Artificial Sequence: Synthetic coding sequence
acccctaatatcaagatcttttctgggtcctcacatcaggacctcagccaaaagatcgcggataggctgggacttgaactgggcaaggtggtgacaaaaaagttctcaaatcaggaaacctgtgtggagattgacgaatcggtgagaggtgaggatgtgtatattgtgcaaagtggatgtggtgaaattaatgacagcctgatggagctcttaattatgataaacgcgtgcaaaattgcttccgcgagtcgtgtaacagcagtaatcccttgttttccttacgcgagacaggacaagaaggataagagcagaagccccatcagcgccaagctggttgccaatatgcttagcattgctggcgcagaccacattattaccatggatcttcacgcctctcaaatacaggggttttttgacatcccagtcgataatctgtacgctgagcctaccgttttgaagtggattcgcgaaaacattccagaatggaagaactgcattattgtgtccccagacgccggaggggctaagcgtgtgacaagcattgccgaccagctcaacgtcgactttgccctgattcataaagagagaaagaaagccaacgaagtggactgcattgtgctcgttggtgacgtcaatgatagggtggccatcttggtggacgacatggcggacacttgtgtcacaatttgcctcgccgctgataaacttcttagcgccggtgctaccagggtctatgcgattttgactcatgggatctttagcggaccagctatctctcggattaatactgcttgctttgaggccgtcgttgtgaccaacacgattccccaagacgagaagatgaagcactgttctaagatcagggtcatcgatatctcaatgatcttggccgaggccattagacgcacccacaatggagaatccgtctcatacctgttcagtcacgtcccactgtag

SEQ ID NO: 234986 - DNA, 957 bp, Artificial Sequence
  Description of Artificial Sequence: Synthetic coding sequence
atgcccaatatagtgctgttttcaggctcctcacatcaggatctgtcccagcgggtcgcagaccggctcggcctggaattggggaaggtagtgaccaagaagttcagtaaccaggagactagtgtcgagataggcgaaagtgtgagaggcgaagacgtctatataatccagagcggatgtggcgaaatcaatgacaacctcatggagttactcatcatgattaacgcttgtaagatcgcctcttcttctcgcgtgactgcggtgatcccatgttttccttatgcaagacaggacaaaaaagacaaaagcagggcacctatttcagcaaaactggttgctaatatgctgagcgtcgctggggctgaccacatcatcactatggatctgcacgcctcccagattcaaggtttttttgatatcccagtcgacaacctgtatgctgagccagccgtgctgcaatggatccgggagaatatcgcggagtggaaaaattgtattattgtgagccctgatgcagggggtgccaaacgcgtaacttccatcgccgacaggttgaatgtggagtttgcgcttatacataaagaaagaaaaaaggcaaacgaggtggaccgtatggtcttggtgggcgacgttaaagatagggtcgctatattagttgatgacatggccgatacctgtggtacaatctgtcatgcagctgacaagttgttatctgctggcgctactaaggtgtacgcaatcctcacacacggcatcttttctggacctgctatctcaagaattaacaatgctgccttcgaggcggttgtagtgacaaataccatcccacaggaagacaaaatgaagcactgcacgaaaattcaggtgatcgatatttcaatgatcctcgccgaagccattcggcgaactcacaacggcgagtctgtgtcctacctgttcagtcatgttccgctgtag

SEQ ID NO: 234987 - DNA, 966 bp, Artificial Sequence
  Description of Artificial Sequence: Synthetic coding sequence
atgcccaatattgtcctgttctctggttcaagccatcaagatttgagccagcgggtcgctgaccggctcggtttagagcttggaaaagtagtgacaaagaagttctcaaaccaagagacttctgtggaaatcggtgagtccgtgaggggagaggatgtctacatcatccagtcaggatgcggggagatcaacgataatctcatggaactgctgattatgatcaatgcctgtaagatcgcatccagtagccgagtgaccgctgtgattccttgcttcccttacgcgaggcaagataagaaggacaaagtgggtgagagcagggcgccaatatccgccaaactcgtggccaacatgctgtccgtggcaggggcagaccacattattaccatggaccttcatgcatctcaaattcaggggttctttgacattcctgtcgacaatttgtacgctgagccagcagtactgcagtggatcagagaaaacatagccgagtggaaaaactgcataattgtgtcacccgatgcgggaggggctaagcgcgtcacatccattgccgacagattgaacgtggaatttgccctgattcacaaagaaagaaagaaggccaatgaggtggaccgaatggtgctagtgggcgacgtcaaagacagggtcgcaatactggtggatgacatggcagatacatgtggcacaatttgccacgcggcagataaactcctgtcagccggagccacgaaagtttatgccatcttaacccacggaattttttcaggccctgcaatcagccgcatcaacaacgcagccttcgaagccgtcgtagtgactaatacaatacctcaggaagataaaatgaagcactgcacaaaaattcaggtgatcgacatttctatgattctggctgaagccatccggcgaacccataacggagaatctgtgagttatctttttagtcatgtgcccctctag

SEQ ID NO: 234988 - DNA, 849 bp, Artificial Sequence
  Description of Artificial Sequence: Synthetic coding sequence
atggaattgctgattatggcctacgcgctcaaaaccgcctgtgcaagaaacattatcggagtgatcccatactttccttactctaagcagtcgaagatgcgcaagagaggtagtatagtctgtaaactcctggccagtatgctcgctaaggccggtctgacccatattatcaccatggatctgcaccagaaggagatccagggatttttcagtttccccgtggacaatctgagggccagtccttttctgctgcaatacattcaggaggagatcccgaactaccgaaatgctgttattgtagccaagtctccagacgccgctaagcgcgctcagtcatacgctgaaaggctgcgactggggctagccgtgatccacggtgaagctcagtgtaccgaactggacatggacgacgggcgacattctccaccaatggttaaaaacgcgacggttcaccccggtctggagctccctctgatgatggcaaaggagaaacctccaatcacggtggtaggagacgtgggcggaagaatcgcaatcatcgtggacgacatcattgacgatgtcgaatcttttgtggccgctgctgaaatactgaaggagagaggtgcttacaagatctatgtcatggctactcacggcattctctcggccgaagccccacgtttgattgaagagagctcagtcgacgaggttgttgttactaacaccgtcccacacgaagttcagaaactgcaatgccctaaaatcaagaccgttgatatcagccttattctttccgaagctattaggaggatccataacggtgaaagcatggcctatttgtttcgcaacataacagtagatgattag

SEQ ID NO: 234989 - DNA, 1158 bp, Artificial Sequence
  Description of Artificial Sequence: Synthetic coding sequence
atgcccaaaaagctgcttcttctgcccccaccatcagccagctctgcgttcagagtgcctagagccaggccagttccgccacctgcgatgaacgccgcaaggacggggtaccgcgttttctccgcaaattctacagcagcctgcactgagttggctaagaggattacagagcgtttgggcgcagagctggggaaaagcgtcgtgtaccaggaaaccaatggcgaaacgcgcgttgaaattaaagaaagcgtcaggggccaagacatcttcatcattcagacaatacctagagacgtgaataccgctgtgatggaactgctgatcatggcatacgcactgaagaccgcttgcgctcggaacattatcggcgtgatcccttacttcccatactccaagcagtccaaaatgcgaaaacggggttccattgtgtgtaagcttctggctagcatgttagctaaggccggactgacacacattatcactatggacctgcaccagaaggagatccaaggcttcttctcttttcctgttgataacttgcgcgctagcccctttcttctccagtatatccaggaagaaattcctaactacagaaacgcagtgatagttgcaaaaagccccgacgcagccaagagggcacagtcatacgcagagcgactgagactgggactggccgtgatccacggcgaggctcaatgtactgagctggacatggacgatggtcgtcattccccacctatggtcaaaaatgctacagtccacccaggactggaactaccgctgatgatggccaaagagaagcctcctatcactgtagtgggggatgtagggggaagaattgcgattattgtggatgacattatcgatgatgtggagtcctttgtagcggcagccgaaatacttaaggaacgcggagcatacaaaatctacgtcatggctacccacggaatcttgagcgcagaggcgcctcgactgatcgaagagagctcagtggatgaggtggtggtgactaacaccgtgcctcatgaagtccaaaaactgcagtgtcccaagatcaagactgtggatatttctctaattcttagcgaagcaatcaggagaatccataatggggaatccatggcatatctcttccggaacattaccgtggacgattag

SEQ ID NO: 234990 - DNA, 1110 bp, Artificial Sequence
  Description of Artificial Sequence: Synthetic coding sequence
atgttctgtgtgacaccaccagaacttgaaaccaagatgaacataactaagggcggactcgtgctgttctccgcaaacagtaattcatcatgtatggagctctccaaaaaaattgcggagcgcttgggcgttgagatggggaaagtgcaggtatatcaggagccgaacagagagacgagagtgcaaatacaagaaagtgtgcgaggtaaagatgtatttataatccaaacggtcagtaaagacgttaataccacgatcatggaattgcttattatggtgtacgcatgcaagacgtcctgtgctaaatctattattggcgtgatcccttatttcccctactctaagcagtgcaagatgcgcaaaagaggatctatcgtgtcaaagctactcgcgtctatgatgtgtaaggcaggtcttactcacctcatcacaatggatttacaccaaaaggagatccaaggtttcttcaacattcccgtagataacctgagggcctcgcccttcttgctgcaatacattcaggaggaaattcccgactacaggaacgccgtgatagtggctaagtctcctgcaagtgctaaacgcgcacagagtttcgctgagcgtttaaggctaggaatcgccgttattcacggagaggctcaggacgccgagagcgatctggtggatgggaggcacagcccccctatggtgagatctgttgctgctatccatcccagtctggagatccccatgctgatccccaaggaaaaaccaccaataaccgtcgttggggatgtggggggaagaatcgccattatcgtagatgacatcatcgacgatgtcgattccttccttgccgcagcagaaaccctgaaggaacgcggtgcctataagattttcgtgatggccactcacggtctgcttagtagtgatgctccaagaagaatcgaggagagtgctatagacgaagtagtcgtgactaacactatccctcacgaagtccagaagcttcagtgccctaagatcaagaccgtcgacattagcatgatactgagcgaggcgatcaggaggatccataacggtgagtccatgtcctacttgtttcgcaacatcggcctcgacgattag

SEQ ID NO: 234991 - DNA, 1110 bp, Artificial Sequence
  Description of Artificial Sequence: Synthetic coding sequence
atgttctgtgtgacccctccagaactggagacaaaaatgaacattacaaaagggggtttggtgctgttctccgcaaacagcaatagcagctgcatggagcttagcaagaagatcgcggaacgcttaggcgtcgagatgggcaaagtccaggtttaccaggaacccaaccgggagacacgggtacagatccaagagtctgttcgtggcaaagatgtcttcatcatacagaccgtttcaaaagacgtaaacaccaccatcatggagctcttgattatggtatatgcctgcaaaacttcctgtgccaaatctatcatcggagtaattccatactttccctattcgaagcagtgcaagatgcgaaaacgcggaagtatcgtcagcaagttgctagccagtatgatgtgtaaagccggactcacccatctaatcactatggatctgcatcagaaagaaatacaaggattcttcaacatacctgttgacaacttgagagcttccccatttttgttacagtacatccaggaggagataccagactatagaaatgcagtaatcgtggccaaaagtccagcatcagctaagcgcgctcaatcttttgctgagcgattaaggctgggcatcgctgtgatccacggtgaagcacaggacgcggagtccgatctggttgatgggagacactccccaccaatggttcgtagtgtagctgcaattcatccaagcttggagattcctatgttgattcctaaggagaagccacccattaccgtggtcggcgacgtgggtggcagaatcgctattattgtcgacgacattatcgacgacgttgacagttttctggccgcagcagagacactgaaggaacggggagcatacaagatcttcgtcatggccacacacggccttctgagcagtgacgcacctaggcggatagaagagtctgcgatcgacgaggttgtggttaccaatacgatccctcatgaggttcagaaattgcagtgcccaaaaataaaaactgtggacatctccatgattctttcggaggcgatcagacgaatccataacggtgaaagtatgagctatctgttcagaaacatcggtttagacgactag

SEQ ID NO: 234992 - DNA, 807 bp, Artificial Sequence
  Description of Artificial Sequence: Synthetic coding sequence
atgttttgcgttacccctcctgagttggaaaccaaaatgaatatcactaagggaggattggtgctttttagcgccaactctaactcctcatgtatggaactctcaaagaagattgccgagcgcctgggggttgagatgggcaaggtgcaggtgtatcaggagcctaatcgggagacccgcgtgcagatccaggagagcgtccggggaaaagacgtgttcataatccagacagtctccaaagatgttaacactactataatggaattattgatcatggtctatgcctgcaaaacttcctgtgccaaatctatcattggagtgattccctacttcccttacagtaagcaatgtaaaatgaggaagaggggatccatagttagcaaattactcgcctctatgatgtgtaaggcaggactcacacatctcattaccatggacctgcatcagaaggaaatccaaggctttttcaacataccggtggataacctgagagcctcaccgttcctccttcagtacattcaggaggaaattccggactacaggaatgccgtcatcgtggctaagtctccagctagcgccaagcgggctcagtcttttgctgagcggctgaggctcggaattgcagtcatccacggcgaagctcaggacgccgagagtgacctggtggatggacgccatagtccacctatggttagatcggtggctgccatccacccttcattggaaattccgatgttaatcccaaaggaaaagccaccaatcacagtggtaggcgacgtaggtgggcgaattgctatcatcgtttag

SEQ ID NO: 234993 - DNA, 585 bp, Artificial Sequence
  Description of Artificial Sequence: Synthetic coding sequence
atgttttgtgtgacccctccggaattggaaactaagatgaacatcacaaaaggtggcttagtcttgttcagtgccaactcaaactcttcctgcatggaactgtcaaaaaaaatagcagaaaggctaggagtggaaatgggcaaagtccaagtgtaccaggaacctaaccgagagaccagagttcagatccaggaatcagtgcgtggaaaagatgtattcataatccagactgtatctaaggatgtcaacacaacgattatggagcttctcattatggtgtacgcctgtaaaacttcttgtgctaaaagcattatcggtgtaataccctatttcccctatagcaagcagtgtaagatgcggaaaagaggttctatcgtatccaagctacttgcaagtatgatgtgcaaggctggcctcacccacctcatcacaatggatctgcatcaaaaagaaatccagggattctttaacatacctgtggataatcttagggcaagcccctttctgttacagtatattcaagaggaaataccagattacagaaacgcagtcattgtggctaagtcccccgcaagtgcaaaatag

SEQ ID NO: 234994 - DNA, 990 bp, Artificial Sequence
  Description of Artificial Sequence: Synthetic coding sequence
atgttttgtgtgacccctcctgagttagaaactaagatgaatattacaaaaggcggactggtactattttctgccaatagcaattcatcctgtatggagctcagcaaaaaaatcgctgaggacgtcaacacaacaatcatggagctgctcatcatggtatacgcgtgcaagacaagctgcgctaaatcaataataggtgtcatcccgtattttccctacagcaagcaatgcaagatgcgcaaacgaggctcgatcgtgagtaagctgctcgccagtatgatgtgtaaagccggattaacgcacttgatcaccatggatctacaccaaaaggagatccaaggttttttcaatatccccgtagacaacctgagagcatctccctttcttttgcagtatatccaggaagaaatcccagattatcgaaacgcagtgattgttgcgaaatcgccagcatctgcgaagcgagcccaatcgttcgccgagcgcctaagacttggaatagctgttatacatggcgaggctcaggatgccgagtctgacttggtggacgggaggcactctcccccaatggtgaggtccgtcgccgcaattcatccctcgcttgaaattccaatgctaataccaaaggagaaacccccaattactgttgtcggcgatgttggaggtcgtatcgcaattattgtggatgatattatcgacgatgtagattcttttctcgccgctgccgagacattaaaagaacggggtgcttataagatttttgtcatggcaactcatggactcctgagttctgacgcgccacgacgcatcgaagagtctgccatcgatgaggtggtggttaccaatacgatacctcatgaggtccaaaagttgcaatgtccaaagatcaaaaccgtggacatatcgatgatcctgtcagaggcaatcagacggatacacaacggggaaagtatgtcatacctttttcgaaatataggactggatgactag

SEQ ID NO: 234995 - DNA, 531 bp, Artificial Sequence
  Description of Artificial Sequence: Synthetic coding sequence
atgttctgcgtaactcctccagagcttgaaaccaagatgaatatcaccaaaggaggactggtgctgtttagcgccaacagcaattccagctgcatggaactcagtaaaaaaatcgccgagaggctaggggtggaaatgggcaaggttcaggtttaccaggaacccaaccgcgagacacgggtgcagatccaggagagcgtccggggtaaagacgtgttcattatccagacggtcagtaaggacgtaaatacgaccatcatggagcttctcattatggtttacgcctgcaagacctcatgcgccaagtcgatcatcggcgtgattccgtacttcccttattcaaaacaatgtaagatgagaaagcgaggcagtattgtgagcaagcttctggcatcaatgatgtgcaaagcgggtctgacacaccttatcacaatggacttacatcaaaaggagatccaaggcttcttcaacatcccagtcgataacttgagagctagcccttttcttctccagtatattcaggaggagtag

SEQ ID NO: 234996 - DNA, 735 bp, Artificial Sequence
  Description of Artificial Sequence: Synthetic coding sequence
atgttctgcgtaacacctcccgagctagaaactaagatgaacatcacaaagggagggctcgtgctctttagcgccaattcaaattcatcctgcatggagctgtcaaagaagattgcggagagactgggcgtggaaatgggtaaggtgcaggtgtaccaggaaccaaaccgggagacccgggtccagattcaggaatctgtgagggggaaggatgtgtttatcattcagaccgtatccaaagacgtcaataccaccatcatggagctgttgatcatggtgtacgcctgcaagacaagttgcgctaaaagtattataggcgtgattccgtactttccgtattccaagcagtgcaagatgaggaagcgagggtcaatagtgtctaaactgttggcttctatgatgtgcaaagcgggtctcacacatctgatcacgatggacctccatcagaaagagatccaaggattttttaatatcccagtggataatctccgggcatctccattccttctgcagtatattcaagaagaaattcctgattaccggaatgccgttatcgtggctaaatcacccgcttccgccaagagagcacagtccttcgctgagagacttcggctgggtatcgccgttattcatggggaggctcaggacgccgagtccgacctggtcgacgggagacattctccccctatggtcagatcggtcgctgcgatccaccccagtctggagatcccttag

SEQ ID NO: 234997 - DNA, 135 bp, Artificial Sequence
  Description of Artificial Sequence: Synthetic coding sequence
atgttctgcgtcaccccccctgagcttgagacaaagatgaacatcactaaaggcggactggtcctatttagcgctaattcgaattcgtcttgcatggagctgtctaagaaaattgccgagcgcctcggggtttag

SEQ ID NO: 234998 - DNA, 807 bp, Artificial Sequence
  Description of Artificial Sequence: Synthetic coding sequence
atgttttgtgtaactcccccagagctggagaccaagatgaacatcactaaaggaggactggtccttttctcggcaaacagcaacagtagttgtatggaattgtctaaaaagattgctgaacgcctcggcgtggaaatgggaaaagtgcaggtttatcaggagcccaaccgggaaactagggtacaaatccaggaatccgtgcgcggaaaagacgtctttattatacagacggtgagcaaggatgtgaataccaccattatggagcttcttatcatggtgtatgcttgtaaaacatcatgtgccaaaagcatcatcggagtgataccctactttccctacagtaagcagtgcaaaatgcgaaaacgcggatccatcgttagcaaacttttggcctccatgatgtgcaaagcaggtctaacacatctcatcacgatggacctgcaccagaaagaaattcagggttttttcaacatccctgtagataatctgagggccagccctttcctgcttcagtatatacaggaggaaatccccgattacagaaatgcagtgatcgtggccaaaagtcctgccagcgcaaaaagagcccagtcattcgccgaacggctccgcctggggatcgccgtaattcacggcgaagctcaggatgccgaatcagatcttgtggatggacggcatagcccacctatggtgaggagcgttgccgctatacaccctagcttggaaatccccatgctcatccccaaagaaaagcccccaataacagtggtcggcgacgtgggcggtagaattgcgatcatcgtctag

SEQ ID NO: 234999 - DNA, 423 bp, Artificial Sequence
  Description of Artificial Sequence: Synthetic coding sequence
atgttctgtgtgacccctccagaacttgagactaaaatgaatatcacaaaaggtgggctggttctgtttagcgctaattctaattcaagctgcatggagttgtccaaaaaaattgctgagcgactgggtgtggagatgggaaaagtgcaggtgtatcaggagcccaacagagagacccgggtgcaaatacaggaatcagtgaggggaaaagatgtcttcattatccagaccgtctcaaaagacgtgaatactaccattatggagctgttaatcatggtttatgcctgtaagacatcttgcgccaagtccattatcggggtgatcccttactttccctatagtaagcagtgtaagatgcgcaagcggggaagtatcgtctcaaagcttctagcatcaatgatgtgcaaggccggtttgacatag

SEQ ID NO: 235000 - DNA, 807 bp, Artificial Sequence
  Description of Artificial Sequence: Synthetic coding sequence
atgttttgcgtgacaccacccgaactggaaacgaagatgaacatcaccaaaggcggactggtactgttttccgccaactctaattcaagctgtatggaactgtctaagaagattgctgaacggttaggggtagagatgggcaaagtgcaggtgtatcaggagcctaatcgggagacgcgggttcaaatacaagagtctgttcgagggaaggatgtgtttatcattcagaccgtaagtaaagatgtcaatacaacaataatggagctcctcattatggtgtacgcatgcaagaccagttgcgctaagtccatcataggcgttatcccatattttccctactctaagcagtgcaaaatgcgcaagagggggagcatcgtgtcgaaactactggcttcgatgatgtgcaaggcgggtctgactcatctgattactatggatctccatcagaaagagatacagggcttcttcaacataccggtggacaatctgcgggctagcccctttctgctgcaatatattcaggaagaaatcccagattatcggaacgccgtcatagtggcaaagagcccagccagcgccaagcgggcacaaagttttgcagaaaggctacgccttggcatagccgtgattcacggcgaagcacaagacgctgagtctgatctcgtggacgggcgacattctccgccaatggtgcggtctgtcgccgcaatccacccaagtcttgaaatcccaatgctgatccctaaagagaaaccacccatcacagtcgtgggagatgtaggaggaagaatagccatcatagtgtag

SEQ ID NO: 235001 - DNA, 852 bp, Artificial Sequence
  Description of Artificial Sequence: Synthetic coding sequence
atggaactgctcatcatggtttatgcttgtaaaacttcttgcgctaagagtattattggcgtcatcccctacttcccttatagtaaacagtgcaaaatgcgcaagcgcggtagcatagtatcaaaattgctggcgtccatgatgtgcaaggccggattgacccatctcatcaccatggacctgcaccagaaagaaattcaaggttttttcaatattcctgtggataacttaagagcctcaccttttctgctgcaatacatccaagaagagattccagactatagaaatgctgtcatcgtggctaagtccccagcatcagccaagagggctcagagcttcgcagagagactgagactagggatagcggtgatccatggcgaagcacaagacgccgagtctgatcttgtggatggacggcattcccctcctatggttcggtccgtggcggcaattcaccccagcctggaaatacccatgctgatcccaaaggaaaaaccgcctattactgtggtgggagacgtcggaggcaggatcgccatcattgtggacgacatcatcgacgatgtggacagttttctggcggcagccgagaccctgaaagaacgaggcgcttacaagatcttcgtgatggctacccatggtctgctgtcctctgacgcaccaagacggatcgaggaatctgccattgacgaagttgtcgtgacgaacacaatccctcacgaggttcagaaactgcagtgccctaagatcaagaccgtcgatatatccatgatcctgtctgaagctatccgcaggattcacaacggggagtccatgtcttacctttttcgtaatataggcctcgatgactag

SEQ ID NO: 235002 - DNA, 963 bp, Artificial Sequence
  Description of Artificial Sequence: Synthetic coding sequence
atgttctgtgtgactccacccgaattggagacaaagatgaacatcaccaaaggcggactggttctgttctccgccaactcgaactcctcctgtatggagttgtccaaaaaaatagcagagaggttaggagtagaaatgggcaaggtgcaggtgtaccaggaacctaaccgtgaaacccgcgtacaaattcaggaatctgtaagggggaaggacgtttttattattcagactgtttccaaagacgttaacactacaattatggagttacttatcatggtctatgcctgcaagacctcctgtgccaagtccattataggcgtcatcccgtacttcccttatagcaaacagtgcaagatgagaaaacggggtagcattgtatccaagctgttggcgagcatgatgtgcaaagcgggactgacccacctgattaccatggacctgcatcaaaaggagatccagggctttttcaatatacccgtggataaccttcgcgctagccctttcctgctgcagtacattcaggaagaaatcccagactaccgcaacgctgtgattgtagcaaaaagcccagcctctgccaagagggcccagtccttcgccgaacgcttgagactgggcatcgcagtgatacatggggaagcccaggatgcagaatctgatctggttgacggccgacactcgcctcccatggttcgaagcgttgcggcaatccacccaagccttgagatcccaatgctgatccccaaagagaagccccctatcaccgtagttggcgacgtggggggaagaatcgctatcatcgttgttgtagtgacgaatacaatcccacatgaggtgcaaaagctgcaatgtcccaaaatcaagactgttgatatttctatgatcctttccgaggctattcgacgcatccacaatggcgaaagcatgtcgtatttgtttcgaaatataggactcgacgattag

SEQ ID NO: 235003 - DNA, 237 bp, Artificial Sequence
  Description of Artificial Sequence: Synthetic coding sequence
atgttttgtgtaacaccccctgaattagagaccaagatgaacattacaaaagggggattggtgctgttctccgcgaacagcaactcttcctgcatggaattaagcaagaagatcgcagagaacaagtcaaccaactcccgcgtgtgcgagggtaagcggtgcttccatcatcccaattgctttgagggcagggagcaccatcatcacggggcacccgatcacggggtctgcatgtag

SEQ ID NO: 235004 - DNA, 678 bp, Artificial Sequence
  Description of Artificial Sequence: Synthetic coding sequence
atggcagggtccagcgaagaggcccctgactacgggcgaggggtggtcatcatggatgactggccgggttacgatttaaatctctttacttacccccagcattactatggtgacctcgagtacgtactcatacctcatgggataattgtcgacaggatcgagaggctcgccaaagatatcatgaaagatataggctacagcgacattatggtgctgtgcgtactgaagggaggctataaattttgtgccgatctcgtggagcacctgaagaacatttcaaggaacagtgaccgttttgtaagcatgaaggtggacttcattagacttaaaagttaccgcaatgaccagtcgatgggagagatgcaaatcatcggcggagacgatctgagcacgctagccggaaagaatgtgctcattgtggaggacgttgttggcaccgggcgtacaatgaaggcattgctgtcaaacatcgagaaatataagccaaatatgataaaggttgcttctctgctggtaaagcgaacgtcccgctcagacggctttcgaccagactatgctggttttgagattccaaatctgttcgtggttggctacgccctcgattacaacgagtactttagggatctgaaccatatctgcgtcatcaacgagcacggcaaggagaagtaccgggtatag

SEQ ID NO: 235005 - DNA, 573 bp, Artificial Sequence
  Description of Artificial Sequence: Synthetic coding sequence
atggcgggaagctcagaggaggccccagactacggtagaggggttgtcattatggacgattggccaggctatgacttgaacttatttacatatccccaacactactacggagaccttgaatacgttctgattcctcacggcattattgtggatcgcatcgagcggctggccaaagatatcatgaaggacatcgggtactcagatatcatggtgctctgcgtcctgaagggtggatacaagttctgcgccgacctagtggagcacctgaaaaatatctctcggaactccgaccgctttgtcagtatgaaagtggactttatacggctgaaatcctataggaatgatcagtcgatgggcgagatgcaaatcatcggaggtgacgatctgagcacattagctggcaaaagtgttcttttcgcaaaagatgtcgtgggaaccggacgcacgatgaaggcgcttctctctaatatcgagaagtataagcccaacatgattaaggtggccagcctgctggtgaagcggacatcgcggtctgacggattcaggccagattctcacatgagacaccagtag

SEQ ID NO: 235006 - DNA, 522 bp, Artificial Sequence
  Description of Artificial Sequence: Synthetic coding sequence
atggctggatcttctgaggaggcacccgattacggccgaggggtcgtaattatggatgattggcccggttacgacctgaatcttttcacatacccacagcactactatggcgatctcgagtacgtgctgatcccccatggaataatcgtcgatcggattgaaagactcgcaaaagatattatgaaggatataggctatagcgatatcatggtcctgtgtgtacttaaaggcggatataagttttgcgccgatcttgtggagcacctcaagaatatctctcgtaattctgaccggttcgtcagcatgaaagtagactttatccggctgaagagctaccgattgagagcccgacttaaacgcaccacgatctgcgaccgcggaggcctggcgttcagccagggctacatgagctcttgtgcgccactgcaggaaagccctaacacgctttggaggggctacctgcaggtgctgatcccatgtttccacatcaggttccagctgcctaggtcagaacagaactag

SEQ ID NO: 235007 - DNA, 573 bp, Artificial Sequence
  Description of Artificial Sequence: Synthetic coding sequence
atggccggtagcagcgaagaggcaccagactacggccgaggtgttgtgataatggacgattggcctggttacgatctcaatctgttcacgtatccccaacactactacggagacctggagtacgtgctgatccctcacggtattatcgtggatagaatcgagcggttggcaaaagacatcatgaaagacattgggtattctgatatcatggtgctttgtgtgctgaagggcggttacaagttctgcgccgatctcgtggagcaccttaaaaacatcagccgcaatagcgatagattcgtaagcatgaaggtggactttattagactgaaatcttatagaaacgatcagtctatgggagagatgcagatcatcgggggtgacgacttgtccacactggcgggtaagaatgtgttgatcgttgaagacgtggtcggcaccggtaggaccatgaaagcgcttctgtcaaacatcgaaaagtataagcccaatatgataaaggtcgccagcttactggtgaagcgcacatcccggagtgatggcttccgccctgatagccatatgagacatcagtag

SEQ ID NO: 235008 - DNA, 1299 bp, Artificial Sequence
  Description of Artificial Sequence: Synthetic coding sequence
atggcgaccgccgaggtgttaaatattgggaaaaaactgtacgaaggcaaaacgaaagaggtgtatgagctgttggactctccaggcaaagtgctattgcaatcaaaggaccagattaccgctggaaatgccgcacggaagaatcacttggagggaaaagcagcgatcagcaacaagattacgtcctgtatcttccaattgctgcaagaggccgtgacatcatacaaatccaaccgcatcaaaacagcctttacgcggaagtgcggcgagaccgcttttatagcccctcagtgtgagatgatccccatcgaatgggtgtgtagacggatcgccactggcagttttctgaaacgcaatcccggagtaaaggaaggttataagttctacccacctaaggtggagctgttcttcaaggatgacgctaacaacgacccccagtggtctgaggaacagttgattgccgctaaattctgtttcgcagggctacttattggccagacagaagtggacatcatgtctcatgctacacaggccatctttgaaattcttgaaaagtcctggcttccccagaactgtaccctggttgacatgaaaattgagttcggggtggatgtgactaccaaagagatcgtgcttgctgacgtcattgacaacgacagctggagactgtggcctagtggagataggtcccagcagaaggacaaacaatcatatcgagacttaaaagaagtgaccccagaggggctgcagatggtgaagaaaaatttcgagtgggtcgctgaaagggtggaattgctgctgaagtctgagtcccagtgtagagttgtggttctgatgggcagtacgtccgatctcgggcactgcgagaaaatcaaaaaggcttgtggcaattttggcattccctgcgaactcagggtgacatctgcgcacaaaggccctgatgagacgctgcgtattaaagccgagtacgagggggacggcataccaacagtttttgttgcagtggccggaagatcaaatggtctgggtcctgtgatgagcgggaacacagcctatccggtgatcagctgcccaccactcacgcctgactggggtgtgcaggatgtttggagcagcctcaggctgccctcggggctcggatgttcaactgtgctgagtcctgagggttctgcacaattcgcggcacagattttcggcttgtccaatcatttggtgtggtctaagctccgtgcctcaatcctgaacacctggattagcctgaagcaggctgacaaaaaaatcagagagtgtaatctctag

SEQ ID NO: 235009 - DNA, 1278 bp, Artificial Sequence
  Description of Artificial Sequence: Synthetic coding sequence
atggccaccgcggaggttcttaacatcggcaagaagctgtacgaggggaaaacaaaagaggtttacgagctcctggactctccaggcaaggtccttcttcagtcaaaggatcagattaccgctggaaatgccgcacgtaaaaaccatttggaggggaaggccgcaatctcaaataaaattacatcttgtatttttcaactgctgcaggaggccggaataaagacagcgtttacaagaaagtgtggcgaaacagccttcatcgcaccgcagtgtgaaatgatccctatcgagtgggtgtgccggaggatcgccaccgggtcttttctcaaaaggaacccgggagtgaaagaagggtacaaattctaccctcccaaagttgagctgttcttcaaggatgacgcaaacaacgacccacagtggagtgaggaacagttaattgcagcgaaattttgcttcgccggtttgctgatcgggcagaccgaggtcgatatcatgagccacgcaacacaggccatctttgaaatccttgaaaagagttggctgcctcagaattgtactcttgtagacatgaagattgagtttggcgtggacgtgactacaaaagaaatcgttctggccgatgttattgacaacgatagctggagactgtggccttcaggtgaccgctcccaacaaaaagacaagcagtcctatcgagacctgaaagaagtgaccccggaggggctccagatggtgaaaaaaaatttcgaatgggtcgccgagcgggtcgaacttctgcttaagtccgaatcacagtgccgagtggtcgttctgatggggtctacctctgatcttggacattgcgagaagataaagaaagcctgcgggaactttgggatcccatgcgagttaagggtaacatccgctcataaaggaccggatgagacgctcaggattaaggccgaatacgagggggacggcattcctaccgtattcgtcgccgtcgcgggaagatccaacggcctcgggccagtgatgtcgggcaacaccgcctaccctgtcatctcgtgcccgcctttgacccccgactggggagttcaggacgtatggtcgagcctaaggctgccttccggactcggatgttctactgtgctgtcacctgaaggctccgctcaattcgccgctcagatttttggactgagcaatcacctggtgtggtccaagctgagagccagcatactgaatacttggatctcactgaagcaggctgacaagaagattagggagtgcaacctatag

SEQ ID NO: 235010 - DNA, 1278 bp, Artificial Sequence
  Description of Artificial Sequence: Synthetic coding sequence
atggcaactgcagaagtgttgaacatcgggaagaaactttatgaaggaaaaactaaagaagtttatgagttgctcgattcgccaggaaaagttctgctccaaagtaaggaccagataactgccggaaacgccgctagaaaaaatcacctggagggcaaggcagcaatcagcaataaaattacatcatgcatctttcagttactgcaggaggctggtattaaaactgctttcacccgcaagtgcggagagaccgctttcatcgctccccagtgcgagatgatcccgattgaatgggtttgccggagaatcgctactggtagctttcttaaacgaaaccctggcgtcaaagaaggatataagttctaccctccaaaggtcgagctgttctttaaggatgacgctaacaatgacccccaatggagcgaggagcagctgatcgccgcaaaattttgttttgccggactgcttataggccaaaccgaggtagatatcatgtctcatgccacccaggccatctttgagattttagaaaaatcttggttgccgcagaactgcacattggtggacatgaaaatagagtttggcgttgacgtgacaactaaggagattgtgctggctgatgtaatagataatgacagctggcggctgtggccttcgggcgaccgctcccagcaaaaggataagcagagctaccgggacttgaaagaggtgacgcccgagggcctacaaatggtcaagaagaacttcgaatgggttgccgagagagtcgaacttctgttaaaatccgaatcacagtgccgcgtggtcgtcctgatggggtccacctccgacttaggtcactgcgaaaaaatcaaaaaggcatgtgggaacttcggtattccgtgcgagctccgagtgacttctgcccataagggtcccgatgagaccttacggattaaggcagagtacgagggtgatgggatcccaacagtgttcgtggccgtagccggacggagcaatgggctggggcctgtgatgtcaggcaatacagcttatccagtgatcagctgtcctcccctgacacctgactggggggtgcaagacgtgtggtcaagcctacggttgccatccggtctggggtgctccacagtcctgagcccggagggctctgcccagtttgcagcccaaattttcggcctgtccaaccatctggtgtggtctaagctacgggcttcaattttgaacacgtggatcagtttaaagcaggcggataaaaaaattcgcgaatgcaatttatag

SEQ ID NO: 235011 - DNA, 4017 bp, Artificial Sequence
  Description of Artificial Sequence: Synthetic coding sequence
atgtcccccgtgctgcatttttacgtacggccttccggccatgaaggcgcagccccaggccatacccgacgcaagctgcagggcaaactgccagaactgcagggggttgaaaccgaactgtgctataacgtgaactggacggctgaggcacttcccagcgctgaggaaacgaagaaattgatgtggctgttcgggtgtccccttctgctggatgacgtggcgagagagtcttggttgctccctggttctaacgaccttctgctggaagtcgggccaaggctcaacttctccacccctacctccactaatatcgtgtcagtatgtcgcgcaacgggactcgggcctgtggaccgggtcgaaaccacaaggaggtaccgtctgtccttcgctcaccctcctagtgctgaggttgaagccattgcactggccacattgcacgacagaatgaccgagcagcattttccgcacccaattcagagtttcagcccagaatcaatgcccgaacctctcaacggacccatcaatatcctaggtgaaggtcgcctggcacttgaaaaggcgaatcaggaactgggcctcgctctggactcatgggatctggatttctacacaaagcggtttcaggaacttcaacggaatccctctactgtggaggctttcgacttggcacagtccaattcggagcattctcgtcactggttcttcaaaggccagctgcacgtggatggtcagaagctcgtccactcattatttgaatcaattatgagtacccaggaatcatcgaatcccaacaatgtattaaagttttgcgacaattccagtgcaatccaagggaaggaagttcgattcctgcggccagaagaccctacaagaccctcgagattccagcagcagcaaggccttaggcacgtcgtgtttactgctgagacacacaatttccccacaggagtgtgccctttcagcggcgctactacaggaacagggggtcggattcgcgacgttcagtgcacaggacggggagctcacgtcgtggctggaaccgccggatactgttttggaaatcttcacatccctggctacaatttgccttgggaagacccaagcttccagtatcccggaaattttgctcgacctctggaggtcgcgattgaagctagcaacggggctagtgactacggtaataagttcggggaacccgtgcttgccggttttgctaggtccctcggcctgcagttacccgatggacagcgaagagagtggattaagcctattatgtttagcgggggaatagggtcgatggaagccgatcacattagtaaagaggctccagaacctggcatggaggtggtgaaggttgggggtcccgtttatagaattggggtgggtggaggcgcagcctcaagcgtgcaggtgcagggtgacaacacatccgacctggatttcggtgccgtgcagagaggggatcctgagatggagcagaagatgaatcgggtcatccgtgcctgtgtggaagcgcctaagggtaatcctatatgttctctccacgatcagggcgctggaggcaacggaaacgttctgaaggaattaagcgaccctgcaggcgcaatcatctacacctcccgattccagctgggggacccaacactgaatgcacttgagatctggggagctgaataccaggaatcaaatgctctgctgttgagatctcccaacagggacttcttgacccacgtgagtgccagagagcgctgcccagcttgctttgttgggacaattaccggcgaccggagaatagttctggtggacgacagagaatgtcccgtgcggaggaatggacaaggagacgctccccctacgcctctacctacccccgtcgaccttgagctggagtgggtgctgggcaagatgccaaggaaagagttcttcttacagcgcaaaccacccatgttgcaacccctggctctcccaccaggtctgagcgttcatcaggccttagagcgggttttgcgccttcccgctgtggcatccaaaagatacttgaccaataaggtggatcgatcagtcggcggactggtcgctcaacaacagtgtgtcggccctctgcagaccccactggcagacgtggcagttgtggcactgagtcatgaggagctcattggggcagccactgctctcggtgaacagccagtaaaatccctccttgatccaaaggtggccgcaagattggctgtggccgaggctctgactaatcttgtcttcgcgctcgtcaccgatctgcgtgacgttaagtgttcggggaactggatgtgggctgcaaagctgcctggcgaaggggcagctctggcggacgcttgcgaagccatggtcgccgttatggccgctctaggagtcgcagtcgacgggggaaaagattcactgtctatggccgctagagtggggactgaaacggtgcgagcaccgggatcccttgtaatatccgcgtacgcagtctgccccgatattactgccacggtgacacccgacctgaaacacccggaaggcaggggacacctcctgtacgtggccctctccccaggacagcaccgccttggcggaactgcactggcccagtgcttcagtcagctgggggaacatccccctgacctcgatctgcccgaaaacctggtcagggccttctctattacccagggcctgctgaaagaccgcttgttatgttcaggccacgacgtatccgatggtgggctagtgacgtgcttactagaaatggcttttgccggtaactgcggcttacaggttgacgtacccgtaccacgcgtagacgtgctgtcggtcctattcgcggaggaacctggcctggtgctggaggtccaagagccagacttagcccaggtgctcaagcgctacagagatgccggactgcattgcttggagctcgggcacacaggagaagcaggacctcacgccatggtgagggtctctgtgaatggggcagttgtgttagaagaacctgtgggtgaactgcgcgctttgtgggaagagacttctttccaattagatagactacaggctgagccgagatgcgttgctgaagaggaaagaggcctaagagaaagaatggggccttcttattgcctgcctccaacttttcctaaagcttcagttccacgtgagccagggggaccctccccacgggttgctattcttcgggaggaagggagtaatggagaccgggaaatggcagatgcttttcacctcgccggatttgaggtctgggacgtcaccatgcaggatctttgttccggggctatagggttggacacattcaggggcgtcgccttcgttggaggcttttcttatgcagatgtgctaggtagcgctaagggttgggccgctgcggtgacgtttcatcctagagcaggagctgaattacgcagattccgcaaacgacccgacactttcagccttggggtgtgcaacgggtgccaattattggcacttctcgggtgggttggcggagacccaaacgaggacgccgctgagatgggcccagactcacagcctgctcggccaggtctgctgttgcgccacaacctgagtggcaggtacgaaagtagatgggcgtccgtccgggtcggaccagggcctgccctcatgctgaggggcatggaaggcgctgtcttgccagtgtggagcgcccatggagaaggctacgtagccttctcctcccccgaattacaggcgcagatagaggccaggggactggctccactccattgggctgatgatgatggcaacccaactgagcaataccccctaaatcccaatggctcaccaggtggagtggccggaatttgcagctgtgacggacgccatctggctgtcatgccccacccagagcgggcagtaagaccatggcagtgggcttggcgacctcctcccttcgataccctgactacatccccttggctgcaacttttcatcaacgcccgaaattggacactggaaggatcctgttag

SEQ ID NO: 235012 - DNA, 2745 bp, Artificial Sequence
  Description of Artificial Sequence: Synthetic coding sequence
atgttctccggcggaattggttccatggaggctgatcatatttccaaggaagctcccgagccgggaatggaggtggtcaaagtgggtggaccagtctatcgcataggcgttggcggaggcgctgctagctcagtccaggttcaaggagacaatacaagcgatttagacttcggcgcagtgcagcggggtgatcccgagatggagcaaaaaatgaaccgcgtgatcagagcctgtgtggaagcccctaaagggaaccccatctgtagcctgcacgatcagggtgccggtggtaatggcaatgtgcttaaagaactcagcgaccccgctggggcaataatttacacatctaggttccagcttggcgaccctaccctcaacgcgctggaaatttggggcgctgagtaccaggagtccaatgctttgctgctgcgttcacctaaccgagatttcctcacccacgtctccgctcgtgaacgatgcccagcctgtttcgttggtacgattactggtgataggcggatcgtgctggtcgacgaccgggaatgccccgtgaggcgaaacggccagggcgacgcgcctcctacaccactgccaacacctgtagaccttgagctggagtgggtactggggaagatgccacgcaaagaattcttcctgcaacgaaagcccccaatgctgcagccactggccttgccacccggtctgagtgtacaccaggctctggagcgggtcttgaggctcccagcagtcgcatcaaaacggtacctgaccaacaaggtggatagaagtgttggcggtttagtggcccaacaacagtgtgttggtcctctccagaccccactggctgacgtcgctgtggtggcacttagtcatgaggaactcattggggctgctacagctctgggggaacaacctgttaagagccttctcgatcccaaagtcgcagccagactcgcggtggcagaggctctgactaaccttgttttcgctcttgttacagacctgagggacgtgaagtgcagtggcaattggatgtgggctgctaagctacccggagaaggtgcagcactggcggacgcgtgcgaagctatggtcgccgtgatggccgcactcggcgtggctgtggatgggggaaaggattctctgagcatggcagcgcgagtaggcaccgagacggtccgggctcccggatccctcgtgatttctgcctacgctgtatgccccgacataactgctaccgtcacccccgacctgaagcatccagaagggaggggtcatctgctgtacgtagcattaagccccggacagcacagacttggcggtaccgcgctggcacaatgcttctcccagctgggcgagcaccctccggacctggacctgcctgaaaatttggtgagggcctttagcattacccagggcctcttgaaggacaggttgctgtgctccgggcacgatgtgtccgatggcggactggttacttgcctgttggagatggccttcgcaggcaactgtgggttacaggtggatgtccctgtaccaagggtagacgtcctaagcgtcttattcgccgaggagccaggtctagtgctcgaggttcaagagcccgatctcgcgcaagtcttgaagaggtatagggacgctggcctgcattgtctcgaattaggtcacacaggcgaggccggaccccacgccatggtccgggttagcgtcaacggagcggtggtgcttgaggagccggtaggggagttgcgggcactctgggaggagacatcgttccagctggaccgcttacaggccgagccccgatgtgtcgctgaagaagagcggggactgcgggagaggatgggccctagctattgtctgccacctacctttcctaaggctagtgtcccccgtgagcccggaggtccatccccaagagtggccatcctacgcgaagaaggctccaacggcgacagagaaatggccgacgccttccacttagccggtttcgaagtctgggacgtgactatgcaggatttatgctctggagcaataggactggataccttcaggggtgtggctttcgtgggtggattctcgtatgccgatgtattgggatccgccaagggatgggccgcagctgtgaccttccatccaagagcaggagccgaattgcgtagattcagaaagcggccagacactttttctttgggggtctgcaacggatgtcagctgctggccttgctcggctgggtaggaggagatccaaacgaagatgcggcagagatgggaccagatagccaacccgctagaccagggttgttgctccggcataatctgtcaggacggtacgagagccgatgggcctctgtccgagtagggcctgggccagccctgatgctccgcggaatggagggcgcagtgctgcctgtttggagcgctcacggcgagggctatgtggctttcagctctccagagctccaggcgcagattgaggcccgaggccttgctcctctacattgggctgacgatgacgggaacccaaccgaacagtatcccttaaaccctaacgggagtccaggtggcgttgccggaatttgctcttgtgatggaaggcacctggccgtaatgccccaccctgaaagagcggttaggccctggcagtgggcttggcggccacccccttttgatactctcaccacaagcccttggctgcagttgttcatcaatgccagaaattggacccttgaagggtcatgctag

SEQ ID NO: 235013 - DNA, 2244 bp, Artificial Sequence
  Description of Artificial Sequence: Synthetic coding sequence
gtgaaaggagagcggaggatagttttggtcgatgatagagagtgccctgtccgcagaaatgggcagggagacgcaccaccgacacctctgccaacacctgttgacctggaattggaatgggttctcggcaaaatgcccagaaaagaattcttcctgcaaaggaaacctcctatgttacaaccgcttgccctgcccccaggcctgtcagtacatcaggctctggaacgcgtgctgcggctgccggcagtcgctagtaaaagatacctaacaaataaggtggacaggtccgtcgggggtctggtcgctcagcagcagtgcgtgggaccactgcagacaccgctggctgatgtggccgtggttgctctttcccatgaggagctgatcggagccgctactgcattgggcgagcagcctgtgaaatccctgttagatcccaaagtagccgcaaggctggctgtagctgaagcgctgacgaatcttgtctttgctctagtgacagatctgcgcgacgttaagtgtagtggaaactggatgtgggctgcaaaactgccaggggaaggcgcagcactcgctgacgcctgtgaagcgatggtcgctgttatggcggctctgggcgtggcagtggatggaggcaaagactccctgagcatggcggctcgcgttgggaccgagactgttcgggctcccggaagtctcgtcattagcgcctacgcagtctgtcccgatatcaccgccactgtcacacctgacctaaaacaccccgaaggccgaggccacttactttacgtggctctcagtccgggtcagcaccgcttgggcggaactgcccttgctcagtgtttcagtcagttaggtgagcatcctcccgaccttgatctgcctgagaacctggtaagagccttcagcattacacaggggctgctgaaagacagattactatgctctgggcacgacgtgtctgacgggggactggtgacttgcctgctcgagatggcctttgccggtaattgcggtttgcaggtggacgtgccagttcccagggtggacgtgctgagcgtgttgtttgcggaggagcctggccttgtcttagaggtgcaagagccggatcttgcacaggtgcttaaaagatatcgcgatgccggactgcactgccttgaactcggtcacaccggcgaggccggtccgcacgccatggtgcgcgtgtctgtgaacggcgcagtggtgctggaagagcctgtcggtgaacttcgagctttgtgggaggagacatccttccagctggatagacttcaggctgagcccaggtgcgtggccgaggaggagcgtggccttcgggagcgcatgggaccttcatattgtcttccccctacctttcccaaggcctccgttcccagagaaccaggcggtccctcaccgagagttgctattcttcgggaggagggttcaaatggtgatagagaaatggccgatgcatttcaccttgcgggtttcgaggtatgggacgtaacgatgcaggatctgtgttcaggggcaataggcctggataccttcaggggtgtggctttcgttggcggattttcatatgccgacgttctcggttctgctaagggatgggccgcagcagtcacctttcaccctagagcaggggctgaactgaggcggtttcgcaaaaggcccgatactttctccctgggcgtttgcaacggctgccagctccttgcgctcctcgggtgggtcgggggtgatccgaatgaagatgccgctgaaatggggcctgacagccaacctgcacgcccagggttactgctcaggcataatctgagcggtagatatgaatctcggtgggcatccgtccgcgttgggccaggacccgctctgatgcttagggggatggaaggagcagttttacccgtttggtccgcacatggcgaggggtacgtcgctttctcatctcctgaactccaagctcagattgaggcaagaggcctcgcgcctctccactgggctgacgacgacgggaatcctactgagcaatatccattaaatcccaatggcagcccaggaggagtcgccggaatttgctcctgcgatggcagacacctcgcggttatgccccacccagagcgagctgtgagaccatggcagtgggcttggaggccgccacccttcgatacactcaccacatctccatggctgcagctcttcataaacgccaggaattggacattggaagggtcttgttag

SEQ ID NO: 235014 - DNA, 1302 bp, Artificial Sequence
  Description of Artificial Sequence: Synthetic coding sequence
atggctgccagggtgctgattataggaagcggaggcagggaacacaccctggcctggaaactggcacagagtcatcatgtgaaacaggtattagtcgcccctggtaatgccggaacagcctgtagcgaaaaaataagcaatacggccataagcataagcgatcatacggccctggcacagttctgtaaagagaaaaaaatcgaattcgttgtggtgggtcccgaagctcctctggccgcaggcattgtcggcaatctgcgatctgccggtgtgcagtgctttggccctacggctgaggcagcacagctggaaagctctaagcggttcgcgaaggagtttatggatagacatgggattccgacggctcagtggaaggccttcacaaagccggaggaggcgtgctcattcatcctctcggcagacttccctgccctcgtggtgaaggcctctggactggcggctggtaagggagttatcgtggccaagagtaaggaagaggcctgcaaagcggtgcaggaaataatgcaagagaaggcctttggagcagcaggcgaaacaatcgtgatcgaagagctgctcgatggagaggaagtgtcatgcctctgcttcacggacggcaaaaccgtcgcgcctatgccgccagcacaagatcacaaaagattgctggaaggcgatgggggacccaacactggcggtatgggtgcatactgccccgcaccccaggtttcaaacgatctgcttctcaaaatcaaggacactgtactgcagagaacagtggatgggatgcagcaggagggtactccctacaccggtatcctttacgccggaattatgctgaccaaaaacggacccaaggttctcgagttcaactgtcgctttggcgaccccgagtgtcaggtcatcttgccattgctgaaatccgatctgtacgaggtaatccagagcaccctcgatggattgttgtgcacatccctgcctgtttggcttgagaatcatacagcactgactgtcgttatggcgagcaaaggttaccccggagactacaccaaaggcgtggagattacaggattcccggaagcacaggccttgggcttagaagtattccacgccggaacagccttgaaaaatggtaaagtggtgacgcacggtgggagggtgctcgctgtaacagcgatccgggagaatttgatatccgcccttgaggaggcaaagaagggcctggctgccattaaattcgagggagccatatacaggaaggatgtgggcttcagggcgattgctttcctccagcagcctcggtag

SEQ ID NO: 235015 - DNA, 3033 bp, Artificial Sequence
  Description of Artificial Sequence: Synthetic coding sequence
atggccgctagggtactgattatcggcagcggcggtagagaacatactctggcttggaaacttgcccagagtcatcatgtgaagcaggtgctggtggctcctggcaacgccggaactgcctgcagcgaaaagattagcaataccgccatctctatctccgaccacacagccctagctcagttttgcaaggaaaaaaagatcgagtttgtcgtggtgggtcctgaggcacctctcgcagccggtatcgtgggcaaccttcgcagcgccggagtgcagtgcttcggaccaaccgcagaggccgcacaactggaatctagcaagagattcgccaaggagtttatggaccgtcatggaatacctactgcccagtggaaggctttcacaaagcctgaagaggcgtgctcctttatcttatccgcagactttccagctttagtggtgaaggccagtggccttgctgcaggcaagggggtcatagtcgccaagtccaaggaggaagcctgcaaggccgtgcaggaaattatgcaagaaaaggcatttggagcggcaggggagacaatcgttattgaggaactcctggacggggaggaggtatcttgcctttgttttacggacggaaaaacagttgcccctatgccccctgcccaagaccataagcgactgttagaaggtgatgggggtcccaacacaggtgggatgggtgcctactgtccagctccacaagtgtctaatgacttgctacttaaaatcaaggatacagtgctgcagcggacagttgacggtatgcagcaggagggcaccccctacacagggatactgtatgccggaatcatgctgactaagaacggcccaaaggttcttgaattcaattgtcggttcggtgacccagagtgccaggtcatactccctttgttgaaatccgacctctatgaggttattcagtcaacgcttgacggactcctgtgcacaagtctgccagtatggttggagaaccataccgcgctgaccgtggtaatggcctctaagggttatcctggagactacactaagggcgtggaaattactggtttcccagaggcacaggccctagggcttgaagtcttccacgccggaactgctttaaagaatgggaaggtggtaacacatggtggccgtgtcctggccgtgaccgctattagggagaatcttatttcagcactagaggaagcaaagaaaggactggcggcaatcaagttcgaaggggcaatctaccgtaaagatgtgggttttcgggctatcgcgtttctgcagcagcctcggtctttgacttataaggagagcggtgtcgatatcgctgcaggcaacatgttggtgaagaaaatccagccactcgccaaggcgacatcacgcagcggctgtaaggtggatctgggcggatttgccggactgtttgacctgaaggcagccggatttaaggatccactgctcgcttcaggcaccgacggagtgggtacaaagttgaagattgcccagctgtgtaataaacacgatacaattggccaggacctggtagctatgtgcgtaaacgatattctcgctcagggcgctgaacccctgttcttcctcgactatttctcttgcgggaaacttgatctgtccgttactgaggccgtggttgccggtattgccaaggcctgtggtaaagctggctgtgctctcttggggggagagacagcggagatgcccgacatgtatccgccaggagagtacgacctggccggattcgccgttggagccatggagcgggatcagaaattgccccaccttgagcggatcacggaaggggacgtcgtggtgggaatcgcttcaagtgggctccacagcaacggtttcagcctcgtacggaagatagtggcgaagtcgagtcttcaatactcatccccggcacctgacggatgtggagatcagaccctgggcgatctgttgctcacgcccacccgtatctactcacactcgttgctcccagtgcttagatctggccatgtgaaagcctttgctcatatcacaggaggcggacttcttgagaacatacctagagtcttacccgagaagctgggtgtggacctggacgctcaaacctggaggatccctcgcgtgttctcttggctgcagcaagagggccacttgagcgaagaggagatggcaagaaccttcaactgcggcgtgggggctgtactggttgtctccaaagaacagactgaacaaattctgcgcgacattcaacaacacaaggaagaggcctgggtcattgggtcagtcgtagctagggccgaaggcagccccagagtaaaggtgaagaacttaatcgaatccatgcaaatcaatgggtctgtacttaaaaacgggagtcttaccaatcacttctcttttgagaaaaaaaaggctcgagttgccgtcttgatatcaggaaccggttccaacctgcaggctctgattgacagtacgagggagcctaactctagcgcccaaattgatattgtgattagcaacaaagccgcagtggccggactggacaaggccgagcgggcaggaatccctacacgggtcattaaccacaagttgtacaaaaaccgcgtagagttcgacagcgcaattgacctcgtgttagaggaattctccatcgacattgtctgtttagccggttttatgcgcatattgagtggccctttcgtgcagaagtggaatggcaaaatgctgaacatacatcctagtcttctgcctagcttcaagggttccaacgcgcatgagcaggctctggagacgggcgtgactgtgacagggtgcactgtgcacttcgtcgcagaggatgtggacgctggacagataatcctgcaggaggctgtcccagtgaaaaggggagatacagtcgcgacattgtccgagcgcgtgaaactggccgaacacaagatcttccctgcagcactgcagctggtggcctctggaactgtccagctcggcgaaaacggcaaaatttgctgggtgaaggaggagtag

SEQ ID NO: 235016 - DNA, 3033 bp, Artificial Sequence
  Description of Artificial Sequence: Synthetic coding sequence
atggcggcacgagtcctaatcatcgggtccggaggaagagaacacacactggcatggaaactggcacagtctcatcatgtcaaacaagttctggttgcaccagggaatgctggaacagcctgttcagaaaaaattagcaatacggccatcagcatttctgatcataccgctttggcccagttttgcaaggagaaaaagattgaattcgtggtggtcggcccagaggccccacttgccgctggcattgttgggaatctgaggtcggccggtgttcagtgcttcggaccaacagccgaggcagctcagctggagtcaagtaagcgctttgccaaagagttcatggacagacacgggatccctaccgcacaatggaaagccttcacaaagcccgaagaggcctgctccttcatcctgtccgcagattttcccgctctggtagtcaaagccagtggtctggctgccggaaagggagtaatagtagcaaagtccaaagaagaggcatgcaaggccgtgcaggagatcatgcaggaaaaagcatttggcgcagctggcgaaacaatcgtcatcgaagagctactagatggggaggaagtgagctgtctgtgttttacagatggaaagacggttgctcccatgccaccagcccaggaccataaacggctcctcgagggagacggcggacccaacaccggagggatgggagcttactgtccggcacctcaggtgtccaatgatcttctgctgaaaattaaggacacggtgctgcagcgaacagtagatgggatgcagcaggagggaactccctatactgggatcctgtacgctggaatcatgttgaccaagaatggtcccaaagtgcttgagtttaactgccggtttggggatcctgagtgccaagttattctacccctcctgaagtctgacctttacgaagtcatacagagcaccctcgatggacttctatgcacttctctgcccgtctggctggagaatcacacagccttgactgtggttatggcttcaaaggggtatcctggcgactatacaaaaggcgtggaaatcactggatttcccgaagctcaggcactgggactcgaggtctttcatgctgggaccgcccttaagaacggcaaggttgtcacacacggaggcagagtacttgccgtaacggccataagagaaaacttgatatcagctctcgaggaagccaaaaagggtctggccgctattaagtttgagggagccatctatcgcaaagacgttggtttccgagctatcgcttttcttcagcaacctcgtagcctgacgtataaagagagtggggtcgacatcgccgcaggaaacatgttggtcaagaagatacagccccttgcgaaggcaacctctagaagtggttgcaaagtggacctgggtggctttgccggattgttcgaccttaaggcagccggatttaaggatccccttctggcttccggcacggacggtgtgggcactaaacttaaaatcgcacagctgtgtaataaacatgacaccattggccaggatctggtggctatgtgtgtaaatgacatcctcgcccagggggctgagccactcttcttcctcgattatttctcctgcggaaaactggacctctccgtgacagaggccgtggtggccggaatcgctaaagcatgcgggaaggcaggctgtgccctcttgggcggtgagacagccgagatgcctgatatgtaccctcccggagaatacgatttagcgggattcgccgtcggcgcaatggaaagggaccagaagctgccccacctggagaggatcacggaaggagacgttgtcgttggtattgcttcatccggactgcactccaacggctttagtctcgtgaggaaaatcgtagctaaaagctcactccaatactcaagtcccgctccagatgggtgcggggaccaaactcttggcgatctcctcttaacgcctacacggatttatagccacagcctgctgccagttctgaggagcgggcatgtcaaggcttttgctcacattaccgggggtggactcttagagaatataccacgtgtgctccccgaaaaactcggggtggatttagacgcccagacttggagaatccccagagtcttttcctggctacagcaggaagggcatctctccgaagaggaaatggctagaacttttaattgcggggtgggagcagtcctggttgtatctaaagagcaaactgaacaaattctcagggacatacagcaacataaggaagaggcatgggtgatcgggtctgtggttgcgagagccgagggatcaccacgggtgaaggtgaagaacttgatcgaatctatgcaaatcaacggcagtgttttaaaaaatgggagcctgaccaaccacttttccttcgagaaaaaaaaagctcgcgtggccgtgcttatctccgggactggaagcaacttgcaagccctgatcgactccacgcgtgagccgaattctagtgcacagattgatattgttatttctaacaaagcagctgtcgcgggactggacaaggcagaacgggctggcatccccacccgggtgatcaatcataagctgtataaaaatcgcgtggaatttgatagcgccattgacctggtcctggaggagttctctatcgacattgtgtgtttggcaggatttatgcggattctatctgggccttttgtgcagaagtggaacggaaagatgcttaacatccaccctagtttgctgccatcctttaagggctcaaatgcccatgaacaggcccttgagacaggagtgaccgtaacgggttgtacagtgcatttcgtggccgaagacgttgatgctgggcagattatcctccaggaggccgtgcccgtaaagcgaggggacacagtggcaactctgtctgagagagttaaactggctgagcataagatcttccctgccgctcttcagcttgtggcttcgggaaccgtgcagttgggcgagaacgggaaaatctgctgggttaaggaagaatag

SEQ ID NO: 235017 - DNA, 3033 bp, Artificial Sequence
  Description of Artificial Sequence: Synthetic coding sequence
atggcagctagagtgctgatcattggatcaggcggacgggagcacaccctggcgtggaagttagcccagagtcaccatgtcaagcaggtgctcgtggctcccggaaacgcagggaccgcctgttcggaaaagatcagcaatacagcgattagcatcagcgatcacacagcccttgctcagttctgcaaggagaagaagattgagtttgttgtagtgggccctgaggcccctctggcggctggtattgtaggcaacctgcggtccgccggtgtacagtgcttcggaccaacggccgaagccgctcagctggaatcctccaagcgctttgcaaaagaattcatggacaggcacgggatccctacagctcagtggaaagccttcaccaagccagaagaagcgtgcagctttattctttctgctgattttcccgcactcgtagtgaaggcttctggccttgctgctggcaagggtgtgatcgtggccaagtccaaggaggaggcatgtaaagcggtacaggagataatgcaggaaaaggccttcggtgcagccggtgagacaattgtgattgaggagcttctggacggagaagaagtgtcctgtctttgctttacagacggcaagactgtggccccaatgccaccagcacaggaccacaagcgcctgctggagggcgacggtggacccaacacgggtggcatgggtgcttattgccccgctccccaggtctccaacgatctgttgcttaaaatcaaggacactgtactgcagcggactgttgacggaatgcaacaggagggaacaccctacaccggaattttgtacgcagggatcatgctgactaaaaacggtcccaaggtgctcgagttcaactgtagatttggcgaccccgagtgccaggtgattctgccactcctcaagtctgacctgtacgaggtcattcagtctactctggacggattgctttgtactagtctgccagtctggttagaaaaccataccgcgcttactgtggtgatggcctcgaagggctacccgggagactatactaagggcgtggagattacaggattccctgaggcccaggccctgggtctggaggtcttccacgccggaactgctctcaagaacggaaaggtagtaacccatggcggaagagtgctggctgtaaccgctataagagaaaatctgatttctgccttggaggaagccaagaagggcttggctgcgatcaagttcgagggcgcaatttacaggaaggacgttggatttcgtgccattgcattcctgcagcagcctcggagcctaacgtacaaagagagcggcgtagatattgccgcaggcaacatgctggtaaagaagatccaacccctagcaaaagcaacaagccggagtggctgcaaggttgaccttggagggtttgctggcctgtttgacttgaaagccgcaggctttaaagacccactgcttgcgtccggtactgatggagtgggcacgaaactaaaaatcgctcagttgtgcaataaacatgacaccattggccaagatctcgtggcaatgtgcgtcaatgacattctggcgcaaggtgctgaacccttgtttttcctggattatttttcctgcgggaaactcgatctctcagtgactgaagccgtcgtagcaggaattgcaaaggcatgcgggaaggcagggtgtgccctacttggtggtgaaacggccgagatgcctgatatgtatccacccggagagtacgacctggccggtttcgcagtgggcgctatggagagggatcagaaactgcctcacctggaacggatcaccgaaggagacgtggtagtcgggatcgccagctcaggtttgcactcaaatggctttagtctggtgcgcaagatagtcgccaagtcatcactgcaatactctagccccgcaccagatgggtgcggggatcagactctcggggatttgttgctgactcccaccaggatatacagtcactccctgttgccggtccttcgcagcggccacgtaaaagctttcgcccacataacaggaggagggttgttagagaacattccacgcgttctgcctgaaaaactgggcgtcgatcttgatgctcagacctggcggatcccacgcgtatttagttggctccagcaagaaggacacctgtccgaagaagaaatggcccgtactttcaactgcggcgtcggagccgttctggtggtgagcaaggaacagacagagcagatccttagagacatacagcaacataaagaagaggcgtgggtcatcgggtcagtagtcgccagggccgagggcagtccacgagtgaaggtcaagaacctaattgagagcatgcaaatcaacggctcagtgcttaaaaacggatccctcaccaatcactttagctttgagaaaaaaaaggcacgagtggccgttttaatttccggaaccggctctaatctccaggctttgattgatagtacacgcgaaccaaactcctctgcccaaatagatatcgtcatttccaataaagccgctgtggcgggactggataaagctgagcgggctgggatcccaacaagagttattaaccacaagctctacaagaatagggtagagtttgattccgctatcgacctcgtacttgaagagttctctattgacattgtttgtctggcaggtttcatgagaatactttctgggccatttgtgcagaaatggaacgggaaaatgttgaacatccatccctcgcttctcccctcatttaaaggttctaacgcacatgagcaggctcttgagaccggggtaacagtgaccggttgcacagttcattttgttgccgaggatgtagacgccggacagatcattctgcaggaggctgttcccgtaaagcggggagatacggtggctaccctgagcgagcgcgtaaaattggccgagcataaaatatttcctgcagcgttacagttggtcgcttcgggtacagtccaactgggagaaaatggaaaaatttgctgggttaaagaagaatag

SEQ ID NO: 235018 - DNA, 699 bp, Artificial Sequence
  Description of Artificial Sequence: Synthetic coding sequence
atggctgctcgtgtcctcattatcggctccggcggtagggaacacactctcgcatggaagttagcccagtcccatcacgtcaaacaagttctggttgctccaggcaatgctggaactgcttgcagcgagaagatttccaatacagccatctccataagtgatcacacagctctggcccaattttgtaaggagaagaagatcgagttcgtggtagttggaccagaagcacctctcgccgcaggtattgttggaaatctgcgcagtgccggagttcaatgctttgggcctactgcagaagcagcccaactggagtcctccaagagattcgcaaaggagtttatggatagacacggcattcctaccgcgcagtggaaagcttttaccaaacctgaggaagcttgctctttcatcctcagcgccgatttccccgcactggtagtgaaggcctcggggctggcggctggaaagggtgtcatagtggctaaatcaaaagaggaggcatgtaaagctgtccaggagattatgcaggagaaagcgttcggagctgccggagagacaattgtaatcgaagaactgctcgacggtgaagaagtgtcttgcttatgctttacagatggcaaaacggtggctccaatgccgccagcccaggaccacaaacgactcctagaaggcgatggtggaccaaacacagggggatag

SEQ ID NO: 235019 - DNA, 726 bp, Artificial Sequence
  Description of Artificial Sequence: Synthetic coding sequence
atggcggcacgtgtccttatcatagggtctggagggagggaacacaccttggcatggaagcttgcccagagccatcacgtgaagcaggtgctggtcgctccaggaaacgccggtaccgcatgtagtgagaagatctccaataccgctatttctatcagcgatcacaccgcactcgctcagttttgtaaagagaagaagatcgaattcgttgtggttggtccagaggcaccattggccgcaggcattgtgggcaatttgcggtcagcaggagtccagtgctttgggcctacagccgaagccgcacagctggagtcatcaaagcggttcgcgaaagagtttatggatcgccacgggatccctaccgcccagtggaaagcattcacaaagcccgaggaagcctgtagctttatcctcagcgccgatttccctgcgctagtcgtgaaggcctcaggcctggccgcaggaaaaggcgtgatcgtagcgaagagtaaggaggaagcatgcaaagctgttcaagaaattatgcaggagaaggcattcggcgctgcaggagagactattgtaatagaggagctgctagacggggaggaggtctcttgcctgtgtttcacagatgggaagacagtggcacctatgcccccagcacaagaccataagaggctgttagagggagatggtgggccaaacacaggaggcatgggcgcttactgcccagccccacagtag

SEQ ID NO: 235020 - DNA, 417 bp, Artificial Sequence
  Description of Artificial Sequence: Synthetic coding sequence
atggcagccagggtattgataattggttctggtgggagagagcatactttggcgtggaagctggctcaaagtcaccatgtcaaacaggtcctggtagccccaggtaatgctggcaccgcttgttctgaaaagatatctaataccgctatatcaatcagtgatcacactgccctcgcgcagttctgtaaagagaagaaaatcgaatttgtggtcgttggcccagaagcaccactcgcggctggcatagtcgggaatctccgcagtgctggggtccaatgcttcggaccaaccgctgaagcggcacaattggaatcaagcaaacgattcgcgaaggagttcatggaccgtcatgggatccctaccgcccagtggaaagcatttacaaagccagaggaagcgtgttccttcatcttatag

SEQ ID NO: 235021 - DNA, 411 bp, Artificial Sequence
  Description of Artificial Sequence: Synthetic coding sequence
atggcagcccgagttctgattataggcagcggcggaagggagcacacacttgcttggaagctcgcgcagtcccatcacgtaaaacaggttctcgtggccccaggaaacgccggtacggcctgtagcgaaaagataagcaacactgctatctctatcagtgaccacactgcactggcccagttctgtaaggaaaagaagatcgaatttgtggtggtcggaccagaggcgcctctagctgctggaatcgtcgggaatctgcgctcagctggtgttcagtgctttgggcctactgctgaagctgcacaactagaatcctccaaaaggtttgctaaggaattcatggatagacacggtatccccactgcccagtggaaagcatttaccaaacctgaggaggcatgttctttttag

SEQ ID NO: 235022 - DNA, 1689 bp, Artificial Sequence
  Description of Artificial Sequence: Synthetic coding sequence
atgctggtgaagaaaattcagcccctggccaaggcaacatcccgttcaggctgtaaagtggacttaggtgggtttgccggactctttgacctaaaggcagctggtttcaaagatcctctgctcgcttcaggcaccgacggggtgggaaccaagctgaaaatagcccaattatgcaataagcacgataccatcgggcaagacctcgttgcgatgtgcgtgaatgacatcttggcacaaggcgctgaacctctgttcttcctggattacttcagttgcggtaagctcgatcttagtgtcacagaggccgtggttgcaggaattgccaaggcctgcggcaaggccggatgcgcactgctaggcggagaaacagcggagatgcctgacatgtatccacccggagagtacgacctagccggttttgccgtgggggctatggagcgggatcagaagctgccccacctggagagaattaccgagggggacgtggtggtaggcattgcgagctctggcctgcacagcaacgggtttagtctagtcagaaaaatcgtagcaaagtcttctcttcagtattcctccccagcgcctgacgggtgtggcgaccaaacactgggcgacctgcttttgacacccacacgaatttactcccatagcctgttgccggttctcaggagcggtcacgtgaaagccttcgcgcacattaccggcggaggactgctggagaacatcccacgggtcctgcctgagaagctaggcgttgatctggatgcccagacgtggagaatcccaagagttttcagctggctgcagcaggagggacatcttagtgaggaagagatggctaggaccttcaattgcggggtaggggctgtcctggtcgtgagtaaagagcagaccgaacagattttgcgagacattcagcagcacaaagaggaagcctgggttataggtagcgtagtcgctagagctgagggttctccacgagtgaaagtcaagaatctcatagaatcaatgcagatcaacggcagtgtcctgaaaaatggctcgctgaccaatcactttagctttgagaagaaaaaggcacgggtggctgtgcttattagcggtactggttcaaatcttcaggccttaatcgattccaccagagagcctaacagctccgcacaaatagacatcgtaatatcaaataaggccgctgttgccggactggacaaggcggagcgggctgggatccctacgcgcgtcatcaaccataaattgtacaagaacagagtggagtttgatagcgcaatcgatctggtgctcgaagagttctccatagatatagtgtgcttggccggttttatgcgtattctgtccggaccatttgttcagaagtggaacggaaaaatgctcaacatccacccctctctgcttccctcctttaaagggagcaacgcccatgaacaagcattggaaaccggggtgaccgttacagggtgtactgtgcacttcgtcgctgaagacgttgatgccggtcagataattctccaagaggctgtgcccgtcaaacgcggtgacaccgtggctactctgagcgagagagtgaagctcgccgaacacaagatctttccagcggctttgcagctggtcgcgagtggcaccgtccagctgggagaaaacggcaaaatatgctgggttaaagaagagtag

SEQ ID NO: 235023 - DNA, 2265 bp, Artificial Sequence
  Description of Artificial Sequence: Synthetic coding sequence
atgtccaggcctctttctgaccaggagaagcgaaaacagattagcgttaggggcttggccggagtggaaaatgtcactgagctgaaaaaaaattttaataggcatcttcactttactctcgtgaaggaccgtaatgtggccactcctagagactattacttcgcgttggcccatacagtgagggaccacctggtgggcagatggattcgaacacaacagcactactacgaaaaggatccgaaaaagatttccggcggatggcagatggaggaggcagacgattggctacgctacgggaacccctgggagaaggccaggcctgagttcaccctgcctgtacatttttacggacacgtggagcataccagccagggcgctaagtgggtcgacacccaagttgtcctggctatgccctacgatactccagtgcctggatacaggaacaatgttgtgaacaccatgcggctttggtctgcgaaggcccctaacgatttcaatctgaaagactttaatgtcggcggatatatacaggccgtgttggatcgcaacctggcagagaatatctcaagggttctctatccaaatgataacttcttcgaaggcaaagagttacgacttaagcaggagtattttgtggtggccgcaacactacaggacattatccggagatttaagtcttctaagtttggatgccgggaccccgtgcggacgaactttgacgctttccccgataaagtcgcaattcaactcaatgatactcacccctccctggcgattccggaactgatgcgcattctggtggacttagagaggatggactgggataaagcatgggacgtgacagtgcgaacatgtgcttatactaaccatacagtgttacctgaggcccttgagagatggccagttcacctcctagaaaccctgctgcctagacacctccagataatctacgagattaaccaacggttcctcaaccgggtggccgctgcctttcccggagatgtggaccgcctgcgcagaatgtcacttgtcgaggaaggcgcagtgaagcgcattaatatggcgcatttgtgcattgcaggctcccacgccgtcaacggtgtggccagaattcacagcgaaatcctcaaaaagacaattttcaaagacttctatgagttggagccccataagttccagaacaaaacgaatggaattacacctaggcggtggcttgtgctctgcaatcccggactggccgaggtgatcgctgaaaggatcggggaagattttattagcgatctcgaccagctgaggaaactcctctcatttgtggatgatgaggcattcatccgtgatgtggctaaagtgaaacaggaaaataaactaaaattcgctgcttacctggaacgcgagtacaaagtgcacatcaacccaaattcgctgttcgacatccaggtgaagcgcattcacgaatacaaacgccaactgttaaattgtcttcacgtgataaccctatacaaccgaattaaacgagagcccaataaattcttcgtgccaaggactgtcatgataggaggcaaggccgctcccggataccacatggctaaaatgattatacgtctggtcaccgctatcggcgacgtagttaaccatgacccggctgtgggagaccggctgcgggttatcttcctggagaattaccgtgtgagcctcgccgaaaaggtgatccccgcagcggacttatctgagcagatttctaccgcaggtacagaggctagcggaactgggaatatgaagttcatgctcaatggagctctcacaatcggaactatggacggagcaaatgttgaaatggcagaagaagcgggtgaagaaaacttttttatcttcggcatgagggtagaagatgttgataaattggaccagcggggatacaatgcccaggagtactacgaccgcatccccgagctgcgacaggttatcgagcagcttagttccgggtttttctccccaaagcagcctgacttgttcaaagacattgtcaacatgctgatgcatcacgatcgctttaaggtgtttgccgactatgaggactacatcaaatgtcaggaaaaggtgtcagcactgtataaaaacccacgggagtggacccgcatggtgatccggaatatcgccacttcgggaaagttctcctctgatagaaccatcgcacagtacgcccgagaaatctggggagtggagccttcacgccagaggctgccggcacctgacgaggccatttag

SEQ ID NO: 235024 - DNA, 3633 bp, Artificial Sequence
  Description of Artificial Sequence: Synthetic coding sequence
atgcgtagtcgatccaactccggggttaggctggacggatatgcccgtctggttcagcagaccattctctgccaccagaaccctgtcaccggtttgttgcccgcttcatatgaccaaaaggatgcctgggtgagagacaacgtgtatagcattctggcagtgtggggcctgggcctggcatacaggaagaacgccgaccgggatgaggacaaagccaaagcctacgagctcgagcagagtgtagtgaaacttatgcggggtcttctgcattgtatgattcgacaggtcgacaaggttgagtccttcaaatactcccaatccaccaaggacagcttacatgccaagtataacacaaagacgtgtgcaacagtggtcggcgacgaccaatggggacacctgcagctggacgccaccagcgtctatctgcttttcctcgcccagatgactgcttcgggccttcatatcatccattcgcttgacgaagtaaactttatccaaaatctcgtattctatatcgaagctgcttacaaaacagccgattttgggatatgggaaagaggagacaaaactaaccagggcatatccgagctcaatgcatcaagcgtgggcatggctaaagctgctctggaggcactagacgagctggatcttttcggagtgaagggcggaccacagtccgtgatccatgtgttggccgacgaagttcaacactgccagagtattctgaactctttactccctcgagcctctacctcaaaggaggttgacgcatccctgttaagtgtggtgtctttccctgcattcgccgtggaagacagccagttggtcgaactgacaaaacaggagatcatcaccaagctgcaaggacgttacgggtgctgtcggtttctgcgggacggatacaagactcctaaagaggacccgaacagactatactatgagcctgctgagctgaaactgttcgaaaacattgaatgtgagtggcccctattctggacgtactttattttagatggagtatttagtggaaatgctgaacaggttcaggagtataaggaggcattggaggctgtgttgattaaggggaagaatggcgtgcccttacttcccgagctgtattccgtgcctccagacagagtggatgaggaataccagaatcctcataccgtcgaccgagtcccaatgggtaaactgcctcacatgtggggccagtccctgtatatactgggatcactgatggcggagggcttcttggctcccggagaaatcgaccctttaaatagacggttcagcactgtgccaaagcccgatgtggtcgtgcaggtatccatcctcgccgagactgaggagattaagaccatcttgaaggacaagggcatctacgtagagaccatcgccgaagtataccccatccgagtccagcccgctaggatcctcagtcacatctattcatcactgggctgtaataaccgtatgaaactgtccgggagaccttatagacacatgggcgtcctaggaaccagcaagttatatgatattaggaaaacaatatttaccttcaccccacaattcatcgatcagcagcagttctatcttgctcttgacaataaaatgattgtagagatgctgcgcaccgacctgagctacctgtgtagtcgctggcggatgacgggacagccgacaatcaccttcccaatcagccatagtatgctcgatgaggacgggacgagcctgaattcttctatcctggccgctctgagaaaaatgcaggatggctattttgggggtgcccgagtgcaaaccggcaagctgagcgagtttttgactacctcttgctgtacacacctgtcttttatggatcccggtcctgaggggaagctctattcagaagactatgacgataactatgactacctggagtcagggaattggatgaatgactatgattcaacctcacatgcccgatgcggggacgaagttgcccgttatctggatcatctattagcccatactgcgcctcatcccaaactcgcaccaacatcgcaaaagggcggactggacaggttccaagcagcagtccagaccacatgcgatctgatgagcctggtgaccaaagccaaggaactacacgtgcagaatgtacatatgtatttacccaccaaactgttccaggcctcccgtccaagcttcaatctgcttgatagcccccacccccgtcaggagaatcaggtgccctctgttcgcgtagaaattcacctcccaagagaccagagtggagaggtggatttcaaagcgctcgtcctacagctgaaagagacaagtagcctgcaagagcaggccgacatcctgtacatgctgtacaccatgaagggtcctgattggaatacggagctatacaacgaaaggtcggctactgtacgggagctactgacagaactttacgggaaagtgggcgagattcggcactgggggcttatccggtatatatccggcattctgaggaagaaggtcgaggcccttgatgaggcctgtactgatttactaagtcaccagaaacacctgacagtgggactgccccctgagcccagagagaagacaattagtgctccgttgccctatgaagcactgacgcaactcatcgatgaagcatcggagggggacatgtcaatatcaattcttacccaggagatcatggtttacctggccatgtatatgaggacacagccaggtctctttgccgagatgtttaggctcagaatcgggttgatcatccaggtaatggctactgagctggcccacagcttacgttgctccgccgaagaggccaccgaggggctgatgaatctctccccaagcgcgatgaagaacctcctgcatcatatcttgtcaggaaaggagttcggagttgagcggtcagttagacctaccgatagcaacgtgtcgccagcaatcagcatccacgagattggcgctgtcggtgcaaccaaaaccgaacgaactggaattatgcaattgaaatcggagattaagcagtctcctgggacaagcatgaccccatcctccggctccttcccctctgcatatgatcaacagagcagcaaggatagccggcagggccagtggcagaggagacgcagactggatggagctctgaatagagttccggtcgggttttatcaaaaggtctggaaagttctccagaaatgtcacggactttctgttgaaggattcgtcttgccaagttctaccacacgcgagatgactcctggggaaatcaaattttccgttcatgttgaaagcgtcttgaatagggttccgcagcctgagtatcggcaactgttggtagaggccatcctagtcctaactatgttggccgatattgaaattcacagtatcggaagcattattgccgtggagaagatcgtacacattgccaatgatttattcctccaagagcagaagaccctgggtgccgacgatactatgctggccaaagaccctgcctctggaatttgcacgcttctgtatgattcggccccatccggacgcttcggcacaatgacttaccttagtaaagccgctgccacctacgtgcaggagttcctcccccactctatttgtgccatgcagtag

SEQ ID NO: 235025 - DNA, 3723 bp, Artificial Sequence
  Description of Artificial Sequence: Synthetic coding sequence
atgcggtcacggagtaactcaggggtgcggctggatggatatgcacggctggtgcaacaaacgatactgtgccatcaaaatccagtgactggcctgctcccagccagttatgatcagaaggatgcctgggtacgcgataatgtgtatagcattctggctgtctggggtctgggcctcgcttaccggaagaacgctgatagggatgaggataaggccaaggcttacgagttggaacaatccgtggtgaagctcatgaggggtctgctccactgcatgattagacaggtcgacaaggtggaaagctttaagtactcacagagtaccaaggatagtttgcacgccaaatataatacaaagacctgcgccactgttgttggcgacgatcagtggggccacctacagctcgatgcaacgtccgtgtatctgctgtttctggcccagatgacggcttctggcctacacataatccatagtctagacgaggtgaatttcatacagaatctggtgttctacatagaagcggcatacaagacggccgattttgggatctgggaaaggggcgacaagaccaaccaaggaatcagcgagcttaatgctagctctgtgggcatggctaaggccgcactggaggctctggacgaactcgatctctttggggtgaaggggggtccacagtctgttattcatgttttagcagacgaagttcagcactgtcagagcattctaaattccctcctgccacgtgccagtacttccaaagaggtagacgcttccttgctgagcgttgtatccttccccgcatttgctgtggaggattctcaactggtggaactcaccaagcaggagatcattacaaagcttcagggtcgctatgggtgctgccggtttctgagggacggttataagacgccaaaggaagatcctaaccggctttattatgaaccagccgaacttaagctgttcgagaatattgagtgcgaatggccgctattttggacgtactttatcctcgatggcgtgttcagcggaaatgctgagcaggttcaggagtacaaggaggcgctggaagctgtactgatcaaaggaaagaatggggtacccctgcttccggaactctattcagtgcctccagatcgcgtggatgaggaatatcagaatccccacaccgtggaccgggtgcccatggggaagttaccccatatgtggggacagagtttgtacatattgggctctcttatggctgaaggatttttggcgcctggcgagatcgaccctctgaaccggagattcagcaccgtgcccaagcctgatgttgtggtgcaggtgagtattctcgcggagaccgaggaaataaaaactatcctcaaggataagggcatctatgtggagactattgcagaggtgtaccccatccgcgtccagccggctcggatcctctcccacatttactcatcactgggatgcaacaatcgaatgaaactgtccggaagaccctacagacatatgggcgtgctgggcacttccaaattatacgatatacgcaaaaccattttcactttcaccccacagttcatcgaccaacagcaattctatctggccctggataacaagatgatagtcgaaatgctcagaactgacctttcctacctgtgctccagatggcgaatgactgggcagccaacaatcacattcccaattagccacagcatgctggacgaagacggaacatccctgaatagctctatccttgctgctttgcgcaaaatgcaggatggctattttggaggagctagggtacagactggcaaattgtccgagttcctcactacatcctgttgcactcatcttagcttcatggatcctggaccagagggaaaactttacagtgaggactatgatgacaattatgattaccttgaaagcgggaactggatgaatgactatgatagcacctcacatgcacgatgtggagatgaagtagccaggtacctcgaccacctactggcccacaccgccccacacccgaagctggcccctacttcccagaagggtgggctcgacagattccaagccgcagtccagactacatgtgatctcatgagcctggttacaaaggccaaagaactacacgtgcagaacgtgcatatgtatctgcccactaagctcttccaagcgagtagaccttcttttaacttgcttgacagtccacaccccagacaggagaatcaagtgcctagtgttcgtgtagagatccatctccctagagatcagagtggcgaggtcgactttaaggccctggtcttacagttgaaggaaaccagttcccttcaggagcaggccgacattctctatatgctttataccatgaaaggacccgactggaacactgagctgtacaacgaaagatccgccaccgtgcgggaactgctcacggagctctacgggaaggttggggagatccggcactggggtcttattcgttacatatccggaatcctgagaaaaaaggtcgaggctctcgacgaagcctgtacagaccttctcagccatcagaagcaccttaccgtgggactccctcctgagccccgagagaagaccatctcggccccactgccatacgaggctctcacccagcttattgacgaggcatctgagggcgacatgtcaatcagcatcttgacccaggagatcatggtttatctggctatgtacatgcgaacccagcccggattgtttgcagagatgtttcggctccggattgggttaatcatccaggtgatggccaccgagctcgcccacagcctgcggtgtagtgctgaggaagctacagaaggattgatgaatttgtccccctcagcaatgaagaatttgctccaccatattctgtccggtaaagagttcggtgttgagagatcagtcaggcctacggattccaatgtgtctcccgcaatcagtatccacgaaattggggcagttggcgctaccaagacagagcgcacagggattatgcagcttaagtcagaaatcaaacaagttgagttccggagactctcaatttcggccgaaagccagagcaatggcggtcatcccttaggaatcgacctgatgagccctagcttcatgagccctggaacatccatgactccttcctccggatcatttcccagcgcatatgatcagcagtcaagcaaggactcccgccaaggccaatggcagcgacgcaggaggttagacggggcactgaaccgcgtaccggtaggattctaccagaaggtctggaaagtacttcaaaagtgtcacggtctgtccgtggagggctttgtgcttcctagtagcaccacccgggaaatgacgcccggtgaaataaagttttccgttcatgtggagagcgtgttgaacagagtgccacagcccgagtacaggcagctgttggtagaggcaatactggtcctaaccatgctggccgacatcgagattcacagcattggcagcatcatcgctgtggaaaagattgtccacatcgctaacgatctgtttctccaagagcagaagacattgggcgctgatgatacaatgctggctaaagacccagcatcaggtatctgtacacttctctatgactcagcgccatctggcagattcgggaccatgacatacttatctaaagccgctgctacgtatgtgcaggagttcctaccacacagcatctgtgctatgcagtag

SEQ ID NO: 235026 - DNA, 3672 bp, Artificial Sequence
  Description of Artificial Sequence: Synthetic coding sequence
atgcgctcgcgtagcaacagtggggtgcgcctggacgggtacgcccgtttagtgcagcaaacgattctctgccaccagaaccccgtcaccggcctgctccccgcttcctacgaccaaaaggacgcttgggtcagggataatgtctactctatactggctgtgtgggggcttgggcttgcctacagaaaaaacgccgacagggatgaagacaaagctaaggcctatgaattggaacagtccgttgtcaaattgatgagaggactcctccattgcatgatccgtcaggtcgacaaggtcgaaagcttcaaatactctcagagtacaaaagactctctccatgccaaatacaacactaaaacctgtgcaacagtggtcggtgacgatcaatggggccatctgcaactagacgcgacgagcgtttatcttctgtttctcgcgcagatgacagcctctggcctccacatcattcatagtttagacgaggtcaacttcatccaaaacctggtcttttatattgaggcagcatataaaaccgctgatttcggcatctgggaacgaggggacaagactaatcaggggatatcagagctgaacgccagcagtgttgggatggccaaagcagccctggaagctctggatgaactggacctttttggagtgaaagggggaccacagtcggtgatccatgtgctagcggacgaagtccaacactgccaatcaattctcaactctttgctgccaagagcaagcacaagtaaggaggtcgacgcttccctgctgagcgtggtttcctttcccgcattcgcagtagaggatagccagctggtcgagctcaccaaacaagagatcataacaaagcttcagggtcgctacgggtgttgtcgttttctgagagatggttataagaccccaaaggaggaccccaatcgtctgtactatgagcccgctgaactcaagttgtttgaaaatattgagtgtgagtggcccctgttttggacatatttcatcctcgacggggtgttcagtggcaatgccgagcaggtgcaggaatacaaggaagctctcgaggctgtcctcatcaaagggaagaacggggtgccactcctgccggaactgtactccgtcccccctgatagggtggacgaagaataccagaatccccacactgtcgaccgggttcctatgggcaaactgccccacatgtggggccaatccttatacattctgggctcacttatggctgagggcttcctggcaccgggagagatcgacccgctcaacagaagattcagcaccgtgcctaaacccgatgtagtagtgcaggtctccatcctggcagaaaccgaggagattaagactattctgaaggacaagggaatttatgttgagaccatcgcagaggtgtatcccatcagagtgcaacccgctaggatcctttcccacatctattctagtttgggctgtaataacagaatgaagctcagcggaaggccttacaggcacatgggggtgctcggtaccagtaaactctatgacattaggaaaacgatctttacttttactccgcagttcatcgaccagcaacaattctatttggctctggataataagatgatcgtggagatgcttcgcacagacctgagttacctatgttcacgctggaggatgaccggccagcctacgatcacattccctataagccattcgatgcttgacgaagacggaacttcacttaacagtagtattctggctgccctgcgcaagatgcaagacggctacttcgggggagcacgagtacagacaggcaagctgtctgaattcttgacgacaagctgttgcacccacctaagcttcatggatccaggacccgagggtaagctgtactccgaggactatgacgacaactacgattaccttgagtccggcaattggatgaacgattacgactcgacctcccacgccaggtgcggcgatgaggtggcgagatatctggatcatcttctggctcacactgccccacaccccaagttggctcccaccagtcagaaagggggactggatcggtttcaggcagctgtgcagactacttgcgatctgatgagtctggtcacgaaggcgaaagaactccatgtccagaatgtccacatgtacctgccaacaaagctttttcaggcatccaggcccagcttcaatttactcgattccccgcatcctcggcaggaaaaccaagtgccaagcgttcgggtagagatccatctgcctagagatcaatcaggcgaggtcgattttaaggcactagtcctccagctaaaggagacctcgtctctgcaagaacaggccgacattctttacatgctgtatactatgaaaggacccgattggaacaccgagctgtataacgagcggtccgccaccgtccgtgaacttctcacagaactttacggaaaggtaggcgaaattcggcattggggcctgataagatatatatctggcattcttaggaaaaaggtggaagccctggacgaggcttgcacggatcttctatcccaccagaagcacctcacagtgggtttgcctccagaaccgagggagaagaccatatccgctccacttccttacgaggccctgacacagttgattgacgaagcgtcagagggtgatatgtctatttcaatacttacccaggagatcatggtttatctggctatgtacatgcggactcagcctggcctcttcgccgaaatgttccgtctgcggataggactgattattcaagtaatggctaccgagctggcccatagcctgcggtgtagcgctgaggaagctacggagggtcttatgaatctcagtccttcagctatgaaaaacctcctgcaccatattctgtctggcaaagagttcggggtcgaacgctcagtgaggcccactgacagcaatgttagtccagccatctccatacatgagattggcgctgtgggcgctacaaaaacagaaaggacaggaatcatgcagctgaaaagcgaaatcaagcaggtggaatttcgacgactgagcatctccgccgaatcgcagtctccgggaacctcaatgaccccaagctccggaagtttcccatctgcctacgatcagcagtcatccaaggactcacgccaagggcagtggcagcggaggagaaggcttgatggggctctaaacagagtgccagtcggattttaccaaaaagtgtggaaggtacttcagaaatgccatgggctgtcggtggaaggctttgtgctaccttcaagtacaactcgggaaatgacacccggagagatcaaattctctgtgcacgtagagtcagtcctaaacagagttcctcagccagagtatagacaactgctggtcgaggcaattctggtcttgaccatgctagccgacatcgagattcacagtatagggtccatcatagccgttgaaaagattgtccatatagccaacgatcttttcttgcaggaacagaaaactctaggcgcagatgacaccatgctggctaaggaccccgctagcggtatctgtactctgctgtatgacagtgccccatctggcagattcggcaccatgacgtacctaagtaaggccgctgcaacgtatgtacaagagtttctgccacactcgatttgtgctatgcagtag

SEQ ID NO: 235027 - DNA, 3546 bp, Artificial Sequence
  Description of Artificial Sequence: Synthetic coding sequence
atgcggtcacgatcaaactcaggggtccgtctggacggctatgctaggcttgtgcagcagacaatcttatgccatcagaatcctgtgaccggcctgctgcccgcaagctacgaccaaaaggatgcctgggtccgggacaatgtgtacagcatactggctgtctggggcctcgggctggcatatagaaaaaacgccgatcgggacgaagacaaagctaaagcctacgagctggagcagtccgtggtgaagttgatgagggggctgctccactgtatgattcgtcaagtggataaggtcgagtcctttaagtactcccagagcactaaagatagcctgcacgccaagtataacactaagacatgtgcaactgtggtgggcgatgaccagtgggggcatttgcagctggatgctactagcgtttatctgctcttcctggcccagatgactgccagtggactccacatcatccatagcctcgacgaggttaatttcatccagaatcttgtgttttacatcgaggctgcatataaaacagccgacttcggtatctgggaacggggtgacaaaaccaatcagggcattagtgagctgaacgcaagcagcgtagggatggccaaagcagcactcgaggcattagatgagctggacctgtttggtgttaaaggagggccacagtcagtgatccatgtcctggccgatgaagtgcaacattgtcagagcattctgaactctcttttaccacgcgcatccacttcaaaggaagtggatgccagcctcctaagcgtcgtgagctttcccgcttttgccgtagaagactcgcagctggtcgagctgaccaaacaggaaataattaccaagctacaggggcgatatggttgctgtcggttcctgagggacggatataaaactccgaaagaggatccaaacaggctgtattatgagccagcagagctaaagttgttcgaaaacatcgagtgcgagtggcctctgttctggacctattttattctggacggcgtattcagcggtaatgcagaacaggtccaggagtataaagaagcactggaggctgtcctgattaagggcaaaaacggtgtgccactgctcccagagctctattcagtcccgcctgaccgggtggatgaggagtatcagaacccccacaccgtggatcgagtccccatgggcaagttgcctcacatgtggggccagagtctttatatcttgggatctctgatggcagaaggttttctggcacctggcgagatcgaccctctcaaccgtaggtttagtacggtcccgaagccagatgtggtcgtgcaggtgtctattctggctgagactgaagagataaagactattttaaaagacaaagggatttatgtggagaccatcgccgaggtgtaccccatccgtgtgcagcctgccaggatcctctcccacatctattcctccttaggctgtaataatcgaatgaagctgagcggccgaccctataggcatatgggggtgctgggtaccagcaagttgtacgatattaggaagacaatattcaccttcacccctcagttcatcgaccagcagcaattttatttggcactcgacaacaagatgatcgtggaaatgctgcgcactgatctgagctacctctgtagcaggtggcgcatgaccgggcagcctaccattacattccccatttcccattcgatgctggatgaagacggaaccagcctgaactcaagtatactggctgccctcagaaaaatgcaggatggctatttcggaggggcaagagttcagacaggcaagctgagcgagtttttaacgactagttgctgtacacacctctccttcatggatcccggtcccgaggggaagttatatagtgaagactacgacgacaactatgactacctggaaagcggcaactggatgaacgactatgatagcacgtcacacgacgtgcatatgtacctacctacgaagctttttcaagctagccgtccatcatttaacctgcttgactctccgcatcccagacaggagaatcaggtccccagcgtgcgtgtggagatccacttacctcgggaccaatccggcgaggtagattttaaagccttggtgctacagctgaaagaaacatcctcactacaggagcaggctgatattttatatatgctctataccatgaagggtcccgattggaacacagagctgtataacgagaggagtgccacagtaagggaactgctaacggagctgtatggtaaggttggggagattagacactggggcctgataagatacatttcaggaatcctcaggaaaaaggttgaagcgctcgacgaagcttgcacagacctccttagccatcagaagcacctgaccgtaggattgccccctgaaccacgggagaagaccatctctgcccctctgccgtatgaagcccttacacagctcatcgacgaggcctccgagggcgacatgtctataagtatcttgactcaggaaattatggtctatctcgccatgtacatgagaactcagcccggattattcgctgagatgtttcgtttgcggatcggcttgattatacaggtgatggctacagagctagcccatagcctcaggtgtagcgcagaggaagctactgaggggctgatgaacttatcaccctcagccatgaagaaccttctgcaccatatcctctccggcaaagagttcggtgtggaaaggagtgtgagacctacagatagtaacgtgtcaccggcaatttctatacacgaaattggcgcagtcggggcaactaagacagaacggacaggcatcatgcagcttaagtccgagattaaacaggtagagtttcggagactatcaatttcagcggagtctcagtcaaacggtggtcacccgcttggcattgacctgatgtcccccagtttcatgtcccctggtacatcaatgaccccttcctccggatcctttccttcagcctacgaccaacagagctcaaaggattcaagacagggccaatggcagagacgcaggcgccttgatggtgctctcaaccgggtgccggttgggttctatcaaaaagtttggaaagttctccagaaatgccacggactcagcgtggaaggattcgtacttccaagttccaccaccagggagatgacccctggagagatcaaattctctgtgcacgttgagagtgttctgaacagagtcccccagcccgagtatagacagctcctggtggaggccattctggttttaaccatgctggcagacatcgaaattcactccatcggcagcataatcgcagtcgagaagattgtccatatcgcaaacgacctgtttttgcaggaacagaagaccctcggggctgacgataccatgttggctaaggaccccgcatccggcatttgcacgctactctatgattcggcaccaagcggcagattcggaaccatgacttatctatccaaagccgcagctacctacgtgcaggaattcctgccccactccatatgtgctatgcagtag

SEQ ID NO: 235028 - DNA, 3456 bp, Artificial Sequence
  Description of Artificial Sequence: Synthetic coding sequence
atgaggagccgatctaattcaggagttaggttagacggctatgcccgacttgtgcagcagacgatactgtgccaccagaatcccgtgacaggcttgctcccggcatcttacgaccagaaggatgcatgggtgcgggacaatgtctactctattctagcagtgtgggggctgggcctggcctacaggaagaacgccgaccgcgacgaagacaaggccaaagcttacgaactggagcagagcgtggttaaactgatgaggggactgctgcactgtatgattcgccaggtggacaaggtggagtcatttaagtatagtcagagtaccaaggactccttacatgccaagtacaacaccaagacatgtgctaccgtggtcggggatgaccaatggggtcatctacagcttgacgcaacctctgtatatcttttgttcctcgcccagatgaccgcctctggcttacacatcattcactctctcgatgaggttaatttcatacagaatttagtgttctacattgaggctgcatataagacagctgactttggcatctgggaaagaggcgacaagactaaccagggcataagtgagttgaacgcctcatcagtcggtatggccaaagcggcactggaggctctcgatgagcttgacctcttcggggtcaaaggcggacctcagtctgtaattcatgttctcgctgatgaagtccagcactgtcagtctatcctgaactccctcttgcctagggcgagcaccagtaaagaagtggacgcatcgctgcttagcgtcgtcagtttcccggctttcgccgtggaggattcacagctcgttgagctcaccaaacaggaaatcattacaaaacttcagggcaggtacggctgttgccgctttttgagggatgggtacaagaccccgaaggaggatcccaataggttatactacgagcccgcagagctcaagttgttcgagaatatcgaatgtgagtggccgttattctggacttattttatcttggacggcgtgttttccggaaatgccgaacaggtgcaggagtataaagaggctctggaagccgtactgattaaaggaaaaaacggagtcccactgctgcccgagctttattccgtgccccctgacagagttgacgaggaataccagaatcctcatacagtggatcgggtgcccatggggaagctaccccacatgtgggggcagagcctctacatcctgggcagcctgatggctgaaggtttcctggcaccaggagagatcgaccctctcaaccgtcgctttagcacagtcccgaagcccgatgtggtggtccaggtgtctatcctggccgaaaccgaggaaattaagactattctgaaagataaggggatttacgtggagaccatcgctgaggtataccctattagagtgcagccggcaagaatcctctctcacatctactctagcctcggctgcaataaccggatgaaactatccggacgcccatacagacacatgggggtgcttggaacttccaaactctacgacatccgcaagactatattcacattcacccctcagtttatagaccaacagcaattctacttggccttagataacaagatgattgttgagatgcttcgtacagacttgtcttatttgtgtagccgttggagaatgaccggtcagcctactataacatttccaatcagtcatagcatgctcgacgaggatggaacgtctcttaattctagcatcctcgctgctctgcgaaagatgcaagacggttattttggcggagcccgtgtccagaccgggaagctcagcgaattcttaaccacaagctgttgtacacacctgagcttcatggacccaggacccgaaggaaagctctatagcgaggattatgacgacaactatgattacctggagagtggcaactggatgaatgattacgattctacttctcacgatgtccatatgtatctaccaaccaagctgtttcaagcatcccgcccttcttttaatttgttggactccccacacccgagacaagaaaaccaggtccctagtgtccgcgtggaaattcacctgccccgtgatcagtccggcgaggtggattttaaggcactcgtattacagttaaaggagacgagctccctgcaagagcaagcagacatcttgtacatgctgtacacaatgaaggggccagattggaataccgagttgtacaatgaacgatcggcgaccgtgagagagctacttacggagctgtacgggaaagtgggagagatcaggcactgggggctgatccggtatatctctgggatacttaggaagaaggtggaggcgctcgatgaagcgtgcacagatctcctgagccatcaaaagcatctgacggtgggactccctcccgagcccagagagaagactatttccgcccctctgccctatgaggccttgacacagctaattgatgaggcttccgaaggggacatgtcgatctctatcctgacacaggaaatcatggtctacctggcaatgtatatgcgaacacagcccggtctcttcgccgaaatgtttcgactgcgcatcggacttattatccaggtaatggcaaccgagttagctcactcactgagatgtagcgccgaggaagccacagaggggctaatgaatctgagcccttctgctatgaagaatctgctccatcatattctctccggcaaagaatttggtgtcgaaagaagcgttcgacctaccgatagtaacgtctctcccgctatttcaatccacgaaattggcgctgtaggagctactaagacggaacggaccgggattatgcagcttaaatccgagattaagcagtccccaggaaccagtatgacaccatcaagtggttctttcccatctgcatacgatcagcagtccagtaaggatagccgacaaggccagtggcagaggcgccgacgtttggacggagccctgaaccgggtgcccgtggggttctaccagaaagtgtggaaggtgttgcagaaatgtcacggattgtccgtagaagggttcgtgctcccatcatcgacaaccagagaaatgactcccggagaaattaaattttccgtgcacgtagagtcagtcttaaaccgggtgccccagccagaataccgccagctgttggtagaagctatcctggtccttacaatgttggcagacattgagatccatagtatcggcagtatcattgcagtggagaagattgttcacatcgcgaatgacttgtttcttcaggaacaaaagaccttaggtgcagacgacaccatgcttgctaaagaccccgcaagcgggatctgcacacttctttacgattccgccccatccggaagattcggcaccatgacttatctgtcaaaagccgctgcgacctatgtccaggaattcctgcctcattcaatttgcgctatgcagtag

SEQ ID NO: 235029 - DNA, 1164 bp, Artificial Sequence
  Description of Artificial Sequence: Synthetic coding sequence
atgacccgagacgaagccctgcccgattcccattcagcccaagatttctatgaaaattacgagcctaaagagatactgggtcgcggtgtctcaagcgttgtgcggaggtgcattcataaacccacttcccaggaatacgccgtgaaggttatcgacgtgactgggggaggctccttctcacccgaggaagttcgggaactccgtgaggcaaccttaaaggaagtcgatatcctcagaaaggtgagcggccacccaaatatcatccagcttaaagatacctacgagaccaatacctttttctttctggttttcgatcttatgaagagaggagagttgttcgattacctaactgaaaaggtgaccctgagcgaaaaggaaacacggaaaattatgagggctcttcttgaagtcatctgcaccttgcacaaactcaatatagtccaccgtgatctgaaacccgagaatattcttctggatgataacatgaacataaaactgaccgactttggcttctcttgccagctcgagccaggggagagactgcgcgaagtctgcggcactccaagctatctggcccctgagatcattgaatgttctatgaatgaagatcacccgggatatggcaaggaggtggatatgtggtcaacaggagtaatcatgtacaccttattggctggatcaccacccttctggcacagaaagcagatgctgatgttaaggatgatcatgtctggaaactaccagttcggcagtcctgaatgggatgactattcagacacagtcaaggatctcgtatctcggtttcttgtggttcagccacagaaccggtatactgccgaggaagctctggcccaccccttttttcagcagtatctggtggaggaggtccgccactttagcccccgagggaagtttaaggtgatcgccctcaccgttctggcctctgtgcgcatttattatcagtatcgccgagtcaagcccgttacacgcgaaatcgtgattagggatccatacgcactccgtcccctgaggcgactcatagatgcatacgcttttcgcatctacggacactgggtgaaaaagggacagcagcagaacagagcggcactgtttgaaaacacaccgaaagctgtgctgctcagcttagccgaggaagactattag

SEQ ID NO: 235030 - DNA, 1260 bp, Artificial Sequence
  Description of Artificial Sequence: Synthetic coding sequence
atgactcgagacgaggctctgccagactcacactcggctcaggacttttacgagaattatgagcctaaagagatcctaggccgtggagtctcgagtgtggtccgccgatgtatccataagccgacgagccaggagtacgctgttaaagtaattgacgtgaccgggggagggtccttctcgcccgaagaggttcgagagctccgagaagcgacactcaaggaggtagacatcctccggaaggtgtctggccatcccaacatcattcagcttaaggacacctatgagacaaacacctttttttttctggtgttcgatctatgggaagatacagacaccatggaaatggaacagaaatggtgtctcggctgggattctcccaaaagcaccaacttccgcgcacagggtagggccaggatgaaaaggggggagctgttcgactacctgactgagaaagtcacccttagtgagaaggagacccgtaagatcatgcgagccctcctcgaagtgatctgcacactgcataagctgaatattgtgcacagggatcttaaacctgagaacatcctgctggacgataatatgaacattaagttaaccgacttcggattttcatgccagcttgagcctggagaacgtctgagagaagtttgtggcacgccaagctatctggcaccagaaatcattgaatgcagtatgaacgaggatcatcctggatatggcaaggaggtggatatgtggagcaccggagtgataatgtacactctgctcgcagggtcgccgccattttggcacagaaagcagatgttgatgctgagaatgatcatgagcggcaattatcaattcggaagccctgaatgggacgactactcagacacagtaaaagatcttgtctcccgatttctcgtggttcagcctcaaaacagatataccgctgaggaggccctggcccacccgttcttccagcagtatcttgtggaggaggtacggcacttctcgcctagaggcaaattcaaggtcatcgccctgactgtcctcgcctccgtgaggatctattaccagtatcgaagagtcaagcccgttacgagggaaattgtgattagagacccctacgctctgcggcctctgaggcgcttaattgatgcgtatgcatttcgcatatacggccactgggtcaaaaaaggtcaacagcagaaccgcgctgccttgttcgagaacaccccaaaagccgtccttctctctttggcagaggaagactactag

SEQ ID NO: 235031 - DNA, 1002 bp, Artificial Sequence
  Description of Artificial Sequence: Synthetic coding sequence
atgcacccccaggcccacgagcccggagtgaggcgggagggacatcgacgccatagatggcggcagctccagccaggtggaggcgctggagccgctagaagccacgccgagggaggcggtcaccccgctcaagggctgcgggcaccacagcatcagatgaaaagaggcgaactgttcgactatctcactgagaaggttactctatctgagaaggagaccaggaaaattatgcgcgcattgctggaggtcatctgtacactgcataagctgaacattgtccacagggatctgaagccagaaaacattctgttggacgataacatgaatatcaagttaactgattttggttttagctgtcagctggaaccaggcgaaagactgcgggaggtgtgcggaacgcccagctacttggcccctgaaatcatcgagtgttccatgaacgaggatcatccgggttacggaaaggaagtcgatatgtggtccacaggcgtcatcatgtatacccttctcgcaggtagtccgcctttttggcataggaaacagatgttaatgctcaggatgataatgtccggcaattatcagttcgggagcccagagtgggatgattacagcgacactgtgaaagacttagtgagtaggtttctggtagtgcagccgcagaaccgctacaccgctgaagaggctctggcacaccctttttttcaacagtacctagtggaagaggttcgtcatttcagcccgagggggaaatttaaggtgatcgctctgaccgtgttggcttctgtgcgaatctactatcagtaccggagggtgaagcccgtgactcgcgagatcgtgattagagacccatatgcactccgaccactgcgcaggctcatcgatgcctacgcctttcgtatctacggacattgggttaagaaggggcagcagcagaaccgtgccgctttgtttgagaatacaccaaaggcagtccttttgtctttggccgaggaggactattag

SEQ ID NO: 235032 - DNA, 2529 bp, Artificial Sequence
  Description of Artificial Sequence: Synthetic coding sequence
atgagcaggcctctgagtgaccaggagaagagaaagcagatttctgtccgaggtctggctggagtcgagaatgtgactgagctgaagaaaaattttaataggcaccttcactttacactggtgaaggatagaaacgtggccacgccgagggactactactttgcattggctcatactgttcgcgatcacctggtcggtagatggatcagaacgcagcagcactattatgaaaaagatcctaagcggatttattacctctccctggaattctatatgggcagaaccctccagaacacaatggtgaacctggctctggaaaacgcatgcgacgaagccacctatcaacttgggttggacatggaggaattggaggaaatcgaggaagacgccggactgggcaacggcggattaggtaggctggcagcatgctttttagattccatggcgacgttgggtctggcagcatatggctatggaattcgctacgagtttgggatcttcaatcagaaaatctcagggggatggcagatggaggaagctgatgattggctgagatacggaaatccttgggaaaaagctcggccagagtttacgttgcctgttcacttttacgggcacgtggagcatacttcacagggtgctaaatgggtggacacccaggtcgtgcttgctatgccttatgacacaccagtgccgggttacaggaataatgtggttaacacaatgcggttatggtccgcaaaggctcccaatgactttaatctgaaagattttaatgtggggggatacatacaagctgtattggatcgcaatttggcagagaatatcagccgagtgttatacccaaacgacaatttctttgaaggaaaggaactgcgtctgaagcaagagtatttcgtcgtagcagccacccttcaagatattattcgacgatttaaaagttccaagttcggctgccgcgaccccgtcaggacaaatttcgacgcgttcccggacaaggtggctattcagttaaacgacacacacccttccctggcaattcccgagctgatgcggatcctggttgatctggagcgcatggactgggataaggcttgggacgtgaccgttaggacctgcgcctacactaatcataccgtcctccccgaagcacttgaacggtggcctgtgcatctgcttgagactttattaccaaggcacctgcaaataatttacgaaatcaaccagcggttccttaaccgggtcgccgctgctttccctggcgatgttgaccgcctgcggcgaatgagtctcgttgaagaaggcgctgtcaaacggataaatatggcacacctgtgtattgctgggtcccacgcagtgaacggcgtcgccagaattcattccgagattctgaagaaaactattttcaaggacttttacgagttggaaccccacaagtttcagaacaagacaaacgggatcacgccgagacggtggcttgtcctctgtaatcctgggctggccgaagtgatagcggagcggatcggcgaggactttatttccgatctcgatcagttgcggaaacttctgtcgtttgtggatgacgaggccttcatccgggacgtagctaaagtgaaacaggaaaataagttaaaattcgccgcttatctggagagggagtataaggtgcacattaatccaaatagcctctttgacatccaagtgaagagaatccacgaatacaagcgtcagcttcttaactgtctccatgtgatcaccttatacaacagaattaaacgcgagcccaacaagttttttgtgcctcggactgtaatgatcggaggcaaggctgctccaggctatcacatggcaaaaatgattatacgtcttgtcaccgccatcggcgacgtagtgaatcatgacccagccgtcggtgacagactgcgggtgatatttctcgagaactaccgagtgagcctggctgagaaggttatccccgctgccgacctttcagagcagatcagtactgccggaaccgaggcttccggcactggcaacatgaagttcatgctcaacggtgctctgactatcgggacaatggatggcgctaatgtggaaatggctgaagaggccggagaggaaaatttctttatctttggcatgcgcgttgaagacgtcgacaagctagatcagaggggatataacgcccaggagtattatgacaggatcccagaactccgccaggtgattgaacagcttagttcaggatttttcagccctaagcaacctgacctattcaaggacatcgtgaatatgcttatgcaccacgatcggttcaaggtatttgcggactacgaagactacatcaagtgccaagagaaggttagcgccttatataagaatccccgagagtggacccggatggtgattagaaatatcgccacaagtggaaagttttcatctgatcgtacaatcgcgcagtacgcaagagaaatatggggcgtagagccgtcacgccaaagacttcccgcacctgatgaggccatttag

SEQ ID NO: 235033 - DNA, 2499 bp, Artificial Sequence
  Description of Artificial Sequence: Synthetic coding sequence
atgtccagacccctgagcgaccaggagaaacgtaaacaaatctccgtccggggactggccggagtcgagaacgtcacagagctcaagaaaaactttaaccggcatctgcacttcacactggtgaaagaccgcaacgtggctacacccagggattactatttcgcacttgcgcacactgtgcgcgaccatttagtcgggagatggattcggacacagcagcactactacgaaaaagatcccaaacgcatctactatctctccctcgagttctacatgggcagaacactacagaataccatggtgaacctcgcactagagaatgcctgtgacgaggccacatatcaggtgggactgggcagattagctgcctgctttctcgacagtatggccacacttgggctggccgcttacggctacggtatccgctatgagttcgggatttttaatcagaagatatccggcggttggcaaatggaggaggccgatgactggctacggtacggtaatccatgggagaaagccaggcccgagttcactttgcccgtacatttctacgggcatgttgaacatacttcccagggcgcaaagtgggttgacactcaggtggtgctggcaatgccctacgacacacctgtcccgggttacagaaataacgtggttaacacaatgagactttggagcgcgaaagctccaaatgatttcaacctaaaagacttcaatgtggggggatacattcaagccgtcttagacaggaacctggctgaaaacattagcagagtgttgtatccaaatgacaactttttcgagggcaaagaactacggctgaagcaggagtatttcgtcgtggcggcaaccctgcaagatattatcagacgctttaagtcatcaaaattcggttgccgcgaccccgtgaggaccaactttgacgctttcccagataaggtcgctatccagttaaatgacactcacccgtcactggccattcctgagctgatgagaatcctcgtcgacctggagcggatggactgggataaggcttgggacgtgacagttaggacatgcgcctacactaaccacacagtgctaccagaagcactggagaggtggccggtacacctcctggagacactgctgccccgacatctgcagatcatttacgaaataaatcagcggtttctgaatagagtagcggctgcttttccaggggatgtcgatcggctgcgacggatgtctctggtggaagagggcgctgtgaagcggattaatatggcacacctatgcatagcaggctctcacgctgttaacggagtggcgaggatccactccgaaattctgaagaagacaatctttaaggatttctacgaacttgagccccataagttccaaaataagaccaacggaattacacccaggcggtggctcgtcttgtgtaatccaggattagctgaggtcattgccgagaggatcggcgaagatttcattagcgacctagaccagctgcgtaaactgctctcattcgtggatgatgaggcatttataagggacgttgcaaaggtaaaacaggagaacaaattgaagttcgccgcatatctggaaagggaatacaaggtccacatcaacccaaattccttgttcgacatccaagttaaacgtattcacgagtacaaacgacagctgctgaattgcctgcacgtaattacactgtacaaccggatcaaaagagaacctaacaaatttttcgtgcctaggacagtgatgatagggggtaaagcagcacctggttatcacatggccaagatgattatccgtctggtgaccgcaattggcgacgtcgttaatcatgatcccgctgtgggggatcgccttagggtgatctttttagagaactatagggtgtctctcgcagaaaaggtgattccggctgcggatctttctgaacagatttcaacagcaggcactgaggcctctggaaccggaaacatgaagttcatgctaaacggtgcactgactatcgggactatggacggcgctaacgtggagatggcagaggaagccggagaagagaatttcttcatctttggtatgagggttgaggatgtggacaagctggatcagcggggttacaacgcccaagagtattacgacaggattccagagctacggcaggtcatcgagcagctttcgtccggctttttttctcctaagcagcctgatctcttcaaggacatagtcaatatgcttatgcatcacgaccgcttcaaagtgtttgccgactacgaagactatatcaagtgtcaggagaaagtttctgctctgtacaagaaccccagagagtggacccgaatggtgattcgcaatattgccacctctggcaaattttcttctgatcggaccatagctcagtacgcccgtgaaatttggggggtggaaccttcccgccagcgcttgccggctcccgcaccacacgcggagggaggcgtgctggagctggacctgtag

SEQ ID NO: 235034 - DNA, 1425 bp, Artificial Sequence
  Description of Artificial Sequence: Synthetic coding sequence
atggccaccaattgggggagcctgctgcaggacaaacaacaactggaagagcttgctagacaggccgtcgaccgggcacttgctgagggtgtgttgctgagaacaagccaagaacccacgtcatcggaagtcgtgagctatgctccattcacattgttcccgagtctagtgccctcagcactcttggagcaagcatacgccgtgcagatggacttcaacctgctcgtggatgcggtaagccagaacgctgcgtttctggagcagaccctgagtagcaccatcaaacaagatgactttacagcccgattgtttgacatacacaagcaggtgttgaaggaaggtatcgcccagactgtgtttctgggcctcaaccggtccgactatatgtttcagcggagcgccgacggctccccagcactcaaacagattgagattaacaccatctctgcatcctttggcggacttgcgagccggaccccggcagttcacaggcacgtgctctccgttctgagtaagacgaaggaggcaggaaaaattctaagcaacaacccctctaagggattagccctcgggattgcgaaggcatgggagttgtatggttccccaaacgccctggtgctgcttatagcacaggaaaaggagcgcaatatttttgatcagcgcgcaatcgagaatgaactgctcgctaggaacatccatgtgatccggaggacttttgaggacatctcagaaaagggaagcttggatcaggacaggcggctgttcgttgatggccaggaaatcgccgttgtctattttagggacgggtatatgccaaggcagtactcactgcaaaactgggaagccagactgctgctcgaaagaagccacgctgctaaatgtcctgacatcgccacccaattggcaggcaccaagaaagtacagcaggaattgtctaggcctggtatgctggagatgctccttccgggacagccagaggctgtcgctagacttagagccacgttcgccggactgtacagcctggatgtgggagaagagggtgatcaagctatagcagaggctctggccgctccatctcgattcgtgttgaagcctcaaagggagggtgggggaaataatctgtatggagaagagatggtccaagctctgaagcagcttaaggactcagaggaacgagcttcttatatcttgatggaaaagatagagcctgagccttttgagaattgcctcctgaggccgggaagcccagcgagagtcgtacaatgcatttcggagctggggatttttggcgtgtatgttagacaagaaaagaccttggtgatgaataagcatgtcggccatctgctcaggacaaaggcaatagagcacgccgacggcggtgtcgcggctggcgtcgccgtgctcgacaacccttatccagtctag

SEQ ID NO: 235035 - DNA, 738 bp, Artificial Sequence
  Description of Artificial Sequence: Synthetic coding sequence
tgaaaacaccatcacaccgtgccaccatctgtgacacccaaggcactcgacaggagccctccatgtcctgagatgttcacccgcgcagcccctgggtatcatatggccaaactgattatcaagctggtaacctcgattggagacgtcgtaaatcatgatccagtggttggagatcggctgaaagtgatttttttggagaattaccgcgtttcgctcgcagagaaagtgatcccggcagctgacctaagccagcagatttccaccgccggtacagaggccagtggcacggggaacatgaaatttatgctcaacggtgctttgaccataggcaccatggatggcgctaacgttgagatggccgaagaggccggagcagagaatctcttcatctttggcctcagggtagaagatgtcgaggctctagatagaaagggctataatgcacgagagtattatgatcatctgccagaactgaaacaggccgtggaccaaattagtagtggattcttctctccaaaggagcctgattgtttcaaggacattgttaacatgttgatgcaccacgaccgcttcaaggtcttcgctgattacgaggcttatatgcaatgccaggcccaagtcgatcagctgtacagaaacccgaaagagtggactaaaaaggtcatacggaacatagcttgcagcggcaaatttagcagtgaccgcaccatcaccgaatacgcgagagaaatctggtag

SEQ ID NO: 235036 - DNA, 975 bp, Artificial Sequence
  Description of Artificial Sequence: Synthetic coding sequence
atggacgcccctagacaggtggttaactttggcccaggacccgctaagcttccccacagtgtgctgctggagattcagaaggagctgctagattataaaggggtaggaatctctgtactagagatgtcacaccggtccagcgacttcgctaaaattatcaataatacagaaaatctagtgcgcgagttactggcagtcccagacaactataaggtgatattcttgcaagggggaggctgtggccaattttctgcggtcccgcttaatcttataggacttaaagctggcagatgcgccgactacgttgtgacaggagcatggagtgccaaggccgcagaagaggccaaaaagtttggcaccatcaatatcgtacaccctaagctgggaagttacaccaagatccccgatccctccacctggaacctcaacccggatgctagctacgtatactactgcgctaatgaaaccgttcacggcgtggagttcgattttatcccggacgtcaagggtgccgtgctggtgtgtgacatgtcttcgaacttcctttccaagccagtggatgtgagcaagttcggagtcattttcgccggtgcacagaaaaatgtaggctccgctggggttacggtcgtgattgtgcgagatgatcttctagggttcgctctgagggaatgtccctcagttctggagtacaaggtgcaggctgggaacagctccctctacaataccccaccgtgcttcagcatatacgttatggggttggtgctggaatggatcaagaataatgggggagcagctgcaatggaaaaactcagttcaatcaagtctcaaacaatttatgagatcattgataacagccagggcttttacgtcagtgtgggaggcatccgcgcttcgctctataatgccgtgactattgaagatgtgcagaaactggcggctttcatgaagaagtttctggaaatgcaccaactatag

SEQ ID NO: 235037 - DNA, 1113 bp, Artificial Sequence
  Description of Artificial Sequence: Synthetic coding sequence
atggacgcgccaagacaggtcgttaatttcggtcctggccctgccaagctcccccacagcgtgttactggagattcagaaggaacttctggactataagggcgttggcatatctgtcctcgaaatgtctcacagaagctcagattttgcaaaaatcatcaataacaccgagaatctggtgagagaactgctcgcagttcccgacaattacaaagtcattttcctacagggcggaggttgtggtcagttctcggcagtcccattgaacctcattggactaaaggccggacgctgtgcagactacgtggtgacaggtgcatggtccgccaaggcggctgaggaagctaaaaagttcggcaccatcaatatcgttcatcccaagctcgggagctataccaagattccggacccctccacctggaacctaaatcccgatgcaagctacgtgtactactgcgccaacgaaaccgttcacggagtggagtttgacttcatccctgatgtgaagggagccgtcctggtgtgcgatatgagcagtaattttctgtctaagcccgtcgacgtgagtaagttcggagtgatctttgctggagcccagaaaaatgtgggctctgctggagtcaccgtggtgatcgtaagagacgacctcctagggtttgcactgagagagtgcccgagcgtgttagagtataaagtgcaagcagggaattcctccttgtacaacacccccccttgctttagcatctacgtgatgggcctggtcctggagtggatcaaaaacaatggcggagctgccgctatggagaagctcagctctattaaatcccaaactatttatgagataattgacaactcacagggattctacgtctgtccagtagaaccccagaaccgctcgaagatgaacatcccattccgtatcgggaatgcgaaaggggacgacgctctggaaaaaaggttcctggacaaggctttggaattgaacatgctatcacttaagggacatcgcagcgtgggcggaatccgtgcttccctttacaacgcagtgactatagaagatgttcagaaactggccgcttttatgaaaaaatttttggagatgcaccagctgtag

SEQ ID NO: 235038 - DNA, 585 bp, Artificial Sequence
  Description of Artificial Sequence: Synthetic coding sequence
atgtccagtaattttctgtcaaagcccgttgacgtatcaaagtttggcgtgatatttgccggtgcccagaagaatgtggggtctgccggagtaaccgtagtgattgtgcgcgacgatctgctgggcttcgccctgcgggaatgccctagcgtgttggaatataaagttcaagctggcaattcatccctctacaatacaccaccttgtttcagtatatatgtaatgggacttgtgctcgagtggattaagaataacgggggtgccgcagctatggagaaactctccagcattaaatctcagactatatatgaaatcattgacaacagccaaggattctatgtctgtcccgtggagcctcagaaccggagtaaaatgaacattccatttcgtatcggcaatgcaaagggagacgatgccttggagaagagatttcttgacaaggcattggaactgaacatgctgagcctaaagggccatcggtcagtggggggtatccgagcctccctttataacgccgtcacaattgaggacgtgcagaaactcgctgcattcatgaaaaagtttctagagatgcaccagctgtag

SEQ ID NO: 235039 - DNA, 1050 bp, Artificial Sequence
  Description of Artificial Sequence: Synthetic coding sequence
atgtcttcgctctctggaaaagtacagactgttctgggactggtggagccgtccaagctcggtcggactctgacacatgaacacctcgcaatgacgtttgattgctgttattgcccacctcccccatgccaagaggctatttccaaggagcctatagtgatgaaaaacctgtattggattcagaaaaacgcatactcgcacaaagaaaatttacagctgaaccaggagaccgaggccatcaaggaagagctactttattttaaggccaacggaggtggggcactagttgagaatacgacaactggaatctctcgggatacccagacacttaaaaggctagcagaagagacaggcgtccacattatcagtggggcaggtttctacgtggatgcgacccattcttctgagaccagggccatgtcagttgaacagttgaccgatgtgcttatgaatgaaattctgcatggtgccgacgggacgagtatcaagtgcggcatcatcggagagattggctgcagctggccactcaccgaatcggagcggaaggtgctgcaggccaccgcccatgctcaggcccagctggggtgccccgtcattatacatccaggtagatcctcccgggcacctttccagattattcgaattctgcaagaagccggagccgacatttccaaaacagtgatgagccacctggatcgcacaatcctggataagaaagagctgttggaatttgctcagttgggttgttatttagagtatgacctgttcgggaccgaactgctgcattatcagcttggcccagacatcgatatgccggacgacaataaaaggattcgccgtgtgcgtctgttggtggaagaaggatgcgaagatagaatccttgtagcccatgatattcacacgaagacaaggctgatgaagtatgggggacacggctattctcacatcttaaccaacgtggttcccaagatgctgttgagaggcattaccgaaaatgttctcgataagatcctgattgaaaacccaaagcagtggctgacattcaagtag

SEQ ID NO: 235040 - DNA, 1050 bp, Artificial Sequence
  Description of Artificial Sequence: Synthetic coding sequence
atgtcatcacttagtggtaaagtgcagactgtgctcggactcgtggaaccatcaaagcttggaagaaccttaacgcatgaacacctggccatgaccttcgactgctgctattgcccaccgcctccgtgccaagaagccatcagcaaagaacccatcgttatgaagaatctctactggatccaaaagaacgcttatagccacaaagaaaacttgcagcttaaccaggagactgaagccatcaaggaggaacttctatacttcaaggctaacggcggaggggctctggtcgaaaatacgaccaccggaatcagtagagacacccagacccttaagaggctggccgaggaaactggggttcacatcatcagcggcgcagggttttatgtggacgctacccacagcagcgagactcgagccatgtcagtggaacaactcaccgacgtactgatgaatgagatattgcacggggctgacgggacaagcattaaatgtggcattattggcgagattggctgctcgtggccgctgacagagtccgaacggaaggtcctgcaggctactgcccacgcccaagctcagctcgggtgccccgtcatcatccaccctggccgatccagccgggcaccttttcaaataatcagaatactacaggaggcgggagcagatatcagcaagaccgtcatgtcccacctggatcggaccattctggataaaaaggagctcctggagttcgcgcagctggggtgctacttggaatacgacctgttcggtactgagcttctccactaccaactagggccagacatcgatatgcctgacgataataaaagaattaggagggtacggcttctggttgaggagggatgcgaagatcggattttagtggcgcatgatatccatactaaaacacgactgatgaagtatggaggccacggatactcacatattttgacaaacgtggttcccaagatgctattacgtggcatcaccgaaaacgtgctggataagatactgatcgagaaccccaagcagtggctgacctttaaatag

SEQ ID NO: 235041 - DNA, 1050 bp, Artificial Sequence
  Description of Artificial Sequence: Synthetic coding sequence
atgagttctctgtccggaaaggtccagactgtgttgggactggttgagccctccaagctgggaaggaccctcacccatgagcacttggcgatgacctttgattgctgttactgtccacctcctccgtgccaggaggccatttccaaggagcctattgtaatgaaaaacttatattggattcagaaaaacgcatacagccacaaggagaatctgcaattaaaccaagagacggaggctatcaaagaagagctgctgtactttaaagccaatggaggaggcgctctagtggagaacacaacgaccggcatttccagagacacccaaacactgaagcggctggccgaagagaccggagtgcacattatctctggggctgggttctatgtcgatgctacgcacagtagcgagacgcgggcaatgtctgtagaacagcttactgatgtcctgatgaacgagatactccatggcgctgacggcacatccataaagtgtggcatcatcggagagattggatgcagctggcccctgaccgagagtgaacgaaaggtcctacaagccacagcccacgcgcaggcgcagctgggctgtccagtgatcatacaccctgggcgtagctctcgggctccgttccagattatccggatccttcaggaggcaggcgctgatatttccaaaacggtgatgagccacctcgatcggaccattttagacaaaaaggaactccttgagttcgctcagctgggttgctatctcgagtacgatttgttcggaacggagctgctccactatcaattgggtccggatatcgatatgcccgatgataataaacggatacgtagggttagattgctggttgaggagggctgcgaggataggatcctggtcgcgcacgacattcacaccaagactagactcatgaaatacggcggacacgggtactctcacatccttactaatgtggtcccgaagatgctgctaagggggatcaccgagaatgtacttgacaagatacttatcgagaatcccaaacagtggttgacatttaagtag

SEQ ID NO: 235042 - DNA, 909 bp, Artificial Sequence
  Description of Artificial Sequence: Synthetic coding sequence
atgagcagcctgagcggcaaagtgcagactgtcctaggcctcgtggagccaagcaagctggggcgtacgctgacccacgagcacctggccatgaccttcgattgttgctactgtccccctccaccctgccaggaggcgatcagcaaggaacctatagtaatgaaaaacctgtactggatccagaaaaacgcatacagtcataaggagaatcttcaattaaatcaggaaaccgaggccatcaaggaggagctcctgtacttcaaagccaacggaggcggagcactggtggaaaatactacaaccgggatcagtagagatacacaaaccctcaagcggctcgctgaagagactggagtgcacatcatctctggagcagggttttatgtggatgcaacgcactccagcgagacacgagctatgagcgtggagcaactgacagacgttctcatgaatgagatcttacatggcgctgatggcaccagtattaaatgtggcataattggagaaattggatgttcttggcctctgaccgagagtgagagaaaggtcctgcaggccacagctcacgcacaggcgcagctgggttgtcccgtcattatccaccctggccgatcttcccgcgcacccttccaaataatccgcatactgcaggaggcaggcgcagatatttctaagacggtgatgagtcacctcgatcgcgttagactgcttgttgaggaggggtgtgaggatcgcatactagtagctcacgacatccacaccaaaactcgtctaatgaagtacggagggcatggctattcccatatcttgacaaacgtggtccctaagatgttgttaagagggatcacagagaacgtactggataagatcctgatagagaatcccaagcagtggctcaccttcaagtag

SEQ ID NO: 235043 - DNA, 1050 bp, Artificial Sequence
  Description of Artificial Sequence: Synthetic coding sequence
atgtcctctttgagcggcaaagtgcaaactgttctagggctcgtagagcccagcaagcttggacggaccttgactcatgaacacctggctatgacatttgattgctgctactgtccaccccctccatgtcaggaagctattagcaaggagccaatcgtaatgaagaacctgtactggatccagaagaacgcttactcccataaggagaacctgcagttaaatcaggagaccgaggcgattaaggaggaactgctctacttcaaagccaatggcggaggtgctctggttgagaatacaactacgggcatttcccgggacacccagaccctgaaacgcttggcggaagaaaccggagtccacatcatctccggtgcaggcttttatgttgacgccacccactcaagcgagacgagggcaatgtcagtggaacaactaaccgacgtgctcatgaatgaaattttgcatggcgctgatggaacctccatcaaatgcgggattattggggaaataggttgttcctggcccctgactgagtccgagcggaaggttctccaggcaacagcgcatgctcaggcgcagctagggtgccccgtcatcattcaccccggacggtccagtcgagcccctttccagattatccgcatactccaggaggcaggtgcagacatatcaaaaacggttatgagccacctagaccgcaccatccttgataagaaggagcttcttgagtttgctcagcttggttgctacctcgagtatgacctgtttgggaccgagctcctccactaccagttaggtcccgacattgatatgcccgacgacaacaaaagaatccgcagggtccgcctgctggtcgaggaaggatgtgaagacaggatccttgtggcccacgatattcacactaagacaagacttatgaagtatggtgggcatggctactcccatatcctcacaaacgtagttccaaagatgctactgcggggaatcacggaaaatgtattagataaaatactcatcgaaaacccaaagcaatggttgaccttcaagtag

SEQ ID NO: 235044 - DNA, 753 bp, Artificial Sequence
  Description of Artificial Sequence: Synthetic coding sequence
atgttctccttacctctgagtttgccactttgcgaagacacggctttccttcctagcaaatgctgctcgagccataagaccatcaaacaggccagaactttaattatgatatttctcgccagcggcacccattttcagacgatgctcaagtctaagcttaatgtcctaaccttgaagaaagagccactcccagccgtgatttttcacgaacccgaggcaatcgagttatgtacgaccacgccactcatgaaaacccgcactcacagcggatgtaaagtgacctatctggggaaggtctccactaccggcatgcagtttctgagcggatgcacagaaaaacctgtcatcgagctgtggaagaagcatacacttgccagagaagacgtcttcccagctaacgcacttctggagattcggccatttcaggtctggttacatcatctcgatcataagggagaggccactgttcatatggataccttccaggtggcccgaatcgcgtactgcaccgcggatcacaacgtgtctccaaacatctttgcctgggtttatcgggagattaatgacgatctgtcttatcagatggactgccatgctgttgagtgcgaatccaaactggaagccaagaagttagcccatgcaatgatggaagcctttcgaaagaccttccactccatgaagtcagacggccgaatccacagtaattctagcagtgaggaagtaagccaagaactggagagtgatgatggttag

SEQ ID NO: 235045 - DNA, 747 bp, Artificial Sequence
  Description of Artificial Sequence: Synthetic coding sequence
atgcccagaatcgccggaaaccacctcatgctagaagaaagtaggacctgttcatccccagagctcctggatggagtgtggccatgccagcctctgcattttggcttacccgcttcggagatgcatttccagactatgctcaagagcaaactgaacgtgctcactctgaaaaaagagcccctgcctgctgtcatattccacgagcccgaggccatagagttgtgcaccacgaccccattgatgaagacccggacacacagtggctgcaaagtcacctacttgggaaaggtgtcaaccactgggatgcagtttctcagtggctgcactgaaaagcccgtcatcgagttgtggaagaagcacactctggctagagaagacgtgttcccagctaatgccctcctggaaatccgccctttccaggtatggctgcatcatctggatcacaaaggcgaggccactgtccacatggatacctttcaggtagccaggatcgcttattgcactgctgaccacaatgttagtccaaatattttcgcctgggtgtaccgagagatcaatgatgatttgagctaccagatggactgccacgccgtcgagtgcgaaagcaagcttgaggcaaaaaaacttgcacacgcgatgatggaggcctttaggaagacttttcactccatgaagtccgacgggaggatccattcgaactcgtcttcagaagaggtgtcacaagaattggagtcagacgatggatag

SEQ ID NO: 235046 - DNA, 654 bp, Artificial Sequence
  Description of Artificial Sequence: Synthetic coding sequence
atgtggcagcctgccactgagcgccttcagcacttccagaccatgctgaagtctaagttaaatgttctgaccctgaagaaagaacctctgccggcagtgatttttcacgaaccggaggctatcgaactgtgtacaactacacctctgatgaagactcggacacacagtggctgcaaggtgacctacctgggcaaagtctccacaaccggaatgcagttcctgtctggctgtaccgaaaagccggtcatcgagctgtggaaaaagcataccctggctcgcgaggacgtgtttccagcaaatgcgcttcttgagattcgacctttccaggtttggctgcatcatcttgaccataaaggtgaggctacagtacacatggacacctttcaagttgctcgcattgcttactgcacagccgaccataacgttagccccaatattttcgcgtgggtttaccgggaaattaacgatgatttaagttaccagatggattgtcacgcggtggagtgcgagtccaagctggaagccaaaaaactggctcatgccatgatggaagcttttagaaagaccttccattcaatgaagtcagatggcaggatccacagcaattccagcagcgaagaagtgagtcaagaactcgaatccgacgacggctag

SEQ ID NO: 235047 - DNA, 507 bp, Artificial Sequence
  Description of Artificial Sequence: Synthetic coding sequence
atgtggcagccggctaccgaacgcctgcaggttacctatctcggcaaagtttcgaccaccgggatgcagttccttagcggttgcacagaaaaacctgtgatcgaactgtggaagaagcataccttagcccgagaagatgtgttccctgccaacgctctcctcgagattaggccatttcaggtctggctgcatcacctggaccacaaaggtgaagccacagttcatatggacaccttccaggtggccagaatcgcctactgcacggccgatcataacgtatcacctaacatctttgcttgggtctatagggaaataaatgatgacctgagttaccagatggattgccatgcagtggagtgtgagagcaagctggaagctaagaaactggctcacgccatgatggaagcttttaggaagacgttccactccatgaagtcggatgggcgaatccactccaattcttcatcagaggaggtttctcaggagctcgaaagcgatgatgggtag

SEQ ID NO: 235048 - DNA, 753 bp, Artificial Sequence
  Description of Artificial Sequence: Synthetic coding sequence
atgttttctcttcctttgagtcttcctctctgcgaggacaccgcctttctgccttccaagtgctgcagcagccataagactattaaacaggccagaactctgatcatgatattcttagcctccggaacacactttcagactatgctcaagagtaaattaaatgtcctgactctgaaaaaggagcctctgcccgcagtgatattccacgagccagaagctatagaactttgcacgaccacacccctcatgaagacacgtacccactctgggtgcaaggttacgtacttgggcaaggtcagcaccacgggaatgcaatttctttctggctgtacggaaaaaccagtgattgagctctggaaaaaacataccctggccagggaggatgtgttccctgccaacgctcttcttgagataaggccttttcaggtttggctgcatcaccttgaccataagggagaagcaaccgtgcacatggatacatttcaggttgctcgaattgcctactgcaccgctgatcataacgtctctcctaatatctttgcgtgggtgtacagggagatcaatgacgatctgtcctaccaaatggactgtcacgcggtggagtgtgaaagcaaactcgaggccaagaaactggcccacgccatgatggaggctttccggaaaaccttccacagcatgaaaagtgacgggaggatccattcaaatagctcatcggaggaagtctctcaggagctcgaatccgatgacggttag

SEQ ID NO: 235049 - DNA, 1017 bp, Artificial Sequence
  Description of Artificial Sequence: Synthetic coding sequence
atggagcagctccgcgcagcagcacggctgcagatcgttcttgggcacctgggaaggccttccgctggggcagtggtggctcaccccacgagcggcacaatctcttctgcctcatttcacccacagcagtttcaatataccctggataataatgtgctgactcttgaacagcgcaagttttatgaagagaatggcttcctggtaattaaaaatctggtgccagatgcggacatccagagattccgaaacgaatttgagaaaatatgtcgtaaagaggtgaagccattagggctaactgtaatgagagacgttacaatctctaagagcgaatacgccccttcagagaaaatgattacaaaggtgcaagatttccaggaggataaggaactgttccgctactgcactctgcctgaaatacttaaatatgtggagtgctttacgggacctaatattatggcgatgcacacaatgttaattaacaaaccacccgacagcgggaagaagacaagccgacacccgttgcatcaagacctgcactacttcccgtttagaccaagcgacctcattgtctgtgcatggaccgctatggaacacatctctaggaacaatgggtgtctcgtggtgctgcctggcacacacaaaggatcacttaaaccccatgattaccccaaatgggagggcggtgtaaacaaaatgttccatggcattcaggactacgaagagaataaagccagagttcatcttgtgatggagaagggcgacacagtattttttcaccccttgctgatccacggctctggtcagaacaagacccagggttttcgtaaggctataagctgccacttcgcctccgccgattgccactatatcgatgtcaagggcacctcacaagaaaacatagagaaggaggtggttgggatcgcccacaagtttttcggagctgaaaattctgtgaacctgaaggatatctggatgtttagggctcgcctagtaaaaggcgagcgcacaaatctgtag

SEQ ID NO: 235050 - DNA, 717 bp, Artificial Sequence
  Description of Artificial Sequence: Synthetic coding sequence
atgagagacgttacaatctctaaaagtgagtatgccccttccgagaagatgatcactaaagttcaggatttccaagaagataaggaactgttccggtactgcaccctacctgagattctgaagtatgtcgagtgtttcaccgggccaaacatcatggccatgcacaccatgctcatcaacaagccaccggattccggaaaaaaaactagcagacacccattgcaccaggatctccactatttccccttccgccctagcgacctcatcgtctgtgcctggaccgctatggagcatattagcaggaacaatggatgcttagtggtgctgcctggcactcacaaaggcagtctcaagccacatgactaccctaagtgggaggggggtgtaaacaaaatgtttcatgggatacaggattacgaagagaataaggccagagtgcatcttgtgatggaaaaaggagataccgtgtttttccatcctctattaatccacgggtctggacagaacaaaacacagggttttcggaaggcaatcagctgtcactttgcctccgcagactgccattatatcgacgtgaaggggacgagccaggaaaacattgaaaaagaagttgttggcatcgctcacaagttctttggggcagaaaattccgtgaacctgaaagatatatggatgttccgggcacggctggtgaagggcgagaggacaaatctgtag

SEQ ID NO: 235051 - DNA, 15429 bp, Artificial Sequence
  Description of Artificial Sequence: Synthetic coding sequence
atgggtaacgaagcctcactggaaggcgaggggctcccagaaggcctggcagccgctgcagctgccggtggcggagcctccggcgcaggatccccaagtcacaccgcaatcccagctgggatggaggcagacctgtcgcagctaagtgaagaggagcgcaggcaaatagcagcagttatgagtagagcccaggggctgcccaagggatcagtcccccctgctgctgccgaaagtccctccatgcacagaaaacaggagctcgactcttcccacccgccaaagcagagcggtcgaccaccggatcctggtcgccctgcgcagccaggtttgagcaagtcccgaaccacagataccttccggagcgaacagaagttaccaggacggtcgccaagtacaatatccttgaaggaatcaaaaagccgcacagacctcaaggaggagcacaaaagctctatgatgcctggctttctgtccgaggtgaacgccttatccgcagtgtccagtgtggttaataagtttaacccctttgacctgatatccgattcagaagcgagccaggaggagacaacgaagaagcaaaaagtagtgcagaaggagcagggcaagccagagggaatcatcaaaccacctctccagcagcagccacccaaacccatccccaagcagcagggcccaggtagggatcccctgcagcaggacggcacccccaaatcaatctcaagccagcaaccagaaaagataaagtcacaacctccaggcactggaaaacccattcagggccctactcagacaccgcagacagaccacgcaaagctcccacttcaacgtgatgctagcaggccccaaaccaagcaggctgacatagtaaggggagagtcagtgaagccttccctgccatctccaagtaagcccccaattcagcagcccacacccggtaagccacctgcccaacaacctggccacgaaaaatctcaacctggaccggcaaagccacctgcacagccctccgggctgactaagcccctggcccagcaacctgggactgtgaaacctccagttcagccccctggtactactaaacccccagcccaaccactcggtcctgctaagcctcccgcacagcagacaggttctgagaaacctagctctgagcagcccggacccaaggctctggctcagcccccaggtgtaggaaaaacccccgctcagcaaccaggccctgccaagccccctactcagcaagtcggcactcccaagcccctcgcacagcagcccggactccagagcccggctaaagcccctgggccaacaaagaccccagtccagcagccgggacccggaaaaatcccggcacaacaggcgggtccaggcaaaactagtgcgcaacagacaggtcccaccaagcccccaagtcagcttcctggcccagcaaagccacccccacagcaacccggaccagctaagccccctccacaacagccgggatctgccaagccaccatcgcagcaacctggcagcactaaacctcctcctcagcagccaggaccagccaaaccttcaccacaacagcctggatccacgaagcccccttcgcaacagcccggttctgctaaaccatccgcccagcagccatctcctgccaaaccaagcgctcagcagagtacaaaacctgtcagccaaacggggtccggcaagcctctgcagcccccaaccgtgtctccatctgccaagcagccccctagccagggcctccccaaaacgatttgccctctctgcaatacgacagagctccttttgcacgttcctgagaaggccaactttaacacctgcaccgaatgccagacgacagtatgttcactgtgtggattcaatccgaatccacacctgaccgaggtgaaggaatggctatgcttgaactgccagatgaagcgagccctcgggggagatcttgccccagtgccatcatccccgcagccaaagctgaagactgctcccgtgaccactactagtgccgtgtctaagagctctccacagccccagcaaacatccccaaagaaggacgccgctccgaaacaggacttgtcaaaggccccagaacctaagaaaccacctccgcttgtgaagcaacctacactccacggatccccctcagccaaggctaaacagccccctgaggcggactcgctgtctaaacccgctccccctaaggagcccagcgtcccttctgagcaagataaggcaccagtggcggacgacaagccaaagcagccaaaaatggttaaacccactaccgaccttgtctccagctcctctgccaccacgaaacctgatatccccagctcaaaggtacagtctcaggcagaggagaaaaccacaccgcctctgaagacagactcagccaagccctcccagagctttccaccaacaggggaaaaggtcagcccattcgatagcaaggcaatccctcgtcccgcaagcgattcaaagatcatttcccacccaggccctagctcggaatctaaagggcaaaagcaggttgatccagttcaaaagaaggaagaacccaaaaaggctcagacaaagatgagccccaagcccgacgctaagcccatgccgaagggctcacctacgcctcctggaccacgccctactgccggtcaaaccgttcccactcctcaacagtcaccaaagccacaagagcaaagtcggaggtttagtctgaatctcgggtctatcactgatgctcccaaaagtcagcccaccacaccccaagaaactgtgactggcaagttatttgggttcggggctagcattttctcacaggcctcaaacctcatctcgacagctggacagcctggaccccacagccaaagtggcccaggcgcacctatgaagcaggcccctgcgcctagtcagccacccacgtcccaggggcctcctaagagcactggacaggctccgccagctcctgccaaatctattccagtgaaaaaagagacgaaagcgcctgcagccgaaaaactagagcctaaagccgaacaggctccgacagtgaaacgaaccgagaccgaaaagaagccccctccaatcaaagattccaagagcctcaccgccgagccccagaaggccgtgctgcccaccaagctcgaaaaaagcccaaaacccgaatcaacttgtcccttgtgtaaaacggaattgaacataggctccaaggaccctcccaacttcaatacatgtaccgaatgcaagaaccaggtttgtaacctttgtggatttaatcccacacctcacttgacggagattcaggagtggttgtgtctgaactgtcagactcagcgagccatctctgggcaactaggcgatattcggaaaatgccacctgctccgtcaggcccaaaggcatccccgatgcccgtgcccaccgagtcttcttctcagaagactgccgtgcccccacaagttaagctagtgaagaaacaagaacaggaagtgaaaactgaagctgagaaggttattttggaaaaagtaaaagagacactcagtatggaaaagatccctcctatggttacaactgatcagaagcaggaggagagtaaacttgagaaggataaggcctcagcacttcaagagaaaaagccactgcccgaggagaagaagctaatacctgaggaggaaaagattaggtcagaggaaaagaagcccttgttagaagagaagaagccaacccccgaagataagaaacttttacctgaagccaaaaccagtgccccagaggaacaaaagcacgatttgcttaagtcccaggtacagatcgctgaggagaagctcgaaggtcgggtcgctccaaaaacggtgcaggagggaaagcagcctcagaccaagatggagggtttaccgagcggcacgccacagtctctacctaaggaggatgacaaaacgaccaagacaatcaaagagcaaccccaaccaccatgcaccgccaagcccgaccaagttgagcccggaaaagaaaagactgaaaaagaggacgacaagtcagatacttcctcttcccagcagccaaaatccccccagggtctgagtgatacgggctattctagcgacggcattagttcaagtctaggagaaattccctctttaattcctacagatgagaaggatattctcaaggggttgaagaaggatagcttcagccaggagagcagtccatcctcgccctctgatttggccaagctagagagtaccgtgctcagcatcctggaagctcaggccagtacccttgcagatgagaagtcggagaagaaaacacagccgcacgaagtctcccccgaacagccaaaggaccaggagaaaacacagtccctgagtgagacgctcgagattaccatcagcgaagaagagatcaaagagagccaggaggagcgaaaggacaccttcaagaaagactcacagcaggatataccttcctctaaggatcacaaagagaaaagtgagtttgtggatgacatcacaaccagaagagagccatacgattccgtggaggaaagcagtgagagtgaaaattctccagtgccacagagaaaaaggcgcaccagcgttggctcgtcatcctcggacgagtacaagcaggaggatagccagggttccggcgaggaggaggatttcatccgcaagcagataattgaaatgtccgccgatgaggatgctagcggatctgaggatgacgagttcattaggaaccagttgaaagagatctcttccagcactgaatctcagaagaaggaggaaaccaagggcaaagggaagatcacggccggaaaacaccggagactcaccagaaagtctagcacatccattgacgaggatgctggcagaagacattcatggcacgatgaggacgatgaggccttcgacgagtcccccgaactgaaatatagagaaaccaagagccaagagagcgaggagctggtggtgaccggtgggggtggtctgcgcagatttaaaaccattgagctgaactcaaccatcgctgacaaatactctgccgaaagttcgcaaaaaaagactagtttgtattttgatgaggagccagaactcgaaatggaatcactcacagacagtcccgaggataggtctcgcggtgaggggtcttcgtcactccatgcaagctcattcacacctggcacctcccccactagcgtttcaagtctggatgaggacagtgactcgtcaccatctcataaaaaaggcgagtcgaagcaacagcggaaggcgagacaccgtccccatggtcccctgttgcctaccattgaggacagctctgaagaggaggaacttcgcgaagaggaggagcttctaaaggaacaagagaaacaacgggaaattgagcagcagcagcgaaagtccagcagcaagaaaagcaagaaagacaaggacgagctgagagcccagcgcaggcgggagagacccaaaacaccccctagcaatctgtctccgattgaagatgctagccctacggaagagctgcgacaggccgctgagatggaggagttgcataggtccagctgtagcgaatactccccaagcattgaatctgaccccgaaggcttcgaaatctcaccagagaagattatcgaagttcagaaggtttataaactgccaacagccgtctctctgtattctccgactgatgaacagagcatcatgcaaaaagaggggtcgcagaaagccctgaaatctgcagaggagatgtacgaggaaatgatgcataagacccacaaatacaaggcttttcccgctgccaatgagcgcgacgaagtgttcgagaaagagcctctctacggtgggatgttgattgaagactacatttacgagagtctcgtcgaagacacttacaatgggtccgtcgatggcagccttctgacaagacaggaagaagagaacgggttcatgcagcagaagggtagggaacagaagatccgcctgtccgagcagatctacgaagatcctatgcaaaaaattaccgatcttcaaaaggagttctacgagttagagtcactgcacagcgtggtccctcaggaggacatagtgtccagttcatttataattcccgaatcacatgagatcgtcgacttgggtacaatggtaaccagcacggaagaggagcgcaaacttcttgacgccgatgccgcatacgaggagttgatgaagcggcagcagatgcagctcacgcccggttcgtcccccactcaggcccctatcggtgaagacatgactgagtccactatggatttcgatcggatgccggatgcctccctcacaagctcagtattatcgggtgccagcctgactgactcgactagcagtgccaccctgtccatccccgatgtcaagattacacaacatttctcaacagaagaaattgaggacgagtatgtgactgactacacacgagagatccaggaaatcatcgcgcatgagtccctcatcctcacctattcagaacccagcgaatcagcaacaagcgttccacccagtgataccccttctttgaccagctcagttagcagtgtatgtaccacggactccagctcacctattacaacactggactctatcacgaccgtttacactgagccagtggacatgattactaaattcgaagactctgaggagatcagctcaagcacttacttccctggctccatcattgactatcccgaggagattagcgtgtccctagatcgtaccgcaccacctgatgggagggcctctgccgatcatatcgtgatctctctgtcagacatggcgtcatctataattgaatccgtggtgcctaagcctgagggtccagtcgccgacaccgtgtccacagatctgctgatttctgaaaaggaccctgtgaaaaaggccaaaaaggaaaccggaaatggcataatcttagaagttctggaagcctacagggacaagaaagagctagaggctgagcggacgaaatcaagcctttccgagaccgtgtttgaccatccaccatcctctgtcatcgcactgccaatgaaagagcagctgtcgactacctacttcacctctggcgagacatttggccaggaaaagcccgcaagccagctgccctctggcagcccaagcgtgagttcacttcccgctaagcccaggccatttttccgttctagcagtctcgacattagcgctcagccccctcccccacctcctccacctcctccacccccacccccacctccgcctccaccgcctccgccacttcctccaccaacaagccccaagcccacaatcctgcccaagaagaagctgactgttgccagccccgtaactaccgctacccctctgtttgacgcagttaccacactggagacaaccgcagtgttacgctccaacggcctacccgtcacaagaatatgcacaacagctcctccgcctgtccccccaaaacctagcagcatcccctccggattggtgtttacacatagacctgagccaagcaaacctcccatcgcccctaaaccagtgatcccgcagctgcccaccactacccaaaagcctaccgatattcatcccaagcccacaggcttgtcactaacctccagcatgactctcaacctcgtaacaagcgccgactataaacttccaagccctacatctcctctgtctccacactctaataagtccagcccacgcttctcaaagagcctcaccgaaacttatgtggtgatcaccctgccgtccgaacccggaacaccaacagatagcagtgcttctcaggctatcactagttggccccttggcagtccctcaaaggatctagtatctgtggagccggtgttttcagtagttcccccagtaaccgcagtggagatccccatatcaagcgagcaaaccttctacatctctggagctctccagacatttagcgcgactcctgttacagccccttcgagttttcaggctgctcccacaagtgtgacccaatttctaactaccgaggtgtccaagacggaggtctccgccactcgctcaacggccccttctgtgggcctctcttccatcagtattaccattcctccagaacctttggcactggataatatacatttggaaaagcctcagtacaaggaggacggaaagttgcaactcgtgggggacgttatcgacctgagaacagttcctaaagttgaagtaaaaacaaccgataagtgcattgatttgagcgcctctactatggacgttaagaggcaaattacagccaacgaggtctatgggaaacagatcagtgctgtgcagcccagtattatcaacctgtccgtcactagttcgattgtgactcccgtgagcctggctactgagaccgtcacctttgttacatgtactgctagcgcttcctacaccacgggcaccgagagtctggtgggtgctgagcacgccatgactactcctctccagctgaccacaagtaagcacgcagaacctccatataggatcccctcggatcaagttttccctatcgcaagagaggaagcaccaattaacctgagcttgggtacaccagcccatgctgttacactcgctattaccaagcccgtcaccgtgcccccagtgggcgtaacgaacggatggacagacagtacggtatcccaaggtatcacggacggcgaagtggtcgacctgtctacaactaagtcacataggactgtcgtcaccatggacgaatccactagctccgtgatgacaaagattatcgaggatgagaaaccggtggatctaaccgccggacgcagagccgtgtgttgcgacgtggtgtacaaactgccatttggaagatcttgcactgcccagcaacctgctaccacattaccagaggacaggtttggttatagggatgaccactaccagtatgatagatctggaccctatggctatcggggaattggtggaatgaagccaagcatgagcgatacgaatctcgctgaagccggtcactttttttacaaaagcaaaaatgcatttgactatagcgaagggacagacaccgccgtggacctcacatctgggcgagtgactacgggggaggtcatggactattcttctaagacaacaggcccatatcctgagacgaggcaggtaatttccggggcaggaatctctaccccccagtactcaacagctagaatgaccccaccccctggcccacagtactgtgtaggctctgtcttgcgtagttctaacggagtggtttacagctccgtcgctactccaacacccagtacattcgcaataaccacgcagcccggaagtatcttcagtaccaccgtgagggatttgtcaggaattcatacagcagacgccgttacttccctgccagccatgcaccatagtcagcccatgcctcgttcctactttattaccactggcgcttcagaaaccgacatcgcagtgaccggaatcgatatttctgcatccctgcaaaccatcacaatggagagccttactgctgagactatagactcagtgccaacgttgacaactgccagcgaagtgtttcctgaggtcgtaggtgatgagtcggctctgctgatagtacctgaggaggacaaacaacagcagcaattagatctagagagggaactgctggagctggaaaagataaagcagcagaggtttgctgaggaactcgagtgggaacggcaggaaatacagcgattccgggagcaggaaaaaatcatggtgcagaaaaagctcgaggagcttcagagcatgaagcagcacctgctcttccaacaggaagaggagcgccaagcccagtttatgatgagacaggaaaccctcgcgcagcaacagcttcagcttgagcagatccaacagctgcagcagcagctccaccaacagttggaagaacagaagattcggcaaatttaccagtataattacgaccctagcgggaccgcttccccacaaaccactaccgagcaagcgatcctggaaggtcaatatgccgcactggaaggttcccagttttgggccactgaggacgccaccacaaccgcctccgcagtggtggccatcgaaatcccacaatcacaggggtggtatacggtgcagtccgacggtgtgacacagtacatcgcccctcctggaatcctgagcactgttagcgagataccgttgactgatgtagtggttaaagaagaaaagcagcctaaaaaaaggtcaagcggagctaaggtaaggggacagtacgatgacatgggagaaaatatgaccgatgacccgaggagttttaaaaaaattgtggactctggggtgcagacggatgacgaggacgccaccgaccggtcctacgtctctcgcaggcgcaggacgaagaaatccgtggacacctcggtgcagactgacgatgaagatcaggatgagtgggatatgcccacgagaagtcgtagaaaagcacgcgtgggcaagtatggtgactcaatgacagaagctgacaaaacaaaaccactctcgaaggtgtcttcgattgctgtccaaaccgttgctgagatctccgtccaaacagagcctgtcggaacaattcgcacgcctagtatcagagcacgtgtggacgcaaaagtggaaatcataaaacacatatcagctccggagaagacctacaaaggcggaagtctcggctgccagacagaggccgactcagacacacagtccccacagtacctctctgcaacaagtccaccaaaggacaaaaagcgccctactcctctggagatcggctattctagccacctgcgggctgactcgacggtccagctcgcccctagccccccaaagagtcccaaggtcctgtatagtcctatttcccctctatcgcccggaaaagccttggaatccgccttcgtgccttatgagaagccactgcccgatgatatctctccacagaaagttttgcatccagatatggcaaaggtgccgcctgcctctccaaaaacagccaagatgatgcagcgcagcatgagtgatcccaaaccactcagccccacagccgatgaatccagtcgggctcctttccagtacaccgagggatatacgacgaaggggagtcagacaatgacaagcagtggcgcacaaaagaaggtgaaaaggactctgccaaacccgccaccagaagagatcagcactggcacgcagtcaacgtttagcacaatgggcactgtctcccgacgcagaatttgtcgaactaatacaatggctcgtgctaaaattctgcaagacatcgacagagagctagatcttgtggagcgggaaagtgccaaattgaggaaaaagcaggccgagctggacgaagaggaaaaggagatcgacgccaagttgaggtacctggagatggggatcaacagacgcaaggaggccctgctgaaagaacgcgaaaaacgcgagcgcgcataccttcaaggagtagcggaagatagggattacatgagcgactctgaggtgtcaagtacccgcccaacccgcattgaatcccagcacggcatcgaacgtccccgaacagcacctcagacagagttctcacagttcattcctccccagacccaaaccgaatctcagctggtcccccctacgagtccatacacccagtaccaatacagcagccccgctcttcccacacaggcgcctactagctacacacagcagagccacttcgaacaacagactctctatcaccagcaggtgtctccgtaccagacccaacctacctttcaagctgtggctactatgtcttttacaccacaggtgcaacccaccccgaccccccaaccatcttaccaactcccatcccaaatgatggtgatacagcagaagcctagacagaccaccctctatttggagccaaaaatcacctccaattacgaagtcatccgcaaccaacccctcatgattgcacctgtctcgacagataatacatttgctgtcagtcatctgggtagcaaatataactccttggacctcagaattggacttgaagaacgcagctctatggcctcatcacccatctcatccattagcgctgacagcttttacgcagacatagatcatcacacaccaaggaattatgtgctgatagacgacatcggtgaaatcactaagggcacagcggctttgtcaaccgcgttttcgttgcatgagaaagacttaagcaagaccgataggctgctgaggactacagagactagaagatctcaagaggtaaccgatttccttgcaccgctgcaaagctcatctcgcctgcactcctacgtaaaagccgaggaggatccgatggaggatccgtacgagctcaagctgctcaaacaccagataaaacaggaattccgaagaggaactgagagccttgatcatctggctggactgtctcattattaccacgccgacactagctacagacatttccctaaatctgagaagtacagtatctcccggctgaccctcgagaagcaggctgctaagcaattaccggctgctatcctgtaccagaaacagtcaaaacacaagaagagcctgattgaccctaagatgagcaaatttagcccaatccaggaatctcgtgacttggagccagattattcctcatatatgacaagctctactagcagtatcggtgggatttcaagtcgcgcaagactgttgcaggacgatatcacgttcgggctgagaaaaaacatcactgaccagcagaagtttatgggtagcagcctggggacaggacttggcaccctggggaatacgattaggtcagccctgcaggatgaggcagacaagccatacagttctggttcacggtcccgtccctcctccaggcccagctcagtgtatgggctggatctatcaatcaagcgagactccagctcttcaagcctcaggcttaaggcccaggaagcagaggccttggacgtttccttttcccacgccagctcaagtgcaagaactaaaccaactagcttgcccatctcgcaaagcagaggcagaatccccatcgtggcccagaattctgaagaggaaagcccactgtctccagttggccagcctatgggcatggcacgggcagcagctggcccactgcccccaatctccgctgatacccgcgatcagttcggatctagccattccctgcctgaagtgcagcaacatatgcgggaggagagcagaacgagagggtacgaccgagacattgcctttattatggacgattttcagcatgccatgagtgacagcgaggcatatcatctgagacgagaagaaacggattggttcgataagccacgtgaaagccgcctggaaaacggccacgggctcgaccggaaactgcctgaacgcctggtgcatagcaggcccctgtcgcagcatcaggagcaaatcatccagatgaacggcaagacaatgcactacatctttccacatgcgaggatcaaaatcactcgcgattccaaagatcacacagtatccggcaatgggctgggcataaggattgtgggaggaaaggaaatcccgggtcacagtggcgagatcggcgcatacatcgcgaaaatcctgccaggcggttccgcagaacagacagggaaactgatggagggcatgcaggttttggaatggaacggtatacccctcacctccaaaacttacgaagaggttcaatccatcatctctcagcaaagtggggaggcagaaatttgtgttaggttggacctgaacatgctaagcgactccgaaaattcccagcatctcgaactgcacgagccacccaaagccgtcgataaggcaaaatcccctggtgtagacccaaagcagctggccgctgaactacaaaaggtgagcctgcagcaatcccccctggtgctgtcctcagtggttgaaaagggctcacatgtgcattctggcccaacgagcgcgggatctagctccgtgccatcacctggacagcccggttctccgagcgtcagcaagaagaagcatggctcctccaaacccaccgatggaacaaaggtcgtgtctcaccctatcacaggggagatacagttgcagatcaattacgatttggggaatcttatcatccacatcttacaagctcgcaatttagttccgagggataataacggatatagtgatccctttgtgaaggtatacctgctccctgggaggggacaggtaatggtggtacagaacgcttcagcggagtataagcggaggactaagcacgttcagaaatctcttaatccagaatggaaccagacagtgatctataaatctatctcaatggaacaactcaagaaaaaaactttagaagtcaccgtgtgggattacgatagattttcgagcaacgatttcttaggagaggtgcttatcgacttaagttcaactagccacttggacaacacgccgagatggtacccgctaaaggagcagacagaatccatcgaccacggcaagtcccattcttcccagtcttcccagcagtcccccaaaccatccgtcatcaagagccggtcacacgggatttttccagaccccagcaaagacatgcaggtgcctacaattgagaagtctcattcctcccccggatcatcgaagagttccagcgaaggccatctcaggtcccacggccctagccgatcgcaatccaaaacatccgttactcagacccacctggaagatgccggagccgcaatcgccgcagccgaggctgcagtgcagcagctgcggattcagcccacgaaacccccaaaccaccggcctgcagagtcttccgtctccaccggtagctctggttctagctttggttctggatactcggtcgatagcgaaggctcctcgtcgaccgcaggcgaaaccaacctcttccctataccaagaattggaaagatgggtcaaaatggacaggaaccagtgaaacagccgggagtaggtgttggcctggcagatacagaagccaagacccaggtcatgggagaaattaaaattgcactcaagaaggagatgaaaacagacggggagcaattgatagtggagatactccagtgcaggaacatcacctataaatttaagtcgcccgatcatctacccgatctctacgttaaaatctacgtgatgaatatctccacccagaagaaggtgattaagaaaaaaactcgggtgtgtcggcatgacagggagccctcttttaacgaaacctttaggttttccctctctccggctgggcacagcctgcaaattcttctgttcagcaatggagggaagttcatgaagaagaccctgatcggcgaagcctgcatttggctcgataaggtcgatctgcgaaagcgaattgtcaattggcacaagctgctcgtgtcgccgacccagacccattaa

SEQ ID NO: 235052 - DNA, 1269 bp, Artificial Sequence
  Description of Artificial Sequence: Synthetic coding sequence
acgaaagtttggaattctaatgggctgggaatacgaatcgtgggcggaaaagagattcccggacattcgggggagatcggggcatatatcgccaagattcttccagggggatccgctgaacagaccggtaagctcatggaagggatgcaagtgttagagtggaatggtattcccctgacctctaagacctatgaggaagtgcaatcaatcatcagccagcagtctggcgaggcagaaatctgtgttcgcctggatctgaatatgctctctgatagtgagaattcacaacacctggagctacatgagcctcccaaagctgtagataaagccaaaagcccaggtgtcgaccccaagcaattagcagccgaattgcagaaagtcagtctccagcagtcaccactcgtgctgtcttccgttgttgagaaggggtctcacgtccattctgggccaactagcgctggttcttcgagtgtaccatcccccggacagcctggcagccctagtgtgtccaaaaaaaagcacggctccagcaagcccacagacgggacaaaagtcgtcagccatcccatcaccggcgaaattcagttacaaatcaactacgatctggggaacctaattatccatatcctgcaagcaaggaacttggttcctcgtgataataatggctacagcgacccgtttgttaaagtctacctcctgcccggacgaggtgctgaatacaagcggagaactaagcacgttcaaaagagcctgaatccggaatggaaccagaccgtcatctacaaaagtatttctatggagcagctcaaaaagaaaactctagaagtgactgtgtgggattacgaccggttcagctccaacgattttttgggggaggtgctcatcgaccttagcagcacatcccacctcgacaatactcctagatggtaccctctgaaagaacagacagagagcatcgatcatggtaaatcccactcctctcagtcaagtcagcagagccccaaaccttccgtgatcaagtctcgctcccatggcattttccctgacccatcaaaggacatgcaggtacctactattgagaaaagccactcctcccccggtagcagcaagagctcctccgagggccatctccgttctcatggcccatcaagaagtcaaagcaagacaagcgtgacccaaacacaccttgaagatgcaggcgctgccattgccgctgcagaagcagcagtacagcagctccgaattcagcctagcaagaggaggaaatag

SEQ ID NO: 235053 - DNA, 14808 bp, Artificial Sequence
  Description of Artificial Sequence: Synthetic coding sequence
atgggcaacgaggcatctctggagggtgaagggctgcctgagggtctcgctgccgctgctgcagcaggcggtggagcctccggcgcagggagcccatcccacaccgctattccagcgggtatggaggcagatctttcacaactcagtgaagaggaacgtcggcaaatagctgcagtgatgagtagagcccagggcctgccaaaaggaagcgtgccgcctgccgctgcagaatctcctagcatgcatagaaaacaggaactcgactcctcccacccaccaaagcagagcgggaggccgccagacccagggaggccggctcagcctggtctgagcaagagtcgtacaactgacaccttccgctcagagcagaagttgcctggccgaagtccaagtactattagcttgaaagaatcaaagtcacggacagatctgaaggaggagcataagagctctatgatgcccggatttctgagcgaagtgaacgcgttgtcagccgttagctccgtagtaaataaatttaaccctttcgacctgatctctgactctgaggcctctcaggaagagacaacaaaaaagcagaaagttgtccagaaggaacaaggaaaacctgaaggtataatcaaacctcccttgcagcagcagcccccaaaacccattccgaaacaacagggacccggtagagatcctcttcaacaagatgggacccctaagtcgatcagtagccagcagcctgaaaaaatcaaaagccaacccccaggaactgggaagccaatccagggcccaacccaaactccccagaccgaccacgctaaattgccactccaacgtgacgcctctagacctcagaccaagcaggcagacattgtccgaggggaatcagtcaagcctagcttgccaagcccctccaaaccgcctattcagcagccgacccccggaaagccacccgctcaacagcctggacatgagaaatctcagcctggccctgccaagcctcctgcgcagccttccggtttgactaagcctttggcccagcaaccaggcactgtcaaaccacctgtgcagccgcctgggaccacaaagcctccagcccagccgctcggaccagctaaaccaccagcgcagcagaccggtagcgagaagccttcttcagaacagccaggtcccaaggcgttagctcagcccccaggcgtgggcaagactcccgctcagcagccaggcccagccaaacccccaacacagcaggtcggaactcctaagcccctggctcagcagccagggctccagtcacccgctaaagctcccggacccacaaaaaccccggtccagcagccgggacccggtaagattcccgctcagcaagcgggaccagggaagaccagtgctcagcagacaggcccaaccaaaccgccaagccagttgccaggtccagcgaaaccaccgccacagcagccgggtccagcaaaaccgccaccacagcagccgggatcagcaaagccgcctagccaacagccaggcagtaccaagcctccaccgcagcaacctgggccagcaaaacccagcccccaacagcctggaagcactaaaccacccagccagcagcccggttcggctaaacctagtgcccaacagccaagcccagccaagccatctgcacaacagagtacgaagcctgttagtcaaactggatctggtaaaccactacagccacctactgtctccccttctgccaagcaaccgcctagtcagggattacctaagactatctgtccgttatgcaacactactgagctgttgctacacgtccctgagaaagcaaactttaatacatgcaccgagtgccagactaccgtgtgttcactgtgcggatttaacccaaatcctcatttaactgaggtaaaagaatggttgtgccttaattgccaaatgaaacgggctttggggggagacctggccccagtccctagcagccctcagcctaagttgaagaccgcacccgtgacaaccacgtctgcagtgtccaaaagttctccccaacctcagcaaacaagccccaagaaagacgcagccccaaaacaggatctcagcaaagcacccgaaccaaaaaagccccctcctctagtaaagcaacctaccctgcacgggtcgccatctgcaaaggcgaagcagccaccggaagctgatagcctgagcaaacctgcccctccgaaggaaccttccgtcccatcagagcaggataaagcacctgtcgcagatgacaagccaaagcagccaaagatggtcaagcctaccactgacctcgtgtcatcctctagtgccactactaagcctgatattcctagttcaaaggttcaaagtcaggcggaggaaaagactactcccccactgaagacggattctgcaaaaccctctcagtcatttccaccaaccggagagaaggtgtcgccattcgatagcaaagccattccaaggcccgcttctgatagcaagataatatcccatcctgggcctagcagcgaatccaaagggcagaagcaggtcgacccggtgcagaagaaggaagaacccaaaaaagcacagactaagatgtctcccaaacccgatgccaagccaatgccaaagggaagcccaacacctccgggtcctaggcccacagccggacaaaccgtaccgacaccgcaacaatcccccaagccccaggagcaaagcaggaggttttcgctgaatctcggcagtatcactgacgccccaaagtctcaaccaaccacaccccaagagacggtgactggaaagttgttcggctttggggcttccatcttctcccaagcctctaacctgatcagtactgctgggcagccagggccacattcccagtctggtcctggagctccaatgaagcaagccccagctccatcccagccacccacttctcagggtccaccaaagtccacaggacaggcaccccctgcaccagccaagtccatcccagtaaagaaggagaccaaggcccctgcagccgagaagctggaaccaaaggcagagcaagccccaactgtcaaaaggactgaaaccgagaaaaagcctccccctattaaggactctaaaagcctgacagccgagccacaaaaggccgtgttaccaaccaaactcgaaaaaagtcccaaaccagaaagcacctgtccgctgtgtaaaactgaattaaatattggctctaaggaccctcccaattttaacacctgcactgagtgtaaaaaccaagtttgcaacctgtgcggatttaaccccaccccccacctgactgagattcaggaatggttgtgtctcaattgtcagacacaacgtgccatctctggacagctgggtgacattcggaagatgcccccagctccttcagggccaaaagccagtccaatgcctgtccccaccgaaagctcctcccagaagaccgctgtcccaccacaggtgaaactggtgaagaagcaggagcaggaagtaaaaaccgaagcggaaaaggttatcttagagaaggtgaaagagaccctgagcatggagaaaattcctcccatggtgaccaccgatcagaaacaggaagaaagcaagctggagaaggacaaggcgtccgcattacaggaaaaaaagccactccccgaggagaaaaaactgattcctgaagaagagaagatccgcagcgaggaaaagaagccactgttagaggagaagaaacccactcccgaggataagaaactgttgcctgaagccaagacaagcgctcccgaggaacagaaacatgacttgcttaagagccaggtgcaaattgctgaggaaaaactagaaggtcgcgtggctcccaaaaccgtccaggagggcaaacaacctcaaactaagatggagggcctgccgagcggaacacctcaaagcctgcccaaggaggacgacaagaccactaagaccatcaaagaacaacctcagccaccctgtactgctaaaccagaccaggtggagccaggtaaggaaaagacggagaaagaagatgataaatcagacactagctcgagccagcagcccaagtcaccccaagggctctcagatacaggatattcctctgatggcattagctcatcgctcggtgaaatccccagtttaatcccgactgacgagaaggacatcctgaaaggcctgaagaaggactctttttctcaagaatcaagcccctccagcccttcggatctggccaagctcgagagcaccgtactgtccattctggaggcacaggcctcaactctggctgacgagaagtcggaaaagaaaactcagccgcacgaggtgtccccagagcagcccaaagatcaagaaaagacccagtccttgagcgaaactctggaaatcactatcagcgaggaggaaattaaagagtcccaggaggagagaaaagacacattcaagaaagatagccaacaggatatcccctcttccaaggaccataaggagaaatctgaatttgtcgatgatatcacaacccgtagagagccatacgattcagttgaggaaagctccgaatcagaaaactcacccgtgccacagcggaaacgccgaactagcgtcggttcctctagcagcgatgagtacaagcaagaggactcacaaggctctggtgaagaagaagatttcattcgaaaacagatcatcgaaatgtccgctgacgaagacgcctctggatctgaggacgatgagtttataaggaatcagctgaaagaaatctcaagctcaacagagagccaaaagaaggaagagactaaaggcaagggaaagatcacggcgggaaagcacaggaggctgacccgaaagagtagtactagcatcgacgaggatgcaggcaggcgacattcttggcacgacgaagacgacgaggcctttgatgagtctcctgagctcaagtaccgcgagacaaaaagccaggagagcgaggagctggtggttacaggaggagggggtctgcgtcggtttaaaaccatcgagctgaacagtacgatagccgacaaatactcagcagagagctctcagaagaagacatctctttactttgacgaggaaccggaattagaaatggaatccctcaccgacagtcccgaagatcgcagtcggggagagggtagctccagtcttcacgcttctagctttacaccgggtacaagccccaccagtgtgtcatccctggacgaagactccgattcatccccgagccacaaaaagggggaatcaaagcagcaaaggaaagcaagacatcggccacatggacccctgcttccgacaatcgaagatagcagcgaggaagaggaattgagggaagaagaagagctgctgaaggagcaagagaagcagcgggaaatcgagcaacagcagaggaagtcctctagcaagaagtccaaaaaggataaagatgagctgcgcgcacaaagaaggcgggagagaccgaaaacgcccccatcaaacctctcccccatcgaggatgccagtccgacagaggagctgagacaggcagctgagatggaagagctgcaccgcagtagttgttcagaatacagcccaagtatagagtccgacccagaagggttcgagatttctccagagaagatcattgaggtgcagaaagtgtacaaacttccgactgcggtgagtctgtacagtcccacagatgagcagagcattatgcagaaagagggaagccagaaggctctgaagagcgctgaagaaatgtacgaagagatgatgcacaagacccacaagtacaaggccttccctgctgccaatgagcgggacgaagtgttcgagaaagagcccctgtatggtggaatgctgattgaggactacatttatgagagcttggttgaagatacgtacaacgggagcgtagatgggagcctgctgacacggcaggaagaggaaaatggatttatgcagcaaaagggtagggagcagaagattaggctaagtgaacagatctatgaagaccccatgcagaagattaccgacctccagaaggagttctacgaactggagtctcttcactctgtcgtgccacaggaggacatcgtgagttcaagttttataatccctgagtctcatgagatcgtggaccttggtacaatggttacaagcactgaggaggagcggaagctcctggatgcagacgccgcatacgaagagctgatgaagcgtcagcaaatgcagctgactcctggatcatcccctacccaggcgccaatcggcgaagatatgaccgagtcaacgatggactttgatagaatgcccgatgccagcttgacctcgtcagtgctgtccggggcttctcttaccgattctacttcttcagctaccttatctatcccagatgttaaaatcactcagcacttctcaacggaagagattgaggacgagtacgtcacagattatacgcgggagatccaagaaattattgcccacgagagccttatactgacttatagcgagccatccgaaagtgcaaccagcgttccaccttcagatacccccagcctgaccagttcagtgagtagcgtgtgtactaccgattctagttctccaattacaaccttggattcgattaccacagtgtacaccgagcctgttgacatgattacaaagttcgaagattccgaagaaatcagctctagtacctatttccctggcagcattatagactatccagaagagatttccgtcagtttggaccgtacagcgcctcctgacggcagggccagcgctgatcatatcgtcattagcctgagtgatatggcatccagcataattgaatcagtggtgcccaagccagaggggccagtggccgacactgtttcaactgacctgctaataagcgaaaaggatcccgttaaaaaggctaaaaaggagactggaaatggtattattctcgaagtacttgaggcctatcgggacaagaaggaactggaggccgagagaacaaaaagcagcctgagcgagacagttttcgaccatcctccaagttccgtgattgcgctgcctatgaaagaacagctgagcaccacctactttacgagcggcgaaacatttggccaggaaaagccagcctcacagttaccttcaggaagcccctctgttagtagcctgccagctaaaccgaggccattttttcgctcctcaagtctggacatctccgctcagcccccaccacccccaccgcctccaccccctcctccaccacctccacccccacctcctccacctccacttccccctccaaccagcccgaagcctacaatcttacccaagaagaagttaacggtcgccagtcctgtgactacagctaccccattatttgacgccgtcacgacactggaaacgacggcagttctgaggagcaatggcttaccagtaaccaggatatgcacaaccgcccctccaccagtgccacccaagccatcctctattccctctggcttggttttcacacatcgccctgagccctcaaaaccaccaatcgcccctaaacctgtgatcccccagctaccaacaaccacccaaaagcctaccgacatccaccccaaacctacgggccttagcctgacgtcgagcatgaccctcaacctggtgacgtccgccgactataagctgcccagccccacttctccactttccccccattccaacaagtcctccccaagattcagtaagtcactaaccgagacatacgtggttatcaccctgcccagtgagccaggcactccaaccgatagttcagcatctcaggcaataacatcatggcctttgggaagcccttccaaggacctggtttctgtggagccggtgttcagcgtggtacctcctgtgaccgccgtcgaaattccaatctcctctgagcagacgttttacatctccggagccttacagaccttctcagcaacgccggtgactgcgccaagctcctttcaagctgcccctacatcagtgacccagtttttaactaccgaagtgtccaaaaccgaggtgtccgccactcgaagcaccgcgccatccgtcggcctgagctctattagtataaccattccgcctgagcccctagctctcgacaacattcatttggagaagccacaatacaaggaggacgggaagttgcagctcgtgggcgatgtaatcgatctgaggacagtgcccaaagtggaagttaaaaccaccgacaagtgtatcgacttgtccgcatcaaccatggatgtcaaaaggcagatcaccgccaatgaggtgtatgggaagcagatctcggctgtgcagccctccatcattaacctgtccgtgaccagctccatagtgacacctgtgagcctggctaccgaaacagttacattcgtaacctgtactgctagtgccagctatacgactggtacagagagccttgttggagctgagcatgccatgaccacccccctgcagttgactacttcaaagcatgctgagcctccctaccgcatcccatcggatcaggtgttcccaattgctagggaggaggctcccataaatctgtcactaggcacccccgcacatgctgttaccctggccatcaccaaacctgtcaccgtgccgccagtgggggtaacgaatggctggactgactccacggtgtcccaaggcattacagacggcgaggtggtagacctcagcaccaccaaatctcacagaaccgtagtcacaatggatgagtccactagttccgtcatgacaaaaatcattgaggacgagaaaccagtggatctgaccgccggaaggagagccgtgtgctgtgacgttgtgtacaagctgccatttggtaggtcttgcacagcacagcaaccagctacaaccttgcctgaggacaggttcggatacagggatgatcattaccagtacgatcgatctgggccatacggctatcgtggaatcgggggtatgaaaccctccatgtccgacacgaatctcgccgaggctggtcattttttttataagtccaagaatgcttttgactactcagagggaacggatacagccgtcgacctcacctccgggagggtgactaccggggaagtgatggattactcgtcaaagaccaccggtccctaccccgagacacggcaggtcatctccggagccggaatcagcacaccacagtacagtactgcgcgaatgaccccccctcccggtcctcagtactgtgttgggtccgtgttgcgctcaagcaacggcgtggtgtactcttctgttgcaaccccaactccatctactttcgcaattaccacccagccgggatcgattttcagtacaactgtgagggatctcagcggaatccacacggctgatgccgtcactagtcttccagcgatgcaccactcacagcctatgccaagaagctactttatcactactggggctagcgagaccgacatcgctgtgaccggcattgatatttctgccagcctgcagacaataacgatggagagcttgaccgccgagacgatcgattccgtccctaccctaactactgccagcgaggtgttccctgaggtcgtgggagacgaatccgcactgctgatcgtgcccgaggaagataagcagcagcagcagttagatttagaacgcgagttgctggaactcgaaaaaattaaacaacagcgatttgcagaggaattggagtgggagcgccaggagattcaacgctttagggagcaggagaaaattatggtgcaaaagaagttggaggagctgcaatcaatgaagcagcatttactcttccagcaggaggaggagagacaggcacagttcatgatgcggcaagagactctcgcgcaacaacagctacagctggagcagattcagcaactgcagcagcagctgcatcagcaattggaggagcaaaaaatccggcagatttatcaatacaattacgaccctagtggaacggcttctccccagacgactacagaacaggctatcctggaagggcaatacgccgctttggaagggagccagttctgggccacagaggatgccacaacaaccgcttcagccgtagtcgcaatcgaaatcccacagtcccaggggtggtataccgtgcagagcgacggggttacacaatacattgcgccacctggtattcttagtacagtttccgagattcctctcacagacgtggtggtgaaggaagaaaagcaacctaagaagcgctcctccggcgctaaagtccgaggacagtatgacgatatgggagagaacatgactgatgacccgcgttcctttaaaaaaatcgtggatagcggagtccagaccgacgatgaagatgctacagaccgtagctatgtatccagacggaggcgaaccaagaagtccgtggatacatccgtccaaacagacgacgaggaccaagatgagtgggacatgcctactagaagccggaggaaggctcgggtcgggaagtatggcgattctatgactgaagcggacaaaacaaagccactgagtaaggtgtccagtatcgccgtccagaccgtggccgagatctcggtgcaaactgagccagttggcaccatccgcacgcccagcattcgggcacgggtggatgccaaggtagaaatcatcaagcacattagcgcgccagagaagacttacaagggaggctctctgggatgccagacagaggcagactcagacacgcaatccccacagtatctatcagccacttcaccacctaaggataaaaagaggcccactcccctggagatcgggtatagctcccatcttagggccgactccactgtccaactggcaccatccccacccaagtcacctaaagtgctttattcaccaattagcccacttagccccggaaaagcactagaatctgcatttgtgccatacgagaagccgcttcccgacgacatctccccccagaaagtgctgcatcctgatatggccaaggtgccccctgccagcccgaaaaccgccaagatgatgcagcgcagtatgagtgaccccaagccactgtcacccactgccgacgagagtagccgggcaccattccagtacactgagggttacaccaccaaagggagtcaaacaatgaccagtagtggcgcacagaaaaaagtcaaaaggaccctgcccaatcctccacccgaagagatctcgacagggacccagagcacgttctctacgatgggaaccgtgtccaggaggcgcatttgcaggactaacacaatggccagggcgaagatcctgcaggacatcgatcgggaactggacctggtggagcgagaatcagctaaactccgaaagaagcaagccgaattggatgaagaggaaaaggagatcgacgcaaaacttaggtatttagagatgggtatcaaccgacggaaggaggcgctgctaaaggagagagagaagcgggagcgcgcatatttgcagggagtcgcggaggacagggattatatgtctgactctgaggtgtctagcactcgccctactcgcattgagtcacaacacggaattgagcgcccacgcactgccccacagactgagttctctcagttcatcccaccccagacccagacagagagtcaattggtccctcccacatcaccatacactcaatatcagtactcttcacccgctctgcctacacaggctcccactagttatacacagcaatcccactttgagcagcagaccctatatcaccaacaagtctcaccatatcagacccaaccaacattccaggccgtcgccaccatgtctttcacaccccaagtgcagcctacccccacaccacagccctcctaccagcttccttcgcagatgatggttatccagcagaagccgcgtcaaacaacgctctacttagagccgaagattacatcaaattatgaagtgatccgtaatcagccactaatgatcgctccggtgagtaccgacaatacctttgcagtgtcacatctgggatctaagtataactccctggatttacgcatcggccttgaggagcgaagttcaatggccagcagtcctatttcatccatttctgctgactctttctatgccgatatcgatcatcacactccgagaaactatgtactgatagacgatatcggtgagattacaaaggggacagcagctttgtctaccgcctttagcttacacgaaaaggatctgtccaaaacagaccggcttcttcgcacaactgagacaagacggtctcaggaggtgacagactttctcgccccactccaaagctcttcacggttgcactcatatgtgaaagcagaggaggaccccatggaggacccttatgaacttaagctactgaaacaccagatcaagcaggaatttagacgaggcaccgagtccctggaccacttagccggtttgtcgcactactaccacgccgataccagttatagacatttccccaagtctgagaaatattcgatcagtcgcctcacacttgagaagcaggcagctaagcagctgccagctgcgatcttgtaccaaaaacagagcaaacataaaaagtctctcatcgacccaaaaatgtccaaatttagcccgattcaagaatcaagagaccttgaacctgattacagcagctatatgacaagcagcacgagtagcattggcggaattagctctcgcgctagacttctgcaagacgatatcacctttggcctgaggaaaaacataaccgatcagcagaaattcatgggctcgagcctggggacagggctgggaacgctcggaaatactatcagatccgccttacaggatgaggccgacaaaccatattcttctgggtcccgctctagacccagcagcagaccttcatcggtttacggcttggacctaagtattaaaagggactcttcctctagttcgctgaggctgaaggcccaggaagccgaggccctggacgtttcattcagccatgcctcttctagcgcccgaactaaacctacgtcgctgcccatctcccagagtagaggcagaatccctattgttgcacagaactctgaggaagaatccccactgtctccagtaggccagcccatgggcatggccagggccgcagctggaccattgcctccgatctctgcagatacccgcgaccagttcggctcttcccactctcttcccgaggtgcagcagcatatgcgggaggagagccgaacccgcggatatgaccgcgacattgcttttattatggatgacttccagcatgctatgagtgactctgaggcctaccatctgagacgcgaggaaaccgattggttcgacaagccacgggagagcagattagagaacggacacggactggaccggaaactgcctgagaggttggtgcattccaggcccttatcacagcatcaagagcagatcatccagatgaacggcaaaactatgcactatattttcccacacgcacgtattaaaattaccagagactctaaagaccatacagtttccgggaacgggttaggcatccgtattgtcgggggaaaggaaatccccggtcactccggagagattggggcatatatcgccaagatactgccaggtggttctgccgaacagaccggtaaactgatggaaggcatgcaggtgctcgaatggaatgggatccccctcacatccaagacgtatgaagaggtccagtctattatctcccagcagtccggcgaggctgagatctgtgtgagactggacctcaatatgttgagcgactccgaaaattctcaacacctggagctgcatgaaccgcctaaggctgtcgacaaggcgaagtcacctggggtggatccaaagcagctcgccgcagagctccagaaagtatccttgcagcagtcgcccttggtccttagcagtgtcgtggaaaaaggaagtcacgtgcactctggacctacctcagctggaagttccagcgttccgagtcccggtcagcctggctcacctagcgttagcaaaaaaaagcatgggtcttccaaacctaccgacggcaccaaggtggtgagccaccccatcacgggtgaaattcagctgcagatcaactatgaccttggaaatttgattatccacatcctccaggcaaggaacttagtgcctagggataacaacggctattcagacccatttgtcaaagtgtacctcctgccaggtcggggacaggttatggtggtccagaacgcctccgcagagtacaaacgtcgaaccaagcacgttcaaaagtctctgaaccctgaatggaaccagactgttatctacaagagtataagtatggagcagctcaagaaaaaaactctggaggtgacagtctgggattatgatcggttttcctctaatgactttctaggagaggtgctcatagatctgagcagcaccagccacctggataatacaccaagatggtatcccctcaaagagcagacagagtctatcgaccacggaaagagccattcctctcagagtagccaacagtctcctaaaccaagcgtgatcaaatcaaggtcacacggcattttcccggatccatcaaaagacatgcaggtccccactatcgagaaatctcacagcagccctggtagtagcaaatccagctccgaggggcatctgaggtctcatggaccctccagaagccagagtaaaacctccgtgacccaaacacatctcgaggatgcgggagccgcaattgcagctgcagaagcagccgtgcaacaactgcggattcaaccaagtaagagaagaaagtag

SEQ ID NO: 235054 - DNA, 10908 bp, Artificial Sequence
  Description of Artificial Sequence: Synthetic coding sequence
atggggaatgaggcctccctcgaaggggaaggactgcccgagggactggctgccgctgctgccgctgggggaggcgcttccggtgcaggaagcccatcccataccgcaataccggcaggcatggaagctgatctgagtcaactctcagaggaagagagaagacagatagcggcagtgatgagtagagcccagggtttgcccaagggcagtgtccccccagctgcggcagagagcccctcaatgcacaggaaacaggagctggattcttcccacccaccaaagcagtccggcagaccccctgatcctgggaggcccgcacagccgggactgagcaagtcaaggacgactgacacattccgcagtgaacagaaattgccaggacgaagccctagtacaatcagcctcaaggagagcaagtctcgcactgatctgaaagaagaacacaaatcctccatgatgcccggatttctatcagaagtaaacgccctcagcgctgtgtccagcgtggtcaacaaatttaatcccttcgatctcattagcgactctgaggcatcccaggaagagaccaccaagaagcagaaggtggtgcagaaggaacagggcaagcccgagggcatcataaaaccgcctcttcaacagcagcctcccaaaccaatccctaagcagcaaggtcctgggagggatccactgcaacaggatgggacaccaaagtcaattagttcccagcagccagagaagatcaaaagtcagcctcctgggaccgggaaaccaatccaagggccaacacagacaccacaaactgaccacgcaaaattaccacttcagcgggacgccagtcgtccgcagactaaacaagccgacatcgtgcgaggggagagcgtgaagccaagtttgcccagtcctagcaaaccaccgattcagcagccgaccccagggaagccccctgcccagcaaccaggccacgaaaagtctcagccaggcccagcaaagccccctgcccagccttcaggcctcactaaacccttagcacaacagcccggtaccgttaagccgcctgtccagcctcctgggacaacaaaaccacctgctcagccccttggccctgccaaaccacccgcacagcagaccgggtctgaaaagccctcttcggagcagccaggcccaaaggcactggcgcagccaccgggtgtcggtaagacacctgcgcagcaacctggacccgcaaagcctccaactcaacaggttggcacccccaaaccactcgcccagcagcctggccttcagagcccagccaaagcccctggaccgacgaaaacccctgtgcagcctaagcccccaagccaacaaccaggatccaccaaaccccctccacaacagccaggtccagcaaaaccaagccctcaacagccgggatccactaagcctccgagtcagcagccaggctctgctaaaccttctgcgcaacagccctcacccgctaagcccagtgcacagcagagcaccaaacctgtgtctcagaccgggtccggtaagcccttgcaacccccaacagtgagccccagtgccaaacagccccctagccagggcctgcccaagactatctgccccctgtgcaacacgaccgagttgctgctgcatgtgcccgagaaagccaatttcaacacttgcaccgagtgccagacgactgtgtgcagcctgtgcggcttcaatcctaaccctcacctgaccgaagtcaaagaatggctgtgtctcaattgccagatgaaacgagcacttggtggcgatctcgcgcctgtgccctctagcccccagccaaagctgaaaacggccccagtcactacaaccagcgcagtcagcaaatcatcccctcagccacagcagacctcgccaaagaaagatgcggcacccaagcaggacttgtctaaggccccagagcccaaaaagccacctcctctggtgaagcagcctaccctgcatggatcgccaagcgctaaagcgaaacagccccctgaggccgattctctgagcaaaccggctcctcccaaggaaccctccgttccctctgagcaagacaaggccccagtggccgacgataaacccaagcagccgaagatggttaaaccaactacagacctcgtctcttcctctagcgccaccaccaaacccgacatcccctctagcaaagtgcagagccaggccgaagaaaagacaaccccaccattaaagacagacagcgcaaagccaagccaaagtttccctcccaccggagagaaagttagcccgttcgatagcaaggccatcccaaggccggcttctgattccaaaatcatttctcatcctggcccttcctctgaatccaagggccagaagcaagtggaccccgtccaaaaaaaggaggagcccaaaaaagcacagactaaaatgagccctaaaccagacgccaaacctatgccaaagggttcgcctaccccccctggccctcgtccaaccgctgggcaaacagtgcccacaccacagcagagcccaaaaccacaggaacaatcccgaaggttttcactgaatctggggagcataacggatgcaccgaagtcacagcccaccactccccaggaaaccgtgacaggtaagctgtttggattcggtgcatcaatctttagccaggcaagtaatttgatctccactgccggtcagcctggtcctcactcccaatcgggcccaggggctcctatgaaacaagccccagcccctagtcagcccccaaccagtcaaggaccacccaaatcaacgggccaggctccccctgcacccgctaagagcattcctgtgaagaaggagacaaaggcgccagctgctgaaaaacttgaacccaaggctgagcaggcacccacagtcaaaaggactgaaactgagaaaaagcctccaccaataaaggattctaagtctctgacagcggagccgcagaaagctgtgctccccacaaaactggaaaaatccccgaagcccgaaagtacctgccctctttgtaaaaccgagttgaatatagggtctaaagacccccctaactttaatacttgtacagaatgtaagaatcaggtatgcaacctttgcgggttcaaccctacacctcatttaaccgaaaattgtcagactcagagggccatctcggggcaattgggtgatattagaaagatgccacccgctccttccggtccgaaggctagtcctatgccggtgccaaccgagtcatcaagccagaaaaccgccgttccaccccaggtcaagctggtgaaaaagcaagagcaggaggtgaagaccgaagcagaaaaagtaattttagaaaaggttaaggaaactctctctatggagaaaatccctccgatggtaacgacagaccagaagcaggaggagtctaaactggaaaaggataaagctagcgccctacaagaaaaaaagccgctccccgaagagaagaagcttatccctgaggaggagaagatcagatctgaggaaaagaagccactcctagaagaaaagaaaccaacgcctgaggataaaaagcttctgcccgaagcaaagacctctgcacctgaagaacagaagcacgaccttctcaagagccaagtgcagatcgctgaggaaaaactggaaggccgtgtggctccaaaaacagttcaagagggaaagcaaccacagactaaaatggaaggcctgccttccggaaccccacagtccttgccaaaggaagatgataagaccaccaaaaccatcaaggaacagcctcaaccgccatgcactgcgaagccggatcaggagaaggaggatgataaatccgataccagttccagccaacagcccaagtccccacaggggttatctgataccggctatagctccgacgggataagctcatctttaggagagattcctagtctcatccctacggacgaaaaagacatcctgaagggacttaagaaggattccttcagccaggaatcaagcccaagctcacctagcgacctggcgaaacttgagagcacggtcctcagtatcctggaagcccaggctagcactctagccgacgagaaaagtgagaagaagacacaacctcacgaagttagtcctgagcagcccaaggaccaggaaaagacgcaatccctttccgaaactctggagatcaccatcagcgaggaggaaatcaaggaaagtcaagaagaacgcaaagacacgtttaaaaaggatagccagcaggatattcctagcagcaaagaccataaggagaagagcgagttcgtagacgatataactacccgacgcgagccatacgattcagtagaggaatccagtgaaagtgagaattcccccgtgccccaacgcaagagacggacaagcgtgggctctagttcttccgacgagtataagcaggaggacagtcaggggagtggggaagaagaggacttcatccgcaagcagatcattgaaatgtccgcagatgaggatgcatcggggtctgaggacgacgagttcattcgtaatcagctcaaggagatctcctcctctactgagagccaaaagaaggaggaaacaaaagggaagggcaaaattaccgccggaaagcaccgaaggctgacaaggaaatctagcacttccatagatgaggatgccggacgcaggcacagttggcatgacgaggacgacgaagccttcgacgagtcgcctgagctgaagtaccgggagactaagtctcaggagtcggaggagctggttgtgacaggcggtggcggattacggagattcaagactattgaactcaactcgacaatcgccgacaaatatagtgcagagagcagccagaaaaagacttcactttattttgatgaagaacctgagctggaaatggaatccctgacagactctcccgaggacaggagtagaggagaaggatcatcttccctgcacgccagttctttcaccccaggtacatctccaacgtccgtctctagcctggatgaggattcagattcaagcccaagccataagaaaggcgagagtaagcagcagcgcaaggcccgacatcggcctcacggtcccctgctgccaacaatcgaggattcatcggaagaagaggaactgcgagaggaagaagagctgctgaaggaacaggagaagcaacgagagatagaacaacagcaacgcaaatctagctccaaaaagtcgaagaaagacaaggacgagctccgtgcacaaagacgtcgagaacggccaaagacacccccttctaatctctccccaatcgaagacgccagtcccacagaagagcttcgccaagcagcagaaatggaggagctgcatcgatcctcctgctcagaatattcaccatctatcgagtctgatcccgaaggattcgagatatcacctgagaaaattatagaggttcagaaggtctacaaattaccaacagctgtgagcctgtatagccctactgacgagcagtcgattatgcaaaaggagggatcccagaaggccctgaagtcggctgaggaaatgtacgaggagatgatgcacaagactcataaatataaagctttccctgccgctaatgagagggatgaggtgtttgaaaaagagccactctacggagggatgcttatcgaagactatatatatgagagccttgtggaggatacctacaatggaagcgtggacggctccctgctgacccggcaggaagaggagaacggctttatgcagcagaaaggaagggagcagaaaatcagactctcagagcaaatttatgaagaccctatgcagaagatcactgatttacagaaagagttctacgagctggagtctctgcacagcgtggtgccccaagaggatatagtcagctcctcatttatcattcctgaatcacatgaaattgtggacttaggcactatggtcacctccacagaagaagagcgaaagcttctcgacgcggatgctgcgtatgaggaattgatgaaaagacagcagatgcagttgacacccggatcctccccgacccaggcccctatcggggaagatatgaccgagtcgaccatggacttcgaccgtatgcctgatgcctccctcacctccagcgtcctgtctggagccagcctgacagatagcactagctccgcaacattgtctattccggacgtgaaaatcacacagcactttagcacagaagagatagaagatgagtacgtcacagactataccagagagatacaggaaattattgctcatgaatctctgatcctcacctatagcgagccctccgaaagtgcaaccagcgtgcccccaagcgacacccctagcctgacatcctctgtgtcaagcgtgtgtacaaccgattcatcaagtcccatcaccacactggacagcatcacaacagtgtacacggagcctgtggacatgattaccaagttcgaggattctgaagaaatctcctcttcgacgtatttcccaggaagcataatcgattacccggaggagatatctgtgtctctcgacagaacggccccaccagatggcagggcttctgccgaccacatcgttatttccttatccgacatggcttcttctatcattgagtctgtggtcccgaaacccgagggtcctgtcgccgatactgtgagtacagacctcctcatctccgagaaggaccctgtcaaaaaagccaagaaggagactggcaacgggattatcttagaggttctggaggcctatagagacaagaaagagttagaagccgagagaaccaagagctcactcagcgagacagtattcgaccacccccctagttctgtgattgctttgcctatgaaggagcagctgagcacaacatatttcaccagtggagagacctttgggcaggaaaaacccgctagccaactcccttcagggagtccctcggtgtcgtccctgccggctaagccgcgaccgttttttcgaagctctagccttgatatctctgcccagcctccgccacctccaccgcctcctccgcctccccctccgcctccaccaccccctccacctccaccattaccacccccaacctccccaaagcctacaatcctccctaagaagaagttaacagtggcctctcctgttactactgcaacaccactttttgacgcagtcaccacacttgagacaacagctgtgcttcgaagcaatggactccccgtgacacgaatttgtacaactgccccaccccctgtcccacctaagccaagttctataccctccggcctggttttcacgcaccggccagaaccctcaaagcccccaattgcccctaagccggtgatcccccagctgccaaccactactcagaaaccaacagacatccatcctaaacccaccggcttgagtctaacctctagtatgacactgaacctagtcacctcagctgactacaagctgccatcgccaacctcacctttgagcccccatagtaataagagttccccacgcttcagcaaaagtcttactgagacatatgtggtcatcactctaccctctgagcccggtacacctaccgactctagcgcgtcacaggcaattacgtcttggccactgggatcgccctccaaggatctggtcagcgtggagcccgtgttctctgtggtgccacctgtgaccgcagtggagatccccatctcctcagaacaaaccttttacatttctggagccctgcagaccttctccgcaaccccagtcacagctccctcctccttccaagctgcccctacaagtgtgacccagttcctgactactgaggtgtctaaaacagaggtctccgcaacaaggtctacggcaccttctgtcggcctgagcagtattagcatcactatcccgccagagcccctcgccctcgataacatccacctcgagaaaccccagtacaaagaggacggaaaactccaactggtcggagacgtcatcgacctgagaacagtcccaaaagttgaggtcaaaacgacagataaatgcatcgacctcagcgcatcaaccatggacgtgaagaggcagatcaccgcaaacgaagtatatggaaaacagatctccgccgttcagccaagcattattaacttatctgtgacttcctccattgtgaccccagttagcttggctactgaaactgttacctttgtcacatgtacagcgtcggcctcctatactactggaaccgaatcccttgtgggagccgaacacgctatgaccactccgctgcaattgacaaccagcaagcacgccgagcccccatatagaatcccctccgaccaggtgttccctatcgcaagggaggaggctcccattaatttgagtctgggtactcctgcccatgcagtgacattggctataaccaagcccgtaacagtccctccagttggagtgactaacggttggactgacagcactgtctcccaaggaatcaccgacggtgaggtagtggatctcagtaccacgaaatctcaccggacggtcgtgactatggatgagtccacttcctccgtgatgacaaaaattattgaggatgagaaaccggtggaccttaccgctggacgcagggcggtctgctgtgatgtagtttataagctgccattcgggaggagttgcacagcacaacagccggcaaccactctcccggaagatcgtttcggatacagggatgaccattatcaatatgaccgcagcggcccatacggataccgaggcatcggtggaatgaagccttccatgagcgatactaatttggccgaggccggtcatttcttttataagtctaagaatgcctttgactattcagaaggcacggacacagctgttgacctgacaagtggcagagtcacaaccggggaagtgatggattacagttcaaagaccactggtccctacccagagacccggcaggtgatcagtggcgcaggcattagcacaccgcaatacagcactgccaggatgacacccccacccggaccgcagtactgcgtagggtcagtactgaggtcatccaacggggtcgtgtattcatctgtggctacccctacaccctctaccttcgctatcaccacacagccaggaagcattttttccacaacagtgcgagatctgtctgggattcacactgctgatgcagttacatccctgccagccatgcaccatagccagcccatgcccagatcttactttataacaacgggagcgagcgaaactgacatagctgttaccggaatcgatatctccgccagcttgcagactatcacgatggagtctctcactgctgagaccatcgactcagtgcccacactgaccactgcatctgaggtattccccgaagtggtgggggatgaaagcgctttgttgattgtccccgaagaagataagcagcagcagcagttggacctggagcgtgagctcttagagttagaaaagattaagcagcagaggttcgccgaggagctggagtgggagaggcaagagattcagcggtttcgagaacaagaaaaaattatggtacaaaaaaaactcgaggagttgcagtccatgaagcagcaccttctgttccaacaagaagaagagaggcaggcacagttcatgatgaggcaggagaccctcgcccagcaacagctgcagctcgaacagatccagcagttgcaacagcaattacaccaacagttagaagagcagaagatccgacaaatatatcagtacaattacgatcctagcggaactgcctccccacagacaactacggaacaagccattctggagggtcagtatgcagcactggaaggcagccaattctgggcaacagaagatgcaaccaccacagccagtgccgtggtggcaatagagatcccgcagagtcagggatggtatactgtacagagtgacggagtcactcaatacattgctcctcccggaattctgagcactgtaagtgagatccctttgacagatgttgttgttaaggaggagaaacaacccaaaaagcggagttctggcgctaaggtgcgcggacaatacgatgatatgggtgaaaacatgactgatgatcccagaagcttcaaaaagatcgtggactcaggagtccaaacagatgacgaggacgccactgacaggagttatgtgtctcgccgacggaggacaaagaaatctgttgacacttctgtgcaaacagacgacgaagatcaggacgaatgggacatgcctacccgttccagacggaaagcccgtgtggggaagtacggtgactccatgactgaggccgataagaccaagcctttatccaaggttagctctattgccgtacagaccgtggctgagatttccgtacagaccgagcccgtcggcaccattcgcacaccatccattagggctcgcgttgatgccaaagtggagatcatcaagcacattagcgccccagaaaagacttataaaggaggcagccttggttgtcagactgaggctgacagcgacacacagtcaccgcaatatttatctgccacatccccacctaaagacaagaagcggcctacgcccctggagatcgggtatagcagtcatctgagggctgacagcaccgtccagctggctccctctccgccaaaatctcccaaggtgctctactcccccatcagtcccttgagtccaggcaaggccctggagtctgccttcgttccatatgaaaaaccccttccagacgatatctccccgcaaaaggtgctgcatcctgacatggccaaagtgccccctgcctctcccaaaaccgctaaaatgatgcagcggtcaatgagcgaccccaaacctctgagcccaaccgcagatgaatcaagcagagcaccattccagtacacagagggctacacgtat

SEQ ID NO: 235055 - DNA, 1635 bp, Artificial Sequence
  Description of Artificial Sequence: Synthetic coding sequence
atggagaagttgcaggaacaccttatcaaagctaaagcattcacgatcaaaaagacattggagatctacgtcccaatcaagcagttcttctataatctgatacatccagagtatagtgccgtgactgacgtctatgtgctgatgttcctcgctgacactgtcgatttcatcattattgtcttcggcttttgggcctttggaaaacattccgcagctgctgacatcacgtcttcattgtctgaagaccaggtgcctggcccattcctggtaatggtgctgatccaattcggcacaatggtggtggacagggcactgtacctgagaaagactgtgttgggcaaggtgatattccaggttatccttgtatttgggattcacttctggatgttcttcatccttcccggagtgacagagcggaagttctcgcagaacctcgttgctcagctctggtactttgtgaaatgtgtgtattttggcctgagcgcgtaccaaatccgttgtggctatccaacacgagtccttggaaatttcttgactaaaagctacaactatgtaaatctgttcctgttccagggcttccggctggtaccgttcctgactgagctaagggccgttatggactgggtgtggaccgacacgactctgtctttatcgtcatggatatgcgtggaggatatctacgctcacatattcattctcaaatgttggcgggaatctgaaaaaccgatctttacgatgagtgcccagcagtcacagctcaaggtgatggatcaacaatcctttaataagttcatccaggctttctccagggacactggcgcaatgcagttccttgaaaattatgagaaggaggacattacagtcgccgaactcgagggtaatagcaactctctgtggaccatcagcccaccctctaaacagaagatgattcacgagcttctggaccccaacagctcgttctcagtggttttttcatggagtatacagagaaatttgtccctgggcgcaaaatcagagattgcgacggataagctttcattccctcttaaaaatatcacaagaaaaaacattgccaaaatgatagcaggaaactctacagaatcctccaaaacccccgtgactattgagaagatctatccgtattacgtcaaggcaccttctgactcgaactctaagccaataaagcagcttctatcagagaataactttatggatatcacaataatactgtccagagacaacaccactaaatataactccgagtggtgggtcctgaatctgaccggaaatagaatttacaacccaaatagccaggccctggaactggtggtgttcaatgacaaagtctctcctccttccctggggtttctagccggatatggaattatgggcctgtacgcctccgtggtgctagtcattggtaaattcgtccgcgagttcttcagtgggatctctcatagtataatgtttgaagagctgcccaacgtggatagaattctcaagttgtgcacagacatcttcttggtgagggagacaggggaactggagctggaggaggacctctacgctaagctgatctttttatataggagtccggaaactatgatcaagtggactagggaaaagaccaactag

SEQ ID NO: 235056 - DNA, 8258 bp, Artificial Sequence
  Description of Artificial Sequence: Synthetic coding sequence
atggcatcggaagtagtctgcggtttaatcttccggctgcttctgccgatctgcctggctgtggcatgtgcgttcaggtataacggattatcctttgtgtacttaatttacctcctgttaatacctctgtttagcgaacctaccaagactactatgcagggccataccggtcggctgctgaaatcactgtgttttatttcattatcctttctgctgctgcacatcatcttccacattaccctggtatctttagaagctcagcaccgcattgcacccggatataactgcagcacatgggaaaagaccttcagacagatcgggtttgagtcccttaaaggcgctgacgcaggaaacgggatacgggtgttcgtgcctgacataggaatgtttattgcatccctgactatttggcttctctgtaggaacattgtccagaagcccgttacagatgaagccgcacagtccaaccctgaatttgagaacgaagaattggctgaaggggagaagatagactccgaggaagccctcatctacgaagaggattttaatggcggagacggagtggagggcgagttggaagagagtaccaagttgaaaatgtttcgacgactagcctctgtagcgtcaaaacttaaggaattcatcggcaacatgataaccaccgccggtaaagtggtggtgactatcttattggggtcttctggaatgatgttgccctcgctcacatccagtgtgtacttcttcgtgtttttaggcttatgtacatggtggtcgtggtgcaggacgttcgatcctctgctgtttagctgtctttgcgtcctactggccatctttacggcgggtcacctcattggactgtacctgtaccagttccagttctttcaggaagcagtgcctccaaacgactactacgcccgactttttggcattaagagcgtgatccaaacagactgctcctccacttggaagatcatagtgaatccggatctcagctggtatcaccacgcaaacccgatcttgctgttggtcatgtattacactctggcaactcttattcgaatatggttacaggaacccctggtccaggatgagggcacaaaagaggaggacaaggcactcgcctgttcacccatccagattacggccggacgcagaagatcgttgtggtacgccacacattaccccaccgatgagagaaagctgttgagcatgactcaggatgattataagccaagtgatggcctcctcgtcactgtgaacggcaacccggtcgattaccacaccatccatccttccctcccgatggaaaatggcccagggaaggcggatctgtactccaccccccagtatcgctgggagccttcggacgaaagttctgagaagcgagaagaggaagaggaggaaaaggaggagttcgaagaagagcgtagtagggaagaaaagcgaagtataaaggtgcatgccatggtttctgtgttccagttcattatgaagcagagctatatctgcgccctaatcgcaatgatggcctggtccattacgtaccattcatggctgacgttcgtgttacttatctggagctgtacactgtggatgattagaaaccgcaggaagtatgccatgatctcgagcccattcatggtggtctatggtaacctcctgcttatcttacaatacatctggtctttcgaactgcctgagataaagaaggttcctgggtttttagagaaaaaagaaccaggagagttagcctcaaagatcttattcacgataacgttctggctgctcctgaggcaacatctgaccgagcagaaggcactgcaagaaaaagaggcgttgctcagtgaggttaaaatcggctcccaagaaaatgaggagaaggacgaggaattacaggatatacaggtcgagggagaaccgaaagaagaggaagaggaggaagcaaaggaggaaaaacaagagaggaaaaaggtcgaacaagaggaggccgaggaggaggacgaacaggacatcatgaaagtgttaggcaatctggtcgtcgctatgtttatcaaatactggatctatgtatgcggaggcatgttttttttcgtttctttcgagggcaaaatcgtgatgtataagataatatacatggtattgttcctattctgcgtggccttgtatcaagttcactatgagtggtggcggaaaatcttgaaatatttctggatgagcgtcgtgatttacacaatgctggtgctgatcttcatttacacgtaccaattcgagaactttccaggactctggcagaatatgacaggtcttaaaaaggaaaagctggaggatctgggattgaaacagttcacagtggcggaactttttacccgcatctttatccccacgagcttcttactggtgtgcatactgcatttgcattactttcatgacagatttctggagctcacagacctgaagtctatcccatctaaggaagacaatactatttatcgcctcgcccaccctgaggggagccttccggacctcaccatgatgcatctgaccgcatccctcgaaaagccagaggtgcgcaagctggccgagccaggggaagagaagctcgagggctacagcgaaaaggcgcagaagggagacctggggaaggattccgaggagtccgaggaggatggagaggaagaagaagaatctgaggaggaggaggaaacctctgaccttcggaacaagtggcacctcgttatcgatagactgaccgttctttttctgaagtttctagagtattttcacaagttgcaggttttcatgtggtggatcctggagcttcacatcatcaagattgtgtcctcttacatcatctgggtctccgtcaaggaggtctccctgttcaattacgtttttctgatcagctgggccttcgctcttccgtacgccaagctgcgccgacttgcatcctccgtgtgcactgtgtggacctgtgtgattatcgtgtgcaagatgttgtatcagttgcagaccattaagcctgagaacttcagcgtgaactgcagcctgccaaatgagaatcagacaaacatcccctttaacgaacttaataaaagcttactctattccgctccaatcgaccctacagaatgggtcggattgaggaagtcctcacctttgttggtttacctgcgtaataatctactaatgttggcgatcctggctttcgaagtcacaatatataggcatcaggaatattacagagggcgaaacaacctgaccgctccagtttcccgaacaatttttcacgacataacgagactccatctggacgatgggctgattaattgtgctaagtactttattaattacttcttttacaagttcggactggagacctgtttcctgatgtctgtcaacgtgattggacagaggatggacttttatgccatgatccatgcctgttggctcatagccgttttgtaccgcagaaggcggaaggcaattgctgagatatggccaaaatattgttgtttcctggcctgcattataacattccagtactttatctgcatcggaatcccccctgccccatgccgggactatccgtggagatttaaaggagcttcttttaatgacaatatcatcaagtggttgtatttccctgatttcatagtgcggccaaaccccgtgttcctggtttacgattttatgctgctgctgtgtgcttcccttcagcggcagatcttcgaagatgagaacaaggccgcagtgcgcataatggcaggggacaacgtagaaatttgtatgaatctggatgctgcttcatttagccagcataatcctgtgccagattttatccactgtcggtcatacctggacatgtctaaagtcattattttcagttatctgttctggttcgtcttgacgattattttcattactgggaccactagaatatcgatcttctgcatggggtacctggtcgcttgcttctactttctgctgtttggcggtgacctgctcctcaaaccaatcaaatctattcttcgctattgggattggctgattgcctacaatgttttcgtgattaccatgaagaatattctttccatcggcgcatgcgggtacatcggtacactggtgcacaattcttgttggctgatccaggcattcagcttggcttgtacagtaaaaggctaccagatgccagctgccaactccccgtgcactctgccaagtggcgaagcgggaatcatttgggatagtatctgttttgctttccttctgttacagagaagagtattcatgagttattacttcttgcatgtggttgcagatatcaaggcttcacagatcctcgcctcccggggagcagagcttttccaggctacaattgtgaaagctgttaaagcacggatcgaggaggagaagaaatccatggaccaattgaagcgccaaatggacagaatcaaggcccgacagcagaagtataagaagggtaaagagcgaatgctatctctgactcaggagcccggagaaggacaggatatgcagaagcttagcgaagaggatgacgagagggaagcagataaacagaaggccaagggcaagaaaaagcagtggtggaggccctgggtagaccacgcctccatggtacgcagcggggattactatctgtttgagaccgacagcgaagaggaggaggaagaggagctcaaaaaggaggacgaggaaccccctagacggagcgcctttcagttcgtctaccaagcttggattaccgatccaaagactgctctgcggcagcggcataaggaaaagaagcgatccgccagggaggaaagaaaaaggcggagaaaaggctccaaggaggggccagtggagtgggaagaccgcgaagatgagcccatcaaaaagaagagcgacgggccagacaacattataaagagaatcttcaacatcttaaagtttacttgggtgctgtttctggcaaccgtggattcgttcaccacatggctcaatagcatcagcagagagcacattgacatttctacagtactgcgcatcgagagatgtatgctgacccgggagattaagaagggcaacgtgccaacccgggaatctatacacatgtattaccagaatcacatcatgaacctttcccgcgaaagtggactggataccatcgatgaacatccaggggctgccagcggtgcacagaccgctcaccggatggactccctcgacagtcatgattcgatttcttcagaaccaacacagtgcacaatgttgtactctaggcagggcaccactgagaccatcgaggaagtcgaggcggagcaggaggaggaggcagggtcgacggccccagagcctcgcgaagccaaagagtacgaggccacaggctacgatgtgggcgctatgggcgcagaagaagcttccctcaccccggaggaggagctgacccagtttagtactctggacggagatgttgaggctcccccaagttatagcaaggccgtgtctttcgagcacctcagcttcggctctcaggatgatagtgccggtaaaaatcgaatggcggtgtctcctgacgatagtcgcacagataagttgggcagcagtatcctgccccctctgactcatgagctgaccgccagcgagttattgctgaaaaagatgttccatgacgatgagctcgaggagagcgagaagttctacgtgggccagccgaggttcctgttgctgttctacgccatgtacaatacacttgtcgctaggagtgagatggtgtgctacttcgtcataattctgaatcacatggtctccgccagcatgattacccttctcctgccaatcctcatttttttgtgggctatgctaagcgtgccccgaccgtccaggcggttttggatgatggcgatcgtctacactgaagtggccatcgtggtgaaatactttttccaatttgggtttttcccatggaataagaatgtggaagtgaacaaggacaagccttatcatccccctaatataatcggcgtggagaagaaagaaggttacgtcctttatgatctaatacaacttcttgctttatttttccacaggtccattctgaaatgtcacggcctctgggatgaagatgacatgacagaaagtggtatggcgagggaggaaagtgatgacgagctgtcactcggacacggccgaagagacagttcagacagcttgaagtcaatcaatttagcggcttccgtggagagtgtgcacgttaccttccctgaacagcagactgcagtccgaagaaagcgcagtgggtcgtcgtccgagccttcccagcggtcctcattctcttcgaatagaagtcaacggggttccacgtctacccgcaattcatctcagaagggatcctctgtcctgagcatcaagcagaaaggcaaacgggagctgtatatggagaagctgcaggagcacctgataaaggccaaagccttcactatcaagaagaccctggagatttatgtgcctattaaacagttcttctataacctgattcatccagagtatagtgcagttacggatgtctatgtactgatgtttctcgccgatacagtggacttcattatcattgtttttgggttctgggcctttggcaaacatagcgcggcagcggacatcacaagttccctgagcgaggaccaggtacccggaccatttcttgtgatggtcctcattcagtttggcacaatggtcgtggacagagccctctatctgcggaagaccgtgctggggaaggtaatctttcaggtgattctggtgttcggcatccatttttggatgttcttcatacttccaggggtaactgagcggaagttctcacaaaacctggtggcccagctgtggtatttcgttaaatgcgtgtactttggtctctccgcttaccaaatccgatgcggctatccaacccgcgtgttaggaaatttcctgacaaagagttacaactacgtgaatctttttcttttccagggcttccgactagtgcctttccttacagaactcagggctgtgatggattgggtctggacagataccactttaagtctgtctagctggatttgtgtggaggacatctatgcacatatctttatcctgaagtgctggagagaatcagagaaacggtacccccagcctagaggtcagaaaaaaaagaaggttgtgaagtacggtatgggaggcatgataatcgtcctcctgatttgtattgtctggttcccattgctgtttatgtctctcatcaagagtgtcgctggtgttatcaaccagcccctggacgtgtcagtcacaatcaccctgggaggctaccagccaatctttactatgtccgctcaacaatcgcagttgaaggttatggatcagcagtcgttcaacaagtttatccaggccttctctcgcgatactggggcaatgcaattcctggaaaactacgagaaggaagatatcacagtggccgagcttgagggaaatagcaattcactgtggaccatctccccaccttcaaagcaaaagatgattcacgagttactggatcccaacagcagtttctcagtggtttttagttggtcaatccagcggaacctttccctaggggctaagtccgagattgccactgataaactgtcttttcctctgaagaacattacacgtaaaaatatcgcaaagatgatagcgggaaactcaaccgagagcagcaaaacaccagttactatcgagaaaatttacccttactatgtcaaggccccaagcgatagcaattcaaagcctataaagcagctgttgtccgaaaacaactttatggacatcaccattatcctaagcagggataatacaacaaaatataattccgagtggtgggttttgaacctgacaggcaatcgaatctacaatcctaactctcaagcactggaacttgtagtgtttaatgacaaggtgtcacctcccagcttgggctttctagccggttacgggatcatggggctgtatgcatctgttgttctggtgatcggaaaattcgtaagagagtttttttctggaatctcacactccataatgtttgaagagctccctaatgtggataggatcttgaagctgtgcacagacatctttcttgttagagagactggggagttagaattagaagaggatctgtacgctaagctgatctttctgtaccgcagccctgaaaccatgatcaaatggacgcgcgagaagacaaacta

SEQ ID NO: 235057 - DNA, 1692 bp, Artificial Sequence
  Description of Artificial Sequence: Synthetic coding sequence
atgtccgtggtgatctatacaatgctggtgcttatcttcatctacacatatcagttcgaaaatttccccggactgtggcagaacatgaccggcctgaagaaggaaaagctggaggacttgggcctgaagcagttcacggttgcagaactgttcacacgcatcttcatcccgacatcctttctgcttgtgtgtatactgcacttacactatttccacgacagatttctggaactgacggatttgaagtccatccccagtaaggaggacaatactatctacagtcacgcgaaagtgaacgggagagtttatctgatcatcaactcaataaaaaagaagcttcccatccaccagaatgagttggctcaccccgaggggagtctgcctgaccttaccatgatgcatctgaccgcttctctggagaagccagaggtgcggaaactcgccgagcccggagaagagaaactggaggggtactccgaaaaggcgcagaaaggcgacctcggcaaagacagcgaagaaagcgaggaagatggcgaggaagaggaggagagtgaggaggaggaggaaacctctgacttgagaaacaaatggcacctggtgatcgataggttgacagtcctgtttttaaagtttctggaatacttccataagctgcaagtgtttatgtggtggatacttgaactacacattatcaaaattgtgagtagctacatcatctgggtatctgtaaaagaggtcagcttatttaattatgtttttctgatatcttgggctttcgctctgccatacgctaagctgaggagactagcttcgagtgtatgtactgtatggacttgtgtgattatcgtgtgtaagatgctgtatcagctccagacaatcaagccagaaaacttcagcgtaaactgttccctcccaaatgaaaaccagaccaacattccttttaatgagcttaacaagtcactcctctacagcgctccgattgaccctacagagtgggtgggcctccgtaaaagctctcccctgttggtttacttgaggaacaatctgctgatgctagcaatcctcgctttcgaggtcacaatctatcgacaccaggaatattaccgtggtagaaataacctgactgccccagtgtcacgtactattttccacgatatcacccgcttacatctggacgacggattgattaattgtgccaaatatttcatcaattactttttttataaattcggcctggagacttgcttcctgatgagcgtgaacgtgatcggccagaggatggatttttatgcaatgatccacgcctgctggctgatagccgtattatacaggcgcagacgtaaggctatcgccgagatttggcccaagtactgctgcttcctggcgtgcattattacattccagtatttcatatgcattggcattcctcctgctccttgtcgtgactatccatggcgttttaagggggctagcttcaacgacaacattattaagtggctgtactttcctgatttcatagtccgacctaacccagtctttttggtgtacgacttcatgctattgctgtgcgcctctctccaacggcagatcttcgaggatgagaacaaggccgcagtgcgaatcatggcaggcgataatgtggagatttgcatgaaccttgatgctgctagcttttctcaacataacccatag

SEQ ID NO: 235058 - DNA, 1941 bp, Artificial Sequence
  Description of Artificial Sequence: Synthetic coding sequence
atgacagagagcgggatggcacgggaggaaagcgatgatgagctgtcacttgggcatggacgcagagactcatcagactcccttaaatcaatcaatcttgccgcaagcgtcgaatcagtgcatgtgacgttcccggaacagcagaccgcggtgaggcgaaaacggtctggaagctccagcgaaccaagccagcggagctccttctctagcaacaggagtcaacgaggctctacatccacaagaaacagcagtcagaaagggtcctctgtgttaagcatcaaacaaaagggaaagcgagaactatacatggaaaaactccaggagcatctgattaaagctaaggcttttacaattaagaagacgctggaaatatatgtgcccatcaagcagtttttctataacctgatccaccccgagtatagtgccgtgactgacgtctacgtgctcatgtttttggccgacaccgtggatttcatcatcatcgtgttcggtttctgggccttcggcaagcactcggcagccgctgacatcacatcttccctaagtgaagatcaggtaccaggacctttcctcgtcatggtgctcatccagtttgggacgatggtggttgacagggcgttatatctgagaaagaccgtgttgggaaaagttatcttccaggtaatcctcgtttttggcatccacttctggatgtttttcatcctgccaggagtcacggagcgcaagttttcccagaatctggttgcccagctgtggtatttcgtgaagtgtgtgtatttcggcctcagtgcctaccagatcagatgtggctaccccaccagagtccttgggaattttcttaccaagtcgtacaattacgtgaacctcttccttttccagggttttagactcgtgccatttctgactgagctcagggctgtgatggattgggtctggacagatacaacactaagtctgagctcatggatatgtgttgaggacatttatgcccacattttcattctgaaatgttggagggagtccgagaagccgattttcaccatgtcagcacagcagtcccagctaaaggtgatggaccaacagtcattcaataaattcattcaggccttctccagggacaccggggcaatgcaattcttagagaattacgaaaaggaggacattacagttgcagaactcgaaggaaattcaaattccctttggaccatcagcccccctagtaaacagaaaatgatccatgagctcctggatccgaattcctcatttagcgttgtgttctcttggagcatccagaggaacctctctctcggcgcaaagtcagaaatcgctaccgacaaactgtcttttcctctcaagaatatcacccggaagaacatcgctaaaatgatagctggcaatagcaccgagtcttccaaaacacccgtaactattgagaaaatctacccctactacgtgaaagccccttccgatagtaatagcaaaccgatcaagcagctgcttagcgagaataattttatggatataactatcattctctcacgggataatacaacaaaatacaactccgagtggtgggttctgaatctcaccggcaaccgcatttacaacccaaatagtcaggccctggaacttgtggtgttcaatgacaaagttagtccaccctccctgggctttctggccggttatgggatcatgggcctctacgcctctgtggtgcttgttatagggaaattcgtccgggagttcttcagcggcataagccatagtatcatgttcgaagaactccctaatgtcgatcgaattctcaaactgtgcactgatattttcttggtgcgcgagactggcgagttggagctggaggaggatctttacgccaagctgatcttcctttacagatcacccgaaaccatgattaaatggacccgcgaaaaaacaaactag

SEQ ID NO: 235059 - DNA, 2130 bp, Artificial Sequence
  Description of Artificial Sequence: Synthetic coding sequence
atgacggaaagcggtatggcacgcgaagagagcgatgatgagttatcgcttggccacggtcgcagggatagttccgattctttgaagagcatcaacctcgccgcttccgtggaatccgttcatgtcacctttcccgagcaacagactgcggtaaggaggaagaggagtgggtcaagtagcgagccgtctcaacgttcaagcttttcatccaatcgctcccagagaggatcaacttcaacccgcaattcctcacagaagggcagctcggtcttaagcattaaacaaaaagggaagcgagagttatatatggagaaactgcaggaacacctgattaaggcaaaagcctttaccattaagaagaccctggagatttatgttccaataaaacagttcttctacaatttgattcatcccgagtattcagctgtcactgacgtgtacgtgctaatgttcctcgccgatacggtggacttcattatcattgtattcggtttttgggcctttggcaaacactcagcagccgcagacattaccagttctctttcagaagatcaggtgcctgggccattccttgtcatggtcctgatccagttcgggactatggttgtagatcgcgctctttaccttaggaaaaccgtcctaggaaaggttattttccaagtcatccttgttttcggtatccacttctggatgttctttatccttcctggtgtcaccgaacgtaaatttagccaaaaccttgttgcgcaactctggtactttgtcaaatgtgtgtactttggactttccgcctatcagattagatgcggatatcctactagagtgctgggcaatttcctgacaaagtcatataactatgtaaatctgttcctttttcagggctttcgcctggttcctttccttaccgagctgagagctgtgatggactgggtgtggacagacaccacgctttctttgagcagttggatttgcgttgaggacatctacgcgcatatttttattctgaaatgctggcgggaatctgaaaagcgctatcctcagccacgagggcagaagaaaaagaaggtggtgaagtacggtatggggggaatgatcatcgtcctccttatatgcattgtctggttcccactactcttcatgtctctgatcaagtctgtcgccggagtcataaaccagcctctagatgtcagcgtgacgatcactttagggggatatcagcccatcttcacaatgtctgctcagcagtcacagctgaaggtgatggatcagcagtcattcaacaaattcatccaagcattctcaagagataccggggctatgcaattcctcgagaactatgaaaaagaggatatcacagtagccgagctggaaggtaattccaactccctctggacaatcagtccaccctctaagcaaaaaatgatccatgaactcctggatcccaatagctctttttcagtcgtgttctcatggtctattcagcggaacttgtctctgggggctaaaagcgagatcgcaacggataaattaagttttccactcaaaaacattacacggaagaacattgccaagatgatagctgggaatagcaccgagtcttcaaaaacccccgtgaccatcgaaaagatttacccatactatgtgaaagcaccctccgatagcaatagtaaacctattaaacaacttctgtcagagaacaacttcatggacatcacgatcattctctccagggacaatactacaaagtacaacagcgagtggtgggtgctgaatctcaccggcaaccgcatatacaacccaaacagtcaagccctggaacttgtggtatttaacgataaggtgagccctccatcattagggttcctcgcgggatacggcattatgggcctctacgcttccgtggtgttagtcattggaaagttcgtgcgggagtttttctccggaatctctcactccattatgtttgaggagctgcctaatgtcgatcgtattctcaaactatgtaccgatatcttcctggtgcgcgaaacgggtgagctggaactggaagaggatttatatgcgaagcttatatttctttacaggtctccggagaccatgatcaagtggaccagagagaaaacgaactag

SEQ ID NO: 235060 - DNA, 2565 bp, Artificial Sequence
  Description of Artificial Sequence: Synthetic coding sequence
atggcgctgcggctggtggcagatttcgacctcgggaaggacgtgctgccttggctaagagcgcagcgggcagtgtccgaggcatccggcgcaggttccggaggtgcagatgtgctcgaaaacgactacgagagcctacacgtgctaaacgttgagcgaaacggtaatataatttacacttacaaggatgacaagggaaatgtcgtgttcggcctgtacgattgccaaacgaggcagaatgagttactctatacattcgagaaagatctgcaggtctttagctgttctgttaactcagaacggactctcctcgcggctagtcttgtccagagtaccaaggagggtaaacgcaacgaacttcagcccggatctaaatgcttgaccttgcttgtagagatccaccctgttaacaatgtgaaggttctcaaagctgtggacagttacatatgggtgcagtttttgtacccccacattgagtcccaccccttacccgagaaccatctgctgctcatctcggaagagaagtacatcgagcagtttcgcattcacgtggcccaggaagacggaaacagagtggtaatcaagaattcgggccatctacccagggaccgcatagccgaggatttcgtctgggcccaatgggacatgtccgagcagaggctgtactatatcgacttgaagaaatcccgcagcatccttaagtgcatacaattttacgcagatgagtcttacaatctgatgttcgaggtgcccttggacatctccctgtccaattctggtttcaaattggtgaacttcggctgcgactatcatcagtaccgtgacaaatttagcaaacacctcacactttgcgtgtttactaatcataccggatctctctgtgtatgttattcccctaaatgtgcatcatggggtcaaattacatacagcgtgttttacatccacaaaggccacagtaagacattcactacatccctggagaacgtcggatcccacatgacaaaaggtatcacgtttcttaatttggactattacgtggcggtctatctgcctggccacttttttcatttactgaatgtgcagcaccccgacctgatctgtcataatctgtttctgaccggaaacaacgagatgattgatatgctgccacattgtcccctgcagtccttgtccggttctctcgtcctggactgttgcagtggcaagttataccgagcactgctgagccagagcagcttacttcagttgctccaaaacacatgcctcgactgtgagaagatggctgccttacactgtgctctttactgcggtcaaggagcccagttccttgaggcacagattattcagtggatttcagaaaatgtgagcgcctgccatagcttcgacctcatccaggaattcattattgcaagtagttactggagtgtgtactcagagacttcaaatatggataaactcttacctcattcaagcgtactgacttggaacactgaaataccaggaataacactggtgactgaggacatcgctcttccattgatgaaggttctgagcttcaagggctactgggaaaaacttaatagtaatctggagtacgtaaaatatgccaagccccacttccactataataattccgttgttcgcagagaatggcacaaccttatatcagaagaaaaaacgggaaaacgaaggtctgcggcatacgtgcgaaatattctagataacgcagtcaaagtgatcagcaacctggaggcccgaaatctcggaccacggttaacgccgctcctgcaggaggaggactcgcaccagcgtttgctgatgggtctgatggtttccgagttaaaggaccattttcttcgccacctgcaaggggtcgagaagaaaaagattgagcaaatggtcctggattacatatccaagttactggacctgatttgccacattgtcgaaaccaattggcgcaagcataacctgcattcatgggtccttcattttaactcccggggaagcgcggcagaattcgcggtgttccacatcatgactaggatcttggaggccaccaactccctgttcctccccttgcccccaggattccacaccctccacactattctgggtgtccaatgtctgcctcttcacaacctcctccactgtatcgactccggtgtcctgttgttaacggagactgcggtcattcggctaatgaaggatttggacaatacagaaaagaatgagaagttgaagttcagcattattgtcaggttacctccacttattgggcagaagatttgtaggctttgggaccacccgatgagtagcaatatcatttctcgtaaccatgtgacccggctgctccagaactataaaaaacagcctcggaactccatgattaacaaaagcagcttttctgtggagttcctccccctgaactacttcatcgaaatcctgacagatattgaatctagcaatcaggccctgtacccctttgagggtcatgacaatgtggatgcggaatttgttgaagaagcggctctgaagcacacagcgatgcttctgggactgtag

SEQ ID NO: 235061 - DNA, 528 bp, Artificial Sequence
  Description of Artificial Sequence: Synthetic coding sequence
atgactaggatattggaggccaccaattccctgttcctcccactccctccagggttccacaccctccacacaatccttggagtgcagtgtctgcctctgcataacttacttcattgcatcgactccggcgtccttctcctcacagaaaccgctgtgatccgtttgatgaaagacctggataacactgagaaaaatgagaaactcaagttcagcataatagtgagactgccaccactaattgggcagaaaatttgccgcctatgggatcacccaatgtcaagtaacattatttcccgcaaccacgttacccgcttactgcagaattacaagaagcagccccgtaattccatgatcaacaaaagttctttctcggtagagttcctgccgctaaactactttatcgaaatattaactgacatcgaatctagtaaccaggctttgtacccattcgaaggccatgataacgtcgatgcggaatttgttgaggaggccgctctgaagcatacagccatgttgctgggcctgtag

SEQ ID NO: 235062 - DNA, 873 bp, Artificial Sequence
  Description of Artificial Sequence: Synthetic coding sequence
atggccaaccccaaacttcttggcatgggcctgtctgaggcggaagccatcggggctgacagtgcccgttttgaggagctactcctgcaagcttccaaggagctgcagcaggctcagaccacaaggccagaatccacgcagatccagccccagcctgggttctgcatcaaaactaactctagcgaggggaaggtgtttattaacatttgtcacagcccgagtatccccccacctgctgacgtcactgaagaggaactgctgcaaatgttagaggaagatcaagcaggattccgcatacctatgtccttgggcgaaccccacgccgagctggacgcaaaaggacagggatgcactgcttatgatgtggctgttaatagtgacttctatcgcagaatgcaaaatagtgactttctgcgagaactggtgataactatcgccagagaagggctggaggataagtacaacctgcagctgaaccctgagtggcgtatgatgaaaaaccgccctttcatgggatccattagccaacagaatattaggagcgagcagagaccgcgaatccaggagctgggtgacctgtataccccagcaccaggcagagctgagtccggccctgagaaaccacacctgaacttgtggctggaggcccctgacctgctgttagccgaagttgacttgccaaaactggacggcgctctaggtctgagcctggagatcggcgaaaatagactggtgatgggaggcccacaacagctctaccacctcgacgcatatattccccttcagatcaacagccacgaatccaaggcggctttccaccgcaaacgtaagcagctgatggtcgccatgccactgttgcctgtgccttcctag

SEQ ID NO: 235063 - DNA, 942 bp, Artificial Sequence
  Description of Artificial Sequence: Synthetic coding sequence
atgctactcagcaaaatcaactctcttgcacatctgcgcgcagctccatgcaatgaccttcatgccaccaaactcgcacccggaaaggagaaggaacccctggagagccagtatcaggtaggccctctcctgggctcaggcggattcggcagcgtgtatagcggaattcgggtcagtgataatttgcctgtggcgattaagcatgttgaaaaagaccggattagcgattggggcgagcttccaaacggcactagagtcccaatggaggttgttctgctcaagaaggtttcctctggattctcaggcgtgatacgcctcctggattggttcgaacggcctgacagtttcgtattgattttggagaggcctgagccagtccaagatctctttgattttatcaccgagagaggcgcactgcaggaagaactcgccagaagttttttctggcaggttctggaagctgtaaggcactgccacaattgcggcgtgctccacagggacattaaagatgagaacatcctgatcgacctaaaccgtggggaactgaagctcattgatttcggatcaggcgcactgctgaaagacacggtgtataccgattttgacggaacaagagtgtactcacctccggaatggatccgctatcaccgctaccacggaagatccgctgctgtgtggagcctgggcatcttactctacgacatggtgtgcggagacattccattcgaacacgatgaggaaattataagaggccaggtcttcttccgtcagcgcgttagctctgagtgtcagcacctcatcaggtggtgtttggcattgcgcccttctgatcgcccaacttttgaggagatacagaaccatccctggatgcaggatgttctgcttcctcaggaaaccgccgagattcacctgcactcactgagcccaggtcctagcaagtag

SEQ ID NO: 235064 - DNA, 936 bp, Artificial Sequence
  Description of Artificial Sequence: Synthetic coding sequence
atgctgaccaaacccctgcagggcccacccgcaccgccaggaaccccgactccccctcctggcggaaaagaccgcgaagcatttgaggctgaataccgacttggccctcttctgggtaaaggagggtttggtacggtttttgcaggccaccgattaaccgacaggctacaagtggcgatcaaggtgatccccagaaatagggtacttgggtggagtccactgagcgacagtgtgacatgccccttggaagtcgcactgctgtggaaggtgggcgcaggcggaggacaccccggagtgatacggttgctcgattggtttgaaacacaagaagggtttatgctggtcttggagcggccactgcctgcgcaggatctgttcgattatatcaccgagaaggggcctttaggcgagggaccttctaggtgcttctttggtcaagttgtcgcagcgatccaacactgccacagtaggggagtggtgcatagggatataaaagatgaaaacatattgattgacctgcgcagggggtgtgctaaattgatagacttcggaagcggagctctgctgcacgacgagccctataccgattttgatggcacacgagtttatagtccacccgagtggatttccaggcaccagtatcatgccttacccgctaccgtgtggtccctcggcatcctcctttatgacatggtctgcggtgacatcccatttgaacgcgatcaggaaatcctggaggcagaactgcatttcccagcacacgtaagtcccgattgttgtgccctgataaggcgttgtctcgccccaaagccctcttctcggccatcgctggaggagatattgcttgatccctggatgcagactccagccgaggatgtgccattgaatccctcaaaggggggacccgctccattagcttggtctctattgccttag

SEQ ID NO: 235065 - DNA, 438 bp, Artificial Sequence
  Description of Artificial Sequence: Synthetic coding sequence
atgttggttctggagagaccgctgccagctcaggacttgtttgactatatcactgagaagggcccactgggagaaggccctagcaggtgtttttttggacaggttgtggccgctatccaacactgtcatagcaggggcgtcgtccacagagacatcaaggatgaaaatatcctcatcgatctgcgacggggatgtgcaaagctcattgacttcggctccggcgctctactgcacgatgagccttacaccgactttgacggcaccagggtatatagtcctcccgaatggatttccaggcaccagtaccatgctctccccgctactgtttggtcccttgggattctcctttatgacatggtgtgcggcgacatccccttcgagcgcgatcaggagattctcgaggcagaactccacttccctgctcacgtgagtccatag

SEQ ID NO: 235066 - DNA, 2925 bp, Artificial Sequence
  Description of Artificial Sequence: Synthetic coding sequence
atggccaaagccggtagggcaggcggtccccctccaggcggaggggctccgtggcatttgcgcaacgttctgtcggacagcgtagagagctctgatgacgaattctttgacgccagagaagagatggccgagggcaaaaatgctatactaatcggaatgtctcagtggaactctaacgatctggtggagcagatcgaaacaatgggaaaactggacgagcaccagggagagggtacagcaccctgtacatctagcattctgcaagaaaagcagcgcgaactgtacagagtgtccctgagaaggcagcgcttcccggctcagggatccatcgagatccatgaggacagtgaggaaggctgcccacagcgaagttgtaaaacccacgtcctcctgttagtgctccatggcggaaatatccttgataccggggcaggggaccctagttgtaaagccgctgacatacacacatttagtagcgtgctggaaaaagttacacgcgcacactttcctgccgctcttggtcacattcttattaagtttgtgccatgtccggctatttgttcagaagcgttctcactggtgtcccatctgaacccctacagtcacgacgagggatgtctcagctcgtcccaggatcacgtgccactagctgccctgcctctcttagccatctccagcccccaataccaagacgccgttgctaccgtgattgagagggctaaccaggtgtatcgggaatttctaaaaagctccgatggaatcggttttagcggacaagtctgccttataggcgactgtgtgggaggcctgttggcgttcgatgcaatctgctacagtgccggaccgtcaggggattcccccgcatcctcaagccgaaaggggtccatctctagcacccaagacacaccagtggcggtcgaagaggattgttctctggcctcatccaagaggctctcaaaaagcaatattgatatctcttctggcctggaggacgaggagccgaagagaccacttccgaggaagcagtccgacagctcaacgtacgattgcgaggcaatcacccaacaccatgctttcttgagttccatccactcttctgtgctcaaagacgaaagtgaaacgcccgcagccggagggccacaactccccgaggtaagcctgggcagattcgacttcgacgtgtcggattttttcctttttggctcaccgcttggtttagtgctggccatgaggcggaccgtcctccctgggctagacggattccaagtcagacccgcatgctcccaggtttacagcttcttccactgtgcagatccaagcgcgtcccgcttggagccactcctggagccaaagtttcacctggtcccaccagtaagcgtccccaggtaccagcgatttcctttgggagatggccagtccctccttctagccgatgccctgcacactcatagccccctttttctggaaggctcttcacgggactctcctcctctccttgacgcccctgcatctccgcctcaggcttcacgtttccagcggccagggagaaggatgtcagaaggatcatcccactctgagtcctctgaatctagtgattctatggctccggtcggtgcctcaagaatcacggcaaagtggtggggatctaaaagaatcgactacgccctatattgcccagacgtgctcacagccttcccaaccgtagctcttccccacctgtttcatgcaagctattgggaatccaccgacgttgtggccttcattctccggcaggtcatgagatacgagtcagtcaatatcaaggaaagtgcaagactggaccccgctgcactatcgcctgcgaaccctcgcgagaagtggttgcggaagaggacccaggttaagcttcgcaatgtgactgccaaccatagagctaatgacgttatcgcggctgaggatggtccccaggtgctggtaggccgatttatgtatggccctctggatatggtggcgctgacaggggaaaaagttgacatactagtaatggctgaacccagctccgggagatgggtacatctagatactgaaatcaccaatagtagcgggcgaatcacgtacaatgttcctaggccacgaaggctcggtgtcggcgtttacccagttaaaatggtcgttaggggcgatcagacctgtgccatgagttacctgacagtactgccgagagggatggagtgtgtcgtcttttcgatcgatggctcctttgcggcaagtgtatcaatcatggggagtgatcctaaagtgcgcccaggagcagtggatgtagtgcggcactggcaggacctggggtatatgatactttatatcactggccgacccgatatgcagaagcagcgcgtggtctcgtggctttctcaacacaacttcccccaagggatgatcttcttcagtgacggcttggttcacgaccccctccgccagaaggctatctttcttcgcaatctgatgcaagaatgctttataaagattagtgctgcttacggatctacgaaggacatttccgtatatagtgtgctgggtttgcccgcatcacagatatttatcgttggcaggcccactaaaaagtatcagacgcaatgccagtttctgtcagagggatatgcagcccatctggctgcgcttgaagcctcccataggtccaggccaaaaaagaataactcccgtatgattctccgcaagggcagttttggcctacacgctcagccggagttcctacgcaaaagaaaccatctccgaagaacaatgtcagtgcagcagcctgacccccctgcggctaaccctaagccagagcgggcacagagtcagcccgagagcgataaagatcacgagaggcccttacccgcactgtcctgggcccgagggcctccgaaatttgagagtgtcccttag

SEQ ID NO: 235067 - DNA, 2817 bp, Artificial Sequence
  Description of Artificial Sequence: Synthetic coding sequence
atggctaaagccggacgagctggaggccctccccctggcggtggcgcaccttggcacctgcggaacgtgctctctgactccgtggagagctccgacgatgagttctttgatgcaaggggcgaaggtacagccccatgtacttctagcattttacaggaaaagcagagagagctgtacagagtcagcctcagacgccagcgctttccagcacagggatccatagaaatccatgaggactccgaggaaggctgtccacagcgctcttgcaagacacatgtgctcctgctcgtcctgcacgggggtaacattctagatacaggggcaggggaccctagctgtaaagctgcggatattcacacattctccagcgttttggaaaaagtaacgcgcgctcacttccccgcagctctcgggcatatcttaattaaattcgtgccatgccccgcaatatgctctgaggctttctctctggtcagtcacctcaacccctactcccacgacgaaggctgccttagctcttcgcaagatcatgtgccgcttgcggcacttcccttgctcgctatctcatcaccccagtatcaggatgccgtggccacagtaattgaaagggccaaccaggtgtatagggaatttctcaagtcctccgacgggataggttttagtgggcaggtgtgtctgattggggactgcgttggaggccttttggcgttcgacgctatatgttactccgcgggtccctccggggactcacccgcttcctcctccagaaagggctccatctcctcaacccaagatacaccggtagctgtcgaagaggattgttcccttgcaagcagcaagcggctaagcaaaagcaacatcgacatctccagtggcctcgaggacgaggaacccaagcgcccattaccgaggaagcaaagcgacagctccacctatgactgcgaggccattacccaacaccatgcattcttgagctcaattcatagctccgtccttaaggacgagtcggagaccccagccgctggcggtccccagctgcccgaggtcagtctcggcagattcgattttgacgtatcagacttttttttgttcggctcgccactcggtctcgtccttgcaatgcggaggaccgtactccccggtctagacggattccaagtgcgacccgcatgtagccaggtttactcttttttccattgtgcagatccttcagcttcacgcttagagcccttgctggagccaaaattccacctcgtgccacccgtgagcgtccctagataccagagatttcccctgggggatggtcaatctcttttgctggctgacgcactccacactcacagcccccttttcctcgagggctcatcccgcgactctccacccttgctcgacgctccggcttccccacctcaggcgagtcggtttcagcggcctgggcgaaggatgtcggaggggagctctcattctgagtcttccgagagctcagattcaatggctcctgtgggcgcatctcgaatcacagcgaagtggtggggcagcaagcgaatagactatgccttatactgcccagacgttctgactgctttccctaccgtggctctgcctcacctctttcacgctagctactgggagtccaccgacgtggtggcttttattcttagacaagttatgagatacgagtccgtgaacatcaaagagtctgcccgactggatccagccgcacttagtcctgccaatccccgagagaaatggttgcggaagcgtacacaggtgaaattacgtaacgtgacagcaaaccacagagccaacgacgtgatagccgcagaggacggtccacaagtgctcgtcggaagatttatgtacgggcctctcgacatggtggcactcaccggagagaaggtcgacatcctcgtcatggcggagccaagctcaggtcgctgggtgcacctcgacactgaaattactaactcaagcggtagaatcacatataacgtacctagacccagaaggctcggcgtaggggtgtacccagttaaaatggtagtgcgaggggaccagacctgtgcaatgtcgtacctcactgtgctaccgaggggaatggagtgcgtcgtgttcagcatagacgggtcattcgcagctagcgtttctataatgggctctgatccaaaggtaaggcccggagccgttgacgtcgtccgtcactggcaggatttggggtatatgattttgtacattaccgggagacccgatatgcaaaagcagcgcgtcgtctcttggctgagtcagcataacttcccacagggcatgattttctttagtgatggcctcgtgcacgaccccctgcggcaaaaggccatatttctgaggaacctcatgcaggaatgtttcatcaaaatctcagctgcttatgggtccactaaggacatttctgtgtattccgtgctggggctgccagccagccaaatcttcatcgtgggacgaccaacgaaaaagtaccagactcagtgtcagtttctgagcgagggatacgccgctcatctggcagccctggaggcctcccatcggagccggccaaaaaaaaataactccaggatgattttgcgcaagggttcgtttggtctgcacgcacagcctgagtttttacgcaagcggaatcatctgcgtcgcacgatgtcagttcagcaaccagacccccctgcggcaaaccccaaaccggagcgtgcccagtctcaaccagagtccgataaagatcacgagcgccctctcccagcgctgtcttgggcgagaggtccccctaagttcgagtccgttccttag

SEQ ID NO: 235068 - DNA, 609 bp, Artificial Sequence
  Description of Artificial Sequence: Synthetic coding sequence
atggcaacgctgatctatgtcgacaaggaaaatggcgagcccggaactagggtagtagccaaggacgggctgaagttaggttctgggccttctattaaggcccttgacggccgatctcaggtgtccacaccgcgatttggcaagacgttcgacgccccacccgcattgccaaaagccaccaggaaggcactagggaccgtcaacagggctactgaaaaatccgtgaagaccaagggccctcttaaacagaagcagccttcgttctcagctaaaaagatgacagagaagacagtgaaagctaagtcttctgtaccggcaagcgacgatgcgtacccagagatcgagaagtttttcccttttaaccctctcgatttcgagtcttttgatttacccgaggagcaccagatcgctcatctgcccctgagtggagtccccctaatgatactcgacgaagagagggagctggaaaaattgtttcaacttgggccaccttcacccgtgaaaatgccatcacccccttgggaaagcaatctgctacaaagcccgtcctccatcctatcaacccttgacgtcgagctgccaccggtctgctgcgatattgacatctag

SEQ ID NO: 235069 - DNA, 609 bp, Artificial Sequence
  Description of Artificial Sequence: Synthetic coding sequence
atggctactctgatttacgtggataaagagaatggagagcctggcactagagtggtcgctaaggacggcctcaaacttgggagtggtccatccataaaagccttagacggccgaagccaagtgtcgacacctcgctttgggaagacgttcgacgcacccccagctctgccgaaggcaacccgaaaggccctgggcaccgtaaatcgcgcaacggagaagagcgtgaaaaccaagggccctctgaaacagaagcagccttccttttccgccaaaaaaatgactgagaaaaccgtcaaggccaagtcaagtgttcccgctagcgacgacgcctaccctgaaatcgagaaattcttcccctttaacccactggatttcgaaagtttcgatctaccagaagagcatcagattgctcacctgccactgtccggtgtccccctgatgatactcgatgaggagcgggaactggagaagctatttcagttggggcctccatctcctgtcaagatgccaagccccccttgggaaagcaacctgttgcagtctccttccagcattctgtccacattggatgtggagcttccccctgtctgctgtgacatcgacatctag

SEQ ID NO: 235070 - DNA, 609 bp, Artificial Sequence
  Description of Artificial Sequence: Synthetic coding sequence
atggctaccctgatctacgtcgataaggaaaatggagagcctggcaccagagtagtggccaaagacggacttaagctcggcagtggaccctcaataaaagccctggacggcagaagtcaggtctcgactccgcgtttcgggaagactttcgatgcaccaccagcactgccgaaggcaaccagaaaggccctgggaactgtgaaccgagcgaccgaaaaaagcgtaaagactaaggggcctctgaaacagaagcaaccctccttttctgcaaagaaaatgaccgagaagacggtcaaggctaagtcaagtgtccctgccagtgacgatgcgtatcctgaaattgagaaattcttcccctttaatcccctcgattttgaaagctttgatcttcccgaggaacaccagattgcccatttacccctgagcggagtgcccctgatgattttagatgaggagcgagaactcgaaaaactctttcagctgggtcccccatctcctgtcaaaatgccctctcccccttgggaatcaaaccttttgcagtctccctcatctatcctaagcacactggacgtggagctgccccctgtttgttgtgatattgacatatag

SEQ ID NO: 235071 - DNA, 543 bp, Artificial Sequence
  Description of Artificial Sequence: Synthetic coding sequence
atggcccctggggtggccagaggacctactccatactggcggctgcgtttgggtggtgctgctcttttgctccttctgatccctgtcgcagccgcacaagagccgcctggcgctgcctgttcgcaaaatactaacaagacttgcgaagagtgtcttaagaatgttagctgtctgtggtgcaacaccaacaaggcatgtctggattaccccgtgacctctgtcctacctccggcaagcctgtgtaagctatcttccgccaggtggggcgtgtgctgggtgaattttgaagccctcattatcacaatgtctgtggtaggcggaacactgctgctgggaattgcgatctgttgctgttgttgctgccggaggaagcgcagccgtaagccagacaggtctgaggagaaagcaatgcgcgagcgagaagagcgcagaattagacaggaagaaaggcgcgcagaaatgaagacacgacatgatgaaattcgaaagaagtacgggctgttcaaagaggaaaatccgtacgcccgatttgagaataactag

SEQ ID NO: 235072 - DNA, 429 bp, Artificial Sequence
  Description of Artificial Sequence: Synthetic coding sequence
atggcacctggtgtggcacgcggacctaccccctactggagactgcgactcggcggtgccgctctgctcctgctcctcatccctgtggctgccgcacaggaacctccaggagctgcttgcagtcagaacactaacaagacttgtgaagaatgtttaaaaaatgtgagtgcatgtttgaaaaagaagacccgcatgcttgacctcaagacaacgaaggctttacaacatatttctcctgacgccagctgcgaggtacatgcccctcagccttcccccgctggacggcctaggggccattgcggacttttaacattagcctctgaacccgcatccctgccaggccaggcagctggggagcttcctttgaaggactcacccctcgttctgcagaccggagatctccttttccccgttcacttgtgcttttag

SEQ ID NO: 235073 - DNA, 576 bp, Artificial Sequence
  Description of Artificial Sequence: Synthetic coding sequence
atggccaccctgatttacgttgataaggaaattggagagcccggtactcgtgtggctgccaaggacgttctgaagttggagtcacggccttccattaaagcactggacggaattagccaggtgctgacacgtcggttcggaaagacctatgacgctcctagcgcattacccaaggctacacgcaaggccctggggactgtcaatagagcaaccgagaagtccgttaagacaaacggcccacgcaagcagaaacagccatcattctcagccaagaaaatgacagaaaagaccgtgaagaccaaatccagcgtgccagcaagtgatgatgcctatcctgagattgaaaaattctttccttttaaccttctagacttcgagagtttcgacttgccagaagagcgacagattgcccaccttcccctctctggcgtgcctttgatgattcttgacgaagagggcgagctcgagaagctcttccagctcggacctcccagtcctgtgaagatgccctctccaccctgggagtgtaatctcttcgccgtctcgttcaagcattcagttgatcctgggtgctag

SEQ ID NO: 235074 - DNA, 2586 bp, Artificial Sequence
  Description of Artificial Sequence: Synthetic coding sequence
atgacaggccgtgctcgagcacgtgctcgaggtagagccaggggacaagagacagcacagcttgtgggctcgaccgccagccagcagccgggatacatacaaccgcgaccccagccgccacccgcagagggggaattattcggtagggggagacagagaggcaccgccggaggaactgcaaaatctcagggtctgcagattagcgctggcttccaggagctttcactcgctgagcggggtggaagaagacgcgattttcacgatctgggggtgaataccaggcagaacttagaccatgtgaaggaatccaaaaccggaagtagtggtataattgtcaggctgagcactaaccatttcagactcacgtcgcgtccccaatgggccttgtatcagtatcacatcgattataaccctctcatggaagctaggcggttgcgatcagccctgctgttccaacatgaggacctgattggtaagtgccatgccttcgatgggaccatcctgttcttgccaaagcgcctccagcagaaagttactgaggtgttctcaaaaacgcggaacggagaggatgtgagaataactattaccctgaccaacgaactccctccgacatcaccaacctgcctgcagttttacaatattatttttagaagattactgaagattatgaacttacagcagattgggaggaattactataaccctaacgacccaattgatatcccgtctcaccggttagtgatctggcccggatttacaaccagtattctccaatacgagaatagtattatgctgtgcactgacgtcagccacaaggtgctccgcagcgaaaccgttctcgactttatgtttaatttctatcaccagaccgaagaacacaagttccaagaacaggtgtctaaagagctgattggtcttgtagtgttaactaagtacaataacaagacttatcgagtcgacgatattgactgggaccagaatccaaagagtacgtttaaaaaagcagacggaagtgaagtgtccttccttgagtattacaggaagcaatacaaccaggagataaccgacctcaaacagcctgtgctggtcagtcagcccaaaaggcgtcgcggtccaggagggactctgccaggcccagctatgctgattcccgaattatgctatcttaccggattgaccgacaaaatgcgcaacgacttcaacgtcatgaaagatctggccgttcatacgcgactcacccctgaacagcgccagcgtgaggttgggagactgatcgactacattcacaagaacgacaacgtgcagagagaactgcgcgattgggggctcagcttcgatagtaatttgctgtctttttcgggcagaatcctccagaccgaaaagatccaccagggcggtaagactttcgactataaccctcaatttgctgattggtctaaagaaacgcgcggtgccccactgatatccgtcaaaccacttgacaattggctgctcatctacacccgaaggaactacgaagctgccaattctctcatccaaaaccttttcaaggtcactcccgctatggggatgcagatgcggaaagccattatgatcgaggtggacgacaggacagaggcatatctcagagtgttgcagcagaaagtgactgcggacacacagattgtggtgtgtttgctgtcttctaatagaaaagacaagtatgacgccataaaaaaatatctctgtaccgactgtcctactcccagccagtgtgtggtcgcaagaactctcggcaagcaacagaccgtgatggctattgccaccaagatcgcactacagatgaactgcaaaatgggcggagagttatggcgcgtggatattcctcttaaactcgtgatgatcgttggaattgattgctaccatgatatgactgccggacgcagatcaatagccggatttgttgcgtcgatcaatgagggcatgacccgatggttcagccgctgcatttttcaggaccggggacaggagctggtggacggactgaaggtttgcctgcaggctgcgctgcgggcatggaattcttgtaacgaatacatgcccagccggatcattgtctaccgcgacggggtcggcgacgggcagctcaagactctggttaattacgaagtacctcagtttctagattgcctgaaatccatcggtcgcggatataaccctcgcctgacagtgatcgtcgtaaagaagcgcgtgaacacgcgcttcttcgcccagtccgggggtaggcttcaaaacccacttcccggaactgtgatcgatgttgaagtgacacgcccagaatggtacgacttctttatagtcagccaggctgtgcggtcaggaagtgtaagtcctactcattacaatgtcatctacgacaactcaggcctgaaacctgatcatatccaacggttaacatataaattgtgccatatctattataattggcccggtgttattcgcgtccctgccccatgccagtacgcccacaaattggcttttctcgttggtcagtccatccaccgggagcccaacctatctctgagcaataggctctactacctgtag

SEQ ID NO: 235075 - DNA, 369 bp, Artificial Sequence
  Description of Artificial Sequence: Synthetic coding sequence
atgacaggcagggccagagcgcgagcaagaggcagggcaagggggcaggaaacagcccaactcgtaggtagtacagcctcgcaacaaccgggttatattcagcctcgaccacagccacctcctgccgagggcgaactattcgggagagggaggcagagagggacagcaggtggaacggcgaagagtcagggtttgcagatttcagcaggctttcaggagctctccctagccgaacgcggaggacgacgccgagattttcacgacctgggggtgaatacccgccagaatctagaccacgtgaaggagtccaagaccgggtcatcaggaatcatagtaaggctcagcaccaaccacttccgcttgacttag

SEQ ID NO: 235076 - DNA, 453 bp, Artificial Sequence
  Description of Artificial Sequence: Synthetic coding sequence
atgaccggtagggccagggctagagcacgtgggagagcacgaggccaggagaccgcgcagttagtgggctcaaccgcttcccagcagcccggatacattcaacctaggccccaaccccctcctgccgaaggagagctgttcggacgaggcagacagcggggtaccgcagggggaacagccaagtctcagggactgcaaatcagcgccggatttcaggagctttccctcgctgagcgtggtgggagaaggcgcgactttcacgaccttggtgttaatacgcgccagaacctggaccatgttaaggaatctaaaaccgggtcatctggcattatcgtcagactgtcgaccaatcacttcaggcttacttccagaccacagtgggccctgtatcagtaccacattgattacaatccactgatggaagcacggcgactgaggagcgcattgctttag

SEQ ID NO: 235077 - DNA, 519 bp, Artificial Sequence
  Description of Artificial Sequence: Synthetic coding sequence
atgactgggagggcccgagccagggcccgaggcagagcaaggggtcaggaaaccgcacagctcgtgggctccacggctagccagcaacctggctacattcagcctagaccgcagcccccacccgcagagggcgaacttttcgggaggggcagacagaggggtactgctgggggtactgccaagtctcaaggcctgcagatctccgccggtttccaggaactgagccttgctgaaaggggcggtcgccgaagggacttccacgatctaggcgtgaatacccgccaaaatctcgaccacgttaaggagagtaaaaccggaagctctgggataatcgtgcgtctctccactaaccactttaggctgactagtcgacctcagtgggcgttgtatcagtaccatatcgactacaatcctctcatggaggcgagaagattaagaagcgcactgcttttccagcacgaggacttgattggcaaatgtcacgcgttcgacggaacgatactcttccttccaaaatag

SEQ ID NO: 235078 - DNA, 498 bp, Artificial Sequence
  Description of Artificial Sequence: Synthetic coding sequence
atgactggcagggccagggcacgagctagagggagagctcggggtcaggaaacagcccagctggtgggttctactgcgtctcaacagcctggctatatccagcccaggcctcaacctcctccagctgagggtgagctgtttggaagagggagacagagaggaaccgccggtggcactgcgaaatcccagggcctgcagatctcagccggatttcaggagctgtcccttgccgagcgcggagggcgtcggcgtgactttcacgatcttggagtgaacacccgtcagaatctggaccacgttaaggaatctaaaactgggagctcgggaattatcgtgagactttcaaccaaccactttaggctgacctctcgtccacaatgggccttgtaccaataccacattgattacaatcccctcatggaggccaggcggctgaggtcagccttactgtttcaacacgaagacctgattggaaagtgtcacgcatttgacggatag

SEQ ID NO: 235079 - DNA, 2922 bp, Artificial Sequence
  Description of Artificial Sequence: Synthetic coding sequence
atggacccctttagaccatcctttcgaggtcagagtcctatacatccttcgcaatgtcaggctgtccggatgccaggctgttggccacaggctagcaaacctctggaccctgcattgggcaggggggcacctgctggaaggggccatgtctttggcaaacccgaggagccttctacccagcgcggtccagcacagagagaatccgttgggctcgtctctatgtttcggggtttgggaatagagactgtgtctaaaacacccctgaaaagggagatgctccccagcgggcgtggaatccttggaaggggcctctccgctaacctggtccgcaaggatagggaagaactctcccctacattctgggaccctaaagttcttgccgcaggcgacagtaaaatggctgagacaagcgtgggatggtccagaacactgggcagggggagctcggatgccagtctgcttccccttgggagagcggctgggggtatctctcgcgaagtagataagcctccttgcacattttcaacgccgtctcgcggaccgcctcagctttcttcaccacccgctctgcctcagtctccactccatagccccgaccgaccactggtcctaacggtggaacataaggaaaaggaactgattgtcaaacagggctctaaggggacccctcagtccctcggcctaaaccttgtgaagattcagtgtcataatgaggccgtgtatcaataccacgtgacgttttccccaaacgtggagtgcaagagcatgcgtttcgggatgctgaaagatcatcaagccgtgacaggcaacgtaaccgcctttgacgggtccatactctacctacccgtgaagctccagcaggtgctcgaactgaagagccagcggaagacagattcggccgaaattagtattaagatccagatgactaaaatcttagagccttgcagcgacctgtgtatcccattctataacgtggtcttcagacgcgtgatgaagctgctggacatgaagctcgtcggccgtaatttctacgatccaacatccgccatggtcctgcaacagcatcggttgcagatttggcctggatacgctgcgtctatacgaaggacagacggagggctgttcctgttggctgacgtgtcacataaggtgatcaggaatgattgtgttctcgatgtgatgcatgcaatataccagcagaataaagagcactttcaggacgagtgcactaaactgttagtgggaaacatagtcatcaccaggtataacaaccggacttatcgtattgacgatgtggattggaacaagaccccaaaggactcttttacaatgtcggatggcaaagaaatcacctttctggaatactattcgaagaattatggaatcaccgttaaggaggaagaccagcctcttttgattcaccgcccaagcgagaggcaagataaccatgggatgcttctgaagggagaaatccttctactgccagagttgtccttcatgactggcatcccagaaaagatgaaaaaggatttccgagcaatgaaggatctggcacagcaaatcaatctgagccccaagcaacaccattccgccttagaatgtcttctgcagagaatcgctaaaaatgaagccgcaactaatgagctgatgaggtggggcctcaggctgcagaaagacgtacataagatcgagggcagagtgttgcctatggagagaataaacctcaaaaacaccagcttcataacgtcacaggagttaaactgggtgaaggaggtgactcgggaccctagcatcctgactatccctatgcatttttgggcgctgttttaccctaaaagggccatggaccaggcaagggagctcgtgaacatgctggagaaaatcgctggacccataggcatgcgaatgagtccccctgcttgggttgagctcaaagacgatcggattgagacctacgtacgcaccatccaatccacactgggtgcggagggaaaaatccagatggtggtctgtattataatgggaccacgcgatgacctttacggcgcaattaaaaaactctgctgtgttcagtcgcccgtgccttcgcaagtggtcaatgtgagaactattgggcaacccactcgcctcagatccgtggcacagaagattctgctccagattaattgcaagctcggcggtgaactgtggggcgttgatatccctctaaagcagctgatggtcatcggcatggatgtctaccacgacccatctagaggtatgaggtccgttgtaggatttgtggctagtattaacctcactcttacaaagtggtatagccgggttgtgttccagatgccacaccaagagatagttgactctttaaagctctgtcttgtggggagcctaaagaaattctacgaggtgaatcactgcctcccggaaaagatagtagtgtatcgggatggcgtatctgatggccagctaaagactgtggccaattacgagattccccaattgcaaaaatgttttgaagcattcgaaaactatcagcccaagatggtggttttcgtggtgcagaagaaaatcagtacgaacttatatctcgctgctccacagaatttcgtcactccaaccccaggcaccgtcgttgaccatactattacctcatgtgagtgggtggatttctacttactggcacatcacgtgagacaaggatgcggcattcctacacactatgtgtgtgtgctcaatacagccaacctttcccctgaccatatgcagagactcacattcaagctctgccacatgtactggaattggcccggaaccattcgagtacccgctccctgcaaatatgcacataagctggccttcctaagtgggcacattctgcaccacgaaccggcaatccagctttgtgaaaatctcttctttctgtag

SEQ ID NO: 235080 - DNA, 2922 bp, Artificial Sequence
  Description of Artificial Sequence: Synthetic coding sequence
atggatccgttccgcccttcctttcgcggtcagtctcccattcacccgagccagtgtcaggctgtgagaatgccagggtgctggccccaggctagcaagcccctggaccccgcactgggcaggggagcacctgctggtaggggacacgtttttggtaagcccgaggagccgtcaacccaacggggacccgctcagagagagagtgtcggtcttgtttcaatgtttaggggactgggaatcgagacagtctctaaaactcccctaaaaagagagatgttgccaagcggaagaggaatcctaggccgtggcttgagcgctaacttagtgagaaaagaccgtgaagagctcagccctacgttttgggatccaaaagtgctggctgcaggagacagcaaaatggctgagactagcgtgggttggtcgcgaacactgggccgaggcagcagcgacgcatcactcctgccattgggcagagcagccggtgggatcagccgcgaagtcgataagcctccatgtacattttccacaccctccagagggcctcctcagctctcgtctccccctgccctgccccagtctcccttgcactcaccagacagacccttggtcctcacagtggagcacaaagagaaggagctaatagtgaagcagggctctaaagggactccccagagtctcggcctgaatttggtcaaaattcagtgccataatgaagccgtttaccaatatcacgtaacattttcacctaacgttgagtgcaaaagcatgcggtttgggatgctcaaggaccaccaagctgtgaccggcaatgtgactgccttcgatggatccatcctgtacttgccagtgaaactccagcaggtcctggagttgaaaagccagcgaaaaaccgactccgccgaaatctctattaagattcagatgactaaaatacttgagccttgtagcgatctgtgtatccctttctataacgtggtattccgtcgcgtcatgaagctgttagacatgaaactagtgggcagaaacttctacgatccaacatctgccatggtcctgcagcaacatcgattacagatatggccgggatacgcagcctcaattcggagaactgacggcggactgtttctcttagcggatgtatctcacaaagtcatacggaatgactgtgtgctagacgtgatgcacgccatttaccagcaaaacaaagagcactttcaggacgaatgtaccaaactgttagtgggaaatattgtgattacacggtataataacagaacgtacagaatcgatgacgttgactggaacaaaacacccaaagattcctttacgatgtctgacggtaaggaaatcacgtttctcgaatattactctaagaattatggtatcacagtgaaagaggaagatcagcctctcttgatccatcgtccctctgagcgccaggacaatcacgggatgctgctaaagggcgagatcttgctcctccctgagctatcatttatgacgggaattccggaaaaaatgaaaaaagatttcagggctatgaaggatctggcccagcagatcaacctctcacccaagcagcatcactccgccctggagtgccttctacagaggatcgccaagaacgaggcagctactaacgagctgatgcgctggggcttgaggctgcaaaaagacgtgcataagatagaagggcgagtgctgccaatggagcggattaacctgaaaaacaccagtttcataacaagtcaagagcttaactgggtgaaagaggtcacaagagatccaagcatcctcactattccaatgcatttttgggccttgttttaccccaagcgcgcaatggatcaagcgagagaactcgtgaatatgttggaaaaaattgccggtcccataggcatgcgcatgtcccctcctgcctgggttgagttaaaagacgaccgaattgaaacatatgtgcgtaccatccagtccactctgggggctgagggcaaaatacagatggttgtttgtattattatgggtccccgtgacgatctgtacggcgcaatcaaaaaactgtgctgcgtgcagtcccccgtgccctcacaggttgtcaatgtgcggaccattggacagcccacccgccttcggtcagtggcacaaaaaatcctcttgcagatcaattgtaagttggggggagaactttggggtgttgacatcccattgaaacagctgatggtcataggcatggacgtgtatcacgacccgtctagaggcatgagatctgtagtggggtttgtagcgtccattaacctcactcttacaaaatggtactcgcgagtggtgtttcagatgccacaccaggaaattgtggatagccttaagctgtgcttagtagggtccttaaagaagttctatgaggtgaaccactgccttccagagaagatcgtggtctatcgcgacggtgtgagtgatggtcagttaaaaactgtggccaactacgagatcccacagctgcagaagtgtttcgaagcttttgaaaactatcagccaaagatggtggtgttcgtagtacagaaaaaaattagcacaaatctgtacctagcagcgccacagaatttcgtaacaccaacaccaggaacagtcgtcgaccacactatcacaagctgcgagtgggtggatttctatctcctggcacaccacgttcggcagggttgtggtataccaactcactatgtctgcgtgttaaataccgccaatcttagtcctgaccatatgcaacgcctcacctttaaactgtgtcacatgtattggaactggcctggcacaatccgagtccctgcaccatgcaagtacgctcataaactggcgtttctcagcggacacattctccaccacgagcctgcaatccaattgtgcgagaatctattcttcctctag

SEQ ID NO: 235081 - DNA, 639 bp, Artificial Sequence
  Description of Artificial Sequence: Synthetic coding sequence
atgaaggtgtttaaatttataggacttatgattctgcttactagtgccttttctgctggatctggtcaatcccccatgacagtcctgtgctcaatagactggtttatggttaccgttcatcccttcatgctgaacaacgacgtatgcgtgcacttccacgaactccatctgggactaggttgcccacccaatcatgttcagccacacgcgtaccagtttacctacagggtgacagaatgtggaatccgagcaaaggcagtgtcacaggacatggtgatttactccaccgagatacactacagcagtaaagggacaccctcaaagtttgtgatcccagtatcttgtgcagcaccccagaagagcccttggttgactaagccatgtagcatgagggtcgcatccaagtcaagggcaaccgctcagaaagacgagaagtgctacgaggtgttttcccttagtcaatcgagccagcggcctaattgtgactgccccccttgcgtgttttctgaggaggagcacactcaagtcccatgtcaccaagcgggtgcgcaggaggcccagcctctgcaaccaagtcactttctcgatataagcgaagactggtccctgcatactgatgacatgattgggagtatgtag

SEQ ID NO: 235082 - DNA, 294 bp, Artificial Sequence
  Description of Artificial Sequence: Synthetic coding sequence
atgcgtccccttctgtgcgcactcactgggctggcccttcttcgagctgccggtagtttagccgctgctgaacccttttcgcccccacggggagattccgctcagtccacagcatgtgacaggcatatggccgtgcaaagacgcctggacgtgatggaagagatggtggaaaaaactgtggatcacctggggacggaagtgaagggattattaggcctattggaggaactcgcctggaacctgccaccgggaccattttcccccgctccagacctgctgggagatggattttag

SEQ ID NO: 235083 - DNA, 264 bp, Artificial Sequence
  Description of Artificial Sequence: Synthetic coding sequence
atgagacctctattgtgcgcgctgacgggcttagcacttctccgagcagctggtagtctggccgctgctgaaccctttagccccccacgcggtgatagcgctcagagtaccgcttgcgatcggcacatggccgtccagcgcaggctagatgttatggaggagatggcctcagagccatggtcatggtcccccgctgttgggggtggagccccagcaagacaacgacctcagaaccagccttgcccgctggactttctgccatag

SEQ ID NO: 235084 - DNA, 168 bp, Artificial Sequence
  Description of Artificial Sequence: Synthetic coding sequence
atggcggttcagcgcagattggatgtgatggaagagatggtggaaaaaacggtggatcatctaggcacagaagttaaagggttactcggcctgttggaggagctcgcatggaatctgcctccaggcccatttagtcctgcgccagacctgcttggggacggcttttag

SEQ ID NO: 235085 - DNA, 2244 bp, Artificial Sequence
  Description of Artificial Sequence: Synthetic coding sequence
atgaaccatagccccctcaagacagccttggcctacgaatgctttcaagatcaagacaacagcacccttgcattaccttcagatcagaaaatgaagacggggacatccggtagacagcgagtccaagagcaagtgatgatgaccgtcaagcgacagaagtcgaagtcttcacagtcttccacactctcgcactccaatagaggttccatgtatgatggcctcgctgataactacaattatgggaccacttctcgcagctcttactatagtaagttccaggcgggaaacggcagctggggttatccaatctataacggaacccttaagagggaacccgataatcgtcgattctcttcctactctcagatggaaaattggtccaggcattacccaaggggatcttgcaacacaacaggtgccggaagcgatatttgcttcatgcagaagattaaggccagtagatccgagcccgacctgtactgtgacccacgtggcaccctgcgaaaaggcacactaggctccaagggtcaaaagactacgcagaacagatacagtttttacagtacctgcagcggtcagaaagctattaagaaatgtccagtcagaccaccatcctgcgcaagcaagcaagaccctgtctacatcccccctattagttgtaataaggatctttcgttcggtcactcacgggcatcctccaaaatttgttccgaggacattgagtgttctggtttgaccatccctaaggcggtgcaatatttgtcttcacaggacgagaaataccaggccataggtgcctactacatccagcacacatgcttccaggacgagagtgccaagcagcaggtctaccaactgggcggtatttgtaaactagtggatctgctgagaagtcccaaccagaacgtccagcaggctgctgccggagctctgagaaacctcgtattcaggagcaccaccaacaagctggagacccgcaggcagaatggcattcgcgaagcagtatccttgctgcggagaacagggaatgccgagattcagaagcagttaacagggctgctctggaaccttagttctactgatgaactcaaagaggagctgattgccgacgctttgccagtattagctgatcgggtgattatacctttttccgggtggtgtgacggaaattcaaacatgagccgggaagttgtggatccagaagtgttcttcaatgccactggttgtctaaggaagcgcctgggtatgagggagctgctcgcacttgtgccccaacgcgctacttccagtagagtgaacctgtcaagtgccgatgccggtcggcaaaccatgaggaactattccggacttattgatagcctgatggcctacgtgcagaactgcgtggctgcaagcaggtgcgatgataagtcagtcgagaactgcatgtgtgtgctccacaatctatcttatcggcttgacgcagaggtacccacccgataccgacagctcgagtacaacgccagaaacgcctatacagagaaaagtagcaccggatgctttagcaacaaaagtgacaaaatgatgaacaacaactacgactgtcccctaccggaggaggagaccaaccctaaaggctccggatggctctatcactcagatgctatccgcacgtacttgaatctgatgggcaagagtaaaaaggatgctacactcgaggcctgtgccggagcactccagaacctcaccgcaagcaaaggcctcatgtcctcaggcatgtcccaactgattggactcaaagaaaaagggcttccccagatcgcgagattgctgcagagcggtaacagcgacgtggttcgctccggcgcatcgctacttagtaacatgtcacgccaccccctgctgcaccgggtaatggggaaccaagttttccctgaagttacccgcctgctgacaagccacactggtaatacctcaaacagcgaggacatcttgagctctgcctgttataccgtccgaaatctgatggccagtcagcctcagctggccaaacaatatttttcaagcagcatgctcaacaatatcattaatctttgccgaagcagtgcaagtcccaaagcggctgaagctgcccgactgctcctgtccgatatgtggtcttcaaaggaactgcagggtgtcctccggcaacagggcttcgatagaaacatgttaggtacattggctggtgctaacagcctgaggaactttacaagccgcttctag

SEQ ID NO: 235086 - DNA, 2244 bp, Artificial Sequence
  Description of Artificial Sequence: Synthetic coding sequence
atgaaccattcccccctgaaaacagcgctggcctatgaatgcttccaggaccaggataactcaactctggctctgccctctgatcagaaaatgaagaccggcacgagcggccgtcagcgggtccaggagcaggttatgatgaccgtgaagagacagaaatctaagagtagtcagagctcaaccctttctcattctaacagaggatctatgtacgatgggctggctgataactacaattacggcaccactagtagatcgtcttactactcaaagtttcaggcaggcaacgggagctggggttaccccatctataatggcacactcaagcgagagccggacaacagaagatttagtagttattcccagatggagaattggtcgaggcattacccgaggggctcctgcaatactacaggggctgggtcagatatctgctttatgcagaaaataaaggccagcaggtccgaacccgacctgtattgcgatccaagagggactctgaggaagggcaccttaggcagcaagggccagaaaactactcagaataggtattcattttacagtacttgtagtggacaaaaggcaataaaaaaatgtcctgttcgtcccccaagctgcgcctccaaacaagaccctgtgtatatccctcctatcagctgtaataaagacctgtctttcggtcacagcagggcaagctctaaaatatgttccgaggatatcgagtgcagcgggctaacaataccaaaagcggtgcagtatctgtcctcacaggacgagaagtaccaggcaatcggagcctactacatccagcacacatgttttcaagatgaaagcgcaaaacagcaggtttatcagttggggggaatctgcaaactggtcgaccttctcagaagtcccaatcagaatgtgcagcaggctgctgccggtgccttgaggaatctggtgttcagaagcacgactaacaagctcgaaacccggagacagaacggaatcagggaggcagtgtctcttttacgacggactggcaatgcagaaatccagaaacagctgacagggttactgtggaacctaagctccactgacgaactgaaagaggaactgattgcggatgcacttcctgtgctcgcagacagagtcattattccattcagcggttggtgcgacggcaactctaatatgtcaagagaagtggttgatcccgaagttttcttcaatgccacgggatgcctgcgaaagcggttggggatgcgcgagttgctagcactggtccctcagagggccacaagtagtcgggtcaatctgagcagtgctgatgctggtcgacagactatgcggaactacagcggactcattgactcgctgatggcctacgtacagaattgcgttgctgcatctcgatgtgatgacaaatcggtcgagaattgtatgtgtgttcttcacaatctgtcttacagactggatgccgaggtgccaacgcggtacagacagttagagtataatgccaggaacgcttacactgaaaagtccagtacgggctgcttcagcaataagagcgacaagatgatgaataacaactacgactgtcccctccctgaagaggagactaaccccaaaggctccggatggctgtaccattccgacgcgattcgaacgtatttgaacctaatggggaagagcaagaaggatgccaccctggaagcatgtgcaggagccctgcagaacctcacagccagcaaaggcctcatgtcctcaggtatgtcccaactcatagggctcaaagagaagggcttgccccaaattgctagattactgcagagcgggaattccgatgtcgttcggagtggcgcaagcttgctatctaacatgagccgtcacccactgctacatcgggtgatggggaatcaagtattcccggaggtgacacgactgctgactagccacacagggaacactagtaactccgaggatatcctgagctcagcgtgttataccgtgaggaacttaatggctagccagccccagctcgcaaaacaatattttagctcatcaatgctcaataatatcatcaatctatgccgctcatctgcctctcctaaggctgcagaggccgcacgactgctgttgagcgatatgtggtcatcgaaagagctacagggagtactgagacagcaggggttcgatagaaacatgctgggaacacttgccggtgcaaattcactccggaactttacctcacggttctag

SEQ ID NO: 235087 - DNA, 2181 bp, Artificial Sequence
  Description of Artificial Sequence: Synthetic coding sequence
atgaaccacagcccattgaagactgctctggcttacgaatgcttccaagaccaagataattcgactctcgcgctaccctccgatcagaaaatgaaaactggcacctccggacggcagagggtacaagagcaagttatgatgaccgtgaaacgccagaaatctaaatccagtcaatcctcgaccctgtctcactccaatcgcggatccatgtatgacggcctggctgataactataactatggaaccacctccaggagcagctactatagtaagttccaggcaggaaacggctcgtggggatatcctatttacaacggtacactcaaacgtgaaccagacaatcggcgtttctccagctattctcagatggaaaactggtcacggcactaccctagaggctcgtgcaacacaaccggcgcaggaagcgatatctgctttatgcagaagatcaaggccagccgatctgagccggatctttattgcgatcccagaggcaccctgagaaagggaactctggggagtaagggacagaagacgacccaaaaccggtactctttctacagcacctgctcaggccaaaaggccatcaaaaagtgtccagtcagacctccaagttgtgcaagcaaacaggaccctgtgtacatccccccaataagctgtaacaaggatctgagctttggtcattctcgcgctagttccaagatttgttcagaagatattgaatgtagcgggctcactatccccaaggccgtgcagtacctcagcagccaggacgagaagtatcaagctatcggtgcttactacatacagcacacatgcttccaagatgaaagtgcaaaacagcaggtataccaactcggcggaatttgcaagctcgtggacctcctacggagcccaaaccagaacgtgcagcaggcagcagctggggctctgcggaacctggtgtttcgctctactaccaacaaactggagacaaggagacagaatggcatccgcgaggctgttagcctgctgcgacggaccggaaacgctgagatccaaaaacaactgacaggcctcctgtggaacctgtcttctacggacgaacttaaggaggagctgattgcggacgctctaccagtgctggccgacagggtgataataccctttagcgggtggtgtgatggaaatagcaatatgtcgcgggaggttgtcgaccccgaggtcttcttcaacgccactggctgcctcagaaatctgagctcagccgatgccggaagacagactatgagaaattacagcggtttaattgactctttgatggcttacgtccagaattgcgttgctgcaagccggtgcgacgataagagcgtggagaattgcatgtgtgttcttcacaacctttcttaccggctggatgccgaagtacctactcgatatagacagctggagtataatgcaaggaatgcctatacggagaaaagttctaccggctgtttcagcaacaagagcgataaaatgatgaataacaattatgactgccccctgcctgaggaagagacaaaccccaaggggagtggctggctctatcactctgatgcaatacggacttatctcaacctgatgggtaaatccaagaaggacgcgaccctggaggcatgtgcaggagccctccaaaaccttaccgcctcaaaagggctgatgtcctcggggatgagccaattgatcggccttaaggaaaagggactgcctcaaatcgccagactgctacagtctggcaattctgatgtggttaggtcaggcgcatcactgctatccaatatgtctcggcatcccctcctccatagggttatgggcaaccaggtgttcccagaggtgacccggctgcttacttctcatacgggcaataccagcaatagtgaagatatcctgtcctccgcatgctacacggtgcgcaatttgatggcctcccagcctcagctcgccaagcagtatttttctagctccatgctcaacaacatcataaatctatgtcgctcttccgcaagcccgaaagctgccgaggccgctagactgttgttgtccgacatgtggagcagcaaagaactgcagggagtcttgagacagcaggggttcgatagaaacatgctagggaccctggctggtgctaatagtttgcgaaatttcacctctagattctag

SEQ ID NO: 235088 - DNA, 2646 bp, Artificial Sequence
  Description of Artificial Sequence: Synthetic coding sequence
atggcagcccctggcgctcctgctgagtacggttatatcagaaccgtcctgggccagcagattcttggccagctggattcctccagcctcgcactgccgtccgaggctaagctcaagctggcaggatcctctgggcgtgggggacagactgtgaagtctcttaggattcaggagcaggtccaacagaccctggctcgcaaggggaggagtagcgtcggaaacggcaatctgcatcggacatcttcagtgcccgaatatgtgtacaacctccaccttgtggaaaacgactttgtggggggacgcagtccagtgccaaaaacatatgacatgctcaaggccggaacaacggctacttacgagggcagatgggggaggggcacagctcaatattcttctcagaaaagtgtcgaggagagaagtttacgccatcctttgcgccgacttgaaatatcacctgatagctccccagaacgtgcccactacacgcacagcgattatcaatactcccagcgaagtcaggctggccatacattacaccaccaggagtctagacgcgcagctttgcttgtgcccccaagatatgctagatccgaaatagttggcgtttctagagctggcacaaccagtcgccagcgccattttgatacataccaccggcagtaccaacacggatctgtatcggacaccgtttttgacagcatcccagccaacccggctctgttgacttacccgaggcccggaacctccaggtctatgggtaacctgctggaaaaggaaaactacctgaccgcaggccttactgtaggccaggtgagacccctagtgccgcttcagcctgtgacccaaaatcgggcttcccggtcatcctggcatcaaagcagctttcattccacccgaacactgcgcgaggcaggcccatccgtcgcagtcgattcgtcaggcagacgagcgcacttaacagtgggacaggccgctgctgggggaagcgggaacttactgactgaacgcagcacctttacagactcccagctcggaaatgccgacatggagatgaccctcgaaagagctgtgagcatgctcgaggccgatcacatgcttcccagccgcatatccgctgctgcaacattcatacaacacgaatgcttccagaaatccgaggctcggaagagggtcaaccaactgaggggcatcctgaaactcctgcaactcctgaaggtccagaatgaagatgtacagcgagccgtgtgcggcgctcttagaaatttagtgttcgaggataacgataacaagttagaagtcgccgagctgaacggcgtgcccagactgttgcaggttctcaaacagactagggacctcgagaccaagaaacagatcactgaccatacagttaacttaaggtcgcggaatggctggcctggcgcagtggcacacgcgtgcaacccctcgactttaggcggacagggaggacgcataacacgaagcggagtcagagaccagcccgaccagcatggtctgctctggaacttgagtagcaacgataaattgaaaaatctgatgatcacagaggccttgctgaccctgaccgagaacatcattatccccttttccggatggcccgagggcgactatcccaaggccaatgggctgttggactttgatattttttataatgtgaccggctgcctgcgtaatatgtcctcagccggagccgatggaagaaaggctatgcgaaggtgcgacgggctgatcgactccctcgtccattatgttcggggaactatcgcagattaccagcccgacgacaaggccacagaaaactgcgtatgcatcctgcataatctcagttaccagctcgaggctgaactgcctgaaaagtactcccaaaatatttacatccagaacagaaatatccaaacggataacaacaaaagtattgggtgtttcggttcccgtagcaggaaggtgaaggagcagtatcaagatgtcccaatgcccgaggagaagtccaatcccaagggcgtggaatggctgtggcattctatcgtgattcgcatgtacctgtctctgatcgccaaaagcgtgcgtaactatacgcaggaagcgtcattgggagctctccagaatctcacggcaggttccggtcccatgcctacttcagtggcacaaaccgttgtccagaaagaatccggtttgcaacacacccgcaaaatgctacacgttggcgacccatccgttaaaaaaacagctatttctcttttacgaaaccttagtcgcaatctttctttgcaaaatgaaattgccaaagagacactgcctgacctcgtctcaattattcccgacacagtaccatccactgatctactgattgagacgaccgcatctgcttgctacaccttgaataacattatacagaactcgtatcagaacgctagagatcttctcaacaccggtggcatacaaaagatcatggccataagcgcaggagacgcctacgcaagcaataaggcctccaaagctgcgtcagtgctattgtacagtctttgggcccataccgagcttcaccatgcttataagaaggctcagtttaagaagacagactttgttaattctagaaccgctaaagcatatcatagtctcaaggattag

SEQ ID NO: 235089 - DNA, 2514 bp, Artificial Sequence
  Description of Artificial Sequence: Synthetic coding sequence
atggctgcacctggagcccctgctgagtacggctatattcgtacggtgttggggcagcagattctcgggcaactcgacagttccagtctagctctgccatcagaggccaagttgaaattagcaggttcttcaggcagggggggacaaaccgtcaagtctttgcgtatccaggagcaagtgcagcagactctggccagaaaaggaaggtcttctgtggggaatggaaatctccaccgaaccagctccgtgcctgagtacgtctacaatctccacctagtcgaaaacgatttcgttggtggccgttctcccgtgcccaaaacttacgatatgctgaaagccggaacgactgccacctatgagggtcggtgggggaggggcacagcacagtacagctctcaaaagtccgtagaagaacggagtctccggcatccactgagaagactggaaatcagccccgatagttcgccggagcgtgctcactacacgcattcagactatcaatacagccaacgaagtcaggctgggcatacccttcatcaccaagaaagtaggcgagcggcactgctagtcccacccaggtacgcaaggtccgaaatagtgggagtctcacgcgcaggtaccaccagcagacagcgacatttcgatacctatcacaggcaataccagcatggaagtgtgtctgatacagtgttcgactctattcccgcaaaccctgctctgctgacatatcccagaccgggaacctcccggtccatgggtaacttgctcgagaaagagaattatcttaccgccggactgactgttggccaggtacggccattggtacccctgcagcccgtcacacaaaacagagcctcacgcagcagctggcatcagagcagcttccattctaccaggacactcagagaagccggtccttccgtggccgtggactcaagcgggaggagggctcatcttacagttgggcaagccgctgccggaggcagcgggaacctcctgaccgagcgctcaacgtttactgatagtcagctcggaaacgctgacatggagatgaccctcgagcgcgcagtttccatgctggaggccgatcatatgctaccctcccggatcagcgctgcagccacatttatccaacatgaatgtttccaaaaatcagaggccagaaagcgggttaaccagctgagaggaatacttaagctgctccagctgctcaaagtgcagaatgaggacgtacaacgagctgtgtgcggcgctctgcggaacctcgtgttcgaagataacgataataaacttgaagtggcagaactaaacggcgttccgcgtttattgcaggtgctgaaacagacccgggatttagagacaaagaagcagatcacagggttattgtggaatttatcttccaacgacaaattaaagaacctgatgatcaccgaagccctgttgactctcactgaaaacatcatcattcccttttcggggtggcctgagggcgactaccccaaagctaacgggcttctggactttgacattttttataacgtgactgggtgtctgcgaaatatgtcaagtgccggagcagatggacgcaaggcgatgagacgctgcgacggacttattgacagtttagttcactatgttcggggaacaatcgcagactaccaacctgatgacaaggctaccgagaactgcgtgtgtatcttgcataacctgtcctatcagctagaggccgagctccccgagaagtacagtcaaaacatttatattcagaaccgtaacattcaaaccgataataacaaatcgattggctgtttcggaagcaggtctaggaaggtcaaggagcagtaccaggacgtaccaatgccagaagagaaatctaatcccaaaggagtggaatggctatggcacagtatcgtaattcgcatgtatctctctcttatcgctaaaagtgttcggaattacacccaggaggccagcttgggcgctctgcagaacctcaccgccggatctggcccaatgcccacatccgtggcacagacagttgtgcagaaggagtcagggctgcagcataccaggaagatgctgcatgttggagacccgagcgtgaaaaaaactgctatttcattattgcggaacctgagccggaatctgtctttgcagaatgagattgccaaggaaacccttccagatctggtaagcatcattcctgataccgtcccaagcacagacctgctgattgagacaactgcatcagcatgttatacccttaacaacatcatccagaatagctaccagaacgctcgcgacctgctgaacaccgggggtattcagaaaatcatggcaattagtgcaggcgacgcttatgctagtaataaggcttcaaaagctgctagtgtcctgctgtattccttatgggcacacactgagctgcatcacgcctacaaaaaggctcagttcaaaaagaccgactttgtgaactcccgcaccgcaaaggcctaccactcattaaaggattag

SEQ ID NO: 235090 - DNA, 2475 bp, Artificial Sequence
  Description of Artificial Sequence: Synthetic coding sequence
atggctgcgccaggcgctccggcagaatacggttacatcaggactgtcttaggacagcagattctagggcagttggactcctcctcgctggccctgccatccgaagcaaagctgaagttggccggtagctctggcagagggggacaaaccgtgaagtctcttcggatccaagagcaggtgcagcagacacttgctcggaaaggacggtctagcgttggcaatgggaacctgcatagaaccagttcagtccctgaatacgtttacaatctgcatttggtagagaacgattttgttggaggcagatcccctgtgcccaagacatacgatatgctgaaagctggcaccacagccacatatgaggggaggtgggggaggggtacggctcagtatagctcacagaaatccgtcgaggaacgcagtctccgccatccccttcgaaggcttgagattagcccagattcaagccctgaaagagcccattacacccactccgattaccagtatagccagcgcagtcaggccggacacacccttcaccaccaggaatcccggagggccgcactgctcgtgcccccaaggtacgccagatcagagatcgtcggagtaagtagggctggcaccactagcaggcagcgccacttcgatacctatcataggcagtatcaacacggctctgtcagtgacaccgtgttcgacagtattcccgctaatcccgcactgttgacatatcccagacctgggacgtcccgttccatgggaaacctgttagaaaaggaaaactacctgacagccggactgactgtgggccaggtccgtcccctggtgcctctgcagcccgtcacccaaaatcgggcttcaaggagctcatggcaccagtcttcctttcactctacgcgtaccctacgcgaagccggtccaagcgtggctgtggactcctccgggaggcgtgcccacttaactgtgggccaggccgctgcagggggtagtggcaaccttctcactgaacgttcaaccttcacggattctcaactgggcaatgcggacatggagatgacgctcgagcgcgctgtcagcatgctggaggccgaccatatgctgcctagtcggatctcggctgctgctacattcattcagcacgagtgtttccaaaaaagtgaagctaggaaacgtgtgaatcagctgagaggcattctgaagctactccagttgttaaaagtgcagaacgaggacgtccagcgcgcagtctgcggcgcattacgcaacctagtgttcgaggacaacgataacaaactggaagtagctgaactcaacggagtccccagactactgcaggtactgaagcagacacgcgatctggagactaagaagcagatcacggatcacaccgtgaacctgaggtctcgtaatggctggccgggagcggtagcacacgcatgtaatccctccacgctggggggtcaaggcggaaggatcactaggtctggcgtccgagatcagccagatcagcacggcctgctgtggaacctcagttccaacgacaaactgaagaatctcatgattactgaggcactactgacccttacggaaaacataataatccccttcagcgggtggcccgagggagactatcccaaagccaatggactgctggattttgatatcttttataacgtaaccggttgcctgcggaatatgagttctgcgggtgctgatggcaggaaggcgatgaggaggtgtgatggtcttatcgacagtttggtccattatgtacggggtacgatcgctgactatcagcctgatgataaagccactgaaaattgcgtctgtatcttgcacaacctgtcctatcagttagaggcagagttaccggaaaagtactcacaaaatatctacatacagaacaggaacattcagactgacaataataagtctattggatgcttcgggtcgcgcagcagaaaagtcaaagagcagtaccaggacgtcccaatgcccgaggagaaaagtaatcccaagggtgtggagtggctgtggcactcaatcgtgattcgcatgtatttgagccttatcgcgaagtccgttaggaactacacccaggaggcttcgctaggcgctctccagaatctgactgctggaagtggacctatgccgacaagtgtcgctcaaaccgtagtgcagaaagaaagcggcctgcagcatactaggaagatgctgcatgtgggcgatcccagtgtcaagaagactgctatttctctgttacgaaatttaagcaggaatcttagcctgcagaatgaaatcgctaaggaaaccctccccgatcttgtgagcattatccccgacactgtcccttcaacagacttactcatagagaccacggcgtccgcctgctatactctcaacaacataatacaaaattcctaccagaatgccagagatctgctgaacagggggcaccctgaaaattatggtcactag

SEQ ID NO: 235091 - DNA, 2394 bp, Artificial Sequence
  Description of Artificial Sequence: Synthetic coding sequence
atgcaggacggcaactttctcctgagtgctctgcagcccgaggcaggggtgtgcagcctcgcacttccttctgacctgcagctcgaccggagaggtgcggaaggtcctgaagcagagagactgcgggcagctcgagtacaggagcaagttcgcgcaagattgctgcagctgggacagcaaccccgacataatggagcggcagaaccagaaccggaggctgagactgccagaggtaccagccggggacagtaccacacactgcaggccggattcagcagccgcagtcagggtctctcaggagataaaacatctgggtttcggcctattgctaagccagcatacagtcccgctagttggtctagcaggtcggccgtggacctgagttgctcaaggagactgagtagcgcccataacgggggatcagctttcggtgctgctggatatggcggagcgcagccgaccccccctatgcccacccgccctgtgagctttcacgagcgcggaggcgtcgggagcagagccgattacgacaccctgtccctgcgctccttaagactgggaccagggggtttagacgacaggtactcccttgtctccgaacagctggaacccgctgccacatcaacctatcgggcttttgcatatgaacgacaggccagttcttcctcctcccgtgctgggggactggactggccagaagcaaccgaggtgagcccatcacggaccatccgcgcaccagccgtgcgcaccctgcagcgcttccagtccagtcatcgcagtcggggtgtgggaggggcagtccccggagcggtgctggaaccagttgcgagagccccttctgtgcgttctcttagcctgagcctagccgactcgggccaccttccagatgtccacgggtttaatagttatgggtcccaccggacattgcagcgcttgtcaagtggattcgacgatattgacttaccaagtgccgtgaaatacttaatggcctccgacccaaatttgcaagtgctaggggctgcctatatccaacacaaatgctattccgacgccgcagcgaaaaagcaggcgaggagtctgcaggccgtgccccgattggtgaaattgttcaaccacgcaaatcaggaagtgcagcgccacgcaacgggggcaatgaggaacctcatctacgacaacgctgacaacaaactggctctggttgaagagaacggaatctttgagctgctgcggacattgagggagcaggatgacgaacttcggaagaatgtgactggcattctttggaatttgtcttccagcgatcaccttaaagatcggctcgcgagagacacactggagcagctgactgacctggtcctgagccccttaagcggggcagggggaccacctttgatacaacagaatgcttccgaggctgaaatcttttacaacgctacaggtttcctgcggaatctctcttcagcatcacaggctactcgccaaaaaatgcgggagtgtcacgggctggtcgatgctctagtgaccagcatcaaccacgcattagatgctgggaagtgtgaggacaagtcagtggagaacgcagtatgtgtgctcagaaatttgtcttatagactgtatgatgaaatgcccccttccgcccttcaacgcctggaaggcagggggaggagggacctggccggagctccacctggcgaagttgtcggatgctttaccccccagagtaggagacttagggagttgccattagcagccgatgccttgacttttgcagaagtgagtaaggatcctaaaggcctggaatggttgtggagccctcagattgtgggtttgtataataggctcctgcaacgctgcgaactgaaccggcacacgaccgaggccgcagccggtgccctgcagaatattacagctggcgatagacgttgggccggtgtactgtcccgactcgctctggaacaggagagaatcctgaaccctttacttgacagggtgcggaccgccgatcaccatcagctgagatcgctgaccggcctcatcaggaacctgtcgagaaacgctcgaaacaaggatgagatgagtactaaggttgtcagtcacctgatagagaagctgccagggtccgttggtgaaaaatcacctccagctgaagtcttggtgaacattatcgcagtcctcaataacctcgttgtcgcctcaccaattgccgctagagatctgctgtactttgatgggctccgaaagctcatattcatcaaaaaaaagcgggattcacccgatagcgagaagtcctcacgagcggcaagctccttgctggctaacctgtggcagtataataagctacaccgcgactttcgtgccaaagggtatcggaaagaagactttttgggcccatag

SEQ ID NO: 235092 - DNA, 276 bp, Artificial Sequence
  Description of Artificial Sequence: Synthetic coding sequence
accgcatttcgtcgaacccctggtgaagagtttgcctggcgagaccctgagctgccggaagtcattcatatgctgcagcatcagttcccttctgttcaggcaaacgcagctgcatatttacagcacttgtgtttcggcgacaataaggttaaaatggaggtgtgccgcttagggggtattaaacacttagtggacctcttggaccatagagtgggctcctcggaggaatgcctgtggtgtccttccaaaccaagattctggcaggtgtaccgatag

SEQ ID NO: 235093 - DNA, 3450 bp, Artificial Sequence
  Description of Artificial Sequence: Synthetic coding sequence
atgcctgccccagagcaggccagccttgtcgaggaaggacagcctcagacgaggcaggaagccgctagcacgggtcctggaatggagcccgaaacaactgccactaccatacttgcaagcgtcaaggagcaggagcttcaattccagagactgaccagagagctggaagttgagaggcagatcgtggcgtctcaacttgagcgctgcaggctcggagctgagtctccatctattgcctcaaccagttcgaccgagaagtcgttcccttggcgcagcactgatgtcccaaacaccggggtgagcaagccccgtgtgtcagatgccgttcaacctaacaattacttgatccggactgaacccgaacaggggaccttgtacagtcccgagcagacttcgctgcacgagagtgagggttccctgggcaactctagatcatcaactcagatgaactcctatagtgattccgggtatcaggaagcaggtagcttccacaactcacagaatgttagcaaggctgacaacaggcagcagcatagttttattggtagtacgaacaatcacgtagttaggaatagtagggcagagggacagaccttggttcaaccttcagtggcaaatcgggctatgcggcgagtatccagcgtgccatcacgcgctcagtctcccagttatgtgatttcaacgggggtgtccccaagtagggggagccttcggactagcttggggagtggctttggttcaccctccgtgacagatcctaggcctctgaaccccagtgcctactcttcaacgactctgcctgctgccagggccgcttctccttattctcagcggccagccagccccacggccatccgccgtatcggatcagtgacctccagacagacttccaaccccaatgggccaactccacagtaccaaacgaccgcaagagtcggctcaccactgacacttactgacgcccagactcgtgttgctagcccatctcagggacaggtggggtcttctagcccgaagcgttcagggatgacagcagtgccccagcaccttgggccttctctgcagaggacagtgcacgacatggagcagtttggacagcagcagtatgacatctatgagaggatggtcccccctcgacccgattccctcaccggtttgaggtctagctacgccagtcagcactcccagctagggcaggatttgagatcagctgtgtcccccgaccttcatatcacccctatctatgaaggcagaacctactactcccccgtctaccgaagtccgaatcacggaaccgtagaactgcaaggatcccagactgccctctaccgtaccggaagcgtgggaataggaaacttgcagcggacatctagtcagcgatcaacactgacgtatcaacggaacaattatgctttgaatacgacagccacttacgcagagccttaccgtccaattcagtatcgagtgcaggagtgtaattataacaggctgcagcacgccgtgccagcagatgacggtactacccgttcacctagcattgactcgattcagaaggaccccagagaattcgcatggcgcgacccagagcttccggaggtgattcacatgctgcaacaccagtttcccagtgtgcaggccaatgccgctgcctacctgcagcacctgtgtttcggggataacaaggtcaaaatggaggtgtgtaggttggggggaattaagcatctcgttgacctgctggaccaccgcgttttggaagtgcagaagaatgcgtgcggcgctctgcgaaacttggtgttcggaaagtctaccgatgagaacaagattgcgatgaaaaacgttgggggtatccccgcactgctcaggcttctccgcaagtctatagatgccgaggtgagagagttggtcactggggtgttatggaacttgtcctcctgcgatgcagtgaaaatgactatcatccgggacgcactatctacgctcactaacaccgtgatagtgccacacagtggctggaacaactcgtctttcgatgatgatcacaaaattaagtttcagacaagcctcgtgctcagaaataccaccgggtgtttgcgcaatctctcctcagctggcgaggaagctcgcaagcagatgagatcatgtgagggtctcgttgactcacttctttatgttattcatacctgcgtgaatacatctgactacgactctaagactgtggagaattgcgtctgtaccctgcgtaatcttagctatcggctcgaactcgaagttccccaggcccgtctactgggccttaatgagctggatgatctactcggcaaggagtccccaagtaaagattccgaaccctcctgctggggcaagaagaagaagaagaagaaaaggacccctcaagaagaccaatgggatggagtcggacccattcccggtctgagtaagtcaccaaagggcgtcgagatgctatggcatccctctgtggtaaaaccttacttgacactgctggcagagtcttcaaacccagcaaccctcgaaggctccgcagggagccttcagaacctaagcgccggaaactggaaatttgcggcttacatcagagctgccgtgcggaaggagaaggggctgcctattctggtcgagctcctcagaatggacaacgaccgggtagtgtcgagcgtggccactgcgctccggaacatggccctcgatgtgcgtaacaaggagctaattggaaagtacgcaatgcgagacctggtcaataggctacctggtggaaatgggccatcagtgctgagcgacgagacaatggccgctatctgctgtgccctgcacgaagtgacttccaagaacatggaaaacgcaaaggctttggctgacagcgggggaatcgagaagctcgtaaacatcacaaagggtcgtggcgatcgcagcagtctcaaagtggttaaggcagcagcccaagtgttgaatactttatggcagtaccgcgacctgagaagtatttacaaaaaggacggctggaatcaaaaccactttatcacccccgtttccaccttggaaagagaccggttcaaatcccacccgagcctcagtacgaccaatcaacagatgtcgccgataatccagagcggctccagcaaaccctccccaatttatatctcaagttacagttctcccgctagggaacagaatcgcagacttcagcatcagcagctgtattactctcaagatgactccaacaggaaaaatttcgacgcataccgattgtatctccagagcccccattcatacgaggacccctactttgacgatagggtgcatttccccgcatccacggattacagcacgcagtacggattaaagtctactactaactatgtggatttctacagcacaaaaaggccatcctaccgtgcagaacagtaccccggttcgcctgacagttgggtgtag

SEQ ID NO: 235094 - DNA, 3579 bp, Artificial Sequence
  Description of Artificial Sequence: Synthetic coding sequence
atgcctgcacctgagcaggcctctctggtggaggagggccagcctcagacccggcaggaggccgcatctaccggacccggtatggaacccgagacgacagctactaccatcttggcctccgtcaaggagcaggagctgcaatttcagagactgactcgtgaactggaggttgaacgccaaatagtcgcatcccagctggaaaggtgccggcttggcgctgaatcaccctcaattgccagcactagttcaaccgagaagagctttccgtggagatctaccgacgtacctaacaccggggtgagtaagcctagagtttcggatgctgtgcagccaaacaactacttgatccggaccgaaccagaacagggaacgctgtacagcccagaacagacctctctgcacgagtccgaaggcagtctagggaattctagatcgtctacccagatgaactcctatagcgacagcggataccaagaggctggtagcttccacaactctcaaaacgtgagtaaggcggacaataggcaacagcattccttcatcggatctactaacaatcatgttgtccggaacagtagagcagaaggccaaaccctggtccagcctagcgtggcgaaccgagccatgaggagggtgtcaagcgtaccaagtagagcccagagcccctcctacgttataagcacaggggtgtccccaagcagaggcagcctgcgcacatcgttaggttccgggttcggcagccctagtgtgactgatcctcgtcccctgaacccatctgcttattcctccacaacccttcctgcagctcgggcagcttcaccttacagccagaggcctgcgtctcctaccgccatcagacgtatcggatcggttacctcgcggcagacatctaatcctaatggtcctaccccacaatatcagactaccgcacgcgtcggaagtcctctgaccctaaccgacgcacagacgcgggtggcctcacctagccagggccaggtggggtcctcttcccccaaaaggagcggtatgacggcggtaccccagcacctagggccatccctgcaaaggacagtgcacgatatggagcagttcggacagcaacagtacgacatctacgaacggatggtgcccccacgccctgacagtctgactggattgcggtcctcatacgcaagtcagcatagccaactaggacaagacctgcggagtgctgtcagccccgatctccacattaccccaatctacgaaggccgtacttattattcccctgtgtataggtcgccaaaccacgggaccgtggagctgcaggggtcgcaaaccgcattgtatcggacgggctcagtcgggattggcaacctccagagaacgtcttcacagcgtagtacgctaacatatcagcgtaataactacgccctgaatacaactgcaacttacgccgaaccgtatcggccaatacaatacagagtgcaggagtgtaattacaatcgcctccagcatgccgtgcccgctgatgatggcacaacaagatctcccagtattgatagcattcaaaaggatcccagagaattcgcatggcgcgaccccgagttaccagaagttatccatatgttgcagcaccagttcccttccgtccaagcaaacgccgcagcttacttgcagcatctgtgtttcggtgataacaaagtcaagatggaggtgtgtcgcctcggcggtataaaacacctagtggacctactggatcatagagtgctggaagtccagaaaaacgcttgtggcgcattaagaaaccttgtgttcggcaaatccaccgatgaaaataagattgctatgaaaaatgtgggaggaatccccgctctcctgaggctgttgaggaaaagtattgacgcagaagtgcgcgagcttgtgaccggcgtgctctggaatttaagctcttgcgacgccgtcaaaatgactatcatcagagatgctctgagtacgctcactaacactgtcattgtgcctcacagcgggtggaataactcctcctttgatgatgaccataagatcaagtttcagacctcactggtgctcagaaataccacagggtgtctccgcaacttgtcgtcagccggagaggaagcacggaagcagatgagatcctgcgagggacttgtcgattcactcctgtatgtgattcatacatgcgtgaataccagcgactacgattcaaagaccgttgaaaactgcgtgtgcaccctgcggaaccttagctataggctggagttggaggtgccacaagcgagattactgggcctcaatgaactagacgatttgctgggaaaagagtctccatcgaaggattctgagcccagttgctgggggaaaaagaagaagaaaaagaaaagaacacctcaggaggaccaatgggacggagtaggaccaatcccgggtctctccaaatcccccaaaggagtcgaaatgctttggcacccatctgtggtcaaaccctacctaactctgctagcagagagtagcaatccggctaccctggaggggagtgcaggcagcctacagaacctatcagccggaaactggaagtttgccgcatatatcagagccgcagtaagaaaagaaaaaggattgcctatccttgttgagcttctgagaatggataacgatcgggtagtaagtagtgtggcaaccgcactcaggaacatggctctggacgtgaggaataaggagctcatcggaaagtacgcaatgcgggaccttgtgaatcgtctcccagggggaaatggtccctccgtactgagcgatgagacgatggccgctatatgttgtgctcttcatgaggtgacctccaaaaatatggagaacgcaaaggcactcgccgactccggcggtatcgagaagttggtgaacattaccaaaggtcgcggtgatcgctccagcctgaaggtcgtcaaggcagctgcgcaggtgctgaatactctgtggcagtatcgggatctgcgctcaatttacaaaaaagacgggtggaatcagaatcacttcattacacctgtcagcaccctggagcgcgatcggtttaagtctcacccgagtttgtctactacgaatcaacagatgtcacctatcatccagtctgttggctcgacaagctcttcacccgcacttctgggcatcagggacccgagatctgagtatgataggacccagccacctatgcagtactataactcccagggcgacgccacccataagggcctgtacccgggatcttctaagccttcccctatctatatctcaagttacagtagcccggctcgcgagcagaatagacgtctccagcaccagcaactatactactcacaggacgactccaatcgcaagaattttgatgcttaccggttatacctccagtccccccactcttatgaagatccttacttcgacgacagggtccatttccccgcaagtaccgactacagcacacagtacggtctgaagagcactacgaattatgttgatttttactccacaaagaggccatcataccgcgctgaacagtacccaggatcccctgactcttgggtctag

SEQ ID NO: 235095 - DNA, 1845 bp, Artificial Sequence
  Description of Artificial Sequence: Synthetic coding sequence
atgaattcatattccgattctggctaccaggaggcgggttccttccacaattcgcaaaacgtgagcaaagcagataatcgacagcagcactcgtttattggcagtacaaataaccacgtagtgagaaactcccgggctgaaggtcaaacactggtgcagccctcagtggccaatagggcaatgcgacgggtgtccagcgtgccttctagggcccagagcccgtcctatgtcatatccaccggggtgtctccaagcagggggagtctgcgaactagtttggggtccggctttggctcaccttccgtgacggatccccgaccactaaacccttcagcatacagttcgaccacgttaccagctgccagagctgcttcgccttattctcagcgacccgcaagtcccactgccattcgcaggattggaagtgtcacgtctaggcagactagcaaccccaatgggccaacgcctcagtatcagacaacggcgagggttggatcacccctcacgttgaccgacgcccagactcgtgtggccagtccctcacaggggcaggtcgggtcaagctcccccaagagaagtgggatgaccgcagtcccgcagcaccttgggccttcacttcagagaacggtgcacgacatggagcaattcggacagcagcagtacgacatatacgagagaatggttcccccaaggcctgattccttgacggcctacggggtcccaatgctcgtttcaatagtgagtctcggaaaaaccttcgtgctcccttgccccgatctccatatcactccaatttatgagggcagaacttattatagccccgtatataggagccccaaccatggtacggtcgagctccagggctcccagacagcactgtaccgcacagggtctgtgggaatagggaacctgcagagaaccagttctcagaggagcactctgacttatcaacgaaataactacgctctaaacaccaccgcgacatacgcagagccctaccgcccaatacagtacagggtgcaggaatgtaattacaacaggctccagcacgctgttccggcagatgatggtaccacgcgcagcccctctattgactccattcagaaggaccctcgcgagttcgcatggcgcgacccagaattgcccgaggtgattcatatgctccagcaccagttcccgagcgtccaggctaatgcggctgcctatttacagcacttatgttttggcgataacaaagtcaagatggaagtgtgtagattgggcggaatcaagcacttagttgatttgctagaccatcgcgtgctagaggtgcagaagaatgcctgcggggcactgaggaaccttgtattcggcaaaagcaccgatgagaataaaatcgcaatgaagaatgtggggggtataccagccttgttgaggcttttacgaaaaagcatagacgccgaggtccgggagctggtgactggtgtgttatggaatctaagttcttgcgatgcagtgaaaatgacaatcatccgtgacgcgttgagcaccctcactaacactgtaatcgtgccacacagcggctggaacaatagtagctttgacgatgaccacaagataaagttccagacctcactcgtactgcgcaacactactgggtgtttacgcaacctgtctagtgcaggggaagaagctcggaagcaaatgcgatcttgcgaaggtctagtggacagcctcctgtacgtgattcacacatgtgtgaacacgtccgactacgatagtaaaacagttgagaattgcgtgtgtaccctccggaatttaatcggctggagttggagatgtccaaggcccggatactgggactag

SEQ ID NO: 235096 - DNA, 1329 bp, Artificial Sequence
  Description of Artificial Sequence: Synthetic coding sequence
atgggactggccatggaacatggaggctcgtacgcaagggcgggaggcagctctaggggttgctggtactacttgcgctacttttttcttttcgtgtctttgatccagttcctgattattctgggcctcgtgttattcatggtgtacggaaacgtgcatgtttcgaccgagagtaatctgcaagcgaccgaacggagagccgaaggcctctattctcagctgctcggcctgacagcttctcaatccaatttaacaaaagaattgaatttcaccacacgagccaaggatgccattatgcagatgtggcttaatgccagacgagatctcgatagaatcaacgcttcattccgacaatgccagggcgaccgtgtcatctacaccaacaaccagcgatatatggccgcaattatcctcagtgagaaacagtgccgggaccagtttaaggacatgaacaagtcttgtgacgccctcctgttcatgttaaatcagaaagtcaagaccctggaggtggagatcgctaaggagaagaccatatgtaccaaggacaaagagtccgtcctgctgaataaaagggtagctgaggagcagctggtggaatgcgtgaagacaagggaacttcagcaccaggagcgacagctcgctaaggaacagttgcagaaggtccaggcgttatgtttgcccctggataaagacaaattcgaaatggacctcaggaatctttggcgagattccatcatccctagatccctcgacaacctcggctacaatctctaccaccctctgggtagcgagctggccagtatccgtcgggcttgcgatcacatgccgtcactcatgagttcgaaagtcgaggaactagctcggagccttcgcgctgacatagagcgtgtcgcacgtgagaactccgacttgcagagacaaaaactggaggcgcagcagggcctacgcgctagtcaggaggcaaagcaaaaagttgaaaaagaagctcaagctcgggaagcaaaactgcaggcagaatgtagtagacagacccagttggcattggaagaaaaggctgttttgcggaaggagcgtgacaacttagccaaagaactagaagaaaaaaaacgggaagccgagcagctcagaatggagttagcgatccgtaatagcgctcttgacacatgtataaaaaccaaaagtcagcccatgatgcccgtgtctagacctatggggcctgttccaaatccccagccaatcgatcccgcatccctagaggagttcaagcggaagattctggaaagtcagcgtcctccagcaggcatcccagtagcccctagcagcggatag

SEQ ID NO: 235097 - DNA, 291 bp, Artificial Sequence
  Description of Artificial Sequence: Synthetic coding sequence
atggagcacaaagaggtcgtactgctgctattactgttcctgaagtctggtcagggtgaacctcttgatgattatgtgaatacccagggacctagcctcttttcagttaccaagaagcagctgggggctggaagcagggaggagtgcgcagccaagtgcgaagaagataaagaattcacctgccgggctttccaatatcactcgaaggagcaacaatgtgttatcatggccgagaaccgaaaaagcagcattattatcagaatgcgggatgccgtcttatttgagaagtag

SEQ ID NO: 235098 - DNA, 291 bp, Artificial Sequence
  Description of Artificial Sequence: Synthetic coding sequence
atggagcacaaggaggtggtgctgttgttgctgctctttctgaagtccggccagggagagcctctggatgactatgtgaacacacagggcccttcactgttctctgtcacaaagaaacagctgggcgcaggaagcagggaggagtgcgccgctaagtgcgaagaggacaaggagtttacctgtcgggcttttcaatatcacagtaaagaacaacagtgtgtcatcatggccgaaaatagaaaaagctcaattatcatccgtatgagggacgctgtgctgtttgagaaatag

SEQ ID NO: 235099 - DNA, 291 bp, Artificial Sequence
  Description of Artificial Sequence: Synthetic coding sequence
atggagcacaaagaggtagttctgctcctgctcttgtttctgaaaagcggccaaggcgagcccctggacgactatgtcaacactcagggtcccagtcttttcagcgttactaaaaaacaacttggagcaggaagtagggaagaatgcgccgctaagtgcgaagaagataaagagtttacctgtcgagcttttcagtatcattcaaaggaacagcagtgtgtgattatggctgaaaatagaaagagctctattattattaggatgcgggatgctgtacttttcgagaaatag

SEQ ID NO: 235100 - DNA, 492 bp, Artificial Sequence
  Description of Artificial Sequence: Synthetic coding sequence
atggacgccctggagggagaatcatttgctctaagtttctccagcgctagcgatgcagaatttgatgctgtggtggggtatctggaggatatcattatggacgacgagttccaactgctccaacgaaattttatggataagtattatctggagttcgaagataccgaggagaacaaattaatatacacacccatattcaacgagtatattagtctggttgagaaatacatagaagagcagctgctacagcgcatcccagagttcaatatggcagcgttcaccaccacactgcagcaccacaaagacgaagtggccggagacatctttgacatgctactgacattcaccgattttttggcctttaaggaaatgtttcttgattatcgggctgagaaagagggaagaggcctggatctctcgtctggccttgttgtgaccagcttgtgtaagtcctccagtttgccggcatctcagaataacttgagacattag

SEQ ID NO: 235101 - DNA, 1890 bp, Artificial Sequence
  Description of Artificial Sequence: Synthetic coding sequence
atggaaaactccactactaccattagtcgggaggaactagaggaactacaggaggccttcaacaagatagacatcgataactccggctatgtgtcagactacgaattacaggaccttttcaaagaagcctccttgcctcttccagggtataaagtccgcgaaatcgtggaaaaaattctgtctgtggctgactccaacaaagacggcaagatatccttcgaggagttcgttagcctcatgcaggagctgaagtcaaaagatatttccaaaacattccggaagattattaacaaaagggaaggcatcacagctatcggagggacaagcacaatctcttcagaaggaactcagcatagctattccgaggaggaaaaggtcgcattcgtgaattggatcaataaagccttggaaaacgaccctgactgcaagcatctcattcctatgaatcctaatgacgactcacttttcaagtccctcgcagatgggattcttctgtgcaagatgataaatctgagtgagccggatactatcgatgaacgcgctataaacaagaagaagctgaccccttttactatatcagagaacctgaatctcgccctgaactcagcatcagcaatcggatgtaccgtcgtcaatattggagctagtgacttgaaggaagggaaaccccatttggtgctgggattattatggcaaatcataaaggtgggcctgtttgccgatattgagatctctcgcaacgaggccctgattgccttgttaaacgaaggggaggaactggaggaactgatgaaactctctccagaagaactgttgctcaggtgggtgaattaccacttgacgaatgccggatggcacaccatcagtaatttctcacaggatatcaaggatagcagagcttattttcacctgctaaatcagatagctcccaaagggggtgaggatgggccagctattgccatcgacctgagcggtattaacgaaacgaacgatcttaagagggccggtctaatgcttcaagaggccgataagctcggatgtaaacagtttgtgacaccagccgatgtggtctctggaaaccccaagttaaatctggctttcgtggctaacctcttcaacacatacccctgtctgcacaaaccaaataataacgatatcgatatgaatctcctggagggcgaaagtaaagaagaaaggactttcaggaattggatgaactcccttggcgttaatccttatataaatcatctgtatagcgacctagcagacgccctcgtaatctttcagctgtacgagatgattagagtgcctgtcaattggtcacacgtcaacaagcccccatatcctgccctcgggggaaatatgaagaaaattgagaactgcaattacgcagttgagttggggaaaaataaggctaagttctcgcttgtcggcattgccggacaggacctgaatgagggaaatagcacccttacactcgccctcgtatggcagctaatgagaaggtatacactcaacgtcctctctgatctcggcgagggggagaaggtaaacgatgagatcataattaagtgggtgaatcagaccctaaagtccgcaaacaaaaaaaccagcatcagttcctttaaggacaaatcaataagcacctccctgccagttctggatcttattgatgcaatagcacccaatgcagtccgccaagagatgatacggcgtgaaaacctgtccgacgaggacaaactcaataatgccaaatacgctatatcagtggcgcgaaaaatcggggcaaggatctacgctctgccggatgacctggtcgaggtgaagcctaaaatggtgatgacagtctttgcctgtctaatggggaagggccttaaccgcatcaagtag

SEQ ID NO: 235102 - DNA, 1890 bp, Artificial Sequence
  Description of Artificial Sequence: Synthetic coding sequence
atggagaactctacaacaactatctctcgcgaggaactcgaggagcttcaggaggctttcaataagatcgatattgacaattccggctacgttagcgactatgagctgcaagatctattcaaagaagcaagcttgcccctgccaggatacaaggtgcgagagatcgtggagaagattttgtctgtggcagactctaataaggacgggaagatcagcttcgaagagtttgtgagcctcatgcaggaactgaagtccaaggatatctctaaaacattccgaaagatcatcaacaagcgtgagggcatcacagctatcggcggaacttctacaattagttctgagggcacacaacattcatattccgaggaggagaaggtagcatttgtgaactggattaacaaggccctggaaaatgatccagactgtaagcatctgattccaatgaaccccaatgatgatagcttattcaagtcgctcgccgacggcattctgctatgcaaaatgatcaatcttagtgaacccgataccatagatgaaagggctatcaacaagaaaaagctgactcctttcacaatctccgagaatcttaatctggcattaaactccgctagcgccattggctgtactgtagttaacataggtgcctcagacctcaaggagggaaaaccccaccttgtacttggtctgctctggcagatcataaaagtcggcttgtttgcagacatcgagatttccagaaacgaggctctcatcgccctccttaacgagggcgaagagctagaggagctcatgaagttgagtcccgaggaactgttattgcgatgggtgaattatcacctgaccaatgcgggttggcacactatctctaacttctcccaagatattaaagatagcagggcatatttccacctgctcaatcaaatcgctcccaaaggaggggaagacggacccgctatcgcaatcgatttgtccggcataaacgagactaacgatctgaagcgggctggcctcatgctgcaggaggcagataaactgggttgcaaacagttcgtgacgcctgcggacgtggtttctgggaatcctaaactgaacctggcattcgttgccaacctttttaacacctatccttgcctccataagcctaataataatgatatcgacatgaatctactggagggggagtccaaggaggagaggactttccgaaactggatgaatagcttgggcgtcaatccttacataaatcacctatacagcgatcttgccgatgccttggtaatctttcagctgtatgaaatgatccgtgtgccagtaaactggtctcacgtaaataaacctccatatccagccctgggcggaaacatgaagaaaattgagaattgcaactacgctgttgagctggggaaaaataaagctaagttctccctggttgggatcgccggacaggacctcaacgagggcaattctacactgactctagcactggtgtggcagctgatgcggaggtatacgctcaacgtgctcagcgatttaggagagggagagaaagtaaacgacgagattatcatcaagtgggtgaaccagactcttaaaagcgcaaataagaagactagtatttcaagttttaaggacaaaagcattagcaccagccttcccgtcttggaccttatcgacgcaattgcgcctaacgctgtgcggcaggagatgatcagacgggaaaacttgtcagacgaggataagctgaataacgccaaatacgcaatctccgtggcaaggaagattggcgctcgtatttatgccctacccgatgatctggtggaggtgaagcccaagatggtcatgactgtttttgcatgtctgatgggcaagggactgaaccggattaaatag

SEQ ID NO: 235103 - DNA, 165 bp, Artificial Sequence
  Description of Artificial Sequence: Synthetic coding sequence
atggagaatagcaccacaaccatttctagggaggaattagaagagctgcaggaggcgtttaacaagattgatattgataatagcggctatgtcagtgactacgaactccaggacctgtttaaagaggcgagcctgccgttgcccggatacaaagtgagagagtag

SEQ ID NO: 235104 - DNA, 363 bp, Artificial Sequence
  Description of Artificial Sequence: Synthetic coding sequence
atggaaaactctacaactaccatctccagggaggagttagaggaactgcaggaggcgttcaacaagatcgatattgataactcaggttacgtgtctgattatgaacttcaggacctgttcaaagaagcgtcccttccccttcccggttataaggtgcgagagattgttgagaagatcctttcggttgccgattccaacaaagacgggaagatcagctttgaggagtttgtgagtttgatgcaggagctgaaatcgaaggacattagcaagaccttccggaagatcattaataagcgcgagggcatcaccgcaatcggcggtaccagcacaatttctagcgagggtacgcagcattcctactag

SEQ ID NO: 235105 - DNA, 360 bp, Artificial Sequence
  Description of Artificial Sequence: Synthetic coding sequence
atggagaatagcacaacaaccattagccgagaggagttagaggagcttcaagaggcctttaataagattgacattgataactctgggtacgtgtcggattacgaactgcaggacctgtttaaggaagctagcctacctctgcctggctacaaggtgcgcgagatcgtagaaaaaatactctcggtagccgacagtaataaggacggcaagatttcatttgaagagtttgtgagtttgatgcaggaactcaagtcaaaagacattagcaagaccttcagaaagattattaataagcgggagggcattacggcaattgggggaacttcaaccataagctccgaagggacgcaacattcctag

SEQ ID NO: 235106 - DNA, 102 bp, Artificial Sequence
  Description of Artificial Sequence: Synthetic coding sequence
atggaaaattctacaaccactatctcccgtgaagagctcgaggagcttcaggaggcattcaacaaaattgatattgacaattcagggtacgttagcgactag

SEQ ID NO: 235107 - DNA, 177 bp, Artificial Sequence
  Description of Artificial Sequence: Synthetic coding sequence
atggagaattcgactacaactatctcccgggaagaacttgaggaacttcaggaggcctttaacaaaatcgacatagacaatagcggatatgtcagcgactacgaacttcaggatctttttaaggaagcttctcttcccctgcccggatacaaagtcagggagattgtcgagaagtag

SEQ ID NO: 235108 - DNA, 1890 bp, Artificial Sequence
  Description of Artificial Sequence: Synthetic coding sequence
atggagaattctacaacgactatttctcgagaggagctggaagaacttcaggaggcgtttaataaaatcgatatagacaacagtggctacgtatcagactatgaactgcaggacctgtttaaagaagcctctctgccgctgccaggctacaaagtccgggaaatagtggagaagatcctctcagtcgccgatagtaacaaggatgggaagatatcttttgaggaattcgtgtcattaatgcaagagctcaaatctaaggacatttcaaagacttttaggaagattattaataaaagggaaggcatcaccgccatcgggggtacttccaccataagttccgagggcacccaacactcatattcggaggaagagaaggtcgcttttgtcaattggattaacaaagctctggagaatgatcccgattgtaaacatctgatccctatgaatcccaatgatgacagcctgttcaaaagtctcgccgacgggatccttctgtgtaaaatgatcaacctctcagagcctgataccatcgacgaaagagccattaataagaaaaagctgacgcccttcactatctccgagaatctgaatctagcgctgaattccgcgtccgcaattggctgcaccgtcgtgaacatcggcgctagtgatctgaaggagggaaagccacacctggtcctgggccttctctggcagatcatcaaagttggactcttcgctgatatcgagatttccaggaatgaggctctcattgccctgcttaatgagggggaggagctggaggaactgatgaagttgtctccagaagagctacttctgcgctgggtgaactatcatttaacaaacgcagggtggcacacgataagcaacttcagtcaggatattaaagactcccgcgcttacttccacctcttaaaccagattgccccaaaaggcggagaggacggaccagccatcgccatagatttaagcgggatcaacgaaacaaatgaccttaaaagagccggtttgatgctccaggaggcagacaagctgggctgcaaacagtttgtgacccccgcagatgttgtgagtggaaaccccaaactgaatctggctttcgtggctaatctgttcaatacttatccctgtctgcataagcctaacaacaacgatatagatatgaatctgctggaaggagagtctaaggaggagcgcacgtttaggaactggatgaacagccttggcgttaatccttatattaaccatctgtacagcgacctggccgacgcgcttgtcatctttcaactctatgaaatgataagggtgcccgtcaactggtcacacgtgaacaaaccaccctatccagctctgggaggtaacatgaaaaagatcgagaactgcaattacgccgtcgaactgggcaagaataaggccaagttttctctggtaggcattgccggtcaggatctcaacgaggggaactccacgctgaccttagcgctagtgtggcagcttatgcgtaggtacaccctcaatgtgctgtcagatctcggcgaaggggaaaaagtgaacgatgaaatcatcatcaagtgggtcaaccagacactgaagagcgcgaataagaagacatcaataagcagcttcaaagataagtcaatctccaccagcctccccgtactcgatctcattgatgccattgcaccgaacgctgtgagacaggagatgataaggcgtgagaacttgagtgacgaagataaattgaataatgccaagtacgccatttctgtggccagaaaaatcggagcgaggatatatgcactcccggacgacttggtagaggtgaagccaaaaatggtgatgaccgtgttcgcttgccttatgggaaaggggctgaataggatcaaatag

SEQ ID NO: 235109 - DNA, 162 bp, Artificial Sequence
  Description of Artificial Sequence: Synthetic coding sequence
atggagaattctacaacgacaatcagccgcgaggagctcgaagaactgcaagaggcctttaataaaatagacattgacaattcaggctatgtgtccgactatgagctccaggacctctttaaggaagcgagcctcccactccctggatacaaagtgaggtag

SEQ ID NO: 235110 - DNA, 1785 bp, Artificial Sequence
  Description of Artificial Sequence: Synthetic coding sequence
atgcctctccctggatataaggtacgggaaatcattcagaaactcatgttggatggtgacaggaataaggacggtaagatctccttcgacgaattcgtctacatcttccaggaggtcaagtcctctgatattgccaagacttttcgcaaagccataaatagaaaagaaggcatttgtgcactcggaggaacttcagagctttctagtgagggcactcagcattcatacagcgaagaggagaaatacgcttttgtaaactggatcaataaagcgctggaaaatgatccggactgtagacatgtcatcccgatgaacccaaacacagacgacctttttaaggccgtcggggacgggatcgtgctttgtaaaatgatcaatctctccgtccctgacaccatcgacgaaagagccatcaataaaaagaaactgaccccatttattatacaggaaaatctcaatctggccttaaattccgcatccgctattggttgccacgttgtgaacatcggggctgaggatctgagagccggtaagccacacctggttctcggtctgctttggcagatcataaagatcggactattcgccgacatagagctgagtaggaacgaagctctcgccgcactactgcgggatggggaaaccctggaagaacttatgaaattatccccagaggaactgctcctgaggtgggccaactttcaccttgagaattccggatggcagaagatcaacaatttctctgccgacataaaactcatcgatttctccaacagtgtcaaggattccaaagcctactttcatcttttgaatcagattgctcctaagggccagaaggagggagaaccgagaatcgacatcaacatgtccgggtttaatgagaccgatgacctcaagcgcgctgaatctatgctgcagcaggccgataaacttggttgtagacagtttgttacaccggcagacgtggtctctggcaaccctaagctgaacctagcctttgtcgctaatctcttcaataaatatccagccctcacaaaacctgaaaatcaggacattgattggaccctcttggaaggagagacaagagaggaacgcaccttcagaaattggatgaactctcttggggttaacccacacgtgaaccatctatacgcagatttgcaggacgccttggtaattctccagttgtatgagcgcatcaaggtgcccgtcgactggtctaaggtgaataagcccccatacccaaagctaggcgctaacatgaaaaaactggaaaactgtaactatgcagttgaactgggcaagcatccagccaagtttagcctggtgggcatcgggggacaagatctgaacgacggaaatcaaacgctgaccctggcactggtgtggcaattgatgcgtaggtacactctgaatgtgctcgaagacctcggtgatgggcaaaaagcgaacgacgacataattgtgaactgggtgaaccgaaccctgagtgaagctggcaaatcaacaagcattcaatctttcaaggacaagacgatcagcagctctctcgccgttgttgatttaattgatgctattcaaccgggttgtattaattatgatctggtaaaatcaggtaatctgacagaggatgataagcacaataacgctaagtacgctgtgtctatggctagacgtattggcgcaagggtttacgctctgcctgaagaccttgtagaagtaaagcctaagatggtgatgaccgtattcgcctgtctgatgggacgaggcatgaagcgcgtctag

SEQ ID NO: 235111 - DNA, 1893 bp, Artificial Sequence
  Description of Artificial Sequence: Synthetic coding sequence
atggacgagatggctacaacccagatttcaaaggacgaactggatgagctgaaagaagcctttgccaaggtcgatctgaactctaatgggttcatctgtgattacgagcttcatgagttgttcaaggaagccaacatgccactgccgggatataaggtgagggagatcatacagaagctgatgttagacggcgaccgaaataaggatggaaaaatttcctttgacgagttcgtgtatatattccaagaagtgaagtccagcgatattgctaaaacgtttcggaaggccatcaaccgaaaggagggaatttgcgccctgggcggtaccagtgaattatccagcgagggcacccagcatagctactcagaggaagaaaaatacgccttcgtaaactggattaacaaggctcttgagaacgatcctgactgccgccacgtgataccaatgaatccaaatacagatgatttgtttaaagcagtgggagatggaatcgttttatgcaaaatgatcaatctgtccgttccagataccattgacgagcgtgctatcaataaaaaaaagttaaccccatttattatccaggagaatttgaacctggctctgaatagcgccagtgccatcggatgtcacgtagtgaatattggcgcagaggatcttcgagctggcaaacctcatctcgtgttgggcttgctctggcagattattaagatcggtttgtttgccgacatcgagctaagccggaatgaggccctggctgccttactgagggatggggagaccctggaggagttgatgaaactcagcccagaagaacttctcctgcggtgggccaacttccacctggaaaactcaggctggcagaagataaacaacttcagcgccgatataaaggacagcaaggcctattttcacttactgaatcagatagcacctaagggacagaaggaaggcgagccaagaatcgacataaacatgtcaggttttaatgaaacagatgatctgaagcgtgccgagtctatgttgcagcaagccgataaacttggttgcaggcagttcgtgacgcccgcagacgtggtgtccggcaaccctaagcttaacctagcttttgtcgccaatcttttcaataagtacccagctttgaccaaacctgagaatcaagacattgattggactctccttgaaggggagacccgcgaagagcgcacttttaggaattggatgaactctctgggcgtcaacccccatgtcaatcatctgtatgccgatctccaggacgcgctcgtaattctgcagttgtacgagagaatcaaagttcctgtagattggtcgaaggtgaacaaaccaccatatccaaagctcggcgcaaatatgaagaagctcgagaattgcaattatgccgtagaactcgggaaacatccagctaagttttccctcgtgggaatcggtgggcaggacctgaacgacggcaaccaaacgctgaccctcgctcttgtgtggcagctgatgagacggtataccctgaacgttctggaggacctgggtgacggccaaaaggccaatgacgacattattgtgaactgggtgaataggactctatcagaggcaggaaagtccacttccatccaatctttcaaagataagacgatcagctcttcccttgccgttgttgacctcatagacgccatccagcctggatgtatcaattacgatcttgtgaagagcggcaacctgacagaggacgacaagcataacaatgccaagtacgccgtgtcgatggctagacgcatcggagccagggtttacgcactgccagaggatctggtcgaggtcaagcccaagatggttatgactgtctttgcttgcctgatgggacgcggaatgaagcgcgtgtag

SEQ ID NO: 235112 - DNA, 1893 bp, Artificial Sequence
  Description of Artificial Sequence: Synthetic coding sequence
atggacgaaatggccacaactcagatctctaaagacgagttagacgaactgaaagaggcgttcgcaaaggtggatcttaactccaacggctttatctgtgattacgagctccacgaactgtttaaggaggccaacatgccactccctggttacaaggtaagagaaatcatccagaaactcatgttagacggtgatagaaataaagacgggaagatttcgttcgatgaattcgtgtacatcttccaggaagttaagagttcagacattgctaagactttcagaaaggcaatcaatcggaaggagggcatctgcgctctaggcggaacaagcgaactgtcctcagaagggacccagcactcatattcagaagaggagaaatacgcatttgttaattggatcaacaaagccttggagaacgatcccgattgtagacacgtgatccccatgaaccccaacacggatgacctgttcaaggctgtcggggatggaattgttctctgcaagatgatcaatttgtccgtcccggacacaattgacgaacgagccatcaataaaaagaagttgacaccttttattatccaggagaatcttaatcttgcgctcaactctgcctctgctattgggtgtcatgtggtaaacattggggctgaggacctccgggcaggcaagccacatttggtgctgggactcctgtggcagattatcaagattggcctgttcgctgacattgaactttccagaaatgaggcattggccgctctactccgagacggagagaccctcgaagaattgatgaagctgtcccccgaggagttgctgctgaggtgggcgaatttccacctggaaaactctggctggcaaaaaattaacaacttttcggccgacatcaaagactctaaggcctacttccacctcctaaatcagattgccccaaagggccaaaaagagggggaacctaggattgacattaatatgagtggatttaatgaaacggatgatctgaagcgagccgagtcaatgctgcagcaggcagacaagctcgggtgccggcagtttgtgactcccgctgacgtggtttcagggaaccctaaattgaatctggccttcgtcgccaacctttttaacaaataccctgccctgactaagcccgaaaaccaggacatcgattggactttactagagggcgagacccgggaagaaagaactttcagaaactggatgaactctctcggagtcaatccacacgttaaccatctttacgctgacctacaagatgcattggtgatcctgcagctctacgagcgcataaaggtaccggtggactggagtaaagtgaacaagccaccatatcctaagctgggcgcaaacatgaaaaagctcgaaaattgcaattatgccgtggagctgggtaagcaccccgcaaagttcagcctggtcggcatcgggggtcaggatctgaatgacggaaaccaaacactcaccctggccctggtctggcaactgatgaggcggtacacactgaacgtcctggaggacttgggtgatggccagaaagcaaacgacgatattatagttaactgggtaaaccgaacactaagcgaggccggaaagtctacttcaatacagagttttaaggataagactatatcgagttccctggccgttgttgacctaatagacgccatccagccaggttgcattaactacgatctggtaaaatcaggaaacctgaccgaggatgataaacacaacaacgcgaagtacgctgtatcaatggcaagacggatcggggctcgggtatatgcgctcccagaggatctcgtcgaggtcaagcccaagatggtcatgaccgttttcgcctgtctcatgggcaggggaatgaaacgggtttag

SEQ ID NO: 235113 - DNA, 1854 bp, Artificial Sequence
  Description of Artificial Sequence: Synthetic coding sequence
atggaggacctcaattccaatggcttcatatgtgactacgaactccacgaactctttaaggaggcaaacatgcccctgcccggatacaaggtgcgagaaattatccaaaagttaatgttagatggagaccgcaacaaagacggcaagatttcttttgacgaattcgtgtatatttttcaggaagtaaaatcttcagatatcgcaaaaacttttcgcaaggctatcaatcgcaaagaggggatatgcgccctcgggggaaccagtgagctcagctcagagggcacacagcatagttactcggaagaggaaaaatacgccttcgtcaactggatcaataaggcattagagaatgatccggattgtaggcatgtcattccaatgaatccaaacacagatgacctgtttaaggcggtcggggacggaatcgtgctttgtaaaatgatcaacttaagcgtgcccgatactatcgatgaacgggctatcaacaagaagaaactgactccttttatcatacaggagaatctgaacctggccctgaactcggcaagtgccataggatgtcacgtcgtgaacattggagcggaggacctgcgcgctggaaaacctcacctggtactggggctgctctggcaaattatcaagatcggcttatttgccgacatagaactgagccggaacgaggcattagccgcattactccgtgatggggagaccctcgaggaactgatgaagctgagtcctgaggagttactgctgcgatgggcaaacttccacctcgagaactctggttggcagaagatcaacaatttcagtgccgacatcaagctgatcgatttcagcaacagcgttaaagactctaaggcctactttcacctcctgaatcagattgcaccaaaaggccagaaagagggcgaaccacgcatcgatattaatatgagcggctttaacgagaccgacgacctaaagcgtgcagagtctatgctccagcaggctgacaagctgggctgccgtcagtttgtgacaccagccgatgtggtgtctggcaaccccaagctgaaccttgcctttgtagccaaccttttcaataagtatcctgccctgaccaaacctgagaaccaggatatagactggacattgctcgaaggagagaccagagaggagcgtaccttccgaaactggatgaacagtctgggtgtcaatccgcacgtcaatcacctctacgctgacttgcaggatgctttagtgattctacagctctacgagcgtatcaaggtgcctgtggactggagcaaagtaaataagcctccttatccaaagcttggcgcaaatatgaagaagctagaaaactgcaactacgccgttgaattgggcaaacatcccgctaaattttcgctggtcggcatcgggggacaggatctgaacgatgggaaccagacactgactctcgccctggtctggcagctgatgcgacggtacaccctgaacgtgcttgaagatctcggagacggccagaaggcaaacgatgacatcatcgtcaattgggttaaccgaaccctgtctgaggccggtaaaagtacctctattcagagctttaaagacaagacaatatcctctagcctagcggtagttgatttaattgacgctattcaacctggttgcatcaactacgatctggtaaaaagtggcaatctaaccgaagatgataagcacaataacgccaagtacgcggtgagcatggcgaggcggatcggtgcccgagtgtacgccctgccggaggacctcgtggaagtcaagcctaagatggtgatgaccgtgttcgcctgtctgatgggcagggggatgaagcgggtctag

SEQ ID NO: 235114 - DNA, 1758 bp, Artificial Sequence
  Description of Artificial Sequence: Synthetic coding sequence
atgccattgccgggttataaggtcagggagatcattcagaaactgatgctggatggagatcggaataaagacggtaaaatctccttcgatgagtttgtgtatatttttcaggaggttaagtccagcgatatcgctaaaacattccgaaaagctatcaaccggaaggaagggatctgcgccctcggcggaacttccgagctgtcgtccgaggggacccagcactcttacagcgaggaagagaaatacgcgttcgtgaactggatcaataaagcattagaaaatgacccggactgtcgccatgtcatcccaatgaaccccaatacggacgatttgttcaaagccgtcggagatgggattgttctgtgcaagatgataaacctatctgtccccgataccatcgacgaaagagccatcaataagaaaaaactgactcccttcataatccaggagaacctgaatctagctctcaacagcgcttcagctatcggatgtcacgtagtgaatataggcgcagaggatctccgggctgggaagccgcatctcgtgctggggctgttatggcagattataaaaatcggcctcttcgctgacattgaactgagcagaaatgaagcacttgctgcccttttacgagacggagaaactttagaagaactgatgaagctttctcctgaggaattgctgctgcggtgggcaaactttcacctcgagaattcaggctggcagaagatcaacaatttttctgccgatattaaggactccaaggcctattttcacctccttaatcagatagcgcctaaggggcaaaaagagggggaaccacgtattgatataaacatgtctggcttcaatgagactgatgatctgaagagagccgaatcaatgttgcagcaagccgacaaactgggttgtagacagtttgtgactcctgccgacgtggtgagcggcaatcccaagctgaatctcgccttcgtggccaatttgtttaacaagtatccagccctgacaaaacccgaaaatcaagatattgactggaccctgcttgagggtgaaacaagggaggagaggacattccgaaattggatgaactcactgggggtgaatcctcacgtcaatcacctctatgctgacctccaggacgccctggtgattctccagctgtatgagcggattaaggtgccagtggattggtccaaggtgaacaagcccccataccctaagctcggcgcaaacatgaagaagctagaaaactgcaattatgcagtggagttgggaaagcaccccgcaaagttttccctggtggggatcggaggacaggacttgaatgacgggaaccaaaccctgacattagcactggtctggcaactgatgcggagatataccctcaacgtgctggaggacttgggcgacggacagaaggccaacgatgatattatcgtaaattgggttaatagaacactgtcggaggccggtaaaagtacatctattcagtcctttaaggacaagacgatcagctcctctctggcggttgttgatctgattgatgccatccagcccggatgcatcaattacgatttggtcaagtcgggtaacttaaccgaggacgacaaacacaacaacgccaagtatgccgtgagcatggctcgtcggatcggagcccgagtgtacgctctgcccgaagacctcgtcgaagtgaagcccaagatggtgatgaccgtgtttgcatgcttaatgggtagggggatgaaaagggtgtag

SEQ ID NO: 235115 - DNA, 675 bp, Artificial Sequence
  Description of Artificial Sequence: Synthetic coding sequence
atgaattcgctcggggtgaatcctcatgtaaaccatctctacgctgacctccaggacgcgctcgtgatcctccagttatacgagcgtattaaagtgcccgttgattggtccaaggtcaataagcctccatatccgaagctcggcgctaatatgaagaaactcgagaactgtaattatgcagtggaactgggtaaacaccctgctaaatttagtctggtgggcattgggggacaggacctaaacgatggtaatcagaccctaaccctagctttagtgtggcagctgatgcgtcggtacaccctgaacgtccttgaggaccttggagacgggcagaaagccaacgacgatatcatcgttaactgggtcaatcgcaccctgagcgaggccggtaaaagtacctcgatccagtcatttaaagacaagacaatctcttccagcctagccgttgtggacttgatcgatgcaattcagccaggatgcatcaactatgatcttgtgaaaagcggaaatctcactgaggatgataagcacaacaacgccaaatacgccgtctctatggcgcgacggataggggcacgtgtctatgcgttgccggaggatttggtcgaggtgaaaccaaaaatggtaatgacagtatttgcatgcctgatgggacggggaatgaagagggtgtag

SEQ ID NO: 235116 - DNA, 306 bp, Artificial Sequence
  Description of Artificial Sequence: Synthetic coding sequence
atgtcttccgctgccggtttttgtgcctctcgaccgggactgctatttctagggcttcttctactgcctctggtggtcgccttcgcgtccgcggaagcagaagaggacggcgacttgcagtgtctgtgtgttaagacaacgtcccaggtgcggccacggcacataactagtctggaagtaataaaagccggaccgcactgtccaaccgcacagctgattgcgaccttgaagaatggtcggaaaatctgtctggacttacaagcgccactttacaaaaaaataatcaaaaaactgctcgaatcttag

SEQ ID NO: 235117 - DNA, 405 bp, Artificial Sequence
  Description of Artificial Sequence: Synthetic coding sequence
atgaagtctcttacctggatcctgggcctgtgggcactcgccgcatgtttcacacccggtgagtctcagagaggccctaggggtccctaccccccagggcctctcgccccaccccctcccccttgctttccatttggtacaggtttcgttccccctccgcacccgcctccgtacggccctggacgattcccccctccactgtctcctccttacgggcctggcaggatcccccctagccctccacccccatacggtcccggtagaattcagtctcattccctaccgccaccatatgggccaggctacccacagcccccaagtcagccccgtccttatcctcccggaccccctttctttcccgttaatagtccaacagaccccgctctgcccactccggcaccctag

SEQ ID NO: 235118 - DNA, 399 bp, Artificial Sequence
  Description of Artificial Sequence: Synthetic coding sequence
atgtcccagggcgatagcaacccagccgcaattcctcacgccgctgaggatattcaaggcgatgatcggtggatgtctcagcataacagattcgtattggattgcaaggacaaagaaccagacgttctgtttgtgggagattcaatggtgcagctgatgcagcagtacgagatctggagggaacttttcagtcctctacacgctttgaattttggaattggcggagacacaacccgtcatgttctctggcgcctcaaaaacggcgagctggaaaacatcaaaccaaaggtgatcgtcgtttgggtaggcacaaataatcacgagaataccgctgaggaagtggccggtgggatcgaggccatcgtccagctcattaacacacggcagcctcaagcttag

SEQ ID NO: 235119 - DNA, 690 bp, Artificial Sequence
  Description of Artificial Sequence: Synthetic coding sequence
atgtctcaaggagacagcaatccagccgctatccctcacgctgccgaagatatacagggcgatgaccgctggatgtcccagcacaacaggtttgtcctggactgtaaggacaaggaaccggatgtgctctttgtgggagactcgatggtgcagctcatgcagcaatacgaaatttggagggaactttttagccctctgcatgctttgaatttcggcattgggggtgatactacacggcatgtgctgtggagacttaagaatggagaactagaaaatatcaagccaaaggtgatcgttgtctgggttggtacaaataaccatgagaacacagccgaggaggtcgccggaggcatcgaagctatcgtgcaactcatcaacacccgccagcctcaggccaagatcatcgtacttggtctgctgccacggggtgagaagccaaatcccttgagacagaagaatgcgaaggtgaatcagctgctaaaagtatcacttcccaaactcgcgaatgtgcaactactagacaccgacggagggtttgtccactccgatggagccatttcttgtcatgatatgtttgattttctccacttaacaggtggcggatatgcgaaaatctgtaagccccttcatgagctgataatgcagctgttggaggaaacgcccgaggaaaaacaaacaacaatcgcctag

SEQ ID NO: 235120 - DNA, 468 bp, Artificial Sequence
  Description of Artificial Sequence: Synthetic coding sequence
atgtctcagggggactctaatcccgctgcgattccccacgcagccgaagatatacagggtgatgatcggtggatgagtcagcataaccgctttgtgttagattgtaaggacaaggaacccgacgtgctgtttgttggagactcgatggtacagctcatgcagcagtacgaaatatggcgtgaattattttctccattgcatgccctaaacttcggcatcggtggagatacaacccgccacgtgctgtggaggctgaagaatggcgagcttgagaatattaagccaaaagtaatcgtggtctgggttggcacgaataatcacgaaaacacagcggaggaggtcgcaggtggaatcgaagcgatagtgcagctgattaacaccagacagcctcaggcaaagatcatcgtactgattatttattggcaagacgagcaggactatcacgaaagaaaggtgcagatggattag

SEQ ID NO: 235121 - DNA, 609 bp, Artificial Sequence
  Description of Artificial Sequence: Synthetic coding sequence
atgtcacaaggggacagcaacccagccgcaattccacacgccgcagaggacattcagggagacgatagatggatgtcacagcacaacaggtttgtgttggactgtaaagataaagagcccgacgtcctctttgtcggcgattccatggtccagctgatgcagcagtatgagatatggcgtgaactgttttcccccctccacgcgctaaacttcggaatcggcggagacactacgcgccatgttctctggcggctaaagaatggtgagctggagaatatcaagcccaaggtgatcgtggtgtgggtaggcacaaataaccacgagaatacggctgaggaagtggcagggggtatcgaggcaattgttcaactgatcaacacccgccagccccaggcgaagatcatcgtgttgggcaaagcagccgctagcaaatactctatatccgagatcgtcagacttgaacaaggaagtgtcaactggagtattgggacctatcccgatgatacaccggcaacaacacgtcccgcaatcctccagctcttcacgggaaagatgtctcggataaccatgaaggaaaagagcagatggactgaagaaatcctgcactag

SEQ ID NO: 235122 - DNA, 696 bp, Artificial Sequence
  Description of Artificial Sequence: Synthetic coding sequence
atgtcaggcgaggagaatcctgcctccaagcccacccccgtgcaagatgtgcaaggcgatggcaggtggatgtccctgcaccaccgtttcgttgcagactctaaggacaaggagccagaggttgtgttcattggggactcattggttcagcttatgcatcaatgcgaaatctggcgggaattattcagccctcttcacgctctgaatttcggaattggtggtgatggcacccaacacgtgttgtggagattggaaaacggcgagctcgaacatattagaccaaagattgttgtcgtgtgggtggggacaaacaatcacggccataccgcggagcaggtgaccggaggcataaaggcgattgtacagttggttaacgaacgccagccacaagccagggtggtggtgcttggtctgctacccagagggcagcacccaaaccctctgagagaaaagaaccgccaagtgaatgaactcgtcagagccgcactggcaggtcaccctagagcacattttcttgatgcagatcccggattcgtacactcagacggaacaatatcacaccacgacatgtacgactatctgcacctcagccgactggggtatacacctgtgtgtcgagccctgcacagtttgctgctacggctcctggcccaagaccagggtcaaggcgctcccctcctcgagcctgccccttag

SEQ ID NO: 235123 - DNA, 696 bp, Artificial Sequence
  Description of Artificial Sequence: Synthetic coding sequence
atgtctggcgaagagaatccagctagcaaacccactcccgtgcaggacgtgcagggtgacggtaggtggatgtcgcttcaccacaggttcgtggccgattccaaagacaaagagcctgaagtagtgttcataggcgactcattggtccagctcatgcaccagtgtgaaatctggagagagctcttctctcccctgcacgccctgaatttcggaatcggcggagacgggacacagcatgtgctgtggagactggaaaacggtgagctggagcatattaggcccaagattgtggtggtgtgggtggggacaaacaaccatggacatacagctgaacaagttaccggtgggatcaaagccatagtgcaactggtcaacgaacgccaaccacaggccagagtggtagtgctggggttgttaccgagggggcagcatcccaaccctctgcgggagaagaacagacaggtaaacgagcttgtgcgcgcagccctagccggtcacccaagagcccatttcctcgatgctgatccaggcttcgtgcacagtgacggcacaatttcacatcacgatatgtatgactacctgcacttgtcgcgactgggatacacccctgtgtgccgtgccctgcactctttactgctcaggctcctcgcccaggatcaaggtcagggggctcccctgctggagcctgccccttag

SEQ ID NO: 235124 - DNA, 720 bp, Artificial Sequence
  Description of Artificial Sequence: Synthetic coding sequence
atgaccatcaaactgtgggattttcagggctttgagtgcatccgcacgatgcatggccatgaccataatgtgtcaagcgttgccatcatgcccaacggggaccacatcgtctcagcgtcacgcgataagactataaaaatgtgggaggtgcagacaggttactgcgtaaagacttttactggccacagggaatgggttagaatggtacgccctaatcaggatggtactctcattgcctcctgtagtaacgatcaaaccgtgagagtatgggtggttgccacaaaagagtgtaaggccgagctgcgagagcatgaacacgttgtggagtgtatttcttgggcacccgaatcgagctactcatctatctcagaggctaccggcagcgaaactaaaaaaagcggcaaacccggtccattcctgttgagcggcagtcgtgataaaaccattaaaatgtgggacgtgtcaactggcatgtgtctcatgacattagtgggccacgacaactgggtgagaggcgtccttttccactctggcggaaaattcattctgtcttgtgctgacgacaaaaccttgcgtgtctgggattataagaataagcggtgtatgaaaaccctaaatgcccatgagcatttcgtgacgagtctggattttcacaaaaccgctccgtatgtcgtcaccgggtctgtggaccaaacagtaaaggtgtgggaatgccgctag

SEQ ID NO: 235125 - DNA, 1233 bp, Artificial Sequence
  Description of Artificial Sequence: Synthetic coding sequence
atggtcctgagtcaaagacagcgcgatgagctgaatcgagccattgctgattacctgagaagcaatggttatgaggaagcttattccgtctttaaaaaggaagccgagctcgatgtgaatgaagagctggataagaagtacgccggactactcgagaagaaatggacctccgtgatccgcttgcagaaaaaagtgatggagctggaaagcaagctcaatgaagccaaggaggaatttacaagtgggggtcctctggggcaaaagagagatccgaaggaatggattcccaggcccccagagaagtatgctctgagcgggcatcggtcccccgtgacccgtgtgatatttcaccccgtgttttccgtgatggtgtccgcatctgaggatgccacaatcaaagtttgggattacgagaccggagactttgaacgcacactcaagggccacacagattcggttcaggatatttcctttgaccattcgggaaaacttttagctagttgttccgccgatatgactatcaaactgtgggattttcaggggtttgaatgtatcaggacaatgcacggccacgatcacaacgtgtcctccgtagcaatcatgcctaacggcgatcacatcgtcagtgcaagtagggacaaaacaataaaaatgtgggaagttcagaccggatactgtgtgaagaccttcacgggacatcgcgaatgggtcaggatggtgcggcctaatcaggatggcactttaatcgcttcctgctccaatgaccagactgtccgggtttgggtggtggccacgaaggagtgtaaggcagagcttcgtgagcacgagcacgttgtggaatgtattagttgggcgcctgagtcatcctacagtagtatatctgaagcgacagggtccgagactaagaagtctggtaaacctggcccattccttctttccgggagtagggacaagacaatcaagatgtgggatgtgtcgactgggatgtgcctcatgacactggtcggtcatgataattgggtgcgcggagtgctgtttcattcgggagggaagttcattttatcctgcgctgacgacaaaacactccgggtgtgggactataagaacaagagatgcatgaagaccctgaatgcacacgaacattttgttacatcactggactttcataaaaccgctccatatgtcgtcaccggctcggttgatcagaccgtcaaagtgtgggaatgcaggtag

SEQ ID NO: 235126 - DNA, 618 bp, Artificial Sequence
  Description of Artificial Sequence: Synthetic coding sequence
atgaccatcaaactgtgggacttccaggggtttgaatgcatacgtacaatgcacggtcacgatcacaatgtaagtagcgttgccattatgccaaatggtgatcatatcgtgagcgcttccagagataaaaccattaagatgtgggaggttcaaacaggatattgtgtaaagacattcactggtcacagagagtgggtcagaatggtgcggccaaatcaggacggcacacttatcgcttcttgttcgaacgaccaaactgtccgagtgtgggtcgtagccaccaaagaatgtaaggccgagctgagggagcatgaacatgtggtagagtgcatttcttgggctccagagagcagctactcatctatttccgaagcaactgggtccgaggtcgggcacgataattgggtgaggggggtcctctttcactctggaggaaaattcatattatcctgtgcggacgacaaaaccctgcgtgtctgggactataaaaacaagcgatgtatgaagacactcaacgctcacgagcatttcgtcacatctctagacttccacaagacggccccatatgtcgttaccgggagtgtcgatcagacggttaaagtttgggagtgccgctag

SEQ ID NO: 235127 - DNA, 1029 bp, Artificial Sequence
  Description of Artificial Sequence: Synthetic coding sequence
atggagccgcatgattcttcccatatggattccgaattcaggtacacactgtttcccatcgtgtattcgatcatttttgtgttgggagtcattgctaatgggtacgtgctgtgggtttttgccagactttatccttgtaagaaattcaatgaaattaagattttcatggttaaccttactatggcagatatgctgttcctgataacactccctctctggatcgtgtactatcagaatcaggggaactggattttgcctaagtttctgtgtaatgtcgcagggtgtcttttctttattaacacctactgttccgtcgccttcctgggcgtcatcacatacaatagatttcaagccgtgaccaggcctatcaagacagcccaggccaatacccgaaagcggggaattagtctgagtctggtgatctgggtggccattgtaggcgcagcgtcatacttcttgatccttgactccacaaatacagtccccgactcagctgggagcggcaacgttactcgctgttttgagcactacgaaaaaggaagtgttccagtgctaataatacacatcttcattgttttcagtttcttccttgtgttcctcataatcttgttctgtaacctcgttatcatccgcacgctcctcatgcagccagtgcagcagcaacgtaacgcggaggttaagcggagggcattgtggatggtttgtaccgtgttggccgtgttcataatctgttttgtgccccaccacgtggtacagctgccctggacacttgcagagctgggcttccaggactctaaatttcatcaggctatcaacgatgcgcaccaagttactctctgccttctgagtactaactgtgtgctggatcctgtgatttactgttttttgacaaagaaatttcggaagcacttaacagaaaaattttattccatgaggtcttcaagaaaatgtagtagagcgactacagacacagtgactgaagtggttgtgccctttaaccagatccctggaaattctctcaaaaactag

SEQ ID NO: 235128 - DNA, 1029 bp, Artificial Sequence
  Description of Artificial Sequence: Synthetic coding sequence
atggaaccccacgacagttcacatatggactcagagtttagatatacactcttccctattgtatactctattattttcgtgcttggagtgatcgccaacggctatgtactctgggtgttcgccagactttacccctgcaagaaatttaatgagataaagatttttatggtgaaccttacgatggcggacatgctgtttctcataaccctgcctctttggattgtatactaccagaatcaggggaactggatcctacccaagttcttatgcaatgtcgccggttgtctattcttcattaacacctattgctctgtggcattcctgggggtcattacatataatagatttcaggcagtgaccaggccaataaaaaccgcacaggcgaacacacggaagcgcggaatatctctctccctcgttatttgggttgccattgtaggggctgcctcttacttcttaatcctagattcaactaatacagtgccagactcagctgggtcaggaaatgttacccggtgtttcgaacactacgagaaaggctcagttccagtactaattatccatatctttattgtatttagtttctttctagtcttcctgattattctcttctgtaatctggttatcatcaggactctgttgatgcagcctgttcagcagcaacgcaatgccgaggtgaaacgcagagccctatggatggtatgtacagttcttgccgttttcatcatatgttttgtaccacaccatgtcgttcaattaccttggactttggccgagctcggcttccaagatagcaaatttcaccaagctatcaacgatgcacaccaagtgaccctgtgtctcctgagcaccaactgcgtccttgatcccgtgatctactgtttcctgaccaagaaatttaggaaacatctcacagaaaaattctactcaatgcgctccagtcgcaagtgtagcagagcaaccactgacacagtcacagaggttgtggttccattcaatcagatccccggaaacagccttaaaaattag

SEQ ID NO: 235129 - DNA, 1029 bp, Artificial Sequence
  Description of Artificial Sequence: Synthetic coding sequence
atggaaccccacgattcttcacacatggatagcgaattccggtataccctgttccctatagtgtactcaattatctttgtgcttggggtgattgcgaatgggtacgtgctatgggtatttgctaggctttatccatgtaaaaaattcaacgaaattaagattttcatggttaaccttaccatggccgatatgctattcctgatcacactgcctttgtggattgtgtattatcagaaccaggggaactggatccttcctaagtttctctgcaacgtcgcgggttgcctgtttttcataaacacctattgttcggtagcttttcttggcgtgatcacgtacaataggttccaggccgtgacccgcccaattaagacagcccaggcgaacacgcggaagagggggatttccttgagcttggtgatctgggtggctatcgtcggagctgcctcttattttttaatattggactccacgaacactgtaccggacagcgccggaagcgggaacgtaacgagatgcttcgagcattacgaaaaaggttccgtgccagtgctcatcatacacattttcatcgtgttctccttctttctcgtcttcttgataatactgttttgcaatctggtgattattcgcacactccttatgcagccagttcagcagcagcgcaatgccgaggtgaaaagaagggctctgtggatggtgtgcacagtactggcagtgtttattatttgctttgtgccgcatcacgtggtgcagctcccctggacgttggcagagctgggatttcaggacagcaaattccatcaggccatcaatgacgcccatcaggtcacactgtgtctgctcagcactaattgcgttttagaccctgtcatctactgcttcttgacgaagaagttccgaaaacatctgacggagaaattctattccatgcggtctagcaggaagtgttctagagccaccaccgacactgtgacagaggtggtggtgccctttaaccagattccgggtaactccttaaagaactag

SEQ ID NO: 235130 - DNA, 1128 bp, Artificial Sequence
  Description of Artificial Sequence: Synthetic coding sequence
atgaaggtgtggctgttgcttggcctcctgctagtacacgaggccttggaggacgtgaccggccagcatctccctaagaacaagcgccctaaagaacccggagaaaaccgcattaaacccacaaataagaaggtgaagcccaagatccccaagatgaaagatcgcgacagcgcaaactccgccccaaagacccagtccataatgatgcaggtgcttgataaaggaaggttccagaagccagccgcaacactcagtttgctggccggacaaacagtggagctgcggtgtaaaggctctcgaatcggttggagttacccagcctacctggatacattcaaagactcccggctgtcagtgaaacagaatgaacgctatggccaactgactctggtgaactcgacatccgctgacaccggggagtttagttgctgggtccaactctgttctggttatatctgccgaaaggatgaggctaagacgggcagcacttacatcttcttcacagaaaagggagaattgtttgtgccttcaccctcctactttgacgtggtttatctgaatcctgacagacaagccgtcgtcccatgcagggtgacagtgctgagtgctaaggtcaccctgcacagagagttccctgcaaaggagattcccgctaatggcacggatatcgtttatgatatgaaacgcggttttgtgtacctgcagcctcactctgagcatcagggcgtggtctattgccgggctgaggcaggcggaagaagccagatctctgtgaagtaccaactgttgtatgtggccgtgcctagtggaccacctagcaccacaattctagcaagttctaataaggtgaagtctggcgatgacatttccgttctgtgcaccgtgctgggcgaaccagacgtagaagtggagttcacatggatattccctggccagaaggatgagcggcctgtaaccatccaggatacctggaggctcattcacagaggattggggcacactactaggatttctcaatcggtgattaccgtcgaggacttcgaaaccattgatgcaggctactacatttgtacagcacagaatttgcagggtcaaaccacagtggcaacaacggtggagttttcgtag

SEQ ID NO: 235131 - DNA, 1128 bp, Artificial Sequence
  Description of Artificial Sequence: Synthetic coding sequence
atgaaggtgtggctgctgctgggcctcctacttgtgcacgaggcccttgaagacgtcactggccagcatctgcccaagaacaagcgccctaaagaacctggtgagaacagaatcaaaccaaccaacaagaaagtcaaaccaaagatcccgaagatgaaagatcgtgattccgccaacagtgcgcctaagacacagtcaattatgatgcaggtactagacaagggcagattccagaagccagcagccaccttgtctctgctcgccggacagacagtggagcttaggtgtaagggatcccggatcgggtggagctatcccgcttatctggacacattcaaagattccaggttaagtgtcaaacagaatgaacggtatggccagcttaccctggtgaattcgacatccgctgacacaggcgaattctcctgttgggtccaactgtgcagcggatacatttgtagaaaggatgaggctaagactggttccacctatatctttttcaccgagaaaggtgagctgtttgtcccctccccctcttacttcgatgttgtctatctgaatccagatcgccaagcagttgttccatgccgggtgaccgtactcagcgccaaggtcacactacaccgagaattccctgccaaggagatccccgctaacggaacggacatcgtgtacgatatgaagcggggattcgtgtacctccaaccgcactctgaacaccagggcgtggtgtactgccgggctgaagccggaggcagaagccaaatcagcgtaaagtaccagctgctgtacgtcgcagttcccagcggacctccctctactaccatcctggcatcttctaacaaagtcaaatcgggggacgacattagtgtgttgtgtacagtgcttggtgagcccgatgtcgaggtggaatttacatggatctttcctgggcaaaaggacgagcgtccagtcacgatccaggatacttggaggttaatccacaggggcttaggccacaccaccagaatatcccagagcgttatcacggttgaagacttcgaaaccatcgatgcaggttactatatttgcacagcccagaatctgcagggccagacaaccgtggccacgactgtagaattctcttag

SEQ ID NO: 235132 - DNA, 1128 bp, Artificial Sequence
  Description of Artificial Sequence: Synthetic coding sequence
atgaaagtttggttattactgggcctgctcctcgtacacgaggccctcgaggatgtgactggtcaacacctgcctaaaaataagaggcccaaggaaccgggagaaaataggatcaagccaactaacaagaaggttaagccgaagataccaaagatgaaggacagagactctgcaaactccgctccaaagactcagtccattatgatgcaggtactggataagggcaggtttcagaagcctgcggctaccctcagtctgcttgccggacaaacagtagagttgaggtgcaaagggtcccgaatagggtggagttacccagcttacttggatacctttaaggactcacgcttgtctgtgaaacagaatgagagatatggacagcttacactagtgaatagtacttctgctgatacgggggagttttcatgttgggtgcagctgtgttcaggatacatatgccgcaaagacgaagccaagactggcagtacttacatcttttttacagagaagggggagctctttgtaccttcaccaagttacttcgacgttgtgtatctcaaccccgatcgacaagcggtggttccatgtcgagtgaccgtgctgtcggccaaagtgacactgcacagggagtttccggctaaagagatccctgccaatgggacagatatcgtgtacgacatgaaacgagggtttgtgtatctgcaaccacactccgagcatcaaggagtagtttactgcagggcagaggctggaggaagatcccaaatatccgtcaaataccaactgctatacgtggccgtgccaagtggtccgcctagcaccaccatactggccagctccaacaaagtgaagtcaggagatgacattagcgtgctatgtactgttctgggagaaccagacgtcgaagtggagttcacttggatcttccccggacagaaagatgaacgacctgtgacaattcaagacacctggcggctgattcatcgcggactggggcatactactaggatctctcaaagcgtaatcaccgtggaggactttgaaacaatagacgctggctattacatatgcacagcccagaatctccaggggcagactacggttgcaacgacagttgagttctcatag

SEQ ID NO: 235133 - DNA, 3075 bp, Artificial Sequence
  Description of Artificial Sequence: Synthetic coding sequence
atggcgcaaggggcaatgcggttctgctcggagggtgactgcgccatcagcccccctcggtgtccaaggagatggctgcctgagggccctgtgccccaaagtccccctgcttccatgtatggctcgaccggcagtctcttaagacgcgtggctggccctggcccacggggacgcgagctcggtagggtgaccgcaccgtgcactcctctgcgcggtccacctagtccaagggtggctcctagcccttgggctccaagctcccccacggggcagccccctcccggtgcccaaagcagcgtagttatttttagatttgtggagaaagcctctgttaggcccttgaatggccttccagcacccggaggactgtccagatcctgggatctcggcggagtgtctccccctaggccgacccccgcactcggacccggtagcaatcggaaacttcgactcgaagcaagcacgagtgacccactgccagctaggggcggaagcgccttgcccggttcccggaatctcgttcacgggccacccgcaccacctcaggttggcgcagacggcctgtactcatccctgcccaacggcctgggcggtcctccagaaaggctggctacattgttcgggggtcccgctgatacaggcttcctgaatcagggcgacacctggtcatcaccccgtgaagtgtcctcccatgcccagaggatcgcaagggcgaagtgggagtttttttatggtagcctggatcctcctagttctggcgctaagccccctgagcaagcgccaccgagcccaccaggagtggggagtcggcagggctccggggtcgcggtggggagggccgctaaatattctgaaacagacctggatacagtgcctttaaggtgttatcgcgagactgatatcgacgaagtgctcgccgagcgcgaagaagccgactctgcaattgagtcacaacctagcagcgagggtcctcctggaaccgcctaccccccagcaccccgaccagggcctctcccaggaccacatcccagcttagggtccggcaacgaggacgaggacgatgacgaggcgggaggcgaagaagacgtcgatgatgaagtttttgaggcctctgaaggcgcacgaccaggatcccgcatgcctctgaagtcccctgttcctttcctccctgggacaagcccttcagccgacgggccagattctttcagctgtgtctttgaggccatattggaatcccatagggcaaagggcacctcttatacttcgctagcaagcctggaggccctcgcctcccctggcccaactcaatctccctttttcacgttcgaactccctcctcagccccctgctccacggccagacccaccagccccagcgccactggcgcctttggaacccgactcaggcacgtcctcagctgccgatgggccatggactcagcgcggagaagaggaagaggctgaagcacgcgcaaagctcgccccaggtagagaacctccttcaccttgtcacagcgaagactcgctgggcctgggcgctgccccattaggatctgagccacccctgagccaattagtgtcggacagcgactctgaactagactcaaccgagcggttggccttaggatccacagacacgctgagcaacggccaaaaagcagacctggaggctgctcagaggttggccaaacggctctatcggttggacgggttccgaaaggccgacgttgccagacatctggggaagaacaacgattttagtaaactggtagccggtgaatacttgaaattttttgtctttactggtatgacccttgatcaggccctccgagtgttcctgaaggagctggctttgatgggagagactcaagagagggagcgggtcttagctcacttttctcagcggtacttccagtgcaatcctgaggccctgagttcagaggatggcgcacataccttgacatgtgctctgatgttgctgaatactgacttacatggccacaacattggcaagaggatgacttgtggtgacttcatcggaaacctcgagggcttaaacgacggtggagattttcccagggaactgctgaaggctctgtactcgtccatcaaaaacgagaaattgcagtgggcgatcgacgaggaagagctcaggagatccttatccgagttagctgaccccaacccgaaggtgattaaaagaataagcgggggaagcggctcgggatcctccccattcctcgatctgacaccggagccgggtgctgcggtgtacaagcatggggcactggtgcgaaaagtacatgccgatcctgactgccgtaaaactccacgtggaaagcggggatggaagtctttccatggcatcctcaagggcatgattctgtatctgcaaaaggaagagtacaaacccggtaaagccctgtccgagacagagctcaaaaatgcaatatctatccaccacgcgctcgccacaagggcaagcgactattccaagaggcctcatgtgttctacctccgcacagccgactggcgcgtgttcctattccaggctccatctctcgagcagatgcagtcgtggataactcggattaatgttgtggctgctatgttttctgcccctccattcccggctgcggtgagctctcagaagaaattttcacgccctttactgccttctgcagccacaagacttagtcaggaagaacaggtcaggactcacgaagccaaactgaaggctatggcgtcagaattacgcgagcatcgtgctgcccaacttggtaaaaaaggccgaggaaaagaagctgaggaacaaagacagaaagaggcttacctagaatttgagaaatccagatattcaacgtatgcggcattgctacgcgtcaaactaaaagccggtagcgaagaacttgatgctgttgaggctgcactcgcccaagcagggtcgaccgaggacgggctgcctccctcacactccagcccaagtctgcagcctaaaccgtcatcacagcctagagcgcagcggcacagcagtgagccacggccaggagcaggctctgggagacggaagccttag

SEQ ID NO: 235134 - DNA, 3075 bp, Artificial Sequence
  Description of Artificial Sequence: Synthetic coding sequence
atggcccagggggcaatgagattttgctccgagggcgattgcgcaatctccccacctcgctgccctagacgatggctgcccgagggacccgtacctcagtctcctcccgcaagcatgtacggcagtacggggtcactgctgagaagggtggccggacccggaccacggggaagggagcttggcagagtgacggctccgtgtacacctctaagggggcctcccagtcctagggtggcaccctcaccatgggcaccaagttctcctactggacagccacccccaggggcacaatctagtgttgttattttccggtttgttgagaaagccagtgtgagaccgctcaacggcttgcccgctccaggtggactatccaggagttgggacctcggaggggtttcacctccccgacctaccccggcactgggcccaggctcaaacaggaaactccggctggaggcctctacatcagaccctctaccagcaaggggtgggagtgcactgcctggaagccggaatctggtgcacggccctcccgcacctcctcaagtgggggctgacggactgtattctagcttgcccaatggactgggtggccctcccgagagactggctaccctgttcggagggcctgcagacacaggattcctcaaccagggagacacgtggagttcccctcgagaggtttcatcccacgctcagagaattgctagggcgaagtgggagttcttctacggcagcctcgatcctccatcatctggcgcaaaaccccctgagcaggctcccccttcacctccaggagtgggctccagacaggggagcggcgttgctgtgggcagagcagcgaagtactccgaaactgatctggacactgtccctctgcggtgttatcgagagactgacatcgacgaggtcctcgcagagcgcgaggaggccgactcagcgattgaatcccagccgtccagtgagggtccacctggcactgcatacccccctgctcccaggccgggtcctctgccaggccctcacccaagcctgggctctggcaatgaggacgaagacgacgatgaagctggcggtgaggaagacgtggacgacgaggtgtttgaagcaagcgaaggagcaagacccggtagccggatgccactaaaatctccagtgcccttcctgccaggaacatcgcctagcgccgacggcccagattctttttcatgtgtgttcgaggctatcctggagagccatcgggctaagggaaccagctataccagccttgctagcttggaggcgctcgcctcaccagggccaacccaaagccccttcttcacatttgagctccccccacagccacccgctcccagaccagatccacctgcacccgcacctttagctccactggagccagacagcggcacttcttccgccgctgacggaccctggacacagagaggtgaagaggaggaagctgaggcacgcgctaaactggcgccagggagagaaccccctagcccatgccactcagaggatagcctgggtcttggagcagctcctctgggtagtgaaccgcctctttctcagctcgtgagcgatagcgactctgaactggattccactgaacgtctggccctgggtagcaccgatactctgagcaatggacaaaaggccgacctcgaggctgctcagagactagccaagcggctctatagactcgacgggttcagaaaagccgacgttgcacgtcatctgggtaaaaacaatgacttctcaaaactggtggccggagagtacctcaagtttttcgtttttaccggcatgactctagatcaggctctcagggtcttcctcaaggagcttgcccttatgggcgagacgcaggagagagaacgagtgttggcccatttttcacaacgatactttcagtgcaaccctgaggcattgagttccgaggatggggctcataccctgacctgcgcccttatgctgctcaacactgaccttcacgggcacaatatcggaaaaaggatgacatgtggagactttattgggaacctggagggtctcaatgatgggggagattttcctagagaactcctaaaggccctgtactcgtcaattaagaacgaaaagttacagtgggccatagacgaagaggaactgcggcgaagtctttccgaacttgcggacccgaatccaaaagtaattaagaggatttcaggcggatccggttcagggtcatcacccttccttgatctaacgccagaacctggagccgctgtctacaagcatggtgcactggttcgaaaagtgcatgccgatccagattgcaggaaaacaccgagggggaagcggggatggaaaagctttcatgggatactgaaaggtatgatcctatatctccaaaaggaggaatataaacccggaaaggccctgtccgaaaccgagcttaagaatgccatcagcattcaccacgctttagcgactagggccagtgattattcaaagcggcctcatgtgttctatctcaggaccgcagattggagggtcttcttgttccaggcaccgagccttgaacaaatgcaatcttggatcacacgcatcaacgtggtcgctgctatgttctctgcacctccattcccggcagccgtgtctagccaaaaaaagttttcaagaccattgctgccgagtgccgcaacgagactctctcaggaggaacaggtccggactcatgaagctaagcttaaagctatggcttcagaactccgagagcaccgggcagcccaactcggcaaaaagggcagagggaaagaggctgaagaacagcggcaaaaagaggcatacctggaatttgaaaaaagtcggtactccacatacgctgcattgctccgtgtcaagctgaaggccggaagcgaagagttagacgcagttgaagcagcactcgctcaggccggttcaacagaggatggtctgcccccttcccatagcagcccaagtttgcagccaaagcctagcagccagccgagagctcaacggcatagctcagagccgaggccaggagctgggtccgggcgaaggaaaccttag

SEQ ID NO: 235135 - DNA, 2784 bp, Artificial Sequence
  Description of Artificial Sequence: Synthetic coding sequence
cagatctggaggtgtccgctgcagcatcatgcggagagtgcaccccctctcccagccctcagctgggcacagcccctgttgtgtttgagctcagtgtcagcgctgggcgagcagcggcctactccagctttgggccctggctctaacaggaaactgaggctggaagccagcacctcagacccattgccagctaggggaggatctgcgctgcctggcagccgcaacctggtgcacgggcctcctgcgccacctcaggtgggagctgacggtctctactcctctctcccgaacgggcttggcggtccccctgagcgcctggcgacactgtttgggggtcctgccgatactgggttcctgaatcagggggatacatggtcctcaccacgagaggtgagctcccacgctcagcgcatagccagggcaaaatgggagttcttctatggttcactggatcctccctcctccggggctaagccccctgaacaggcccctccttcccctcccggagtcggaagtcggcagggtagcggagtagcagtggggcgagcagctaagtactcagaaaccgatctggacacagtgcctcttcggtgttacagggagacagacatcgacgaagtactggctgaaagggaagaggctgattcagcaatcgagagtcagccctcttcagagggcccaccgggaaccgcatatccccctgcaccgaggcctggtccactcccaggcccacacccaagcttggggagcggtaacgaagatgaagatgacgatgaggccggtggggaggaggacgtagatgacgaggttttcgaggcttcagaaggcgctcgtccaggctccagaatgcccctgaagagtccagtcccctttctgcctggcacttcaccctcagcagatggccctgactctttttcatgtgtcttcgaggccatactggaatctcacagagcaaaagggacatcttacacctccttggcaagtctcgaggccctcgcatcccctggccctacccagtcacctttttttaccttcgaattgcctccccagcccccagcccctcggcctgatccccctgctcctgctcccttggccccactggaaccagattcagggacaagtagtgccgctgatgggccttggacacagagaggcgaggaggaagaggcagaggcacgtgctaaactcgccccagggagggagccacctagtccctgccactcagaggattcgctgggcctgggggctgcacctcttggctcggaaccacctcttagtcagctcgtgtctgatagcgattcggaactggattctacagagagactggctttgggctcaactgacacccttagcaacgggcaaaaggcagatctggaggcagcccagaggctagccaaaagactgtaccgcttagacggctttcgcaaggccgacgtcgcgaggcatttgggcaaaaataatgattttagcaagctagttgcgggtgaatatctgaaatttttcgtgtttactggcatgaccctggatcaggcacttcgcgtgttcctcaaagagctcgctctgatgggcgagacccaggagcgagagcgggttttagcccatttttcacagcgatacttccagtgtaatccggaagcactgagtagtgaggatggtgcacacacactaacgtgcgccctgatgcttctcaatacagacctgcacggccataacatcggcaaaagaatgacttgcggagacttcataggcaacctcgaagggttgaacgacggcggagatttccctcgagaattgctgaaagccctttacagtagcattaaaaatgaaaagctccagtgggcgattgacgaggaggagttgcgaagatctctgagtgaactggccgacccaaatccgaaggtcatcaaacgcatcagcggcggatcgggtagcggaagctcccccttcttggatctgacaccagaaccaggcgcagcagtgtataagcacggagctcttgtgagaaaggtgcacgcggatccagactgccgcaagactcctaggggaaaaagaggatggaagtctttccatggaatactaaagggcatgatcctgtacctgcaaaaggaggaatacaaacccggaaaggctttgtctgagacggaactcaaaaatgccatctcaattcaccacgccctggcaactcgtgctagcgattacagtaagcggcctcacgtcttctacctgcgcactgcagactggcgtgtctttttatttcaggctccatccctggagcagatgcagtcctggatcacaagaataaacgtcgtggccgctatgtttagcgcccctcctttccccgcagcagtgtcatcccagaaaaaatttagtcggcctttgttgccatccgctgctacccggctgtcccaggaggaacaggtgcgcacccacgaggccaagctgaaagccatggcctctgagctacgcgagcatagggcagcccagcttgggaaaaaagggagagggaaagaggctgaagaacagcggcaaaaggaggcatacctggaattcgagaaatctcggtactccacatatgccgcactcctaagggtcaagctcaaagcaggatcggaggaactggacgccgttgaagcggcactggctcaggctggctccactgaagatgggctgcctcctagccactcctcacccagccttcagcccaaacccagcagccagccccgtgcccagcgacactctagcgagccccgaccgggtgccggttctggacgaagaaagccgtag

SEQ ID NO: 235136 - DNA, 1542 bp, Artificial Sequence
  Description of Artificial Sequence: Synthetic coding sequence
atgggaagtagttggtgcttgtatggttgctgtaatgctggtgtgaaaaccactcgcctggaggcacacagtgaaatgggctcaaccgagattttagagaaagagaccccagaaaatctgagtaatggtacctcatccaatgtggaagccgctaagcgcctggcaaagcgactgtaccagctggaccggtttaaaagaagtgacgtggccaagcatttgggtaaaaacaatgagttttctaagcttgtggctgaggaatatctgaagttttttgactttacaggtatgacattggaccagagccttcgctatttttttaaagctttcagtcttgttggcgagacccaagaacgggagcgggtactaatccatttctcaaatagatatttctactgcaaccccgacacaattgccagccaggacggggtccattgtctgacgtgtgccataatgctgttaaatacagatctgcacgggcataacatcggaaaaaagatgacctgtcaggaatttatagctaatcttcagggcgttaacgaaggtgtagatttctctaaagaccttctcaaggccctctacaactcgatcaaaaacgagaagctggaatgggcagtagacgacgaggagaaaaaaaagtctccctccgagtcaactgaggagaaagctaacggaacacaccccaaaacaatatcccggattggctctaccactaatccctttctcgatattcctcacgatcctaatgccgctgtttacaagagtggctttctcgctaggaaaatccacgcagatatggacgggaagaagactccgcgtggtaaaagagggtggaagacattttatgctgtgctgaaaggcaccgtgttgtacttgcagaaggacgagtacaaacccgaaaaggcattatctgaagaggatctaaaaaatgctgtgtccgtccatcatgctctggcaagcaaagccactgactatgaaaagaagcctaacgtctttaaactgaagaccgccgactggcgggtgctcttgtttcagactcagtcgccggaggaaatgcagggttggatcaacaagataaactgcgtggctgccgtgtttagcgcccctccctttccagccgcaataggctcccagaagaagttcagtcgccctcttcttcccgcaacgactaccaaactcagccaggaggagcagcttaagtcacatgagtctaagctcaaacagatcactacagagctggccgagcaccgatcctatcctcccgataaaaaagtgaaagcaaaggatgtagatgagtataaattgaaagaccactaccttgaattcgaaaagactaggtacgagatgtacgtgtctatccttaaggagggcggaaaggaactcctgagtaatgatgagtctgaggccgcagggctgaagaaatcgcactcatccccgagtcttaaccccgatacctccccaataacagccaaggttaagagaaacgtgtcggagcgtaaagaccatcggccagaaacgccctctatcaagcagaaggtcacctag

SEQ ID NO: 235137 - DNA, 3144 bp, Artificial Sequence
  Description of Artificial Sequence: Synthetic coding sequence
atggaaggtcgatctgccgctgccgagaccttcgtgtgggtcaataacgcaagcgctcactctcagtccgttgcaaaagcaaagtatgagttcttgtttgggagatcggagggcaaggcccctgacacttcagatcatggtggcagcactctactcccccctaatgttaccaatgagtttccagaatatggtactatggaagagggaggggaaggcctgagagcctccctcgagtttgacggagaagcccttccttgccaccctcaagaacagcagggggtacagcccctgactggctgccactccgggctggactctgtgaccgagggacccaaggatgtgcgggaggccccttctcagagccacctgaaggaacaaagtttacagcctatcgacagcctgatcagtgccctaaaggctacggaggctaggataatttcaggcactctacaggcaacaaaagttctggaccaagatgccgtgagtagtttcagcgtccagcaagtcgagaaggaactcgacacggcatccaggaagactcagcgcgtaaacaagacgcttccagccggacagaagaacctgccagaaatacccttgtcagccgaagtgacaactgaagaatcattctacctcagcatccaaaaggacctgacggccctgctaacgggggacacccaggcagagatcagtcagatcatgaacaacggaagaaagggagcagtgtgcgtccaggaacccagctgtcctctggcaagcctgggctccagcgcggtgacctgtcattcggctggttcagtgggattccttaaggagcagagaagcgcattgggaagagaacacccagggggatgtgaccgaagtagctctatgggcaggcccggtagagtgaagcacgtagagtttcaaggggtggaaattctgtggactggaggggacaaacgggagactcagcacccaatcgatttcgaaaccagcctccaaaggacagcaagccccgacagcaaagaatcaagtaaggttcccaggcatctcatatcttcagccggactatgcaattccagttctttgactgaaaacgtgtgggatgagtcgtggaaggcccctagtgaaaggccgggaacatcaagtggaacgttctctcctgtgcggcttgacgagagtggcgaagatgaggtgtttctccaggaaaataaacagcatctcgagaaaacccctaagccggaacgagatagagaacgaatttcagaacaggaagagcacgtgaagggcgaagacgaggatatcctggggccaggatatacagaagattctaccgacgtgtattcttcccagttcgagacaatcctggataatacgtcactgtattactctgccgaaagcctggagacgctgtactcggaaccagacagttacttctcgttcgagatgccactcactccaatgatccagcagaggattaaggaaggtggccagttcctggaacggaccagcgggggtggccaccaagacatcctctccgttagcgcagacgggggtatagtaatgggctactcaagcggggtgactaacggcttgaacgatgcctctgacagcatctatacgaaaggcacccccgaaatcgccttttgggggtctaacgctggtgtcaaaacaacgcgactcgaggcgcattctgaaatgggctctactgaaatattagagaaagaaacacccgaaaacttgtctaatggtacctcatctaacgtggaggccgctaaaaggctagcaaaaaggttgtaccagctagaccgtttcaagcgttctgacgtggctaagcatctggggaaaaataacgagttctccaaacttgtggcagaggagtatttgaagtttttcgacttcacaggcatgactctggaccagagcctccgatatttctttaaggccttctccttagtaggagagacacaagagagagagcgcgtgctcatccatttttcaaacagatacttctattgtaatccggacaccattgcctcccaggatggagtgcattgcctgacatgcgcaatcatgttgctgaacactgacctccatgggcataatatcggtaaaaaaatgacctgccaggagttcatagccaacctgcagggtgttaacgaaggcgtggacttttccaaggacttgctcaaggccctctataacagcattaagaacgaaaagttagagtgggccgtggacgacgaggaaaagaaaaagtcaccgagcgagagtacggaagagaaagccaacgggacccatcccaagacaatctctcggatcggaagtacaactaacccattcctggatatcccacacgacccaaacgcagctgtatataaatcagggtttctggcccgaaagattcacgccgatatggacggaaagaagactccacggggtaagcggggatggaagaccttttacgctgtcttgaaggggacggtcctgtacctgcagaaggacgaatacaagcctgagaaggccctgtcagaggaagacctgaaaaatgcggtctcagtgcatcacgccctagctagcaaggcaacagactacgagaagaaacctaatgtgtttaagttgaaaaccgccgattggcgagtgctcttgttccagactcaaagccctgaggagatgcagggatggattaacaaaattaactgcgtggctgccgtcttcagcgctccaccattccctgctgctatcggctctcagaaaaaattcagccggccattgctgcccgctaccaccaccaagctgagtcaggaagaacagctcaagagtcacgagagtaaactgaaacagattaccaccgaactggctgagcatcggtcctatccccctgataaaaaagtgaaggcgaaggacgtcgacgaatacaaactcaaggaccactacctggaattcgagaaaactcggtatgagatgtacgtgtctattctcaaggaagggggaaaggagttactgtcaaatgacgagtctgaagcggctggcttgaagaagtctcactcttcccctagcttgaatcccgatacatcaccgatcacggccaaagtcaagcggaatgtgagcgaaagaaaggatcatagacctgagactccttccattaaacagaaggtgacttag

SEQ ID NO: 235138 - DNA, 810 bp, Artificial Sequence
  Description of Artificial Sequence: Synthetic coding sequence
atgatcggagtcaactctgtgcaatcggcaagcaaggttagggtcagaacctctgggagtgtcaaatactctagggaggactcgattaggcggcaatctcacagatccaagtcgatgaagataagtaactcctccgaattttctgcaaaagaaaataaggccttatacaatagcattaaaaacgagaagctggagtgggccgtcgacgacgaggagaagaaaaaatccccgtccgaaagcactgaagagaaagcaaacgggactcaccctaagacaatatcccgtattgggtctacaactaaccccttccttgacatcccgcatgatccaaatgcagctgtctacaagagtggattcctcgcgcgaaagatacacgctgatatggacggcaaaaagactccgaggggcaaaagggggtggaaaacattttatgctgttcttaaaggcacagtcctttacctgcagaagcatgaatccaaactaaagcaaataaccacagagctggccgaacacagaagctacccacctgacaaaaaagtgaaagcgaaagacgtcgacgagtataaactgaaagatcactatttggaatttgaaaagacacgatatgaaatgtacgtcagcatactcaaggaaggtgggaaagaactcctctcaaacgatgaaagtgaagcggcaggcctcaagaagagtcattcatctccgtcccttaatcccgatactagccctatcactgcgaaggtgaagaggaatgtgagtgaaagaaaggaccatcgccctgagactccaagcatcaagcaaaaagttacgtag

SEQ ID NO: 235139 - DNA, 3150 bp, Artificial Sequence
  Description of Artificial Sequence: Synthetic coding sequence
atggaagggcgatccgccgcagccgagactttcgtgtgggtcaacaacgctagtgcccatagccagagtgtggctaaggccaaatatgagtttctgtttggtcgaagcgagggtaaagcgccagatacttcagaccacggcggttctacccttttgccccctaatgtgacaaatgaatttcccgagtacggaaccatggaagaaggtggcgaggggctcagggcaagtcttgagttcgacggcgaggcgctaccttgccacccccaagagcagcagggagtgcagccactcactggttgtcattccggcttggatagtgtgacggaggggccaaaggacgtgagagaggctcctagtcagtcccatctgaaggagcaaagcttgcagcccatagacagccttatcagtgccttgaaagctacggaggcaagaatcatctctgggacgcttcaggccaccaaagttctcgaccaagatgcggtgagctcattctccgtgcagcaagtagagaaagagctggataccgcatctcgtaagacgcagcgggtgaataagacccttccagccggtcagaaaaatctcccggaaattccgttgtccgcagaggtaaccaccgaggaatcattctatttatccatccaaaaggacctcacagctctgcttaccggcgatacccaggctgagatctcgcagataatgaacaatggacgcaagggcgctgtgtgtgtccaggagccaagctgcccccttgcctccttgggctcatcggccgttacgtgtcacagcgcaggctctgtcggatttctgaaggagcagcggtctgcacttgggagagagcatccaggaggatgcgaccggtcgtcatccatgggcaggcccggtagggtgaagcacgttgaattccagggggtggaaattctctggactggcggtgataaacgtgagactcagcaccctatcgacttcgagaccagcctacaacggaccgcgagtcctgattctaaagaatcctccaaagtgccaagacacctcatttcttctgcgggtctctgtaactccagcagcctgactgaaaacgtttgggacgaatcatggaaagcaccctccgagaggccaggaacctcaagcgggacattctcccccgttcggttagatgagagcggagaagacgaagtatttttacaagaaaacaagcaacacctggagaagacccctaagccagagcgcgaccgcgagcggatctcagagcaagaagagcatgtcaaaggagaagatgaggacattctcggccctggctatacagaggatagtacagatgtttattcttcacaattcgagacaattctggacaatacaagtttatattactctgcagaaagccttgaaactctttattctgagcccgattcttacttttccttcgagatgcctcttacccctatgatccagcagagaattaaggaggggggacagttcctggaacggacttccgggggagggcatcaggatattttgagcgtgtctgctgacggcggaatcgtgatgggctactccagtggcgtgaccaacgggctgaacgatgcttctgattcaatttatacgaaaggtacacctgaaatcgctttctggggctctaacgccggtgtgaagaccacacgactggaggcccactccgaaatgggatctacagagatcttggagaaggagacacccgaaaatctctcaaatggaactagttcaaatgtggaagctgcaaaacgactggccaagcggttataccaactggatcgctttaagagatcagatgttgctaagcatctgggcaaaaacaatgaattttcaaagctagtagcagaggagtatttgaaattcttcgatttcactggcatgaccctcgaccaatctctcaggtatttcttcaaagcatttagcctggtgggagaaacccaggagagagagagagtgctgatccattttagcaacaggtacttctactgtaaccctgacacaatcgcctcacaggatggcgtccactgccttacttgtgcaatcatgctgttgaacacggacctgcacggtcatgtttcaaatatcgggaagaagatgacctgccaggagttcatcgctaatttgcagggggtaaacgagggcgtagatttctcaaaggacctccttaaggccctatacaatagtattaaaaacgagaaactggagtgggccgtggatgacgaagagaaaaagaagtctccatccgagtccacagaagagaaagcaaacggtacccatcctaaaactatcagcaggatcggttctactactaacccattcctagacataccacatgaccctaatgccgcagtgtacaaatctggctttcttgcacggaagattcacgctgatatggatggcaagaaaaccccacgagggaaacggggttggaagactttttatgccgtcctgaaaggcacggttctctacctacagaaggatgaatataagcccgaaaaggcattgtctgaagaagacctgaagaacgcggtgagcgttcaccacgccctggcttctaaggcaacagattatgaaaaaaaaccaaacgtctttaagctcaagacagccgattggcgagttctgctcttccagactcagtcccccgaggaaatgcagggatggatcaacaaaattaattgtgttgccgcagtcttctcagctccccctttcccggcagctatcggctcgcaaaagaaattctcccggcctctgctgccagccaccacaactaaattgtcccaggaggagcaactgaagtctcatgagagcaagctgaaacagattacaactgagctggccgagcaccgttcctaccctcctgacaagaaagttaaggcaaaggatgtggacgaatacaagctgaaagatcactacctggagttcgaaaaaaccagatatgagatgtacgtcagcatcttgaaagaaggtgggaaagaactgctctcaaacgatgagagtgaggctgccggactcaagaagtcacactccagtcccagcttgaatccagatacatctcctatcaccgccaaagtgaagcgcaatgttagcgaacggaaagaccatagaccagagacaccatccattaaacagaaggttacttag

SEQ ID NO: 235140 - DNA, 3171 bp, Artificial Sequence
  Description of Artificial Sequence: Synthetic coding sequence
atgatgggtgattaccgattgcctgaccaccctcagcccatggagattctcaatctgtaccttggcgacagtcttgagcctcatccaggggagtgcccacgggaaacatgcagtcacgaagacccccctgaaccattcgaggagcagacttgggcaactgatcctccggagcccacacggcagaacgttcctccatggggttccggggtggaactcacacatctgggatcttgggtgcatcaagatggccttgagccatgtcaagaacagacaagagctacagatccgcctgagtccaccagacaggatgcccctccctgggggtcaggtgtggagctgactcatttaggctccccttcagctcaaagggaacatcgccagaacaccgcctctcccggatcccccgtgaactcccatctgcccggttctcccaagcagaacaggagcacgtctacacaggttgtgttttgggccggaatcctgcaggctcagatgtgtgtgcttgacctggaggaagaactcgagaagaccgagggacttaaggcaggactgaagtgttgcctgcccactcctcccgtagacctacccggagataccggactccacagctcccctccagaaaacgaagacagcggcgaggactcctccgaacctgagggcgaggggcaggcttggctgagggaggggacccccgacagttcgccacagtggggggctgaagaagaaagcatgttcttctccaacccactgtttctggcatctccatgttcggagaacagtgcatctggggaatgcttctcctggggagccagtgacagccatgcaggagtgcgaaccgggcctgaatcacctgccacattggaacctcccctgccagaagacaccgtgttatgggaattagagtcagaaccagacttaggagacggggctgccattagtggacactgcaccccccctttcccggtgcccatatacaagccccacagtatctgctgggcatcagtggccgcagccgagggcgcacctgcagcccctcctggccatggggagagcgagggtgaccgattaggacccgctcctagtgctgctccctgcgtcgatgaggcgctcacttgggagtctggatgtgtcggctccgatctaggtcctgcagcccaccccgtacagccctgggcgagtctgagtcctgagggctggcaacgaggtggaccgttctggcctcaggtgactctcaattcccaagaccgggatgaacgtgaaggcggtcacccccaagagtcccttccctgtactctcgccccatgtccatggagatctcctgcttcaagtccggaaccttcgagccccgagtcagagagccggggtccgggaccgaggcctagccccgcatcttcccaggaaggtagcccccaactccaacatcacagcagcggaatactgcccaagtggacactggacgcctcccagagctccttgctggagacagacggggagcagccgagcagcttaaaaaagaaggaagccggagaagctccgaaacctggcgaggaggtgaagtcagaaggcactgcaagacctgccgagacaggggatgttcaaccagacatccatctgacaagtgccgaacatgaaaatctgcggacccctatgaacagcagctggctgccagggagtccaatgcctcaagcacagagccctgaagaaggacagaggccgccagcgggtgataagttggcaaacggagtgagaaataataaggtggcctggaacctggccagtaggctttaccggcttgaggggttcaggaaatcggaagtggcagcctaccttcagaaaaacaacgatttctctcgagccgttgcagaggagtatctgtccttttttcagtttgggggacaaagcctggatagggcgctcaggagctttctccaagccttggtgctttctggagagactcaggagagggagcggattctgtaccaatttagtaggaggttccaccactgcaacccgggtatctttcctagcgtggacagcgtacatactctcacctgcgcaatcatgctgttaaatacggacctgcatggccagaacattggtaagtcgatgtcttgccaagagtttatcaccaaccttaacggactcagggacggagggaactttcctaaggagctgctgaaagcactctattggagcatcaggtctgaaaagctagaatgggctgttgacgaagaggataccgcacgacctgagaaggctcagccatccttgcccgcaggaaaaatgagcaaaccgttccttcagctggctcaagacccaaccgtgccaacatacaagcaaggaatattagctcgtaaaatgcaccaggacgccgatggaaaaaaaacaccatgggggaagcgaggttggaagatgtttcataccctgttgcgaggaatggtcctatacttcctcaagcagggcgaagaccattgtctcgaaggagaatcactggtcggccagatggtggatgaacctgtgggcgtgcatcactccctggctactcccgctacacattatacaaagaagccacatgtatttcaactgaggactgcagattggcgtctgtatctgttccaggccccaacagcaaaggagatgtctagttggattgctcgaattaatctggctgcggcaacacactctgccccaccatttcctgcggctgtggggagccagaggagattcgtcaggcccatactacccgtgggccctgctcagagtagcctggaagaacagcatcggtcacacgaaaattgcttggacgctgccgcagacgacttattggacctccagaggaacttaccggaacgcaggggccgagggagagagttggaagaacaccgcctgcggaaggagtacttagagtacgagaaaacccgctacgagacctacgtgcagttgttggtggctcgactgcattgtccttctgacgctctagacctatgggaagaacagcttggccgagaggccggaggaactcgagaaccaaaactctcgctcaagaaaagtcacagtagtccaagtctccaccaagacgaagcccctacaactgccaaagtcaagcgtaatatctcagaacgcaggacataccggaaaatcatcccaaagagaaaccgaaaccagctgtag

SEQ ID NO: 235141 - DNA, 1152 bp, Artificial Sequence
  Description of Artificial Sequence: Synthetic coding sequence
atgccttacgtggataggcaaaaccgcatttgtggattcctggacatcgaggaaaacgaaaatagcggcaaattcttacgaagatactttattctggacactagggaagacagctttgtgtggtacatggataatccacaaaacctgcccagcgggtcaagtcgcgtgggggctatcaagctgacatatattagtaaggtcagcgatgcgacaaagctgagaccaaaggcagaattctgttttgtcatgaatgccggaatgcggaaatacttcttgcaggcaaacgatcagcaggaccttgttgaatgggttaacgtgctgaacaaggctatcaaaattacagttcccaagcagagcgatagtcaaccaaatagcgataatctttctcggcatggcgaatgcgggaagaagcaggtcagttaccggactgacatcgtggggggtgttcctataatcactccaacgcagaaggaagaggtgaatgaatgtggggaatctattgatagaaataacttaaaacgcagccaaagtcacctcccttatttcaccccgaagcccccacaggattcggcggttatcaaagcaggatactgtgtgaagcagggggctgtgatgaagaattggaagagacgttacttccaacttgacgaaaataccattggatacttcaagagcgagctcgagaaggaacccctccgagtgatcccactgaaggaggtacataaggtccaagagtgcaagcaaagtgatattatgatgagggataatctatttgagatcgtgactacctccagaactttctacgtccaggctgactcaccagaggagatgcattcgtggattaaagccgtcagcggcgctatcgtcgcccagagagggcctggccgtagcgccagcagcatgcgtcaggcaaggcgactgagcaacccatgcatccagagaagcattccacccgttctccagaaccccaacactctgagcgtccttccaactcaaccccctcccccacacattcctcagcccctggccgctaccttgtggagccaacctcttccttggaggtcagaagacttcacgtcactgttgccacgctcttcccagggaacgtctaggtcaagactcagcctgcaggaaaatcagcttccaaaatag

SEQ ID NO: 235142 - DNA, 1152 bp, Artificial Sequence
  Description of Artificial Sequence: Synthetic coding sequence
atgccttacgtggatcggcagaaccgaatttgtggatttctcgacatagaggagaatgaaaactcaggcaagttcttgagaagatatttcattctggatacacgggaagactccttcgtgtggtacatggacaatccccagaacctgccctcgggcagcagtcgagttggcgcaatcaaactaacatacatctccaaagtgagtgacgcaacaaaactgcggcctaaagcagaattttgcttcgtgatgaacgccggtatgaggaagtattttctgcaggcgaatgaccaacaggatctggttgaatgggtcaacgttcttaacaaggctatcaagataaccgtgccaaagcagtcagattcccagccaaattctgataacttatctcggcatggcgagtgcggaaaaaaacaggtctcttatcggactgacattgtgggtggcgttccgatcattactccaacacagaaggaggaagtcaacgagtgcggcgagtcgattgatcgcaataatctgaaacgctctcaatcccacctgccttattttaccccgaagccacctcaggactccgctgtcattaaggctggttactgcgtcaaacagggagccgtcatgaaaaattggaaaagacgttactttcagctcgatgaaaacacaattgggtatttcaagtctgaactcgagaaggaacccctgcgggtgattcctcttaaggaggtgcataaagtgcaggagtgcaagcagtcagacatcatgatgagggacaatctattcgagatcgtgaccacgtcccggacattctacgttcaggctgattctcctgaggagatgcactcttggattaaggccgtttcgggagccattgttgcccaacgaggacctgggcgtagcgcttcaagcatgcgacaggccaggcgactatctaatccctgcattcagcgctcaatcccccctgtgttgcagaatcctaacaccctctcagtgcttccaacacagccacccccacctcatatccctcagccactggccgcaaccctctggtcccagccccttccttggcgaagtgaggatttcactagcctgctgccccgaagctctcaaggaacctctcgatccagactgtctcttcaggagaatcagctcccgaagtag

SEQ ID NO: 235143 - DNA, 1215 bp, Artificial Sequence
  Description of Artificial Sequence: Synthetic coding sequence
atgccttatgttgaccgtcagaatagaatctgcggcttcctggatatcgaggaaaacgaaaattccggtaaatttctgaggcggtacttcattttagacacgcgcgaggactcctttgtgtggtacatggacaacccacagaacttgcccagcggttcaagcagagtcggcgcaatcaagctaacctacatcagcaaagtctcagatgctacaaaactgaggcccaaagccgagttctgtttcgtaatgaatgccggaatgagaaagtactttttgcaggcgaacgatcagcaagacctggtggagtgggtcaatgtgctgaataaagctatcaaaattactgtaccgaagcagtctgattcacagcccaactccgacaatctaagtaggcacggtgaatgcggcaaaaagcaggtgtcttaccgcaccgacatcgtcgggggagttccaatcataacaccaacccaaaaggaggaggttaacgaatgcggagagagcattgaccggaacaacttaaagcgaagccaaagtcacctcccttatttcacccctaagcctccacaggacagtgccgtgattaaggctggctactgtgtcaaacagggagcagttatgaagaattggaaacggaggtactttcagttggatgagaatacaattggctatttcaagtccgaactggagaaagaaccactgagagtgatacccctcaaggaggtccacaaggtgcaggaatgtaagcaatccgatattatgatgcgcgataacctgttcgagatcgttactacatcccgtactttctacgtgcaagcagacagtccagaggagatgcattcatggatcaaggcagtgagcggcgctatagtggctcagcgcggacctggcaggagcgcatcttcggagcacccacccggtccttcagagtcaaaacacgccttcaggcccaccaatgccgctactgctacttctcactccacagcatccagatccaattccctggtaagtactttcaccatggagaaacggggattttacgagtccttggcgaaagtgaagcccggaaactttaaggtgcagaccgtttctcccagagagcctgcttccaaggttaccgaacaggccctcttgcgaccacagtctaagaacgggccacaggaaaaagactgcgaccttgtggacctggacgatgcgtccctgccagtcagcgacgtttag

SEQ ID NO: 235144 - DNA, 345 bp, Artificial Sequence
  Description of Artificial Sequence: Synthetic coding sequence
atgccatatgtggaccggcaaaatagaatctgtggctttcttgacattgaggagaacgaaaactctggaaagtttttgcgacgttatttcatcctggatactcgggaggactccttcgtgtggtatatggacaatccacagaacctgcccagtggcagcagtcgggtgggcgcaatcaaactgacctacatcagtaaggtgagtgacgccaccaaactgagacccaaagccgagttctgctttgtcatgaatgctggaatgaggaaatactttctacaggcaaatgatcaacaggatttggttgaatgggtgaatgttttgaacaaggccatcaaaattacatag

SEQ ID NO: 235145 - DNA, 1215 bp, Artificial Sequence
  Description of Artificial Sequence: Synthetic coding sequence
atgccgtacgttgacaggcagaacagaatttgtgggttcctcgacatcgaagagaatgaaaatagcgggaagttcctgcgtcgttatttcattcttgatactcgcgaggatagctttgtttggtacatggacaacccgcagaatcttccttccggaagctcaagggtgggggctataaagctgacttacatttcaaaggtgagcgatgcaaccaagcttcgtccaaaggcagaattctgcttcgtgatgaatgccggaatgcgcaagtactttttacaggctaacgatcagcaagacctggttgagtgggtgaatgtgttaaacaaagctattaagataacagttcctaaacagagcgacagccagccaaattccgacaatcttagccggcatggggagtgcggtaagaagcaggttagctaccggaccgatatagtcggcggagtgccaatcattacacctacccagaaagaggaggttaacgaatgcggggagagtatcgatcgcaacaacttgaagcggtcacagagtcacttgccgtatttcacacctaagcctcctcaggactcggcagtgatcaaggccggttactgtgtgaagcaaggcgctgttatgaagaactggaaaaggagatactttcagctggacgaaaatacaatcgggtattttaaaagtgaactggaaaaggagccattacgagttattcccctgaaagaagtacacaaagtacaggaatgcaagcagtcagacattatgatgcgcgataatctgttcgagattgttacaaccagccgaaccttctacgtgcaggctgacagcccggaggagatgcattcctggatcaaggccgtgtcaggggcaatagtggcccagagaggtcccggaaggagcgctagcagcgaacatcccccaggaccctccgagtccaagcacgccttccggccaaccaatgctgcaaccgctacctctcactccaccgccagcagatccaattccctggttagtacgttcaccatggagaaacggggattctatgaatcccttgccaaagtcaaaccagggaactttaaggtgcagacagtgagtccccgagagccagccagcaaggtgactgaacaagccctgttgaggccacagtctaaaaacggccctcaagagaaagactgcgacttggtcgatctggatgatgccagtctcccggtctcggacgtgtag

SEQ ID NO: 235146 - DNA, 1215 bp, Artificial Sequence
  Description of Artificial Sequence: Synthetic coding sequence
atgccctatgtggaccgccaaaataggatctgcggatttcttgacattgaagagaatgagaacagtgggaaatttctccgaagatatttcattctggacacgcgcgaggactcctttgtctggtatatggacaacccccagaacctcccaagtggctcatcccgcgtgggagctattaaactaacctatatctctaaagtaagcgacgccacaaagctgcgaccaaaagccgaattttgctttgtcatgaacgccggtatgaggaagtacttcctccaggcaaacgaccagcaggatctagtcgagtgggtgaacgtactgaacaaagcaatcaagatcactgttccaaagcagagcgactctcagcctaactccgacaatctatctcgccacggtgaatgtgggaagaaacaggttagctatcggacggatatcgtcggaggagtgcctataattacacccacacagaaggaggaagtcaacgagtgcggagaatccattgatagaaacaacctgaaaaggtcccagtcccacctgccctattttactccgaagccaccgcaggactccgccgttattaaggccggatattgtgtcaaacagggcgcagtcatgaaaaactggaaaagacgttacttccaacttgatgagaataccattggctatttcaaatccgaactggagaaagaacccctccgcgtgatacccctgaaagaggtccacaaggtgcaggagtgtaagcagtctgacatcatgatgagagataatctgtttgaaatagtgaccacaagcagaaccttctacgtgcaagccgactcgcccgaagagatgcattcttggataaaggcggtgtccggagctattgtcgcccagagagggcctggtagatcagccagttctgagcaccctcccggacccagtgaatctaagcatgcatttcgacccacaaatgcagccaccgctacttcacactcaacggcatcacggagcaatagccttgtatcgacatttaccatggaaaaacgaggcttctatgagtcactcgctaaggtgaaacctggtaactttaaagtgcagaccgtgagccctagggaacctgcctcgaaagtgactgaacaggccctccttaggccgcagtccaaaaatggtccccaggagaaggattgcgatcttgtggacctcgacgatgcatctctgcctgtcagtgacgtttag

SEQ ID NO: 235147 - DNA, 1005 bp, Artificial Sequence
  Description of Artificial Sequence: Synthetic coding sequence
atgccttacgttgatcgacagaacaggatctgtggcttcttggacatcgaggaaaatgagaatagtggcaagttcctgcggcgatactttattctagatacccgggaagattcgttcgtttggtacatggacaacccacaaaatcttccctccggttcttccagagtgggcgctattaagctgacctatatctccaaggtaagtgacgccaccaagttgaggccaaaagctgaattctgcttcgttatgaatgccggtatgcgtaagtatttcctccaggccaacgatcagcaagacctggtcgaatgggtgaatgtgctgaataaggcaatcaaaattaccgtgcctaagcaaagcgattcacagcccaacagcgacaacctctcaaggcatggggagtgcggtaagaagcaggtgtcataccggaccgacatcgtagggggtgtaccaatcattactccaactcaaaaagaggaggtaaatgagtgtggtgaaagtatcgatcggaacaacctcaagcgtagccagagtcatttgccatactttacaccaaagcccccacaagattcggccgtcatcaaggccggttactgcgtgaagcaaggggctgttatgaagaactggaaacgccgttatttccagcttgacgaaaataccattggctattttaagagcgagctcgagaaagaaccgttgcgggtgatcccgctcaaagaggtgcataaggttcaagaatgtaagcagtcagatatcatgatgcgggataatctctttgagatcgttacaacgagtcggaccttttacgtgcaggccgatagccctgaggagatgcattcatggatcaaagcagtatcaggcgcaatcgtggctcagaggggcccaggtagatccgccagctccatgaggcaggcaaggcgcctgagtaacccatgcattcagagatatacgagccgcgctggtgaatgctccacgtacgtgggatctcatgcaaacgtgccatcatag

SEQ ID NO: 235148 - DNA, 1278 bp, Artificial Sequence
  Description of Artificial Sequence: Synthetic coding sequence
atgccttatgtggataggcagaaccgaatatgtggcttcttggacatagaggagcacgaaaattccggcaagttcttgcggcgttactttatccttgacactcaagccaactgcctgctgtggtatatggacaaccctcagaatctggcaatgggcgcaggagccgtgggtgcactgcagctcacctatatctctaaagtatctattgctacccctaagcagaagccaaaaacccccttctgtttcgtcatcaatgctctgagccagcggtattttctccaggctaatgatcaaaaggacatgaaggactgggttgaggctctcaaccaagcatcaaaaataaccgtgcctaagggaggtggcctgcccatgactacagaagttctgaagagcctcgccgcaccacccgctctggagaagaagccacaggttgcctataagactgagatcatcggtggcgttgtcgtccacacaccaatcagccagaacggcggagacgggcaagagggaagcgagcccggttctcatactatactccggaggtcccagagctacatacccacatcaggctgcagggcttccacaggccctccattaattaaatccggttactgcgtgaaacagggtaatgttcgtaaatcatggaagcgcaggttctttgctctcgatgattttacaatttgttattttaagtgcgaacaagaccgcgagcctctccgcacgatctttctgaaggacgtgctgaaaactcatgagtgccttgtaaaatcgggtgatctgttgatgagggacaatcttttcgagattatcacaagttcaagaacattctacgtgcaggcagatagtccagaggatatgcactcttggatcaaggagatcggagctgctgtgcaggccttgaagtgtcatcctagggaaacctctttcagcaggtccatcagcctgactcggccaggctccagctccctgtcctcaggcccaaattctattttatgccggggacgcccaccccttgaagaaaaaaaagccctgtgcaaggctccttcggtggcgtcttcgtggcagccctggacccccgtgcctcaggcgggtgaaaagctgctgccccctggtgacacctctgaggactccttatttacgccaaggcccggtgaagggagcgcccctggcgtgttaccttcttctaggataaggcatcggagcgagcctcagcaccccaaggagaagcctttcatgtttaatctagacgatgagaacattcggactagcgacgtgtag

SEQ ID NO: 235149 - DNA, 348 bp, Artificial Sequence
  Description of Artificial Sequence: Synthetic coding sequence
atgccctacgtcgacagacagaataggatctgcgggttcctggatatcgaggagcacgagaattctggaaagttcctccggaggtatttcatattagacacacaggctaattgccttttgtggtatatggacaatccccagaatctagccatgggcgctggcgcagttggggcactgcagctgacgtacatttctaaggtttccatagccactccaaaacagaaaccaaagactcccttctgcttcgttattaacgcactgagccagcgatactttttgcaggccaatgaccaaaaagatatgaaggactgggttgaagccctgaaccaggccagcaagataacctag

SEQ ID NO: 235150 - DNA, 1128 bp, Artificial Sequence
  Description of Artificial Sequence: Synthetic coding sequence
atgggagccggagccgtgggagccctccagttgacgtacataagcaaggtctctatagctacgcctaagcagaaacctaaaacacctttctgctttgtcattaacgctctgtctcaacggtattttctacaggctaacgaccagaaggacatgaaagactgggtcgaagctctcaatcaggccagcaaaattactgtccctaaaggtggaggtctgccaatgacgacagaggtcctaaagtcccttgctgctccgccagctctggaaaagaagccacaggtggcctataagaccgagataattggaggcgtggtggtgcatactcccatttcccaaaacgggggtgatggccaggaaggctcagagccagggagccacactattctgcgtagatcgcagtcctacattcccacttcgggatgccgcgcttcaacaggtccccctctgataaagtctggatactgcgtcaagcaggggaacgtccggaagtcatggaagcggaggttctttgccctggacgattttacaatctgctacttcaagtgtgagcaggatcgggagccactgcggacgatcttcctgaaagatgtcctgaagactcatgagtgtttagtgaagtcgggcgacctactgatgagggataatctgtttgaaataataacgtcatcgcgcaccttttatgtccaggctgactcgcctgaagatatgcattcctggatcaaggaaatcggcgctgcagtccaggccctgaagtgtcacccccgtgagacaagtttctccaggtcaatctccctgacaaggccaggctcttctagcctgtcatcggggcctaactcaattctgtgtcgcggtcggccacccctcgaagaaaagaaggcattgtgcaaagcccctagcgtggccagctcatggcaaccctggactcccgtgccccaggccggtgaaaaattactcccaccaggcgatacctccgaagattctctgttcactcccagaccaggcgaaggtagcgcacctggcgtcctgccatcctctagaatccgtcaccgcagcgagccacaacatccgaaagagaaacccttcatgttcaatctggatgacgaaaatatcagaacctccgacgtgtag

SEQ ID NO: 235151 - DNA, 4083 bp, Artificial Sequence
  Description of Artificial Sequence: Synthetic coding sequence
atgagtcgacaatccactctgtattctttcttccccaagtcacccgctctaagcgatgccaataaggccagtgccagagcttcccgggagggcggacgggctgccgctgcccctggagcctcaccctcacctgggggtgatgcggcatggtccgaagctggtcccggtcccaggccgttggcaaggtccgcttctccgccaaaggccaagaacctcaatggaggcctgcggaggagcgttgcccctgcagcacccaccagctgcgatttttcccctggagatctggtgtgggctaagatggagggatacccatggtggccttgcttagtctataatcaccctttcgacgggaccttcatccgggagaagggcaaaagcgttagggtgcacgtgcaatttttcgatgattcccctacaaggggatgggtgagcaagagactgctgaaaccctacactggatctaaaagcaaagaagctcagaaaggcggtcacttttacagcgctaaaccagaaatcttaagggctatgcagcgagccgacgaagctttgaacaaagacaaaattaagcgactggaacttgctgtttgcgacgagccaagcgaacccgaggaagaagaggagatggaggtcggcaccacctacgtcactgataagtctgaagaagacaacgaaatcgaaagtgaggaagaggtgcagccgaaaactcaggggtccagaaggagctcaaggcagatcaaaaagcgccgagtcatctctgatagtgaatccgacataggcggttccgatgtcgaatttaaacccgacactaaggaagagggcagctcagacgagatttcaagcggagtaggagactccgaatccgaaggcctaaatagcccagtaaaggtggcacgcaaaaggaagaggatggtcacaggcaacgggtccctcaagcgaaagtctagcagaaaagaaactcccagtgcaacaaagcaggccacatctatcagctctgagaccaagaacacgctgcgcgcatttagtgcaccgcaaaacagcgagtcacaggcccacgtcagcgggggaggagacgactcaagccgccctaccgtgtggtatcacgagaccctggagtggctgaaagaggagaaaaggcgggacgaacaccgaagacggcctgaccacccagactttgacgccagtacactgtacgtccccgaagacttcttaaactcatgcaccccaggcatgcgcaagtggtggcaaataaaaagtcagaacttcgacctcgtgatctgctataaggtcgggaaattttacgagctgtaccacatggacgccctcataggagtgtctgagcttgggctggtttttatgaaggggaactgggcccatagcggatttccagagatcgcttttggcaggtactccgactccctggtccaaaaaggctataaggtggcgagggtagaacagacagaaacaccagagatgatggaggccagatgtagaaagatggcgcatattagcaagtacgatcgggtcgtacggagggaaatttgcaggatcattacaaaggggactcagacgtattctgtactggagggggatccctccgaaaactattcaaagtacctgctatctctcaaagagaaagaggaggacagttctggacatacaagagcgtacggagtgtgtttcgtcgacacctctctcgggaaatttttcattggacagttttctgacgaccggcactgtagccggtttcggacgctggtggctcattatcctcctgtgcaggtgctctttgaaaaagggaatctttcaaaggagacgaaaaccatcctgaaaagttccctcagttgctccctgcaggaggggcttatccccggatcacaattctgggatgctagcaagactttgcggactctgctggaggaggaatattttcgggagaagctgtcagacggcatcggcgtgatgctgcctcaagtacttaaagggatgacgagtgagagcgattccataggtctcaccccaggggagaagtccgaactggcgctcagtgcacttggagggtgtgtgttttacctcaaaaaatgcctaatcgatcaggaacttctgtctatggcaaattttgaagaatatattccacttgatagtgacacggtttcaacgactcgtagcggcgcaatctttaccaaagcttatcagcgtatggtcctcgatgccgtaacacttaacaatctagaaattttcctgaacggaaccaacggtagcaccgagggaaccctcctggaaagagtggacacatgccatacaccttttggaaaacgccttttgaagcaatggctgtgtgccccattgtgtaatcactacgctattaacgataggctggatgcaatagaagacttgatggtcgtcccagacaagatctcagaggtggtggagcttctcaagaagctgcccgacctggagcggctccttagtaaaattcacaacgtaggctcccctcttaagtcccagaaccatcctgactcaagggctatcatgtacgaagaaacaacgtacagcaaaaagaagataattgactttcttagtgctcttgagggattcaaagtaatgtgtaaaattatcggcatcatggaggaggttgcagacggatttaagtctaagattctgaagcaggtcatttcactccagactaagaaccccgaaggcagattccctgatctaacagtggaactcaaccgctgggatacggcttttgaccatgagaaagccagaaagaccggcttgattactcctaaggcagggttcgacagcgattatgaccaggccctcgccgatatcagagagaacgaacaatcactgttagaatacctggagaaacagagaaaccggattgggtgcagaactattgtctattggggcattggcagaaaccggtaccagctggaaatacctgaaaatttcacaacccggaacctacccgaagagtatgagctcaaatcaactaagaagggatgcaaacgctactggaccaagactatcgagaaaaagctagcaaacctcattaacgcagaagaacggcgagacgtgtctctcaaagactgcatgcgccgtctgttctacaacttcgacaagaactacaaggactggcagtctgccgtggaatgcatagccgtgttggatgtattactgtgtttagcaaactatagccgaggcggtgatggaccgatgtgtcgacctgtcattttgctgcccgaggatactcccccatttctggagctgaaggggtcccgccatccctgtattacaaaaacattctttggtgatgactttatcccgaatgacatcttgatcggttgtgaggaagaagagcaggagaatggaaaagcatactgcgtcttagtcacaggccctaatatgggcggtaaatctacactgatgaggcaggccggattactggcggttatggctcaaatggggtgttacgtgccagccgaggtgtgtcggttgacacccatcgatagagtgtttaccaggttgggtgcctcagatagaattatgtctggcgagtccaccttttttgtggagctcagtgaaaccgcttctatcctgatgcacgccactgctcacagccttgtccttgtggatgagctggggcgtggaaccgctacctttgatgggacagccatcgctaacgcggtggtgaaagagttggccgaaaccataaagtgtcggacactcttttccactcactatcacagcctagttgaagattacagccagaacgtggctgtccgcttgggacatatggcctgtatggttgagaacgagtgcgaggatccttcacaggaaactatcaccttcctttataagttcatcaaaggcgcttgtccaaagtcgtatgggtttaacgcagccagattggctaacctgcctgaagaggtgatccaaaaagggcaccggaaggcacgcgagtttgagaaaatgaatcaatccctgagactttttcgagaggtctgtttagcctctgaacgatctaccgtagatgcagaggcagtccataaactgctaaccctgatcaaagagctatag

SEQ ID NO: 235152 - DNA, 2340 bp, Artificial Sequence
  Description of Artificial Sequence: Synthetic coding sequence
atggagggttcccgacctcgttccagcctttccctggcgagctctgccagcaccatttcatccctcagctccctgtcaccaaaaaagcccacacgagcagtaaataagattcatgcattcggaaagaggggcaacgccctgagacgtgacccgaacctgcccgttcatatccgcggatggctgcataagcaggactcctcgggcctccgcctttggaaaaggaggtggttcgtgctgagtggtcattgcttgttttattataaggactcccgggaggagtctgttttggggtcagttctgctgccgtcctacaacatcaggccggacggacccggagcaccccgtggaaggcggttcacgtttacagcagagcatccaggaatgaggacatatgttcttgctgctgatacactggaggacttgcgaggttggctgagggcgctgggacgcgcaagtcgggctgaaggagatgattacggtcaacccaggtcacccgcacgccctcaacccggagaggggccaggtggccctggcggacctccagaagtctcacgaggagaggaggggagaataagtgaatctccagaagtcacgcgcttgtcccgtggcagaggccgacccagactactaacaccatcccctactaccgatttgcattccggtctgcagatgagacgggctaggtccccggatctgtttaccccactgtctcgcccaccctcccccctgagcctgcccagacctcgaagcgccccagcacgacgccctccggctcctagcggggatacagcacccccagccagaccccatacacctttgagtaggattgacgtgaggcccccactcgactggggaccccagcgccagaccctctctcggcctcccacacctagaaggggacctcccagcgaggcaggcggagggaagcctcctagatctccgcagcactggagccaggagccccgtacccaagctcatagcggatcccccacctacctgcaactacccccaagacctccaggtacaagagcctctatggttctgttgcccggaccacctctcgagtcgacatttcaccagtcgctggagacagatacgctgcttaccaaactctgtggtcaggatcggttactgcgaagattgcaggaagagatagaccagaaacaagaagagaaggagcaactggaggctgctttagaacttactcggcagcagctgggccaagccactcgtgaggccggagctcctggaagggcctggggtcggcagcggctgttgcaagatcgactcgtctccgtgagggctaccctttgccacctcacccaagagagagagagggtttgggatacatactccggccttgagcaagaactcgggacgttgagggagactttggagtatctgctgcacctgggaagtcctcaggaccgggttagtgctcaacaacagctgtggatggttgaagacacccttgctggtctgggcggaccgcagaaaccccctccacataccgagccggactcaccttcccccgtcctccagggcgaagaatcttcagaacgggaaagcctgccagagtctctggagctgagctccccccgaagcccagagaccgactgggggaggccacctgggggagacaaggacctcgcttcaccacacctcggtttgggcagcccgagggtatctcgggcatcatctcccgaggggagacacctgccgagtcctcagttaggcacgaaagcacctgtggctcgtcctcgaatgagtgcacaggagcaactagaaagaatgcgtagaaaccaggagtgcggtcgccctttcccaaggcctacttctccgcgtttgctaaccctcggtcgcaccctttcccccgctcgcagacagccggacgtggaacagcggccagtcgtcggccacagcggtgcccagaaatggctgcgcagtagcggctcatggagcagtcccaggaacaccacaccttacctccccacctctgaggggcacagagagcgggtgctgtcactttcgcaagcactggctacggaggcatcacagtggcacaggatgatgactgggggtaacctggactcccagggggatcccctgcccggtgttccattacccccaagcgatcctactcggcaagagacgccccctccaaggagtccacctgttgccaattctgggagcaccggcttctcacggcgagggagtggccgaggtgggggacccacaccctgggggccagcatgggatgctggaatagcccctccagtgctccctcaggatgagggagcctggcccttaagagtcactctcttacaatctagcttctag

SEQ ID NO: 235153 - DNA, 1752 bp, Artificial Sequence
  Description of Artificial Sequence: Synthetic coding sequence
atggagggttctcgcccacggtctagcctgtctttggcctcaagcgcctccacaatttcctctttatccagcctctctcctaaaaagccaactcgtgctgtgaacaaaattcacgcctttgggaaacgcggaaatgcactcagacgagatcccaatctgccggtgcatatcaggggttggcttcataagcaagactccagtgggctgcggctgtggaagcggaggtggttcgttctatcaggacattgccttttttactacaaagatagcagggaggaaagcgtactcggcagcgtgcttctgcccagctataatatccggcctgatggtccgggagcaccacgaggcagacgattcacttttacagcagagcatcccggaatgcgaacgtacgttctggccgctgacactctggaagatttgagagggtggcttagggccttaggacgcgcttcacgtgctgaaggggacgactatggccagcctcgcagcccagctcgccctcagcccggagagggacccggtgggccaggcggtccacctgaggttagcagaggggaggaagggaggatttctgagtccccagaagtaaccaggctgtccaggggccgaggcagaccacggttgttgaccccatcaccaactacggatctgcattccggcctgcagatgcgaagagcacgctcacccgacttattcacaccgctgagtcgtcccccttctcccctcagtctgccccgtccacgcagcgcccctgcaaggcggccacctgctccctctggagacactgcccctccagctaggccacacacacctctgagtagaatagatgtacggccaccactggactggggaccccagagacagacactgagtcgaccgccaacacctcgtcgcggtcctccatctgaggctggcggaggcaagccacctcgctctcctcagcactggagccaggaacctagaacacagccaggcccacctttggaatctaccttccaccagtccctggagactgacactttgcttacgaaactgtgtggacaggacaggttgctgcggagattacaagaggaaattgatcagaagcaggaagagaaggagcagctcgaagctgccctggagcttacccgtcaacagctcgggcaggccaccagagaagccggagcgcctgggagagcgtgggggagacagagattgcttcaggatagactggtgtctgtgagagcaacactttgccacctcacccaggagcgtgaaagggtctgggacacttatagcggattggagcaggagcttggtaccttgagagaaacactggagtacctcttgcatctgggaagcccacaagacagggttagcgctcagcagcagctgtggatggtcgaggacaccctggctggcctgggcggtcctcagaagcccccaccccatactgagccagatagccccagtcctgtgctccagggcgaagagagcagtgagcgagaatcgttgccggagagccttgaactgtcatctcctcgtagccctgagacggactggggtcgaccaccgggtggcgataaagacctcgccagtcctcacctgggccttggatctccacgggtgtccagagctagtagtcctgagggacgtcacctgccttcccctcagttggggacaaaaagtaaagagcatcatccgctgcttgcggacttccgcaggtccccgggagcgggttctcagccattgccgtctcccggatactag

SEQ ID NO: 235154 - DNA, 3366 bp, Artificial Sequence
  Description of Artificial Sequence: Synthetic coding sequence
atggcggcagccacagtggggcgtgacactttgcctgagcattggagctacggcgtctgccgagacggcagagtcttttttatcaatgatcagctgagatgtaccacctggctccacccaagaacaggggaacctgtgaattctggacatatgattcgctcagacctccctcggggttgggaggagggtttcacggaagagggggcatcctacttcattgatcataatcagcagactaccgcatttagacaccctgtgaccggacagtttagtcccgagaacagtgagttcatcttacaggaggaacctaacccacacatgagtaagcaggataggaaccagcgaccgtccagcatggtctcagaaaccagcactgctggcacggcaagtaccctggaggcaaagccgggacccaagatcattaagtcttccagcaaagtccacagtttcggcaagagagaccaggccatcagaaggaaccccaacgtgcccgtggtggttcgcggttggctccataagcaagactcaagcggaatgcgactgtggaaacgcagatggttcgtgttagccgattattgtctgttttattacaaggattctagagaggaggcagtgctggggagtatacctctccctagttacgtcatctccccagtggcccctgaagatcggattagtcggaagtattcttttaaagccgtgcacaccgggatgcgggctctgatttacaactccagtacggccggaagccaagcagaacagtccggtatgaggacttactatttctctgcagatacccaggaggacatgaatgcttgggtccgggcaatgaatcaagctgcccaggtattatcccgtagctctctgaagagagacatggaaaaagtggagaggcaggccgtgccacaggctaatcatactgaaagttgccacgaatgcggccgtgttggccctgggcatactagggattgtccacacagggggcatgacgatatcgtgaatttcgagcggcaagaacaggagggtgagcagtacagatcccaaagggatcccctcgaagggaaaagagatcgttcaaaagcaagatctccatactcccctgcggaggaggatgcactgttcatggatctccccaccgggccaagaggccagcaagcccagccacaacgagctgaaaaaaatgggatgcttcctgcatcttacggtccaggagagcaaaatggtaccggaggctatcagagagcattcccgcctcgcacaaatcccgagaagcactcacagcgaaagtctaacctggctcaggtggagcattgggcgagggctcaaaagggcgattcaagaagtttgccactggatcagacgctcccaagacaaggccctgggcagtctctctcatttcctgagaactaccaaactttgcctaaatctacacgccacccttctggtgggagctcccctccccctcgaaatttaccatctgattacaaatacgcccaggaccgggcttcccacttgaagatgtctagcgaggagcggagggctcaccgggacggaacagtttggcagttgtacgagtggcagcagcgacagcaattcaggcacggcagcccaaccgcccctatctgcctaggatctccagaatttacagatcagggtcgaagccgctccatgctggaggtgcctaggagcatctcagttcctccatcacctagcgacatcccgcctcccggaccaccacgtgttttcccccctcgcagaccacatacacccgctgaaagggtgaccgttaaaccaccggaccagcgcaggagcgttgatatttcacttggtgattctccgaggagggcaagggggcacgccgtgaagaatagtagccacgtggatagacggagcatgcccagtatgggctacatgacacacaccgtctctgcgcctagccttcatggcaaatctgctgacgatacgtatctacaactgaaaaaagatttggagtatctggatcttaagatgactggcagggatctcttaaaagaccgttctttaaagccagtgaaaatcgccgaaagtgacactgacgtgaagctatccattttctgcgaacaggatagagtactccaggatttggaagacaagatccgcgctctgaaggagaacaaggatcagttggagtccgtactcgaggtgttacataggcaaatggagcagtaccgagatcagccacagcatttggaaaagatcgcgtatcagcagaagctgctccaggaggacttggtgcacattcgagcggaactcagccgggagtccactgaaatggaaaacgcttggaatgagtaccttaagctggagaatgatgtcgaacagctcaagcagacactccaggaacagcaccggcgagctttcttttttcaggaaaaaagtcagattcagaaagatctttggagaatagaggacgtcacagcagggttgagcgctaacaaggagaatttcaggatccttgtcgaatctgtaaaaaatcctgagcgaaaaacagtgccgctgttcccccaccctcctgtcccgagcctgtcaacttccgagagtaagccccctccgcagccctctcctccaacttcacccgtcagaactcccctagaagtcaggcttttccctcaactgcaaacatatgtcccctacaggcctcacccaccccagctaaggaaagtgaccagccccctccagtctcccacaaaggcgaagcctaaggtggaagacgaggccccaccccgacctccactgcctgagttgtattctcccgaagatcagcctccggcagtccccccactgccaagagaggctaccataattcgacacaccagtgtgagaggacttaagcggcagtccgacgaaagaaagcgggatcgggaacttggccagtgtgtgaatggggatagtcgggtagagttacgaagttacgtgagtgaacctgaacttgcaacattgtcaggagacatggctcagccctctctggggctcgtgggtcccgagagcaggtatcagactctccccggaaggggcctgagtggttccacttcccgtctgcaacagtcctcaaccatcgcgccttatgtcaccctcagaagaggtctgaacgctgagtcaagcaaagctactttcccacgtccaaagagtgccctggagaggctgtatagcggcgatcaccagcgagggaagatgtctgcagaggagcaattagaaagaatgaagagacaccagaaggccctcgtccgagagcgaaagcgtacattaggccaaggagagcgcacaggcctgccttcctcccgctacctgagtagacctctgccaggcgacttaggtagcgtatgctag

SEQ ID NO: 235155 - DNA, 3369 bp, Artificial Sequence
  Description of Artificial Sequence: Synthetic coding sequence
atggctgccgcaaccgtgggcagggataccctccctgagcactggtcttatggtgtctgcagagacggacgtgttttcttcattaatgatcaacttagatgcacgacctggttacaccctcgaaccggtgaaccggtgaactccggacacatgatcagatctgacctacccaggggttgggaggagggatttaccgaggagggggctagttactttatagaccacaaccaacagaccacggcattccgccaccccgtgaccggacagttttctccggaaaatagcgagtttatccttcaggaagaaccaaatccacatatgtccaagcaggatcgtaaccagagacccagtagtatggtatctgagacgtcgaccgctgggactgcaagcaccctggaggccaagccagggccaaagataatcaagagttcttccaaagtccactctttcgggaagcgagaccaggcaatacgcaggaatcctaacgtccccgtcgtcgttagggggtggcttcataagcaggactcttcaggtatgagactgtggaagcgcagatggtttgtgctggcagactactgtctattctactataaggactcacgtgaggaagcagtactggggtcaatacctcttccgtcctatgtgatctctcctgtggctcccgaggacaggatatctagaaagtacagcttcaaggccgttcatactgggatgcgtgccctcatctacaattcaagtaccgccggttcacaagccgagcaatctgggatgcgcacctactatttttcagccgacacgcaggaagatatgaacgcctgggtgcgggcaatgaaccaggctgcccaagtactgtccaggtcttctctgaagcgcgacatggagaaagtggagcgccaggcagttccccaggccaatcacaccgagtcctgtcacgagtgcggtcgggttggaccagggcacacacgcgactgcccacataggggccatgacgacattgtcaattttgaacgccaggagcaagagggcgagcagtaccgcagccagagagatcctctggaggggaagcgcgatcggagcaaggccaggtccccatatagtcccgcagaggaggatgcactgtttatggacctccccaccggcccacggggacaacaagctcagcctcagcgggcagaaaagaatggcatgttacctgcttcctatgggcctggcgagcagaacggcacaggtggctatcagcgggcatttcccccaaggaccaaccccgagaagcacagccagcgcaagtcaaatctcgcgcaggtcgagcactgggctcgggcacaaaagggagatagtcgctcactcccgctcgaccagactttgcctcggcagggcccaggccaatctctatcttttccggaaaactatcaaaccctccctaaaagcactcggcacccctccggcggttctagcccccctcccaggaacttgcccagcgactataaatacgcgcaggaccgggcaagtcacctcaaaatgtcctccgaggagaggcgtgctcatagggacggcactgtttggcagctgtacgaatggcagcagcggcagcagttcagacatggatctcccacagcccctatttgcctcggtagtcctgagtttacagaccagggtagaagtcgctccatgctggaggtgcctcggtccatctctgtgcctcccagcccttctgatatcccaccgccaggaccaccccgagtcttcccgcctagaaggccacatacccctgccgaaagagtgactgttaagcccccagaccagaggaggtcagtagacatttcgctcggcgatagtccacgacgtgccagaggccatgctgttaagaacagctcccacgttgaccggagatcaatgccttctatgggatacatgacgcataccgtcagcgccccttctctgcatggcaagtccgctgacgacacatatctgcaactgaagaaggatctggagtatctggacttgaagatgacggggagggacctgcttaaagataggagtctgaagcccgttaaaatcgcggagtctgacacagacgtcaagctgagtattttctgcgaacaggaccgggtactgcaggacctcgaggacaaaattcgggctcttaaggagaacaaagaccagctggagtctgttctggaagtcttacaccggcagatggagcagtatagggatcagccgcagcacttggagaaaatcgcataccagcaaaaactcttgcaagaggatctcgtgcatattagagccgaattgagtagagaaagcactgagatggagaacgcctggaatgagtatctaaagttagaaaatgatgttgagcaactcaagcagactctccaggagcagcaccggcgagcgtttttcttccaggagaagagtcagatccagaaagacctctggaggattgaagacgtgacagctggcctgagcgccaataaggaaaattttcggatcctggtggagagcgtcaagaacccggaacgtaaaactgtgccactgttcccgcacccgccagtgcctagcctgtctacaagcgaatccaaacctcctccacagcctagccccccaacttctccggtgcgaacacccctggaggtacggttgttccctcagcttcagacctatgtgccttacaggccgcatccccctcaactgcgaaaagttacatccccactccaatcccctactaaggctaaacccaaagtgcaggaggacgaagctccccctagaccacctttacctgagctgtactcacctgaagatcagccacccgcagtcccaccactgccccgagaggccacaattatacggcataccagcgtaaggggcctgaagaggcagtcagacgagagaaagcgtgatagggaactcggtcagtgcgtcaacggagactcccgcgtcgaactcagatcctacgtgtctgagccagaactcgctacgttatccggggatatggcgcaacccagcctgggcctggtaggcccagagtctcggtaccagacccttccgggaaggggcctgtccggaagcacttcgaggttgcaacaatccagtactatcgccccatatgtcacgttgcgccgaggtctgaatgcagagtcctccaaagctacatttcctcgacccaagtccgcactggaacgtttgtatagcggcgaccatcaacggggtaaaatgtctgctgaggagcagctcgagaggatgaaacgccatcaaaaggccctggttcgggaaagaaagaggacactggggcagggggagagaacggggttgccatccagccgatatctcagtcggcctctgcccggtgacctcggcagcgtgtgctag

SEQ ID NO: 235156 - DNA, 2262 bp, Artificial Sequence
  Description of Artificial Sequence: Synthetic coding sequence
tgagatgccttgttcatggaccttcctaccggacctcgcggacagcaggcccagccccagagggcggagaagaatgggatgttgcctgctagctatggaccgggtgagcaaaacggcaccgggggataccaaagagccttcccgccacggaccaatcctgaaaaacacagtcagaggaaaagtaaccttgcgcaagtggagcactgggcgagggcccagaagggggactcaagatctctcccgctagatcagaccctcccacggcaggggccaggccaatctctatctttcccagagaattaccagactttacctaaaagcacaagacatccttccggaggcagcagccctccacctcggaatttaccttcagactacaagtatgcacaggatcgcgcttctcacctcaaaatgtcctcggaggagcgaagggctcaccgcgacggcacagtttggcagctatatgaatggcagcagcggcaacagtttaggcatgggagtccgactgcccctatttgcctgggcagtccagagttcactgatcaggggaggtcaaggagcatgttggaagtgccaaggtccatttccgttccccctagtccttcagatatccccccacccggaccccctagagtgtttcctcccaggcggccacataccccggcagaaagggtcacagtgaagccgcctgaccagcggaggtccgtggacatttctctgggggacagcccaagacgcgctaggggacatgcagtcaaaaactcctcccacgtcgaccgaagaagcatgccatctatgggatatatgacccacaccgtttcagctccttcattacacggcaagtctgcggacgatacatatctacagctcaagaaagacctagagtacttggatctgaagatgactggacgagacctactgaaggatcgcagcctgaaacccgtcaagatagctgagtccgacacagacgtgaagctatcgatcttctgtgaacaggaccgagtcctacaggatctggaggacaaaattcgggctctgaaagaaaataaagaccagcttgaaagcgtgcttgaagtcctacatagacagatggagcaatatagagaccagcctcagcacctggaaaagatcgcttatcagcagaagctgctccaagaagacttagtccacattagagcagaattgagtagggagtcaacggagatggagaatgcctggaatgagtacttaaagctcgagaatgatgttgaacagttaaagcagactctccaggaacagcaccgtagggccttttttttccaggagaagagccagatccagaaggatttgtggcgcatcgaagatgtgactgctgggctcagtgccaataaggaaaacttccgcatactggtggagtcagtgaagaacccagagcgaaagaccgtccccctctttcctcatccacctgttccctcactgagcacctcagaatcaaagccccctccccagcctagcccacccaccagccccgtaagaactccactggaggttagactgttcccacagctgcagacctatgtgccctataggccgcaccctccacagctgaggaaggtgactagtccgctgcaaagtcccaccaaagccaaaccaaaagtacaagaggacgaagcaccacccagaccgccactcccagaactgtacagtcctgaagatcaaccacccgcagttcctcccctaccgcgagaagccacaattatccgccacacatcggtacggggtctcaagcggcagtcggatgagcggaagagagatcgagaactgggccagtgcgtgaacggcgacagccgggtagagctgaggagctacgtttcagagccagaactggctaccttgagcggagacatggctcagccaagtttaggacttgtgggtcctgaatctcggtaccagacacttccagggaggggcttgtccggttcgacctctagactgcagcaaagtagcaccattgccccatacgtaactctgaggcggggactgaatgccgagtcaagcaaagccacgtttcccagaccgaagagcgccctggagagactgtactccggagaccatcagcgaggaaagatgtctgccgaagaacaactggagcgcatgaaacggcatcagaaagcccttgtccgtgagaggaaacgcacacttggtcagggcgaacgcactgggttacccagcagtaggtatctgtcccggccactgccaggagatctcggaagcgtgtgctag

SEQ ID NO: 235157 - DNA, 816 bp, Artificial Sequence
  Description of Artificial Sequence: Synthetic coding sequence
atgcttcaggcgtgtaaaatggagggattcccgctcgtgcccccacagcctagcgaggatttagtcccctacgatacagatctataccagagacagacacatgagtactatccttacctttcgtctgatggcgaaagccatagcgaccattactgggacttccatccacatcacgttcactcggagtttgaatcatttgctgagaataacttcacagagcttcaaagcgttcagccaccacagctgcagcagctttataggcatatggagttagaacagatgcacgtgctggacacgcctatggtgcccccacacccctcactcggtcatcaggtctcatatttgccacggatgtgtctgcagtatcctagcctgagccctgcgcagccgtcatctgatgaagaggaaggtgagcgtcagagcccaccactggaagtgtccgacggggaagctgatgggctggagcccggtcctggcctgctgcctggtgaaaccggttctaagaagaagatccggctgtatcaatttctcttggacctgctacgaagtggcgacatgaaggactccatctggtgggtagataaggacaagggtacattccagttctcatcaaaacacaaggaggcattggctcatcggtggggaatccagaaaggaaacaggaagaaaatgacataccagaagatggctagggccctgagaaattatgggaaaacaggggaagtgaaaaaagtgaaaaaaaagctgacctaccagttcagcggggaggtgctcgggaggggcggactggcagagaggagacatccaccacattag

SEQ ID NO: 235158 - DNA, 732 bp, Artificial Sequence
  Description of Artificial Sequence: Synthetic coding sequence
atgagccctgccgctcccgtgcctcctgactctgccctggagagcccctttgaggagatggccctggttagggggggttggctctggaggcagtcttctattctccgcaggtggaagcgtaattggtttgcactgtggcttgacggcacactggggtattaccatgatgagactgcccaagatgaggaagaccgggtccttatccattttaatgtacgcgacataaaaattggaccagagtgccacgatgtgcagccccctgaggggagaagccgggatggtctgctaactgtgaatcttcgggaaggagggcgtctgcatctctgtgctgagacaaaggatgacgcactggcctggaagaccgccctgctggaggctaacagtacacctgcacccgctggcgctaccgtacctccaagatcgcgccgtgtctgttccaaagtccgctgcgtgaccaggtcatggtccccatgtaaggttgagcgcagaatttgggtccgtgtttattctccctatcaggattactacgaagttgttcctccgaacgctcacgaagcgacctatgtaagatcctactatggccctccatacgctggtcctggggtgactcacgtgatcgttagggaagatccttgctacagcgccggagctcctctcgccatggggatgctggccggagctgccacgggcgctgctctgggatctcttatgtggtccccttgctggttctag

SEQ ID NO: 235159 - DNA, 627 bp, Artificial Sequence
  Description of Artificial Sequence: Synthetic coding sequence
atgtcaccagctgcgccagtccctccggactctgcgctggaatcgcccttcgaagaaatggcgcttgtgagaggaggctggttgtggagacaaagctcaattctaaggcgttggaagcggaactggtttgctttgtggctcgacggtaccctcggctattatcacgacgagactgcccaggatgaggaagatagagttctgattcattttaacgtcagggatatcaaaattgggccagaatgccatgacgttcaacctcctgaaggcagatcgagagacggtctgctcacagttaatttaagagagggcggaagactacacttatgtgcagagaccaaggacgatgccctcgcctggaagactgcactgctggaggcaaactctaccccagtgcgagtttacagcccttatcaggattactacgaagtagtgccaccgaatgcccacgaagcaacctacgtgagaagctactatggacccccttatgcaggcccaggcgtaactcatgttatcgtccgcgaggatccctgctactctgccggagcgcctctggcgatggggatgttagccggtgcagctacaggcgctgcgttggggtctctgatgtggtcaccgtgctggttttag

SEQ ID NO: 235160 - DNA, 675 bp, Artificial Sequence
  Description of Artificial Sequence: Synthetic coding sequence
atggcgctggttcgaggtggctggctgtggagacaatccagcatcctgcgcaggtggaagcggaattggtttgctctctggctcgatggcaccctgggctactatcatgatgaaactgcacaggatgaggaggatcgggtcctgatccacttcaatgtgagggacattaagattggtccagaatgccatgacgtccaaccaccagaaggcaggtcacgtgacggccttcttaccgttaatctgcgcgaaggaggcagacttcacctttgtgccgaaaccaaagacgacgctcttgcgtggaagaccgctctgctagaggcaaattctactcccgctcccgcaggagcgaccgtgccaccacggagtcgtagagtatgctcgaaagtccggtgtgtgaccagatcctggtcaccctgcaaggtcgaaagaagaatatgggtacgggtttacagtccttatcaggattactacgaagtggtgccacccaacgcccatgaggcaacgtacgttaggagctattacggcccaccgtacgctggcccaggagtgactcacgttatcgtacgcgaagacccctgctactctgctggcgcaccgctggctatgggcatgttagcaggtgccgctacgggtgctgcgctcggaagcctcatgtggtccccgtgctggttttag

SEQ ID NO: 235161 - DNA, 570 bp, Artificial Sequence
  Description of Artificial Sequence: Synthetic coding sequence
atggctctggtccggggagggtggctctggcggcagtctagtatccttcgcaggtggaagcgcaattggtttgctctctggcttgatggcactttaggctactaccacgacgaaacggcccaggacgaggaagatcgggtcctgattcactttaacgtacgtgatattaagattgggccagaatgtcatgacgtacagcctcctgagggcaggagcagggacggtttactcaccgtaaaccttcgcgagggcggtaggctacacctctgtgcagagaccaaagatgacgcactggcatggaagacagccttgctcgaagctaattcaaccccagtcagggtgtactccccataccaggattactatgaggtggttcctcccaacgctcacgaagcgacctacgtacgttcttattacggccctccatatgctggccctggcgtgacacacgttattgtcagggaggacccctgctacagcgcaggagcccctctggctatgggcatgctggcgggagcagcgacaggcgctgccctgggcagcctgatgtggtccccttgctggttttag

SEQ ID NO: 235162 - DNA, 354 bp, Artificial Sequence
  Description of Artificial Sequence: Synthetic coding sequence
atggctctggtgcgtggcggttggctctggcggcagtcttcgatactacggcgatggaaacggaactggttcgcactctggttagatggtaccctcggttattaccatgacgagactgcccaggatgaggaggatagggtcctcatccactttaacgtgcgggacatcaaaattgggcctgaatgccatgacgtccagccccctgagggcagatcccgggacgggctcttaaccgttaacctgcgggagggcggacgccttcacctgtgtgctgaaaccaaagatgacgcactggcatggaagactgcactcctcgaggcaaacagcaccccggtgcgggtctactcgccctag

SEQ ID NO: 235163 - DNA, 492 bp, Artificial Sequence
  Description of Artificial Sequence: Synthetic coding sequence
atggctctcgtaagaggcggatggttgtggaggcagtcaagcatcctacggaggtggaaacgcaactggttcgccctgtggctggatggaacattgggctactatcacgacgaaaccgcacaagacgaagaagacagggtcctaattcactttaatgtcagagatatcaagattggtccagagtgccacgatgtacagccgcctgagggcaggagtagagatggtctgctcactgtgaacctacgcgaggggggacgacttcacctgtgcgcagaaacaaaggatgatgccctggcttggaagacagcgcttctcgaggccaattctacgcccgtgcgcgtgtattccccttatcaagactactacgaggttgtgccaccaaacgctcacgaagctacatatgtcaggagctactatggccctccatatgcgggacctggcgttacgcacgtaatcgtgcgtgaagacccttgctacagcgcgggagcgtag

SEQ ID NO: 235164 - DNA, 480 bp, Artificial Sequence
  Description of Artificial Sequence: Synthetic coding sequence
atggccctggtaagaggtgggtggctttggcgtcagagttcgatcctgagacgctggaaacgcaattggtttgctctatggttggacggaacgcttggttactaccacgatgagacagcccaggatgaggaagatagagtgcttatccattttaatgtccgtgatatcaagatcggaccggaatgtcatgacgtccagccgccagagggtaggtctagagatggtctcctgacagttaatctgcgcgaggggggtcgccttcatttgtgcgcagagaccaaggacgacgctttagcctggaaaacagctctgctcgaagcaaacagcacaccaatgatccgcctgaaactgattcacccccacaataagtatctcctgtcatgctattccgctggcgcaccactggcgatgggtatgctagccggagctgccacaggcgctgccctggggtcgctgatgtggtccccttgctggttctag

SEQ ID NO: 235165 - DNA, 483 bp, Artificial Sequence
  Description of Artificial Sequence: Synthetic coding sequence
atggcactagtccggggaggctggctctggcggcagtctagtatacttcgacgttggaaacgaaactggtttgctctttggctggatggcaccctgggctactatcatgacgaaactgcccaggacgaagaggatcgggtcctgatccactttaatgtgagagacatcaaaatcggcccagagtgtcacgatgtgcagccccctgaaggaaggagcagggatggcctcctcactgttaatctgagggaaggaggacgactccatctatgcgccgagactaaggacgacgccctagcctggaaaacagccctgctggaggctaactcaacgcctgccccagcgggagccacggtcccccctaggtccaggcgggtctgctctaaggtccgctgtgtcacccggagctggtctccctgcaaggtagagcgcagaatttgggttcgggtgtactcaccctaccaggactattacgaagtagtatag

SEQ ID NO: 235166 - DNA, 465 bp, Artificial Sequence
  Description of Artificial Sequence: Synthetic coding sequence
atggcactggtccgcggaggatggttgtggcgacagtcatctatccttagaaggtggaagagaaattggtttgctctctggctggatggcactcttggctactaccatgacgaaactgcccaggacgaagaagaccgagtgctcatccattttaatgttcgtgacatcaagattggcccagaatgccacgatgtgcagcctccagaaggcaggtcaagagacggattgctcacggtgaatctgcgcgagggagggcgactgcatctatgtgccgaaactaaggacgacgctttagcctggaagaccgccctcctggaagccaattcgacgccagtgcgcgtttactctccctaccaggactattacgaagtggtgcccccaaatgcacatgaagctacttacgtccgcagctattacggcccaccctatgccggaccgggagtgacccacgtaatcgtccgatag

SEQ ID NO: 235167 - DNA, 258 bp, Artificial Sequence
  Description of Artificial Sequence: Synthetic coding sequence
atggctttggtgagaggcggttggctctggaggcagtcctccatactgcgacgctggaagcgtaattggttcgccttatggttggacggcacattaggctactaccacgacgagactgcacaagacgaggaggacagggtactcatccatttcaatgtaagggatataaaaattggacccgagtgccacgacgtgcaaccccctgagggacggtctcgcgacgggcttttgacagtgaatctccgggagggtggttag

SEQ ID NO: 235168 - DNA, 3576 bp, Artificial Sequence
  Description of Artificial Sequence: Synthetic coding sequence
atggaacggcctctggaaaacggagacgaatctccagattcccagggtcatgccacggattggaggttcgctgtctgctccttccgtgacgcttgggaggaagaagagcctgctagccagatgcatgttaaggatccaggaccgcctcgaccaccagcgggtgccacacaagacgaggagctgcaaggcagccctttgtcacggaagttccaactaccaccagccgctgatgaatccggagacgctcagcgaggtaccgtggagtcaagctccgtccttagtgaaggacctggaccatccggcgtggaaagcctgttgtgtcccatgtcgagccacctgagtctggcccagggcgagtcagatacaccaggagtaggcttggtgggcgaccctggcccttctagggcaatgccatcgggattgtctcccggagccttggattcagatcccgtaggcctgggcgacccattaagcgaaatcagcaagctgctagaagcggctccctccggcagtggcctccccaagccagctgactgtttgttagcccaggacttgtgctgggagctcctggcttcaggtatggctaccctgcctggcaccagagatgtgcagggaagagctgtgctactcctgtgcgctcattcacctgcatggctgcagagcgagtgttccagccaggaacttatccggctgttgctctacctgcgctcaatccccagaccagaagtgcaggctttgggcctcactgttctcgtggatgctcggatttgcgcccctagctcaagcctcttctccggactctcccagcttcaggaagccgcacccggagctgtgtaccaggtgctgctggtaggaagcactttgttaaaagaggtcccgtcaggcctgcagttggaacagctacctagccagagcctgctgacgcatattccaacagctggtctaccaacctcactggggggagggttaccttactgtcaccaagcgtggctagacttccgtcggcgattagaggctctgctgcagaactgccaggccgcatgcgccctgctacagggggctatcgaatccgtgaaagccgttccccagcccatggagcctggggaggtgggacagctccttcagcagaccgaagttctcatgcaacaagtccttgatagtccatggctagcctggctgcagtgccaaggcggtcgcgaactcacctggcttaaacaagaggtgcctgaagtaacactaagccctgactacagaacggccatggataaggctgatgagctctatgacagagtggacggactgctccaccagcttaccctccagtccaatcaacgcatccaggccttagagctggttcagaccctggaagccagggagagcggactgcaccaaattgaagtttggctgcaacaggttggttggccagcactggaggaggctggggaacctagcctggacatgctgttgcaggctcagggatccttccaagagctctatcaagtggcacaggagcaggtacggcagggcgagaagttcctgcagcctctgaccgggtgggaagctgccgagctggatccacccggtgcccgattccttgctctccgtgcacagctcactgaattttcgcgggcactggcacaaaggtgccagagactggccgatgccgaacgactttttcagctgtttcgagaggctctgacttgggctgaggagggacagcgcgttctggctgagctcgagcaggaacgtcccggagtggtgttgcagcaactacaacttcactggacaaggcacccagacctgcctcccgctcacttccggaaaatgtgggcgcttgccaccggcctcgggtccgaggcaatccgccaggagtgtcgatgggcatgggcccgatgccaggacacatggttggcgttggaccagaagctcgaagccagccttaagcttcctcccgtaggctctacggcctctctttgcgtgtcacaggtgcccgctgccccagcgcaccctccactgcgcaaagcttactcctttgatcggaatctgggacaatcgcttagtgaaccagcctgtcattgtcaccatgctgctactatagcagcctgccggaggcctgaagcaggagggggagctctgccccaggcaagcccaactgtgcccccacccggttccagcgaccctcgcagccttaaccggctgcagctggtactagcagagatggtggcaacggaaagggaatacgtgagagctctcgaatacactatggagaattactttccagaactggaccggccagacgtgcctcagggcttgcgaggccaaagagcacacctattcggcaatctggagaaacttcgagactttcactgccacttctttctgcgggagctggaggcttgcaccagacatcctccgcgagtggcctatgcctttctaaggcacagagtgcaattcggcatgtatgcactttactccaaaaataagcctcggagcgacgccctgatgtctagctatggacatactttcttcaaagataagcagcaagctctcggcgaccacctggatctcgcatcataccttctgaaacccatccaacggatgggcaagtatgccctgctgctccaggaactcgctcgcgcatgtggtgggcctacacaggaactttccgcactgagggaagcccaaagtcttgttcactttcagctgagacatgggaatgacctgctcgccatggatgccatccagggttgtgacgttaacctaaaggagcagggacaacttgttcgtcaggatgagtttgtcgtccggacaggtaggcacaaatcagtcaggcggatcttcctgtttgaggagctgctgctgttctcgaaaccgaggcatgggcctacgggcgtggatacgttcgcctacaagagatcctttaaaatggcggacctgggcttaacggaatgttgcgggaatagcaatctgagatttgagatctggttccggaggagaaaggctagagatacatttgtgcttcaagcatcaagtctggctatcaagcaagcgtggaccgcggatatctcccatttactgtggaggcaggctgtgcacaataaggaggtccgtatggccgaaatggtatccatgggggtaggtaacaaggcctttcgggatattgcgccaagtgaggaggccatcaatgaccggaccgttaactacgtactgaagtgtcgagaagtgcgcagtcgcgcaagtatcgctgttgcccctttcgaccacgatagcctgtacctcggcgcatcgaactccctgcccggtgatccagcatcttgcagcgtcctaggatctctgaacctccacttgtacagggaccccgcactgttaggcttgagatgtccactgtacccatcctttccagaagaagcagccctagaggcagaggcagaattaggagggcagccatccttaacggctgaggacagcgagatctcctctcaatgtccttccgcatccggatcctcggggtcagattcatcatgtgtctcaggacaggcactggggaggggcctggaggatctgccgtgcgtctag

SEQ ID NO: 235169 - DNA, 3576 bp, Artificial Sequence
  Description of Artificial Sequence: Synthetic coding sequence
atggagcggccactagagaacggtgatgagtcacctgattcccaaggccatgccactgactggagattcgccgtgtgttcctttcgcgacgcttgggaggaagaggaaccagcctcacagatgcacgtcaaggatcccggacctcctcggcctcccgcaggagcaacccaagatgaggaactccagggaagccccctctcacggaaattccaactaccacccgctgccgacgagtctggtgacgctcagcggggaaccgtcgaatcgtctagcgttcttagtgaaggccctggtccctcaggagtcgagtccctgctctgtccaatgtcatctcacctgtcccttgcccagggcgagtctgatactccgggagtgggccttgtgggcgaccccggtccctctagggccatgccttcaggactgtctcctggcgcattggatagtgacccagtcggcctgggggaccccctgagcgaaatctccaagctgcttgaggcagcccctagcggatctggcctccccaagcctgccgattgccttctggcccaggacctctgttgggaattactcgcatctggcatggccactttgcccggtactcgggacgtgcagggacgtgcggttttgttgctctgtgctcattcaccagcatggctgcagagtgagtgttcctcacaggagcttattcggctgctcctgtacctgagaagcataccacggcctgaagtgcaggcccttggcctcactgttctggtagacgctagaatctgtgctccatcaagctcattgttcagcggcctgagtcagctccaggaagccgcacccggtgccgtgtaccaggtcctattagtgggaagtacccttctaaaggaggttcctagtggtcttcagctggagcaactgccttcccagtctctcctgacacacataccaacagccggattgcctacatctttgggcggaggtcttccatactgtcatcaggcatggctggacttccgcagaagactcgaggccctcctgcagaattgtcaggctgcttgcgctctgctgcagggggcaattgaatctgtgaaagctgttccccagcctatggagcctggtgaagtagggcagctcctgcagcaaaccgaagtcctgatgcagcaggtgctggatagcccctggttagcctggctgcagtgtcaagggggtagggagctgacgtggctgaaacaggaggtcccagaagtgacattatctccggattataggaccgccatggacaaggctgatgagctgtatgacagagtcgacggcctcctacatcagttaactctgcagtcgaatcagagaattcaggcgctggaattagttcaaactctggaagctagagagagcggattacaccaaattgaggtgtggctgcagcaggtgggttggccagcactcgaagaagcgggtgaaccgtcgctggatatgctcctgcaggctcagggatcattccaagagctctatcaggttgcccaagagcaggtacgccagggggaaaaatttcttcagccgttgacaggctgggaggccgcagaactcgaccctcctggcgcaagattcctggcactgcgggcacagctgacggagttttcccgagcgctcgctcaaaggtgccagagactggccgacgctgaacggctgttccaactttttcgggaggcactgacatgggcagaggagggccagagagttcttgcggaattggaacaggagcgccctggagtggtgctgcagcagttacagctgcattggacacgacatcctgatctaccacctgcccactttagaaaaatgtgggccttggcaacaggtctgggatctgaagccatccgtcaagaatgcaggtgggcgtgggctagatgtcaagacacttggcttgctttggaccaaaagcttgaggcaagccttaaacttcccccagttggttcgacagctagcctgtgcgtcagccaggtgcctgctgcacccgctcacccgcctctcaggaaggcctacagctttgatcgtaaccttggccagtcgctcagcgaacccgcttgccactgccaccacgccgcaacgatcgcagcttgccgcaggcctgaagcaggtggcggagctctgccacaagctagtcctacagtgcctccacctggctctagtgacccacgcagcctcaatcgcctacagttggtactagccgaaatggttgcgacagagcgtgaatatgttcgagcactggagtacactatggaaaactattttccagagctggatagacccgacgtgccacagggcctgaggggccaaagagcccacctgttcggaaatctcgagaaactgagggatttccactgccactttttcttacgcgagttagaggcttgtacaaggcacccacccagggttgcttacgctttcctgagacacagagtgcagttcggaatgtacgccttatactccaagaataaaccgaggtctgatgccctgatgtcctcctatggccacaccttcttcaaggataagcagcaagcgctgggagaccacttggatttggcctcgtacttgctgaagcctatacagagaatgggcaagtatgccctgttgctgcaggaactggccagggcctgtgggggacccactcaggagctgagtgctctgagagaagcccagtctttagtgcattttcagctaaggcacgggaacgatctgttagctatggacgctatccaggggtgtgatgttaatctgaaagaacaaggtcaactggtccgacaggatgaattcgttgtgcggacaggacgtcataaatcagtgcgacgtatcttccttttcgaagaacttttgcttttttcaaaaccaaggcacggcccaaccggtgtggacacttttgcatataagaggagtttcaagatggcagacttgggactcacagaatgttgcggcaattccaatcttcgctttgagatctggttccgcaggaggaaagctagagataccttcgttctgcaggcgtccagtctggctatcaaacaagcttggaccgccgacatcagccatttgctctggcgtcaggcagttcacaataaagaagtgagaatggctgagatggtttccatgggcgtggggaataaggccttcagagatatcgcgccttctgaagaagccatcaacgacaggacagtcaactacgttttgaaatgccgtgaggtgcggtctcgagcctccattgcagtcgctccgtttgatcatgacagtttgtatctgggcgcatctaatagcctgccaggcgatcctgcctcatgctctgtcctcgggtccctgaatctccacctgtatagagacccagccctgttaggtttgcggtgtccactgtatccgtccttcccagaagaggccgctctcgaggccgaagctgaacttggcggacaaccaagcctcacagccgaggactccgagatctctagccagtgtccctctgctagcgggtcctccggatccgattctagttgcgtgtccggccaggcactggggcgtggtctggaggatttgccatgtgtgtag

SEQ ID NO: 235170 - DNA, 582 bp, Artificial Sequence
  Description of Artificial Sequence: Synthetic coding sequence
atggaaagacccctcgaaaacggcgatgagtccccggactcccagggccacgcgaccgattggcgcttcgccgtctgtagcttccgtgatgcctgggaagaagaagagccagcttctcaaatgcacgtgaaagatccaggccctcctcgccctcccgcaggcgctactcaggacgaagagctgcaagggagccccttatcccgtaaattccagctcccacctgcggcagacgagtcgggtgacgctcagagagggacggtagagtccagcagcgtgctgtccgaaggcccaggccctagcggagtggaatccttactgtgcccgatgtcttcgcatctgtccctagcacagggagagagtgacacgcccggagtgggactggtgggtgaccccggtcccagccgtgccatgccatccggattgagcccaggtgcactggactccgaccccgtggggctaggggacccactttcagaaattagtaagctgctggaggcgggtaaagagggatgggccagggaagtctgggaagggaatggagatgcatggcgtgacgaatgccaggactttggagggctgtag

SEQ ID NO: 235171 - DNA, 3576 bp, Artificial Sequence
  Description of Artificial Sequence: Synthetic coding sequence
atggagcggcctctggaaaatggtgacgagagcccggacagtcagggccatgctaccgattggcggtttgccgtgtgttcattccgagacgcctgggaggaggaagagcctgcctcgcagatgcatgtgaaagaccctgggcctccaaggcctcccgcaggagcgacacaggatgaagagttgcagggcagccccttgtccagaaaattccagctccctcccgctgccgatgagagcggggatgcccagagaggcaccgtggaatcaagcagtgtccttagcgaggggcctggacccagtggcgtcgagagtctactctgtcccatgagtagtcacttgtccctggcccaaggcgagtcagacaccccaggagtgggtctggttggggaccccggtccgagtcgggctatgcccagtgggctgtcaccaggggcactcgatagcgatcctgttgggctcggtgatccgctgagtgaaatctctaaactgctcgaagcggcaccatccgggagtgggctgccaaagcccgcagactgtttacttgcgcaggacctttgctgggaactcctggcctctggcatggcaaccctgcctggcacccgcgatgttcaggggagagcagtgttactactctgcgctcatagtccagcctggctgcaatcggagtgtagtagccaggaactcattcggctgctgctttatttaaggtcaatcccaaggcctgaggtacaggccttaggactgacagtgctggttgacgccaggatttgcgccccatcctcttccctgttttccggattatcccagttgcaagaggctgcgcctggcgcagtctaccaagtcctgctcgttggctctacgcttctgaaggaagtgccctcgggccttcagctcgaacagttacccagccaaagcctcctgacccacattcccactgctggcttacccacttctttggggggaggcctcccatactgtcatcaagcttggttagattttcgtcgaagacttgaagccctgctgcagaactgccaagctgcatgcgccttgctccagggagccatagaaagcgtgaaagcagtgcctcagccaatggaaccgggtgaggtcgggcaacttctacagcagacggaggtactcatgcagcaagtgctcgattctccgtggttggcatggttgcagtgccaaggagggagagagcttacttggctcaaacaggaggttcccgaggtgacacttagcccggactacagaacagccatggataaggccgatgagctttacgatagggtggatggcctgctgcaccagctaactctgcagtctaaccagaggatacaggccctcgagttggtacagaccttggaagccagggaaagcggcctgcatcagatcgaggtgtggctgcagcaagtgggatggccagcactcgaagaggcaggagaaccttccttggacatgcttctgcaggcccagggctctttccaggagttataccaagttgctcaggagcaggtgcgccagggcgagaagttcctgcaaccattgactggatgggaggccgctgagctggacccacccggagccagattcctggctctcagagcccagctgacggagttctctcgagcccttgcacaaaggtgccaacgcctggcggacgctgagaggctctttcaactcttcagggaagcactgacctgggctgaggagggccagcgggtgctggcagagttagagcaagaaagaccaggggtggtactccagcagctgcagttgcactggacccggcaccctgatctgcccccagcgcacttcagaaagatgtgggcacttgctaccggcctggggagcgaggccatccggcaggagtgtcgatgggcatgggctcggtgtcaggatacttggctggccctcgatcagaagctggaagcgagcttgaaattgccccctgtgggcagcactgcatcattgtgtgtatcacaggtgccggcagccccagcccacccaccactgaggaaggcttatagttttgaccgcaatctgggtcaaagtctgtctgagcctgcctgccactgtcaccacgccgcaacaattgcagcctgcagacgccctgaagccggaggaggtgccctccctcaagccagcccgacggtcccaccgccaggatcttccgatcctagatcacttaaccgcttgcagcttgtgcttgcagagatggttgccacagaaagggaatatgtgcgagccctggaatataccatggagaactattttcctgaattagataggccagatgtccctcaaggcctgagaggacagcgggctcacctgttcggcaatttagagaagctccgcgactttcactgccactttttcctgcgagagctcgaggcctgcaccagacacccgcctcgggttgcttacgctttcctgcgacatcgtgtccagttcggtatgtatgccctgtacagcaaaaacaagccacgctctgatgctttgatgtcgtcctatggccataccttcttcaaggacaagcagcaggcacttggcgatcacctcgatctggctagctacttgctcaaacccatccagcgcatgggcaaatatgcattacttctgcaggaactcgcacgtgcttgcggagggccaactcaggaactctccgctcttcgggaagcccaaagtcttgtgcactttcagcttcgacacggaaatgatctgctggcgatggatgctatacagggatgcgatgtcaacctgaaagagcaggggcagctggtgagacaggatgaattcgttgttcgcactggaagacataagtcagtgagaagaatcttcctttttgaagagttgttgctcttctctaagcccagacacggccctacaggggtggacaccttcgcctacaagcgaagcttcaagatggctgacttggggttgaccgagtgctgtgggaacagcaatctcaggtttgaaatctggtttcggagacgcaaagcgagggatacctttgtgctgcaggcttcaagcctggcaatcaagcaagcatggaccgcagatatctcacacctactgtggagacaggctgtgcataataaggaggtcagaatggccgagatggtgagcatgggggtcggtaacaaggcgtttcgcgacattgcccctagcgaggaagccatcaatgaccgcactgtcaactatgtgctgaagtgccgcgaagtgagaagccgcgcatccattgccgtggccccattcgatcatgactctctgtatctgggagcgtctaattccctccctggcgacccagcctcctgtagcgtcctgggctcccttaatcttcacttgtaccgggacccagcccttctggggctgcgctgtccactctacccgtctttcccagaagaagccgcactggaagccgaggccgagctggggggtcagccgagccttacagctgaggattccgagatttcgtcacagtgtccctctgccagcggcagttctggatcggattcctcctgtgtcagcggccaagccctggggagaggtcttgaagatcttccctgtgtgtag

SEQ ID NO: 235172 - DNA, 3333 bp, Artificial Sequence
  Description of Artificial Sequence: Synthetic coding sequence
atggagcggcctctggagaatggggatgaatccccagatagccagggtcatgctaccgactggcgattcgcagtgtgctccttccgtgacgcatgggaggaagaggagccggcatcccagatgcacgtgaaggaccctggtcctccgaggccgcctgccggagcaacccaggatgaggaacttcagggcagccctttatcacgcaaattccagctgcctccggcagcagatgagtcgggggacgcacagcgcggtactgtggaatcatccagcgtgctcagtgaggggcctggcccttcaggcgtggagtcactgctgtgtcctatgagtagtcacctcagtttggcacaaggcactcgggacgtccaaggacgggctgtactgctgctctgcgctcatagccctgcttggctgcagtcagagtgttcctctcaagaactgattcgtctgctcctgtacctgcgcagtatacctaggccagaggtgcaggcgctgggtctgactgtgctggtcgatgcaaggatttgcgctccatcctcctctctgtttagcgggctgtcccaattgcaagaggccgcacccggagcagtttaccaggtgttactcgtgggcagtacactgctcaaggaggtgcccagtggattacagttagaacagctgccctcacaatctctgttgacgcatattcccaccgcaggacttcctacaagcctgggaggaggactcccctattgtcatcaggcctggctcgacttccggaggaggctagaagcgttgctgcagaactgccaggcagcctgcgccctactccagggcgcaatcgaatcagtaaaggccgtgcctcaaccaatggagcccggtgaggtgggccagttgctgcaacagacagaggttctaatgcaacaagtcctcgacagcccttggctcgcctggttacaatgccaggggggaagagagctcacttggctgaaacaggaggttccggaggtgaccctttccccggactacagaaccgctatggataaagccgacgagctctatgatcgcgtggacgggttgctccaccagctgaccctgcagagcaaccaaagaattcaggctttggagcttgtgcaaactctggaagcacgggagtctggcctgcatcagatcgaggtgtggctccagcaagtcggatggccggctttggaggaggccggtgagccaagcctagacatgctgctgcaggcacagggaagttttcaggaactgtaccaggtggcacaggagcaggtaaggcagggcgaaaagttcctccagccgctgaccggttgggaggctgcagagctggacccccctggcgctcggttcctggctttgagggcgcagttaacagagtttagtcgagccctcgcacagaggtgccagagactggcagatgccgagagactattccaactgtttagggaggcgctgacttgggctgaggaaggccagagggtcctggcagagctcgagcaagagcgaccaggggttgtcctccagcagctgcagttacactggacccgccatcccgacctgcctccggcacactttcgcaagatgtgggctttggccacagggctcggtagcgaagccattcggcaggaatgccgctgggcttgggccaggtgtcaggatacctggcttgctcttgaccagaagctcgaagcttccctgaaactgcctccggttggtagcaccgctagcttatgtgtcagccaggtccccgctgctccagcgcacccaccactgcgcaaagcgtactccttcgaccggaatttgggacagagcctgagtgagcccgcatgtcactgccatcacgctgcgaccatagcagcctgtcgacggccagaagcgggtggaggcgctctgccacaggctagccctaccgtgcctccacccggttcatccgaccctagatcactgaatcgcctgcagttggtactcgcagagatggttgccactgaaagagaatacgtgagggccctagagtacaccatggaaaattatttccccgagctagatcgccctgacgttccccaagggctccgcggacagcgggctcacctctttggcaatctggagaaattgagagactttcactgccatttctttctgcgggagctggaggcctgtacaaggcaccctccacgcgtggcctatgctttcttacggcacagggtccagttcggcatgtatgcactatactcaaaaaataagcctaggtctgatgcattaatgagtagctacggccatacattctttaaggataaacagcaggcgctcggtgatcacctcgatctggcctcctacctgctcaagcccattcagaggatgggcaaatatgcacttctgctccaggagcttgctcgtgcctgcggcggaccgacacaggaactgtccgcgttgagagaagctcagtccctcgttcactttcagctgcgtcatggcaacgacctgctggctatggatgcaattcagggctgtgacgtaaatttgaaggaacagggacagctcgtacgccaggatgaatttgtcgtgcggacggggaggcataagagcgtgagacgtatctttttgtttgaagagctgctcctgtttagtaagccccgtcacggccctacgggggtggatacctttgcttataaaaggtcattcaagatggctgacctcggcttgaccgagtgttgcggaaactccaatctgcgctttgagatatggttcagaaggaggaaagccagggataccttcgtcctgcaggccagttctcttgccataaagcaagcatggaccgctgatatcagccaccttctctggcggcaggccgtgcacaacaaggaggtccggatggccgagatggtctcaatgggggtcggaaacaaggcattccgagatatcgccccatcagaggaggccataaacgaccggaccgtgaattatgttctgaaatgtcgcgaagtgcgaagcagagcttctatcgcggtggctccttttgaccatgattcactttatctgggagcttccaattctctcccaggagatcccgctagttgtagtgtcctcggatccctgaatttacatctctatcgcgacccggctctcctgggactacggtgtccgttatatccatctttccctgaagaagctgctttggaggccgaagcagagctcgggggacagccctcactaaccgccgaggactccgaaatatcctcccagtgtcccagcgctagcggctcttccgggtcagatagctcctgtgtgagcggacaggcacttggccgaggtctggaagatctgccctgcgtgtag

SEQ ID NO: 235173 - DNA, 3021 bp, Artificial Sequence
  Description of Artificial Sequence: Synthetic coding sequence
atgcactatgacggccacgtgcgtttcgacctcccacctcaggggtccgtgctcgccagaaacgtgtctactcgcagctgtccaccacggacatccccggctgtcgacttagaggaggaagaagaggaatcctccgtcgatggtaaaggtgatcgaaagtccactgggctgaaattgagtaaaaaaaaagcaaggaggcgccataccgatgatccctcaaaggagtgcttcactcttaagtttgatctaaacgtcgatattgagacagaaattgtccccgctatgaagaaaaagtctctgggcgaagtgctgctgccagtgttcgagcgcaaaggcattgcactcggtaaagtagacatctacctagatcagtccaacacaccactttctttgacgttcgaagcatatcgcttcggaggtcattatctaagggtaaaggcccctgcaaagcccggagacgaagggaaagtcgagcagggcatgaaggattcaaagtctttaagcctgcccatcctacgtccagccggtaccggcccaccagcgctcgagcgcgtcgacgcccaatcccgccgtgagtctttagacatcctcgctcccggtagaaggcgtaaaaacatgagcgagtttttgggggaggctagcattcctggacaggagcccccaactccaagctcttgttctctcccctccggttctagcgggagcactaacacaggcgattcttggaagaaccgcgcagcctcacgcttcagcgggtttttttcatcggggccatccactagcgcatttggccgtgaagtcgacaaaatggagcagctggagggcaaactgcacacctacagcttgttcgggcttcccagactgcccagagggctgaggttcgaccacgattcatgggaggaggaatacgacgaggatgaagatgaagataatgcatgtctgcggttagaagactcatggcgggagctgattgacggccatgagaagttgactcggaggcagtgccaccaacaagaagccgtgtgggagctccttcacacagaggcaagttacatccggaaactgcgagtgattattaacctgtttttgtgttgtctcctcaatctgcaggaatccggcctcctctgcgaggtagaggccgaacgcctgtttagtaacatcccagagatagcgcaactgcatcgtcgcctatgggcatccgtgatggcacccgtcttggagaaggcacggcgaacccgcgctttgctgcagcctggggatttcttgaagggcttcaagatgttcgggtctctgttcaaaccctacattaggtactgtatggaagaagaggggtgcatggaatacatgcggggtctgttacgcgacaatgatctttttcgggcatacatcacctgggccgagaagcatccccagtgtcagcggctgaagctctctgacatgctggccaagcctcaccagcggctgactaagtatcctctgctccttaaaagcgtgctgcgcaagactgaggagcccagagctaaggaggctgtggtcgccatgatcgggtccgtggaacggtttattcaccacgtgaacgcttgtatgcgacagcgccaggaacgacagcgcctggctgctgtggtgtctaggatcgatgcttatgaggtggttgaaagctcaagcgacgaggttgacaaattgctgaaggagttcctgcatctcgacttgacggcccctatcccaggtgcctctccggaggaaactcggcagctcctgctagaaggcagtttgcggatgaaggaggggaaagactccaaaatggatgtctattgctttctgttcaccgatctcctcttggtcacaaaggctgtgaaaaaggcagagcgtacccgcgtcattaggccacccttgcttgtggataaaattgtgtgcagagaactgagagatcctggctcatttcttctgatatacttgaatgaattccacagtgccgtgggagcctacacgtttcaggcctccggtcaggctctgtgccgcggttgggtggacaccatctacaacgctcagaaccagctgcagcagctcagagcccaggaacccccagggtcccagcaaccattgcaaagcctggaggaggaagaggacgagcaggaggaggaagaagaagaggaggaagaggaggaggaaggagaggattctggcacctcagctgcttcgtcccccacaatcatgaggaagtccagcggctctccggattcccaacactgtgcttcagacgggtcgacagaaacgcttgcaatggtcgtggtggagccaggtgataccctatctagccccgaatttgactctggccctttctcatcgcagagtgacgagacaagccttagcacgacagccagctccgcaactcctacgtcagagttgcttcctttgggccctgtcgacggaagatcctgttctatggatagcgcatacggcacattgagccctacatcgctacaggatttcgtcgcaccaggacccatggccgagctggttccacgcgcacccgaaagtccacgtgtgccctccccaccaccaagcccaaggctccggaggcggactcctgtacagctcctttcttgtcctccccaccttttgaaatctaagtccgaagctagtctgttacagcttcttgctggcgctgggacccacggcaccccaagcgctccatcacggtctctctctgaattatgcctggctgttcccgctccaggaatcaggactcaggggtctccccaagaagccggaccatcttgggactgtagaggcgcaccctctcctgggtccggccctggcttagtcgggtgtcttgctggtgagcctgccggaagccatcgcaagagatgcggcgacttaccctcaggcgcatctccgagagttcagcccgaacccccacctggagtttcagcacagcaccggaaactaacccttgcccagctctaccgcattagaaccacattgctcctcaactctaccctgaccgcatccgaagtctag

SEQ ID NO: 235174 - DNA, 2793 bp, Artificial Sequence
  Description of Artificial Sequence: Synthetic coding sequence
atgcattacgatggccatgttcgctttgatttgccacctcagggctccgtactggctaggaacgtgtcaactcgaagctgtccccctaggacctctcccgcagttgacctggaagaagaagaggaagaatcctccgtggatggaaagggcgacagaaagtcaacgggcctgaagcttagtaaaaaaaaggcacggaggaggcacaccgacgatccgtccaaggagtgtttcaccttgaagtttgatcttaacgtggacatcgaaactgagattgtaccggctatgaaaaaaaagtctctcggggaagtgctgcttcccgtcttcgagcgtaaaggcatcgccctgggtaaggtggacatctaccttgaccagtctaataccccactcagcctgacgttcgaggcttacagatttggaggacattacttgcgagtgaaagcacccgcaaagcctggcgacgaggggaaagttgagcaaggaatgaaggattctaagtctctgtccttgccaatactcagacccgctggaactggacccccagcacttgagagggtcgacgcccagtcacggagggagtcactcgatattttagccccaggcagacggagaaagaatatgtcagagtttctcggggaggcctctattcctggccaagaacccccaacgcccagctcttgcagtctccctagtgggagttcaggctcaacaaacacaggtgacagttggaaaaatcgggcagcatcgaggttcagcggctttttcagcagcggccctagcacaagcgccttcggaagagaagtggacaagatggaacaactggaaggcaagctgcatacttatagtctctttgggctccctagactgccacggggtctgcggttcgaccacgatagttgggaggaggagtatgatgaagatgaggacgaagataatgcctgccttcgtctggaggactcctggagggaattgatcgacggacacgagaaactcacgaggagacagtgccatcagcaggaggcagtctgggagctcttgcacacggaggcttcttatatacgtaagctcagagtgataatcaacttattcctgtgttgtctgctcaatttacaggaatcaggtcttctgtgcgaagtagaggcggaacgactgttttctaatatccctgagattgcccagctccatcgccgactgtgggcctctgtgatggcacccgtcttggagaaggctagaaggacgcgcgctcttctccaaccaggagactttttgaaaggctttaagatgtttggaagcctgttcaagccatacattcgctactgtatggaagaagaggggtgtatggaatatatgcgcggacttctgagggataacgacctgttccgagcgtatattacttgggcggagaaacacccccagtgccaacgcctgaagttgtccgatatgctggctaaaccacaccagcggctgacgaaatatcctctgctgttaaagtccgtgctgaggaaaacagaggaacctcgggctaaagaagccgtcgtcgcaatgattggcagcgtagaacggttcattcaccatgtgaatgcctgtatgcgtcagcgccaggagaggcagagacttgccgctgtggtctctcggattgacgcatacgaggtcgttgaaagcagctcagatgaagtggacaaactgctgaaagagtttctccacttggatctgaccgccccaataccgggagcttcaccagaggaaacacgccagcttctgcttgagggttccctacggatgaaggagggtaaggattcaaagatggatgtctactgcttcttatttaccgatctgctccttgtgacaaaggccgtgaaaaaggctgaacgaacccgcgttatccggccaccattgttagtggacaaaatagtctgccgggagcttcgagacccaggttcattcttattaatttacctcaatgaattccattcagctgtgggggcttacacttttcaagccagcggacaagctctctgtcgagggtgggtggacaccatatataacgcacagaaccagttgcaacagctgagagcacaggagcctccagggtcccaacagcctctccagagcctggaagaggaggaagatgagcaagaggaggaggaagaagaggaagaggaagaagaggagggagaggactctggaaccagtgcagcatcttccccaactatcatgcgcaaatccagcggctccccggatagccagcactgcgcaagcgacggttccacagaaactctcgcaatggtggtggtcgaaccaggtgacacccttagctctcccgagtttgatagcggcccttttagcagccagtctgacgaaacatccctctccacgacagcaagctcagcaacacctacatccgaacttctacctctggggcctgtcgacgggaggtcatgttccatggatagtgcctatggaactctgtcccctacctccctgcaagacttcgtagcccctgggcctatggccgagttggtgccgagggcacccgaatctcctagggtgccgtccccgccaccaagccccagactacgcaggcgaacaccagtccagttgctgagctgtccccctcacctgctgaagtcaaaatctgaggccagccttctgcagctgcttgccggagccggtacgcacgggactccatccgcacctagtcgctccctgtccgaattatgtctggctgtcccagccccagcgcaggaagccgaccctggcccagcattgccaaatcaggaccacccagcagcatag

SEQ ID NO: 235175 - DNA, 3021 bp, Artificial Sequence
  Description of Artificial Sequence: Synthetic coding sequence
atgcactatgacggacatgtacgcttcgaccttccccctcaaggatcagtgctcgctcgaaacgtgtccacaagatcatgtcccccacggacctccccagccgtggatctggaggaggaggaagaggagagttccgtggatgggaagggggatcgcaagtccaccggcttgaagctctccaagaaaaaggcacgccgaaggcataccgacgatcccagcaaagaatgcttcacactaaagttcgacctgaatgttgatatcgaaaccgaaatcgtacccgctatgaagaaaaagtctttaggggaggttctgctgccggtgtttgaacgaaaaggaatcgcactggggaaggtggacatctatctcgaccagtccaatacgcctctctccctcactttcgaggcttaccgcttcggcggtcactacctcagagtcaaggcgcctgctaaacccggagacgaggggaaggtggaacaagggatgaaggacagcaagtcattaagcctaccaatactgcgcccagctgggaccggccctcctgccctggagagagtggacgctcaaagtcggagggagtcccttgatatacttgctcctgggagaagacgcaagaacatgtcggagtttcttggcgaagcctctattcctggtcaggagccccctaccccatccagctgcagcttgccgtcaggcagttcaggaagcactaacaccggggattcttggaagaatcgtgcagccagtcggtttagcggatttttcagttccggaccttccaccagtgctttcggacgcgaggtggataaaatggagcagttggagggtaaactccacacgtacagcctcttcgggctcccaaggctccctcggggtttgagattcgaccacgattcttgggaagaggagtacgatgaggacgaagacgaggacaatgcctgcttgaggctggaggatagctggcgcgagctaatagacgggcatgagaagctgaccaggaggcagtgccatcaacaagaagcagtatgggagctgttgcacacagaggcatcatatatcaggaagctgagagtcataataaatttgtttctgtgctgcctactcaatttgcaggagtccggtcttctctgcgaagttgaggcagaacgcctcttctccaacataccggagatcgctcagctacataggcggctgtgggcctccgtcatggctccagtgttagaaaaagcgcgtcggaccagagcactgctccaaccaggtgacttccttaaagggtttaaaatgttcggctccctctttaaaccttatattcggtactgtatggaggaagaaggatgtatggagtatatgagaggcctgctgcgggataacgatctgttccgggcttatattacttgggcagagaagcatcctcagtgccagagattgaaactgagtgacatgctggctaagcctcatcagaggctgaccaaatatcctttgctgctaaaaagcgtgctgcggaagacagaagagcccagggccaaagaggcagtagtggcaatgatcggcagtgtagaacgctttatccaccacgttaatgcatgcatgcggcagaggcaggagaggcagaggctggctgctgtagtttctcgaatcgacgcttatgaggtagtcgaatcttcatcggatgaggtggataagttgctgaaggaatttttgcatctagatctaactgctccaatccccggtgcttctcccgaggaaacccggcaattgctgcttgaaggaagtctgagaatgaaagaagggaaagactctaaaatggacgtgtattgctttctgttcaccgacttgctgcttgtgaccaaagccgtgaaaaaagcggaaaggacaagagtcatccgccctccccttttggtggataagatagtttgccgcgagcttcgcgaccccggaagctttctgttgatctatctgaatgaatttcatagtgcagtgggcgcatacactttccaggcaagcgggcaggctctttgcaggggctgggttgatacgatctacaatgctcaaaatcaattgcagcaattaagggctcaggaaccacctggaagccaacagccattgcagtcgctagaagaggaggaggatgagcaagaggaagaggaagaagaggaggaagaagaggaggagggcgaagatagtggaaccagtgctgcatctagccctactattatgaggaagagcagcggaagccctgactctcagcactgcgcaagcgacggatcaaccgagactctcgcaatggtggtcgttgagccaggtgacaccctctctagcccagagttcgattcaggacctttttcatcccagtctgacgaaaccagtctctccacaacagcctctagcgcaacccccacttctgagctgctcccactggggcctgtggacggcagaagctgctcaatggatagcgcctacggaaccttgagtcctacaagcttacaggatttcgtcgcaccgggacccatggctgaactggtaccacgcgcacccgaatcaccccgagttcctagccccccaccgagtcctaggctgaggcgcaggacccccgtgcagctcctcagctgtccaccacatttactaaagtcgaagtcagaggcctccctcctgcagttacttgccggtgcgggaacccacggaacaccttcagctccttcccggtcactgtcagaattgtgtcttgcggtgccggctcctggaatacgtactcagggctctcctcaagaggccggtccctcctgggactgtcggggtgccccttctcctggaagtggccctggcctcgttgggtgtctagccggagagccagccggaagccatagaaagcgctgcggagacctgccttcaggtgcaagtccaagagttcaaccggagcctccacctggtgttagcgcccagcatagaaaactgacccttgcccagctgtacagaatccgtacaaccttgttgctcaatagcacgctcaccgcgtctgaggtgtag

SEQ ID NO: 235176 - DNA, 3132 bp, Artificial Sequence
  Description of Artificial Sequence: Synthetic coding sequence
atggataaggggagggccgctaaggtgtgccaccatgcagactgccagcaactccaccgtcggggacctctgaacctttgtgaggcctgcgactccaagtttcacagtaccatgcattatgacgggcacgtgaggtttgatctgccccctcagggcagcgtgctcgcacgcaacgtgtcaaccagatcttgccctccccgaacctcacccgcagtcgacttggaagaagaggaggaggagtccagcgttgatgggaagggcgaccgcaagtcgacaggccttaaattgagcaagaagaaggctcggcgtcggcatacggatgatccaagtaaggagtgttttactcttaaatttgacctgaatgtcgatattgaaacggagattgtgcccgctatgaagaaaaaatctctgggcgaggtgctcctgcccgtgtttgagcgcaaagggattgccctgggcaaggtggatatctacttagatcagagcaatacgcccctgtccctgacttttgaagcctaccgattcggtggccattatcttcgggttaaggccccagctaagcccggagatgaaggcaaggtggaacaggggatgaaggattccaagtccttgtcactgccgatcctgcgcccagccggtacagggccacccgcattggagagagtagatgcgcagtctagacgggaaagcttagacatactagctcctggtcgcaggcggaaaaatatgtccgaattcctgggcgaggcctcaatacctggccaggaacctccgacgccctcctcatgtagtctgccatcgggaagctcgggatccacgaataccggcgactcatggaagaatagagctgcctcccgtttctcaggattcttttctagcggaccttcaacttctgccttcggacgagaggtggataaaatggaacaactggagggaaaactgcatacctattcactgttcggccttcctcggctgccgaggggactgcggtttgatcatgactcatgggaggaggagtatgatgaagatgaggacgaagacaatgcttgtctccggctggaggactcctggagagaactgatcgacgggcacgagaagcttacccgcagacaatgccatcagcaggaggcggtttgggagctgctgcataccgaggcctcatatatcagaaaactgcgagtgatcatcaacctctttctctgttgccttctgaatcttcaagaatccgggctcctctgcgaggttgaagccgagaggttattctccaacataccagagattgctcagctgcacagaaggctgtgggcctccgtgatggcccctgtactggagaaagcccgaagaacacgggcactgctccagccaggcgactttctgaaaggttttaaaatgtttggctctctgtttaaaccctacatccggtattgtatggaggaagaaggctgcatggagtacatgaggggcttgctgcgagacaacgatttgtttcgcgcttacatcacctgggcagaaaagcacccccagtgccaaagactaaaattaagcgacatgctcgctaagccccatcagagactcactaaataccccctgttgcttaaaagcgtgctgcggaagacagaagagcctcgagcaaaggaagcagtcgttgccatgatcggcagcgtggagagatttatccatcatgtcaacgcctgtatgaggcagagacaagaaagacagcgcctcgcagctgtggtgtctaggattgatgcttatgaggtggtagaaagttcctctgacgaggtggacaagctgctcaaggaattcctgcatttggatttaaccgctccaatcccaggggctagtcctgaagagactcgacaactgcttctggaggggagcctgcgcatgaaggagggcaaggactcgaaaatggacgtttactgttttcttttcaccgatctgcttcttgtgacaaaggccgtgaagaaagcagagagaacccgcgtgattcggcctccactattggttgataaaatagtatgtcgcgaactccgggatccgggttcttttctactgatctatctgaacgaattccactctgcggtgggagcgtatacctttcaggcttctggccaagctctgtgcaggggatgggtcgatacaatctataatgctcagaaccagctccagcagttaagagcccaggagcccccaggaagccagcagcccctgcagagtctggaggaagaagaagacgagcaggaggaggaggaggaagaagaagaggaggaggaggaaggcgaagattctggcacttctgcggcttcaagccctacaatcatgcgaaaatctagcggcagtcctgattcccagcactgtgcttccgatggcagtactgaaacattggctatggtggttgtggagccgggagacacactgtcttccccggaatttgatagcgggccattctctagtcaatctgatgagacatctttatcaactacggcttcaagtgctacacccaccagcgagttattgcccctgggcccagttgatggccgttcctgctcaatggattccgcctatggcactttgagccctacatccctccaggactttgtagcgcctgggcctatggccgagctggtccctagggcccctgagtccccgagagtgccaagtccacctccttcgccaagacttcggaggagaacacctgtccagctgctgtcatgtccaccgcatcttttgaagagtaaatccgaagcctcgctgttgcagctgctagccggagctggaactcacggtactccttcagcgccaagtaggtccttgtccgaactgtgtctggcagttcccgctccagggattcgaacacaaggctccccccaggaagctgggcctagctgggactgccggggagcaccgagtcccggttctggccctgggcttgtgggttgtctggccggagagcctgctggaagccataggaaacgttgtggggatctgccctccggagcgtctccgagggtccagcccgagcccccaccaggagtctcagcacagcaccggaaactcaccctcgcgcagctctacaggattagaacgactttgctgctgaactcaacccttacagcctcagaagtttag

SEQ ID NO: 235177 - DNA, 3021 bp, Artificial Sequence
  Description of Artificial Sequence: Synthetic coding sequence
atgcactacgacggacatgttagatttgacctccctccgcaaggttctgtgctagctagaaacgtgtctacaaggagctgtccacccagaacaagtccagcggttgacctggaggaggaggaggaagaaagctcagtggacgggaagggagatcgcaagtctaccggcctgaagttatccaaaaagaaagccaggagaagacacacagacgacccatcaaaggagtgttttacacttaagtttgacctcaatgtggacatagaaacggagatcgttcctgcaatgaagaagaaatctctgggggaagttttgctgcccgtcttcgaacggaaaggcatcgcgctgggcaaggtggatatctatctcgatcagagtaatacacccctcagtctgactttcgaggcttatcgcttcgggggacactatttgcgcgttaaagctccggctaaaccaggtgatgaaggtaaagtggagcaagggatgaaagacagtaaaagcctctccttgcctatcctccggccagcgggtaccggccctccggcattagaacgcgtcgacgctcagtctagaagagaaagtctcgacattctggccccaggacggcgaagaaagaacatgtccgagtttctaggagaagcatctattcctggccaggaacctccaactccgagctcctgctccttacctagcgggagctcaggttcgaccaatactggggacagctggaaaaatcgcgcagcatcaagattcagcgggttcttcagttcaggaccttcaacttcagcgtttggccgtgaagttgacaaaatggaacagctggagggtaagctgcacacgtacagcctatttggcctgcctagactccccaggggcctcagattcgaccacgacagctgggaggaagaatatgacgaggacgaggacgaggataacgcctgcctcaggctggaggactcctggagagaactgatcgatggacacgaaaagctgactaggcggcagtgtcaccagcaggaagcggtctgggagcttctacatacagaagcaagctatatcagaaaactgcgcgtcattatcaacttgtttctctgttgtctgctgaacctgcaggagtctggtctactctgcgaggtggaggctgagcgcctatttagcaatatccccgaaattgcacagctgcaccgccgactgtgggcgtcagtgatggcacctgtgctggaaaaagcgcgacgcactagagccctgctacagcccggtgacttcctgaaaggattcaaaatgttcgggtctcttttcaagccatacatcaggtactgtatggaagaagaaggctgtatggaatatatgcgaggtctgttgcgcgataatgacctcttcagggcctacatcacatgggcagaaaagcacccacagtgtcaacggctgaagttatcagacatgctcgctaagccgcaccagcgactcaccaaatacccattgctccttaagtcagtcctgagaaagacagaagagccacgagcaaaggaggccgtggtcgccatgatcgggtcggttgaacgctttatacatcatgtgaacgcctgcatgagacagcgccaagaaaggcagaggctcgctgcagtggtttctcggatagatgcttacgaggtcgtcgaatctagctccgacgaggtggacaagctcctaaaggaatttcttcacttagatttgacagctcccatccctggtgcaagtcccgaagagacccgacagttgctgctcgaaggctccctcaggatgaaggagggcaaagactcaaagatggatgtttactgcttcttatttacggatctcctgttagtgactaaagctgtcaagaaagctgaacgaactcgggtgatccgccctccactcctcgtagacaaaatagtgtgccgggaactaagggacccgggatcctttctgctaatatacctcaacgagtttcactccgctgtgggggcttataccttccaagcttccggccaggctctttgcaggggatgggtggatacaatctacaatgcacaaaaccagctccagcagttacgggctcaggagccaccagggtcccagcaacccctgcagagcctggaagaggaggaagacgaacaggaagaggaagaggaggaggaagaagaggaagaggagggcgaggacagcggtacctccgcagcgtcttccccaacaataatgaggaaatcgagtggaagtcccgacagtcagcattgcgcttctgacggatctacagaaaccttggcaatggtggtggtagaaccaggcgatactctgtcctctccagaattcgactcaggcccattcagttctcagtccgatgagacctcgcttagcacaacggcttccagtgcaacacctaccagcgaacttctgccactgggcccagtggatggtcgctcttgcagcatggattctgcttacggcaccctctctcccaccagcctccaggactttgtcgcgcctggacctatggctgaactggtgcccagggccccagagagcccccgtgtccctagcccgcctccttctccgaggctacggagaagaacccccgtacagctgctgtcttgcccaccacatctgctgaaatcaaaaagtgaggcgtcactcttgcaactgctagccggagccggtacccacggaaccccctccgcaccgagccggagtctgagcgagctgtgcttagccgtgcccgcaccagggattcggacccaagggtcgccacaggaagcgggtccttcatgggactgcagaggggctccatctccagggtccgggcctggactggtcgggtgtctggcaggggagcccgctgggtcgcatagaaagcgttgcggcgatctgcccagtggcgcaagcccacgagtacaacccgagcctcctccaggcgtctcggcgcaacaccggaagcttaccctggctcagctctaccggatacgcacaacacttctgttgaacagcacactgactgcaagcgaagtttag

SEQ ID NO: 235178 - DNA, 2559 bp, Artificial Sequence
  Description of Artificial Sequence: Synthetic coding sequence
atgaattctgtgctcacaaaacatgggtctccaccgaggagctggctcagtttatgctcaggcaccgatgaccagtccccagctgagaagaaagggttgcgctgccagaatcccgcatgtatggataagggcagagctgccaaagtgtgtcaccacgctgactgccagcagttgcataggcgaggcccactgaacctctgtgaggcctgcgactccaaatttcatagcacgatgcactatgatggccacgtgagattcgatctgcctcctcagggctctgttctggctcgcaatgtgagtacacgtagttgccctcctcgcacatccccagccgtggatctggaggaggaagaagaagaaagcagtgtggacggcaagggcgataggaagtcaacaggtttgaaattgtctaagaagaaagccagacggaggcacactgatgatccaagcaaagaatgcttcacactgaaattcgacctgaacgtggacattgaaacagaaattgtgccggcaatgaaaaagaagtccctaggtgaagttctactgccagtgtttgaacgtaaaggtattgcactgggaaaggtggatatctacctggaccagtccaatacgcccctttctctgacctttgaggcttaccggtttggcggacactatctccgagtcaaagcgcctgcaaagcccggagatgaagggaaagtggagcagggcatgaaagattcaaaatctcttagcctgcccattttgcgacccgctggtacaggccctccggcactcgagcgggtggatgctcagagccgcagagaaagcctcgacattctggcccctgggaggcgtcggaagaatatgtcagagttcctgggggaggccagcatccccggacaggagcctcctaccccatccagctgctccttgccctccggttcgagcgggtccaccaacacaggcgactcttggaaaaatcgggctgccagtcgcttctcagggttcttctcaagtgggccttctacatccgcttttggccgtgaggtggataagatggagcagctggaaggaaagctgcacacctacagtttgttcggtttgcctcggctgccaagaggacttagattcgaccacgatagctgggaagaagagtatgacgaggacgaagacgaggataacgcctgcctaaggttagaggatagctggagagagctcatcgatggccacgagaagcttactcggaggcagtgccaccagcaggaagcagtgtgggaactgctgcacacagaagcctcttacattcgaaaactgcgggtgatcatcaatctattcctttgctgtctgctgaaccttcaggaatcaggtctactgtgcgaagtagaggcagagaggctgttcagcaacattcccgagatcgctcagctgcaccgcaggctctgggcatccgtcatggctcctgtgttggaaaaggcacgaagaacgagggctttactccagcccggtgactttctgaagggctttaaaatgtttggcagtctgtttaagccatatatacgatattgtatggaagaagaggggtgcatggagtacatgaggggcctgctgcgcgataatgacctgtttagagcgtatataacatgggccgagaagcatcctcagtgccaaaggctcaagctgagcgatatgttggcaaagccacaccaaagactgacaaaatatccgcttctcttgaagtccgtgctgcggaaaactgaagaaccgagagctaaagaagccgtcgttgccatgattggctctgtggaacgtttcattcaccatgttaacgcctgcatgagacagagacaggagaggcagcgcttagctgccgtggtcagtaggatcgatgcttacgaagttgtcgaatcttccagcgatgaagttgacaagctcctcaaggagttcctccatctggatctgaccgctccaattccaggagcatcccctgaagagacacggcagctgctgctggagggaagcttaaggatgaaggagggtaaggactcaaagatggacgtctattgcttcctgttcactgatctgctccttgttactaaagccgtgaagaaagccgagcggacgcgcgttatcagacccccattattggtggataagatcgtctgtcgtgagctgagagacccaggttcgttcctccttatttatctcaacgagtttcactcagctgtgggcgcatataccttccaagcctccggacaggccttgtgtcggggttgggtggatactatatataacgctcagaaccaacttcagcagcttcgagctcaggaaccacccggaagccagcaacctctccaaagtctggaagaggaggaggacgaacaggaggaggaggaggaggaagaggaggaggaggaagagggcgaggatagtggaactagtgctgcctcttccccaaccataatgagaaaaagcagcggtagccccgacagtcagcactggaagctcacactcgcacagctgtaccgtatacggacaaccctgctgctgaactcaaccttaacagccagcgaagtttag

SEQ ID NO: 235179 - DNA, 3252 bp, Artificial Sequence
  Description of Artificial Sequence: Synthetic coding sequence
atgaacagcgttctcactaagcatggctctccacctcgcagttggctttccctgtgttcagggacggacgatcagtccccagcggagaagaaaggcctaaggtgccaaaacccggcatgtatggacaaaggccgagccgcaaaggtctgccatcacgccgactgccaacagctccatcgtcgcggtcccctgaacctttgtgaggcatgcgattcaaagtttcactctactatgcactacgacggccacgttaggtttgatttacctcctcaaggctccgtgctcgcgaggaatgtcagcacaagaagttgtccacctagaacgagccctgcggttgacttggaagaagaggaagaggaatcctccgtggacgggaaaggcgaccgtaagagtaccggcctcaagctgagcaagaagaaggcacgcaggaggcacaccgatgatccaagtaaagaatgcttcaccttgaaattcgacctcaatgttgacattgagaccgaaatcgtgcccgctatgaagaagaagagcctcggagaagtgcttctacccgtgtttgagagaaaaggaatcgccctgggaaaagtggatatttacctggaccagtctaatacgcccctgtctctgacatttgaggcatatcgcttcggcggacactacctcagagtgaaggcgcctgccaaacccggagacgagggcaaagtggagcaaggaatgaaggactcaaagtctctgtccttgccaatcctccgccctgccggaactggacctccagccctggaacgcgtcgatgctcagtcccggagggagagcctggacatccttgcaccaggacgtaggcgaaaaaacatgtctgagttcctaggagaagcttctatccccggacaggagcctcctaccccttcgagctgctctttaccttcagggtcttccggatctaccaatacgggcgatagttggaaaaatagggcagcaagtcgtttttccggcttcttcagcagcggtccaagcacctccgccttcgggagagaggtggataagatggagcagctggaaggaaagcttcacacatacagtctcttcgggctgcctcgcttacctaggggcctgcgattcgaccatgactcatgggaggaagagtatgatgaagacgaggatgaagataacgcctgcctgagactggaggattcatggcgcgagctgatcgacggacatgaaaagttgactcgtaggcagtgccatcaacaggaagccgtttgggaattgctccatactgaggccagctatatcaggaagctgcgtgtcatcatcaatctgtttctgtgttgtctgctgaatctacaagagtcgggtctgttgtgcgaagtagaggccgagcgtttgttttctaacattcccgagatcgcacaattgcataggagattgtgggcaagcgtaatggcacccgtgttagagaaagccaggagaactcgcgctctgctccagccaggcgattttcttaaagggtttaaaatgtttggatcattgtttaaaccctacattagatattgcatggaagaagaaggctgcatggaatacatgagaggtctgctgagggacaatgacctatttagagcatatattacatgggccgaaaaacaccctcagtgccagaggctgaaactgtctgatatgcttgctaagccgcatcaaaggcttaccaaatacccacttctactcaaatctgtcctacggaagacagaggagcctcgggcaaaggaggccgtggttgcaatgataggatccgtggaacggtttatccatcacgtgaacgcttgcatgcggcagcggcaggaaagacagaggctcgcagcggtggttagcaggattgatgcatacgaggtcgtggaatcttctagtgatgaggtcgacaagctgttgaaagagttcttgcatcttgacctgactgcacccatccccggtgcgtctcctgaagaaacaagacagctgctgctggagggttccctaagaatgaaagagggcaaggacagtaagatggacgtctattgcttcctcttcactgatctgttattagtcacaaaggccgtgaagaaagcagaacggacgcgagtcatcaggccccctctcctggtggataaaattgtctgcagagaactccgggatcctgggtctttcctgctcatctacttgaacgaatttcattcagcagtcggcgcttacacatttcaggctagcggacaggcactttgtaggggttgggtggataccatctacaacgcacagaatcagctccagcaattgcgggctcaagagccccctggctcacagcagcctttgcagtcactggaagaggaggaggatgaacaggaagaggaagaggaagaagaggaggaggaggaggaaggggaggactctgggaccagtgccgcatccagcccgaccattatgaggaaaagcagcggaagcccggatagccagcactgtgccagtgacggttctacagagaccctggcaatggttgtggtcgagcccggtgatactttgtccagtcccgagttcgattctggacccttttccagccagtccgacgaaacgagcctctccaccacggccagctcagcaacacccacgtcggagctgttgcccctggggccagtggacggacggagctgtagcatggattcagcttacggtaccctgtcccctacaagcctacaggacttcgtggcgcctggccctatggccgagctggtaccaagggcgccagagagcccacgcgttcccagtcctcccccatctccccgtctcagacggagaacacccgtacaactcctgtcgtgtcctccacacctcctgaaatccaaatctgaagcctcactattgcaactcctggccggagccggaacccacgggacaccatctgctccgagcagatccctcagcgaactctgcctggccgtcccagccccagggatccggacccagggttcaccccaggaggctggcccatcctgggactgccgaggggctccttcacccggaagcggccctggactggtcggttgcttggctggagagcccgctgggtcacatcggaaacggtgtggggatctgccttcaggcgcaagcccgcgtgttcagcccgaacctcccccaggtgtgtcagcccagcatcggaaactgactttagcccaactctacaggattcgcacgactctactgctcaactcgactctgacggcctctgaggtctag

SEQ ID NO: 235180 - DNA, 3021 bp, Artificial Sequence
  Description of Artificial Sequence: Synthetic coding sequence
atgcactatgatggccatgtgcgcttcgatctgccgccacagggttcagtgcttgccagaaacgtcagtacacgatcttgtcctccaagaacctcccccgctgtagatctggaggaggaggaggaagagtcctcagtcgacggcaaaggagaccggaaaagcaccggtctgaaactcagcaagaagaaggccagaagacgacacactgacgatccgtctaaagaatgcttcactctgaagttcgacctgaacgtggacattgaaactgagatcgtgccagcgatgaaaaagaaaagcctgggggaggtactgttgcctgtctttgagcgtaagggcatagccctgggcaaggtggatatctacctggatcaatccaacaccccactctctctgacctttgaagcctaccggtttggtgggcactacctcagagtgaaggcccctgccaaacccggtgacgaaggaaaagtggaacaagggatgaaggattctaagagcctttctcttccaattctgcgcccagccggtacagggcctcctgctctggagagggtagacgcccagtcccgcagggagagcctggacatcctggcaccagggaggcgcagaaagaatatgtccgaattcttgggtgaggcttcaatacctggtcaggaacccccaacccccagttcatgttctttaccaagtggatcaagcggctcaacgaatactggagactcttggaaaaaccgagccgcatccagatttagtggattcttctcaagtgggccttctaccagcgcttttggcagagaggtcgacaagatggagcagttagaggggaagctgcacacctacagcctattcggactgccaagactgcctcggggattgaggtttgatcacgattcctgggaggaagaatatgacgaagatgaagacgaggataacgcctgtctacgactggaggatagctggcgcgaactaattgatggacacgagaaactgacccggcgacagtgccaccagcaagaggcggtgtgggagctgctgcatacagaagcttcctacatccggaagttgagagtgattatcaatctgtttctgtgttgcctgttgaacctgcaggagagtggcctgctctgtgaggtggaggcggaacgcctgttttccaacattcccgaaatcgctcagttacaccggaggctctgggccagcgtaatggcacctgtgctggaaaaagcacgtaggaccagagctctgctccagccaggggactttcttaagggctttaaaatgtttggctcccttttcaaaccttacatccgatattgcatggaggaggaaggatgtatggagtatatgcgcggtttgcttcgggataatgatcttttcagggcatacattacctgggcagagaaacatcctcagtgccaaagattaaaactgtccgacatgttggccaagcctcaccagcgcttgactaaatatcccctgctcttaaagagcgtacttaggaagaccgaggaaccacgcgcaaaggaggccgttgtggccatgataggcagtgtcgagagatttatccatcatgtgaatgcatgtatgcggcaacgtcaggagaggcagaggctcgcagcggtcgtctccaggattgacgcgtatgaggtggtggagtccagcagcgacgaagtcgacaaactcctgaaagaatttctccacctagacctgactgcacctatccctggggcatctcccgaagaaacccgccagctcttgctggaaggctctctgcgtatgaaagagggaaaagacagtaagatggacgtctactgcttcctattcaccgatcttttgctggtgacgaaagcagtgaagaaggccgagcgcactcgggttattcgcccacccctgttggttgataagatcgtgtgtcgggagcttagagatccaggatcctttttgctcatatatcttaatgaattccatagtgcagttggagcttacactttccaggcatctggccaagccctgtgtcgcggatgggttgacaccatttataacgcacagaaccaattgcaacaactgcgggcacaagaaccgccaggatcacagcagccactgcagtctctggaagaagaggaagacgaacaggaagaggaggaggaggaagaggaggaagaggaggagggggaagacagcgggacatcagctgccagctcgccgactattatgaggaaatcctctggctctccagacagccagcactgtgccagtgatggctccaccgagaccctcgccatggttgtggtagagccaggagacacgctcagtagtccagagtttgactccggcccattttcttcacagtcagacgagaccagcctgtctacaaccgcgagctctgctactcccactagtgagctgctgccgctcggccctgtggatgggcgatcatgttcaatggacagcgcgtatgggactctctcacccactagcctgcaggactttgtagcacctggcccaatggccgagttggtgcccagggcacccgaatctccacgcgtgccttctccccctccgtcaccccgtctgaggaggcgtacccctgtgcaactgctctcatgtccgccacacctcctgaagagcaaatcggaggcatcactcctccaactgctggccggtgccggaactcatggaacacctagcgccccttcacgttctctgtctgaactgtgtctggccgtgccggctcccggaatcaggactcaggggtctccacaggaagccggaccctcctgggactgccgcggtgcgccttcccccggaagcgggccaggcttggtagggtgcctcgctggtgagccggcagggagccaccgcaaacgttgtggcgacctgcccagcggggctagcccacgggttcaaccggagccccctccaggcgtctccgcgcagcatcgcaaacttacattggcacaactgtatcggatcagaaccacactgctcctgaattccacgctgacagcttccgaggtttag

SEQ ID NO: 235181 - DNA, 3189 bp, Artificial Sequence
  Description of Artificial Sequence: Synthetic coding sequence
atggacgaccaaagtccagccgagaagaaaggcctgaggtgtcagaaccccgcatgcatggacaaaggacgcgcagcgaaggtgtgccaccatgcagactgtcaacagctgcacaggcgcggacctctgaacctgtgtgaggcgtgtgactcaaagttccactctactatgcattatgatggccacgtgcggttcgatttaccccctcagggctcagtccttgccaggaatgtctctactcggtcctgtccacccagaacgagccctgccgtggatcttgaagaagaagaggaggagagtagcgtagacggaaagggtgaccgtaaaagcaccggtctaaagctcagtaagaaaaaggctaggcgccgacatactgacgatccaagcaaagagtgcttcacactcaagtttgatctgaacgtggacattgagacagaaatcgtgcccgcaatgaagaagaagtccctgggggaagtcctcctccccgtgttcgagcgcaaaggaattgcattggggaaggttgacatctatttggatcagagtaacacccctttgtcactaacttttgaggcatatcggtttggaggacattatttacgtgttaaagcgccagcgaaacctggcgatgagggcaaagtcgaacagggaatgaaggactcgaagagccttagcctgcccatcttgagaccagcaggcaccggcccacctgccctggaacgagtcgacgcccagagccgcagggaatcacttgatatcctggcacccggaagacggcgtaagaacatgtccgagttcctgggggaggcctctattccgggacaagaaccaccaaccccttcatcttgtagcctccccagcggcagttctggcagcaccaacaccggtgacagttggaagaatcgggctgcctcccggttcagcggattcttcagttccggtccaagtacttcagcctttggccgagaggtggacaagatggagcagctggaaggtaagttgcacacctactcccttttcggtctccctcgcctgcctcgtgggctgcgctttgaccacgacagctgggaagaggaatatgacgaagatgaggatgaggacaacgcctgtttgaggttagaagatagttggagagagcttattgatggccacgagaaactcacacgcagacagtgccatcaacaggaggctgtatgggagttgctgcatacagaggcctcctacattcgcaagctgagagtgatcataaatctgttcctgtgctgcttgctgaatcttcaggagagcggcctgctgtgcgaggttgaagccgagcggttattctccaatatccctgaaatagcacaactgcacagaagactgtgggcaagtgtgatggccccagtacttgaaaaggccagacgcacccgggctctacttcaaccaggtgattttctgaaaggatttaagatgttcggatcactgtttaagccctacattagatactgcatggaggaagaaggttgcatggaatatatgaggggtctactccgggataacgacttgttccgggcatacataacttgggcggaaaagcatccacaatgtcagagattaaagctgtccgacatgctagccaaacctcaccagcggctgacgaagtatcctctgctcctcaagtctgtgcttagaaagacagaggagcctcgtgccaaggaggccgtggtggccatgataggcagtgtggagcgtttcattcaccatgtgaatgcatgtatgagacagaggcaggaaaggcagcgtcttgcagccgttgttagtaggatcgacgcatacgaagtcgtcgagtcttcttcggatgaagtggataaactgctgaaggagttcctccaccttgacctgactgctcccatacctggagcatctccagaagagaccagacaactgctgctggagggctccttgaggatgaaggaggggaaggacagtaagatggatgtctactgcttcctcttcacagacctcctgcttgtcacaaaggctgtaaaaaaggctgagagaacaagagtgatccgccctccgctgctggtcgacaagatcgtgtgcagggagttacgggacccaggatcatttctgctgatttacctgaacgagttccatagcgcagtgggagcatacacatttcaggcctccggccaggcgttgtgtagaggttgggtggacacgatctataatgcgcagaatcaactgcagcagctgagagcacaggagcctcccggttcccaacaacccttacagtccctggaggaagaggaggacgagcaggaggaagaggaagaggaagaggaggaggaggaagagggcgaagacagcggaacttccgccgcatcatctccaacaatcatgcgcaagtcctctggatcacccgatagccagcattgtgcgagtgacgggagcactgaaactctggctatggtggtcgtggaacctggagataccctgtcaagtcctgaattcgactctggcccattttcttcacagagcgatgagacgtcactgtcgacaacagctagtagcgctacccctacatccgagttacttcccctgggaccggtggacgggaggagttgctcaatggacagtgcttatggcacactgagccccacgtctctccaggactttgtggccccaggccctatggccgaactggtcccacgggcaccagaatctcctcgtgtacctagcccacccccaagccccagactgagaaggagaacaccagtgcagctcctgtcctgtccccctcacctgctgaaatccaagtccgaagcctcactactccagctgctagctggcgctggcacccatggtacacccagcgcaccgtctagatccttgagtgaactgtgcctggcagtcccagcccctgggatcagaacccagggctccccacaggaggcaggcccttcctgggactgtcggggagcgccttcccccggttccggtcctgggttggttggctgcctggcaggtgagcctgcaggaagccacagaaagcggtgcggcgaccttccatccggggcatctccacgtgtccaacccgaacctccacccggtgtgtccgcacagcacagaaaactgaccctggctcagctgtataggatacggactacactcttgctgaattcaacgcttacagcatcggaggtgtag

SEQ ID NO: 235182 - DNA, 3228 bp, Artificial Sequence
  Description of Artificial Sequence: Synthetic coding sequence
atgggcactggcccaggagttagcgggagacttgctgcctcgcgccctggaccgggattgcctctgcgcgacagcgagcccagctgggcaggtggaagagcacgggatggggactcccaagtgtgtcatcacgccgactgtcagcagctgcacaggaggggtccgttaaatctgtgtgaagcctgcgactcgaagtttcacagcaccatgcactatgatgggcacgtgcggttcgatctgcctccccagggaagtgtgttagcgagaaacgtgtcaaccagatcatgtccccctcgcacgtcaccagccgttgatttagaagaggaagaagaggaatcttctgtagacggaaaaggcgaccggaaaagcacggggctcaaactgagtaaaaaaaaggcccgtcgaaggcacacagatgatccctcaaaggagtgctttaccctcaagtttgatctgaatgtggatatcgagaccgagatcgtgcccgcaatgaaaaagaaaagcctaggcgaggtgctcctgcctgtgttcgagcgaaagggcatcgcactgggcaaagtggatatctacctggaccagagcaatacacctctgtctctgactttcgaggcttatcggttcggagggcattatcttagggtgaaagctcctgctaagccaggtgacgagggaaaggtggagcaggggatgaaggattctaaatcactttcactgcctattctccgcccagccggaactgggcctccagctctggaacgcgtggacgcccaatcaagacgggaaagcctcgacatccttgcaccaggcaggcggagaaaaaacatgagtgaattcctgggcgaagcatctataccaggccaggagcctcccactccttcgtcatgttctcttccgtctgggagttcggggagcaccaacaccggagactcatggaaaaacagggctgcctccagattctcggggttcttttcatctggcccatccacctctgcctttggtcgcgaagtggataaaatggaacagctcgagggaaaactacatacttattcattgttcggtctgccacgcctgccacggggattgcgttttgaccacgactcctgggaagaagaatatgatgaagatgaagatgaggacaacgcctgtcttaggctggaagatagctggcgggagttgatagacgggcacgagaaattaaccaggcggcagtgccaccagcaggaagcagtttgggagctcctccacaccgaagcatcctacatccggaagctccgagtgataatcaatctgttcttgtgctgcctcctgaacctgcaggaaagtggcttactttgtgaagtcgaggctgaacgccttttctccaatatcccagaaattgcgcagctccacagaaggctctgggccagcgtgatggctcccgtattggaaaaggcaaggcggacccgcgctctcctgcagccaggggactttctgaaggggtttaaaatgtttgggtccctatttaagccttatattcgttattgcatggaggaagaaggttgtatggaatatatgcgcggtttgttgagagacaatgacctgttccgcgcttatatcacttgggccgaaaagcatcctcagtgccagagactgaagttgagcgacatgctggcaaaaccacaccaacgcctcaccaaatatcctctgctcctgaaatctgtgctgcgaaagacagaagaacctagagccaaggaggcagtcgtggcgatgattggatccgtggaaagattcattcatcacgtaaacgcctgtatgcgtcaacggcaagagcgccagcggctcgccgctgtggtttctcgcatcgatgcttacgaagtcgtggagtctagcagcgacgaagtggataagcttctcaaagaattcttgcatcttgacctgactgcgcctattcctggagctagccctgaggagacccgacagttactgctggaaggaagcttgcgcatgaaggagggcaaggattccaagatggatgtgtattgctttctgtttactgacctcttgctggtgacaaaagcggtaaaaaaagcagagagaacgcgagttatacggccaccccttctcgtcgacaagatagtgtgtagggagttgcgagaccccggatcattcttgctgatttacttaaatgaattccattcggccgtgggcgcatacaccttccaggcaagcggacaagcattgtgtcggggttgggtagatacgatctataacgcccagaaccagcttcaacaactccgcgctcaggaacctcccggatctcagcagcccctgcaatctctggaggaagaggaggacgagcaggaagaggaggaggaagaagaagaggaggaagaggaaggtgaagactccggtacgtctgcggctagttcacctaccataatgcggaagtccagtgggtcaccagatagtcagcactgcgctagcgatggtagcactgagactctggcgatggtcgtcgtagagcccggagataccctttcttctcctgaattcgattctgggcctttctcaagccagagtgatgaaactagtctttcaacaacagccagtagcgccactcctacctccgagttgctgccactgggacccgtggatggtaggtcttgctcaatggattctgcctatggtacgttgtcccctacatcgttgcaggattttgttgcgccaggacccatggcggagttggttccacgcgctccagaatcgcccagagtgcccagccctccacctagtccgagactcagacgcagaactcctgtgcaattgttgagttgccccccacaccttctgaaaagtaagtctgaggcctcactactgcagctgctcgccggagcaggcacgcacggcacgcccagtgcaccttctaggtctctctccgaactgtgcctggcagtaccagcacccggtatcaggacccagggtagcccccaggaggctggtccatcctgggactgccggggtgcccctagcccaggctctggccctggactggtgggttgccttgccggagagcctgcagggtcccataggaaaagatgcggtgacctcccttcaggggcatcccccagggtgcagcctgagccgcctcctggggtatcagcgcaacatagaaagctgacattggcccagctgtatagaatcaggacaacgttgcttctgaactctacgctgaccgcgagtgaggtttag

SEQ ID NO: 235183 - DNA, 2739 bp, Artificial Sequence
  Description of Artificial Sequence: Synthetic coding sequence
atgaagaaaaaatctctaggcgaagtactgctgcccgtatttgagcgcaaaggaatcgctctcggcaaagtcgatatttacctcgaccagtccaatactccactttctctgacgtttgaagcctacagattcgggggacactatctccgcgtcaaggcccctgcaaagccaggagacgagggcaaggtagagcaaggcatgaaggactctaagagtctgagcttgcctatcctccgacctgcgggaacaggtccgcctgctcttgaacgggtggacgcccagagccggagggagtcccttgatatccttgcccctggccgacgcagaaagaacatgtctgagttccttggcgaagctagcatcccgggacaagaaccgccaaccccaagctcttgctcccttccttccgggagctcaggcagtacaaatacaggagattcatggaagaatagagccgcatctcgcttctcaggctttttcagctctgggccaagcacgagcgctttcggtcgggaagtggataagatggaacaattggaggggaaactccacacgtactccctgttcggcttaccaaggctgccgcgagggcttcggttcgatcacgactcctgggaagaagagtacgacgaggacgaggatgaggacaatgcctgcctgcggttagaggatagttggagggaactcatcgacggacacgagaaattgaccaggcggcagtgtcatcagcaagaggctgtctgggagctattgcatacggaagcttcttatattcgcaaacttagagtcattattaatcttttcctgtgctgtctcctcaaccttcaagaaagcggcttgctatgtgaggtggaggccgaacgactgttcagtaacattcctgaaatcgcccagctgcatcgtaggctgtgggcgagcgtgatggccccagtcctggagaaagccaggcgaactcgggctctcttacagcctggtgattttctgaagggcttcaaaatgtttgggtcattattcaaaccctacatcagatactgcatggaggaggaggggtgcatggaatatatgcgcggtttgctcagggataatgatctatttagagcatacatcacttgggctgagaagcatccgcagtgccagcggctcaagcttagcgatatgctggcgaagccgcaccagaggctgactaaatatccccttctgctcaagtccgtgttacgaaagacagaggagcccagggccaaggaagccgtcgttgccatgatcggcagcgtagagcggttcatccatcatgtgaacgcatgtatgcgtcagaggcaagagcggcagagactcgccgcagtcgttagcagaattgatgcttacgaggttgtcgagagtagttcagatgaggtggacaaactattaaaggaatttttgcacttggacctgaccgctcccatacccggtgcctctcccgaagaaacaaggcagttgctgctcgaagggtctctgcggatgaaagaaggaaaagactctaaaatggacgtctactgcttcttgtttacagacctgctgctggttacaaaggccgtgaagaaggccgagcggactagagtaataagacccccactgctagtagacaagattgtgtgccgggagttgcgggaccctgggtcatttctgcttatctacctgaatgagtttcatagtgctgtgggcgcttatacctttcaggcttccggacaagctctgtgccgaggttgggtggacacaatttacaacgctcaaaatcagctccagcagctcagggcgcaagagccgcctggctcgcagcaaccactgcaatccctggaggaggaggaggatgaacaggaagaggaagaggaagaggaagaagaggaggaagagggcgaggattcaggcacaagcgccgcatcctcacccactataatgcggaaaagttccggctcgccagattctcagcattgtgcctctgatggttctaccgaaacattggccatggttgtggtggaaccaggagacacgctgagctctcccgaatttgacagcggacctttctcatcccagtcagacgaaacaagtttgtctaccactgcaagcagcgccacacctacatcagaactactgccattgggcccagttgacggtaggagctgttcgatggatagtgcatacgggaccctaagcccaactagcttacaggacttcgttgccccaggaccaatggctgaactggtgccgcgagcaccagagtctcctcgagtgccaagccctccaccttcccccagactccgtagaagaacccctgtccaattgctgtcttgcccgccacatctactcaagtcaaaaagcgaggccagcctgcttcaactgctcgctggtgctggcactcatgggactccgagcgctcctagccgctctctctcagagctttgtctggctgtgccagccccaggcatcagaacacagggaagtcctcaagaggccggtccctcatgggactgccgtggtgcaccatcccccggttccggaccaggacttgtgggctgcctggccggagagccagcaggatctcaccggaagaggtgtggggatctcccttccggagcatcacccagggttcagccagagccccctcccggagttagtgcgcaacatcgaaagctgactctggctcagttataccggatcaggacaacccttctgctcaacagcaccctgaccgcatcagaagtatag

SEQ ID NO: 235184 - DNA, 3258 bp, Artificial Sequence
  Description of Artificial Sequence: Synthetic coding sequence
atgtcattgggagagagagggagtccccaaacctttggagggtcatctgtcagcaaggggtcagatgccggacacgatcaatctcccgcagaaaagaaagggctgagatgccagaatcccgcatgtatggataaggggcgagcagctaaagtctgccatcatgcggactgtcagcaactgcacaggcggggtcctttaaacctatgcgaggcatgcgacagcaagttccactctactatgcattatgatggccacgttcgttttgacctcccccctcaaggttcagtgctggccagaaacgtgagcacccgatcatgcccccctcgcacttcccctgccgtggatctggaggaggaggaagaagagtcctccgtcgatggtaaaggtgaccggaagagtaccggtctcaaactcagcaaaaaaaaggcacgccgaagacacacggatgacccttcaaaggaatgcttcacactgaagtttgatcttaacgttgatattgagaccgagatcgtgccggcaatgaaaaagaagagcctcggcgaagtgttactgcccgtgtttgagcggaagggtattgcgcttggaaaggtggacatttatctagaccagagcaacacccctctatcgctcacatttgaggcctatcgctttggaggacactacctgcgggtgaaggcccctgcaaagcccggagatgagggaaaggtggaacaaggaatgaaagatagtaagtctttgagtttgcctattctgcggcctgctgggactggtcctcctgctttagaacgcgttgatgcccaatcccggagagagagcctggatatcctggctcccggtagacggagaaaaaacatgtcagagttcctaggagaagcttcaattcccggacaggagcctcccactcccagctcttgctccctcccgtccggttcgtctggctcgacaaacaccggggactcatggaagaacagggctgctagccgattttcaggctttttttcttctggcccatcgacgtcagcgttcgggcgtgaggtcgacaagatggaacagttggagggaaagctgcatacctactccttatttggcctgcctcgattgcccagagggctgagattcgaccacgattcttgggaggaggagtatgatgaagatgaggatgaggataatgcctgtcttagattagaggactcgtggagggagctgattgacgggcatgaaaaattaactcgcaggcagtgccatcagcaggaggcggtgtgggaactgctgcacaccgaggcttcctacattaggaagctgagagtgatcatcaacctttttctctgctgcttgctcaacctgcaggagagcggcctgctgtgtgaagtggaagccgaacgcctgttttctaatatccccgaaatagcacagctccaccggagactctgggcctcagtaatggcccctgtgctggagaaggctcgcagaacgcgagcgctcctgcaacccggtgactttctgaaaggattcaaaatgtttggcagcttgttcaagccttacatccgttattgcatggaagaagaagggtgcatggaatacatgaggggcctgctccgcgacaatgatcttttcagggcatacatcacttgggcagaaaaacatccgcagtgtcagaggttgaagctgagtgatatgctggccaagccccaccagcgcctaaccaagtacccactactcctgaaaagcgtgctgaggaaaacagaggagccacgggctaaagaagccgtggtggcaatgatagggtcagtggagcgttttatccaccacgttaacgcctgtatgcggcagcggcaggagagacaacgactcgccgctgtggtgtctcgaatcgacgcatatgaagtagtcgagtcctccagtgatgaagtggacaagcttctgaaggaattcctgcacctcgaccttacagctcctatccccggagccagtccagaagaaaccagacagttactgttggagggcagtttacgcatgaaggaaggaaaggacagcaaaatggacgtgtactgtttcttgtttacagatctgctcctggtgactaaagccgtcaaaaaggcagagaggacccgagtgatacgccctccgctgttagtcgataaaattgtctgcagagagttgcgggaccctggcagctttctccttatatatctcaacgagtttcactcagcagtcggcgcttatacattccaggccagcggtcaggcactctgtcggggttgggtcgacaccatttataacgcgcagaatcagttgcagcaactcagagcacaagagcctccaggctcccagcagcctttgcagtccctggaagaggaagaagacgagcaggaggaggaggaagaagaggaagaggaggaggaggaaggtgaggattcgggcacatctgccgctagctccccaacaatcatgcgcaaatcatcgggatcaccagattctcagcattgcgcttcagacggaagcactgagacactggccatggtggttgttgaacctggcgacacgctgtcaagccccgaatttgactcaggaccattttcaagtcagagtgacgagacctccctcagcaccaccgcatctagcgccacacctacctccgaactcctgcctctcggccctgtcgatggcaggagctgctctatggattcggcatacgggacccttagccccacatcgctccaggatttcgtagcccctggcccaatggctgagctcgtgccgagggcgccagaatctcccagagttccctctcctcctccctctcctcggcttcgtagacggaccccggtccagctcttatcatgcccccctcatcttctcaagagtaagagcgaggcctcactcctgcagctgcttgctggggctggaacccacggcactccctctgctccctctcgcagcctgtcagagctttgtttggccgtcccagcacctgggattcgcacacaaggcagtccccaggaagccggtccatcatgggactgtcgcggagccccttcacctgggtccgggcctgggctcgtggggtgtcttgccggagaacccgcaggctcccaccgtaaacgttgtggggatctcccttctggtgcatctccacgtgttcagcccgagcccccaccaggcgtgtctgctcagcacaggaaactgacacttgcccagctttataggatccggaccactctccttctaaattccacactgaccgcctccgaggtttag

SEQ ID NO: 235185 - DNA, 2793 bp, Artificial Sequence
  Description of Artificial Sequence: Synthetic coding sequence
atgcattacgatggacacgttaggtttgatctcccgccacaggggagtgtgttggcaagaaatgtctcaacgagaagctgccccccacgtacttcccccgctgtggatctggaggaagaggaggaagagtctagtgtggatggcaagggagacagaaaatccaccggtctgaaactatccaagaagaaggctaggaggcgtcacactgatgatcccagcaaagagtgctttactctaaaatttgacctgaatgtcgacatcgagactgaaatcgtgccagccatgaagaagaaaagtctgggggaggtactgctgccagtgtttgaacgtaagggaatcgccctgggcaaagtagatatctatctagatcagagtaatacgccactgagcctaactttcgaagcctatcgctttggcggacactaccttagagtgaaagcccctgctaaacctggcgatgaaggcaaggttgagcagggaatgaaagatagcaaatccctctctctgccaattctgcggccagcagggacgggtcccccagccctggaacgtgttgatgcccaatctcgccgagagtctctcgacatactagcgcctggccgacgcagaaagaacatgtccgaatttttgggtgaggcctccattcccggtcaggagcctccgaccccaagctcctgctctttgccctctggatcctcaggctcaaccaacacaggggacagctggaaaaaccgcgctgcctccagattctccggctttttttccagtggcccaagcacctccgcttttgggcgagaagtggataaaatggagcagctagaagggaagctacacacttatagtctgtttgggctccctagacttcctcgcggattgcgctttgaccacgattcttgggaagaagaatacgacgaggacgaggacgaagacaacgcttgcctcagactggaggattcctggagagagctgatagacggtcacgagaagctcacgcggagacagtgtcaccaacaggaggcagtatgggaattgctacacactgaagccagctacatccggaagttaagagttataattaaccttttcctctgctgtcttctcaacctgcaggaatctggactgttgtgcgaggttgaggcagaacgactcttttctaacattccagagatagctcaactgcaccgaaggctatgggcctccgtgatggccccagtcctggaaaaggcacgcagaaccagggcactgttacagccaggcgactttttgaaaggctttaaaatgttcgggtcactgttcaagccctacataaggtactgtatggaagaagagggctgcatggagtacatgcggggactcctgcgcgacaacgatctgttcagggcctacatcacgtgggcagagaagcacccacagtgtcagcgtctgaagctttctgacatgctggctaagcctcatcagcggctgaccaagtatcccttgctgctgaagtcagtgctgaggaaaactgaggagccccgtgccaaggaggcagtcgtggccatgattggcagcgtcgagaggttcattcaccacgttaacgcctgcatgcgacaacggcaggaacgacaacgcttggctgctgttgtgtctcgaattgacgcttatgaggttgtcgagtcaagttctgatgaggtcgacaagttgctgaaggagttcctccacttagacctcaccgcacccattccaggcgctagccctgaggagaccaggcaactgctcctggaaggttcacttagaatgaaagaggggaaggattctaaaatggacgtgtactgttttctgtttaccgaccttctgctggtaaccaaggctgtgaagaaagccgagaggacgagagttatccggcctcccctgctggtcgataaaatcgtgtgcagagaattacgagatcccggatctttcttactaatttatctcaatgaattccattctgcagtgggagcgtatacctttcaagccagcggacaggcactgtgtagagggtgggtggacaccatttataacgcacaaaaccagcttcaacagctgagggcacaggaacctcctggttctcagcagcccctgcaatcccttgaggaggaagaagatgaacaagaggaggaagaggaagaggaagaggaagaagaagaaggggaagactctgggacttcagcagcctcttccccaaccatcatgcggaaatcatcgggcagtccagattcacaacactgcgcaagcgatggatccacagaaactctcgccatggtggtcgtggaaccgggtgacacactcagctctcccgagttcgattctgggcctttctctagccaaagcgacgagacaagcctatcaacgaccgccagcagtgctacgccgacatccgagctgctgccgcttggaccagttgacgggcgtagttgctccatggacagtgcttacggcactctttcccccacgagcttgcaagacttcgttgcacctggaccgatggccgaactcgtccctagggccccagaaagccctcgcgtcccctcgccacctccttccccaagactgcgaaggaggacgccagtccagctgctttcttgcccccctcaccttctgaaatctaagtccgaagcatccttgcttcaattactggcaggcgcagggacccatggaacccctagcgccccatcccggtcactgtccgaactgtgtttagctgtgccagctcccgctcaagaggccgacccaggccctgctttgccaaatcaggatcaccctgcggcatag

SEQ ID NO: 235186 - DNA, 2373 bp, Artificial Sequence
  Description of Artificial Sequence: Synthetic coding sequence
atgaaagcttttggacctccccatgagggcccactgcagggactcgttgcctccaggattgaaacctacggcggacgacatagagcgtctgcacaatcaactgcaggtaggctgtaccccaggggttaccctgtgttggacccgagccgcagacgcctccagcagtacgtgcctttcgccagggggtcaggacaggcgaggggactgtcgcccatgcgcctgcgcgaccctgagcctgagaagcggcatggaggccacgttggagcgggattgctgcacagcccaaagctgaaggagctcacaaaggcccacgagctcgaagtgaggttgcacacctttagcatgttcggaatgccacgtctcccgccagaggataggcggcattgggaaatcggagaaggcggagactcagggctgactatagagaaatcttggcgagaactggtgcccggacacaaggaaatgtcacaggaactgtgccatcaacaggaggctctctgggagctgttgacaacggagctgatctacgttcgcaagctgaaaatcatgaccgacctcctggctgcagggctgctcaacctgcagagggtggggctcctgatggaggtgagcgcagagacgttatttgggaacgtaccctccctcatccggactcaccggagtttttgggacgaagttctggggccaacgctcgaggaaacacgtgcgagcgggcagcctttggatcctataggattacagtccggtttcctcacgttcgggcaaaggttccacccctatgtgcagtactgcttaagagtgaagcagaccatggcatatgctcgcgaacaacaggagaccaatccattgtttcacgcattcgtgcagtggtgcgagaaacataaacggagcggaagacagatgctctgcgatcttctcattaagcctcaccagcgaataaccaagtacccactgttgttacatgcagtccttaaaaggtcacccgaggctagggcccaagaggctcttaacgccatgatagaggcagtcgaatcatttctgagacatatcaacgggcaagtccgtcagggagaagagcaagagagtcttgccgctgcggcacagagaatcgggccttacgaggtactggagcctcctagcgacgaagtggaaaagaacctgagaccctttagcacactagatctgaccagtccaatgctgggagtggccagcgagcacacccggcagctgctgctggagggcccagttagggttaaggaaggcagggaaggcaagctcgatgtgtatctgtttctgttctctgatgtgcttcttgtcactaagccccaacggaaggcagacaaagctaaagtcatccggcctcccctgatgctggagaaattagtgtgccaacctctgagagatcctaattctttcttattgattcacctgaccgagttccagtgcgtcagctccgctctgcttgtacactgtccctccccaaccgatcgggcacaatggctcgaaaagacccagcaggctcaggcagctctccaaaagctgaaagcagaggaatatgtccaacagaaaagggagctgctcactctataccgtgaccaagaccgggaatcaccatccacccggccaagcactccgtccctcgaagggtctcagtcatctgcagagggacgtacaccagaatttagcacgatcatccctcacctcgttgtcactgaggacactgatgaagatgctcctctagtgcccgatgacacatctgactccggatacgggaccctcatcccaggaacgcccacaggatctcggtccccgctaagtcgtctacggcagagggcactgcgcagagaccctcggctgacattcagcaccctcgagctgcgggatattccattacgcccacatcctccggatccgcaagccccacaacggaggtccgcaccagaacttcccgagggcatcttgaaggggggaagtctccctcaagaagaccctcctacctggtcagaagaggaagacggagcctccgagcgaggcaatgtggtggtggagactttacacagggcaaggctgcgaggacaattaccctctagccccacacatgccgacagcgcaggggagtctccatgggagtcttcaggggaagaggaggaagagggtccactgtttctgaaagctggccatacaagcctgcgccctatgcgcgctgaagacatgctacgggagatcagagaggaacttgcctcgcaacgcattgagggcgctgaggagcccagagacagcaggcccaggaagctgacccgtgcacaacttcagcgaatgcgtgggcctcacatcatccagctggacacgcccctgtccgccagcgaggtgtag

SEQ ID NO: 235187 - DNA, 963 bp, Artificial Sequence
  Description of Artificial Sequence: Synthetic coding sequence
atgtgcccaagggagggcggacgcgcaagtactatccaccagaagactgaaaaagcctttggtcaacttctgtgtcagccccttggtgagcccaagatccagcatccgctgaaagcggctctccagaaactcaaggcggaagaatatgttcagcaaaagcgggaactgctcacattatatcgagatcaggatcgggagtcaccaagcactcggccttcaacacctagtcttgaaggtagccagagctcagccgagggaagaacccccgagttctcaactatcattcctcacctcgtagtgacggaggacacggacgaagatgcgcctctcgtgcccgacgacacaagtgattctggctacgggaccctcattcccggtacaccaacaggtagcaggtctccgctcagtcggctgcgacagcgtgccctccgccgtgacccgagactgacgttttcaaccctggagctccgcgatatacccctccggcctcaccctcctgatccacaggctccccagagacggtcagctccagagctacccgaagggatcctgaaggggggatcactgccccaagaagaccccccaacttggtctgaggaggaggacggggcatccgagcgaggcaatgtggttgttgagaccctgcaccgggcaagactgcggggtcaactaccttctagccccactcatgctgattctgcaggggagtctccatgggaatctagtggcgaagaagaggaggaggggcctctgttcctcaaggccggacacacaagcttacgacctatgagagctgaagatatgctgcgagaaatacgcgaggaactggctagccagcgaattgagggtgcagaggaaccacgggattccaggcctcgcaaactcactagggcccagctgcagagaatgaggggacctcacatcatccagttggatacaccgctgtcagcttccgaggtttag

SEQ ID NO: 235188 - DNA, 2373 bp, Artificial Sequence
  Description of Artificial Sequence: Synthetic coding sequence
atgaaagcattcggccctcctcacgaaggcccactgcaaggcctggtggccagccggattgaaacctacgggggtaggcaccgggcatccgcccaatccaccgcaggaaggctctatccacggggatatccggtcctggatcctagccggagacgcctgcaacaatacgttccatttgcccgaggcagtgggcaggctcgaggattgagtccaatgcgcctcagggaccccgagcccgagaaaaggcacggtggccatgttggtgctgggcttcttcacagtccaaaactgaaagagttgactaaggcacacgagcttgaagtgaggctccataccttcagcatgttcgggatgcccagactcccccctgaggatcggagacattgggagatcggtgaggggggtgattctggcctaactattgagaagagttggcgcgagcttgtgcctggtcacaaggagatgtctcaggaactttgtcaccaacaggaggctttgtgggaactgctgaccacagagctgatatatgtgaggaagcttaaaattatgacagacctcctcgccgcaggcctgctgaatcttcagcgcgtgggccttttgatggaggtttccgctgagacactgtttgggaatgttccctctctaatcaggacacatagaagtttttgggacgaggtgctgggtccaactctcgaggaaaccagggccagtggtcaacctctcgaccccatcgggctccaatcaggctttctgacctttggccaacggttccatccgtatgtacagtattgtcttcgggtgaaacagaccatggcatacgctcgggaacagcaggagactaatccgctctttcacgccttcgtccagtggtgcgaaaaacacaaaagaagtggacgtcaaatgctatgtgacttactgatcaagcctcatcagcggattacaaaatacccgctgctgctacatgccgtgctaaagcgttctccagaggcacgggcacaggaggccttaaacgccatgattgaagcggtcgagagttttctcagacacattaacggccaggtgcgacagggcgaagagcaggagtcccttgccgcagctgcccagaggataggcccatatgaagtcctggagcctccatcagacgaggtcgagaagaacctgaggccctttagcacactggacctgacgagcccaatgctaggcgtggcaagtgagcacactcgtcagctattgctagagggcccagtacgcgtgaaggaaggcagggagggaaagctagatgtctatttgttcctgttctcagatgtgctgctggtgaccaaaccgcaaagaaaggctgacaaagccaaagttattcgccctcccctgatgctcgagaagctggtttgtcagcctttgcgggacccaaattctttcctgctgattcacctcactgagtttcagtgcgtgtctagcgccctactggtccattgtccctccccgactgacagagcccagtggttggaaaagacacaacaggcacaggctgccctacagaaactaaaagctgaggagtatgtgcagcagaagagagagctcctcacactgtaccgtgatcaagaccgcgaaagtccgagtactcgcccttctacaccatcccttgaggggtcccagtctagtgctgagggcaggaccccagagttttccacaattattcctcaccttgtggtgactgaagacacggatgaagacgcgcctctggtgcccgacgacacttctgacagtggctacggcactcttattccaggcactccaacggggagccgaagtccactgagtagattgcggcagcgggcactaaggcgcgatccaaggctgacattcagcaccctcgaactacgcgacatcccgctgaggccacatccccctgacccacaggcccctcagcgaagatcagctcctgaactccctgaaggcatactcaagggcggatccctgccacaagaggaccctcctacctggagtgaagaggaggatggtgcctccgaaagaggcaacgtagttgtggagactctccacagagcccgactaagggggcagcttccaagcagtccaacccatgcggattctgcaggggaatccccgtgggaaagcagtggggaggaagaggaggagggccctctgtttctcaaggcaggacacacatctctccgccctatgcgggctgaggatatgctgagagagataagggaggagctcgctagccagcgtatagagggagccgaggaaccacgcgacagtcgtccaaggaagctgaccagagcgcaactgcaaagaatgaggggaccacacataatccagctggacaccccgctgtcagctagtgaagtgtag

SEQ ID NO: 235189 - DNA, 2277 bp, Artificial Sequence
  Description of Artificial Sequence: Synthetic coding sequence
atgggctgccgtttacatgcccctggagagaaagctgcgcatgatccatctaggcggaggctgcagcagtacgttccattcgccagagggagcggccaggctcgagggctctcgcccatgagactgcgtgaccccgagccagaaaagagacatggcggtcatgtcggcgctgggcttctccatagcccgaagctcaaagagttaactaaggctcatgagttggaggtgaggttgcacaccttcagcatgttcggtatgccacgcctcccacccgaagatagacggcattgggagatcggagagggaggcgactccggactgacgatagaaaaatcatggcgcgaacttgttcccggtcacaaagagatgtcgcaggagttgtgtcaccaacaggaggcgctgtgggaacttctcaccactgagctaatatatgtccgcaagttgaagattatgacagatttgctcgccgctgggctgctgaacttacagcgggtaggcctcctgatggaggtttccgcggagacgctgttcggcaatgtgcccagcttaattaggactcacaggtctttttgggacgaggtactcgggcctactttggaagaaacacgcgcaagcgggcaacctcttgatcctatcggactgcagtcaggtttcctgacttttggccagcgtttccatccttacgtccaatactgtcttcgcgttaaacaaaccatggcttatgccagagagcagcaggagactaatcctttattccacgcattcgtgcagtggtgcgagaaacacaagcgcagtggacgacagatgctgtgtgacctcctgataaagccccatcagaggattactaaatatcctcttttgctccatgcggtgttgaagagatccccggaggccagggcccaagaggccctcaatgcgatgatagaagctgtagagagctttctgcgacatattaacggacaggtcaggcagggggaggaacaggagtctctggctgctgccgctcagagaatcggcccatacgaggtcctagagccaccctccgatgaagtggaaaaaaatttgcgcccattcagcactctggatcttacctctcccatgctcggtgtggcctccgaacatacacgacagttgctcttggaaggccctgtccgcgttaaagaggggcgtgaaggcaagctggatgtttacctgtttttgttctcagacgtgttattagtgacgaaaccgcagcgcaaggcagacaaagcaaaagtgataaggccccctcttatgctcgagaaattggtgtgccaacccctgcgagacccgaattccttcctgctgatacacttgacagagtttcaatgcgtgtcctcagccctgcttgtgcattgcccaagccctaccgaccgggctcagtggttagaaaaaacccagcaggctcaagcagccctgcagaaattgaaagcggaggaatatgttcagcaaaaacgcgaactgctgaccctttacagagaccaagatagagagagcccgtccactcgaccctcaacaccatccctggaaggcagccagtcttccgcggaggggagaactcctgaatttagcactattataccgcatctcgtggtgacagaggatacagatgaggacgccccattagtccctgatgacacatctgattcaggatacggcacgctcattccaggcaccccgacggggagccgttctccactcagtcgcctgaggcagagagcccttcgcagggatcctaggctgacattcagcaccctggaactgagggacattcccctccgaccacacccccctgatccacaggcacctcagcgaagaagtgcccctgaactccccgagggaattctaaaaggagggagcctgccccaggaggacccaccaacctggagtgaagaggaggatggcgcttccgagcggggaaatgtggtcgtggagaccctccacagggcacgattgagggggcagctgccaagttcccccacacatgccgatagtgctggcgaaagtccttgggaatctagtggtgaggaagaggaggagggacccctctttttaaaagccggacatacatccctccgtccaatgcgggcagaagacatgctgagagagatcagagaggaacttgccagccagaggatagaaggcgctgaagagccacgggactctcgcccacgaaagctgacgcgcgctcagctccagcggatgagagggccacacatcatccagctcgacacgcctctgtccgcatccgaggtctag

SEQ ID NO: 235190 - DNA, 4482 bp, Artificial Sequence
  Description of Artificial Sequence: Synthetic coding sequence
atggctgagctgagtgaaccagagggacccgtcgactggaaggagaggtgtgtggctttagagagtcaactgatgaaattccgagtgcaggcaagcaaaataagagaactgctagcggagaaaatgcaacagctggaacgtcaagtaatcgacgccgagagacaggctgaaaaagcattccagcaggtccaggtcatggaggataaactgaaggccgctaacatccagacctccgagtccgaaacacgactctacaataaatgtcaggacctcgaatccctgatacaagaaaaagacgacgtgattcaaaatctggagttgcagctggaagagcagaagcaaatcaggattcaggaggccaaaatcattgaagaaaaagctgctaagatcaaagagtgggtgaccgtgaaactcaacgagctggaactggaaaaccagaatctgaggcttatcaatcagaatcagaccgaggaaatacgaacaatgcagagtaaattacaggaggtacaggggaagaagagctccacggtgtcaacattgaagctcagtgagggccagcgcctgagctcattaacctttggatgctttctgagccgtgctagatcgccgccacaagtggttaaatccgaagagatgagtaagatctccagtaaggagcctgagttcacagagggtaaagatatggaggaaatggaaatcccggaaaaaagcgttgataaccaggttctcgagaacaaccgcggtcagcgtaccctccaccagactccatgcgggtctgagcagaaccgcaaaacgaggacaagcttcgctacagacggcggaattagccagaatagcggagcgcctgtgagcgattggtccagtgacgaagaagacggcagcaaagggagatctaaatctcggtgcacttcaaccttgagctctcacacctcagaggaaggggtccagtgcagcagaatgggcagtgaaatgtacctgacagcaagcgacgattcatcgagtatctttgaagaggaaactttcggcatcaaacgacccgagcacaagaaactgtattcctggcagcaggaagctcagtggaaggcgttaaacagcccattagggaagggcaacagtgagctgtcgaaaaaagaacaggacagcagcagcgacgagctgaataagaagttccagagccagaggcttgactactcaagttcctcatctgaggccaataccccatcgcccattctgacgccggctctgatgcccaagcatcctaacagcctcagtgggaaaggcactcaactggttccgagcagccatttgccgccacctaagctgcgcattcccaatgtgttctctatttcagttgcgctggcaaaaaggcacctgagtcaaccgcaattatccagtgacagaatgtttgggactaatcggaatgctattagcatgattaggcctctgcggccacaggagacagatcttgacttggttgatggagactcaaccgaggtattagagaacatggataccagctgtgatgacggcctcttctcatacgactcgctggatagtcccaacagcgacgaccaagaacactgtgactcagcaaaaaaggtggcttacagcaaaccccctacacccccactccaccgcttccctagttgggagtcacgtatttacgcagtggccaaaagtggcatcaggatgtcagaagcttttaatatggaatctgtaaacaaaaatagtgcggctacgcttagctacaccacatctggtctgtacacaagcctaatttataaaaacatgacaacacccgtgtataccaccttaaagggtaaagccactcaaatctcatcatctccatttcttgacgatagcagtggatccgaagaggaggattcatccaggtcttcgtctagaacatcagagtccgactcgcgctcccgctccggcccaggaagtcccagggccatgaagagaggggttagtctatccagcgtagccagcgaaagcgactatgccatccctcctgacgcctactccaccgatacggaatactcgcagcctgagcagaagcttccaaaaacttgttcgtctagctccgataatggtaagaacgaaccactggagaagtctggatacttgttgaagatgtccgggaaggtaaaaagttggaaacggagatggtttgtgctaaaagggggtgaactcctgtattataagtccccctcggatgttatccgaaaaccgcaggggcatatcgagctgtctgcatcttgctctatccttagaggcgataataagcagactgttcagctgactaccgagaaacacacctattatctcaccgcagactcccccaacattttagaggagtggatcaaagttctgcagaacgtcttaagagtccaggcagcaaacccgctgtctttgcagcccgaaggtaaacccaccatgaagggcctgcttacgaaggtcaaacacggatacagcaagagagtgtggtgcacccttataggcaaaacactttattattttcgatcccaagaggataaattcccactgggccagatcaagctgtgggaggctaaagtggaggaagtcgataggagctgtgactcagatgaggattatgaagcttccggcagatccctacttagtacgcattatacaatcgtgattcatccaaaggatcagggacctacatacctcttgattggctctaaacatgagaaagatacatggctttatcacctgacggtggctgctggatccaacaacgtgaatgtcgggagtgaatttgagcagctcgtatgtaagctccttaacatagatggggagccaagcagccagatttggcggcatcctaccctttgtcatagtaaagaagggatcatatctcccctcacgaccctgccaagcgaagcattgcagacggaggcaatcaagctgttcaaaacatgccagttatttattaatgccgctgtcgactctccagcaatcgattaccatatctccttagctcaatcggcgctgcagatctgtctcacccatccagagctccagaatgagatttgctgtcagctcataaagcaaactcggcgtcgccagccgcagaatcagcccggtcctttgcagggatggcaattgctggcattgtgtgtgggcctgtttctcccccatcatcccttcttatggctcctgcggctgcacttgaaacgcaacgccgactccagaacagagttcggtaaatatgccatatattgccagcgctgcgttgagcggacacagcagaacggggacagagaagcaagaccatcccgcatggaaatcttatccaccctgctgcggaacccttaccatcattccttaccattttccatccccgtgcacttcatgaatggtatttaccaagtcgtgggctttgacgccagcacaacggttgaggagttcctcaataccctgaatcaggacaccggaatgcgaaagcctgcccagtcgggttttgccctgtttaccgacgatccaagcgggcgtgatctagaacattgcctgcagggcaacataaaaatctgtgatattattagcaagtgggaacaggcctccaaagagcagcagcccggtaaatgcgagggaacccgaacagtgcgtctgacctacaagaatagactgtacttctccgtccaggcccgaggcgagacagacagagagaagctactactgatgtaccagactaacgaccagattattaacgggctcttccccctgaacaaggatttggcgcttgagatggctgcattgttgagtcaggtggaaataggggatttcgaacggcctttctcaacccccgcaggtcatgttacaaaccaatgcaaagtgaaccaaactctcaaacaggtcattgaaaagttctatcccaagaggtatcgggacgggtgttcagaagagcagctgcgccagctatgccagcggctgagcactcgctggatggccttgaggggacattctgctgccgactgtgtgagaatctatttgacagtggccaggaagtggcctttcttcggcgctaagctcttccttgcgaagcctatcacacctagttccttggggtctactttcctgtggcttgccgtgcacgaagacggcctgtcactccttgagtataacagcatgagactcatagtgagctacgtgtataaaagcctgatgacttttggaggctatcaagatgactttatggtcgtgatcaataacacacattcaaaggataagcctacggagaagttacttttcgcgatggctaagccaaagatcctggagattactcttctgattgcttcatacataaataacttccaccagcagaaggctgccttccatcatctgagtgctccggcactgctgtccgctcagactcggggacctcaggcacgcatgatgggttcgcagcctttgctctcatccagtcgcccaacaaagggtcccaccctgctatag

SEQ ID NO: 235191 - DNA, 2904 bp, Artificial Sequence
  Description of Artificial Sequence: Synthetic coding sequence
atggattggacccctcgcctaccttcccgtcatataatctcagaactggaacatcttacctttgtcaacacggatgttggccgatgtcgcgcttggctcaggttagcgctgaacgacgggctcatggagtgctatctcaaactgctgctccaggaacaggccaggctgcatgagtactatcaacccaccgccctccttcgggacgctgaggagggagagttcctgctgtcgttcctgcaggggttgaccagcctctcatttgaattaagctacaagagtgctattctgaatgaatggacattgacccccctagctctctccgggctttgtccactgtctgagttggatcccctgagcacttctggggcagagttgcagcgaaaagagagtctcgattcaattagtcattcatccggttcagaggatatcgaagtgcaccacagcggccacaaaataaggaggaatcaaaaactgacagcatcttctctgagccttgataccgcttcttcctcacagctctcatgctccttgaactcagactcctgcctgctccaggagaacggctccaagtcacccgatcattgcgaggagcctatgtcctgtgattccgacctcgggactgcaaacgctgaagatagtgatagaagtcttcaggaggtgctgctcgaattctcaaaggcacaggtgaattctgtgccaactaatggcctgtctcaggagactgagatcccaaccccccaggccagtcttagcttacacggacttaatacatctacatacctgcactgcgaggcccctgccgaacccctgccagcccaggctgcttctggaacacaggacggcgtccacgtgcaggagccacggcctcaagcgcctagtcctctcgatttgcagcagcctgtcgaatccactagcggccagcagccatcttcaaccgtctccgaaactgcgcgagaagtaggtcagggcaacggattgcagaaggcacaggcgcacgacggtgccggactgaaactagtggttagttctcctactagccccaaaaataaatcttggatatctgaggacgacttctatcgcccaagccgagaacaaccactagagtccgctagcgaccatcccatagcgtcttaccgaggaacacccggatctcgccctggcttacaccgccatttcagtcaggagccgcgtaaaaactgcagccttggcgctcttgaccaggcctgtgtcccatcacctggacgacgtcaagcccaggcagccccatcccaaggacataagagctttcgtgtagtgcaccgcagacagatggggctgtccaacccattcaggggcctgatgaagctgggtacagtcgaacgtagaggggcaatgggcatttggaaggagctgttttgcgagctgtcccccctggagttccgcctttacttgagcaacgaagagcacacatgtgtagaaaactgttccctgctgcggtgcgagagcgtggggccagcacattctgatgggaggtttgagctggtattctccggcaaaaaactggcactgcgggcttcttcacaggatgaggcggaagattggcttgacagggtgcgagaagcactccagaaagtcagaccccagcaggaggacgaatgggtgaacgttcaatacccagatcaacctgaggagcctccagaggcgcctcagggttgtttgtctccttccgacttactttctgaaccagcagctctgcaaggaacacagttcgattggagcagtgcgcaggttccggagcccgatgcgatcaaagagtcactgctctatctctacatggatcgcacgtggatgccgtatatattcagcctatccttggaggctctgaagtgttttcgcataagaaataacgagaagatgctgtctgactctcacggcgtcgaaacgatccgggacattcttcctgatacaagcttaggtggtccttcattcttcaaaatcataacggcgaaggcagtccttaagcttcaggccggtaacgcagaggaggccgcactgtggcgcgatctggtgcggaaagttcttgccagctacctagagacagccgaagaggcagttactctgggtgggagcctggacgagaactgtcaggaggtcctgaaattcgctacaagagaaaacggtttccttctgcagtacttggtggctattcctatggagaagggacttgattcccagggatgtttctgcgcaggctgctcacggcagatcggctttagttttgtgaggccgaagctgtgtgcattctcaggcctatactattgcgatatatgtcatcaggatgatgcgagcgttatccccgctcgcatcattcataactgggacttgacgaagagaccgatctgcagacaggctctaaagttcctcacacagataagggcccaaccactaatcaacttgcagatggtaaatgcctctttgtacgagcacgttgaacgcatgcacctcataggaagacgaagagaacagttaaaactcctgggagactatctcgggctctgcaggagtggcgctcttaaggagttgtctaagagactgaatcacaggaactacctgcttgaaagtccacatagattttcagtggcggacctccaacaaattgccgacggtgtgtatgagggatttctgaaagctttgattgagtttgccagccagcatgtttatcattgcgacttatgcactcagcgtggtttcatttgccaaatttgccagcaccacgacatcatctttccctttgagttcgacaccacagtgagatgcgccgaatgcaagacagtgtttcaccagtcttgtcaggccgtggtgaagaagggttgtcctcgatgtgccagacggcgtaagtaccaggaacagaacatcttcgcctag

SEQ ID NO: 235192 - DNA, 3171 bp, Artificial Sequence
  Description of Artificial Sequence: Synthetic coding sequence
atgcttagtgtggtggagaacggactggacccccaggccgcaattcccgtgatcaagaaaaaattagtgggcagtgtgaaggctcttcaaaagcagtacgtcagcctggatacagtcgtcacaagcgaagacggggacgccaatacgatgtgttctgcactagaagccgtgttcatccatggacttcacgctaagcacatccgcgctgaagcgggtggtaaaaggaagaaatccgcccaccagaaacccctcccacagcctgtgttttggccactgctcaaagcagtgacacataaacacataatcagcgagttggagcacctgacgttcgttaacaccgatgtgggcagatgccgtgcttggctgcgcctggcgctgaatgacggtctaatggagtgctaccttaagctcctgcttcaggaacaggctagactgcacgaatactatcagccaaccgcattactcagagacgctgaagaaggcgaatttttgctctccttcctgcaggggctgacttcactgtcatttgagctcagttacaaaagcgcaatcctgaatgagtggaccctgacccccttggcactgtctggtttgtgcccactgtccgaactggatccactttctacatccggagccgaactccagagaaaggagagccttgacagtatatcccactcttctgggtcagaagatatcgaggtacaccactccggccataagatcagaaggaatcagaaactcactgctagcagtttgtcactggacaccgctagcagttcccagctatcatgctcccttaatagcgactcatgtttgttacaggaaaacggctccaagagtcctgatcattgtgaggaacctatgtcctgcgacagcgacctagggaccgccaatgccgaagattcagaccggtctctgcaggaggtcctgctcgagttctccaaggcccaagtcaattctgttccgactaatggactctcccaggagacagaaatcccaacaccccaggccagcctcagcctacatggtctgaacacatctacctaccttcactgtgaagccccagccgagcctctacctgcacaggctgcttcgggcactcaggacggcgttcacgtgcaggaaccaaggccgcaggccccatcccctctcgacctccagcaaccagtcgagtctacttctggacagcagccaagctccacagttagcgaaaccgcacgggaagtgggtcaggggaatggtctgcagaaagcacaggcccacgatggcgctggattgaagctcgtggtgagctccccaacaagccctaagaataaatcatggatctccgaggatgacttctatcggccttctagagagcaacctttggagtctgcctcagatcaccccattgcttcctacagaggcactccaggctctaggcctgggctccaccgccacttttcccaagaacctaggaagaattgtagtcttggggctctggaccaagcctgtgtcccttcgccagggcgacggcaagcccaggccgctccaagtcaaggtcacaaaagctttagggtcgtgcaccggcgacaaatgggcctatcaaatcctttcagggggctcatgaaacttggtacggtcgaaaggagaggagctatgggcatctggaaagagcttttctgcgagctctcaccattagaatttcgcctgtatctgagcaacgaagagcatacttgcgtggagaattgtagtctcttacggtgcgagtcagtagggcctgcacattccgacggtagattcgagctcgtttttagcgggaagaagctagcccttcgcgcatcctctcaggacgaggcagaagactggctggatagggtgcgggaagctctccagaaagttcggcctcagcaggaggatgaatgggtaaatgtgcagtatccagaccagcctgaggagccccctgaagcccctcaaggctgcctaagtccctctgacctgctgtcggagccagcggcattgcagggaacacagtttgactggtcttcagcacaagtgcccgaacccgacgcgataaaggagtctctgctctacctctacatggatcgaacttggatgccctatatcttttcactctcactggaagccttgaagtgttttagaataagaaataacgagaagatgctgagtgactctcatggtgttgagaccatcagggatatactccccgacaccagcctcggtgggccttccttcttcaagattatcaccgccaaagctgtccttaaattgcaggccggtaatgcagaagaagctgccttgtggcgcgaccttgtcaggaaagtactggccagctacctcgaaaccgccgaggaggccgtgacgctcggcggttccctggacgagaactgccaggaagtgctgaaatttgctacccgagagaatggatttctgctgcagtatctagttgccatacctatggaaaaagggctcgattcacaaggatgcttttgcgccggttgttccaggcagatcggatttagctttgtcaggccaaaactgtgcgcattctccggcctgtattattgtgatatctgccatcaagacgacgcatccgtaatcccagccagaatcatccataattgggacctcacaaagcgtccaatctgccgccaggctcttaagtttctcacccaaatccgcgcacagcctctcatcaatctccagatggtgaacgccagtttgtatgagcatgttgaacgaatgcacctcattgggaggaggcgtgagcaactgaagttgctaggcgactacttggggctgtgccgttccggagctctgaaggaacttagcaagcggctcaatcatcgaaattacctgctcgaaagccctcatagattctccgtcgcagatttgcagcagatcgctgatggagtgtacgaaggattcttaaaggccctgattgagttcgcatcacagcacgtgtatcactgcgacctgtgtactcagagaggctttatctgccagatatgtcagcaccatgatatcatattccctttcgagtttgacaccacagttcgatgcgccgaatgcaagaccgtgtttcatcaatcctgtcaagcggtggtgaaaaaaggctgcccacggtgtgccaggaggcgcaagtatcaggaacagaatatctttgcatag

SEQ ID NO: 235193 - DNA, 3003 bp, Artificial Sequence
  Description of Artificial Sequence: Synthetic coding sequence
atggtggaatgtttcgagtctggaggaactaggcttagcctgtcctcttttaacgtatcatgcgattcgctgagggagcagctccgagagtggaggtgctttcagtggtggcgcatggattggactcctaggctgccctctcggcatatcatctcagaactcgagcacctcacctttgtcaacacggatgtggggaggtgtcgggcttggcttcgacttgcattgaatgacggtctaatggagtgctatttaaagctcctgttacaagaacaggcgagactacacgaatactatcaacccacggctcttctccgggacgcagaagagggggagtttttactgtcttttctgcagggccttacttccctgtcattcgagctgagctacaagtcggccatcctgaacgagtggactttgaccccattggcactttcggggttgtgccctcttagcgagcttgatcctctctccacttctggcgcagagctacagaggaaagaatcgctcgacagcatcagtcacagctccggctcggaagacatcgaggtacaccacagtggtcacaaaatccgcaggaaccagaaattaactgctagctccctttcgctcgacaccgcctcttctagtcagctgagttgttcgctgaactcagattcgtgcctgcttcaggagaacggcagcaaatcaccagaccattgcgaggagcctatgtcatgtgatagcgatctgggcacggcaaatgccgaggatagcgaccgaagtctccaggaagtcctgttggagttttctaaagctcaagtgaatagtgtccccaccaatggactttcccaagagaccgagatacctaccccgcaagcctcactgtcactccacggattaaatacctctacgtacctgcattgcgaggcacccgcagagccactccctgcacaagccgctagtggaacgcaggacggagtgcatgtgcaggaacccagacctcaagctccctcgcccttagacctgcagcagccagtggagagcacctctgggcaacagccctcttcgaccgtgtccgagacagccagagaagtaggtcaaggcaatggtctccagaaggctcaagcgcatgatggtgcaggacttaaattagtcgtaagctctcctaccagcccaaagaataaatcatggatttcggaggatgatttttacagaccttcccgtgaacagccactggaatccgcttctgatcacccaattgccagctaccgaggcactcctggttcacgcccaggcctgcacagacacttttcccaggaaccccgaaagaactgttcgctgggagcactcgatcaagcatgtgtgccttcacccggacggagacaagctcaggccgctcctagccaggggcacaaaagctttcgcgtggtccatcgcagacagatgggtctgtctaatcctttccgtggtctgatgaaattggggaccgtggaacgccgaggggctatgggtatctggaaggagctgttctgtgaactcagccccctggaattcagattgtatctaagcaatgaggaacatacctgcgtggagaactgcagtttgctccgctgcgagtccgtcgggcctgcccacagcgacggaagattcgaactcgtgttctcagggaaaaagctggctctccgcgcatcttcacaggatgaggcagaggattggctggatcgtgttagagaggcacttcagaaagtccgaccacagcaggaggatgagtgggttaacgtgcagtacccagatcagccagaagagcccccagaagccccacaggggtgcctatctcccagcgacctgttgtccgagccagccgcactacagggcactcaatttgactggagctctgcccaagtcccagaacccgacgctattaaggagtcactcttgtatttatatatggatagaacttggatgccctatatcttctccttatctctggaggcgttgaaatgctttcggattagaaacaatgagaaaatgttgagcgactctcacggtgtggagactataagggacatactccctgacacctcattagggggaccttcctttttcaagattattacggcaaaggctgttctgaaactccaggcagggaatgccgaggaggctgccttgtggagagacttggttcgcaaggtgctggcgtcttatttagaaacagccgaggaggctgtaactttgggaggatcattggatgagaattgtcaggaggtgctgaaattcgccactcgcgagaacggtttcctgctccagtatttggtggccatcccaatggagaagggtctcgattcccagggctgtttttgtgctggatgcagcagacaaattggcttctcgttcgtacgacctaaactctgcgcgttcagcggcctctactattgcgacatttgtcaccaggatgacgcaagcgtaattcccgcacgcataatccacaactgggatcttacaaagcgacccatctgtaggcaggcactgaaattcttaactcaaattagagcccagccattaataaatttacaaatggtgaatgcctctctgtacgagcacgtagaacgtatgcacctcatagggaggcgtcgggagcagctcaagttgctaggtgattaccttggtctatgcagatctggggctctgaaggaattgtccaaacgacttaatcatcggaattatctgctagagtccccccaccgttttagcgttgccgacctccagcagatcgctgacggtgtttacgagggctttagccccaaagtgccaagtgaggccgcaggattaagaccgtggggagcccgatcccctgaagcagcatccgcgttccgatgcatcgattcgagccggctgccaagcctgcgaaaggtggtgccgactttgtttcttaaatgctattttatgcaatatacagtgccctccgaacagggatccggtcccgaggaatctcttcagtgcatcgaaggcatagccgcagtttag

SEQ ID NO: 235194 - DNA, 5466 bp, Artificial Sequence
  Description of Artificial Sequence: Synthetic coding sequence
atgagttgcgagagaaaaggtttgtctgaactccgaagtgagctgtactttctgatcgcccgattccttgaggatgggccttgtcaacaggctgcgcaggtactcatccgagaggtggcggaaaaggagttgctccccagaagaaccgattggacagggaaggaacatccgcgaacttaccaaaatttagtgaagtattatcgacacctggctcctgatcatctgctgcagatttgccacagactcggaccgctgcttgaacaagaaataccccaaagtgtgcccggagtccagaccttgttaggagctgggaggcaatcactgctccggactaacaagagctgcaaacacgttgtgtggaaggggtctgccttggcggctctgcattgcgggagacctccagagtcccctgtgaactacggctcccccccatcaatcgcagataccctattttcacgcaagctcaatggaaaataccgattggagagactcgtgcctactgccgtctatcagcacatgaagatgcacaaacgcatcctggggcacctgtcctcagtctattgcgtaacctttgacaggaccggacggagaatcttcactggatccgacgattgtttagtgaaaatctgggcaactgacgacggcaggctcctcgccacattgaggggccatgcggcagaaatcagtgatatggcagtgaactacgagaatacgatgattgctgcaggttcgtgtgacaaaatgatccgagtatggtgcctgaggacctgcgcgcctctcgctgtgctacaaggacactccgctagcatcacttctcttcaattttctccactgtgtagtgggagtaaacgctacctgtcatctactggcgcagatgggacaatttgtttttggctttgggacgcaggcaccctgaaaatcaaccctaggccagccaagtttacggaaagacccaggccgggagtgcagatgatttgcagttcattcagcgccggaggtatgtttcttgctacgggcagcacagaccacataattcgagtttatttctttgggtctggccagcccgagaaaatctccgagcttgagttccatactgacaaagtcgactcaattcaattctcaaacacctctaacagattcgtgtcagggagccgcgatggtaccgctcggatctggcagttcaagagaagagagtggaagtctattctcctggacatggcgacgaggcccgcagggcagaatctgcagggtatcgaggacaaaatcacaaaaatgaaggtcaccatggtagcctgggataggcacgataacaccgttattaccgcagtaaataatatgactctgaaggtgtggaatagttatacaggccagcttattcacgtgcttatgggccatgaggacgaggtgttcgtgttggagcctcatccctttgacccccgtgtgctctttagcgccggacacgacggtaacgttatagtttgggaccttgcaagaggcgtaaagatacgtagctacttcaatatgatcgagggccagggccacggcgcagtgttcgattgtaagtgcagtcccgatggtcaacacttcgcttgcaccgattcacatggacaccttctcatcttcggcttcgggtctagtagcaagtacgacaagatagccgatcaaatgttttttcattctgattatcgtccactgatcagggatgccaacaacttcgtgttggacgagcagactcagcaagctccccacctgatgcctcctccgtttctcgtggacgtggacggtaatccgcatccttcacggtaccagcgccttgtgcccggacgagagaattgtagggaggagcagttgatccctcagatgggagtgacttcttccggactgaatcaagtactatctcagcaggccaatcaagaaatcagcccactggacagtatgatccagcggcttcagcaggagcaggacctgcggcgtagtggcgaggccgtgatctccaatacttccagactgtctcgcggtagtatttcttcgacatccgaagtgcatagtcctccaaacgtggggcttaggcgctccgggcagatcgagggtgtcagacaaatgcactcgaatgcacctcgatctgagatcgcaacggaaagagatttagttgcctggagtcgtagggttgtggtgccagagttaagcgcaggcgtggcctcaagacaggaggagtggaggacagccaaaggtgaagaggaaatcaaaacctaccgcagcgaagagaaacggaagcacctgaccgtgccaaaggagaataaaatcccgacggtctctaagaatcacgcccatgagcacttcctcgaccttggggaatccaaaaaacaacagaccaaccagcacaattaccgcacccggagcgccctggaggagacccctcgaccaagtgaagaaattgaaaatggctccagctccagcgacgagggggaagttgtcgccgtctctggcggaacatcagaggaagaggagcgcgcatggcattcggatgggagcagctccgattacagtagcgattatagcgactggactgccgacgcaggaatcaatcttcaacctcccaagaaagtgccaaagaacaaaaccaagaaggcagaatccagctcagatgaagaagaggaaagcgagaagcaaaagcagaagcaaattaaaaaggaaaaaaagaaggtcaacgaagagaaggatgggccaataagcccaaaaaagaagaagcccaaagaacgtaagcagaaaagactggccgtaggtgaactcactgagaacgggctgaccttagaggaatggctccccagcacttggatcaccgacacgattcccaggagatgtcccttcgtaccgcagatgggagacgaggtgtattatttccggcaggggcatgaggcctatgttgagatggccagaaaaaataagatctactcgatcaaccccaagaagcagccatggcacaaaatggaactccgcgagcaagaactcatgaaaattgtggggataaagtacgaagtgggcctgccaactctgtgctgtctcaagcttgcatttctggaccccgacacaggtaaactcacaggcggaagctttacaatgaagtaccacgacatgcccgatgttatcgattttcttgtgctgcgacagcagttcgatgacgctaagtaccgacgttggaatattggagaccgcttcagaagtgtgatagacgacgcgtggtggttcggcactattgagtctcaggagccgctgcagctagagtaccctgactctctgttccaatgctataatgtgtgctgggacaacggagatacagagaagatgagtccttgggacatggaactgatccctaataatgccgtgttccctgaggaactcggtacgtctgttcccctgaccgacggagagtgtcgctcccttatctataagcccttggatggcgagtgggggactaaccccagggacgaggagtgtgaaagaatcgtggctggaatcaaccaactcatgaccttggacattgcatctgccttcgtggctcccgttgacctgcaggcctaccccatgtactgcaccgtcgtggcatatcctacagacctctcgactataaaacagaggctggaaaaccgcttctacaggagagtctcttcccttatgtgggaggtcaggtacatcgagcacaacacccgtacatttaacgaaccaggcagccctatcgtgaaaagtgcaaaatttgtgaccgacctgctcctgcacttcatcaaggatcagacatgctataatatcattcccctgtataacagcatgaaaaagaaggtgctttccgacagtgaagacgaagagaaggatgctgatgtgccgggaacctctactcgtaagcgcaaggatcaccagccaagacgccgactgcgcaacagggcgcagagctacgatatccaagcctggaaaaagcagtgtgaggaacttcttaatcttattttccagtgcgaggattcagagcccttccgacagcctgtagatctgttggagtatccagattaccgggatatcatcgatactcccatggactttgcgacggtaagggagacactcgaggcaggcaactatgaaagccccatggaactgtgcaaggatgtaaggctgatttttagtaacagcaaagcctatacacccagtaaaaggagtcggatttacagtatgtctctgagactatccgctttcttcgaagagcatattagcagcgtactcagcgactacaagtccgctctccgatttcacaagagaaataccattacaaaacggagaaagaagaggaatagatcttcatctgtgtctagctccgcggctagttcgcctgagagaaagaaaaggatcctgaagccgcagttgaaatccgaaagctcaacctctgcgttcagcaccccaacccgatccattcctcccaggcacaacgcagcacaaatcaacggaaagaccgagagcagtagcgtcgtacgtacgcggtccaaccgagtcgtggtggaccctgtggtgactgaacagccctcaacgtcctccgcagccaagactttcattacgaaggctaatgcatccgccatccccggaaagacgatcctcgaaaacagcgtgaagcattccaaggcactgaacacattatcctctccaggacagagcagtttttctcacggtacacggaataattccgccaaggagaacatggaaaaagagaagccggttaaaagaaagatgaagagctccgtcttacccaaagccagcactctgtctaaatcttcagccgtgatcgaacagggcgattgcaagaacaatgctctagtgcctggtactatccaagtcaatggtcacgggggacagccttccaaattagttaaaagaggcccaggtcgaaagcctaaggttgaggtgaataccaactctggcgaaatcatccataaaaagcggggacgcaaacccaaaaaacttcagtacgccaagcctgaggatctggagcagaacaacgtccaccccatccgcgacgaagtactgccatctagcacatgcaactttctgtccgagacaaataacgtaaaggaggacctgctgcagaagaagaatagaggaggaagaaagccaaaacgaaagatgaaaacacagaagcttgacgcggatctgctggtgccggcatcagtcaaagtgctgcggcgaagcaatcgcaagaaaatcgacgatcccatcgacgaggaagaggagtttgaagaactgaagggatctgaaccacacatgcgcactaggaatcagggacgcagaaccgcattttacaatgaagacgatagtgaggaggagcagcgccagctgctctttgaggacacgtctcttactttcggaacctcatctcggggaagggtgaggaagttaacagagaaagccaaagctaacttgattggctggtac

SEQ ID NO: 235195 - DNA, 1197 bp, Artificial Sequence
  Description of Artificial Sequence: Synthetic coding sequence
atgaagaagaaggtgttgtctgactctgaggatgaagagaaggacgcggacgttcctggcacatctacccggaagaggaaagaccaccagccgcgtcgacgactcagaaatcgcgctcagtcatacgacatccaggcctggaagaaacagtgtgaagaacttttgaatctgatttttcagtgtgaggacagcgagcctttccgacagcccgttgatctcctggaataccctgactaccgcgatattattgatacgcccatggactttgcaaccgtacgggaaaccctggaagctggaaattacgagtcccccatggagttgtgtaaggatgttcggcttattttcagcaactccaaagcctataccccctcgaagcgctctcggatttattctatgtcgctgagactttcagcctttttcgaagagcatatcagtagcgttctgtctgactacaagagcgcccttcggtttcacaagcgcaatacgataacgaagcgcagaaagaagcggaataggagttcatctgtctcatcttcagctgccagctcgcctgagcggaagaaaaggattcttaaaccccagcttaagagcgagagcagcacaagcgcattcagtactccaacccggtctatcccccctcgccacaatgcagcacagatcaacggcaagaccgagtcctcttcagtggtgcggacacggtccaatagggtggtagtggatccagtcgtgacagagcagcccagcaccagctccgcagcaaaaacttttattactaaggcgaatgcctcagctatcccaggcaaaacaattctcgagaacagtgttaagcacagtaaggccctgaatacactgagttcacctggtcaatcatccttcagccacgggacgagaaataactcagccaaggagaacatggagaaagaaaaacccgttaagcgcaaaatgaaaagtagtgtgctgcctaaagccagtacactgtcaaagagctccgctgtaattgagcagggcgattgtaaaaataatgctctggtgcccggaacaattcaggtgaatgggcacggtggacaaccatccaagttagttaagagggggccaggaaggaagcctaaggtggaagtgaatatcgtggtcaaactgtataccaggaagggagtcgaatccccaaagagctactcaatgcaatcacaaaagatctag

SEQ ID NO: 235196 - DNA, 1206 bp, Artificial Sequence
  Description of Artificial Sequence: Synthetic coding sequence
atgcgcagggctcctgctgccgagaggctgttagagctgggtttcccccctcggtgcggtcgccaagagcctcctttccctttaggtgtcactagaggctggggccgttggcccatccagaaacgtcgcgagggagcgaggccagtccctttttccgagaggtcccaagaggacggcagaggaccggcagctcgttcctccggtactctttggcgaattcggacaaggttgagcctgtgtagggatcccgaaccgccacctcccttgtgtctcctgcgagtgagcctcttgtgcgccctgcgtgcagggggaaggggcagtcggtggggagaggatggtgcgagactgcttctcctcccccctgctagggcggcaggtaacggagaggccgagccatcagggggacctagctacgccggaaggatgctagaatcctctggctgtaaagcgctgaaggaaggggtactggaaaagcgatccgatggcctgttgcagctgtggaaaaagaagtgttgtatcctgaccgaggaaggtctgctgctgatcccccctaaacaattacagcatcagcaacagcagcagcagcagcagcagcagcagcaacagcaacagcctggacagggacctgccgagccgtcgcaacccagtggccctgctgttgcgtccctggagcctccagtgaagctgaaagaactccatttcagcaatatgaagactgttgactgtgttgagcggaaggggaaatatatgtactttactgtagtcatggcggaggggaaggaaattgactttcgctgccctcaggaccaagggtggaacgctgaaattactttacagatggtccagtataaaaacaggcaggctattcttgccgtcaaaagcacaagacagaaacagcagcatttggttcaacaacagcctccttctcaaccgcaacctcagccccagttacagcctcagccccagccacaaccacagccccagccgcagccacaaagccaaccgcagccccagccccagcccaagccacagccacagcagttacatccttatcctcacccacatccccacccacacagccacccccatagccacccacacccccatcctcacccacacccccaccaaatcccacaccctcacccacagccacatagccagcctcacgggcatcggctgctgcgcagtacttccaattcggcctag

SEQ ID NO: 235197 - DNA, 660 bp, Artificial Sequence
  Description of Artificial Sequence: Synthetic coding sequence
atgctcgagtcgagcgggtgtaaagcccttaaggagggcgttttggaaaagagatcggacggactgctgcagctgtggaaaaaaaagtgctgtatcttgaccgaagaagggctcctcctcattccccctaaacaactgcagcaccaacagcagcagcagcagcagcagcagcaacagcagcagcagcagcccggtcagggaccggctgaaccatcccaaccatctggaccagccgttgctagtctggagcccccagtcaaattgaaggagctgcacttctctaatatgaagaccgtggattgtgtggagcgaaaaggtaagtatatgtacttcactgtggttatggccgagggaaaggagatcgatttcaggtgtccgcaggatcagggttggaacgcagagataaccctacagatggtccagtataagaacagacaggccatcctggctgtgaagagcacacgacagaagcagcaacatctcgtccagcagcagcttcacccatacccccatccccaccctcacccccacagccaccctcattcccacccacatccacacccacacccccatccccatcagatcccccatccgcaccctcagcctcatagccagccacatggacacaggctgctgcgatctacaagtaactccgcctag

SEQ ID NO: 235198 - DNA, 459 bp, Artificial Sequence
  Description of Artificial Sequence: Synthetic coding sequence
atgaagtccccagacgaagtcttacgggaaggagagctcgaaaaacggtcggacagcctatttcagctatggaagaagaaacggggtgtattaacctctgatcgactttccctctttcctgcatctcccagggcacgccctaaagagctgcggttccactctattttaaaggtagattgcgtggagcggactggaaaatacgtctatttcacaatcgtaacaaccgatcacaaggaaattgacttccggtgcgccggtgagagctgctggaacgctgccattgccctggctttgatagactttcagaatcggagggccctgcaagactttcgatccagacaagagcgcaccgcccctgcggcaccggctgaagacgcggtggccgctgctgctgcggcaccctctgagccgagcgaaccttccagaccttccccacagccaaaacctcgaaccccgtag

SEQ ID NO: 235199 - DNA, 3960 bp, Artificial Sequence
  Description of Artificial Sequence: Synthetic coding sequence
atggacgcacttaatcgaaaccaaatcggccctggctgccaaacacaaacaatggttcagaaaggcccactggacctgattgagacgggcaaaggcctgaaggtgcagaccgataaaccacatctcgtgagcttagggtccgggaggttgtctaccgccatcaccttacttcctctcgaggagggcagaactgtcattggcagtgccgctcgcgatatcagtcttcagggtcccggtttagctcctgagcactgctatattgagaatttgcgcggtacactcaccctctacccatgcggaaatgcctgtacaatcgacggactaccagtccgtcaacctactaggctaactcaagggtgtatgctatgtctgggacagagtactttcctccgtttcaaccatccagcagaagcgaaatggatgaagtccatgatacctgccggaggacgcgcacctggacctccttattcacctgtgcctgcagaatccgaatccttagtcaatggcaaccacaccccacaaacggctacccgcggacctagtgcctgtgcgagtcactcaagcctggttagcagtatcgagaaggatttgcaggaaattatggatagcctggtacttgaagagccaggcgcagctgggaagaagccggcagcgacttctcccctgtcaccgatggctaacggtgggaggtatctgctcagtccccctacgagcccaggggctatgagcgtcgggagctcctatgaaaacaccagtcctgctttcagtcccttgtcctcacctgcaagcagcgggagctgtgctagccactcaccctcaggccaagaacctggtccttctgttccacctctcgttccggcacgctcgtcctcataccatcttgctctccagcctccgcagtcacggccttcgggggcacggtcggagtctccgagattgagccgcaagggcggacacgaacgtccaccctctccaggactgagagggcttctgacggactccccagccgctacagttttggcagaggctagaagggctacagagtcgccacggctgggcggacagttgcccgtggtggccatctccctaagcgagtacccggcaagtggagccttatcacagcccacctctattcccggttctcccaaattccagcccccagtgccagcgcctcgaaacaaaattggcacacttcaggaccggcctccatctccctttcgcgagcctcccggaagtgaacgcgttctgaccaccagccccagtcgacagctcgttggcagaactttctcagacgggttagctactcgcacgcttcagcccccagagtcaccaaggcttggacgcagaggcttggactccatgcgcgagttgccccctcttagcccttccctcagtagaagagccctcagtccacttccgacacgtacaactccagatcctaagttgaatcgggaagtggctgagtcacctcgccctcgcagatgggccgcacacggggcttctcccgaagatttttcattgacactgggcgcacgtggaaggagaacgcggagcccgtcccctacactgggcgagagcctcgctcctcacaaagggtcattctccggaagactgtcacctgcctactccctaggttctctgacaggcgcaagcccatgccaatctccatgtgtccagcgcaaactgtcctcaggggatttacgtgtgcctgtcacaagggagaggaaaaatagtatcaccgagatttccgacaacgaagatgatcttctggagtaccatcgtcggcagcgacaggaaaggttgagagagcaggagatggagcggttagaaagacagcgccttgaaacgattttgaacctctgcgctgagtatagccgggcagatgggggaccagaggcaggcgaattgccttccattggtgaggctaccgcagctttagcactggcagggagacggccttcacggggactagccggagctagtggtagatcttctgaagagcctggagtggccacacagcggctctgggaatctatggaacgatctgacgaagagaacctcaaggaggagtgttcctcgaccgagagtacccaacaggagcacgaggacgcgccaagcacgaagctgcagggggaggtcctggcgttggaagaagaacgggcacaagtattaggccacgtggaacagctgaaagttcgagtgaaagagctggaacagcagttgcaagagtccgcccgagaagcagagatggagcgagcgctgctgcagggggaacgagaggcggagagggctctgctgcagaaagaacagaaagccgttgatcagctgcaggaaaagcttgtggcgttggagactgggatccagaaagagcgcgacaaggaggccgaagccttggagaccgagactaagctgttcgaggatcttgaattccaacagcttgagagagagagcagagttgaagaggagagggagctggccggtcagggcctgctccggtctaaagccgagcttctgcggtccattgctaagcgcaaggagagactggccattctggactctcaggccggtcagatccgagcccaggcggtgcaggaatcggaacggcttgcaagggacaagaacgcttcgctgcagctgctgcagaaagagaaggagaaactgacggttctggagagaagataccatagcctgactggtgggcgacctttcccaaagactacctctacgcttaaggaggtctacaggagtaagatggacggtgaggccacttcccctctgcctcggacacgctccggccctttgccctcctccagcggtagcagctcctcttcgtctcaactaagtgtagccaccctcggaagaagtccctcccctaagagtgcactgctgactcagaacggcacaggaagtctgcccagaaacttggccgctaccctgcaagatatcgaaacaaaacggcaactggctctgcagcagaagggtcaacaggtcattgaggagcagcgaagacgattagctgagctgaagcaaaaggccgctgccgaggcccaatgccagtgggatgcactgcatggagcagcaccgtttcctgcaggaccttctggcttcccacctctgatgcaccacagcatcctccatcatctgcctgcaggaagagaacggggagaagagggggaacatgcctacgacactctgtctctggagagcagcgactctatggagaccagcatttccactggcggtaattccgcgtgttccccagacaatatgtcttccgcttccggtcttgacatgggcaaaatcgaagaaatggagaaaatgctgaaagaagctcacgccgagaaaaatagactcatggagtcaagagaaagggaaatggaactccgaaggcaggccctagaagaagaacgaagaagaagagaacaagtggaacgtagattacagtccgaaagtgccagaagacaacaactggttgaaaaagaggtgaagatgcgggaaaaacagtttagccaggcaaggcccctgacgcgttacctccccattcgaaaggaggattttgacctgaaaacacacattgagagctcaggacatggggtggatacctgtcttcacgttgtgctttcatctaaagtgtgtagggggtacctcgtaaaaatggggggaaaaatcaagtcttggaagaaacgttggtttgtattcgatagactgaaaagaactttatcttactatgtggataagcacgagactaagcttaagggcgtgatttacttccaagccattgaggaagtgtattacgatcatctaagaagcgcagccaaatcccctaaccccgctcttactttttgcgtgaaaacccacgaccggttatactatatggtggcgcctagtgccgaggccatgcgtatatggatggatgtaatcgttactggagctgaggggtacacccaatttatgaattag

SEQ ID NO: 235200 - DNA, 2193 bp, Artificial Sequence
  Description of Artificial Sequence: Synthetic coding sequence
atggagcgatctgacgaagaaaatctgaaggaagaatgttccagcacagagtcaacccaacaggaacacgaagatgcacctagcaccaagcttcagggggaggtcctggccctcgaagaggaacgcgctcaggtcctggggcacgtcgagcaacttaaggtccgcgttaaagaactggagcaacagctgcaggagtccgcaagagaagccgagatggaaagagccctgctacagggtgaaagggaggcagaacgagcattgttacagaaagaacaaaaggccgtcgaccagctgcaagaaaaattagttgccctggagacgggaattcaaaaggaacgcgacaaagagcgggcagagctggccgcaggcagaagacatctagctcgacaggccctgtatgcggagctgcagacccagctagataattgccccgaatccgtgagggagcagctgcaagagcaactgcgtcgtgaggcagaggcccttgagacagaaaccaagttatttgaggatttggaattccagcagctggaacgagaatcacgggtcgaagaggaacgtgaactcgctgggcagggcttgctacgctcaaaggcagagctcctgcggagcatagctaaacgcaaggaaagactggccatcctcgactctcaagctgggcaaattcgcgcacaggccgtccaggaaagtgagagactcgccagagacaagaacgcttcccttcagctcctccagaaggagaaggagaaattgaccgtgctggaacggagataccattccttaactggtggcagaccctttcctaagaccacatctactcttaaagagatggagaaattactcctgcctgccgtggacctggagcaatggtaccaggagctgatggccggtctggggactggaccggcagccgcatcacctcactctagtccaccccctctacccgcaaaagcgtcccggcagctgcaagtgtatcgtagcaagatggatggggaggccacatccccactgcctagaactaggtccggcccacttccttcttcatctggctccagcagcagctccagtcaactcagcgtggcaacactggggaggagcccgtctcctaagtccgcactactgacacagaatggtactgggagcctcccacgaaacctggcagcaactctccaggatattgagacaaagcggcagctcgctctgcagcagaaaggtcagcaggttattgaggagcagcgtagacggctcgctgagctcaagcagaaggccgctgccgaggcacagtgtcaatgggacgcacttcacggcgcagctccattccctgcaggacctagcggctttcccccacttatgcatcactctattctgcatcacttgccagcagggagagaaaggggagaggagggggaacacgcttacgacacgctgtctctggaatcttccgatagcatggagacttccataagcaccggcggaaatagtgcctgctctcctgataacatgtcttctgctagcgggctggacatgggtaaaatcgaggaaatggagaaaatgctgaaggaagctcacgctgaaaagaatcgactcatggagagtagggaacgcgagatggaactgcggaggcaggctctcgaggaagagaggagaaggagagaacaagtcgaacgtagactgcaaagcgaatctgccagaagacagcagttggtggaaaaagaggtgaaaatgcgggaaaaacagttctcacaagccaggccgttgactagatatcttccaatacgcaaagaggacttcgatctgaaaacacatatagaaagctccggtcacggcgtcgatacctgccttcatgtggttctttcgagcaaagtgtgccggggatatttagtgaagatggggggaaaaatcaaatcatggaagaagagatggtttgtgttcgaccgactgaagcggacactgtcttactatgttgataaacacgagacaaaactcaagggggtcatttactttcaggcaatcgaggaagtttactatgaccatctgcgttctgccgctaaatcccctaaccctgccctcacattttgcgtcaagacacacgatagactctattacatggtcgcccctagcgccgaggcaatgcggatttggatggacgtgatcgtcaccggcgctgagggttatacacagtttatgaattag

SEQ ID NO: 235201 - DNA, 4134 bp, Artificial Sequence
  Description of Artificial Sequence: Synthetic coding sequence
atggacgctctgaacagaaatcaaatcgggccagggtgtcagacacagaccatggtgcagaaagggcctctcgacttaatagagacgggcaaggggttaaaggtgcagaccgacaaaccccaccttgtgagcctcgggagcggcagattatccacggcaataactcttctgccgttggaggagggtaggaccgttattggttccgctgcccgtgatatctccctgcagggacctggactggcgccagagcactgctatatcgaaaacttaagaggaacactgacgctctacccctgtggcaatgcatgcacaatagatggcttgcctgtgcggcagcccacgagattgactcaggggtgtatgttgtgtctcggccaatcaaccttcctgcgatttaaccaccctgccgaggcaaagtggatgaaaagtatgattcccgcaggaggtagggctcccggtcccccttatagccctgttcccgctgaaagtgaatcccttgttaacggtaaccatacaccgcagacagctacccgtgggccatctgcctgtgcaagccacagctctcttgttagttctatagaaaaagacctccaggagatcatggactctcttgtgctcgaggagcctggtgccgcagggaagaagcccgctgccacaagtcccctatccccaatggccaatgggggacgttacctgctgtcacctcctacgtccccgggagccatgagtgttgggtccagttatgagaacacaagtcctgccttttctccgctctccagccccgcttcttccgggagctgtgcgtctcatagcccttcagggcaggagcctggtccatctgtgcctcccctcgtcccagctcggtcatctagctatcacttggcgctgcagccccctcaaagccgcccatcaggcgcaaggagcgagagtcccagactgtccaggaaaggaggacatgaacgaccaccatcgccgggtctgcgcggtctgctgactgacagcccagcagctaccgttctggccgaagctcgacgagccactgaatcacccaggctggggggtcaactcccagtcgtcgccatctcccttagcgagtatcctgcatcaggagcactgtcacagcctacttccatcccagggtcccctaaattccagccaccggtgcctgcccctcgaaacaagatcgggacccttcaggacaggcctccttcaccttttagggagccgccaggctctgagcgggtccttacaaccagtccctctcgacaattggtaggcaggacattctcagatggacttgctactcgtactctgcaacctcccgagtctcccaggttgggaaggcgtgggctggactctatgcgcgagctgcctccactgtctccatccttatctcgccgagcactgagtcccctgcctactaggaccacccctgacccaaagctcaatcgggaagtagccgaatcacctagaccacgcaggtgggccgctcatggggcttcccccgaggattttagtttgacattaggcgcaagagggcgaaggacccgttccccatcccctaccctgggtgaatccctagcacctcacaaaggcagtttctctggccgactctcgcccgcatatagcctgggatccttgaccggagcttcaccttgccagtcaccgtgcgtgcagagaaaattgtccagcggggacctgcgagttcctgtcacacgcgagagaaagaacagtatcactgagatttccgataacgaagacgatctgctggagtatcacagaagacaaaggcaggaacgattacgcgaacaggagatggagaggcttgaacggcagagattagagaccatactcaacctctgtgcagaatactctcgggcagacggaggacctgaagctggcgaactaccaagtattggagaagctaccgctgccttagctctggccggacgcagaccaagcagaggactcgccggagcctcaggacgcagctccgaggaaccaggcgtagccacacaaaggctgtgggaaagtatggagaggagcgatgaggaaaatctcaaagaggagtgcagctcaaccgagtccacccagcaggagcatgaagatgccccaagcacgaagttgcaaggggaagtcctggctcttgaggaggagagagctcaggttttgggacatgtggagcagttaaaagttagagtaaaggaactggagcagcagcttcaggagagcgcccgagaggccgaaatggagcgcgcactattgcagggggagcgcgaagcagaaagagccctcctgcaaaaagagcagaaggctgttgatcaactgcaggagaagcttgtggccttagagaccggaatccagaaagagagagacaaggaagctgaggccctcgagaccgaaactaaactctttgaggatctggaattccagcagttagagcgtgaaagtcgggtggaggaggaaagagagctggccggacaggggctgctccggtctaaagccgagctgctgcgcagtatcgcaaagcgcaaggagagactggcgattctggattcccaggccggacagatccgcgcacaagctgtccaggaatccgagagactggctcgtgataagaatgcttctcttcagttgctacagaaggagaaagaaaagctgaccgtgctcgagcggagataccactcactgactgggggacgtccttttcccaagacaacgtctaccctaaaggagatggagaagttattgttgcccgctgtggatctggagcagtggtatcaagagttgatggcagggctcggcaccggacctgccgcagcatcaccccactcctctccccctcccctgcccgctaaggcatctcgccagctccaagtgtaccgctcaaagatggatggcgaagccacctctcccctgcccaggaccagatccggcccactcccctcaagcagtggtagttcttccagtagctctcagctatcagtggctacgcttggacgatccccctccccaaaatctgcgctgctgactcagaatggcactgggagtctgcctcgtaacctcgctgcaactctgcaggacatcgagacaaagcgccagttagcccttcagcaaaagggccagcaggtcattgaggaacagaggcgccgtcttgctgaacttaaacagaaggccgcagcagaggcccagtgccaatgggatgccctacacggtgccgctccatttccggcagggcctagtggcttcccacccttaatgcaccattccatactgcatcatttgcccgctggaagagagcgcggtgaggagggagaacacgcctatgacaccctgagtctcgaaagcagcgactcaatggagactagtatcagtaccgggggaaatagtgcgtgctcgcccgataacatgagtagcgcgagcggtctggacatgggcaaaatagaggagatggaaaagatgctcaaagaggctcacgccgagaagaatcgattaatggaatctcgcgaaagagagatggagttgagaaggcaggccttggaggaggaacggagacggcgagagcaggtggaacggcgactccagtccgaatctgcacggaggcaacaactggtcgagaaagaagtcaagatgagggagaagcagttctcacaagccagaccgctgacccgatatctgcccattaggaaggaagattttgacctcaagacccacatcgaatcaagcggacacggagtcgatacctgtttgcacgtggtactgagcagcaaggtgtgcagggggtatttggttaagatgggtggcaagatcaaatcatggaagaaacgttggtttgtgttcgatcggttgaagcgcacgctgtcctactacgtggacaaacatgagacgaaacttaagggagtcatttacttccaggcaatcgaggaagtgtactacgatcatcttcgaagcgcggcaaagaagcggtttttccggttcacaatggttaccgagtctcccaatcccgcactgacgttttgcgtgaaaacgcatgaccggctgtactacatggttgctccaagcgccgaagccatgcgtatctggatggacgtaatagttactggagccgagggctacactcaattcatgaactag

SEQ ID NO: 235202 - DNA, 3423 bp, Artificial Sequence
  Description of Artificial Sequence: Synthetic coding sequence
atgagcgtcggctccagctatgagaataccagtcctgcgttttcccctctaagcagcccagctagcagcggctcctgcgcctcccactccccatccggccaggaaccaggccctagcgtgccaccactcgtccctgccaggagctctagctatcacctcgctctccagcctccccaatccaggccatccggagccagatctgaatctcccaggctcagccggaagggtggccatgagcgtcccccatctccaggcctccggggtcttctcacagattctcctgctgcaaccgtgctcgcagaagctaggagggcaaccgaatccccaaggctcgggggacagttacccgttgttgccatctccctatctgaataccctgcatccggagcactgtctcagcctacaagtattcctgggagccctaagttccagcccccagtgcccgctcctcgaaataagattgggaccctccaggatagacctcctagcccctttagggaacctcccggatctgagagggtcttgactaccagtcccagccggcagctggtgggccgaaccttctccgacggccttgccactagaacgctccagccacctgaatcacccaggctcggaagaaggggcctggactcaatgagggaactgccacctttgagtccctctttatcacgccgagcactcagtcccctcccgactagaaccacaccggaccccaagctcaatcgtgaagtggccgagtcaccaaggcccagaagatgggcggctcatggcgcatctcctgaggacttctcgctcactctcggcgctcggggacgtagaacccgatcacctagccctactcttggagagtcccttgcaccccataagggctccttttcagggcgactgagccccgcttattctcttggttccctgaccggcgctagcccatgccaaagcccatgtgtccagcggaaactctctagcggcgacttgagagtacctgtaactcgtgagcggaagaactcgattactgaaatttccgacaacgaggatgatctgttggagtatcaccgacgccagcgacaagaacggcttcgagagcaggaaatggagagacttgagagacagcggcttgagactatccttaacttatgtgctgaatactcacgcgctgacgggggacccgaagcgggtgagttaccttctatcggcgaggcaaccgctgctctcgcattagcagggagacggccaagcaggggattggccggagcttctggcaggtcaagcgaagagcccggtgttgccacacagcggctgtgggaatccatggagcgctctgacgaagaaaatctgaaggaggagtgttcctcgaccgagtctacccagcaggagcatgaagatgccccttctacaaaactacaaggggaagtgctggcgctggaggaggagagagcccaggttctgggacatgtggaacagcttaaggtccgtgtcaaggagctggagcaacaattacaggagagcgctcgtgaggcagagatggaacgagcattactacagggggagcgggaagcagagcgggcactgcttcagaaagagcagaaagctgtggaccagctgcaggagaagctcgtggcactggagaccgggatccagaaagagcgcgacaaggaagcggaagcgctggagacagaaactaaattgttcgaggacctcgagttccagcaactggaaagggagtctcgcgtcgaagaagagcgggagcttgccggtcaagggttattaaggagtaaggccgaactactccgctctattgccaagagaaaggaacgactggcaatcctggactcacaggccggacagataagggctcaggccgtgcaggagtctgagcgactggccagagacaagaacgcgagtttacagcttctgcagaaagagaaagagaagcttactgtgctggagagacggtaccactcactaacaggaggccgacccttccctaaaacaacaagtacactcaaagagatggaaaaacttctgctccctgccgttgaccttgagcagtggtatcaggagttgatggccggtttgggaactggaccggctgctgcctctccacactcttctccccctccgttgccggcaaaagcatccaggcaactgcaggtttaccggtccaagatggacggcgaggccacgtcccctctgcctaggacaagatctggccctctgccctcaagctcaggctcttcctccagtagctcgcagctgagtgtggctactttaggtcggtctccaagccctaagtctgccttgctgacccagaacggaactggttcacttcctagaaacctcgctgcaactctccaagatatcgaaacaaagagacagttagccctccagcagaaggtagagagcctgccggctgaaccactgccgaccgatgatcccgctgggcaacaggtgatagaagagcagagaagacgactggccgaactgaagcagaaagccgctgctgaagcgcagtgtcaatgggacgccctgcatggcgctgcccctttccccgcaggccctagcggatttccacccctgatgcatcattctatcctccaccacctgccagcgggacgcgagagaggtgaagagggggagcacgcctacgatacattgagccttgagagctcagatagtatggaaactagcatcagtaccggaggaaattctgcttgctctcctgacaatatgagctctgcttccggccttgatatgggtaaaatcgaggagatggagaaaatgctcaaggaagcccacgccgaaaaaaatcgcttaatggagtcccgggaaagggaaatggaactgagaaggcaggcccttgaagaagaaagaaggaggcgcgaacaagtggagaggcgactgcaatctgaatctgctaggaggcagcagctggtggagaaggaagtgaaaatgcgtgagaagcaattcagtcaggccagacccctgaccagataccttcccattcgcaaagaggactttgacctgaagacccatatcgagagctccgggcacggggtggatacttgtcttcatgtggtactctccagtaaagtttgccgcggatacctggtcaagatgggcggaaagattaagtcatggaaaaaacggtggtttgtttttgatcggcttaaaaggacacttagctattatgtcgacaagcacgagacaaaactcaagggagtgatctacttccaggcaattgaggaggtgtattatgaccacttgcgcagcgccgctaagtccccaaatcccgctttaacattttgtgtgaagacccacgatcggttgtactacatggttgcaccgagtgccgaggcaatgcgtatttggatggatgttattgtgaccggtgctgaagggtacactcagttcatgaactag

SEQ ID NO: 235203 - DNA, 306 bp, Artificial Sequence
  Description of Artificial Sequence: Synthetic coding sequence
atgggtgggaagattaagagttggaagaagaggtggttcgtttttgacagactgaaacggacgctcagctattacgtggataaacacgagacgaaattaaagggtgtgatttacttccaggcaattgaggaggtgtattacgatcatctgagaagcgctgcaaaaagccccaacccggctctaacattttgcgtaaagactcatgaccgcctttattacatggtggctccttcagccgaggccatgcgcatctggatggatgtgatcgttacaggtgcagaagggtacactcagtttatgaactag

SEQ ID NO: 235204 - DNA, 1119 bp, Artificial Sequence
  Description of Artificial Sequence: Synthetic coding sequence
atggatgcacttaacagaaaccaaatcggcccaggctgccagacgcagactatggtgcagaagggtcctctggatttgattgagactggaaaaggactcaaggtccagactgacaaaccacatttggtgagcctgggttccgggcgtctctcaactgcaatcaccctattacctctggaggaaggtcgtaccgttataggctcagccgctagggacattagcctgcaagggcctgggctagcgcctgagcactgctacatagaaaatctaaggggcacccttactctttatccatgtggcaacgcatgcaccatcgatggattgccggtgaggcaaccaacgcgcttgacacaaggctgcatgctgtgtctcggacagtcgaccttcctgcggttcaaccacccagctgaggcgaagtggatgaaaagtatgatccccgcaggcggacgcgcacctgggcctccttacagccctgtgcctgagagcgaatctctcgtgaacggaaaccatacgccgcaaaccgcaaccaggggtcccagcgcttgcgcatcccactcaagcttagtctcttccattgaaaaagatctgcaggaaattatggatagcctggtgctggaggagccaggagccgctggaaagaaacccgcagctacttctcctctgtcaccaatggcaaatggagggagatatctcctgagccccccaacgtcccctggtgcaatgtctgtggggagctcctatgagaatactagccctgccttttctcctctgagctcacctgcatcctcaggaagctgcgcctcccatagcccctcgggccaagaaccaggaccctccgtcccccctctcgtgcccgcaagatcatcctcgtatcacctcgctctgcaaccgcctcagtcccgtccatccggtgcacgcagcgaaagtccgaggttgtcgcggaaaggcggtcacgaacgacccccatctcccggactgcgaggactcctcacagattccccagctgcaacagtcctggctgaggctagacgcgcaactgaaagtcccaggctggggggacaattgcccgtggtcgccatttctctgtctgagtacccagcggctagacgctgcacgtag

SEQ ID NO: 235205 - DNA, 744 bp, Artificial Sequence
  Description of Artificial Sequence: Synthetic coding sequence
atggatgccctgaacagaaatcaaatcggtccgggttgtcagacacagacaatggtgcaaaaaggccctctcgatctgatcgagacaggcaagggtctgaaagtgcagacggacaagccgcatttggtatcgctgggctcaggtcgactgagtaccgccattactctgctgcctctcgaggagggcaggacagtgatcggatccgctgctcgagatatttctctacagggccctggtctggccccagagcactgctacatcgaaaacttaagaggtacactcaccctctatccttgcggaaatgcttgtactatcgacggcctccccgttcgtcaacctactagactgacacaaggttgcatgctgtgcctgggacagtccacgtttctccgtttcaaccaccccgctgaggccaaatggatgaagtccatgattcctgcgggtggccgagctccaggtccgccatactccccagtccctgccgagagcgaatccttggtgaatgggaaccatactccacagactgctaccagagggccatcagcatgtgcttcacactccagcttggtgtcatctattgaaaaggacctacaggaaattatggacagccttgtgctggaggagcctggcgcagctggcaagaagcctgcggctacctcccctttgagccccatggcaaacggcggaagataccttctctctcccccaaccagccccggtcacgtatgtgggttacaactgtag

SEQ ID NO: 235206 - DNA, 14055 bp, Artificial Sequence
  Description of Artificial Sequence: Synthetic coding sequence
atggttgctggaatgttgatgcccagagaccagctgagagcaatttacgaggttttattccgggagggcgtgatggtggctaagaaagacaggcggccaagaagccttcatccgcacgtgcctggcgtaacaaacctgcaggtgatgagggcaatggcttcactgagggcacggggactggtgagggagacattcgcctggtgtcacttttattggtacctgacaaacgaagggatcgctcacctccgacaatacttacacttgcccccagaaatcgtgcccgcatcactccagcgggtgcgtaggcctgtggcgatggttatgcccgcaagacggacaccacacgtccaagccgtgcagggacctctggggagcccacccaagcgcggacccctgcccacagaggagcagagggtctacaggagaaaagagcttgaggaggtttcccccgaaacaccagtggtgccagcaaccacacaaagaacactcgcccgtcctgggccagaacccgcacctgcaaccgacgagcgagacagagtgcaaaaaaaaaccttcactaagtgggtgaacaagcacctgatcaaagcccagcgccacataagcgatctgtatgaggacctcagagatgggcacaatcttatcagtcttcttgaagtgctatccggggattccctaccgagagagaagggtcggatgagatttcataaactgcagaacgtgcaaatcgccttggactacctccgtcaccggcaggtcaagctagttaatattcggaacgatgacatcgccgatggaaaccctaagctcacccttggcctcatatggaccattattcttcacttccagattagtgatatacaggtctccggacagagcgaggatatgactgccaaggagaagcttcttctgtggtcacaacgcatggtcgagggttaccagggattacggtgtgacaattttacatcgtcatggagagatgggcgactgttcaatgctataattcatcgacacaaacctttgcttatcgacatgaataaggtgtatagacagaccaacttggagaacctggatcaggcatttagtgtggctgagagggatctcggtgttacacggcttctggatccagaggatgttgacgtcccacaacctgacgaaaaatcaattattacatacgtttcttctctgtacgatgccatgcctagagtcccagacgtccaggacggagtgagggccaatgaactacagctgagatggcaggagtatcgggaattggtgctgctgctgctccagtggatgaggcaccacaccgcagcgttcgaagagaggcgatttccctcctccttcgaagagatcgaaatcttgtggagccagttccttaaattcaaagagatggagctgccagctaaagaggccgacaaaaatagaagcaagggaatttatcagtctctcgagggtgctgttcaagccggtcagctcaaagtgcccccaggataccatcccctggatgtggagaaagagtggggcaagctccacgtggcaatactcgagagagagaaacagctgagaagcgagttcgagcgcttagagtgcctgcagcgtatcgtcacaaagctgcagatggaagccggactctgtgaagaacagctcaaccaggcagatgcgctgttacagagtgatgtcagactgctggccgcaggcaaggtaccccagcgcgctggtgaagtggagagagatctggacaaggccgacagtatgattcgtctcctttttaacgatgtgcaaacgctcaaagacgggcgtcatcctcagggagagcagatgtaccgccgagtgtacaggcttcacgagagacttgtcgccatcaggacagagtacaacctcagacttaaagcaggggtggcggctccagcaacccaggtcgctcaggtgacactgcaatctgttcagcgccgaccagaattagaggactctaccctaagatacctgcaggacctcctggcctgggtcgaggagaatcaacatagagtggacggagccgagtggggcgtggatctcccttctgtggaggcccagcttggctctcaccgcggtctgcaccagtctatcgaagagttcagggccaagattgaaagagcgagaagcgacgaggggcagctgagccctgccacccgcggagcttaccgggactgcttgggtcgtttagacctgcagtacgctaaactgctgaacagcagcaaagctcgtctcaggagtctggagagtctgcattcatttgtggctgctgcgactaaagagctcatgtggctgaatgagaaagaagaagaggaagttggcttcgactggtccgacagaaacaccaacatgaccgctaagaaggagagctactcagctttaatgcgggaacttgaactgaaggaaaaaaaaataaaagagcttcagaatgcgggagacaggctgctgagggaggaccatcctgcgagacctacagtcgaatcttttcaggcggctctccagacacagtggtcttggatgctccagctctgttgttgcatcgaagcccaccttaaggaaaacgctgcttactttcaattctttagcgatgtccgggaagccgagggacagttgcagaaattgcaggaggccttaagacgtaaatattcttgcgaccggtcagcgacagtgaccaggctggaggacctactccaggacgcacaggacgagaaggagcagttaaatgagtacaaaggccatctttctggcctggctaagagggccaaggccgtggttcagctgaagcccagacatcctgcccaccccatgcgaggcaggttacctttactggctgtatgcgattacaagcaggtcgaggtgactgtccataaaggcgacgagtgtcagctggtgggacccgctcagcccagtcactggaaagtcctgtcttcatccggctccgaggcggctgtcccttctgtgtgcttcctggtacctccacccaatcaggaggctcaggaggccgtgactcggctggaagctcaacatcaggcattggtgactttatggcaccagctccatgttgacatgaaaagcctgcttgcctggcagtcgctgcggagagatgtacagctgatcagaagctggtccctggcgaccttccgcactttgaaaccagaagaacagagacaggctcttcactctctcgaactgcattatcaggcatttcttagagactcacaagatgcgggagggttcggcccagaggacaggctgatggctgaacgtgaatacggctcatgctcacaccattaccagcagctcttgcagtcactggaacagggggctcaggaggaaagccgctgtcaacggtgcattagtgaactcaaggacattcgccttcaacttgaagcgtgtgaaacaaggacagtccataggctgaggctcccacttgacaaagagcccgctagagaatgcgcccagcgcattgccgaacagcaaaaggcccaggcagaagtggaagggcttggaaagggggtcgccagattgtctgccgaagcggaaaaggtacttgccttgcctgaaccatcccctgcagcacctactctgagaagcgaacttgaactgacccttggtaagctggagcaagtacgctccctctctgctatctatctcgagaaattaaagaccatttctcttgtcatccgtggaacgcagggtgcagaagaagtgcttcgagcccatgaggagcagctgaaagaagcccaggccgtgcctgcaaccctgccagaactggaggctaccaaagcaagcctgaagaagctgcgagcccaggctgaggctcagcagccaacatttgacgccctaagagacgagctgaggggcgctcaagaggtgggggaacgcttgcagcagcggcacggcgagcgagatgtggaagtggagcgttggcgagaaagagtggcccagctgctggaaaggtggcaggcagtgctcgcccaaacagatgtccggcagagagagctagagcagctaggcaggcagttgcgctattaccgggaatctgccgatccactgggagcgtggctccaggatgccagacgcagacaggagcaaatccaggccatgcctctggcagattctcaggctgtacgtgagcagttgcgtcaagagcaagctctgttggaggagatcgaaagacatggcgaaaaggtcgaggagtgccagcgatttgccaagcagtacattaatgcaataaaagattacgagctgcagttagtgacttataaagcgcagcttgaaccagtggccagcccagccaagaagcctaaagtccagagcggtagcgaaagtgtgatccaggagtatgtggacctgagaacccactactcagaactgactaccctgacctcccagtacatcaagtttatcagcgagacgctgcgaagaatggaagaggaagagaggttggctgagcagcagagggctgaggagcgggagaggctggctgaggtcgaagctgcactggagaaacagcgccagctagcagaggcgcacgcgcaagccaaagcgcaagctgaaagagaggccaaagagctgcagcagcggatgcaagaagaagtggtgcggcgagaggaagccgctgtagatgcgcaacagcaaaaacgctctattcaggaagagctgcagcagctccgccagtcctccgaggccgagatccaggccaaagccagacaggccgaggccgcagaacggagccgtttgcgcattgaggaagaaatcagagtggtccgcttgcagctcgaggctaccgaacgacagaggggcggtgctgaaggagaactccaggccttgcgggcacgcgctgaggaagcggaggcgcagaaacgacaagcccaggaagaagctgagcgcctccggagacaagttcaggatgaaagccaaaggaaacgtcaggctgaggtggaactagccagccgcgttaaggcagaggccgaagcagctagggagaaacagagagctctgcaggccctggaagaactccgcctgcaggcagaagaagctgagcggaggttgaggcaggcagaagtcgagcgggcaaggcaggtccaggtcgctctggaaactgctcaacgtagtgcagaggccgaactacagtctaagcgcgcaagcttcgcagaaaaaacagcgcagctggagagaagtcttcaagaagagcacgtggctgtggcccagctgagggaagaagctgaacggcgagcacagcaacaggccgaagcagagagggccagggaggaagctgagcgtgagttggaaaggtggcagcttaaggccaatgaggctctgagactcaggttgcaggctgaagaagtggctcaacagaaatctctcgcccaggcggaagctgagaaacagaaggaagaagccgagcgtgaggctagaaggagagggaaggctgaggaacaggccgtacggcagcgcgagctggctgaacaggaactggagaagcagaggcaacttgcagagggtacagcccagcagcgcctcgccgcagagcaggaactgattagactccgagctgagacggaacagggggaacagcagcgacaactgctggaagaagaattggctagactccaacgagaagccgctgccgcaacacagaagagacaggagctggaggctgaacttgcgaaggttagggccgagatggaggtgctattagcctcgaaagcacgagccgaggaagagtcccgatcgacctccgaaaagagtaagcagcgtttagaagctgaggccggaagatttagagagcttgctgaggaggccgctcggcttcgcgctctagctgaggaggctaagcggcagagacagctggccgaggaagacgccgcaagacaaagagccgaggcggaacgggttttggccgaaaaattggctgctattggggaggctacgagactcaagacagaagcggaaattgctctgaaggaaaaggaagccgaaaacgagaggctacgacggttggctgaagacgaggcgtttcaaagacgacggctggaggagcaagcggctcaacacaaagccgacattgaagagcggcttgcacagttgcgcaaagcgtcggacagtgaactggagcgacagaagggcctggttgaagacaccttgcgccaaaggaggcaagtggaggaggagattctggctctgaaggcgtcatttgaaaaggctgccgcaggcaaggccgaattggaactagaactgggcaggattaggagcaacgctgaggacaccctgagaagcaaggagcaggcagaactcgaagcggcaagacagagacaactcgccgcagaggaggagaggcgtcgcagagaagcagaggaaagagtacaaaagagcttggctgcggaagaggaggccgctcgccagcgcaaggcggcacttgaggaagtagagaggcttaaggcaaaagttgaagaagccaggcgactgcgtgaacgggctgagcaggagtctgcacgccaacttcaactggcccaggaggcggcacagaagcgcctgcaggccgaggagaaggcacatgcctttgctgtgcaacaaaaagagcaggaactgcagcaaactctgcaacaggaacaaagcgtcctggatcagctgcgaggagaagccgaagcggctcgccgagcggctgaggaggcagaagaggcacgcgtccaggccgaaagggaggctgcccagagccgccgacaggtggaggaagccgaaaggttaaagcaatcagccgaggagcaggcgcaggctagagcccaggctcaggcggctgccgaaaagttacggaaagaggctgaacaagaggctgcaaggagagcacaggccgaacaagccgcactcagacaaaaacaagcagcggacgccgaaatggagaaacataaaaagtttgcagagcagacactcagacaaaaagctcaggtggaacaagaactgacgacgctgcggctgcagctggaggagacagatcatcaaaagaatctcctggacgaagaacttcagagactcaaggctgaggctacagaagcggctaggcagcgaagtcaggttgaagaagaattgttcagcgtacgcgtacagatggaagagctctccaaactgaaggcacgcatagaggcagagaacagagccctcatcctgagagacaaagacaacacacagcgctttctgcaagaggaggccgagaaaatgaaacaagtagctgaagaggcggcaagattatcagtggccgctcaggaagcagcaagactgaggcagcttgcggaggaggatttggcccagcagagggccctcgctgaaaaaatgttgaaggagaaaatgcaggctgtacaggaggcaaccaggctgaaagctgaagccgaactactgcaacagcagaaggagctcgctcaggagcaggccaggcgcttgcaagaagataaggaacagatggctcagcaactcgctgaagaaacccaaggctttcagcgcaccctggaagctgaaaggcagcgacagctggagatgagcgcagaggccgaacggctgaagcttcgtgtcgccgaaatgtctcgtgcccaggcacgcgctgaagaggatgcgcaaaggttcagaaaacaggcggaggagatcggagaaaaattgcacaggactgagcttgcaacccaggaaaaggtcactcttgtgcagactctggaaatccaacggcagcagtccgatcatgatgctgagcggctaagggaggctatagctgagcttgagcgcgaaaaggagaagctgcagcaggaggctaagctactgcagctaaaaagcgaagagatgcagaccgttcagcaggaacagctcttgcaggaaacccaagcactgcagcagtccttcctatccgagaaagacagcttgttgcagcgagagaggtttatcgaacaggagaaggccaagcttgagcagctctttcaagatgaggtggctaaggcgcagcaactgcgtgaagagcagcagcgccaacagcagcaaatggaacaggagcgccagaggctggtggcctcaatggaggaagccaggcgtcgccagcacgaggccgaagaaggcgtgcgacgcaagcaggaggaactgcaacagctagagcaacagcgccgtcagcaggaagagctcctggcagaggagaaccaacgtctgcgggaacagctgcagctgttagaagagcagcaccgcgcagccctggctcacagcgaggaggtgacggcttcccaagttgctgccacaaagacactgcccaatggtcgtgacgcccttgatgggcctgcagcagaagcagagccggaacattcttttgatgggcttcgcagaaaagtctctgcccagaggctacaggaggccggtatcctgagcgctgaagagctgcagcggctcgctcaaggtcacaccaccgtggacgagcttgctagaagggaggacgtgcgccattacctccagggcaggtccagcatcgccggtctgcttcttaaggctactaacgagaaactgtctgtgtatgctgccctacagcggcagctgctcagccctggaacagcattaatcctgctcgaggctcaggccgcatccggtttcctattagatcccgtgagaaaccgtcgcttaacagtcaacgaagcagttaaagaaggcgtcgttggtccagagttacaccataaattgctgtcagctgagcgagctgttactggctataaagacccttatacaggacaacagatctccctgtttcaggcgatgcagaaaggcctgattgttcgcgaacatggaatccgactcctggaggctcagatcgccacagggggtgtaatcgacccagtccacagccacagggtccccgtggatgtggcttataggaggggctactttgacgaggagatgaaccgggtcttagccgacccctccgatgatacaaaggggttctttgaccctaacacgcacgaaaacctcacctatctgcagctactggagcgatgtgtcgaggaccccgaaacgggcttatgtctgcttcctctcacggacaaggctgccaagggcggagaactggtgtataccgactccgaggccagagacgtattcgagaaggccacagttagcgctcctttcggtaagtttcagggcaagacagtcaccatctgggaaatcatcaactccgaatacttcacggctgaacaaagacgggatttgctgcggcaattccggactggtcggatcactgtggagaagatcatcaaaatcatcatcacagtggtggaggaacaagagcaaaaaggccgtctgtgttttgagggactgcgctctttggtgcccgctgcagaactgctggaatcacgcgtgatcgacagggagttgtatcagcagttgcagcgaggggaacggtcagtacgggacgtggccgaggttgatactgtcaggagagccctgaggggtgcgaatgttatcgctggggtgtggctcgaggaggcaggccagaaattgagcatctacaacgcattgaagaaggatttactcccatcggatatggccgttgctctactggaggctcaggctggtaccggccacatcatcgatccggctacctccgcgagactgacagtcgacgaagctgtccgggcaggcctggttggaccagagttccatgaaaagctgctttccgcggagaaagcggtaaccggatatcgcgatccgtacactggacagtctgtaagccttttccaggctctgaagaaagggctgatcccacgggaacaggggctgcggttgctggatgctcagctgagcaccgggggaatagtagatccttctaagtcccacagggtgccactggacgtagcttgtgcgaggggctgccttgacgaggaaaccagtcgggcattgagtgcgcctcgtgctgacgccaaagcttactccgacccaagcacaggcgagccagctacatacggggaattgcagcagcgatgtaggccagatcagctgaccggtttgtcacttctgcctctctctgaaaaggcagccagagctcgacaggaagaactctactcggagctgcaggcacgggagacgttcgaaaaaacgcccgtggaggtgcctgtggggggatttaagggcagaaccgttaccgtttgggaacttataagctccgagtacttcactgccgagcagcgccaagagcttctcagacaattccggacagggaaagtgaccgttgagaaggttataaagattctgattacgatcgtggaagaagttgagactttgcgccaggagcgactgagcttctcaggccttcgcgctccagtccctgcttcagaactgctggcttcaggggtcctttccagagcgcaatttgagcagctaaaagatgggaaaaccactgtaaaggacttaagtgagctcggcagcgttcgtaccctgttacagggttctggctgtctggccggaatttacctggaggatactaaagagaaggtgagcatttacgaggcaatgcggcgaggcctgctgagggccactactgccgcactgctcttggaggcccaagcagctactggatttttggtggatccagtgcggaaccaaagactttacgtgcacgaggccgtgaaagcaggcgtcgtgggaccagaactgcatgaacaacttctgagcgcagaaaaagcggtcacaggttaccgggacccatacagcggcagcacaattagccttttccaagccatgcaaaagggtctggtcttgagacagcatggcatccgattgttagaagcacaaattgccactggtggaattatagatcctgtccactcccatcgggtgcccgtggatgtcgcctaccagcgtgggtactttagcgaagaaatgaatcgagtcttggcggatccatcagacgacaccaaggggttttttgatccaaacacccatgagaacttgacctatagacagttgctggaacggtgtgtggaggatcctgagaccggactgcgattgctgccgttgaaaggcgctgaaaaggccgaggtggtcgagacaacccaggtgtatactgaggaagaaacgcgtcgggcattcgaggaaacgcagatagacattccaggcggaggtagccatggtggatcaactatgtccctgtgggaagtcatgcagagcgacttaatccccgaggagcaacgtgctcagctgatggccgatttccaggcaggtagagttaccaaagaaagaatgatcattataatcattgagatcatcgagaaaacagaaatcatccgccagcagggcctcgcaagctacgactacgttcggaggcgcctcactgccgaggacctgttcgaagcacgcattatttcgctcgagacctacaacctgttaagagagggaacacgatccctccgggaggcacttgaggcagaatccgcgtggtgctatctgtatgggaccggttccgtggctggtgtatacctccccggtagccgtcagaccctgagcatctaccaggccttaaagaagggcttactctctgcggaggtggcccgtctcctccttgaagctcaggccgctactggttttctacttgatccagtgaaaggggagagactgactgtggacgaggccgtccgtaaaggtctggtcggaccggaacttcatgatcggctgctgtcggctgaacgggctgtaaccggctaccgggatccatatactgagcagaccatttccctgtttcaggctatgaaaaaggaactgattccaactgaggaagccttaaggctcctggatgcccagttggctacaggtggaattgtggatcctagattgggcttccacctccccctagaggttgcctatcagcgcggatacctgaataaggacacacacgatcagctttctgaaccctccgaagtgcgttcatatgtagacccaagcaccgacgaacggttatcatatacccaactactcaggaggtgtcggagggacgacggcacagggcagctattacttccgctgtccgatgccagaaaactgacattcaggggccttcgtaaacagatcaccatggaagaactcgtgagaagccaagttatggatgaagctactgccctgcagctgcgggagggactgacctctatcgaggaagtgactaaaaacctacagaaatttctggagggcacatcttgcattgcaggagttttcgttgatgccactaaggagcgcttaagcgtttatcaagcaatgaagaagggcataatcagaccgggaaccgcattcgagctgcttgaagcccaagccgctacgggctatgtgatcgacccaatcaagggactgaaactgacagtcgaggaggcagtgagaatgggaatcgtgggtcccgaatttaaggataagctgctgtccgctgaaagggcagtgactggttataaggatccttattccggtaagctaatatcactgtttcaggccatgaaaaaggggctgatcctgaaagatcatggaatccgcttgcttgaggcacagatcgccaccggtggaattattgacccagaagagagtcatcggctccccgtggaagtggcctataaacgaggcctcttcgatgaggaaatgaacgagattctcaccgacccatccgacgataccaaagggttctttgaccctaacaccgaggagaaccttacctacctgcagcttatggagaggtgcatcactgacccccagaccgggttgtgcctgctgccgctgaaggaaaagaaacgcgaacggaaaaccagctcgaaatctagcgtgcgcaaacgcagggtcgtgatagtggatcccgagaccggcaaggagatgtccgtgtacgaggcctatcgaaagggcttaatcgaccatcaaacatatctcgagctgtctgagcaggaatgtgagtgggaagaaattaccatatcaagcagtgacggcgttgttaaaagtatgatcatcgataggagatctggtcgccagtacgacatcgacgacgctatcgcaaaaaatctaatagaccgatccgccctcgatcagtacagggctggaaccctctctatcacggagttcgctgacatgctctccggaaacgccggtggctttagatcacggagctcgtcagtaggttcgagttcaagctacccgatttccccagcagtgtctcgtacccagctggcttcatggagcgatcccacggaagagacaggcccagtggcagggatactcgataccgagacgttagagaaggtttccattaccgaagccatgcataggaacctggtcgacaacattactggtcagaggctcctcgaggcgcaagcatgtaccggtggtattatcgatcctagcaccggagaaaggtttccagttaccgacgccgtgaacaagggcctcgttgataagataatggtagatcgtataaatcttgcacagaaggcattctgtggattcgaagatcctcgcactaaaaccaagatgtctgcagcccaggccctaaagaaggggtggctgtactatgaggccggtcagcggtttttggaggtgcagtaccttacgggagggctcatcgaacccgatacacccggaagagtgccgctcgacgaagcactgcaaagaggcaccgtggacgcaaggacggcacagaagctgagggacgtcggcgcatactctaagtacctcacctgccccaagaccaaactcaagatctcctacaaggatgccctagatagatcaatggtggaagagggcactggactacggctgctggaggcagcagctcaatccactaagggctattacagcccttattctgtgtctgggagcggtagcacagctgggtctaggacaggctcacgtactgggtctcgggcaggttctaggcggggttcttttgatgcaacaggatcaggattttcaatgactttctcttcctctagctatagcagttcagggtatggtcggagatatgcaagcgggtcctcggctagccttgggggtcctgagagcgcggtcgcctag

SEQ ID NO: 235207 - DNA, 13644 bp, Artificial Sequence
  Description of Artificial Sequence: Synthetic coding sequence
atgtctcaacatcaactgcgtgtgccacaacccgaaggtctgggcaggaagcgcacctccagtgaggacaacctgtacctggcagtcctgcgcgctagcgaaggtaagaaggacgagagagaccgtgtgcaaaaaaagacattcacgaagtgggttaataaacatctaattaaggcgcagaggcatattagcgatttgtacgaggatctgcgggatggccacaacctcatctcccttctggaggtgttaagcggagactcactgcctcgcgagaaaggtcgaatgcgattccacaagctgcagaacgtccagatcgcattggactatctacggcatcgacaagtgaagttggtcaacatcagaaacgacgacatcgcagatggtaaccccaaactgaccttgggtctcatttggactatcatccttcattttcagatatctgacatccaggtgagtggccaatctgaggatatgaccgccaaagaaaagcttctcctctggagtcagaggatggtcgaagggtaccagggcctccgctgcgacaatttcactagcagttggcgcgatggacgactgtttaacgctattatccaccgtcataaacctttgcttattgacatgaataaggtttataggcagaccaacctggaaaatctggatcaagccttcagcgttgctgagagagatctgggtgtgacaagacttctcgaccctgaggatgtggatgtgccccagcctgacgagaaatcaataatcacttatgtgagtagtttatacgatgccatgcctagggtgcctgatgtgcaggacggggtgcgggcaaatgaactgcagctccgctggcaggaatatagggaacttgtgctcctgctgcttcagtggatgcgtcaccacaccgcggcatttgaggagcgcaggttcccctcgtctttcgaggaaattgagatcttgtggagccaatttctgaagttcaaagagatggaactcccagcgaaggaagccgacaagaacaggagcaagggcatatatcaatccttggagggagccgtgcaggcaggccagctcaaggtccctccagggtaccatccgcttgatgttgagaaggaatgggggaagctgcacgttgcaattctggaaagagaaaaacaattgcggtccgagtttgaacgcttggagtgcttgcagaggattgtaaccaagctgcaaatggaggcaggattgtgtgaggagcagctcaatcaagccgatgctctgttgcagtccgatgtgcgcctgctcgcggctggcaaagtgccccagagggccggtgaagtggagagagacttggataaagcagacagcatgattcggctcttgtttaatgacgtgcagactctgaaggatggccgtcacccccagggggagcagatgtaccggcgagtgtaccgtctccacgagaggttagtcgccataaggacagaatacaacctgcggctcaaagcgggtgtcgcagctccagcaactcaggtggcccaggtcaccctccaaagtgtgcaacggcgacccgaactagaggatagtaccttgcggtatctccaggatctcctcgcttgggttgaggagaatcagcacagggtcgacggggcagaatggggtgtggacctcccaagcgtggaagcccaattaggcagccaccgtggcctgcaccagtccatcgaggaattccgcgctaagatcgaacgcgcaagatccgacgagggtcaattgtctccggcaactaggggggcttaccgtgattgtctggggagacttgaccttcagtacgcaaagctactcaatagtagcaaggcaagactccgctccctcgaatcgctgcacagttttgttgccgctgctacaaaggaactgatgtggttgaacgaaaaggaagaagaggaggtgggctttgactggtctgatcggaatacaaacatgactgctaaaaaggaatcatattccgccttaatgcgggaactcgagcttaaggagaagaagattaaggagctccagaacgccggtgacagactgctcagagaagaccacccagcacgaccaacagtagagagctttcaagcagccttgcaaacacagtggagttggatgttgcagctgtgttgctgtatcgaggctcacctcaaggagaacgctgcatattttcagtttttcagcgatgtgagggaggccgagggacaactgcaaaaactgcaggaagcgttgagacgcaagtactcttgcgacagaagcgccaccgttacccgcctcgaagatttactgcaggacgctcaggacgagaaggaacaactgaacgaatataagggacacttgtcaggcctggcaaaacgtgccaaggccgtggtgcagctgaagcctcgacacccagcccatcctatgcgcggacggctacccctgcttgccgtgtgcgactataaacaagtggaagttaccgtacacaagggcgacgaatgtcagctagtgggaccagcccaaccatcacattggaaagttttgtcttcctctgggtctgaagctgcggtaccttcggtatgcttcttggtgccccctccaaatcaagaggcccaggaagcagtcactagactcgaggcccagcatcaggccctggtgactctttggcatcagctgcacgtagatatgaagagcttgctcgcttggcagtcgctccggagagatgtgcagctcatccggtcttggtcattggccacatttcgcactctaaagccagaagagcagcgacaggccctgcactcccttgaactacactaccaagcctttttgagggatagtcaggacgcgggagggttcggccctgaggatagacttatggcggagcgtgaatacgggagttgttcccaccactaccagcaactgctgcagtctctcgaacagggagcacaggaagagagccgatgtcagaggtgcattagcgagcttaaagatattcgcctgcagcttgaggcttgtgaaacgaggacagtccatcgattgagactacctttggacaaggaaccagctcgcgaatgcgcacagcgaatcgccgagcagcagaaggcgcaggcagaagtggagggtctcggcaagggagtggcacggctgtcagctgaggcagagaaggtactcgctttgcctgagccatcccctgcagcccctaccctgcgcagtgagcttgagctcacccttggcaagctggagcaagtacggtccctatcggccatctatctagaaaagttgaaaactatctcattagtgatccggggtacacagggtgccgaggaagtcctccgggctcacgaggaacagctgaaagaggctcaggcagtaccagctacgttgccagagctggaggcaaccaaagcttcccttaaaaagctgcgggcacaggctgaagctcaacagccaactttcgatgcgctgcgcgacgagctgcggggagcccaggaggtgggtgaacgcctgcaacaacgacacggcgagcgcgacgttgaagtggagcggtggcgagagagagtggcccaactgctcgaaaggtggcaggcagttctggctcagacagacgtgcggcaacgcgagctagagcaactgggcagacagctacgctactaccgcgagagtgcggaccccctcggcgcatggttgcaggacgcacgcagacggcaggaacagatccaagctatgcccctcgccgattctcaagctgtaagggaacagttgagacaagaacaggccttgctggaagaaattgaacggcacggggaaaaggtcgaggagtgccagagatttgctaaacagtatattaatgcaattaaggattacgagttgcagttagtcacatacaaggctcagctggaaccagtggcctcaccagccaagaaaccaaaggtgcaatccgggtcagagtctgtgatacaagagtatgttgatctgagaacccattactctgaacttactaccctgacttctcagtacatcaagttcatctccgaaacgttgaggcgcatggaagaagaggagcgccttgccgagcagcagcgagccgaggagagagagcgcctggcagaggtcgaagccgctttagaaaagcagcgacagcttgcagaggcccacgcgcaggctaaggctcaggctgagcgcgaagcaaaagaacttcagcagagaatgcaggaggaggtggttaggcgcgaggaggctgccgtggacgcacagcagcagaagaggtccattcaggaagagctccagcagctgcgccagtcgagcgaggccgagattcaggctaaagctcgccaggccgaagctgcggagcggtctcgactgcggattgaggaagagatcagggtggtgaggcttcagttggaagccaccgaaaggcagaggggtggtgctgaaggcgaactacaggcactccgagctcgggctgaggaagcagaggcacagaaaagacaggcccaagaagaagcagaaaggctgcgacgacaggtgcaggatgagtctcagcgtaaacggcaggccgaggtcgaactagccagccgtgtgaaggcagaggccgaagccgcacgtgaaaagcagcgggcattgcaagcactggaggaactgcgcctccaggctgaggaggctgaacgaaggttgaggcaggctgaagtggaaagggccaggcaggttcaggtagccctcgaaactgctcaaagaagtgccgaggctgaactgcagtctaagcgcgcaagtttcgccgagaagaccgctcaattagagcgctcgctgcaagaagagcatgtggccgtcgcccagctacgggaggaggccgagagacgggctcaacagcaggcagaggccgagagggcacgggaggaagccgaaagagaattggagcgatggcagttaaaagctaatgaggcgctcagattacggctgcaggcagaagaagtcgcacaacagaaatctcttgcccaggccgaggccgaaaagcagaaagaagaggccgaacgtgaagcccgacgtcggggaaaggctgaggagcaggccgttcgccagagggagctggctgaacaggaattagaaaagcagcgtcagctggcagagggcacggctcagcagcggctggccgctgagcaagaactgattaggctgagggccgagacagaacagggcgagcaacagaggcagctcctggaagaagagctggcacgcctccagcgagaagctgcggctgccactcagaagcgacaggaactcgaggcagaacttgccaaagtccgcgctgaaatggaagtgctgctcgcctctaaagccagagccgaagaggagagccgttcaacttcagaaaaatctaagcagcgattagaggcagaggcgggacgctttagagaactggctgaagaagctgcacgcctgcgggctcttgccgaggaggcgaagagacagaggcagttggctgaggaggacgcagcccgacaaagggctgaggcagagcgcgttcttgccgaaaagcttgccgcaatcggagaggcaactcgcctcaagacagaggccgagatcgccctcaaagagaaagaggctgagaatgaaagattacggagactagctgaagacgaggcttttcagagacggaggctggaagagcaagcagcccagcacaaggctgacatagaggagcgcctggcccaattaagaaaagcttctgatagcgaactagaaagacagaagggcctggttgaggacactctgcgccagcggaggcaagtcgaggaggagattttagctctcaaggcctcatttgagaaggccgctgcagggaaggctgagttagagttggagctgggacgcattcgatcaaatgccgaggacacactgcgctccaaagagcaggccgagcttgaagcggcacgacaaagacaacttgcagctgaagaagaacggagacgcagagaagccgaggagagagtgcagaagagcctggccgctgaggaggaggcagcaaggcagagaaaggcagctctggaggaggtggagcggctcaaagcgaaggtggaagaagcacgaagacttcgagagagggcggagcaagaatctgccagacagctacaactagcccaggaggccgctcagaaacgcctgcaagctgaggagaaggctcacgccttcgccgtgcagcagaaggaacaggagctccagcagacccttcagcaggaacaatctgtgcttgatcaactgcggggagaggccgaagcggcaagaagagccgcagaggaggccgaagaggctcgtgtccaggccgaacgcgaagcagctcagtcccgtcgtcaggtcgaggaggctgagaggctgaagcagtcagctgaggaacaggctcaggcccgagctcaagcacaggccgcagccgaaaagctgagaaaggaggccgaacaagaggctgctagaagagcccaagccgagcaagccgcactccggcagaagcaggccgctgacgccgaaatggaaaaacacaagaagtttgctgagcaaacgcttcggcaaaaagcacaagtcgagcaggaactcaccaccttaagattgcaattagaagagacagatcaccaaaaaaatctgctggatgaggagctccaaaggctcaaagcagaagccacggaagccgcaagacagagatcacaagtggaggaagagttgttcagcgtgcgcgtgcaaatggaagagctatccaagttgaaagcacggatcgaagccgagaaccgggctttgatcttacgcgacaaagacaacactcagagatttctgcaggaggaagctgaaaaaatgaaacaggtggcagaggaggccgcacggctgtccgtggctgctcaagaggctgcgagattgcggcagctggcagaggaggatctggcccaacagcgggctctggccgagaaaatgcttaaggaaaaaatgcaggctgtccaagaggctacacggctgaaggcagaagccgaactactacagcagcaaaaggagttagcgcaagaacaggcccgacgactgcaggaagacaaggagcagatggcccagcagttagcggaagaaacacagggatttcagcgcaccctcgaggccgaaaggcagcgtcagttggagatgagcgccgaagctgagcggttaaaactccgggtcgccgaaatgtcaagagcacaggccagagctgaggaggatgctcagaggtttcgcaagcaggctgaggaaattggagaaaagctgcatcgtacagagctcgcgacccaggagaaggttaccctggttcagacactggaaatccagagacagcagagcgatcatgatgccgaaaggctcagggaggcaattgccgaattggagcgcgagaaggagaaactccagcaggaagctaaactgctccagctgaagtcagaagaaatgcaaaccgtccagcaggagcaacttcttcaggagacccaggctctccagcagagttttctgtctgaaaaggactcactgctgcagagggaaagattcattgagcaggaaaaggctaaactcgagcagctgtttcaggacgaggtggccaaggcccagcaacttagagaggagcagcaacggcagcagcagcaaatggagcaggagagacagcgtcttgtcgcctccatggaagaggcaaggcgcaggcagcacgaggctgaggaaggcgtgaggcggaagcaggaggaactgcagcagctcgaacagcagcggagacagcaggaagagcttctcgctgaggagaaccaaagacttagagagcagctccagctcctggaagaacaacaccgggctgctctggcccactccgaggaagtgactgctagtcaggtcgccgctacaaagacactgcctaatgggagagacgcacttgacgggcctgccgctgaggctgaacctgagcattcattcgacgggctgcgcagaaaggtttcagcacagcggctgcaggaggcgggaatcctgtctgctgaggagctacaaaggttagctcaggggcatactaccgtggatgaactggctaggagggaggatgtccggcactacctacaggggagatcttcaattgcaggtctgttactcaaggccaccaacgaaaagcttagtgtgtacgcagcacttcagcggcagctgctttccccaggaaccgccctgatactcttagaggctcaagccgcaagcggattcttactggatcctgtgcggaaccggagactgaccgttaacgaagccgtgaaagaaggagtggtcgggcctgagcttcatcataaactgctctcagccgaacgggcagtaaccgggtacaaggatccttacaccggccaacagataagcctgtttcaggcgatgcagaaaggtctgatcgtgcgcgaacatggcatacggctcctggaggcacaaatagctaccggcggagtaatcgaccctgtacactctcaccgggttccagtggatgtcgcttatcgccgaggttattttgacgaggaaatgaaccgtgtactggcagacccttcagacgacactaagggtttttttgaccctaacacacatgagaatctgacctacctccagctgctcgaacgttgcgtggaagaccctgaaacaggcctgtgcctattacctcttacagacaaggccgctaaagggggtgaactagtgtataccgattccgaagccagagacgtgttcgaaaaagcaaccgtttctgccccatttgggaagttccagggtaagaccgtcacaatctgggaaatcatcaattccgaatatttcaccgccgaacagaggagagacctcctgcgtcagttcaggaccggaaggattacagtggagaaaatcattaaaattatcattaccgtggtagaagaacaggagcagaagggcaggctgtgcttcgagggcctccgctcactggtccctgcagccgaactcctagagagtagagtcattgacagggaactgtaccagcagctgcagcgcggtgaacggtcagttagagacgtagccgaagtggatactgtgcgcagggcgctgagaggggctaacgttatcgctggagtgtggctggaggaggctggccagaaactgtccatttataacgcgttgaagaaggacttactcccgtcagacatggccgtggccctgctggaagcgcaggcgggaacaggtcatatcatcgacccagcgacctctgcgaggctcacagtcgacgaggccgttagggctggcctggtgggaccagaatttcacgagaagctgctttccgccgagaaagctgtcacaggatatcgggacccgtacacaggacaatcagtctcactcttccaggctctgaaaaaaggcctgatacccagggagcagggcctgcggcttctggacgcccagttaagcacgggaggaatcgtggatccttcaaagtcccacagggtccccctggacgtcgcctgtgctagagggtgtctggatgaggagacaagtagggcactttccgcgccacgggcagatgcaaaggcgtatagtgatccttccaccggggaacccgcaacctacggcgaactgcaacagcgttgccggcctgatcaattgaccgggctgtctttactccctctgagcgagaaagcagctcgagccagacaagaagagctctacagcgaactgcaggcaagggagacatttgaaaaaacgcctgttgaggtccctgtaggcggattcaaaggacggactgtaacagtgtgggagctgatcagcagcgagtacttcactgcggaacagcgtcaggagctgctacggcagttccgaactgggaaggtgacagtggaaaaagttattaagatcctgattactatagtcgaagaggtggaaacgctgcgacaggagcgcctgtcattcagtggcttaagagcccctgtgccagcaagcgagctgctcgctagtggagtgctgagtcgagcccagtttgaacagttaaaagatggaaagaccacagtgaaggatttgagcgagctaggctccgtgaggactctactccaagggtctggctgccttgcaggcatttacctcgaagacactaaagaaaaggtgtcaatctacgaggcaatgaggagaggcctgcttagggcaactacagcagctttacttctagaggcccaggccgctactggtttcctggtggacccagtccggaatcagcggttgtacgtccatgaggccgttaaagcaggtgtcgtcggaccggagttgcatgagcagttgttaagcgctgagaaagccgtgaccggctacagggatccatactcaggttcgaccatttcactgtttcaggctatgcagaagggtttggtgctgcggcagcacggaattcgcttacttgaagcccaaatcgctacaggtggaatcattgacccagtacatagtcacagggtgcccgtagatgtggcctatcagcggggatatttctctgaggagatgaatagagttctagcagatccctctgatgacaccaaggggttctttgacccaaatactcacgagaatctgacgtatagacagctcctggagagatgcgtcgaagatcctgagactggcttgaggcttttgccgctaaagggcgcagagaaagcagaggtggtagaaaccacacaggtatacacagaggaggagacacgacgcgcatttgaggaaacccagattgatatcccagggggtgggtcccacggcggatccactatgtcgctttgggaggtaatgcagtccgatctgatcccagaagaacagagggcccagctaatggccgatttccaggcaggccgagtgacaaaggaacggatgatcatcatcattatagagatcatcgaaaaaaccgaaataataaggcaacagggcctcgcaagctacgactacgtaaggcgacgcttaaccgccgaagacttgtttgaggccagaatcatttctctggaaacctataacctcctgcgcgagggaacgaggagtctgcgtgaagctctggaggctgaatccgcctggtgctatctgtatggcaccggatctgtagccggtgtgtacctccctggaagccgacagacactgtcgatttaccaagccctgaagaaggggcttctttccgctgaggtcgctaggttacttcttgaagcacaggcagcaactggatttctgctggatccagtcaaaggcgagcggcttacagtggatgaggccgtgcgcaaaggcctcgtcggccctgagttacacgataggctactctcagccgaacgcgcagtgaccgggtacagagatccctacactgagcagactatcagtctattccaggccatgaagaaggaactgatccccacagaggaggcattaagactcctagacgcacagcttgccacaggaggaatcgtggacccacggctcgggttccatctgcccttagaagtggcttatcagcgaggctatcttaacaaagacacacacgatcagttgagcgagccttctgaggtcaggtcctacgtggatccatcaactgacgagcgtttgtcttatactcagctgctgagaagatgtagacgcgacgatggcacaggacaactgctcctgcctctgtcagatgcacggaagctcacattccgaggccttaggaaacagattacgatggaagagcttgttcgaagccaggtaatggacgaagccacagcccttcagctcagagagggcttgactagcatcgaggaggtcactaagaatctgcagaagtttttagaagggacgagttgtattgctggagtcttcgttgacgcgacaaaggagcgactgtccgtgtatcaggccatgaagaaggggattataagacccggtaccgcgttcgagctactggaggcacaggcagcaacaggctacgtcatcgaccccatcaaaggtcttaaacttactgtggaggaggctgtacgaatggggatcgttggtccagagttcaaggataaactgctgagcgccgaaagagcagtcacaggatataaagatccttatagcggtaaactcatttctctgttccaagctatgaagaaggggctgatcttgaaggaccacggaataagactattggaggcacagatcgccactgggggaatcatagacccagaggaatcccaccgtttgcctgtggaggtggcttataagagggggctatttgacgaagagatgaatgagatcctgacagacccctcagacgataccaaagggtttttcgacccgaacactgaggaaaaccttacatacttacaactaatggagcgctgcataactgacccccagaccggactgtgcttgctaccactgaaggagaagaagcgagaacgtaagacctcctcaaaatctagcgttagaaaacgtcgcgtggtcatcgtggacccagagaccgggaaggagatgagcgtctacgaggcctacagaaagggacttatagaccatcaaacgtacctggaactgagtgaacaggaatgcgaatgggaggaaataaccattagttcctccgacggcgtcgtgaagagcatgattattgataggcggtctggacggcaatacgacatcgacgatgccatagccaaaaacctaattgaccgctccgccctggaccagtaccgggcaggtaccttatccatcaccgaattcgccgatatgctgtccggcaatgctggtggtttccggtcacgctcaagttctgtcgggagctctagctcctatcccatcagccctgccgtgagccgcactcagttggccagctggtccgaccccaccgaggagacgggtccggtggccggaatcctggatactgaaactctcgagaaggtgagcattactgaggccatgcaccgcaatctcgtggataacatcacggggcagcgtctgttggaggcgcaagcgtgtaccggtgggattatcgacccctccaccggggagaggttccccgtaacagatgcagtgaataagggactggtggacaaaatcatggtggacagaattaatttggcccaaaaggccttctgtgggtttgaagaccccagaaccaaaacgaaaatgtctgccgctcaggccttgaaaaaaggctggttgtattacgaagccggacagcgtttcctcgaagttcagtatctgaccggcggactgatcgaaccagatacccccggacgggtacccctggacgaggcactgcagcgtggtactgtcgacgctcgcaccgctcaaaaattgagagacgtcggcgcttactccaagtatctgacatgtcccaaaaccaagctgaaaatcagctacaaagatgctttagacagatccatggtggaggaagggaccggactaagactgttggaagcagccgctcagtcaacgaagggctactactctccgtacagcgtctcaggctcaggatcaacagctgggtcacggacagggagccggactggcagcagggccggatcccgcaggggatcctttgatgccacagggagcggcttctccatgacatttagctctagttcctactcaagctccggctatggtcggagatacgcttccgggtccagcgcctcgctgggtggccctgaaagtgccgtggcataa

SEQ ID NO: 235208 - DNA, 13644 bp, Artificial Sequence
  Description of Artificial Sequence: Synthetic coding sequence
atggaacccagcggatccttgtttccctcattagtggtagttggccacgtcgtcactctggcagcagtctggcattggcgtagaggtcggaggtgggctcaggacgaacaagatgagcgtgatagggttcagaagaaaacctttacaaagtgggtgaataagcatcttattaaggcacagcgtcacatctccgatctctacgaagacctccgggacggacacaacctaatatctctgcttgaagttctgtcaggcgattctcttcctagagaaaaaggcagaatgcgatttcataagctgcagaacgtgcaaattgccctcgattaccttcggcatcgacaggtcaagttggtgaacattcgcaacgacgatattgcagatgggaaccctaagctcactctaggcctaatttggactatcatcttgcatttccagatttccgatatccaagtgagcggacagtccgaagacatgacagccaaggagaagttgctcctgtggtctcagaggatggttgaaggctatcaggggcttcgctgtgataattttacctcatcgtggcgcgatggcagattgttcaacgccattatccaccggcacaagccactgctgattgatatgaacaaggtgtatagacagactaatttagaaaaccttgatcaagcctttagtgttgccgaaagggacctgggcgtgacccggctgctagaccccgaagatgtggacgttccacagccggacgagaagtccatcattacttacgtgtcctcactttacgacgccatgccaagagtgcctgacgttcaggatggggtgcgcgctaacgaattacaattgcgatggcaggagtaccgcgaactggtgctcctgctgcttcagtggatgcgccatcacacagccgctttcgaagagcggaggttcccctcaagtttcgaggagatcgagatcctgtggtcccaatttcttaaattcaaagaaatggaactgcctgccaaagaagcggacaagaatcggtctaagggtatctaccaatctctagagggggctgtgcaagcagggcagctaaaagtgccacccggataccaccccctagatgttgagaaggagtggggcaagctacatgtggccatcctcgaaagagaaaagcaactgagaagcgagttcgagaggctggagtgcctccagcgcatagtgacaaagttacagatggaggcgggactctgtgaagaacagctgaaccaggctgacgccttattgcaaagcgacgttagacttctggccgcaggaaaagtgccacagagggccggagaggttgaacgtgatctggataaagctgattcaatgatccgcctgctgtttaacgacgtacagacactgaaggacggcagacatcctcagggcgagcagatgtatcgtagagtctacaggttgcacgagcgactcgttgcgattcgcaccgagtataatcttagattgaaggccggtgtggccgcacctgccacccaggtcgcccaggtgactctacaatccgttcagcgtcgcccagagctggaagactccacactgagatacctgcaggatctcctcgcatgggttgaggaaaatcaacacagggtggatggcgcagagtggggtgtggaccttccctctgtggaagctcagttaggctcgcatagaggattacatcagtctattgaggaatttcgtgccaaaatcgagagggctaggtctgacgagggccagctgagccccgctacaaggggagcttaccgggattgccttggtagacttgatctccagtacgccaagctgctcaactcctcaaaggcacgattacgctcgctggaatccttgcactcttttgtcgccgctgcaactaaggagcttatgtggctcaacgagaaagaggaggaagaggtgggcttcgattggagcgatcggaataccaatatgacagctaaaaaggagagttacagcgccctcatgcgcgagttggaacttaaggagaagaaaattaaagagctgcagaatgccggagataggctgctccgtgaagaccatcctgcacggcctacagtggaatcattccaggcagcgctgcagacacagtggtcttggatgctgcagctgtgctgttgtattgaggctcacctaaaagagaacgcagcatattttcagttcttcagcgacgtcagggaggctgagggtcagctgcagaagctacaggaggccctaaggagaaaatattcatgcgaccgatccgcgacagtgacccgcctcgaagacctgctgcaggatgctcaagatgagaaagagcagctcaacgagtataaaggacatctatcaggacttgcaaagcgcgcaaaggctgttgtccagctcaagcctagacatcccgctcacccaatgaggggccgtttacctctgttggccgtttgcgactacaagcaggtggaggtaacagtccacaagggcgatgaatgccagctggtcggccctgcccagcctagtcactggaaagtgctctcatctagcggaagtgaggccgctgttcctagcgtgtgcttcctggtccccccacccaatcaggaagcacaagaggcggtgacccgcctcgaggcacaacaccaggccctggtcacgctgtggcatcagttgcacgtggatatgaaaagtttgctggcctggcagtcccttcggagagatgttcagcttattcgatcctggagcctggccacattcaggacactgaagccagaggagcaaaggcaagccttacatagtctggaactgcattaccaggctttcctccgcgattcccaggacgccggtggcttcggaccagaggaccgcttgatggctgaacgcgagtacggaagttgtagccaccattaccagcagctcctgcagagcttggagcaaggcgctcaggaagagagcaggtgccagaggtgcatttccgagctcaaagacatcagactgcagttggaggcatgtgaaacacggactgtgcatcggctcagactgcctcttgacaaggaaccagcaagggaatgtgctcagagaatcgctgaacagcaaaaagcccaggccgaagtagaagggcttggcaaaggagtcgcgagactgtcagctgaagccgagaaggtcctcgcgctgcctgagcccagtcccgctgcccctactctgcgtagcgaactcgagttaactctggggaaacttgagcaggtcagaagtctgtcagcaatttacttagagaaattgaagactatctccctcgtgattagaggcacgcaaggagctgaggaagtgcttagggcccacgaggagcaattaaaagaggcccaggccgtcccagccactctgcccgaattagaggctacgaaggcgagcctcaaaaagttaagagcccaggctgaggcgcagcagccaacttttgacgccctccgggatgagctcaggggcgcacaggaggtaggtgagaggttgcagcagcgacacggagaaagagacgttgaggtggaacggtggcgcgagagagttgcacaactgctcgaaaggtggcaggccgtgctggcgcagacggatgtcagacagcgagaactggaacaactaggcaggcagttaaggtactacagagaatccgccgatcccctcggagcctggctgcaggatgccagacgtaggcaggaacagatccaggcgatgcccttagccgactcccaggccgtgcgggagcagttaagacaggaacaggcattgctggaggagatagagagacatggagaaaaggtggaggaatgccaacggttcgcaaagcaatacattaacgccatcaaggattacgagctgcagctggtcacctataaggcccagttggagcccgtggcaagccctgctaaaaagcccaaggtccagagcggctccgagtctgtgatccaggagtacgtggacctacgcacccattattcagaactgaccacgctaactagtcaatatatcaaattcatcagcgagaccttaagacgaatggaagaggaagaaagattggccgaacaacagcgtgcagaagagagggagaggttagctgaggtcgaagccgctctggaaaagcaaaggcagctggcggaagcgcacgcccaggcgaaagctcaggccgagagagaggcaaaggagctccagcagcgtatgcaggaggaggttgtgcgacgcgaagaggcagctgtggacgcccagcagcagaagcgatcgattcaggaggaacttcagcagctccggcagtcttcagaagccgagatacaggcaaaagccagacaggccgaggcggcagagaggtcacgcttaagaattgaagaagaaatacgggtggtccgtctacagctcgaagcgaccgagagacagagaggcggtgcggaaggagagcttcaagccctacgtgcccgtgccgaagaagctgaagcccagaagcgacaggcccaggaggaagcagagcgactacgcaggcaggtccaggacgagagccagcgtaagcgccaggccgaagtggaattggcctcccgtgtgaaagcagaagccgaagccgctagagagaagcagcgggcactgcaggctctggaagaactgcgccttcaggcagaggaggctgaacgaagattgcgtcaggcggaggttgaacgagcacggcaagtgcaagtagccttggagactgctcagcgatccgccgaggcggaattgcagtcaaagagagccagctttgctgaaaagaccgctcagctggaaagatctctgcaggaagaacatgttgcggtagcacagttgcgagaggaggcagagcggagagcacagcagcaagcagaagcggagcgggctagagaggaggcagagagagagctcgagcgctggcagctcaaggcaaatgaagcgctcaggttaaggctgcaggccgaggaggtggctcagcagaagtcccttgcgcaggcagaggccgaaaagcagaaagaggaagcggagcgagaagcacggcgacgtgggaaggcggaggaacaggcggtgcggcagcgggaactggcagagcaggagttagagaaacaacggcaactagcagaggggaccgcccagcagcgcctggccgctgagcaagaattgataagactgcgggcagagacggagcagggagaacaacagagacaactgctcgaggaggaactggctagacttcagagagaggcagctgctgctacacagaagcgtcaggagttagaggctgaactcgcgaaagtgcgagccgaaatggaggtcttacttgctagtaaggcaagagccgaggaggagtcgcggtcaacttctgaaaagagcaaacagcgcctcgaggcagaggccggtcgttttcgggagctggctgaagaagccgcaagactgcgggctctcgcagaagaagctaaacggcagcgccagctcgctgaggaggacgccgctcgacagcgtgccgaggctgaaagagtactcgccgagaagctggcagctatcggagaggccacgaggttaaagaccgaagcagagatcgctcttaaggagaaggaggcagagaatgaaaggctccggaggctggcagaggatgaggccttccagaggaggcgtctggaggaacaggccgctcagcacaaagctgacatcgaggagagactcgctcagctacggaaagcctctgattcagaattggagcggcaaaagggcctggtcgaggatacattacggcagcgcagacaggtggaggaggagatcttagcccttaaggctagcttcgaaaaagcggctgccggaaaagcagagctcgagctcgaattgggcagaatccgatcaaatgcggaagatacgcttagaagtaaagagcaggcggaactagaagcagcaagacagcggcagctggctgcagaggaggaaagaagacggagagaggccgaggaaagagtccaaaaatcactggccgcagaggaagaggccgcacgccagcgcaaggccgcattggaggaagtcgaaagattgaaagcaaaggttgaggaggccaggcgcctcagagagcgtgcggagcaggaaagtgccaggcagctccagctggcacaggaggctgcccagaagaggctacaagctgaagagaaggctcacgccttcgccgtgcaacagaaggaacaagaacttcagcagactttacagcaggagcagtcggtgttggatcaactgcgtggcgaggcggaggccgcacgccgtgctgctgaggaggcggaggaggctagagtccaggctgagagagaggccgcacagtcgcgaagacaggtcgaagaggccgagcgcctcaagcagtccgcagaggaacaggctcaggccagggcgcaggcacaggctgccgcagagaagctgcgcaaggaagcggagcaggaagccgctcggagggcccaggcggagcaggcagctctgcgtcagaagcaggcagccgatgctgaaatggaaaaacataagaaatttgccgagcagactctcagacaaaaggctcaggtcgagcaggaactcacaacattgagactgcaactggaggagacagatcatcagaagaatcttttggatgaggagctgcagcgattgaaagctgaagccacagaggcggctcgccagcgttctcaggttgaggaggagcttttttcagtgcgcgtccagatggaggagttgtcaaaactcaaggccaggattgaagcagaaaaccgggctctcattctgcgcgataaggacaatacacagaggtttcttcaggaagaggccgagaaaatgaagcaggtggcagaggaggcagcgagactcagcgttgccgctcaggaagcggctcggctgcgccagcttgccgaagaagatctggctcaacagagagctctggccgaaaagatgctgaaggagaagatgcaggctgtgcaagaagccactaggttaaaagcagaagccgaactcttgcagcagcaaaaagaactcgctcaggagcaggcgaggcgcctccaggaggataaggagcagatggcccaacagctcgccgaggagacgcagggattccaaaggaccctcgaagccgagagacagcgacagctcgaaatgtccgctgaagccgagcggctgaagctgagggttgccgagatgtcacgcgcacaagctagggccgaggaagacgctcaaaggtttaggaaacaagctgaagaaattggggaaaagttacaccggaccgaattggcaacacaggaaaaagtaacactggttcagactttggagatccaacgacagcagtctgaccacgacgccgagcggcttcgtgaagccattgccgagctggaacgggaaaaagagaaactgcagcaggaggccaagttgctccagttaaagtctgaagagatgcaaacagtacagcaagagcagctgctacaggagacacaggcccttcagcagagcttcctctcagagaaagatagcctgctgcaaagagagaggttcatcgaacaggaaaaagcaaaactggaacagttgttccaggatgaagtggcaaaggcccaacaactgcgagaagaacaacagcgacaacagcagcaaatggaacaggaacggcagcgcttggttgcctcgatggaagaagccagaaggcgacagcacgaggccgaagagggcgtgaggagaaaacaggaagagctccaacagttggaacagcagcggaggcagcaggaagagttgctggccgaggagaaccaacgcctgcgggagcaactgcagttgctggaagaacagcaccgggcagcgctggcccattctgaggaggtcactgcaagtcaggtggcagccaccaaaacactgccgaatggcagggacgccctggacggccctgccgcagaagctgagccggaacattcatttgacggcttacgccgaaaggtctctgctcagcgcctgcaggaggccggaattctcagtgccgaagagctgcagcgattagcgcagggtcacactaccgtcgatgagctggctagacgagaagacgtgagacactacttgcagggacgatcaagcattgctggcctgttgttgaaggctactaatgagaaattgagtgtttatgcagcactgcagagacaattactgagccctggcaccgctttgatcctgctcgaggcacaggccgcttcgggctttttgcttgacccagttcgcaaccggaggttgacagtcaacgaggctgtgaaggaaggcgttgtaggccctgagctacaccacaaactattgtcggctgagagggcagtgacaggctataaagacccttatacaggccagcagatcagtctgttccaggccatgcagaagggcttgatagtgagggaacacggtattcgattgttggaagctcagattgcaacggggggtgtgatagatccagttcacagccacagggttcctgtggatgttgcatacagaagagggtacttcgacgaggagatgaatcgagttctggcagatccttcggatgatactaaagggtttttcgatcccaatacgcacgaaaacctgacatacctgcagctgctggaacgctgcgtcgaagacccggaaaccgggttgtgtctgctgccgctgaccgataaggcggctaaaggcggtgaactggtgtacactgacagtgaagccagagacgtgtttgaaaaagccactgttagcgccccattcggcaaatttcaaggtaagacagtgaccatctgggagattataaattcggagtactttacagccgagcaacggagagatctcctaaggcagtttcggaccggcaggatcacagtggaaaagatcatcaagataattattaccgtagtggaggagcaggagcagaagggacggctctgctttgaaggactgcgcagcctagtgcctgctgccgagttgctcgaatcacgcgtaatcgatcgcgaactctaccagcagttacagagaggtgagcgaagcgtgcgggacgttgcagaggtcgacaccgtgagaagggctttgagaggtgctaacgtgatcgccggagtctggctagaagaggccggacagaaactgtccatttataatgccctgaagaaagaccttcttccatctgacatggctgtggccttgttggaagcccaggcaggcaccggacacatcattgatcccgcaacttccgctagactaacggttgacgaagccgtccgggcaggcttggtaggaccggaattccatgagaagttgctgtccgcagaaaaggccgtcactggctaccgggatccctacaccgggcagagtgtttcacttttccaagctctgaaaaagggactcatccctcgagagcagggcttgaggcttcttgacgcccaactctcaacagggggaattgtagaccctagtaagtcccacagggtgccactggatgtcgcttgcgcacgcggatgcttggatgaggaaacatctagggcactcagtgctcctagggctgacgccaaagcttattctgaccctagcaccggggagcccgctacatacggagagctgcagcagcgctgcagacccgaccagttaacgggcctttcactcttacccctcagcgaaaaggctgccagggcgcgacaggaagagctgtacagtgaactccaggctcgggagactttcgagaaaacccccgttgaagtcccagtgggaggctttaaaggaagaactgtgaccgtgtgggaactgatcagctctgagtattttactgccgagcagcgccaggaactgctgcgccaattccgtactgggaaagtcaccgttgagaaggtcatcaaaattcttattacaatagtagaggaagtcgagaccctgcgacaggaacgactgtcgttcagcggtcttagggcccctgttcccgctagtgaactcctggcttccggcgtgctttcccgtgcccagttcgagcagctaaaggacggcaagaccactgtgaaggacctttctgagctgggcagtgtcaggacattacttcaaggatccgggtgtctggcgggaatctatctggaggacacaaaggagaaagtaagcatctatgaggccatgagaagaggtctgctgcgggctaccactgccgctttattattagaagcccaggcagctaccggcttcctcgtcgaccccgtgaggaaccagaggttatatgtgcacgaagcagtgaaagcaggggtggtgggtccagagctccacgagcagctcctcagcgccgaaaaggcagtgactggctaccgagatccctatagcgggtctactatcagcctgtttcaggccatgcagaaaggactcgtattgcgacagcatgggatccggttgctcgaggcccagatcgctacaggcggaattatcgacccagtccactcccacagagtaccagtggatgttgcttatcagcgtggctacttctcagaggagatgaaccgggtcctggccgacccctccgatgacacgaaaggcttctttgatccgaacacccatgaaaacctgacgtaccgacagttattagagagatgtgtggaggatcctgaaaccggactccggctgctgcctctcaaaggcgcagagaaagccgaggtcgtagaaacaactcaggtttataccgaggaggagactagacgggcttttgaagagacacagattgatatcccaggaggtggtagccatggaggttccaccatgagcttgtgggaggtgatgcaatccgacttgatcccggaagaacaacgcgcacagttgatggccgactttcaggccggtcgcgtcactaaagagcgaatgatcataattatcatcgaaattatcgagaaaacggagattatccgacagcagggcctcgcaagctacgattatgtcaggagacgactgaccgcggaagacctctttgaggcgcgtatcatcagcctagagacatacaacctgttgcgggaaggcacgagaagcctgcgcgaggcactcgaggccgaaagtgcttggtgctatctctacggcactggaagcgtggccggtgtttatctgcctggatccagacagaccctttcgatttatcaggccttgaagaaggggttgctgtccgccgaggtggcccgactgctcttagaggcccaggccgctacgggattcctcctggacccggtgaagggcgaacggttgactgtggatgaagccgtgagaaagggactcgtggggcctgagcttcatgaccgcctactgagcgcagagcgcgcagtcacagggtatagggatccctacacagagcaaactatctccttgtttcaggccatgaagaaggagctcatcccaaccgaggaagcgctgagactactcgatgctcagctcgctaccgggggtattgtggacccacgcttaggattccacctcccactggaagttgcttatcagcgaggttatcttaacaaagacacacatgatcagctatcagaacccagtgaggtgcgctcctacgtggacccttccacagacgagcgcctctcctacacacagctgctcaggcggtgccgaagggacgatgggaccggacaattactgcttcccctcagtgatgcacggaagctcactttccggggactccggaagcagataaccatggaagaactggtgaggtctcaggtgatggacgaagctaccgccctgcaactgcgggagggtctgacctcgatcgaagaggtgacgaagaacctgcagaagtttctcgagggaacaagctgtattgccggtgtgtttgtcgacgcgacgaaagagaggctgtcggtgtatcaggccatgaaaaaaggtattatcagaccaggtacggctttcgagctgctggaggctcaggctgcaactggctatgtgattgaccctatcaagggtttaaagctaaccgtggaagaggctgtgaggatgggcatcgtgggccctgagttcaaagacaaactgctgagcgcagaacgagccgtcactggctataaggatccgtatagtggaaaactcatttcactgtttcaggccatgaagaaggggttgattctgaaagatcacgggatccgactgcttgaggcccaaatcgccacgggaggaatcatcgaccccgaggagtcccaccgcctgccagtggaagtagcttataagcggggtctgtttgatgaagagatgaacgagatcttaaccgatcctagcgacgataccaaaggctttttcgatccgaacaccgaggaaaatcttacttatttgcagcttatggaaagatgtataaccgacccgcaaaccggtctgtgtttactgcccctcaaggagaaaaagagggagcggaagacctcatcaaaatcctcagtgaggaaacgaagggtggtgatcgtagatccagagaccggaaaagaaatgtctgtgtatgaggcctacagaaagggtctcatcgaccatcaaacctatctggaactcagcgaacaggaatgcgaatgggaagagatcacaatttccagcagcgacggcgtcgttaaatcaatgattattgaccgacgatctggacgccaatacgatatcgatgacgccattgctaagaacttgatcgatcggagtgctctcgaccagtatcgcgctggaaccctgagcattaccgagttcgctgatatgttgagcggtaatgctgggggattcagaagccggagttcgagtgtgggcagttcttcgtcctaccccatttcaccggctgtgtccagaacccagctggcctcctggagcgaccccaccgaagaaaccggacccgttgctggcattctggacacagagactttagaaaaggtgtcaattacagaggccatgcacagaaatctggtggataatataaccggccagcgattgttggaagcgcaggcctgcacaggtgggattattgatccttctaccggcgaaagattcccggtcacagatgcggttaacaaaggcttagtcgacaaaataatggtcgatcggatcaatctagcacagaaggctttttgtgggttcgaagacccaaggacaaaaaccaagatgagtgcagcacaggctttaaagaaagggtggctgtattacgaagccggacaaaggtttctagaggtgcagtacctgacgggcggtcttattgagccagacacaccaggcagggtccccctcgatgaggctctgcagcggggaaccgtcgacgctaggaccgcgcaaaagttgcgggacgtgggtgcgtactccaagtatctgacatgccctaaaactaaactcaaaataagctataaagacgcccttgacaggtccatggttgaggaggggaccgggcttagactgttagaagcagcggcacagagcactaaggggtattattccccttattctgtttcaggttccgggtccaccgctgggagcaggacagggtccaggaccggttctcgcgcagggtctcgacgtggaagctttgacgcaactggctccggattttcaatgaccttttcatcttccagctactcatcttccggatacggacggcgttacgcgagcggctcttccgcaagtctcggcggacctgagagcgcggtggcatag

SEQ ID NO: 235209 - DNA, 13578 bp, Artificial Sequence
  Description of Artificial Sequence: Synthetic coding sequence
atggacccatctagggctattcagaatgaaatctccagcctgaaagatgagagggatcgtgtccaaaagaaaaccttcacgaagtgggtaaataaacatctcattaaagctcaacgccacatttctgacttatatgaagatcttagagatggacataatctgataagtcttctcgaagtgctgtcaggcgactcgctccctcgggaaaaaggacggatgagatttcacaagctgcagaacgtgcagattgccctggattatctgaggcaccgtcaagtgaaactggtaaatattagaaacgacgatatcgccgatggcaatccaaaactcactttgggcctgatttggaccatcattctccattttcagattagtgacatacaggtgtccgggcagtctgaggacatgactgccaaagagaaacttcttctctggtctcagcgtatggtggaggggtaccaaggcctccgatgtgataacttcaccagctcatggagagacggacgactttttaacgccatcatccacagacataaaccacttctgattgacatgaacaaggtttaccgtcagaccaatctcgagaatttggaccaggccttttcggtcgccgagcgtgacctcggagttacacgactgctggatccagaggacgtggacgtgcctcagcccgatgagaagagtatcatcacatatgtgagctccctttacgatgcaatgcccagggtgcctgatgttcaggacggagtgagagcaaacgaactccaattgcgctggcaggagtatcgcgagctagtgctacttttactgcagtggatgagacatcacacggccgcttttgaagagaggcgctttccctctagttttgaggagatcgagatcctatggagccagttcttgaagtttaaagagatggagttaccagccaaagaagcagataagaaccgctctaaggggatttaccagtccctcgagggagccgtgcaggctgggcagctcaaggtgccccctggctaccatcccttggacgttgagaaagaatggggaaagttacatgtggctatacttgaaagagagaaacagctgcgctctgaatttgagcggctcgagtgtcttcagcgtattgtcaccaagcttcagatggaggccggtctatgtgaggagcagttaaaccaggctgatgcattactgcaatccgacgtgcgcctgcttgctgcaggtaaagtgcctcaacgcgctggtgaggtggagcgcgatctggacaaagcggacagtatgataagattgctctttaacgatgtgcagaccctaaaagacggacgccacccacagggagagcagatgtacagacgagtatacagactgcacgagaggctggtagcaatacgcaccgaatataacttgagattgaaagctggggtggcagccccagcaacacaggtggcacaggtgactctgcaaagcgtacagagacgccctgagctggaagactctacacttaggtacctccaggacctcctggcctgggtggaggagaaccagcacagagtggacggggcagagtggggagtggatctgccgtcagtggaggcacagctgggctcccatcgtggactccaccagagtattgaagaatttcgggcaaagatcgaacgcgctcggtcagacgagggccaactgtcccctgccactaggggcgcataccgtgactgtttaggtagactggatctccagtacgctaaactcctgaattccagtaaagccagactgcgatcccttgagagccttcacagcttcgtggcagctgcaaccaaggaattgatgtggctgaatgaaaaagaggaagaggaggtgggtttcgattggagcgacaggaacactaacatgaccgctaagaaggaatcttactctgccctaatgcgcgagttagagctcaaggaaaagaaaattaaagaactacaaaacgccggtgaccggctcttacgagaggatcaccctgcaagacctactgtagagtcattccaggctgcactgcagacacagtggagttggatgctgcaactttgctgctgtatcgaggctcaccttaaggagaatgccgcttactttcagttcttctcagatgtgcgagaggccgaagggcagcttcagaagctacaggaggcactgcggcgaaagtattcgtgtgacaggagtgccactgtaacacggttggaggacctcttgcaggacgcccaggatgagaaggaacagttaaatgagtacaagggtcatttgagcggccttgccaagcgagcaaaggccgttgttcagttgaagccaagacacccagcgcatcccatgcgaggacgccttccgctgctggccgtgtgtgattacaagcaggtagaggtaactgtgcacaaaggggatgagtgccagctcgtgggacccgcacagccaagccattggaaggtactgtcatcgagcgggagtgaggctgccgtcccgagcgtgtgcttcctggttccaccccctaaccaggaagcacaggaggcagtgaccagactcgaggcacagcaccaagccctggtaacactatggcaccagcttcacgtggacatgaaatccctgctagcttggcagtcccttcgcagagacgtacagctcatcagaagttggagtctggctaccttccgcaccttgaaaccagaagagcaaaggcaagccctgcacagtctggaactgcactaccaagccttcctccgggatagtcaagacgccggtggctttgggcctgaagatcgcctgatggcagaaagggagtatggatcttgcagtcaccattaccaacagcttctgcaaagcctcgagcagggagcccaggaagaatcaaggtgccagagatgcattagtgagctgaaagacatcaggctgcagctcgaggcttgcgagacgcgaactgtacatagacttcggctgcccctggacaaagagcccgcacgtgaatgcgcccaaagaatcgcagagcagcaaaaagcgcaggccgaagtggaagggctgggaaagggagtggcacggctgagtgcagaggcagaaaaggtgctggctttaccagagcccagtccagctgctcccaccctacgatccgagctggagctgactttaggtaagctagagcaggtgcgaagcctgagcgccatctatctggagaagctgaagactatctccctggttatccggggaactcagggcgcagaggaagtactaagggcccacgaggagcagctcaaggaggcacaggcagttcccgcaactctacccgagctcgaggccacaaaggcctccctcaagaagctcagagcacaggctgaggcccagcagcccaccttcgatgcactccgagacgagctgagaggcgctcaggaagtgggcgaacggctgcagcagcgccacggagaaagagacgtggaagtggagaggtggagggagcgagttgcgcaactgctcgaacggtggcaggccgtgctggctcagaccgacgtccggcagcgggagctcgaacagctcggacgacaactgagatactatcgcgaaagcgcggaccccctaggggcatggctgcaagacgccaggcgccgtcaggagcaaattcaggcaatgcctctggccgatagccaggctgtgcgtgagcagcttcgccaggagcaggctttgcttgaagaaatcgagagacatggagagaaggttgaggagtgccagcgctttgcaaaacagtacattaatgctatcaaagattatgagctccaactagtgacctataaggcccagcttgagcctgtggcatcaccagctaaaaaaccaaaggtccagtctggctctgaaagcgttatacaggagtatgtcgacttgcgaactcattactcggaactgaccactttgacatcccagtatatcaaattcattagtgagaccctgaggcggatggaggaggaagagagattggcagaacagcagcgggctgaggaacgggaacggttggcggaggttgaggccgctctggagaaacaaaggcagcttgcagaggcccatgcccaggctaaagctcaggccgagcgcgaggctaaggaactgcagcaacggatgcaggaagaggtcgtccggagggaagaggctgccgtggacgcacagcagcagaagcgctccatccaggaagagctgcagcagttgaggcagtccagtgaggctgaaatccaggccaaggcccgtcaggccgaagccgctgagaggagccgacttcgaatcgaggaggaaattcgggttgtacggctgcagttggaagccacagaacggcagaggggcggagccgagggagaacttcaggctctcagagcccgtgccgaggaggccgaggctcagaagcgccaggcccaagaggaagcagaacgcctcagacgtcaggtgcaggacgagagccagcgcaagcgccaggccgaggtggagcttgcgagcagggtcaaagccgaagccgaggcagccagagaaaaacaaagagccctccaggcgctggaagagctccgtcttcaggcagaggaggcagagcgacgcttgcggcaggctgaggtcgaaagggcacggcaggtgcaagtggcactcgagaccgcccagcgttctgccgaagccgagcttcagagcaagcgggcttccttcgctgagaagacagcacagctcgaaaggtcgctgcaagaggaacacgtggcggtagctcaactgcgagaggaagcagaacgccgagctcagcagcaggctgaggccgaaagggctagggaggaggctgagcgtgagctggagagatggcagctgaaggcaaacgaagccctccggctgcgccttcaggccgaggaagttgctcaacagaagtctcttgcccaggcggaggctgaaaagcaaaaagaggaagcagagcgagaggccagacgcagaggcaaagcagaggagcaggccgtacgacagagggagctggctgaacaagaactcgaaaaacagcgtcagctggcggaaggcacagcccagcagcgcctggctgctgagcaggagctcattaggctgagggcagaaacggaacagggcgaacagcagagacaactcctggaagaagaactggcaagactacagcgagaggcggctgccgctacgcagaagagacaagaactggaggctgagctggctaaggtgcgagccgagatggaggtgctgctcgcttccaaggctcgcgctgaggaagagagtaggagcacttctgagaagtctaagcagcggctagaggctgaagcgggtaggtttcgtgaactggccgaggaagcagccagattgcgagccctcgcggaggaggccaagcgacaaagacaattagctgaagaggatgcggcacgtcagcgcgctgaagcggaaagagttctcgctgagaagttggccgctataggggaggccaccaggttgaaaaccgaagccgagatcgctcttaaggagaaagaggctgaaaacgaaaggttacgcaggcttgccgaggacgaagcctttcagagaagaagactggaggaacaggcggcacagcacaaagccgatattgaggagcggctcgctcagctccggaaagcctcagattcagaattggaaagacaaaaaggattagtcgaagacacgctgagacagagaagacaggttgaagaggaaatccttgcgcttaaagcatctttcgagaaagctgcagccggtaaagccgagttagagctcgaactaggtcggatacgaagcaacgcagaagatacccttcgttcaaaagaacaagctgaactggaagccgctcgacagcgccaactggcggcagaagaggagcgacgcagacgtgaagccgaggagagggtgcaaaaaagtctcgccgctgaggaggaggccgcaaggcagcgcaaagctgccctggaagaggtggaacgcctgaaagccaaagtcgaggaagcccgacgcttgcgggaacgagccgaacaggaatctgccaggcagctccagttggcccaggaagcagcccagaaaaggctgcaggctgaagaaaaggctcatgcattcgcggttcagcagaaggagcaggagcttcaacagactctgcagcaggagcagtctgttctcgaccagctaaggggggaggcagaagcggcacgacgcgctgcagaagaggctgaagaagccagggtccaggccgaacgggaggcagcccagtcaaggaggcaggttgaggaggcagaacgactgaagcagagcgcagaagaacaggcacaggcacgcgctcaggcgcaggctgcagctgagaagctacgcaaggaggcagagcaggaagccgcacgtcgcgcacaggcagagcaggcggcactgagacagaaacaagccgctgatgcagaaatggagaaacacaagaagttcgccgagcagacgctgcgtcagaaggcgcaggtcgaacaggagctgaccaccctcaggcttcagctagaggagaccgaccaccagaagaacctcctagacgaggagttgcagcgattgaaggcagaggccacggaagcggcaaggcagcgctcacaagtggaggaggaactgttctctgtccgtgtgcagatggaggaactcagcaagctgaaagccaggatcgaagctgagaatagagctctaattttgcgggataaagacaacactcagcgtttcctacaggaagaggcggaaaagatgaagcaggtcgccgaggaggctgccaggttaagcgttgcagcacaggaggcggctaggctccgacagttggccgaagaagacctcgcgcagcaacgcgctcttgccgagaagatgcttaaggaaaagatgcaggccgtgcaggaagcgacaagactcaaggccgaggccgaactgctgcagcagcagaaagaactggcccaggagcaggcacgccgactacaggaagacaaagaacagatggcccagcagctagctgaagagacccagggatttcaaagaactctcgaagcggaacggcaacgccagttagaaatgtcagccgaggctgaacgcctgaagctgcgggtcgccgagatgagcagagcccaggcccgagcagaggaagatgcgcaacgtttcagaaagcaagccgaggaaataggcgaaaaactgcatcgcaccgagctagccactcaggaaaaggtcacgctggtacaaactctggaaatccagagacagcaaagcgatcacgatgcagagcgcctgcgcgaagcaattgctgagctcgagcgagagaaagagaaactgcagcaggaggccaaactgctgcaactaaaaagcgaagagatgcagaccgtccaacaggaacagctgctgcaggagacccaggcattgcagcagtctttccttagcgagaaagatagtctgcttcagcgagagcgttttatagagcaggagaaggccaaactggagcaattgtttcaggacgaggtggctaaagcccagcagctgagagaggaacagcagcgccaacaacagcagatggagcaagaacgacagcgcttggtggcttccatggaggaagcgaggcgcaggcagcacgaggccgaggagggagtacgcagaaaacaggaagagcttcaacagctagagcagcagcgacggcagcaggaggagctcttggccgaggaaaatcagaggcttcgcgagcagctgcagctgctcgaggaacaacaccgcgcagctctagcccacagcgaagaagtgacagcaagccaggtggccgcaactaagactctgccaaacggcagagacgcacttgacggccctgctgcagaggccgagccagagcactctttcgacggactccgaaggaaggtgtccgcccaaaggctgcaggaagcgggaatcctgtccgcagaggagctgcagcgactggcacagggccatacaacagtggacgaactcgcacgacgggaagatgtccgtcattacctgcagggtagaagctccattgcaggccttctgctgaaggccacaaacgaaaagttgagtgtgtacgcagctctgcagcggcaactcctctcccccggaaccgccctgatcctgctcgaagcccaagcggctagcggctttctccttgaccctgttcgaaatcggcgattgacggtcaatgaagccgtgaaagagggcgttgttgggccagaattgcatcataaactgttaagcgcagagcgcgcagttaccggatataaggacccctacactggacagcaaatctcactcttccaggcaatgcaaaaaggcttgattgtccgcgagcacggtatccgtcttctggaggcccagatcgcgacaggaggagtcatcgaccccgtgcacagtcaccgggtacctgtcgatgtggcctaccgcagaggatatttcgatgaggagatgaatagagtattggcggatccttcagatgacactaagggcttcttcgacccaaacactcatgaaaacctaacttatcttcaactcctggaaagatgtgtcgaggatccagaaactgggttgtgcctgctgcccctcaccgacaaagcagccaagggcggtgaactggtgtacactgactccgaggcacgcgacgtgttcgaaaaagcaaccgtgtctgccccttttggaaagtttcagggaaagactgtgacaatttgggaaataatcaactccgagtattttactgcggagcagcgcagagacctgttacgccagttccggaccggaagaataactgttgagaaaatcataaagatcattatcacagttgtggaggagcaggagcagaagggaaggttgtgtttcgagggtttgcgcagcctggtgcccgcagcagagctgcttgagagccgcgtgattgacagagagctgtaccagcagctccaaagaggcgaacgctctgtgcgtgatgtagccgaggttgacaccgtaaggagagctctgcgtggtgcaaacgttattgcaggtgtttggctcgaggaggccggacagaaacttagtatatacaacgccttgaagaaagatctccttccatccgacatggccgtggcgctcctggaggcgcaggccggtacagggcacatcatcgatccggcaacatcagcccgactgactgtagatgaagcagttcgagctggcttagtcggaccggaatttcatgagaagttgttgtctgccgaaaaggctgttacggggtacagagacccctacactggtcagtcagtgagcctgtttcaggctcttaagaaaggccttatccctcgcgaacaaggcctgcgtctccttgatgctcaactgagcaccggcggtatcgtggacccgtcgaaaagtcaccgagttcctcttgatgtagcatgtgcgcgtggttgcctggatgaggaaacaagtagggcactttcagctcctagggctgacgcaaaggcctattcggacccgtcaaccggcgagcctgctacctatggggagctgcagcagcgctgccgccctgatcagctgaccggtctgagtctgctgcccttatctgagaaggccgctcgggcacgacaggaagaattgtactctgaactgcaggcaagagagactttcgaaaagactcccgtggaagtacctgtggggggtttcaagggacgcactgtgacagtctgggagctgatatcttcagagtacttcacagccgagcaacgccaggaactcttgagacagtttaggactggaaaggtgactgttgaaaaagtgatcaagatcctgataaccatcgtggaagaagtcgaaactctgcgccaggagcgcttgagcttttctggcttaagagcgcctgtccccgcaagcgaacttctggctagcggcgtgctgagtcgggctcagttcgagcagctgaaggacggaaaaacgaccgtaaaggacctctcagaactgggcagtgtgcggaccctgctacaggggagcggatgtctcgccggtatctaccttgaggatactaaagagaaagtgtcaatttacgaggccatgcggcgtggcctgctgagagccacgactgctgccctcctcctagaggcccaggctgccactggcttccttgtggatcccgtcaggaaccagagactctatgtacatgaggctgtcaaagcgggtgtcgtggggcctgagttgcacgagcagctgctcagtgctgagaaagcagtgaccggctaccgagacccctactctgggtcaacgatcagcctgttccaggccatgcaaaaaggtttggtgctgcgtcagcatggcattcgcctgctggaagcacagattgctacgggaggcatcattgaccccgtacatagccatagggtgcccgtggacgttgcctatcaacgtggatatttcagtgaggagatgaaccgggtgctggcggacccttctgacgatacaaagggcttttttgatccaaatacccacgaaaacctgacttacagacaattgctcgaaaggtgcgtcgaagatccagagaccggattaaggctccttcctttgaaaggtgccgagaaagccgaggtagttgaaaccactcaggtgtacaccgaagaggagacgcgaagggcgttcgaggagacacagattgatatccctgggggtggctcccacgggggttccaccatgagcttatgggaggtaatgcagtccgacctgataccggaggagcagagggcacagctgatggccgactttcaagctggccgtgtaacaaaagagcgaatgatcataattatcattgaaattatcgagaagactgagataattcgccagcaaggccttgcctcctacgattacgtgcgccgaagactgacagccgaggacctatttgaggccaggatcatttccctcgaaacatacaatttgttaagagaaggtacaagatctctgcgagaggcactggaagccgaatcagcctggtgttacctgtatggcaccggctccgtggctggggtgtacctcccgggatctcgacagaccctgtccatctaccaggctctgaaaaagggattattgtcggccgaagtggctagattactgctcgaagctcaggccgctaccggcttcctcctggacccagtgaaaggcgaacgcttgacggtcgatgaggccgtgcggaaggggctggtgggaccagagctgcatgaccgattactctctgcagagagagcggtaactggatatcgggatccctatactgagcagacaattagtctgtttcaggccatgaagaaggagctaatccctactgaggaggctctgcgcttactagatgctcagctggctacgggcggaattgtcgaccctagacttgggttccacctcccattggaagtggcctaccaacgcggatacctgaataaggatacgcatgaccaactttccgagcctagcgaggtgagatcctacgtggacccatcaacagatgaaagactctcatatacccaactactcaggcgctgccgccgagacgacggtaccggacaactgctgctccctctgtccgacgcccgtaagctgaccttccgtggcctgcggaagcagatcacaatggaggaacttgtccggtctcaggtgatggatgaggctacagcacttcagttgcgcgagggcctaacctcaatcgaagaggtgacaaagaatctgcaaaagtttctggagggaaccagctgcatcgctggtgtgttcgtggatgctaccaaggaaagactgtctgtttatcaggcgatgaagaagggaatcatccgtccaggtaccgccttcgaactgttggaagcacaagctgcaactgggtatgtgattgatcctataaagggcctgaaactaactgtagaggaggcagtgcgaatgggaatagtgggccctgagttcaaagataagctgttgtccgcagaacgagctgtgacaggatataaggatccctatagtgggaaactgatctcccttttccaggccatgaagaagggtcttatcctgaaagaccatggcattagactgctggaggcacagattgcaacaggcggtattatcgacccagaggaatcacaccggcttcctgtcgaggtggcctacaaacggggactgttcgatgaagaaatgaatgagattctgactgacccaagtgatgacacaaaaggtttctttgatccgaacacagaagagaatctgacatacctgcagttaatggagcgttgtataactgatcctcagaccggactctgtctgttgccacttaaagaaaagaaacgcgagaggaaaactagttcaaagagttccgttcgcaaacgtagggtggttattgtcgatcctgagacaggaaaagaaatgtctgtttatgaggcctacagaaagggacttattgaccaccagacctatctggaacttagcgaacaggaatgtgaatgggaggaaataaccatctcctcctctgatggtgtagtcaagtctatgattattgatcggaggtccgggcgacagtatgacatcgacgacgccattgcaaagaatttgattgacaggtctgcactggatcagtaccgcgcagggactctgtcgatcaccgaatttgcggacatgctgtccggcaacgcagggggattccgctcccgaagctcctccgtcgggagctccagttcctatccgatctctcccgcagtctcccggacacagttggccagttggagtgaccctaccgaagaaacaggccctgtggcagggattctggataccgagacgctagagaaggtcagtatcactgaggctatgcacaggaatctggtagataatatcactggccaacgcctgctcgaagctcaggcctgcactggtggtataatagacccttccacgggggaacggtttcccgtcacagatgcagttaataagggcctggttgataagatcatggtcgatcgcatcaaccttgcccagaaggccttttgtggctttgaggaccccaggactaaaaccaagatgagcgccgcacaggcattgaaaaaaggctggctgtactatgaagcaggacagcggtttctcgaagttcagtacctgactgggggactgatcgagcctgacacacctgggcgagttccacttgacgaagcacttcagcggggtaccgttgatgccagaaccgctcagaagttgagagacgtcggtgcctatagtaagtatctgacctgtccaaagaccaaactaaaaatcagttacaaggatgcgctagatagatctatggtggaggaaggtacgggattgagattgttggaagctgctgcccagagcaccaaaggatattactcaccctattctgtttctggcagcggttctactgcagggagtaggacagggagtcggacaggcagccgcgctgggtcaagacgcggatccttcgacgcaacaggttctggttttagtatgacatttagttcaagtagttacagcagctccgggtatggcaggcgttacgcaagtggatcaagtgcctccctcggcggtcccgaatccgcggttgcttac

SEQ ID NO: 235210 - DNA, 13602 bp, Artificial Sequence
  Description of Artificial Sequence: Synthetic coding sequence
atggctgggccattacccgacgaacaagacttcatacaggcctatgaggaagtccgggagaaatacaaagatgagagggatcgggtccagaaaaagacattcacaaagtgggtgaataaacacctgattaaagctcaacggcatatcagcgatctgtacgaagacctgcgcgacggtcataacctcataagtctgcttgaggttctgagcggggattctcttccgagagagaagggccgaatgcgattccacaagcttcaaaatgttcagattgctttggactacctgagacataggcaggtgaagctagtcaacattcgcaatgacgatatcgccgatggaaaccctaaactcacactcggcctgatttggacaattatcctgcatttccaaattagcgatatccaggtgagtggtcagagtgaggatatgactgccaaagagaagcttctcctgtggtctcagcgaatggttgagggataccagggtctaaggtgcgataatttcacctcctcctggagagacgggaggctgtttaacgcgataatccacagacataaacccctgctcattgacatgaacaaggtctataggcaaacgaatctcgaaaatcttgatcaggctttttcagtggctgagagagaccttggggtgactcgcttgctcgacccagaagatgtggatgtgccacaacctgacgagaagagcattattacttatgtgtcctccttatatgacgcgatgccaagggtccctgatgtgcaagatggagttagggccaacgaactgcagctgaggtggcaagagtacagggaactcgttttgcttctcttgcagtggatgcggcatcataccgctgcatttgaggaaaggcgcttcccttcctcttttgaggagattgaaattttgtggtcccaatttctaaagtttaaagaaatggaactaccggctaaagaggcagacaagaatcggagcaaagggatctaccagtccctggaaggtgcagtacaggccggacagcttaaggttcctccaggctatcaccccctcgatgtggagaaggagtggggcaaattacatgtagcaatcctggagagagagaagcagctccgctccgagtttgaacggctggagtgtcttcagaggatcgtgaccaagcttcagatggaggcaggcctttgcgaagagcaactgaatcaagctgatgctttacttcagagcgacgtgagactcttggcagcaggaaaggtaccccagagagcaggcgaggtagagcgggacctggataaagcagactccatgattcggctgctgtttaacgacgtgcagactctgaaagacggccgtcacccacagggggagcagatgtatcggagagtgtaccgccttcatgagaggcttgttgctatccgtacagaatataatctgcgactaaaagccggagtcgccgcacccgcaacgcaggttgcccaggtaacgctccaaagcgtacaacgaaggccggagctcgaagattccaccctgcggtatctgcaggatctactggcctgggtcgaggagaaccaacacagagtcgatggcgctgaatggggcgtggacctgccgtctgtcgaggctcagctgggctcccacaggggtctacaccagagcatcgaggaatttcgggctaagatagagagagctaggagtgacgagggacagctctcccctgcaacacggggtgcatatagggattgtttggggagattggatctgcagtacgctaagttattgaactcgagtaaggctagactcaggagcttggaaagcctgcattccttcgtggctgctgccaccaaggagctcatgtggctgaatgagaaggaagaggaagaagtgggatttgactggtctgaccgcaacacaaacatgacagctaaaaaagaaagttattctgccctgatgagggaactcgagctcaaggagaagaagatcaaggaactccaaaacgcgggtgatcgattgttaagggaggatcatcctgccaggcctactgttgaaagctttcaggctgccttacaaacccagtggtcatggatgctacagttatgctgttgtatcgaagcccatctcaaagagaacgcagcatacttccagttttttagtgacgtgagagaagcagaggggcagctgcaaaagctccaagaagcgttacgtaggaagtattcatgcgaccggtcagctacagtgacccgtctggaggacctgctgcaggatgcccaggatgaaaaggagcagcttaacgagtataaaggacaccttagtggactggctaagagggctaaggccgtcgtgcagctcaagcctaggcaccccgctcacccgatgaggggaaggctgcctctcctggctgtctgcgattacaagcaggtcgaggtgacagtgcataagggcgatgagtgccagctggtagggcctgctcagcctagccactggaaggtcctatcatctagtggttccgaagctgctgttcccagtgtctgctttctcgtcccacccccaaaccaggaggcccaggaggcagtaactcgtttagaagcacagcaccaggccctggtcactctgtggcatcagctgcatgtcgacatgaagagtctcctggcctggcagagtctgcgaagagacgtccagctgatcaggagctggtccctggcaacctttagaacactgaaacctgaagagcaacgccaggccctgcattccctggaattgcattaccaggcttttctgcgggatagccaggatgcaggcggtttcgggcctgaggacaggctgatggccgaacgcgagtatgggagctgcagtcaccactaccaacagctgctgcagtcacttgagcagggtgcccaggaggagtcaaggtgccagaggtgcatcagcgagcttaaggacatccgtctgcagcttgaagcctgtgaaacacggaccgttcacagactccgccttcctctggataaggagcctgcccgagagtgtgctcaaagaatcgcggagcagcagaaggctcaagctgaagttgaaggactcggcaaaggagtggcacggctgtcggccgaggccgaaaaggttctggccctgcctgagcccagccctgcggcaccaaccctgaggtcagaactcgagcttaccctgggcaagctggaacaggtaagatctctcagtgctatttatttagaaaagcttaaaacaatatccctagtaatccgcggtactcagggagccgaggaggtgttaagggcgcacgaggaacagctaaaagaagcacaggccgttcccgctacactcccagaattagaggcaactaaggcctctctaaaaaaactgcgggctcaggccgaggctcagcagcccacctttgacgccctgagggatgagctgcggggagcccaggaggtgggcgagcggttgcaacaaagacacggggagcgcgatgtagaagtcgagagatggcgagagcgcgtggcccagctgttagagaggtggcaggcggtcctggcccagacagatgttcggcagagggaactggaacagcttggtcggcaactaagatattatcgggagtcagcggatccactgggagcctggctccaggatgcaaggcggcgacaggagcagatacaggcaatgccccttgctgattcccaggcagtaagggaacagctgcggcaggaacaggctctgctcgaggaaattgagcgccacggggaaaaagtcgaagagtgccagcgattcgccaagcagtatattaacgccatcaaggactacgaactacagcttgtcacatacaaggcgcaactggagccagttgcctcgcccgcaaaaaagcctaaagtccaatccggaagcgagtccgtcattcaggagtatgtggatctgcggacccactacagtgaactcacaacactgacatcacaatacataaagttcatatccgaaacactcaggaggatggaagaagaagagcggttagcagagcagcagagagccgaagaacgggaacggctggccgaggtagaagccgctttggaaaaacaaagacaattagccgaagcccatgcccaggccaaggctcaagctgagagggaggcaaaggagctgcagcagcggatgcaggaggaggtcgtgaggcgagaagaggccgcagtggatgcccaacaacaaaaacggtcgattcaggaggagttacagcaactaaggcaatcttccgaggcagagattcaagccaaagcacgacaagccgaagcagccgaaaggagccggctcaggatcgaggaagagattcgggtggtcaggctgcagttggaggccacagagcgccagagggggggagcggaaggggaattacaggccctacgggcacgcgctgaggaagccgaggcacagaagagacaggcccaggaagaagctgagcggcttcgcagacaggttcaggacgaatctcagcgcaaacgacaagcggaggtcgagctcgcatcgcgggtcaaggcagaggcggaagcagcacgtgagaagcaacgcgctctgcaggcactggaagagctgcgcctccaagctgaagaggcagaaaggagactgcggcaagccgaggtcgaacgggcaagacaggttcaagtagctttagagacggcgcaacggagcgctgaggcagagctgcagagcaagcgagcctctttcgctgaaaagaccgcccagctagagcggtcgctccaggaggaacacgtggccgtggcccagcttagagaagaagcagagagacgggctcagcagcaggccgaggccgagagagccagggaggaggctgaacgggagctcgagcggtggcagctgaaagccaacgaggcactgcgtttgaggctgcaggctgaagaagtggcccaacagaagtcattggcccaggccgaagccgaaaagcaaaaagaggaagcagagcgagaggcacgcagaagaggcaaggccgaagaacaggcggtcaggcagcgtgagcttgctgagcaggagctcgaaaagcagagacagctggcggaggggactgcacaacaaagactcgctgcggaacaggagctgatcaggctgagagcggaaaccgaacagggcgagcagcagagacagctgcttgaggaagagctcgcccgattacagagggaagctgccgctgcaacacagaagaggcaggagttagaagccgagcttgcgaaggtccgtgccgagatggaggtgctcttggccagtaaggcacgggctgaagaggagagccgttccaccagcgagaaatcaaaacagcgcctggaagccgaggccggaagatttagggaactcgctgaggaggctgcacggctcagggccctggccgaagaagccaagaggcaacggcagctggccgaagaggacgccgctcgtcagcgggctgaggccgagcgagtgctcgctgagaaactggccgctatcggagaggcaacacgactcaaaacagaggcagaaattgccttgaaagaaaaagaggctgaaaacgagcgcctgcgcaggctggcagaagatgaggccttccagagaagacggctggaagagcaggcagcccagcacaaggcggacatcgaagagagattggcccaattgcggaaggcctccgactcggaattggagcgtcaaaaaggcttagtggaggatacacttcgtcagcgcagacaggtggaggaggagatactggccctgaaggcatcgtttgagaaggccgcagctggaaaagcagaactggaactagagttgggcagaatccggagcaatgccgaggataccctccgcagtaaagaacaggccgaactcgaggccgctcggcaacgacagttagccgcagaggaagaaagacgaagacgggaggcggaggagcgcgtacagaaatccctggccgctgaggaggaagcagctcgccagaggaaagctgccctcgaggaggtcgagaggctgaaggccaaagttgaggaggccaggaggctgcgggagcgagctgagcaggagagcgccagacagctgcagctggcccaggaagcagctcaaaagcggcttcaagccgaggaaaaggcccacgctttcgccgtgcagcagaaggagcaggaactgcaacaaacactgcaacaagaacagagtgtcctggatcagctgcggggtgaggctgaggccgcacgaagggccgctgaggaagccgaggaggcacgcgttcaggcagagcgcgaggctgcccaaagcaggcgtcaggtggaggaagccgagcgcctcaaacagagtgctgaagaacaagcccaggcgcgagcacaggcccaggcagccgcagaaaaactccggaaagaagccgagcaagaagctgcccgtagagcccaggcagaacaggcagcactgaggcagaagcaagctgccgacgccgagatggagaagcataagaagtttgctgaacaaaccttgaggcagaaagcccaagtagaacaggaacttactactttgaggttgcaactcgaggaaacggatcaccagaaaaacctgctagacgaggagttacagagactgaaagctgaggccaccgaggcagctcggcaaaggagccaagtggaggaggagttattttccgtacgcgtacaaatggaggagctctccaagttgaaagctcgcatcgaagccgagaatcgggctcttattctcagagacaaagataatacccagcgtttcctgcaggaagaggccgagaaaatgaagcaagtggctgaggaggctgctcgtctttcagtcgctgcccaagaagcagcacgtctgcggcagcttgccgaagaagatctcgcccaacaacgggcactcgccgagaagatgctcaaggagaaaatgcaggcagtgcaggaggctacccgactgaaggcagaagctgagctcctccaacaacaaaaagagcttgcccaggagcaggccagaagactgcaggaagataaagagcagatggcacaacagctcgccgaggagacacaaggtttccagcggacgctcgaggctgagagacaaaggcagctcgaaatgtcagccgaggcggagagactcaagctcagagtggcagaaatgtcaagggcgcaggcgcgagccgaagaagacgcgcagcgatttaggaagcaggctgaggaaataggcgagaaacttcaccgcactgaacttgccacacaggagaaggtcaccttggtgcagaccctcgagattcagaggcagcagagcgatcatgatgccgagcggttgagagaggctattgccgagcttgagagggaaaaagagaagctccagcaagaagctaagcttctccagctgaaatctgaagaaatgcagactgtgcagcaggagcagttgctgcaggagacacaggccctccaacagagctttctttcagagaaagattcccttctgcagcgtgaaagatttattgagcaagaaaaggccaagctcgaacagctcttccaagacgaagtggccaaggcgcagcaattgcgggaagagcagcaacgccagcagcagcagatggaacaggaaaggcaacgactcgtggccagcatggaggaagctagaagaagacagcacgaggcagaagagggcgttcggagaaaacaggaggaactccagcaactcgaacagcagaggcgccagcaggaagagctcctcgcagaagaaaaccaacggttacgggagcagttacagctcctcgaggagcagcatcgtgctgcactggctcacagcgaggaagtgacagccagccaggtagcggcaaccaagacccttcctaacggccgtgacgccctggacgggcctgctgccgaggccgagccagaacacagtttcgacggactgaggagaaaggtgagcgcccagcgcctccaggaggcagggatactcagtgccgaagaattacaacggctggctcagggccacacgactgtggacgaactcgccagacgagaagatgttcgtcattatctgcaggggagatcctccattgctggactgctgctcaaagcaacaaatgaaaagctcagtgtgtacgcagccttgcaacggcagctcttaagtccgggaacagccctgatcctactcgaggcgcaagctgcttctggctttctgctggacccagtgaggaatcgtagactgaccgtgaacgaggccgtgaaagaaggtgtggtggggccagaattgcatcataaactactgagcgccgagcgtgccgttacagggtacaaggatccatacacaggacaacagatctcgctgtttcaggccatgcaaaaagggcttatagtacgggagcacggtatcaggttactggaagcacaaattgccaccggcggagtgatcgatcctgtgcactctcacagagttcctgtcgatgtggcataccgcagaggctatttcgacgaagaaatgaaccgggtgctggcagatccaagcgacgacacgaaaggcttctttgaccccaatacacatgaaaaccttacgtatctgcagctactggagagatgcgtagaggacccagagactggcctgtgcctcctgccgctcaccgacaaagctgctaagggaggggaacttgtttacacggatagcgaagcacgagacgtgttcgagaaagccaccgtatccgcacctttcggaaaattccagggcaaaaccgtcactatttgggaaattattaacagtgagtatttcacagccgagcagcgacgggacctactccggcagtttagaactgggaggattactgttgaaaagattattaagattattataaccgtggtggaggaacaagaacagaaggggcgtctctgcttcgaaggactcagatcactggttcccgcagctgagttgctcgagtccagagtaatagacagagaattatatcagcagctacagcggggagagcgttcagtgcgcgatgtcgcagaagttgacaccgtgcgccgagcactgaggggggcaaatgttattgccggagtttggctcgaggaagcaggtcagaaactttccatctacaatgcactgaaaaaggaccttctaccttctgacatggccgtggccctgttggaggcccaggccggaactggccacatcattgaccctgccaccagcgcccgtttgactgtggacgaagctgtacgggctgggctggttggtccagaatttcacgagaagcttctgtctgctgagaaggctgtcactggctatagggatccatacacgggccagagcgtgtcgctgttccaagccttgaaaaaggggttgatcccgcgtgagcaagggctgaggctgctcgacgcccaactaagcacaggagggattgtggatccatccaaatcacacagagtacccctggacgttgcctgtgctcggggttgtctggacgaggagacatctcgggctctctctgcacctagagccgatgccaaggcgtactccgatccttctacaggagaacccgcaacatacggagagttacagcaacgttgcagaccagaccagctgacaggcctatcgctgctgcccctgtctgaaaaggccgcaagggcccgtcaggaagaattgtattccgagcttcaggcacgcgagacttttgagaaaactcctgtggaagtgcccgtgggtggttttaaaggacgaactgtgaccgtgtgggaacttattagctctgagtattttaccgctgagcagcgccaggaactgctgcgacagtttcgcactggaaaggtgaccgtggaaaaggtgatcaagattctgatcacaatcgttgaggaggtcgaaaccctacggcaggagcggttgagtttttccggactccgcgctcctgtgccagcgtcagaactgttggcctcaggcgtactttcccgggcacagttcgagcagctgaaggatggcaaaacgacagtgaaggatcttagcgagctggggtcggtgagaacacttctacaaggatccggatgtcttgccggtatttacctggaagatacaaaggaaaaagtgagcatctatgaagccatgagaagaggcctactgcgggcaactacagctgcgctgctccttgaggcccaggccgctacaggcttcctggtcgatcccgtcagaaaccagagactttatgtccatgaggctgtgaaagctggagtggtcggtcctgaacttcacgagcagctgcttagtgccgaaaaagctgtcaccggataccgggacccttatagtggatccaccatatcactgttccaggccatgcagaaagggctggtgctccggcaacatggcattaggttacttgaggctcagatagcaactggcggtatcattgaccctgttcatagtcatcgggtacccgtggatgtggcttaccagcgcggatacttctctgaagaaatgaacagggttctggccgatccatccgacgacactaaggggttcttcgaccccaacacacacgaaaacctgacttatcggcagctcctagagcgatgtgttgaggatcccgaaactggcctccggctccttcctttaaaaggagccgagaaggcagaggtagtcgaaaccacacaggtttatacagaggaggaaactcgcagggcatttgaagagacccagatagatatccctggtggcggaagtcacggcggaagcaccatgtcgctgtgggaagttatgcagtcagacttgatccctgaagaacagcgcgcacaactcatggcggattttcaagcaggtcgcgtcacaaaggaacggatgatcatcattatcattgaaattatcgagaagactgagatcatccggcaacagggtctggcatcttacgattacgtgcgccgacgtctgacggccgaggacctgttcgaggctagaataatatctctggagacctacaacctgctaagagaaggaacacggtcgctcagagaagccctggaagccgaaagcgcttggtgttatctctatggcacgggatcagtggctggcgtctatctgccaggaagcagacagacactctcgatttatcaggcgctcaagaagggccttctttccgcagaagtagccagactgttgttggaggcccaggcggcaactggcttcttattggatccagtaaagggggaaagactgacagtggatgaggcggtgcggaagggtctggtgggaccagagctccatgaccggctcttgagcgcggagcgggctgtcacaggatatcgtgacccctatacagagcaaactatctctttgttccaagcaatgaaaaaggagctgatacccactgaggaagccctgcgtctgttggatgcccagcttgcaacagggggtattgttgatcctagacttgggttccatctacccctcgaagtggcctatcagcggggttacctgaacaaggatacccacgaccagcttagcgagccgtcggaggtgcgctcctatgtggaccctagtacagacgagaggctgtcatacacccaactgctgagacggtgcagacgcgacgacggcaccggtcagttgctcttgccgctcagcgacgccagaaagctcaccttccggggattgaggaaacagatcaccatggaagaattagttaggtcccaggtcatggacgaggctacagcgctgcagttaagagaaggtcttacgtcgattgaagaggtcacaaaaaaccttcagaagtttttagagggtactagctgtattgctggagtattcgtggacgccaccaaggaacgactcagcgtttaccaggctatgaaaaagggcatcatccgccctggcaccgccttcgagttgctggaggctcaggcagccacaggctatgttattgatcctatcaaaggactgaagcttactgtagaggaagctgtacgcatgggtattgttgggccagagttcaaggacaagctgctgagcgccgaaagagctgtgacggggtacaaagacccgtatagcgggaagttaattagcctctttcaagcaatgaaaaaaggcttgatacttaaggatcacgggatccgtttgctcgaggcacaaatcgccacaggcggtattatcgaccctgaggaatctcatcggctgccagtggaggtggcctacaagcggggactgttcgatgaggagatgaacgaaattcttacagatcccagcgacgataccaagggctttttcgatcctaacaccgaagaaaacttgacatacttgcagctcatggagcggtgcatcacagatccccaaaccggattgtgtcttctccctctgaaagaaaaaaagcgagaaagaaagacctcctctaagtcgtcggtacgcaagaggcgcgttgtgattgttgatccagaaactggcaaagagatgtccgtttatgaagcttataggaaaggtctgattgatcatcaaacctatctggagctttcagaacaggagtgcgagtgggaagagataaccatcagcagctctgatggggttgtgaaatccatgataatagatcgccgatcagggaggcaatatgatatcgacgacgccattgctaagaacctgattgacaggtctgctctggaccagtatcgggctggtaccctgagcattaccgaatttgcagatatgctctcaggcaacgctgggggattcaggtctcgttcttcctctgtgggatcttcttcatcttaccccatctcgcccgctgtctcaagaacccagcttgcttcctggtccgatccaaccgaggagactgggcctgtcgcaggaatcctggataccgagacccttgagaaagtgtctatcacagaggcaatgcatcgcaacctagttgataacatcacgggccagcgcctgctggaagcgcaggcttgtactggcggtataattgacccctcaaccggcgagcggttcccggtgactgacgccgttaacaagggtctggttgataagataatggttgaccggataaacctggcccagaaggctttttgtggttttgaagatcctaggactaagaccaagatgagtgccgctcaggccttgaaaaagggttggctatactacgaagccggacagagattcctggaggttcaatacctcacaggcggattaatcgaacctgatacgcccggtagagtgccgctggatgaagcgctccagcgtggcaccgtcgatgccagaactgcccagaagcttcgcgacgtgggggcttacagtaaatatttgacctgccccaaaacaaaactgaaaatctcatataaagacgcattggaccgaagtatggtggaggaggggaccggtctgaggttactggaggcagccgctcagtctactaaggggtattattcaccttactctgtgagtggttctggctctaccgctggctctaggacagggagcagaacaggctctcgagctggatcccgtcggggtagttttgatgcaaccggctcaggattcagcatgacatttagctcatcaagttacagttcttctggctacggcaggcgatacgcaagcggcagcagcgctagcctcgggggacccgagtccgctgtggcgtag

SEQ ID NO: 235211 - DNA, 13656 bp, Artificial Sequence
  Description of Artificial Sequence: Synthetic coding sequence
atgtctggggcaggcggagcctttgcctcacctagagaggtgctgctggaacgcccttgttggctcgatgggggatgtgagccagccaggcggggatatttgtaccagcagttatgctgcgtcgacgaaagagacagagtgcagaagaagaccttcaccaaatgggtaaacaaacacctaattaaagcccaacgccacataagcgacctctacgaggatcttcgggatggccacaatttaatcagcttgcttgaagtgctgagtggggactcgttaccccgagagaagggcaggatgcgattccacaaactgcagaacgtccagattgccctggactacctgcggcatcggcaggttaaattagtgaatattcgcaacgacgacattgccgacggcaaccccaagctcactctaggcctgatctggaccattatcctgcattttcagatctccgatattcaggtttcggggcagtccgaagacatgacagccaaggagaagctgttactgtggagtcaacgcatggtggaggggtaccagggcctgcgatgcgacaactttacctcttcatggagggacggcaggctgtttaacgccattatccatcgccataagcctctgcttatcgacatgaataaggtctacaggcagacaaacctggaaaacttggaccaggccttttccgtcgctgaaagagatctgggcgtgacacgactgctggaccccgaggatgtggacgtccctcaacctgacgaaaagagcattataacctacgtttcctctttgtatgacgcaatgcccagggtgcccgatgtgcaagatggagttagagctaatgaactgcagctccggtggcaggagtaccgcgaactcgtgttgctgctcctgcagtggatgaggcaccacactgctgcatttgaggaaagaagattccctagcagttttgaagagatcgagatcctctggtctcagttcctgaaattcaaagagatggagctcccagcaaaagaagccgacaaaaaccggagtaaggggatctaccagtccctggaaggagctgtccaagctggacagttgaaggtgcccccagggtatcatccccttgacgtcgagaaagaatggggaaagctgcacgtagctatccttgagagggagaagcaactgcgaagcgaattcgagaggctggaatgcctgcagcgtatagtgaccaagctgcaaatggaagccggactctgcgaagagcagctcaaccaggccgacgctttgctgcagtccgatgtgcgactattggccgcagggaaggttccacaaagagctggagaggttgaaagggatttggataaagcggactctatgattaggcttctttttaacgatgtccagaccttaaaggatggcaggcacccacaaggagagcagatgtataggagagtgtacaggttgcacgagagacttgtggcgattagaaccgaatataacttacggctgaaggctggggtcgcagccccagccacacaggtggctcaggtcacgctccagtcggtgcagcgacgtccagagttggaggattcaacacttcgatatctgcaagacctcttggcgtgggttgaggagaatcagcaccgcgtggatggcgcagaatggggggtcgacctgccatctgttgaggcacaactcggcagccaccggggactacaccagagtatcgaagagtttagggccaagatcgagcgtgcccgatctgatgagggacaattatcaccagcaacgcggggagcatatagggactgcttgggaaggctggatcttcagtatgctaaactgttgaacagttccaaggccaggctgcgcagcctcgagagtctgcactccttcgtggccgcagccactaaagaactgatgtggctgaacgagaaggaggaagaggaggttggatttgattggtctgaccgcaataccaacatgaccgctaagaaggagagctattccgctctgatgagagagctcgaacttaaagagaaaaaaattaaagagctgcagaacgccggagaccgcctgctccgtgaggaccaccctgcacggcctacggtcgaatcttttcaggcagcattgcagactcagtggagctggatgcttcagctttgctgctgtattgaagctcacctgaaggaaaacgccgcatatttccagttcttttcagacgtgagggaagccgaaggccagctccagaaattgcaggaggccttacggcgtaaatattcctgcgatcgcagtgcaacagttaccaggctggaggacttattgcaggacgcccaggatgagaaggaacagctgaatgagtataagggtcacttgtccggcctggccaaacgggctaaagctgtggtccaactcaaaccccgtcaccctgcgcatccaatgcgcggaaggctaccccttctggccgtatgcgattacaagcaagtggaggtcaccgtgcataaaggcgatgagtgccaactggtgggtcctgcccagccaagccactggaaagtgctatcttctagcggaagcgaggcagcggttccatccgtgtgcttcctggtccctcctccaaatcaagaggcccaggaggctgtcaccagattggaagcccaacaccaagccctggtcaccctctggcaccagctgcatgtggacatgaaatccttgttagcgtggcagtccttaaggagggacgttcagctcattcggtcgtggtcactggccacttttcggaccctcaagccagaggagcagcgacaggctctccactctctggagctccactaccaggctttccttagagattcacaagacgcgggaggcttcggaccagaagatcgacttatggccgagcgtgagtatggctcctgtagccaccattaccagcaactgcttcagagtttggagcagggggcacaggaagaatctcgctgccaaaggtgcattagtgagctgaaggacatacgcctgcagcttgaagcctgtgaaactcgcaccgtccaccgcctcagactgcctctagataaggagccagcccgagagtgtgctcaacgaatcgccgagcaacaaaaggcccaagccgaagtagaaggcctgggcaaaggagttgctcggctctccgccgaagcagaaaaagtgctggcgctcccagagccaagccctgccgcacctaccctccgctctgagctcgaactgaccctgggtaagcttgaacaggtacgatccctgagcgcaatctacctcgagaaactgaagacaatcagtctggtcatcaggggaacacagggggcagaagaagttctacgcgctcatgaggagcagctcaaagaagcccaggcagtccctgcaacacttcccgagctggaagcgacgaaggcctccctgaagaagctgagggctcaggctgaggctcagcagcccacattcgacgcactgcgcgacgagttgcgcggagcgcaggaggtgggcgaaagactgcagcaaaggcatggtgagcgggatgtcgaagtggaacggtggcgcgagcgcgtggctcaactgctggaacggtggcaggctgtattggctcaaactgacgtccggcaaagggagctggagcagttgggccgtcagctgcgctattacagagagtccgcagatcctcttggcgcttggctccaagacgcacggcgacgccaagagcagattcaagcaatgcctcttgcagattcgcaggcagttcgcgagcagctgcgacaggagcaagccttgttggaagaaatcgaaagacacggcgagaaagttgaagaatgtcagcgatttgcgaaacaatacatcaacgctattaaagattacgagctgcaactggtgacatacaaggcccagctagaacctgtggcctcccctgccaagaagcccaaggtacagtcagggagtgagagcgtgattcaagaatatgtcgatctcaggacccactattctgagctcaccaccctcacttcccagtacatcaagtttatatccgaaacactcaggaggatggaggaagaggaaagactagccgagcagcagcgcgctgaggagagggaacgcctggcggaggtggaggccgctctggagaaacagagacaactagctgaggcacacgctcaggcaaaagcccaggctgagcgcgaagctaaggagcttcagcagcgcatgcaagaagaagtggtacgcagggaagaggccgctgttgacgcacagcagcagaagagatctattcaagaagagctccagcaattaaggcagtcaagtgaagcagagatccaagctaaagccaggcaggccgaagcagcggaaaggtcaaggctgcgcatagaggaggagatacgggtagtgaggctgcagctggaggccactgagcggcagagaggcggtgccgagggcgaactccaagcactaagagcccgagcagaggaggcggaggcacaaaagagacaggcgcaggaggaggccgaacgactcaggaggcaggttcaggatgaatcccaaagaaaacgccaagccgaggtggaattagcctccagagtgaaggcagaggctgaagccgcacgggagaagcagagagccctgcaggctctggaggagctgcgtttacaagccgaagaggctgaaaggagactaaggcaggctgaagttgagagggctagacaggttcaggtggccttggaaactgcacagagatccgccgaagctgaattgcagagcaagcgggcttcgtttgccgagaagaccgcgcagctcgaacgctccctgcaagaagaacacgtggcggtagcccagctacgcgaggaagccgagcgcagagctcaacagcaagctgaggccgagcgggcacgcgaagaggctgagcgggaactcgaacggtggcagctgaaagctaacgaagccctgaggctgcggctgcaggccgaagaggtcgcacagcagaaaagccttgcccaagcagaagccgagaagcagaaggaggaggccgaaagggaagcccgtcggagaggcaaagcggaggagcaggcggtgcggcagagggaactagccgaacaagaactcgagaagcaaaggcagctggccgaaggcacagcgcagcaaaggctggcagcagagcaggagttgattaggctccgcgcagaaactgagcagggagagcagcagcgacaactgctggaggaggaacttgccagattacagcgggaggccgcagcagctactcaaaagagacaggaactggaggcggaactggccaaagtgcgggctgagatggaggtactgttggccagcaaggctcgcgcagaagaagagtcccggtccacctccgagaagtccaaacagcgactggaagccgaagccggtcggtttcgggagttggctgaggaagcagctagactgcgtgctctggctgaagaggccaagcgccagcggcagctcgcagaggaggacgcagcacgccagcgcgctgaggccgaaagggttctcgctgaaaaactggcagctatcggggaagccacacgcttgaagaccgaagctgagattgccctaaaagagaaagaggctgaaaatgagcgcctcaggagactggcagaggatgaggcattccagcgtcggagactggaggaacaggcagcccaacacaaggccgacatcgaggagagattagctcagttgcgcaaagcaagtgactctgaactggagcgccaaaaaggcctggttgaggatacactgagacagcgcagacaggttgaggaagaaattctcgctctgaaagctagctttgagaaagcggcagccggaaaggctgagctggaactagagctgggtaggatccggagtaatgctgaggacaccctgagatccaaggagcaggctgaactcgaggcagctcgtcaaaggcagctggccgcagaagaggaaaggcgccgtcgggaagccgaggagcgcgttcagaagagtctggcagcagaagaagaagccgcacgccaacggaaagcagcccttgaggaggttgaacggttgaaagcgaaggtggaggaggcacgccgtcttcgcgagcgtgccgagcaggagagtgcgaggcagctacagctcgcacaggaggctgctcaaaaacggcttcaggctgaagaaaaggcccacgcatttgctgtgcaacagaaggagcaggagctccagcaaaccctgcagcaagaacaatctgtgctcgatcaacttcgaggtgaagcggaggctgcgagaagggccgcagaggaggctgaggaagcccgtgtgcaggctgaacgtgaggcagcacagtccagaaggcaagtggaggaggccgagcggctaaaacagagcgctgaggagcaagcacaggccagagctcaggctcaggcggcagcagagaaactgcgtaaagaagccgagcaagaagctgcacggagagcccaggccgagcaggccgctcttaggcagaaacaggccgctgacgctgagatggagaaacataaaaaattcgcagagcaaactttacgccagaaggcacaggtagagcaagagctgaccacacttagattacagctcgaagagaccgaccaccaaaagaacctgctcgatgaagaactacagcggcttaaagcggaggcaaccgaggctgcacgacagcgatcgcaggttgaggaggaattgttcagcgtccgggtgcagatggaggaattgtctaagctaaaagccaggatcgaggccgagaatcgggctctgatcctccgagataaagataacacccagagatttctgcaggaagaagctgaaaaaatgaaacaggtcgccgaggaagcagccaggctgagcgtggccgctcaggaggcagcgcgactcaggcaactcgcagaagaagatctggcacaacagcgcgcactggcagagaagatgctgaaggaaaagatgcaggcagtccaggaagctactcgcctgaaggcggaggctgagctgctgcagcagcagaaagaattagcccaggagcaagctagaaggctacaggaggataaggagcagatggcccagcagttggcagaggagacgcaggggttccagcgtaccctcgaggctgagcgacagcgacagttggaaatgtcagcagaggcagagcgccttaaactacgcgtggccgaaatgagccgggctcaagcccgagccgaagaagacgctcagcgcttccgcaaacaggctgaggagatcggtgagaagctgcatagaaccgagttagccacccaggaaaaagtcacgctggtgcaaactctggaaatccaacgccagcagagcgaccatgacgccgaacggcttcgagaggcgatcgctgaattagaacgcgagaaagaaaagcttcagcaggaagccaagctgctgcaacttaaaagcgaagaaatgcagacagtacagcaggagcagctgttgcaagagacacaggcactgcaacagtcattcctgtccgagaaggattcactgctacagagggaaaggttcatcgagcaggagaaggcaaaacttgaacagctcttccaggacgaagtagccaaggcgcagcaactgcgggaggagcaacagcgacaacagcagcagatggagcaggagagacaacgattagtcgcatcaatggaagaggctcggagaaggcagcacgaggccgaggaaggcgtccggagaaagcaggaagaattgcaacagttggaacagcaaagacggcagcaggaagaactactcgcagaagaaaatcagaggctgagggaacagttgcagctgctcgaggagcagcaccgtgccgcactggctcatagcgaggaggttaccgcctcgcaggtcgccgctaccaaaactctgcccaacgggagagatgctttggatggccctgccgcagaagcagagcccgagcactccttcgacggtctccgtcggaaagtgagtgctcagaggcttcaagaagctggaatcctctcggcagaagagctgcagagactggcacaaggccacaccacagtggacgagttggctcgccgagaagacgtacgccactacctacagggccgtagtagcatcgcaggactcttgctcaaagcaacgaatgagaaactatcggtctatgcagctctgcagcgccagctcctgtctcctggaaccgctttgattttactcgaggcccaagcagcttctggcttcctcttggatcccgtgcgcaacagaagactgaccgtgaatgaggcagtgaaggaaggcgtggtgggtcctgaattacaccacaagttgctgtccgcggaacgggcagtgaccgggtataaagatccgtatactggccagcagatttctctgttccaggccatgcagaagggcctcatcgtcagggaacatggaattcgacttctagaagcccagatagctactgggggtgtgatagaccccgtccacagccaccgggtcccagtcgatgttgcttatcgtcggggttactttgatgaggaaatgaacagggtgctcgctgatcctagcgatgacacaaagggtttctttgatcccaacacacacgagaacctgacatatctgcagttattggaacggtgcgttgaggaccctgagactggcctctgcttactgcccctgaccgacaaggcagctaaaggtggcgaactggtctacacagactctgaagctagggatgtgtttgaaaaggccacagtctccgctccctttggcaaattccaaggcaagactgttacgatctgggagattattaatagcgagtattttacagccgaacaaaggcgcgacctgcttagacagtttcgaactggccgtattactgtggaaaagatcataaagatcatcatcactgtggtggaggaacaagagcagaaaggccgactttgcttcgaaggactccgatcactggtccctgccgcagaactgctggagagccgggtcatcgatagggaactctatcagcagctgcagcgcggtgagcgctcagtgcgagacgtagccgaagtggacaccgtaagacgggctctccgcggtgcaaacgtgatcgccggagtgtggctggaggaagcagggcaaaagctttcaatctataatgccctgaagaaggatctgctcccgagcgatatggctgtcgccctcttggaggctcaggctggaacaggacatattattgaccctgctactagcgccagattaacagtcgatgaagccgtccgcgctggactcgtggggccagaattccacgagaaactgcttagcgctgaaaaagctgtgacgggatacagagatccctatactggccaaagtgtgtccctgtttcaggcactcaagaaagggctcattcccagagaacagggcctaaggctgcttgacgcacagctgagtactggcggaatcgtcgacccttctaagtctcacagggtgccactggatgtggcctgtgcacggggatgcctcgatgaggagacctctagagccctgtcggccccacgggcagacgccaaggcttactcggatccatcaacaggagaaccagctacgtatggtgagttgcaacagagatgtcggccagaccagttgactggtctgtccctgctgcccctgagcgaaaaagcagctagagcacgacaggaagagctctattccgaactacaggcccgtgaaacgttcgagaaaacccccgtggaagtgcccgttgggggatttaaaggcaggaccgtcacagtgtgggagcttatttcctcagaatattttaccgcagagcagcggcaggagctgctgcgtcagttccgcaccggtaaagttactgttgagaaggtaatcaaaattctgattaccattgtggaagaggtagagacactgcgccaggagagactgagcttcagcggactaagggcgccagtgcccgcatcagaattgctggcctctggcgtgctgagtagagctcagttcgagcagcttaaagatggaaagactacagtgaaggatctcagtgagctgggttccgttcgcactcttctccagggatcaggctgcctcgctgggatctacctcgaagacactaaggagaaggtgagcatatacgaggcgatgcgacgcggacttctcagagctacaactgcggctctgctcctcgaggcgcaggccgcaaccgggttcctggtggatccggtccgaaaccaacgcttgtacgtccacgaggccgttaaagctggggtcgtgggccctgagctacacgagcagcttttgtctgccgaaaaggctgtgaccggctatagagatccttactccggcagtactatcagtctgttccaggcgatgcaaaagggcctcgtcctgaggcagcacgggatcagactgctagaggctcaaattgccaccggaggaatcatcgatcctgtgcactcacacagggtgcccgtcgacgtggcttaccagcgagggtacttttccgaagagatgaatcgcgtcttggccgatccctcagacgacactaaagggtttttcgatcccaacacacacgaaaacttaacctatcgccaactactagagcggtgtgttgaggacccagagactggtctgagactgctgcccctaaagggcgcagagaaggcagaagtcgttgagaccactcaggtgtacaccgaagaggaaacccggcgtgcattcgaggagactcaaattgatatacccggtggtggttctcacggaggctctaccatgtccctatgggaagtgatgcagagcgacttgatacctgaggaacaacgcgctcagttgatggccgactttcaagccggtagagtcacaaaagagcggatgattataattattattgagatcattgaaaaaaccgagatcatacgccaacaggggctcgctagttatgattacgtcaggcgcagactcactgctgaggatctgttcgaggccaggattatcagtctggagacttacaacctgctgcgcgaagggaccaggtctctgcgcgaagcccttgaggcggagagtgcctggtgctacctctacggaacgggttctgtggccggtgtgtacctaccaggcagtagacagacattgtcaatctatcaggcgctcaagaagggcttgctatcagcagaggtggctcggctgctgttggaggctcaagcagccaccggattcctgctcgatcccgtgaagggagaacggctaactgtggatgaggcggtacgcaaagggttggtgggacctgagttgcatgatcggttgctgtcagccgaacgagccgtgactggatacagagatccttatacagaacaaacgattagcctttttcaggctatgaagaaagagctgatacccactgaagaagctctgcgactgttggatgcccagttagctactgggggtatcgtggatccaaggctgggcttccacctgccacttgaggttgcttatcagcgcggttaccttaataaggacacccacgaccagctttcagagcccagcgaagttcgctcatatgtagatccatccacggacgagagactgtcctatacgcagctgctgcgcagatgccgacgggatgacggaacaggccagttgctcctcccgctatccgatgcgagaaagctgacctttcgcggtctgcgcaagcaaattacaatggaagagctggttagatcgcaagttatggatgaggccacggctttgcaactgcgcgagggactaacctccatagaagaagtaacaaaaaatctgcaaaaattcttggaagggacctcctgcattgcaggcgtttttgtggatgctaccaaggaacgtctgtccgtttaccaagccatgaaaaagggcatcatccggcctggaactgctttcgagctgcttgaggctcaggccgctacggggtacgtcatagatcccattaaaggcctaaagcttacagtggaagaggccgtgaggatgggcatcgtaggcccagagtttaaggataagcttctgtccgccgagcgcgctgttacaggctacaaggacccttatagtggcaagctgattagcctcttccaggctatgaaaaagggcctgatcctcaaggatcacggaatccggcttctagaggcccaaatcgctactgggggaataatagaccctgaagagtcccatcgcctgccagttgaagtagcctataagaggggcctgttcgatgaggaaatgaatgagatcctgaccgacccatcagatgatacaaaaggattcttcgatccgaatactgaagaaaacctgacttatcttcagttaatggaaagatgcatcacagacccgcaaacgggactgtgtttactgccacttaaggagaagaaaagggagcggaaaacatcctcaaaaagctccgtgcggaagaggagagtcgtaatagtcgaccccgagaccggaaaggaaatgagtgtgtacgaagcctacagaaagggattaatcgatcaccagacctacctggagttgtctgaacaggaatgtgaatgggaggagattaccatctccagttctgacggcgttgtgaagtctatgattatcgatagacgaagtgggcgtcagtacgacatcgatgacgccatcgcaaagaacttaatcgatcgctcagcactagatcaatatcgggcagggaccttaagcataaccgaatttgctgacatgctctcaggaaatgctgggggattcagatcgagaagcagctcagtgggttcctcctcatcttaccccatctcccccgcagtcagtagaacccagctcgcctcctggtcagacccaactgaggagacgggccctgtcgccggtatcttggatactgaaacccttgagaaggtgtctattactgaagccatgcatcggaatctggttgataacattaccggccagcggcttctcgaggctcaagcttgcacagggggtattattgacccgtctaccggggagcgttttccggtgacagacgccgttaataaaggcttggtcgataagatcatggtggatagaatcaacctcgcccagaaggctttctgtggatttgaggatccccgtaccaaaaccaagatgtcggcggctcaggcgcttaagaaaggatggctctactacgaggctgggcagcgatttctcgaagtacaatacctgaccggtggcctaattgaacctgacacccccggtcgcgtaccattggatgaggccctccaacgcggaactgtcgatgcacgcacagcccagaaactgcgtgacgtgggtgcttattctaagtacctcacttgccctaagaccaagctgaaaatctcttacaaggacgctttggatagaagcatggtggaggagggcaccggactgcggttgctggaggctgctgctcaaagcacaaaagggtattattctccatacagtgtgagcgggtccggttctacagctggctccagaacggggagcagaaccggaagtcgggctggaagtaggcggggatcttttgacgccacgggatctggcttctctatgacattttcctcgtcctcctacagcagctctggatacgggcgtcgctatgcatccggaagttcagcttccttaggaggccctgaatctgcagtggcttag

SEQ ID NO: 235212 - DNA, 13548 bp, Artificial Sequence
  Description of Artificial Sequence: Synthetic coding sequence
atgaagattgtgcccgacgagcgggatcgagtccagaagaagactttcaccaagtgggtcaacaaacatctaattaaggcacagcgtcacatcagcgacctctacgaagacctccgtgacgggcacaatctgattagcttattggaagtcctgtccggcgattcactgccaagagaaaaaggtcggatgagatttcacaaattgcaaaacgttcaaatcgccctcgactatttgaggcatcggcaggttaagctggtgaatatccgcaatgacgacatcgcagacgggaacccaaagctgacactgggtctgatctggactattatcctgcattttcagatctcagatatccaggtgtccgggcaatcagaagatatgacagccaaagagaagttattgctgtggagccagagaatggtcgaaggctaccaggggctcagatgcgataattttacaagttcctggagagatggcagacttttcaacgcgattattcatagacataaacctttacttatcgatatgaacaaagtctatcggcaaacgaacttagaaaatctggaccaggccttctcagtggccgagcgggacttgggagtgacacgtctactcgacccggaagacgttgacgtgcctcagcctgatgagaaaagtatcataacctacgtctcctcgctgtacgacgctatgccacgcgtcccagatgtgcaggacggagtgcgcgcaaacgagctccagctacggtggcaggaatacagggagctggtgctcttactgctgcagtggatgagacaccacactgctgcattcgaggagaggaggtttccatctagctttgaagagatcgaaattctctggagccaatttctcaagttcaaggaaatggagctgcctgcaaaggaagccgacaagaatcgctcaaaggggatctatcagtctctggaaggcgctgtccaggcaggccagcttaaagtgccaccgggttatcatccgctggatgtggagaaagagtggggaaagctgcatgttgctatcttggaacgcgagaaacaactgcgatccgagttcgaacgcctggaatgcctgcaacgaatcgtaaccaaattgcaaatggaggccggactgtgtgaggagcagctcaaccaggccgacgcattgttgcaatccgatgtcagattactcgctgcaggcaaagtgccacaacgcgcaggcgaagtggaacgagacctggataaggcggacagtatgatccgcctcctgtttaacgatgtgcagacattaaaggacggaaggcatccccagggtgagcagatgtacaggcgcgtgtaccgactgcatgagagattagtggcaatccggaccgagtacaacctgcggctgaaggcgggagtcgctgcaccggcaacgcaggttgcacaggtcacccttcaatccgtacagcggaggcccgagctcgaggatagtacgttgcggtatctgcaggacctgctggcttgggttgaggaaaaccagcaccgagtggacggagcggagtggggcgtggatttaccttcggtggaggcacagctggggtcccacagaggactgcatcagtctatcgaggagttcagagcaaaaattgagagggcaaggagtgacgagggtcaactctcacctgcaacccgcggagcataccgcgattgcctgggtagacttgacctgcagtacgccaagctgctgaactccagtaaagctcggttgagatccttggaaagtctacattccttcgttgcggcagcaacaaaggaactcatgtggctcaatgagaaagaggaggaagaagtcggatttgactggagcgaccgtaacaccaatatgaccgccaaaaaggaaagttactctgcgctcatgagagaactcgagctaaaggaaaaaaagattaaggagctacagaacgcaggcgaccgcctgctgcgtgaggaccacccagcaagacccacagtagaatcctttcaggccgctcttcagacccagtggtcatggatgcttcagctgtgttgctgcattgaagcacacctgaaagagaatgccgcttatttccagttcttttcagatgtgcgtgaagctgagggacagcttcagaaactccaggaggccctcagacgaaaatatagctgcgaccgaagtgctacagtgaccaggttggaggatctccttcaggatgcccaggacgagaaagaacagttgaacgaatataagggccacctgagtggcttagctaagcgagctaaggccgtagtgcagctgaaaccccgtcacccagcccaccccatgcggggacgacttcctctgctggctgtgtgtgactataaacaagtggaggtgactgtccacaaaggcgatgaatgtcagttggtcggtccggctcagccaagccattggaaagtcctctctagctccggctcagaagccgcagttcccagcgtgtgcttcttagtccccccacccaatcaggaggctcaagaagcggttaccagactcgaggcccaacatcaggctctcgtgactctatggcatcagctccacgtggacatgaaatcactgcttgcatggcagagcctacgcagagatgtgcaattgatcaggagctggtctctggctacgttcaggactctaaagcctgaagagcagcggcaagctctgcatagcttagagctccactatcaggccttcctgcgcgattcacaggatgctggagggtttggcccagaggatagactgatggcagaacgagagtacggatcctgttcacaccactaccagcagctcctgcaatctctcgagcagggcgcacaagaagagagcagatgccaacgatgtatatccgagctcaaagatatcaggctgcagctcgaggcctgtgaaacccgcacagtccatcgactccgcctgccattggataaggagccagctagagaatgtgctcaacgaatcgccgagcaacagaaggcccaggcggaagttgaaggcctgggaaagggcgtcgcacgactcagcgcagaggccgaaaaggtccttgctctcccagagccatctcccgctgcacctaccctgcgcagcgagctggaactaacactgggcaaactggaacaggtcagaagcctgtcagccatatacctggagaagctcaagaccatttccctggtgatcagagggacccagggcgctgaggaggtactccgagctcacgaggagcagctgaaagaagcccaagccgttccagctactctcccagagttggaggccacaaaggcaagtttgaagaagctgcgtgcccaggctgaagcccagcagccaacattcgacgccttgcgagacgagctccgtggcgctcaggaggtgggcgagcgtctgcagcaacgtcacggtgaacgggatgtggaagtcgaaagatggcgtgagagggtggcccagctcctagagcggtggcaggcagttcttgcccaaactgacgtccgccaacgggaattggagcagctcggacgccagctgaggtattacagagagagcgctgacccactgggagcatggttgcaagacgctagaagacgtcaggagcagatacaagcgatgccgctcgccgattcacaggccgtaagggagcagctgcgtcaggagcaggcactgcttgaagaaattgaaaggcacggcgaaaaagtagaagaatgccaacggttcgccaaacaatacatcaacgcaatcaaagattacgagctccagctggtgacctacaaggcccagctcgagcccgtcgcctcgccagccaagaaacctaaggtgcagtccggctctgagagcgtgattcaggagtacgtagatctgcgaactcattattctgagttgacaactctaacttctcagtacatcaaattcatttccgagacactcaggcgtatggaggaggaggaacggctggctgaacagcaaagagccgaggaacgcgagcggctggctgaagttgaagctgctcttgaaaaacagaggcagctggccgaggcccacgctcaggctaaggcgcaagcagaaagggaagcgaaagagctccaacagagaatgcaggaagaggtcgttcgcagagaagaagccgctgtcgatgcccaacagcagaagaggagtatccaggaagaactccagcagctgaggcagagctcagaagccgagattcaggctaaggcacgccaagctgaggccgctgaaagatctcggctccgaattgaggaagaaattagagtggtaagattgcagctggaggctacagagcggcaaagaggaggggctgagggcgagctccaagcactgcgagcaagagccgaagaagccgaggcacagaagcgacaagcgcaggaagaagctgaacgactccggcgtcaggtccaggacgagtctcagagaaagagacaggcggaggtggagctggccagcagggtgaaagcagaagctgaggctgctcgggaaaaacagagggcgctccaggctctggaggagctgagactccaagccgaggaagccgagaggcggcttcggcaggccgaggtggagcgagccaggcaggtccaagttgcgctggagaccgctcagcggagcgcagaggcagagctgcaatctaaacgggcatcttttgctgagaaaactgcgcaactggaaaggtctctgcaagaggaacacgtcgcagtcgcccaactgcgtgaggaggccgaacgaagggctcaacagcaggctgaggcggagagggccagggaggaagccgagagagaactggagcgttggcagctgaaggctaatgaagcactgcgcctcagactgcaggccgaggaagtggctcagcagaagtctctggcccaggccgaagccgagaagcaaaaggaagaggcagagagagaggccagacgcagaggaaaggcagaggaacaggcagtgaggcagagagagctggcggaacaagaactcgaaaagcaaagacaattggcagaaggcactgcacagcaacggcttgcggctgagcaggagctcatccgcctgagggctgagaccgaacaaggagagcagcagaggcaattgttggaagaagaattggctcggttgcaaagggaagcagccgctgctacccagaaaaggcaggagctggaagctgagctggctaaggtgagggctgaaatggaggtgctcctagcctccaaagcgagggccgaggaggaaagtaggtccacgtcagagaagagcaagcagcgactggaggctgaggctggccgtttcagagagcttgcagaggaggctgcaagacttcgcgctctggcagaggaagctaaaaggcaacgacagctggccgaggaagacgctgcacggcaacgagcggaggcagagcgagtcctcgctgagaagctggctgctatcggggaggctacccggctgaagaccgaggccgagatcgccctcaaagagaaagaagccgaaaacgaaagactccgccgtctcgcagaggacgaagcctttcagcgtcgtaggttggaggagcaggccgctcaacacaaagcagatatagaagagcgcttggcacagctgagaaaggccagcgacagtgagcttgagcgccaaaaggggctcgtcgaagacaccctccgacaaaggcgacaggtggaggaggagatcctggcactaaaagcctccttcgagaaggctgctgcaggcaaggctgaactggagctggagctgggcaggatcaggtctaacgctgaggataccctgcgaagcaaagaacaggcagagctggaggccgctaggcagcgccaactcgctgccgaagaagagagacgccgacgagaagctgaggaacgcgtgcagaagagcctcgccgctgaggaggaggctgctaggcagaggaaggcagcgctggaggaggtggagcgtctaaaggcaaaggtcgaagaagcaaggcgtttgagggaacgggcagagcaggaaagcgcaaggcagctgcaactggcacaggaggccgctcagaagagacttcaggcagaggaaaaggctcatgcctttgcagtacaacagaaagaacaggaactgcaacaaaccttacagcaagaacaaagtgtgctcgatcagctcaggggggaggctgaagctgctagaagggccgcagaggaggccgaggaagcacgagttcaggcagaacgcgaggctgcccagtctcgaagacaggttgaggaggccgagcgtttgaagcagagcgctgaagaacaagcccaggccagggcgcaggctcaggccgcagccgaaaagttgagaaaagaggctgagcaagaagctgctcggcgtgctcaggccgagcaggcagccctgaggcagaagcaggccgctgatgctgagatggagaagcacaagaaattcgcagagcagactctccggcagaaggcccaagttgagcaggagctcacaacactgaggctgcagctggaggaaacagatcaccagaaaaacctgctcgacgaggagttgcagcggcttaaagcagaagctaccgaggcagcgcgtcagcgctcacaggtggaggaggaactgttttcagtgcgtgtgcaaatggaggaacttagtaaactgaaggctcggatcgaagcagagaatcgagctctgatccttagggacaaagacaacacccagaggttcctacaagaggaggccgaaaaaatgaagcaggtggctgaggaagccgcacgcctgagcgtggctgcccaggaggccgcaagactcagacagttggccgaggaggacctggcgcaacagcgggcactcgctgagaagatgctgaaagagaagatgcaagccgtgcaggaggcaacacgcttaaaggcagaggctgagcttcttcagcagcagaaggaactggcccaggagcaggccagacgacttcaggaagataaagagcagatggcgcagcagctagccgaagagacacagggattccagcgcacgctggaggcagaaaggcagcgccagctggaaatgtctgccgaggcagagcgcctgaagctgcgggtcgcagaaatgtcccgagcacaggctcgagccgaagaggatgcccaacgattcagaaagcaggcggaagagatcggtgaaaaactccatagaacagagctggccactcaagaaaaagttacactcgtgcagaccttggagatccagagacaacagtccgatcatgacgccgaacgcttgagggaagccatcgccgagctcgaacgagagaaagaaaagctccagcaagaggcaaagcttctgcaactcaaaagtgaagaaatgcagactgtccagcaggagcagttactccaggaaacccaggctctgcaacaaagtttcctttctgagaaggattctcttttacaaagagaaagatttatcgaacaggaaaaggccaagctggagcaactcttccaggatgaggttgccaaagctcagcagctaagggaggagcagcagcgccagcagcagcaaatggaacaggagcgtcagcgcctagtcgcaagcatggaggaggccagacgacggcagcacgaggcggaagagggtgtgaggcggaagcaggaagagctacagcaactggagcagcagaggaggcagcaagaggaacttctggctgaggagaaccagagactcagagaacaattgcaattgcttgaggagcagcacagggctgcgctcgcgcatagcgaggaggttactgcctcccaggttgctgctaccaaaacactgcctaacggaagagacgcactggatgggccagccgctgaagccgagccggaacattcctttgacggcctgcgccgaaaagtatctgcccagcggctgcaggaagcagggatcctgagtgccgaagaactgcagaggctcgcccaaggtcacaccactgttgacgagctcgcacggcgagaagatgtgcgccattacctacaggggaggtctagcattgccggactgcttctaaaggccaccaacgagaaattgtccgtttacgccgcactgcagcgtcagctgctgtccccaggaactgcacttattctcctagaagctcaggcagcatcgggatttttgcttgaccctgtgagaaatcgtcgcctgacagtgaacgaggccgtgaaagaaggcgtggtcggaccagagctccaccacaaactgcttagtgccgaaagagctgtgaccggatataaggatccttacacgggtcagcagataagcctgtttcaagctatgcagaaggggttaatagtgcgagagcacggaatcaggttgctggaagctcagattgccaccgggggagtgatcgatccggtgcattcacacagagtccccgttgacgtggcataccgaagaggttattttgacgaggagatgaatcgcgtgctggctgacccctccgatgatacaaaaggcttttttgaccctaacacccacgaaaatctaacatacctccaactgctggagagatgtgtcgaggaccccgaaaccggactctgcttgctaccgttgaccgacaaggctgcaaaaggcggtgagcttgtctataccgatagcgaggctagagacgtctttgagaaagccactgtgagtgccccattcgggaagttccagggtaagaccgtgacaatctgggagattataaactccgagtacttcaccgccgagcaacgaagagacttgttgcgacaattccggacaggccgaataaccgtggaaaaaattattaagataattatcacagtggtcgaagaacaggaacagaaaggacgcctgtgtttcgaaggccttaggagcctggttcccgctgctgagctcttagaaagcagggtgattgaccgtgaattatatcagcagctgcagcggggtgagaggagcgtaagggacgtagctgaagtagacactgtccggagagctctgagaggagccaacgtgattgccggagtgtggctggaagaagctggacaaaaactctctatctataacgccctaaagaaagacctcctaccatccgacatggcagtcgcacttctcgaggcccaagcaggcactggccacatcattgatcctgccacttccgctagactgaccgtggacgaggcggtgagagccggtctggtgggacctgaatttcacgagaagctcctcagcgccgaaaaagccgttaccgggtacagggatccatacactggacaaagtgtctccctgtttcaggcactgaaaaaagggctgatacccagggaacagggcctgaggctgctggatgcccaactctccactggagggattgtcgatccctccaaatcccatagggtgccactcgacgtagcttgtgctcgtgggtgtctggacgaagagaccagtcgcgcattgtccgccccacgggctgacgcaaaagcctactccgacccaagtaccggggaaccggcaacctacggggagctgcagcaacgctgtcgtcccgatcagctcacaggcttaagcctccttccgttaagtgagaaggccgctcgggcacggcaggaagagttgtattcagagttgcaggctcgggaaaccttcgagaagacccctgtcgaggtccccgtcggcggtttcaaaggcaggactgttacagtgtgggaactgatcagcagtgagtattttaccgccgaacagaggcaagaactgctgcgccagtttcggacagggaaggtgacagtggagaaggtgattaagattctcattacgatcgtggaggaagtggaaaccctccggcaggagcgtttgtccttctccggccttagagcgccagtgcccgcttcggagttgttggcaagcggagtcctcagccgcgctcagttcgaacaactcaaggacggcaaaactaccgtaaaggatctttccgagctgggttccgtcaggacgctgttacaaggcagcggctgccttgcaggtatctacctggaggacaccaaggagaaagtctccatctatgaggcgatgcgtagggggctcctgcgtgccaccactgctgctctcttgctcgaggcccaagccgctacaggatttctggtcgaccccgttagaaatcaaaggctgtacgtccatgaggccgtgaaagctggggtggttgggccagaactgcacgaacagctcctgagtgcggagaaggccgtgactggctaccgcgatccttactccgggagcactatttctctctttcaggcaatgcagaagggactggtcctgaggcagcacgggatcaggctgcttgaggcccagatcgcaaccggtggtattatagatccggtccattcacatagggtgcctgttgacgtggcctaccagcggggatatttttctgaagagatgaatcgagttctggccgacccatctgacgatactaaaggcttctttgatccaaatacccatgaaaacctgacctatagacagcttcttgaacgctgcgtagaggaccctgagacgggactgaggttacttccattaaagggagcagaaaaagcagaagtcgttgagaccacccaggtctatacagaggaagagacccgacgcgcttttgaggaaacacagattgacatacccggaggaggctcccacgggggttcaacaatgtctctgtgggaagtaatgcaaagtgatctgataccggaggaacagcgggctcagttgatggctgactttcaagctggtcgcgtaactaaggagcgcatgattattatcattatcgaaatcatcgagaagaccgagattatccggcagcagggactggcatcctacgattatgtccggagaagactcacagctgaagacctgttcgaggccaggatcatatctctggaaacctataatctgctgagagagggcaccaggtctctcagggaggcacttgaggccgaatccgcctggtgctatttatacggcaccggatcagtggccggtgtatacctgcctggctctagacagacactgtccatctatcaggcgttaaagaaaggcttgctcagtgccgaggtagccagactgctactcgaggcccaggcggcaacaggatttctgcttgaccctgttaaaggggagcgattaacggttgatgaagcggtgcgcaaaggcctggtcgggccagaactgcacgacaggctgctgagcgctgagcgagccgtcactgggtaccgtgatccctacacagagcagactattagtctcttccaagccatgaagaaagagctgattccaaccgaagaggctctgcgcctgttggacgctcagctagcaaccggcggaatcgtcgaccctcgtcttggcttccatttgcccttggaagtggcctaccagcgcggatacctgaacaaagacacacatgaccaattgtctgaacctagcgaggtgaggagttacgtggatccaagtactgatgaaagactttcatatactcagctcctgagaagatgcaggagggacgacggcacagggcagctgctgcttcccctgagcgacgcccgtaagctgacatttagaggattacgcaaacaaatcacaatggaggaactcgtgaggtcacaagtgatggacgaggctactgcactccagctcagagaaggattgacctctatagaagaggtgaccaagaatcttcaaaagttcctggaaggaacaagctgcatcgccggagtgttcgtcgatgccacaaaggaacgcctctccgtgtatcaggccatgaagaaggggatcatccgaccaggcacagcctttgaactcttggaggcccaggcagcgacaggatatgttattgatcctatcaagggcttgaagttgactgtggaggaggccgtccgaatgggaattgtcggcccagagttcaaagacaaactgctgtcggcggagagagctgtaacgggttacaaggacccttacagcgggaagctgattagtctgttccaggccatgaaaaaagggcttattctcaaagaccatgggattcgtctgttagaagcacagatagctaccggtgggattattgacccagaagaatcacaccgtctcccggtggaggtggcatataagcgaggattgttcgacgaggaaatgaacgaaatcctcaccgatcctagtgatgacaccaaaggtttctttgaccccaatactgaggagaatcttacatatctgcagctcatggagcggtgtattactgacccccagactggcctgtgcctcctgccactgaaggagaagaagcgggagcgcaagacctcctccaagagcagtgttagaaagcgtagagtcgtgattgtggatcccgagacgggtaaggagatgtccgtttatgaggcatatagaaaaggtctgattgaccaccagacatacctcgagctcagcgagcaggaatgtgagtgggaggagattacgatatcctcatccgacggggtggtaaaaagcatgataattgatcgaagaagcggtaggcagtacgacattgacgacgcgattgccaagaatttgatcgatcgttccgctctcgaccagtacagggccggaaccctgagcataacagaattcgccgacatgttgtctggcaatgccggaggatttaggtcccggtccagctccgtcggatcgtctagttcatacccaatctcacccgctgtgtcccgcacacagctcgcgtcttggagtgatcccactgaggagacagggccagtggcaggcatcctggacactgagaccctggaaaaggtcagcattactgaagccatgcaccgcaacttggtggacaatatcacagggcagcgtttgttggaagcccaagcctgcacggggggaattatcgacccctcaaccggagagcggttccctgtgaccgacgcagtgaataaaggcctggtcgacaagattatggtcgatcgcatcaacctggctcagaaggccttctgcggcttcgaagatcctcgcactaagaccaaaatgtcggctgctcaggctcttaaaaaaggatggctgtattacgaagcgggacaaaggtttttggaagtgcagtacctcactggtggcttgattgagccagatacaccaggtcgtgtacccctggacgaggcactacaacgcggaacagtggatgctaggactgcccagaagctgcgagacgtgggcgcatactctaagtatctaacatgtcccaagacaaagttgaaaatcagctacaaggatgccctggatagaagcatggtggaggaggggaccggccttcggctactcgaagcggctgcccagtcaactaaaggttattacagcccatacagcgtgagcggatctggcagcactgctgggtcacggaccgggtcccggaccggctcaagggctggttcaagaaggggcagtttcgatgcaaccgggagcggtttttctatgacattcagctcctcgtcatattcttcgtctggatatggtagacggtatgcatctggtagtagtgccagtctgggcggtcctgagagcgccgtcgcctaa

SEQ ID NO: 235213 - DNA, 13725 bp, Artificial Sequence
  Description of Artificial Sequence: Synthetic coding sequence
atgtccggtgaggacgccgaggtgagggctgtctccgaagacgtatctaatggcagctcaggctccccctcccccggagatacactcccatggaatctaggcaaaactcaaaggagccggagatcgggcggaggagccggaagcaatggctctgtgctcgacccagcggagagagccgtgattcgaattgccgatgaacgtgatagagtgcaaaaaaaaacattcacaaaatgggtaaataaacacctgatcaaggcacagcgccacatctcagatttgtatgaggatctgagagacggacacaatttaatcagcttactcgaggtgctgagtggcgattctctgccacgggagaagggcaggatgcggtttcataaattgcaaaacgtgcagattgcgctggactatctgagacaccggcaggtgaagctggtgaacattcgcaatgatgacattgctgacgggaatccaaaactgactctagggttaatatggactattattcttcatttccaaattagtgatatccaggtctctgggcagagtgaggatatgacagctaaagaaaaactgctcctctggtcacagagaatggttgaggggtatcaaggcctcaggtgcgacaatttcacttccagctggagggatggtcgcctctttaacgccatcatacaccgccacaagcctctactgattgacatgaacaaggtgtataggcaaaccaatttggaaaacctagatcaggcgttcagtgtggccgaacgggaccttggagttactcgccttttagaccccgaggacgtggacgttcctcaacccgatgaaaagagtattattacttacgtctcttcactttacgacgctatgcccagggtccccgatgtgcaggacggagtgagggctaatgagctgcagctgcggtggcaggagtaccgcgaactggtcctgttgctcttgcagtggatgagacaccacacggcagcttttgaggaacggcgtttcccgtcttccttcgaagagatagaaattctgtggagtcagtttctcaagttcaaggaaatggaactgcccgctaaagaagctgataaaaaccgtagcaagggcatttatcagtccctcgagggtgccgtccaggctggccagctgaaggtgccccctgggtaccaccccctggatgtggaaaaggagtggggtaagttacatgtcgcgattttggagcgcgaaaagcagctgagaagtgaattcgaacgtctcgagtgtctgcagagaattgtgacaaaactgcagatggaggctggattgtgtgaggagcagctaaatcaggccgatgctttacttcaatcggacgtgagactccttgcagccggaaaagtgccgcagagagctggggaggtagagcgggatttggataaggctgattcaatgataagactgctcttcaacgacgtgcagactctgaaggacgggaggcaccctcagggtgaacaaatgtatcggagagtctacagattacatgagcggctcgttgcaatcagaacagaatacaatctcagactgaaagcaggggtcgccgctcccgctactcaggtcgctcaggtgactctccagtctgttcagcggaggcctgaactcgaagactcgactctacgatacctccaggatttgctggcttgggtcgaggagaaccagcaccgggtcgatggcgctgaatggggcgtagacttgccttcagtggaagcccagctgggcagtcatcgtgggctgcaccagagtatcgaagagttccgcgctaagattgaaagggctcgaagcgacgagggacagctctctcctgcaacacgaggggcttatcgggactgcctagggagattagatctgcagtacgccaagctgctgaattcaagtaaggcccgtctccggagccttgaaagtcttcattctttcgtggctgcggctacgaaggaacttatgtggttaaacgaaaaggaggaagaggaggttggcttcgactggagcgatagaaacaccaatatgacggcaaaaaaggaatcctactcggccctgatgcgcgaattagagcttaaggagaaaaaaatcaaggaacttcagaacgcaggcgatcggctcttgagagaagatcacccagcaagaccaacggtggagtcttttcaagccgctctccagacccagtggtcatggatgctccaactctgctgttgcattgaagcacacctgaaagaaaatgctgcctattttcagttcttcagcgacgtgcgggaagcagaagggcagctgcagaagctgcaggaggcgctccgcaggaaatactcatgcgacaggagcgcgaccgttactcggttggaagacttactccaagatgctcaggatgagaaggagcagttaaatgaatataaggggcacctatccggcctcgcaaagcgcgctaaggctgtagtccaattgaagcccagacaccccgctcaccccatgcggggtcgattgcctctcttggccgtttgtgattataagcaggtcgaagtgaccgttcacaaaggcgatgagtgtcagctcgttgggcctgcacagccttcccactggaaagtacttagcagtagcgggagtgaagctgcagttccgtctgtgtgctttctcgtgccaccacctaaccaggaggcacaggaggccgtcacaaggttagaagctcagcaccaggccctcgtgaccctctggcaccagctgcacgttgacatgaaatccctgttggcctggcagtccctccgtagagatgtgcagctcatcaggtcttggtcgcttgctactttccggacattgaagccagaggaacagagacaggccctacactccctggagttgcactatcaggccttcctcagagacagtcaagatgcagggggatttggccctgaggatcggcttatggcggaacgcgaatacggcagctgctctcaccattatcagcaactattgcagtcacttgagcaaggggctcaggaggagtcgcggtgccaaagatgcattagcgagcttaaagacattaggctgcagctagaggcttgtgaaactcgcacagtgcaccgcttacgtctgccattagataaggaacccgcaagggaatgtgcacagaggatagctgagcaacaaaaggcccaggccgaggtcgaggggctgggcaaaggtgtggccaggctatctgcagaggcagaaaaggtgctggctttgcctgaaccgtcgccagccgcaccgacactgcgatccgaactcgagttgaccctcggcaaactcgagcaggtgcgaagcctttctgctatttacctggaaaagctgaaaacaatctcacttgtgatccgcggtacacaaggagcagaggaagtcttacgcgctcacgaggaacaactgaaggaagctcaggcagtcccagccaccttgccggagctggaggcgacaaaggcctccctcaagaagttgagagcccaggcggaagcccagcagcctactttcgacgctttaagggatgaattgcgcggagctcaggaggtgggcgagagactccagcaaagacatggcgagcgggatgtcgaggttgaaaggtggcgcgagcgcgtggcccaactcctggaacggtggcaggctgtgctggctcagacagatgtacgacagcgggagcttgagcaactgggccgtcagcttcggtattaccgcgagtctgctgaccctttaggagcatggctccaggacgctcggaggaggcaggaacagatccaagcaatgccactggcagattcgcaggcagtgagggagcaacttaggcaggagcaggctctactggaggaaatagaaaggcacggagaaaaggtggaggagtgccagaggttcgccaaacagtatattaacgctatcaaggactatgagttgcaactagtgacgtacaaagcccagctggaaccagtcgcatctcctgctaagaagccgaaggtgcaaagtggctctgagtccgtgatccaggaatatgttgatcttaggacccactattcagagcttacaactttgacgagccaatacataaaattcataagcgagaccctgagacgcatggaggaggaggagcgtctggccgagcaacaacgcgcagaggaacgggagaggctggctgaggttgaagctgccctcgagaagcagagacagctggcggaggcccacgcacaagccaaggcccaggcggaacgcgaagccaaagaactgcaacaaagaatgcaggaagaggtcgtgagacgggaggaggccgcagtggatgcacaacagcagaaacggtctattcaggaggaactgcaacagctgagacagtccagcgaggccgagattcaggctaaggctcggcaggccgaggcagctgaaaggtctcgcctgagaattgaagaggaaattcgggtcgttaggctgcagcttgaggcaaccgaacgacagcgcggaggcgcagagggcgaactgcaggctctgcgggctagggctgaggaggccgaagcccaaaagcggcaggctcaggaagaggcggagcggttgagaaggcaggtgcaggacgagtcacagcggaagcgacaggccgaggtggagttggcttctagggtgaaagccgaagcagaggccgcacgggagaagcagcgcgcattacaggccttagaagagctgagactgcaggctgaagaagccgagaggagattacgccaagccgaggtcgaacgcgcacgccaggtccaggttgcgctcgaaaccgcacagcgctctgccgaagctgagctacagagcaagcgagcttcttttgccgaaaaaactgcacagctcgagaggtctctccaggaggaacatgtggcagtcgcacagttgcgggaagaggccgagagacgcgcacagcagcaagcggaggctgagcgcgctcgtgaggaagctgagcgcgaactggagagatggcagttaaaagcgaacgaggcgctcagattgcgtctccaagccgaggaggttgcgcagcagaaatctcttgcacaagcagaggcagaaaaacagaaagaagaggcagagcgtgaggccagaaggcgaggaaaagcagaggagcaggccgttcgtcagcgcgaactcgctgagcaagaactcgagaaacagcggcagctcgctgaaggcaccgcccagcaacggctggctgccgaacaggagctcatccgcttgagagctgaaaccgaacagggagaacagcaaaggcagttgctggaggaagagctcgcgcgactccaacgtgaagccgcagcagcaacacagaaacggcaggaactggaagcagagctggccaaggtgagggcggaaatggaagtgctactggcttcaaaggcacgcgctgaagaagaaagccgatctacctccgaaaaatcaaaacaacgactcgaggccgaggccggacgcttcagagaactggcggaagaggcagcacgactgagagccctggccgaagaagctaaacgccagcgccaattagcagaggaggacgcggctcgccagcgagccgaggccgaacgagttcttgctgaaaaactggcagctattggagaggctaccagactcaaaacagaggctgagatcgctctcaaggaaaaagaggcagaaaatgagcgactgcggagattagcagaggacgaggcctttcagcggcgtcggcttgaggagcaagccgctcagcataaggccgatatcgaggaacgcctggcccaacttaggaaggccagcgattccgagttagagaggcaaaagggcttggtagaggatacactgaggcagagacgccaagtggaagaagagatattggccctgaaggcgagtttcgagaaagctgcggcaggtaaggcagagttggaactagagcttgggaggattcgctctaatgccgaggataccctcaggagtaaagaacaagcagagctggaggccgcaagacagcgccagctggctgcagaggaggagagacgccgacgtgaagccgaggagcgggtccagaagagcctagcagcagaagaagaagcggcacggcagcgcaaggctgccctggaggaagtcgagcggctgaaggcgaaggttgaggaggcccgtcgcttgcgcgaaagggcagagcaggaatcagccaggcagttgcagctggctcaggaagccgcacagaagcgtcttcaagcggaggagaaagcccatgcctttgcagtgcaacagaaggaacaggagctgcagcagactctgcaacaagaacagtccgtgttagatcagctgcggggagaggctgaggccgctaggcgggctgcagaagaagccgaagaggcccgtgtgcaggctgagcgtgaagctgcacaaagcagacgccaggtagaagaagctgaacgactgaaacagagtgcagaagaacaggcccaggcccgagcacaggcccaggcggctgccgaaaaattgaggaaggaagccgaacaggaggcagccaggcgcgcacaggccgagcaggctgctttgcgacagaagcaggccgcagatgcagagatggagaaacacaagaaattcgcggaacagactttgcggcagaaggcacaggtggagcaggagttgacgacactgaggctgcaactggaggagacagaccatcagaaaaacctgctggacgaggaactccaaaggttgaaggctgaggcaaccgaagctgcaagacagaggtctcaagtggaagaggagctattctccgtgagagtgcaaatggaggagctaagtaaactgaaagccaggattgaggctgaaaacagggcattaatccttagagacaaagacaacacacagcgttttctgcaggaggaggcggaaaagatgaagcaggttgctgaagaagccgcaaggttgagcgtcgcagcccaagaggcagcaaggttaagacaattggccgaggaggacctcgcacagcaacgcgcactggctgaaaagatgttgaaggagaaaatgcaggcagtgcaggaagcgactagactgaaggcagaagccgaacttctccagcagcagaaagagttggcgcaggaacaggcccgtcggctgcaggaggataaagaacaaatggctcagcagttggcggaggaaactcagggtttccagcgaactctcgaggcggagaggcaaaggcagctcgagatgtctgctgaggcagaacggcttaagttgcgagtagccgaaatgtcacgagcacaggctcgggctgaagaggacgctcagcgcttccgcaaacaggccgaagagataggtgaaaagctgcatcggaccgagctcgcgacgcaggagaaagtgacactggtccaaaccctcgagattcaacgacaacaaagtgaccacgacgccgaaagactgagggaggcgattgcagagctggagagggagaaggagaaactccagcaggaggccaagctgcttcagctgaaaagtgaagaaatgcagactgtgcagcaggagcagctactccaggaaactcaggctttacagcaatcattcctgtcagaaaaggatagcttgcttcagagggagaggttcatcgaacaggaaaaggccaagctggaacagttgttccaggatgaggtggctaaggcccagcagctcagggaagaacagcagaggcagcagcagcagatggaacaggagcggcagcggttggtagctagtatggaggaagcgcgacgaaggcaacatgaggccgaagagggggtgcgcagaaagcaggaagagctccagcagctcgaacagcagcggcgacagcaggaagaacttctagccgaggagaaccagaggctgagagaacagctccagctactggaagagcaacacagagctgccctggcccactcagaggaggtgaccgctagccaagtcgctgcaacgaagacactgcctaacggaagggacgctcttgatgggcctgctgccgaggctgagcctgaacattcatttgatggcctgcgcagaaaggtcagcgctcagcgactccaggaggccggtattctaagtgccgaagagttacagcgtctggcccaggggcatactactgttgatgagctggccaggagagaggatgtgcgacactacctgcagggaaggagttcgatcgcgggtttactgcttaaggcgaccaacgagaagttgtctgtttacgccgctctgcagagacagctgctgagcccgggaacagcgctaatcctgttggaggcgcaggccgcttcaggattcctccttgatcccgtgagaaataggaggctgaccgtgaacgaagccgtaaaggagggagtcgttgggcctgagttgcatcataagctgctatcagcagaaagagccgtgactgggtacaaggatccctacacagggcaacaaataagcctctttcaagcaatgcagaagggattaatcgtgagggaacacggaatacggctcctggaagcccagattgccaccggaggggtgatcgaccccgtccacagccaccgagtaccggtcgacgtggcttatcggagaggctactttgatgaagagatgaaccgggtcctcgccgaccccagcgatgacactaaggggttttttgaccctaacacacacgaaaatttaacctacctgcagctgcttgaaagatgcgttgaagaccccgaaactggcctgtgcctccttcccctgactgacaaagctgctaagggtggcgaactggtgtatacagattcagaagcacgcgacgtgttcgaaaaggctacagtctcggccccatttggcaaattccagggaaaaacagtcacaatctgggagattatcaacagtgaatatttcactgctgaacagcggcgagatttactgcgtcagttcaggaccggcagaatcactgtcgagaagatcataaagatcatcatcacagtggtagaggagcaagaacaaaaagggcgtttgtgtttcgagggcctgcggagcttagtgcctgcagcagaactgctggagtcaagggtcatcgatcgggagctctaccaacagctgcagagaggcgagagaagcgtgcgcgacgtggcggaggttgacactgtgagacgtgccctgaggggagccaatgtgatagctggcgtctggctggaagaagccggtcaaaaactgagcatttacaatgccctcaagaaggacctgctgccgtctgacatggccgtcgccctgctggaggcacaagcgggaactggacatattatcgaccctgcaacttccgcaagactcactgtagatgaagccgtgcgcgcaggcctggtgggaccagagtttcacgaaaagctgctcagtgctgaaaaagccgtgaccgggtatcgcgatccatacacagggcagtctgtgtcactgttccaggcactcaagaaaggactgatcccacgtgagcaggggctaagactgctggacgcccagttatcaactggtgggatcgtggaccccagcaagtcacatagagtaccactggatgtggcctgcgccagaggatgcctcgatgaggagacctctcgggcactgagtgcccctcgtgccgacgctaaggcttattctgatccctccaccggagagccggctacttacggagagctgcagcagagatgtagacccgatcagctcacagggctttcacttttgcccctgtctgaaaaagccgctcgggcacgacaagaggaactctactcggaactgcaggcccgagaaacctttgagaaaacaccagtggaggtccccgtcggtggattcaagggtcgcaccgtcactgtctgggagctgatttcatctgagtactttactgccgagcagaggcaggagttactaaggcaattccggaccggaaaggtaaccgtagagaaagtgattaagattctgattactatcgtggaagaggtcgaaacattgcgccaggaaagactttcattctcagggttacgggctccagtgccggcatccgaattactcgcttcaggcgtgctgtctagagctcagttcgaacagctgaaagatggcaagaccacagtcaaggatttgtccgagttgggctctgtgagaacattgcttcagggctccgggtgtctggctggaatctatttagaggatacaaaagaaaaggtctctatctacgaagccatgcgtagggggctgctgcgggctactaccgctgccctcctgctcgaggcacaagcagctaccggatttcttgttgatccagtgcggaatcagcgcctatacgtacacgaggccgtcaaagcaggagtggtgggtcccgagctgcatgagcagctgctctctgctgagaaggcagtcactggatatcgggacccgtactcagggtctacaatcagcttgtttcaagccatgcagaagggacttgtcctccgccagcatggcatccgacttttggaggctcaaatcgccaccggtggtatcatcgaccccgtgcactcccacagggtgccagtcgatgtggcataccagcggggttacttctctgaagagatgaaccgggtccttgccgaccccagtgacgacacaaagggattcttcgacccaaacacccatgaaaaccttacgtacaggcagctgctcgagaggtgcgtcgaagatccggagactggattgaggctcttaccactaaagggggctgagaaggctgaagtggtggagactactcaggtctatacggaagaggaaacccggcgtgcctttgaggagacacagatcgacatcccgggaggtgggagtcacggcggatctaccatgtcgctatgggaagtgatgcagagcgacctgattcctgaggagcagcgggctcagcttatggcagattttcaggctggtcgggttaccaaggagcggatgatcatcattattatagaaatcatcgaaaaaactgaaattatccgacaacaaggccttgcaagctacgattacgtcagacggcgattgactgctgaggacctgtttgaggctaggatcatttccctggagacatacaacctgctgcgggaggggacacggtcgttgagggaggcattagaagcggagtccgcctggtgttacctttatggcacaggatctgtggctggagtttacctccccggaagtcgccagactctaagtatctatcaggccctgaagaagggtctgctaagcgccgaagtggccagactgctgttggaagctcaagctgcaaccggattcctgctcgatccagtcaagggcgagagattgaccgttgacgaggccgtacggaagggacttgtgggcccagaactacacgatcgcttattaagcgccgaaagagcggtgaccgggtatagggatccatacaccgagcagaccatctccttattccaagctatgaaaaaggaactcatcccgacggaggaagcattgaggctcctggatgcccagttggctaccgggggaattgtcgacccccgactcggctttcatctacctttagaggtagcctaccaacgcggttatcttaataaggacacccatgaccaactctcagagccgtccgaggtccggagttacgtcgacccatctactgatgaaaggctgagttacactcagctgctgagacgatgcaggcgagacgacgggaccgggcagctgctgttacccctatctgacgcccgaaagttgactttccggggtctccgcaagcagatcactatggaggaattggtacgctcgcaggtcatggacgaggcaactgcactgcagttaagagaaggcctcaccagtatcgaggaggtgaccaagaaccttcaaaaattcctcgaaggaacctcctgcattgccggtgtgtttgttgatgctaccaaggaacgactcagtgtctaccaggctatgaaaaagggcatcatcagacccggaacggccttcgaactgttggaggcgcaggccgcaaccggctatgtgattgatcccatcaaaggcttaaaactaaccgtggaggaggcagtaagaatgggtatcgtggggcctgaatttaaggataagcttctgagcgctgagagagcagtaacgggttataaagacccgtacagcggaaaactcatttctctgttccaagctatgaagaagggcttaattttgaaagaccacggcatccggctgttggaggcgcaaatcgccacagggggaataattgaccctgaggagtcacatcgacttcccgtcgaggtggcctataagagaggcctttttgacgaggagatgaatgaaatcttgactgatccaagcgacgatacaaagggtttctttgatccgaacaccgaagagaacctgacctatctgcagctgatggaacgctgtatcacggatcctcagaccgggctttgcttgttacccctgaaagagaaaaaaagggaacgcaaaacttctagcaagtccagcgtccgaaaacgcagagtggtgatcgtggaccccgaaaccgggaaggagatgtctgtatatgaagcttaccgtaagggtctaatcgaccatcagacttatctggagctctccgagcaggaatgcgagtgggaggaaattactataagctcttccgacggagtggtgaagagcatgatcatcgatcgccgttctggtcgacaatatgacattgacgacgcaatagccaagaacctgattgatagaagtgctcttgatcagtacagggccggtaccctcagtattacagaattcgcggacatgcttagcggaaacgctggtggctttcgatccaggtctagttccgtgggatcatcttcctcctacccaatcagcccagccgtcagtaggactcagctagcgagctggtcggaccccacagaggagactggtccagtggccggaatcctggatactgaaactctcgagaaggtgtcaattaccgaagctatgcataggaacctggtcgacaatattaccggccagcgactgctcgaggcacaagcgtgcacaggaggtatcatcgacccctctaccggtgagaggtttcccgtcactgatgctgtgaacaaaggactggtggataagattatggttgatcgtatcaacttagctcagaaagcattctgcggttttgaagatcctaggaccaagactaagatgtcagccgcacaggccctaaagaaagggtggctgtattatgaggcaggccaacggttcttggaggtacaatacctgactgggggtctcattgagccggacactcccggaagggtgcccctggacgaagcactccagaggggtaccgtggatgctcggaccgcacagaagctgcgggacgtcggagcctatagcaagtatcttacctgtccaaaaactaaattgaagataagttacaaggatgcacttgatcgcagtatggtggaggaaggcaccggcctgagactcttggaggctgctgctcaatctaccaaggggtattactccccatactcagtatccggttctggctctactgccggtagccgaaccggaagtcgtactgggtctcgggcaggcagcaggaggggatccttcgacgccaccggatctggtttctctatgactttctcgagcagtagctacagcagttccggctacgggcgacgctacgcatccgggagctccgcaagtctagggggacccgaatctgccgtcgcctag

SEQ ID NO: 235214 - DNA, 13713 bp, Artificial Sequence
  Description of Artificial Sequence: Synthetic coding sequence
atgtccggggaggacgcggaggtacgagcagtgtccgaggatgtgagcaacgggagctccggctcgccatctcccggtgacacgctgccctggaacctcggcaagactcagcggtcccgcagaagcggaggaggtgccggatccaatggaagtgtgctggatcctgctgagagggcggtcattcggatagccgacgagcgagaccgagtacagaaaaagactttcaccaagtgggtgaataagcacctgatcaaagcacagcgccacatcagtgacttatacgaagacctccgggatggccataatcttattagtctcttagaagtgctcagcggggacagcctccctagagagaaaggacggatgaggtttcataagctccagaatgtgcagattgctctggactatttaagacatcgccaggtaaaactcgtcaacataaggaacgacgacattgcagacggaaaccctaagctgacactgggtttgatctggaccatcatcctccacttccagatttcagatatccaggtgtccggtcagagcgaagatatgaccgcgaaagagaagctgttgctttggagccagcgtatggtggaagggtaccaagggttgcgctgcgacaacttcaccagctcatggcgtgacggcagacttttcaatgccattatccaccggcacaagccactgctgatagacatgaacaaggtatatcgacagaccaacttagagaacctggaccaggcttttagtgtggctgaaagagatttgggcgtcacacgactcttggatcccgaggacgtcgacgtaccacagcccgacgagaaaagtattatcacatacgtctcatctctttacgacgccatgcccagggtgccagacgttcaggacggcgagctgcagctgagatggcaggagtatagagaactcgtcctcttactgttacagtggatgaggcatcacaccgctgctttcgaggagaggaggttcccaagctctttcgaagagattgagattctatggtctcagtttctgaagttcaaggagatggagctgccagcaaaagaagccgacaagaaccgcagcaagggcatctatcagtctttggagggagcggtccaggccggtcagttgaaggttccacccggttaccatccacttgacgtggaaaaggagtggggaaagttgcacgtggccattctcgagcgagagaagcaactccgttctgagtttgagagattggaatgtcttcagcgaatagttacaaagctccagatggaggcaggtctgtgtgaggagcagctgaaccaggcagatgcactactacagagtgatgtcagactactggccgctgggaaagtgccgcagcgggctggggaagtagagagagatctggacaaggccgactcgatgattcggctcctgttcaacgatgtgcaaacactgaaagatggccgacatccccagggcgaacaaatgtaccgtcgggtttacagactgcacgagagactggtcgccattaggaccgagtacaatttaagactcaaagcgggtgtcgctgcccctgctacgcaggtggcgcaggtgactttgcagtccgtccagaggagaccagaactggaagatagcacattacgatacctgcaggatttactcgcatgggtcgaggaaaatcaacaccgtgtcgacggcgctgaatggggcgtggatttgccatctgtagaggctcagctgggttcccatcggggtctgcaccagtcgattgaagaatttagagcgaaaatcgagcgtgcacggtctgatgagggacagctatcaccagccacaaggggagcctatagagactgtctggggaggcttgacctccaatatgccaagctcctgaattcgtcaaaagccagactgcggtctctggagtcgctgcactcattcgtagcagcggctacaaaggaactcatgtggttaaatgaaaaagaggaagaagaagtggggtttgactggagcgatcgcaataccaacatgactgctaagaaagagagctactccgcactcatgagggagctcgagctaaaagaaaaaaaaattaaagaactccaaaacgctggtgacagattgctgcgagaggatcaccctgcaaggccaaccgtggaaagttttcaagctgcgctccagactcaatggtcttggatgctgcagctctgctgctgtatcgaggctcatctgaaggagaacgcagcctacttccagttttttagcgatgtacgggaggcagaaggccaactgcaaaagctccaggaagccctgaggagaaagtattcttgtgatcgaagtgctactgtgaccagactggaggatctgcttcaggatgcccaggacgaaaaggaacagctcaacgagtacaaaggtcatctgtccggactcgctaagcgggctaaggcagtcgtgcagttgaaacccaggcatcccgcacaccctatgcggggtaggttacccctgttggcagtgtgcgattacaagcaggttgaggtcactgtgcacaaaggagatgagtgtcaactggtcggccctgcccagccaagccactggaaagtgttgtcttcgtccggctccgaagcagccgtgccgagcgtgtgcttcctggtgccaccacccaatcaggaggcgcaagaggccgtgactcgcctagaagcacagcaccaagcactggtgacattgtggcaccagctgcatgtcgatatgaagagcttgctggcttggcagagcttaaggcgcgatgtgcagctgataagatcctggtcactggctaccttcaggaccctcaagccggaagaacaacgtcaggccctgcatagcctggaactgcactaccaggcattcttgcgggattcccaggacgcagggggatttggtcccgaagataggctgatggccgaaagagagtacggttcctgctcacatcactaccagcagctgttacagagcctggagcaaggggctcaggaggaaagccgctgtcaacgctgtattagcgagctaaaagacatccgtctccagctggaggcttgtgagactcgaaccgttcacagacttcgtctgccactggacaaggagccggcacgtgagtgcgcgcagcggattgccgagcagcagaaggctcaagcagaggtcgagggtcttgggaaaggagtggcacgcttaagcgctgaagcagagaaagtcctggccttgccagagccttcacctgctgctcctacactgagatctgagttggaactaaccctcggcaagctggaacaggttcgatctctgagcgcaatctacctggaaaaactcaaaaccatcagcctcgtaattcggggaacacagggagccgaggaggtgttaagggcccacgaagaacagctcaaggaagctcaagccgtgcccgcaacgctgcccgaactggaggccactaaagctagccttaagaagttaagagcgcaggcagaggcacaacagcctacctttgacgcactccgggatgagctgcgaggtgctcaagaggttggcgaaagactccagcaacggcacggggagagagacgttgaagtcgagagatggcgagagcgcgtggcacagttacttgaacggtggcaggccgtgctggcccagacagacgtgcgtcagcgggagcttgaacagcttgggagacagctccgctattatcgcgaatccgccgatcctctgggggcttggcttcaggacgcccgtaggaggcaagagcagatccaagccatgcctctggctgatagtcaggccgtgcgcgagcagctaaggcaggagcaggctctacttgaggagatcgaacggcacggtgaaaaggtcgaggagtgtcagcggttcgctaagcaatatataaacgccatcaaggattacgaactgcagctggttacctacaaggcacaactcgaacctgtggcgtcaccagccaagaagcctaaggtgcagtctggatccgagagcgtgatccaagagtatgtcgacctcagaacacattacagcgaactcaccacgctgaccagccagtacattaaattcatttccgaaacattaagaagaatggaggaggaggaaagactggccgagcagcagagagccgaggaaagagaacgtctggccgaggtagaggccgctcttgagaaacaacgacagctcgctgaagctcatgcgcaggcgaaagcacaggccgaaagagaggccaaggagctgcagcagaggatgcaagaggaggttgttcggagagaggaggctgctgtggacgcccagcagcagaagaggtccatccaagaggagttgcagcaactgagacaaagtagcgaggccgaaatccaggctaaagcaaggcaggccgaagctgccgagcggagcagactgcgtatcgaagaagaaatcagggtggtccgcctgcagttggaagcgacagagcggcagcgcggaggagctgagggagaactgcaagcattgagggccagggccgaggaggcagaggcccaaaaacgacaggctcaggaagaggctgaaagacttagacgccaggtgcaggatgaaagccagcggaagaggcaggccgaagtggagctggcaagccgggtgaaagccgaggcggaggcagcgcgagagaagcaaagagcactgcaagctctggaagagctccggctgcaagctgaggaagccgaaaggaggctgcgacaggcggaggtggaacgtgctcggcaagtccaggttgcattagagacagcccaacgaagcgcagaagccgaacttcagtcgaagcgggcatctttcgccgaaaagactgcccagctcgaacggagcctgcaggaagagcacgttgctgtggctcagctgcgagaggaagccgagcggagggcacagcaacaggctgaggccgagagggccagggaggaggctgagcgtgaattggaacgttggcagttaaaggctaatgaggccctgaggctcaggttacaggctgaggaggtggcccagcagaaaagtttggctcaggctgaggctgaaaaacagaaggaagaagccgagcgagaggcacggaggcgtgggaaagctgaggagcaagccgtgaggcagagggaactggctgagcaagagctagaaaaacagcgccagctcgctgagggcaccgcccagcagcggctggcggctgaacaggagctgattcgcctccgcgcagagacagagcagggcgagcaacagcggcagctcctggaggaagagctggccagattgcagcgggaggccgctgctgcaacacagaagcgccaggagctggaggcggagttggccaaagtgcgtgctgagatggaggtcttgctggcgtcaaaggccagagccgaagaagaatcacggtcaacttctgagaagtctaagcagcgcctagaagccgaggcaggtcggtttagggaactcgcggaggaggccgcacggctacgcgcactcgccgaggaggccaagagacagaggcaactcgctgaagaagacgccgcaaggcagagggctgaggctgagcgtgtcttggccgagaaactcgcagcgatcggcgaggccactcgtctgaagaccgaagccgagatagccctgaaagagaaggaagccgagaatgagaggctgagacgccttgccgaggacgaggctttccaaaggcgacgtcttgaagaacaagctgcacaacacaaggccgacatagaagaaagactcgcgcagttgcgcaaggcaagcgattccgaattagaacggcaaaagggtcttgtcgaagatacactacgacagcgccgtcaggtcgaggaagagatcctggcattgaaagcgtccttcgaaaaagctgctgccggtaaggctgaactggagctggagctcggcagaatccgctctaacgccgaagacactctgcgcagcaaggaacaggctgaactggaggccgctcgtcagaggcagctggctgccgaagaggaaaggagaagaagggaggcagaggaacgtgtacagaaatcactagccgcagaagaggaggctgcgaggcagcggaaagccgcattggaagaggtcgagcgcctgaaagcgaaagttgaggaagccagaaggctccgagagagagcagaacaggaaagcgcacgccagctgcaactggcacaggaggcagcccagaagcgattgcaagctgaggagaaggctcacgcgttcgctgtgcagcagaaagaacaagagctgcagcagaccctccaacaggaacagtcagtgttggatcagctgcgcggagaagccgaggccgcaagacgggcagcagaggaagccgaagaagcaagagtgcaggctgagcgggaagcagcgcagtccagacgccaggtggaagaggcagaacgtctgaaacagtcggcagaagagcaggctcaggctcgagcccaggctcaggctgcagccgagaaactccggaaggaggccgaacaagaggctgccaggcgcgcacaggccgaacaagccgctctcaggcagaagcaggccgctgacgccgagatggaaaaacataaaaaatttgccgagcagactctgcggcagaaagcccaggttgaacaggagctcactacacttcgccttcagttagaggagactgaccaccaaaagaacctgcttgacgaggaactgcagcggctcaaggctgaagctacggaggctgctcggcaacgctcgcaggtcgaggaagaacttttttccgttagggtgcagatggaggagctgagcaagctgaaagcccgaattgaagctgaaaaccgagctctcatcctgagggacaaagataatacccagcgctttctacaggaggaggccgagaagatgaagcaagtcgcagaggaggcagctcgcctgtcagtggccgctcaggaggccgcaagactacgtcagttggccgaagaagacttggcccagcagcgggctctcgccgagaagatgttaaaagagaagatgcaggctgtccaggaggcaacccgccttaaagccgaagcagagcttctccagcagcaaaaggagctggcgcaggaacaagccaggcgactgcaggaggacaaagagcagatggctcaacaactcgccgaggaaacacaggggttccaaagaactcttgaagccgaacgtcaacgtcaactggaaatgtccgctgaggctgagcgcctcaagctgagggtcgcagagatgtcccgcgcacaggcaagggctgaggaggacgcacagcgttttagaaagcaggccgaggaaatcggagagaagctgcacagaactgagctggcgacccaggaaaaggttaccctcgtccaaacccttgagatacagcgtcaacagtctgaccacgatgctgagcgtctgcgagaagccatagctgagcttgagcgggagaaggagaagctgcagcaagaggccaaattactccagcttaaaagtgaggagatgcagacggtccagcaggaacagctgctgcaggaaacacaggccctgcagcagagctttttgtcagagaaggactctttgttgcagagggaaaggtttattgaacaagaaaaggccaagctcgagcaacttttccaggatgaggtcgccaaggctcagcagctgagggaagagcaacagcggcagcagcaacagatggagcaggaacggcagcggctcgtggcctcaatggaagaggccaggagacgacagcatgaagccgaggaaggggtgcgaagaaagcaagaagagcttcagcagcttgagcagcagcggaggcagcaggaggaactacttgccgaggagaaccagcgtctcagggaacaactgcagttattagaggagcagcacagggcagcgctcgctcactccgaggaggtgactgcgagccaggttgccgctactaagacactccctaatggacgtgatgccttggacggtcccgcagctgaggcagaacccgaacattcatttgacggcctcagacggaaggtctctgctcagagactgcaggaggctgggatactctctgctgaggaactgcaacgcctcgcacaggggcacactactgtagacgagctggccagaagggaagatgtgcggcattaccttcaaggacggagctctatcgccggtttgctcttgaaggccactaacgagaaactgtctgtgtacgccgctttgcaacgccagctgctgtcaccgggaactgcactgatcttgctcgaggcccaggccgcaagcggatttctgttagatccggtgaggaataggcgactcacggtaaatgaggccgtgaaggagggggtggtgggcccagaactccaccacaaacttctctcggctgagagagctgtaaccggttacaaagacccgtatacagggcagcagatatctctgtttcaagctatgcaaaagggccttattgtgcgcgagcatgggattagattgctggaagcgcagattgccaccgggggagtaatagatccggtgcattcccatcgggtgcctgtggatgtagcttatcgtcggggatactttgacgaggagatgaacagagtgcttgcggacccaagtgacgacaccaaaggcttttttgaccccaatacccatgaaaacctgacttatttacagctgctggagagatgcgtagaggatccagagaccggtctgtgcctcctgccgttaacagacaaagctgctaaggggggagagctcgtatatacggatagcgaggctagggatgtgtttgaaaaagcaaccgtctccgccccttttggcaaattccagggtaagaccgtgactatatgggagatcatcaatagcgaatactttactgcagaacagaggcgcgatctgctacgacaatttcgaactgggaggattacagtcgagaagatcatcaagattatcatcacggtggtcgaggagcaggagcaaaaagggagactttgcttcgaaggcttacggagtcttgtacccgctgcagagctcctggagtcacgggttatagatagagagttgtaccagcaacttcaaagaggagagaggtcagttcgcgatgtggccgaggtcgatactgttagaagagcccttagaggggctaatgtcatcgcaggcgtgtggctggaggaggctggccagaaactcagcatctataacgcactcaagaaagacttactccccagtgacatggccgtagccttacttgaggcacaggccggtactgggcacataattgaccccgcaacaagcgccaggttgacggtcgatgaggcagtcagagccggactcgtggggcctgaatttcacgagaagctgctgtccgccgaaaaagctgttactgggtatcgcgatccttacacaggccagtctgtcagtctattccaggctctgaagaaaggcctcatcccacgcgagcagggtttgaggctcctggatgcccagctctcaaccgggggaatcgtggatccatcaaagagtcatcgcgtccccctggatgtcgcgtgtgcacgcggatgtctcgacgaggagacatcccgggctctaagcgcccctcgcgctgatgccaaagcctattctgacccgtccaccggagagcctgcaacctacggagagctgcagcagagatgccgaccagatcagttgactggattgagcctattacccctgtcggagaaagcggcaagagcccgtcaggaggaattgtacagcgagctacaggccagggagaccttcgagaaaactccggtggaggtacccgttggcggtttcaaggggagaaccgtgaccgtctgggagctgatctccagcgaatacttcacggcagagcagagacaggagcttcttcgtcaattcagaacaggcaaagtgactgtcgagaaagtgatcaaaatccttatcaccatcgtggaggaggtggaaaccctccgacaagaacgactgtcattctccggcttgagagcgccagtgcctgcttccgaattgctcgcatctggggttctctcccgtgcacagttcgagcagcttaaggatggaaagacaactgttaaggatctgagcgagctcggcagtgtaagaaccctgttacagggatctggatgccttgctggcatatatctagaggacacaaaggaaaaggtttctatttatgaggcgatgaggagagggctcctgcgtgctaccactgcggctctgcttctggaggcccaagccgcaactggctttctggttgatcctgttagaaatcagagactgtacgtacatgaggcagtgaaggcaggagtcgtgggtccagagctccacgaacaactactgagtgccgagaaagccgttaccggatatcgggacccctatagcgggagtactatctccctttttcaggccatgcagaaaggactggtcctgcgccaacacggtattaggctgcttgaggcgcagatcgccaccggaggcataattgacccggtccactcccaccgcgtccccgtcgatgtggcctaccaaaggggctatttttcagaggagatgaaccgggtcttagctgacccctctgacgacactaaagggttcttcgatcccaatactcatgaaaacctcacttaccgacagttactcgaaagatgcgttgaggacccagagacaggactgaggctactgccactgaaaggagctgaaaaggccgaggttgtagaaactactcaggtgtacactgaggaagagacccgcagagcctttgaagaaacacagatcgatattcctgggggagggagccatggaggatcaaccatgtctctctgggaggtcatgcagagcgacctgattcctgaagagcaaagagcgcagttgatggcagatttccaagccggacgcgtcactaaagaaagaatgataatcatcataatcgaaatcattgagaaaactgagatcatccgacaacagggcctagcttcttacgattatgttcgacggcgtctgaccgccgaggatttgttcgaagcgagaattatctctttggaaacctataacttgctcagagagggcacgaggtcactgcgggaggctctcgaggcagagtcagcttggtgctatctgtacggaaccggaagcgtggctggcgtgtatctcccgggatcacggcaaaccctctctatttatcaggcccttaaaaaggggttgctttccgctgaggtcgctcgactgctattggaggcccaggctgctacagggtttctgctggaccccgtcaagggtgagcggttgaccgttgatgaagctgtcagaaagggattggttggccctgaactccacgatcgtctattgtctgcagagagagccgtaacggggtatagggacccttacaccgagcagacaatcagcctctttcaagctatgaagaaggagctcataccaaccgaagaggcattgcggctgctggatgcccagcttgctacaggaggcatcgtggacccacggcttggattccatttacccttggaagtagcctatcagcggggatatttgaataaagacacacacgaccagctgagcgagccttccgaggtgcggagttatgttgatcctagcacagatgagcgactgtcctatacacaactgttaagacgctgccgaagagatgacggcactgggcaattgctgctccctctatctgacgcacgcaagctgacctttagagggcttcgcaaacagattactatggaagaactagtgaggtctcaggtaatggatgaggcaacagccctgcagcttagagaggggctgacatcaattgaggaggtcacgaagaatttgcagaagttccttgaaggtacctcatgtatcgcgggagtgtttgtggacgccacaaaagaacggctgagcgtgtaccaagccatgaaaaaggggatcatcagaccaggcacagcctttgagctcttggaagcacaagctgccacagggtatgtcatcgatcccattaagggactcaagctaacagtggaagaagcagtgagaatgggaattgtgggccctgaatttaaagacaaactgctgtccgcagagcgcgctgtgacggggtacaaagacccctacagcggcaagctgatcagccttttccaggcaatgaagaagggactgatcctgaaggatcacggtatccgcttgttggaggcccagatcgccaccggcggaatcatcgaccccgaggagtcacatcgattaccggttgaagtggcctacaaaagaggattgttcgacgaagagatgaacgagattctgacagacccctccgatgataccaaaggatttttcgaccctaatactgaagagaatctcacttatttacagctgatggaacgctgcattacagacccccagaccggtctgtgtctccttcccctaaaggaaaagaaacgggagcgtaaaacatcatccaaatcttctgtcagaaagcggagggtggtcatagtggacccagagacgggaaaggagatgtctgtgtacgaggcttaccgaaagggtctcatcgaccatcagacctatttggagttgtctgaacaagagtgcgagtgggaagagataacaattagttcttctgatggcgtggtgaagtctatgattatcgaccgccgtagcggtagacaatacgatatcgacgacgcgattgcaaaaaatctaatcgacagaagcgccctggatcagtacagagcaggcactctgtcaatcacggagtttgcagatatgctatccgggaatgccggaggattcaggtctagatcctcctccgtgggtagctcaagcagctatccgataagtcctgctgtttctcggactcaactcgccagttggtccgaccccaccgaagaaactggtccggtcgctggcattcttgatactgaaaccctagagaaggttagtatcacggaggctatgcacaggaatctggtcgacaacatcacagggcagcggctgttggaagcacaagcctgcacaggcggaatcatagatccctctactggcgagagattccctgttacagatgcagtcaataagggcctggtcgacaagataatggtcgaccggatcaacttggctcaaaaggccttctgtgggttcgaagacccacgcacaaaaacgaaaatgagtgctgcgcaagctctgaaaaaaggttggctttactatgaagccggtcagagattcctggaagtgcagtatttgaccggaggcctgatcgagccagacacccctggtagagtgccactcgacgaagcactgcaacgcggaactgtggatgcacgaaccgcgcagaagttacgggatgtgggagcctacagtaagtatctcacttgtccaaaaacgaaactgaagatttcctacaaggatgcactcgaccgatccatggtggaggagggaactggattgcggctgctcgaagccgcagcgcagtctaccaaaggctattatagcccttactccgtcagtggttccgggtcgaccgccggatctaggaccggcagtcgaaccgggagtcgcgcaggctcacgcagggggtcttttgacgcaacaggaagtgggtttagcatgacattcagctctagcagctactccagcagtggctatggcaggaggtacgcctccggcagtagtgcttcgctgggaggccctgagtcagccgtcgcctaa

SEQ ID NO: 235215 - DNA, 1503 bp, Artificial Sequence
  Description of Artificial Sequence: Synthetic coding sequence
atggctacagtgataccgggagatttatctgaggtgcgtgatacacagaaagtcccaagcggcaagaggaaacgaggcgagaccaagccaaggaaaaattttccttgtcagctgtgcgacaaggcatttaacagtgttgagaagctgaaggtgcattcatactctcataccggtgaaagaccctacaaatgcattcagcaggactgtactaaggcattcgtgagcaagtataaacttcagaggcacatggcaactcactctcctgagaaaacccataaatgtaattactgcgagaagatgtttcatcgcaaggaccatcttaagaaccatttgcacactcatgacccaaataaggaaactttcaaatgtgaggaatgtggaaagaattataacactaaactcgggtttaaacgtcacttggccctgcatgccgctacttcaggtgacctcacttgcaaggtgtgtctgcagacatttgagtccaccggagtgctgctggaacatcttaaaagtcacgcgggaaagtccagtggtggcgtgaaggagaagaaacatcaatgcgagcactgcgatcgtcgattttacacccgcaaggacgtccgcagacacatggtcgttcatacaggtaggaaggatttcctgtgtcagtactgtgcccagaggttcggaaggaaagaccatctcaccagacatatgaaaaagtcccacaaccaagaactgctgaaagttaaaaccgaacctgtggattttctcgatccattcacgtgtaacgttagcgtacccatcaaggatgaactattgcctgtgatgtcactcccatcttccgagctcctgtctaagcccttcacaaatactcttcagctaaatttgtataacacgccattccagagcatgcagtcatccgggtccgcacatcaaatgataacaacattacctctaggcatgacttgccctatcgatatggacacagtgcaccctagtcaccacctgagctttaagtacccgttctcgtctacaagttacgcaatcagcatcccggaaaaggaacagccactgaaaggggaaattgaatcatacctgatggagttgcaggggggtgtcccctcttcttctcaagatagtcaggcctcctccagttctaagctgggcttagatccacaaatcggaagcttggatgacggtgcaggcgatctgtctctatccaaatctagcatatccatctcggaccccctcaacacgccagctttggacttctcacagttgttcaattttattcccttgaatggtcccccatacaaccccttgagcgttgggtcattgggaatgtcatacagccaggaggaagcccacagctctgtgtcccagttaccaccccagacacaggatttacaggacccagcgaataccatcggccttgggagtttacactccctgtccgccgctttcacttctagcctgagtacatcaaccacattacccagattccaccaggcctttcagtag

SEQ ID NO: 235216 - DNA, 1257 bp, Artificial Sequence
  Description of Artificial Sequence: Synthetic coding sequence
atggccacacattccccagagaaaacgcacaagtgcaattattgtgagaagatgttccaccgcaaggaccatctgaagaatcacttgcacactcacgaccccaacaaagagacatttaagtgtgaagaatgcggtaagaattacaacacaaagctgggcttcaaaaggcaccttgctctccacgccgctactagcggagaccttacctgcaaagtgtgcctccagaccttcgagtccacaggagtgctgttagaacatttgaagtcccacgctggtaagtctagcggcggagtgaaagaaaaaaagcaccagtgtgagcattgcgacagacgcttttatacacgcaaagacgtaaggaggcatatggtggtgcacacaggcaggaaagattttttgtgccagtactgtgcccagcgcttcggaaggaaggaccatctgacacgccacatgaagaagtcccacaaccaggagttgctgaaggtcaaaacagaacccgttgactttttagacccctttacctgtaatgtgagtgtccccatcaaggatgaactgctgcctgtgatgagcctgcccagttccgaattgctgtcgaagcccttcaccaatacactgcaattgaacctgtataataccccttttcagagtatgcagagttcaggctcagctcaccaaatgataacaacactacccttagggatgacatgcccaatcgacatggacaccgtgcacccctctcaccatctcagctttaaatacccattctcctctacaagttacgccatttccattccagagaaggagcagcctttaaagggggagattgaatcttacctgatggagcttcagggaggagtcccttcgtcctcacaggactcacaggcctcttcgtcatcaaagctcgggctggatccgcaaataggttcgctggacgacggcgcaggggacctgtctttgtctaaatctagcatttcaatctccgatccccttaatacgccggcactcgacttttctcaactcttcaattttatcccgctgaacgggccaccctacaatcccctttccgtcggatcgttggggatgagctactcccaagaagaggcacatagttctgtgtcacagctgcctccacagactcaggacctacaggacccagcgaacactatagggctggggagcctccactccttgtctgccgctttcacgagctctttgtctacttccacaaccttgcccaggtttcaccaggccttccaatag

SEQ ID NO: 235217 - DNA, 1503 bp, Artificial Sequence
  Description of Artificial Sequence: Synthetic coding sequence
atggcaacagtgattcccggagacctgtccgaagtaagggacacccaaaaagtgccaagcggaaaaaggaagcggggagagacgaaacctcgaaaaaactttccctgccagctgtgcgacaaagcctttaattccgttgaaaagctcaaggtgcactcctatagtcacacaggagaaaggccatacaaatgcatccagcaggattgcaccaaggcctttgtgagcaaatataagctccagaggcatatggcaacccacagcccagagaagacccataagtgtaattattgcgagaaaatgttccatcgaaaggaccatctgaaaaatcatctgcatacacacgatcccaataaagagacattcaaatgtgaggagtgtggcaagaactacaatactaagctgggttttaaaaggcacttagccctgcacgcagccacctctggggacctgacctgcaaggtgtgtctgcaaaccttcgagagtacaggagtactcctcgagcacctgaagtcccatgctgggaaatcctcagggggtgtcaaagaaaagaagcaccagtgcgaacactgtgataggcggttctacacccgtaaggatgtcaggcgacacatggtggtgcatacaggccgaaaagattttttatgtcagtactgcgcacaaaggttcggaagaaaggatcacctcacaaggcatatgaaaaagagtcacaatcaggaactgttaaaggtgaagacagagcctgttgacttcctggacccctttacttgtaacgtctccgtccccattaaggatgaattgcttcccgtgatgtcgcttccatcatcagagcttttaagtaaaccattcactaatactctccagctaaacttgtataacactcccttccagagcatgcagtcttccggttctgcccatcagatgatcaccactttgcctctaggtatgacttgtccgatcgatatggacaccgtgcacccaagccatcacctgagctttaaataccccttctcctcaaccagctacgcgatatcaattcccgaaaaagaacagccccttaagggtgaaattgaatcctatctgatggagctgcagggcggagtaccaagtagcagtcaggactctcaagcctcttcctcaagcaaactcggcctcgaccctcaaattggttcacttgacgacggagctggcgacctgtccctgagtaagtcttcaatctccatctctgatccgctgaatacccccgcactggacttcagtcagctgtttaattttattccgctgaatggtccgccatataatcccctgtccgttgggtccctgggtatgtcctactcacaggaggaggctcacagcagcgtatcacaattgccaccccagacacaagacctgcaggaccccgctaatacgattgggcttggcagtctccactcactgagcgcagccttcacttcatctctcagtacctccactactctccccaggtttcaccaggctttccagtag

SEQ ID NO: 235218 - DNA, 1392 bp, Artificial Sequence
  Description of Artificial Sequence: Synthetic coding sequence
atggcaacttttccttgccagctctgcggaaagacttttctgacattggagaagttcacgatccacaactattcgcactcccgggagagaccctacaaatgcgtgcagccggactgtggtaaagccttcgtgagtcgctacaaactcatgcggcacatggccacgcactctccccagaaatcccatcagtgtgcccactgtgaaaagacgttcaatcggaaggaccaccttaagaaccacctccaaactcacgaccccaacaagatggctttcggatgtgaggagtgtggcaagaaatacaacacaatgttaggctacaagcggcacctcgcattacatgctgcctcgtccggcgacctgacatgtggcgtatgtgcattggagctgggctccactgaagtgcttctcgatcacctcaaagcacatgccgaggagaaacctcccagtggcaccaaggagaaaaaacaccagtgtgaccactgtgagcggtgtttctacacgagaaaggatgttagaagacatttggtcgtgcatacggggtgcaaagattttctgtgccaattttgtgcccagcgtttcgggaggaaagaccatctcacccgccacactaaaaaaacccatagccaagagcttatgaaagaatccctgcagacgggggatctgctatctacattccacacgatctcacctagcttccaactgaaggccgcagccctacccccattccctttaggggcttcagcccagaatggtttggcttcgagcctgcctgccgaggtccactcgctgacactgagccctcccgaacaagcagctcagccaatgcagcctctgccggagagtcttgcatctctccacccaagcgtcagtcctgggtcccccccaccccctctaccaaaccataagtataacactacatcaactagttacagtcctttagcgtccctccctctcaaggctgacacaaaaggtttttgcaacatcagtctctttgaggacctgcctctccaagaaccccagtccccccagaagctgaatccgggattcgatttagcaaaaggcaatgccggtaaagtgaatctgcctaaggagctccccgctgatgccgtgaacttgaccattcccgcttccctcgatctgagccctctcttgggattttggcagctcccccctcccgcaacccaaaataccttcgggaactcaacactcgctttgggccctggggaaagtctaccccatcggctgtcctgtctgggacagcaacaacaagaacctcctttggccatgggtactgtttcactaggacaactgccccttcctcccatcccacacgtatttagtgccggaactggcagcgcaattttacctcactttcatcacgcgttccgatag

SEQ ID NO: 235219 - DNA, 1392 bp, Artificial Sequence
  Description of Artificial Sequence: Synthetic coding sequence
atggccacatttccatgccagttgtgtggtaagactttcctgactctggaaaagttcaccatccacaactattcccacagtcgcgaacgcccatacaagtgcgtccagcccgattgcgggaaagccttcgtatcacgctacaagctgatgcgacacatggccacccatagcccacagaaatcccaccagtgcgctcattgcgaaaagacctttaaccgcaaagaccatttgaagaaccacctgcaaactcacgaccctaacaaaatggccttcggttgcgaggagtgcggcaagaaatacaacaccatgctcggctacaaacgccacctggcactgcacgccgcttccagtggcgacctgacctgcggcgtgtgcgcacttgagctcggctctacggaggtgctgctcgaccatctgaaggcccacgccgaagagaaaccaccttcgggcaccaaggagaagaagcaccaatgtgaccactgcgagcgctgcttctacacccgcaaagacgtgcgacgccacctggtcgttcataccggatgcaaagactttctgtgtcagttttgcgcgcaaaggttcgggcgaaaggatcacttgaccaggcacactaaaaaaactcactcacaggaactgatgaaggagagtctgcagacaggggatctgctgagtaccttccacacaatctctccctccttccagctgaaagccgcagccctcccgccattccctctgggagcctctgcccagaacggtctcgcgagtagtcttccagccgaagtgcattctttgaccctgagcccacctgagcaggccgcacaaccaatgcagcctctacctgagagccttgcatcgctgcaccctagtgtgtcgccgggtagccccccacctccactccctaatcacaagtacaacactacgtccacgagttattcccctctggcgtcactccccctcaaggccgacaccaaggggttttgtaatatctcactcttcgaagatctcccattgcaagaacctcagtccccccaaaagctaaacccgggattcgatcttgcaaaaggcaatgccggaaaggtgaacctccctaaggagctgccggcagacgccgtgaacctgaccattcctgcgagcctagatctgagcccactgctgggattctggcagctgccacctcctgctacgcagaacacgttcggcaactcaacactggctttgggtccaggagaatctctgcctcacaggctttcgtgtctgggacagcagcaacaggaaccacctcttgccatgggaacagtatcgctggggcagttgccacttcctccaattccacacgtgttcagcgccggaaccggttcggccatcctgccgcacttccatcatgccttcaggtag

SEQ ID NO: 235220 - DNA, 1392 bp, Artificial Sequence
  Description of Artificial Sequence: Synthetic coding sequence
atggctacatttccttgccaattgtgcggaaagacatttcttactctggaaaagtttactattcacaattactctcatagcagggagaggccctacaagtgcgttcagcccgactgtggcaaggcctttgtgtctcgatacaagcttatgcgacacatggccacacattctccccagaagtcacatcaatgtgctcactgcgaaaagacctttaaccgcaaagatcatctgaaaaatcacttacagacccacgaccctaacaagatggcatttggttgtgaagaatgtggtaagaaatacaatacaatgttgggatacaagcgtcacttggctctacacgcagcaagtagcggagacttaacttgcggcgtctgtgcattggaactgggcagcactgaggttctgcttgaccatcttaaggctcatgccgaggagaagcccccatcaggcactaaggagaagaagcaccaatgtgatcattgtgagcggtgtttctatacacgtaaggatgtgcgtaggcacttggtggtgcacactgggtgcaaagactttctgtgtcagttctgcgcccaacgttttggtcgaaaggatcatctgacacgtcataccaaaaagacacattcacaagagctgatgaaagagtctctgcaaaccggggatcttctctctacgttccacacaatcagccctagctttcagcttaaagccgcagcccttccaccttttcccttaggggcatcagcccagaatggactggccagctctttgccagctgaggtccattctctgaccctaagtccgcctgaacaggccgctcagcctatgcagccgttacccgagagcttagcgtctcttcacccctccgtgagccctggttccccaccacccccacttcctaatcataagtataataccacctccacatcatactctccccttgcctctctccctctgaaagccgatactaaaggattttgtaatatttcgctgttcgaggacctccccttgcaggagcctcagagccctcagaagcttaatccgggattcgacctcgctaaggggaatgcgggaaaagtgaacctgcccaaagagttgcctgctgacgcagtcaatttgacgatcccagcgtccctagacctttctccactgctcggattctggcagctgcccccacccgcaactcagaatacttttggcaatagtaccctggcccttgggcctggagaaagtctgccacaccgcctgtcctgcttgggccagcagcagcaggagccgccactggcgatggggaccgtgtcactcggccagctaccattaccaccaatcccacacgtgttctcggccggaactggatccgccatcctaccccatttccaccacgccttcagatag

SEQ ID NO: 235221 - DNA, 1236 bp, Artificial Sequence
  Description of Artificial Sequence: Synthetic coding sequence
atggccacccatagtccacagaagagccaccaatgtgcccactgtgagaagacattcaatcgaaaagaccatttgaaaaatcacctacagacacacgatcccaataaaatggccttcggctgcgaagaatgtggaaagaagtacaatacaatgctagggtataaaagacacctcgctctgcacgctgccagttcgggcgatctcacttgcggcgtttgtgcccttgagctgggctctacagaggtgctgttggaccacctgaaggctcatgctgaggagaagcccccaagtggaacaaaagagaaaaaacatcaatgcgatcactgcgaacggtgtttctatacccggaaagacgtgaggcggcacctggtggtgcatactgggtgtaaggatttcctgtgtcagttttgtgcgcagcggtttggcagaaaggaccacttaaccagacacaccaaaaagactcatagtcaggagctgatgaaagagtccctgcagacaggagatctgctgtccacatttcatacgatcagcccgagctttcagttgaaagcagccgctttgccgcctttcccccttggcgcatccgcgcagaacggcctcgcctcttccctccctgcggaagtacattcacttactctctctccccctgagcaggccgcacagccgatgcagcctctccctgagtcgctggccagtcttcacccttccgtaagcccgggttccccacctcctccactcccaaaccacaagtacaatactacttcaacttcttattctcctctcgcctccctgccccttaaagcagacactaaaggattctgcaatatctcactgtttgaggatttgcccctgcaggaacctcagagtccccagaaactgaatcctggtttcgatttggccaaaggcaacgccggtaaggtgaatctccctaaggaactccctgccgatgctgtgaatcttacaatccctgcttcactcgacctgagtccgctgctagggttctggcaactgccaccgcctgctacacagaacacctttggtaactccacgttggctctgggcccaggggagtctttaccccacagactcagctgccttggacaacaacaacaggagcctcctctggccatgggaacagttagtctggggcaactcccactccctcccattccacacgtgttctcagcaggaactggctctgccatccttccccattttcaccacgcattccggtag

SEQ ID NO: 235222 - DNA, 1236 bp, Artificial Sequence
  Description of Artificial Sequence: Synthetic coding sequence
atggcaactcattctccacagaaatcgcatcaatgtgctcactgtgaaaaaacatttaacaggaaagaccacctcaagaaccacctgcagactcacgatcctaataagatggcattcggatgtgaagagtgtgggaagaaatataacacaatgctgggatacaaaagacatctggccctccatgcggcttctagcggtgatctcacctgtggcgtgtgcgctctggagctcggatcaaccgaagttctccttgatcacctgaaagcccatgcagaggagaaacctccgtcagggaccaaggaaaagaagcaccagtgtgaccactgcgaaaggtgcttctatactagaaaagacgttagaaggcatctcgtggtccataccgggtgcaaagattttctgtgccaattctgcgctcagaggtttggtcgcaaggatcatctcactcggcacacaaaaaagacacacagccaggaactgatgaaggagtctcttcagactggagacctcctttccacatttcatacaatatccccgagtttccagcttaaggctgcggcattgccaccgtttccactgggcgcaagtgcccagaatggccttgcttctagcctgcccgcagaagtgcattcattaacactcagccctcctgaacaggcagcccagcccatgcagccgctgccagagagcttggcgtctttacatccttccgtgagccccggatcccctccacccccactgcccaatcacaagtacaacacaacgagcacctcttactcacccctggccagcttgcccctcaaggcagacactaaagggttctgtaatatttccttattcgaagacctgcccttacaggagccccagagccctcagaagttaaatcccggattcgacttggccaagggcaatgctggcaaagtgaatctccctaaagaactccccgctgatgccgtaaacctcactatccccgcttctcttgacctctctccccttcttggattttggcagttgcccccacctgccacacagaataccttcgggaactccacacttgcgttagggccaggggagtccctgccacaccgcctgtcttgcctcggacaacagcagcaggagccaccgctcgctatgggcactgtgtcccttgggcagctgcctctgccaccgattccccacgtttttagcgccggaactggcagtgccattctgccccacttccaccacgccttccgttag

SEQ ID NO: 235223 - DNA, 1392 bp, Artificial Sequence
  Description of Artificial Sequence: Synthetic coding sequence
atggcaactttcccgtgccagctttgcggaaagactttccttactcttgagaagttcacaatccacaactatagccacagtagggagcgcccttacaaatgcgttcagccagactgtggcaaggctttcgtatcaagatataaacttatgaggcacatggcaacccattcccctcagaaatcccaccaatgtgctcactgtgagaaaactttcaaccgaaaggaccacctgaaaaatcacttgcagacacacgatcctaataaaatggctttcggttgtgaagagtgtggcaagaagtacaacacgatgcttggatacaagagacacctggcattgcacgctgccagcagcggtgaccttacctgtggagtttgcgctttagagctgggaagtactgaggtgctgttggaccatttaaaggcccatgcagaagagaaaccgccatctggcaccaaagaaaagaaacatcagtgcgatcattgcgaacggtgcttctacacacgaaaagacgtcagacgacacctggtggtccacaccgggtgcaaagactttctgtgtcaattctgcgctcagagatttggcaggaaggaccacttgacaagacacactaaaaaaacccacagccaggagttaatgaaggaaagtttgcagaccggcgatctcttaagtacgtttcacaccatttcaccttctttccagcttaaggcagctgcactcccccctttcccactgggagcttctgctcaaaatggcttggcctccagtctgccagcggaggtacactcactaactctgtctccaccggagcaggcagcccagcccatgcaacctttgcccgagagccttgcttccctacatcctagcgtgagcccagggtcacctccacccccattgccaaatcacaaatacaatactacctctacttcttatagtcctttggcctccttgccgctgaaagccgatactaaaggtttctgcaacatttccctgtttgaggatcttccgctccaggagccgcagagcccccaaaagctgaatcctggatttgatctggctaaggggaacgctggtaaggtgaatctgcctaaggagttgcctgcagacgctgtcaatctgacgatccccgcatctctggacctgagtcccttgttaggattttggcagctgccccctcccgctactcaaaataccttcgggaactcgaccctggctctaggaccgggagagagtttgccccacagattgagctgcctgggtcagcagcagcaagagcccccactggccatgggcaccgttagcctgggacagttacctctcccccctattccacacgtgtttagtgccggaaccggctccgccattttgccccacttccatcatgcctttcgctag

SEQ ID NO: 235224 - DNA, 1392 bp, Artificial Sequence
  Description of Artificial Sequence: Synthetic coding sequence
atggctacctttccttgtcaactttgcggaaagacattccttacgttagaaaaattcacgatacacaattacagccactcgcgggaacggccatataagtgtgttcagcccgactgcgggaaggcctttgtatcgagatacaagctgatgcgccacatggccacgcattcaccacaaaaaagccatcagtgcgcccactgcgaaaagactttcaatagaaaagatcacttaaaaaaccacttgcaaacccacgatccaaataaaatggcgtttggctgcgaggaatgcgggaagaagtacaatacgatgctcggctataagcggcatcttgccctgcatgccgcatcttcaggcgatctgacttgcggtgtttgtgcattagaactgggctccacggaagtgctgctggatcatttaaaggcccatgcagaggaaaagcccccttccggaacaaaggaaaagaaacaccaatgcgaccactgtgaacgctgcttctacacaagaaaggatgtgcggcgtcatctggtggtgcacacaggctgtaaggactttctgtgccagttctgtgcacagcggttcgggaggaaggaccacctaacaaggcacactaagaagacccatagccaggagctcatgaaggagtctctgcaaactggcgacctcttatcaacattccacactatttccccatctttccagcttaaggcagccgctcttcccccttttcccctgggcgcatctgcccagaatggtctggcatccagcctccccgcagaggttcactctttgactctgagtcccccagagcaggcggctcagcccatgcagcctcttcctgagtctctggcatccttgcatccctctgtctcaccgggaagtcctccgccacctcttccaaaccacaagtacaatacaacaagcacatcctatagccctctcgcgagcctgccattaaaagccgacacaaagggcttctgcaatatctcactgttcgaggatcttccacttcaggaaccgcagtccccccaaaagctcaatcccggattcgacctagcaaaagggaatgccggaaaggttaacctacctaaggaattacctgctgatgctgtcaacctcactataccagcctcactggacttatcccctctgctcggcttttggcagctacctccgcctgcaacacagaatacctttggcaatagcactctagccctcggccctggcgagagtctgccccataggctttcttgcctgggccagcagcagcaggagcctccgctcgcgatggggacagtgagtttggggcagctgccacttccccctatccctcacgtgtttagcgcgggaaccggatctgccatcttaccccactttcaccacgcattccggtag

SEQ ID NO: 235225 - DNA, 531 bp, Artificial Sequence
  Description of Artificial Sequence: Synthetic coding sequence
atggccactcactcacctcaaaagagtcaccaatgcgctcattgcgaaaaaacttttaaccgaaaagatcacctgaaaaaccatcttcagacccacgaccctaacaaaatggcctttggctgcgaggaatgcggcaaaaaatataacaccatgcttgggtataagagacacttggcactgcatgctgccagctccggggacttgacatgcggtgtatgcgcgctggagctggggtctactgaggtactgctagaccacctgaaggcgcacgcagaagagaagcccccatcggggaccaaagaaaaaaaacaccaatgcgaccactgcgagagatgtttctataccagaaaggacgtccggagacaccttgttgtgcacacaggatgcaaggactttctgtgtcagttttgtgcacaaaggtttggccgaaaggatcatcttaccaggcatactaagaagactcattctcaggagttaatgaaggagtcactgcagacaggcgaccttctgtctaccttccataccatctag

SEQ ID NO: 235226 - DNA, 1392 bp, Artificial Sequence
  Description of Artificial Sequence: Synthetic coding sequence
atggctactttcccatgtcagctgtgcggaaagacatttctcacattggaaaagtttactatccataattatagccacagcagagagaggccatacaaatgtgtgcaacctgactgcggtaaggccttcgtttcgaggtacaagttaatgcgccacatggccacacatagcccacagaaatctcatcagtgtgcgcactgcgagaaaacatttaataggaaggaccatctgaaaaaccatctccagacacatgatcccaataagatggccttcggctgtgaggaatgcggcaaaaaatataacacaatgctggggtacaagcgccatctggcactacatgccgcttcctcaggcgatctgacctgcggcgtgtgcgctctcgagctggggtccacagaagtgctgcttgatcacctgaaggctcatgctgaagaaaagcctccttcggggaccaaagagaagaaacaccagtgcgatcactgtgaaagatgtttctacacaaggaaagacgtgcgcaggcatttagtggtccatactggctgcaaggactttctttgccagttttgtgcacaacggttcggccgaaaggaccacctgacacggcacaccaagaaaacccacagccaagaactgatgaaggagtcccttcagactggtgatctgttatctacgttccacacaattagcccttctttccagctcaaggccgctgccctacccccttttcccctgggtgcatccgcccagaatggactggcgtcttcactgcctgctgaggtacactctcttactctcagcccacccgaacaagctgcccagccaatgcagcctcttcccgagtcgcttgcgtcattgcatccttccgtgagccccggatccccgccaccacctttgcccaaccataagtataacacaacatccacatcgtactcaccacttgcttctttacctttgaaagccgacacgaaagggttttgtaacatctccctttttgaggacctgcccctgcaagagcctcagtcacctcagaaactgaacccgggttttgatctggcaaagggtaatgctgggaaagtgaatctaccaaaggagttaccagctgatgccgtgaacctcacaattccggcaagtctagaccttagccctctgctgggcttctggcagctgcccccacccgctactcagaatactttcgggaattcaacactggctctcggcccaggggaatctctcccacacagactgagttgtctggggcagcagcagcaggagcccccattagctatggggacagtgtccctgggtcagctcccattaccccctattccacacgtgttctccgcaggtaccggatccgctatcctgccgcactttcatcacgcattccggtag

SEQ ID NO: 235227 - DNA, 1236 bp, Artificial Sequence
  Description of Artificial Sequence: Synthetic coding sequence
atggcgactcactctccacagaaaagtcaccagtgtgctcactgcgaaaaaacctttaaccggaaagatcatctcaaaaaccaccttcagacccatgatccaaacaaaatggccttcgggtgtgaggagtgcggtaagaaatacaatactatgctgggttataagcggcacctggcactgcatgccgcatcctccggagatctcacctgtggggtttgcgccctggaactggggtccacggaagtgctgcttgatcatctcaaggcacacgcagaggaaaaaccaccatcgggaacaaaagaaaagaagcaccagtgcgaccactgtgagcgctgcttctataccaggaaagatgttagaaggcacctcgtagtacacaccggctgcaaggactttttgtgccaattttgcgctcagaggtttggtcgcaaggatcatctgacacgtcataccaagaagacacactcgcaggaacttatgaaggaatccctgcagaccggagatctgctgtctacattccatactatctccccaagctttcagctcaaggccgctgccctcccccctttcccgttaggagcctcagcccagaatgggcttgcttcatctctgccagcagaggtccatagcctgaccctatcccctccagaacaggctgcccaaccaatgcaacctctgcctgagtccctcgcgtctttgcacccatctgtaagcccagggtcaccacctccccctctcccaaatcacaagtataacactaccagcacctcctattcccctcttgccagcttaccgttgaaggccgatacaaaaggcttttgcaacattagtctcttcgaggacttgcctctccaggagccacagagtccgcaaaagctgaaccccggatttgatctcgccaaggggaatgccggaaaagtcaacttgcctaaagagctccccgcagatgctgtcaatttgaccatccctgctagtcttgacctgtcaccgcttttgggcttttggcaactccccccacctgccactcaaaacactttcggaaattctacactcgcgctggggccaggagagtctttaccccaccggctttcctgcctgggccagcagcaacaggaaccgcctctggccatgggaaccgtgtccttggggcagctccccctgccccctataccacatgtcttcagcgctggcacagggtcagcaatcctgccccatttccaccacgctttccgctag

SEQ ID NO: 235228 - DNA, 1392 bp, Artificial Sequence
  Description of Artificial Sequence: Synthetic coding sequence
atggctaccttcccttgccagttatgtggtaaaaccttcctgacgctggaaaagttcacaatccacaactattcccattccagggagagaccgtataagtgtgtccagccagattgtggtaaggcctttgtcagccgttataagctgatgaggcacatggctacccattctcctcaaaagtcccaccagtgcgcgcactgtgagaagacatttaacagaaaagaccatctgaagaatcatctgcagactcatgacccaaacaaaatggcctttggctgcgaagagtgcggcaaaaagtacaataccatgctgggttataaaaggcatctggccctccatgcagcctcatcgggtgatctgacttgtggcgtgtgcgccctcgagctgggcagtacagaggtgctgctcgaccacctcaaggcacacgccgaagaaaaaccgcctagcggcacaaaggagaaaaagcatcagtgcgatcattgtgaacgctgcttctatacccggaaggacgtccggaggcacttggtcgtgcatactgggtgcaaagacttcctttgccagttttgcgctcagaggtttggcaggaaggatcacctcacgcgacatacgaagaagacgcattctcaggaacttatgaaagaaagcctgcagacaggcgacctcctttccacgttccataccatctccccaagttttcaattgaaggctgccgcactgcctccattcccacttggggcttccgcccagaatggcttagcgagtagtctccctgccgaggttcactcacttacattgtctccacccgagcaggccgctcaacccatgcagccactccctgagagcctagcctctcttcatccatcagtgtccccaggcagccctcctcctcctctgcccaaccacaagtacaataccacctccactagctattcccccctcgcttcacttcccctaaaggccgacaccaaggggttttgcaatataagtctctttgaagaccttccgctgcaggagcctcagagccctcagaaacttaatccagggttcgacctggccaaaggaaatgccggtaaagttaatctgcctaaagaactgccagccgacgcagtcaatctcactattcctgcctccctggatctgtcccccctgttgggcttctggcagctgccacctccagccactcagaatacttttggcaactccaccctggccctgggcccaggggaatccctcccacacaggctgtcttgcctgggtcagcaacaacaagaacctcctttggccatggggactgtgagtctgggccagctccctctgccacctatcccccacgtgttttctgctggtactggctctgcgattctgccccacttccatcatgcttttaggtag

SEQ ID NO: 235229 - DNA, 759 bp, Artificial Sequence
  Description of Artificial Sequence: Synthetic coding sequence
atgaaggaatctctacagactggagacctgctgtccacctttcatacaatttcaccttcttttcagctcaaggccgctgctctgcctcctttccccctgggcgcatctgcccagaatgggctggctagctcattgcctgccgaggtccactcccttaccctaagtccccctgagcaggctgcccagccaatgcagccactccctgagagcttggcctccctgcaccctagcgtgagccctggctcaccccctcctccactgcctaaccataaatacaatactactagcacaagctactctcctcttgccagcctgccgctcaaggctgacactaagggattctgcaacatttctttgttcgaggacctacctctgcaggaaccgcagagtcctcaaaaactgaatcccggtttcgatcttgccaaagggaacgccggtaaagtgaacctgcctaaggaattacctgcggacgccgtgaatttaactatacccgcttctctggacctctctccactgctggggttctggcaacttccacctcctgcgacacagaacacttttggaaatagcacactggctttgggccctggagagtctcttccacacaggcttagttgcctcggccagcagcagcaagagccccctctggcaatgggaacagtttcactgggccaactgccactcccccctatcccccacgtcttctctgcagggactggatccgcaatcctgccacactttcaccatgccttccggtag

SEQ ID NO: 235230 - DNA, 1491 bp, Artificial Sequence
  Description of Artificial Sequence: Synthetic coding sequence
atgaccactttcttcacctcggtgcccccttggatccaggacgcaaaacaggaggaggaggtcgggtggaaacttgtgcccagaccaaggggaagggaagctgaatctcaggtgaagtgtcagtgtgagatctctggcaccccatttagtaatggagagaagctcagacctcacagtctgcctcagcctgagcaacggccttattcctgtccccagttacattgcggaaaagccttcgccagtaaatacaaactgtatagacacatggcgacacacagcgcacagaaaccccatcagtgcatgtattgcgacaagatgtttcaccggaaagaccacctcagaaatcacctccagactcacgatcccaacaaggaggccctgcattgttcagaatgtggaaagaactacaataccaagctgggctaccgacgccacctcgccatgcacgccgcaagtagtggggacttgagttgtaaagtctgcttacaaacctttgagtccactcaggcactactcgagcacctcaaggctcattcacggcgtgtcgccggaggtgcgaaagagaaaaaacatccgtgcgatcattgcgacagaaggttttatacaaggaaagacgtcaggagacacctggtggtccacaccggccgtaaagatttcctctgccagtactgtgcccaacgattcgggaggaaagaccacctaacaagacacgtgaagaagtcacactcacaggagctgctcaaaatcaagaccgagccagtcgacatgctgggtcttctgtcttgctccagcaccgtcagcgttaaggaggaactgtccccagttctgtgtatggcctctagggacgtgatggggaccaaagcctttcctggaatgctccccatgggcatgtacggtgctcatataccgaccatgccttcgaccggcgtcccccattcgttagttcataacaccctccccatggggatgagctaccctttagagagtagtcctatctctagtcccgcacaactccccccaaagtaccagctcggatcaacgagctacctgcccgataaattacccaaggtggaagtggactccttcctggcagagcttcctggatctttgtccctgagttcagctgagccccagcctgcttccccccagccagccgctgccgcagctctgctggatgaggcactgttagccaagagccctgccaacctgtcagaagctctctgtgccgctaatgtggacttctctcacctgcttggattcttaccgcttaacctccctccatgtaatcctcccggtgcgaccggaggcctggttatgggctacagccaggctgaagcacaacctctactcaccaccttacaggcccagccacaggattctcctggagccggagggccactgaacttcggacctcttcactcactgcctccagtttttacatcggggctgagctccactactctgccaaggttccatcaggcctttcagtag

SEQ ID NO: 235231 - DNA, 507 bp, Artificial Sequence
  Description of Artificial Sequence: Synthetic coding sequence
atgcaggcccagcagtatcagcagcaaaggaggaaattcgctgccgcttttctcgccttcatattcatattggctgcggtggatactgccgaagccggaaagaaagagaaaccggagaaaaaggtgaagaagtcagactgtggcgaatggcaatggagtgtgtgcgttcctacaagcggcgactgcggactgggaaccagggagggcacgagaaccggtgctgagtgtaaacagacaatgaaaactcagcgttgtaagatcccttgtaactggaaaaagcagttcggagccgagtgtaaataccagttccaggcctggggcgagtgtgacttgaataccgcgttaaaaactaggacaggcagcctgaaaagagctctccataacgccgaatgccagaagacagtcacgattagcaaaccatgcggtaaactgacaaagccaaaaccacaggctgaatcaaagaagaaaaagaaggagggcaagaagcaggaaaagatgttggattag

SEQ ID NO: 235232 - DNA, 1518 bp, Artificial Sequence
  Description of Artificial Sequence: Synthetic coding sequence
atggtagaagaagtgcagaagcattctgttcatacattggtgttccggagcttgaagcgcacccatgacatgttcgttgccgacaacggcaaacctgtgccactcgatgaggagtcgcataaaagaaagatggctataaagttaaggaatgagtacgggcctgttcttcacatgccgactagcaaagaaaatctgaaggagaaaggaccccagaacgctactgatagctatgtccacaagcagtatcccgcaaatcaggggcaggaagtggaatattttgtggccggagtggcccttacagcggatacaaagatccagcggatgccttccgaaagcgcagcccagagcctggccgtcgcccttcctctccagactaaggcggatgccaaccggaccgccccttctgggtccgagtataggcaccctggggcaagcgacaggcctcaacccaccgcgatgaacagcatcgttatggagaccgggaacaccaaaaattccgcattaatggccaagaaagccccaacgatgcctaaaccgcagtggcaccctccttggaaactgtacagagtgataagcggccacctgggatgggtgcggtgtattgctgtcgagcctggtaatcagtggtttgtgacggggagcgcagaccgaaccatcaagatctgggacctggctagtggcaaactgaaactgtcactgacgggccatatatctaccgtgcggggtgtcatagtcagcacccgctccccttacttgttcagttgcggcgaagataagcaggtcaaatgttgggatctcgagtataacaaggtcattagacactaccatggccatttgtcggcagtgtatggtttggacctgcatcctaccattgacgtgctagtgacctgctctcgagattcaactgctaggatttgggacgtaagaacgaaggcttccgtgcataccttgtctggccatactaatgccgtagcaactgttagatgccaagctgctgagccgcagatcattaccggatcccacgataccactatccgcctctgggatttagttgctggaaagaccagagtaacgttgaccaatcataagaaatctgtgcgcgctgtggttctgcacccgagacactatacattcgcatctggctcccccgataatattaagcaatggaagttcccagatggcagtttcattcagaatctgtctggacataacgcgataatcaatactcttactgtgaactcagatggtgtcctagtgtcaggcgcagataatggtacgatgcacctttgggattggcgcaccggatataatttccaacgcgtgcatgccgctgtgcagcccggaagtctggacagcgaatcagggattttcgcttgcgcattcgaccagtctgagagccgcctgctcaccgctgaagccgacaagacaatcaaagtttatagagaggacgacacagctaccgaggagacacaccccgtctcttggaagcctgaaattatcaagcgcaaaagattttag

SEQ ID NO: 235233 - DNA, 1545 bp, Artificial Sequence
  Description of Artificial Sequence: Synthetic coding sequence
atgatctgcgaggtacagaagcattctgttcacactctagtgttccgcagcctcaagcgtacccatgatatgtttgtagcggataatgggaagccagtgcctctggacgaagagagtcacaagcgcaagatggcaatcaaactgaggaacgaatacgggccagtactgcacatgcctacatcaaaggagaatctgaaagagaaagggcctcaaaatgccaccgatagttacgtacataagcaatatccagccaaccaggggcaagaagtcgagtattttgtcgctggaacacacccataccccccaggtcccggtgtcgctctgacagctgacaccaagatacagagaatgccgtccgagtctgccgcacagtcattggcggtggcactgcctcttcaaactaaagccgatgccaataggaccgccccttcgggcagtgagtacagacacccaggagcatcagaccggccacagccaactgcaatgaactccatcgtgatggagacagggaacacaaaaaatagtgccctcatggcgaagaaagctcccaccatgcctaaaccacagtggcaccctccctggaaactgtatcgggtgattagcggacatctgggatgggtccgctgcatagctgtggagccgggaaaccaatggttcgtgacaggttctgccgaccggacaatcaagatttgggacctggcaagtgggaaattgaaattatctttaaccggccacatctccactgtgcggggagtgattgtctcaacacgatctccctatctcttttcctgcggcgaagacaaacaggtgaaatgctgggatttggagtataataaggttatccggcattatcatggtcacttaagcgctgtgtatggcttggatctccatccgaccatcgacgtgttggttacttgtagtcgcgatagcactgctcggatctgggatgtcagaactaaggctagcgtgcacaccctttctggacataccaacgcggttgcgaccgtacgatgccaggccgcagaaccgcaaatcatcactggcagtcacgacaccaccattagactgtgggatctcgtcgctggaaagacacgagtaaccttaaccaaccataagaaaagcgtgagagccgtggtgctccatcctcgacattacacctttgcttctggcagccctgataatatcaagcagtggaagttccctgatggctcttttattcagaatctctccggccacaacgctattatcaataccctcacagttaattcagatggggtcctcgtatcgggcgctgacaacgggacaatgcatttgtgggactggcgaacaggatataattttcagcgtgttcacgccgctgttcaacctggcagcctggatagcgaatccggcattttcgcctgcgcgtttgaccagtccgagagcaggctgctaaccgccgaggccgataagaccattaaagtgtatcgcgaggatgacaccgccaccgaggagacacacccagtttcctggaagccagagatcattaaacggaaacgtttttag

SEQ ID NO: 235234 - DNA, 1545 bp, Artificial Sequence
  Description of Artificial Sequence: Synthetic coding sequence
atggttgaagaagtgcagaaacactccgttcacactcttgtttttcgttctctcaaaaggacccacgatatgttcgttgccgacaatgggaagcccgtgccactcgatgaagagagtcataagcgcaagatggcaattaaactcagaaacgagtacggtcctgtcctacacatgcctacctcaaaggaaaatctgaaggagaaggggccacagaatgcaacagactcctatgtacacaaacagtatccagccaatcaagggcaagaagttgagtacttcgtggccggaacccacccatacccaccgggacctggtgtggcactgaccgctgataccaagatccagaggatgccctcagagtccgcagcacagagcctagccgtggccttgccactccagacaaaggctgacgctaaccgaacggcaccatccggatccgaatatcggcatcctggcgcatccgaccgccctcagccaacagcaatgaacagcattgtgatggagactggaaacacaaaaaactctgctctgatggctaaaaaggccccaaccatgcctaagcctcagtggcatccgccatggaagctgtacagagttatcagtgggcacctagggtgggttcgatgtatagccgtcgagcctggtaatcagtggttcgtcaccggcagcgcagacagaacaattaagatctgggacctggcttctggaaagctgaaattgagtctgacgggccacatcagcacagtgcgaggagtcattgtcagcacaagaagcccttatctgttctcttgtggtgaagataagcaggtcaaatgctgggatttagaatataataaggttattcggcactaccatggccatttgtctgccgtgtacggattggatctccatccaacaatcgatgtcttagtgacctgcagtagggattcaacagcacgtatctgggacgtgcgcactaaagcctctgtacacactctgtctggtcatacaaatgcagtggcgaccgtgagatgccaggctgccgagccccagatcattaccggaagccatgacactacaatacggctgtgggacctcgtggccggtaaaacaagggtgacattaacgaaccataagaagagtgtgcgggcagtggtgctccacccacgacattacacatttgcgtctggtagcccagataacattaaacagtggaagtttccagacggctccttcatccaaaacctgagcggacacaatgccattatcaacacactaaccgtaaactctgacggcgtgctggtttccggcgctgacaatggaactatgcacttgtgggattggagaaccggatacaacttccagagagttcacgccgcagtgcagccaggatccctggatagcgaatcaggaatttttgcatgtgccttcgaccagtccgaatcgagactgctcaccgccgaagccgacaaaactattaaggtataccgagaggacgacaccgcgaccgaagagacacatcctgtgagttggaagccggagatcattaagagaaaaagattttag

SEQ ID NO: 235235 - DNA, 5622 bp, Artificial Sequence
  Description of Artificial Sequence: Synthetic coding sequence
atgtgggccgaggccggactccccagagccggaggcggatctcagccacccttccggacttttagcgcctccgattggggattgacccatttagtcgtgcacgaacagacgggtgaagtgtatgttggcgctgtgaacaggatctataaactgtccggcaaccttactctcctgcgggcacacgtgaccgggccagttgaggataacgagaaatgttacccacccccaagcgtacaatcatgtccacacggcctcggaagcaccgataacgtaaacaagctgttgctgttggactatgccgctaacagactgctggcttgcggatccgcctcccaggggatttgccagttcctgcggctggacgacctctttaaactcggtgagccacaccacagaaaggaacattacctatcctccgttcaggaggctgggtcgatggccggagtgctcatcgctggacccccagggcagggccaggccaagctgttcgtgggcacccctatagatggcaagtctgaatactttccaaccctgtcttctcgccgactcatggccaacgaagaagacgccgatatgtttggcttcgtctatcaggacgaattcgtgagttctcagcttaaaatcccctcagatacattatcaaagttccctgctttcgacatctactacgtgtacagtttcagaagtgagcagttcgtctattatttgaccctacaactagacacccagcttacttcacccgacgcagccggtgagcatttctttaccagcaagatcgtcaggctgtgtgtcgatgaccctaagttttactcttacgttgagttccccattggctgtgagcaagccggtgtcgagtaccggttagtacaggacgcatacctgtctcgtcctgggagggccttggcccaccagttaggactcgcagaggatgaggacgttctctttaccgtatttgctcagggccagaagaatcgtgttaaacccccaaaggagagtgctctgtgtctgtttactctgagagccataaaggagaagattaaggagcgtatccagtcctgctatcgcggagaaggaaaactgagcctgccatggctcttgaacaaagagctgggttgtattaactctcctcttcagatcgatgatgacttttgtggccaagatttcaatcagccattagggggaactgttacaatagaaggcacgcccctatttgtcgacaaggacgatggcctcacagctgtggcggcatatgactataggggcagaaccgtggtgttcgcaggaactcgctcggggaggattcgcaaaatattagtagatctctccaatccaggaggccgacctgctctggcatacgaatcagttgtggctcaagagggatctcccattttgagagacctcgtgttgtctcctaatcaccaatacctctatgcaatgaccgagaaacaggtcaccagggtcccagtggagtcgtgtgtgcagtacacatcctgtgagctgtgtctgggcagtcgcgatccacattgtggttggtgcgtgctgcattcaatctgctcacggagagacgcttgtgagagagctgatgagccccaacggttcgcagctgaccttctgcagtgtgtgcagctgaccgtgcagccgagaaacgtctcagtgacaatgtcccaggtacccttggtcctccaggcctggaacgttccagatttgtcagcaggagtaaattgtagttttgaggactttactgagtctgagagcgtgctggaggatgggcgaatacattgtcggtctccctccgctcgagaagtcgcccctattaccagaggccagggggatcagagagtagtcaaattgtatctcaaatctaaggaaacagggaaaaagttcgcttcggtcgatttcgtgttctacaattgctccgtccatcagtcttgtcttagctgcgttaatgggtcctttccgtgtcactggtgcaagtataggcatgtctgcacccataatgtggctgattgcgcctttctggagggtagggtgaacgtgagtgaggattgccctcaaatcctgcccagcactcagatctatgtgcccgtgggtgtcgtgaagccgatcaccctggctgctcgcaaccttccccaacctcaatccggacagagagggtacgaatgtttatttcacattcccggttccccagccagagtgactgccttgaggttcaattcttcatctcttcagtgccagaacagttcttactcatacgaaggcaatgacgtcagtgatctccctgtgaacctgagcgtggtctggaatggcaactttgtaatcgacaacccacagaacatacaggcacatctgtacaaatgccctgccctcagagaatcctgtggcctttgtttgaaggccgatcctagattcgagtgtggatggtgtgtggccgagcggcgttgttcgcttcgccaccattgtgcggctgacactcccgctagctggatgcacgctcgtcacggaagctcacgctgcactgatcctaagatactgaagctctcacccgaaaccggcccacggcagggagggacccgcctcacaatcactggcgaaaatcttggccttcgctttgaggatgtgagattgggcgtgagggtgggcaaggtcctatgctctcctgtcgagtccgaatatatttctgctgagcagatcgtgtgcgaaattggcgatgcctcatccgtccgcgctcatgacgctttggtggaggtctgcgttagggattgttctccccactatagagcactgtctcccaagagattcacttttgtgaccccaactttttacagggtgagcccctctaggggccctctgtcaggcggtacatggataggcattgagggttctcatctgaacgccggatccgacgtggctgtctctgtgggcggaagaccctgctcctttagctggagaaactcaagagagatccgatgtctcacgccccctggacagagccccggatctgcgcctatcattatcaatatcaatcgagctcagctgacgaatcccgaagtgaaatataattacacagaagaccctacaatactgcgtatcgatcctgagtggagcataaactccggcggaactttgttgacagtcaccgggaccaatcttgccacagtgcgagagccacgtatccgcgcaaagtacggaggcattgaaagagagaatgggtgcctggtctacaatgacacaaccatggtatgtcgagcaccttcagttgcgaatcccgtgcggagtccaccagagttgggagagcggcctgacgaacttgggttcgtcatggataacgtccgttcactcctcgtattgaattccacctcttttctctactaccctgaccccgtgttggagccactcagcccaaccggactcctggaacttaagccctcaagccccctgatcctcaaaggaagaaacctgctgccaccagctcccggaaatagtcggctcaactacaccgtgctgattggctcaacaccatgtacgctcaccgtatcggaaacacagctgctttgcgaggcaccaaatctcaccggacagcacaaagtgaccgttagagcagggggatttgaatttagcccagggacactgcaggtctatagtgactctctgctcacactccctgccattgtgggaattggcggaggtgggggtcttctactcctcgtcatagtagctgtactgatcgcctataagcggaaatccagagatgctgaccggaccctgaagagattgcagcttcagatggacaatctggaatctagggtggctctagaatgtaaagaggcattcgccgaactgcagacagatattcacgagctgaccaacgacttagatggcgctggcatccccttccttgactatcgcacctatgccatgcgtgttctgtttcctggaatcgaggatcaccccgtcctcaaagaaatggaagtccaagcaaatgtggagaagagtcttaccctttttggtcaactcttgaccaaaaagcatttcctgttaacattcattcggactctagaggcacagcgctcgttcagcatgcgggaccgaggaaacgtcgcaagcctcatcatgaccgcactgcaaggtgagatggaatatgccactggcgtgctgaagcagctgctgagcgacctgatcgaaaagaacttagagagtaagaatcaccccaaactgctgctcaggagaaccgagtctgtcgctgagaaaatgttaacaaactggtttacatttctgctgtataagttccttaaggaatgcgcaggggagccactctttatgctgtattgcgctattaagcagcagatggagaagggcccaattgacgccattacaggggaggcacgctattccctgtccgaggataagttgatccgtcagcaaattgactacaagaccctgactctaaattgcgtaaacccagagaacgagaacgcacctgaggtgcccgtaaaaggtctggactgtgacaccgtgactcaagccaaagagaagctgctggatgcggcttacaaaggcgtaccgtattcacagaggccgaaggccgctgatatggatcttgagtggagacaaggcaggatggcgagaatcatcctccaggatgaagatgtgaccaccaagatcgacaacgactggaaaagactcaacacccttgcacactatcaagtgacagatggatcatccgtcgcactggtgcccaagcagactagcgcctataatatttccaatagctccacttttacaaaaagcctctccaggtacgagtctatgctgcggacagcgtctagtcctgatagcctcagaagccgcacacctatgatcaccccagatcttgagtctgggacaaaactgtggcatttggtcaaaaatcatgatcatctagaccagagggagggagatcggggaagcaagatggtaagtgagatctaccttactcggcttctggccacaaaagggacccttcagaaatttgtggacgatctgttcgagaccattttcagtaccgctcatcgagggagtgctctcccactggcaatcaagtatatgttcgacttcctcgacgaacaggctgacaagcaccagattcacgacgccgatgtgaggcacacctggaagtcgaactgcctaccactaagattttgggtcaacgtcataaagaacccccagttcgttttcgatattcacaaaaatagcatcactgatgcatgtctctcagtcgtcgcccaaacttttatggactcgtgctctacttcagagcacaagctaggcaaagattccccttcaaacaaactgctgtacgccaaggacatcccgaactataagagttgggtggaacggtattatgcggatatcgccaagatgcccgctatttcagatcaagacatgtctgcctacctcgcagagcaaagcaggctgcatcttagccaattcaacagtatgtctgcacttcacgaaatttatagttacattacgaagtacaaggatgaaatcctagcagccctcgagaaagacgaacaggcaagacgacaacgacttcgaagcaaactggaacaggtagttgatactatggccctcagctcatac

SEQ ID NO: 235236 - DNA, 5690 bp, Artificial Sequence
  Description of Artificial Sequence: Synthetic coding sequence
atgccactcccacccagaagccttcaggttttgctgctgctattgctgcttttactgctgctgcccggaatgtgggccgaagctggtttgccaagagctgggggagggagccagccgcctttcagaaccttcagcgcttccgattggggcctgacccacctcgtggtccatgaacaaacaggggaggtgtatgtcggcgcagttaatcgtatatataagttgtcgggtaatctcacattactgagagcccacgtgaccggacctgttgaagacaacgagaagtgttatccgcctccatctgttcagtcctgtccccacggcctgggctcaaccgacaacgtaaataaactgctcctgctggactatgcggcaaatcgtttgctggcctgtgggagcgcttcccaggggatctgccagttcctgcgcttggacgacctattcaagctgggcgagccccaccacagaaaggagcactacctctcgtccgttcaggaggcagggtcaatggcaggagtcctaatcgccggacccccagggcagggccaggccaagctgtttgtcggaactccaatcgatgggaagtccgaatacttccccactttgtcaagccgtaggttgatggcaaacgaagaagatgcagatatgttcggcttcgtgtatcaggacgaatttgttagtagtcagctgaagatcccctctgacaccctgagtaaatttccagcgtttgatatatactatgtctactccttcagatctgaacagttcgtctactacttgaccctgcagctggacacccagctgacatcccccgacgctgctggcgaacatttcttcacgagtaagatcgtgagactgtgtgtggacgacccaaagttttattcctatgtggagttccctatcggatgcgaacaggccggagtcgaataccggctggttcaggatgcctatctgagtaggccagggcgagcactcgcccatcagctggggttggccgaagacgaggatgtgcttttcactgtcttcgcccagggtcagaaaaatagagtaaaacctcccaaagaaagcgcactgtgtctgttcaccctcagggcaattaaagagaagatcaaagagaggatccagtcttgttaccggggagaaggcaaactgtcacttccatggctgctcaacaaggagttagggtgcatcaactccccactgcagatcgacgacgatttctgcggacaggatttcaaccagcctttaggtgggactgtaaccatcgaaggcactcccctgtttgtggacaaggacgatggactcacagctgtcgccgcttatgactaccgcggacggaccgtggttttcgcgggtactcgctctggccgtatcaggaagattcttgtggacctttctaaccccggagggcgtcccgcactggcctatgagagcgtggtcgcacaggaagggagccccattctccgagacctagtgttgtccccaaatcatcagtatttgtatgccatgaccgagaagcaggtcaccagagtgccagtcgagagttgcgttcaatacaccagctgtgagctgtgtctgggcagccgcgacccgcactgtggatggtgcgttctgcactcaatttgcagtcggagggatgcctgcgaacgcgcagatgagcctcagcggttcgctgctgatcttctccagtgcgtccagctgaccgtgcagcctaggaacgtaagtgtaacaatgtcacaggtccccctcgtactgcaggcatggaatgttccagacctatcagctggcgtgaattgctctttcgaagactttacagagtctgagtctgtactcgaagacggcagaatacactgccgctcaccgtctgccagagaagtggcccctattacccggggtcaaggagaccagcgtgtcgtgaagctatatcttaaaagtaaggagaccggcaaaaaattcgcgagcgtcgatttcgttttctacaactgcagcgttcaccaatcctgcctatcttgtgtgaatggatcttttccctgccactggtgtaaataccggcacgtctgtactcacaacgttgccgactgcgcgttcctcgaaggccgtgtgaacgtgtcagaagattgccctcagatactcccctctacacagatttacgtccctgtgggcgtcgtcaagcccatcactctggccgcacgcaaccttccccagccacagtctggccaaagaggctatgagtgtttgttccacatccctggttcccccgctagagtgaccgcgctgaggtttaacagcagctctcttcagtgtcaaaattccagttattcatatgagggaaacgatgtgtctgaccttcctgtaaacctgtcggtggtttggaacggcaacttcgtgatcgacaatcctcagaacatccaggcccatctgtacaaatgccctgctctgcgagaatcctgcggactctgcttgaaggctgatcccagattcgagtgcggatggtgcgtagccgaaaggcgctgtagtctgcgtcaccattgtgctgccgatacacctgcctcttggatgcacgctcgccatggaagctccaggtgcactgatccaaagatccttaagttgtctcccgagacggggcctcgacagggaggaacgcgactgaccatcacaggcgaaaatctcggcctgcggttcgaggatgtccgactcggagtacgcgtgggtaaggtgctgtgtagcccagtggaatctgaatacatctcagctgaacagatcgtatgtgagattggtgatgcatctagtgtgcgggcacatgatgccttggttgaggtgtgcgtgcgtgactgctcaccccactatagggcgctgtctccgaagcgttttacctttgtgacgcctaccttttaccgagtatctccctccaggggccctctgagcggcggaacctggatcgggattgagggaagccatctcaacgccggaagcgacgtggcggtgtcggtgggcggaaggccctgcagcttctcctggcgaaattctcgagagatcaggtgcctgactcccccaggccagtccccagggtcagcacccataataattaacattaatcgcgcacagctgacgaatccagaagtcaaatataactataccgaagatcctaccatactcagaatcgatccagagtggagtatcaattctggcggtactctcctcacagtcactggtaccaacctggcgaccgtacgcgagccgcgtatcagagccaagtacggcggaatagagcgcgaaaacggctgtctggtgtacaatgatacgacgatggtgtgcagggccccatcagttgcaaatcccgtacgcagtccccctgagttgggcgagcggcctgatgaattaggcttcgtcatggataatgtaaggtcacttctggtcctaaactcgaccagtttcctgtattaccccgaccctgtacttgaaccactgagtccaactggcctgctggaactgaaacctagcagtcctcttatattgaaggggagaaatcttctgccacctgcaccgggtaacagccgcttaaattataccgttctgatcggaagcacgccgtgtaccctgactgtgagcgagacccagctcctgtgcgaggctccaaatttgacagggcagcacaaagtgactgtgagagccggtggtttcgagttttcccctggcactctccaggtttacagtgactccctcttgactctccccgctatcgtagggatcggcggaggcggtggcctgctgctgctcgtgattgtagctgtactcatcgcatataaacggaaatcaagggatgccgacaggaccctgaagaggctccaactccagatggacaacttggagtctagagtagcactggaatgtaaggaggcattcgccgaattgcaaacagatattcacgagctgacaaatgatctggatggggctggcataccattcctggactacaggacatatgcaatgagagtgttatttcccggtatcgaggaccatcccgtgcttaaggagatggaggtccaggccaacgttgagaagagtctgacactattcgggcagctcttaacgaaaaaacactttcttctgactttcatcaggaccctagaagctcagcggtctttttcaatgagagatcgaggtaacgttgcttctttgatcatgactgcattgcagggagaaatggaatacgctacaggggtgttaaagcagctgctgagcgacttgattgagaaaaacctggagagtaaaaaccatccaaagctgctgctaaggaggacagagtcagttgccgaaaaaatgctcaccaactggttcacattcctgctgtacaaattccttaaggagtgcgctggcgagcctcttttcatgctgtattgcgccatcaagcagcaaatggagaaaggtcctattgacgcaatcaccggcgaagcccgatactccttgtccgaagataaattgatccggcagcagatagactacaaaactctgacactgaactgcgtaaaccctgaaaacgagaacgcccctgaggtgcccgtgaagggccttgactgtgacacagtgactcaagccaaagaaaaactgctggatgctgcctataaaggcgtgccatactctcagcggccaaaagccgctgatatggatctagaatggcgccaggggagaatggcacggatcatcctccaggatgaagacgtcactactaagattgataacgactggaagaggctcaataccttggctcattatcaagttacagatggctccagtgtggctctagtgcccaagcagacttctgcctacaacatttctaatagttcgacctttacaaaatcactgtcccggtatgaatcaatgctacggactgcttcaagcccagactccctgcgaagcagaacaccaatgataacaccggatttagagtccgggaccaagttatggcacttggttaaaaaccatgaccacctcgatcagcgggagggcgatcggggatcgaaaatggtgtccgaaatttatttaactcgcctgctggctacgaaaggcacactccagaagtttgtcgatgatctgtttgagacaatcttcagcacagcgcatcgcggaagtgcactgccactggcaataaaatacatgtttgattttcttgatgagcaagccgacaagcatcagatacatgatgctgacgttcggcatacgtggaagtcgaactgtctgcctctacgcttctgggtgaatgtcattaagaacccccaattcgtatttgatattcataaaaattcgatcactgacgcctgcctcagcgtggttgcccagacattcatggacagctgttcaacaagcgagcataagctggggaaagactcacctagtaataagcttttatacgccaaggacatcccaaactacaagtcctgggtcgaaagatactatgcggacattgccaaaatgccagccatcagcgatcaggacatgtccgcataccttgctgagcagtctagacttcatctcagccagttcaatagcatgtctgcgctccatgagatctattcttatatcactaaatacaaggatgaaatccttgcagccctggaaaaagacgagcaggcccgacgacagcggttgagaagtaaacttgaacaggttgttgatacaatggccttatcctccta

SEQ ID NO: 235237 - DNA, 5684 bp, Artificial Sequence
  Description of Artificial Sequence: Synthetic coding sequence
atggaacaacgaagaccatggccaagagctctggaagtagacagccggtcggtagtgctgctatcagtggtatgggtgcttctcgcccctcctgccgcagggatgcctcaattctctacatttcactccgagaacagagactggacatttaaccaccttaccgtccaccagggaaccggcgctgtctatgttggtgcgattaatagggtatataagctcacaggtaaccttacgatccaagtcgctcataagacaggtccagaagaggataacaagagctgctatccacctctgattgtccagccatgttccgaggtactgacactgacaaataacgtgaataaactgttgataatcgattattcggagaaccgccttttggcttgcggatcgttatatcagggggtctgtaagctgcttcggcttgatgacctttttattctggtggagccatcccacaagaaagaacattatctgagcagtgtgaacaaaaccggcacaatgtatggtgttatcgtgagaagcgaaggagaggacggaaagctgttcataggtaccgccgtcgacgggaaacaggactactttccaactttatctagccggaagctacccagagaccccgaaagcagcgcaatgctggactacgaactgcatagtgactttgttagctctctaataaaaattcctagcgacacattagccctcgtgtctcattttgatatcttctatatatatggattcgcctcaggtggattcgtttattttcttacagtccagcctgagactccagagggcgtcgcaatcaattccgccggagatctgttttatacctctagaatagtcaggctgtgcaaggatgacccaaaatttcatagctacgtaagcctaccttttggctgcacgagagcgggtgtggaatacagactgttacaggcggcttaccttgccaaaccgggtgactcgctagctcaggcgttcaatattacgagccaggatgacgtcctttttgctattttctccaagggccagaagcagtatcaccaccctccagacgattctgcgttatgcgcctttcctataagggccatcaacctgcaaatcaaagagaggctgcagagctgctatcagggcgagggaaatcttgaattaaactggctgctgggcaaagacgttcaatgtacaaaggcgccagttcctattgatgataacttctgcggcctggatattaaccagcccctgggcggttcaaccccggtagagggtcttactctatataccacaagccgagatcgtatgacctctgtggcttcttatgtatacaacggatatagtgtcgtgttcgtggggaccaaaagcggaaagctcaaaaaaatcagggcggatggcccaccccacggaggcgtgcagtacgagatggtatccgtgctcaaagacggaagcccgatactgagagatatggcatttagtatagatcagcggtacctctatgtcatgagcgaacgacaagttacacgggttcccgtcgagagctgcgagcagtacacaacctgcggcgaatgccttagttccggtgacccacattgcggatggtgtgctctgcataatatgtgcagcagacgagacaaatgccagcaggcttgggagcccaatagatttgccgcatctatttctcaatgtgtgtcactggcagtgcaccccagtagcatctctgtctcggagcactcgagattactttctctagtggtgtctgatgccccagacctgtctgcaggcatcgcttgcgcttttggaaacctgacagaggtcgaagggcaagtgtcaggaagccaggtgatctgcatcagcccgggtcctaaggacgttccagtgatcccgctggaccaggactggttcgggctcgagctgcaactgcggtccaaggaaactggcaagattttcgttagtacagaattcaagttctacaactgttcagcccaccagctgtgtctcagctgcgtcaactccgccttccgctgccactggtgcaaatacaggaacctgtgtacacatgatcctactacctgcagctttcaggagggtagaattaacatctccgaggactgcccacagcttgtgcccacggaggagatcctcatccccgtgggagaggtgaagccaattacgctcaaggccaggaatcttcctcaaccgcagtctggacagagaggctacgagtgcgtcctgaacatccaaggggcaatccatcgtgtccctgcactccggttcaacagctccagcgtacagtgccaaaattcatcctatcagtacgatggaatggacatctcaaacctggctgtggatttcgcggtggtgtggaatggcaacttcatcatcgacaacccccaagatctgaaggtacacctgtacaagtgcgccgcacagagagagagttgcggactctgtcttaaggctgacagaaaatttgagtgtgggtggtgctccggcgaaaggcgctgcacactccatcagcattgcacctccccctcctcaccttggttggattggagcagccacaatgtgaagtgctcaaacccacagataactgagatacttacggtttccgggcctccagaaggaggtacccgcgttacgattcatggggttaacctcggactcgattttagcgagatcgcccatcatgtgcaagtggctggcgtgccctgcacccctttacccggtgaatatatcatcgctgagcagattgtgtgcgagatgggccacgcacttgtcggaactacctcaggccctgtccgcctttgtattggcgagtgtaaacctgaatttatgacaaagtctcaccaacaatacacgtttgtgaatccctcagttctctccctgaaccctattcggggtcccgagagtgggggaacgatggtgacaataactggacattacctcggcgcaggatcgtccgtcgctgtttacctagggaatcagacttgtgaattctacggacgatcaatgagcgagatcgtgtgcgtcagtcccccttcatctaacgggctcggaccagttcctgtctccgtgtccgttgatcgcgctcatgtggatagcaatctgcagtttgaatacatcgacgatccgagagttcagcggatcgagcctgagtggagtatcgccagcggacatacccctttgaccatcaccggctttaacctggatgttatccaagagccaagaattcgcgtgaagttcaatggcaaagagtccgtcaacgtttgcaaggtcgtgaatactacaacactcacgtgcctggcacctagtctgactaccgattaccggcctggcctcgacacagtggagcggccagatgagttcggctttgtctttaacaatgtccagtctttactgatctataacgacactaagtttatatactaccccaaccccacctttgagctcctgtcccccaccggcgtactggatcagaaacctggcagccctataattctcaaagggaagaatctgtgtccaccagcctccggtggggcaaagctaaactacacagttcttattggtgagaccccgtgcgcggtgacagtgagcgagacgcagttgttatgcgagcctcccaatctgactgggcagcataaggttatggtccatgtaggaggcatggtctttagccccggttccgtcagcgtgatttccgattctctgcttacgctcccagccatcgtgagcattgcagccggtgggagcctgctcttgatcatagtgatcatagtgttaatagcttataagagaaaaagccgagaaaatgatcttaccttaaaacgtctgcagatgcagatggacaatctcgaaagccgagtcgctcttgaatgtaaggaagcgttcgctgagctccagaccgatattaacgaactgaccagcgatctggaccggagcggaatcccgtacctggattaccggacttatgccatgagggttttgttccccggaattgaggaccaccccgttctcagggaactggaagttcagggtaacggccaacagcacgtcgagaaagcacttaagctgttcgctcaacttattaacaacaaggtattcttgctgacattcatacgaacccttgagctgcaaagaagctttagtatgcgcgataggggaaacgtagctagcttaatcatgactggcctccagggacggctcgagtacgccacagacgtcctcaagcagttgctttcagacctcattgacaaaaatctagagaacaaaaatcatcccaagctgctcctgcgtcgcacagagagcgttgcagaaaagatgcttaccaactggttcgccttcctgcttcacaaattcctaaaagagtgtgcgggagaacctctgtttatgctctactgtgccattaaacagcaaatggagaagggacctatagacgctatcacgggtgaggccagatattccttgagcgaagacaaacttattcggcagcagatcgaatacaaaacactcattctgaactgtgtaaatcctgataatgaaaatagtccagaaatcccagtgaaagtgctgaactgtgacacaataacccaggtaaaggagaaaatcctcgatgccgtctacaaaaacgtgccctatagtcagcgcccaagagctgtcgacatggaccttgagtggaggcagggaagaattgcgagggtggtcttgcaagatgaggacattacaactaaaatcgagggcgactggaagcgattgaatactctgatgcactatcaagtgtccgacaggtcagttgtggccctagtccctaagcagacatcgtcatacaacattcccgcatccgcatctatatctaggaccagcatcagccgctatgatagtagctttcgctacacaggttccccagactcactgaggagtagggctccgatgattacgccggacctggaaagcggcgtaaaggtgtggcatctcgttaaaaaccacgaccatggcgatcaaaaagaaggtgacagaggatccaaaatggtctccgagatatatcttacacgtcttctcgccaccaaagggaccctacagaagttcgtcgacgacctcttcgagacactattcagcacagttcatcgcggttctgcgcttccattggccattaagtacatgttcgacttcctggacgagcaggcagacagacactcaattcacgacactgacgtcaggcacacatggaagagcaactgtctgcccctgcggttttgggtgaacgttataaaaaacccccagttcgtgtttgacattcataaaggcagcattacggacgcttgtctgtccgtggtagcacagacattcatggacagctgtagcacatctgaacatcgcctgggaaaggatagtcctagcaacaagttgctctacgccaaggacatccctagctataaatcctgggtggaaagatattacgcagatattgccaagttacctgccatttccgaccaggatatgaatgcttatctggctgagcagagccgactccatgctgtggagttcaatatgctaagtgccctgaatgaaatttattcttacgtgtctaagtattccgaggagttgatcggcgcactggagcaggatgagcaagcgcgtagacagcggttggcatataaggtggaacaactgattaatgcaatgagtattgagtccta

SEQ ID NO: 235238 - DNA, 5684 bp, Artificial Sequence
  Description of Artificial Sequence: Synthetic coding sequence
atgaaggccatgccttggaactggacttgtttgcttagccacctgctcatggtcggtatggggtcctctacgcttcttacgcgccagccagcacctctctcccagaagcaaaggtctttcgtgactttcaggggtgaaccagctgaagggttcaatcatcttgtggtagacgagaggactggccatatttatttgggcgcagtgaacaggatctacaagctgagtagtgacttgaaagtgcttgtaactcacgaaaccggccctgacgaggacaatccaaaatgctacccacctcgtatcgtgcagacctgcaacgagcccctaaccactactaacaacgtgaacaaaatgctgctgatcgattacaaggaaaacaggctgatcgcctgtggatccctgtatcaaggtatatgtaagcttcttcgcctggaagacctgtttaaactgggagagccctaccataaaaaagagcactatctgtcaggggtgaatgagtcaggctccgtgttcggggtcatagtttcttacagcaatctggacgataaactttttatagccactgcagtagacggaaaaccggagtacttccccacgataagctctaggaaactgaccaagaactctgaggctgatggaatgttcgcttacgtctttcatgacgagttcgtggccagcatgattaagataccgtcggacacattcactatcatccctgattttgacatttactacgtatatgggttctcgtcaggaaactttgtttacttcttaacgctgcagcccgaaatggtttcccccccaggcagtactacaaaagaacaagtgtatacctcaaagcttgtaaggctgtgcaaagaggacacagccttcaactcctatgtggaagttccgattggatgtgagagaagcggagtggagtatcggttgctccaggccgcttatctgagcaaggcaggcgctgtgctcggacggaccctgggcgtgcatccagatgatgacctcctgtttacagtgttctctaaggggcagaaacgcaaaatgaagagcttggacgaatccgccttgtgtatcttcattcttaagcagataaacgaccggattaaggagaggttacagagttgctacaggggtgaagggaccctggatctcgcgtggctgaaagtgaaggacatcccatgtagctcagcgcttctgactatagacgacaacttttgtggcttggacatgaacgctcccttaggcgtctctgatatggttaggggaatcccagtatttaccgaagatcgtgatcgcatgacttcagtaatagcatatgtgtataagaatcactctctggctttcgtggggacaaagagtggaaagctgaagaaaatccgggtagatggtcctcgagggaatgcgctccagtatgagacagtgcaagtggtggaccccggacccgtgcttagggacatggcgttctccaaggatcacgagcagctgtatattatgagtgagcggcaactgacacgggttcctgtggaatcttgtgggcagtatcagtcctgcggtgagtgcctggggtccggtgatcctcactgtggatggtgcgtgcttcacaatacctgcaccaggaaagagcgttgcgagcgcagcaaagagcccaggaggtttgccagcgaaatgaaacagtgcgttcgcttaacagttcaccctaataatatctcagtttctcaatacaatgtgctgctggttctggagacctataacgtgcccgaactcagcgccggagtgaattgcaccttcgaggacctgtccgagatggacggcctggtcgtagggaaccagatccaatgctacagtcctgcagcaaaggaagtgcctcgcatcatcaccgaaaacggggaccatcatgtggtgcagctgcagcttaagagtaaagagacagggatgacatttgcttctacctcatttgtgttctacaattgttccgttcacaacagttgtctatcttgcgtcgagagtccttaccgctgccactggtgtaaatacagacatgtttgtacccacgatccaaagacttgcagtttccaggagggaagggtcaagttaccggaggattgccctcagctcttaagggtagacaagatactcgtgccagtggaggtgatcaaacccattactctgaaggcaaagaacttgccccagccgcagtctggacagaggggatacgaatgcatcctaaacatacagggaagcgaacagcgggtgcctgctctcagattcaattccagttctgttcaatgccagaacacttcgtattcatatgagggaatggagattaacaatttgccagttgaactcactgtcgtctggaacggccattttaacatcgataatcctgcacagaacaaggtacatctgtacaagtgtggcgctatgagggagagttgcggactgtgcctgaaagcggatccggactttgcctgtggctggtgccaggggccaggacagtgtacgctgcgccagcattgtccggctcaggaatcccaatggcttgaactgagtggagcaaagtccaaatgtaccaacccgaggattacagagattattcccgttaccgggcctcgcgagggaggaacaaaagtcactatccgcggagagaacctggggttggagttcagagatatcgcttcccacgtgaaggtggctggagttgagtgctcgcccctggtggacgggtatattccagctgaacagattgtgtgtgaaatgggcgaggccaaaccctcccagcacgcaggttttgtggaaatctgtgtggcagtttgtcgccctgaattcatggctagatcaagccagctctactattttatgacactgacactgtcggatctcaaacccagtcggggacccatgagcgggggaacacaggtcacaattacgggaaccaatcttaacgcaggctccaatgttgtcgtgatgtttggaaagcaaccctgtctgtttcacaggagatctccctcctacattgtttgtaacacgacctcatccgatgaggtgctggagatgaaagtcagtgtgcaagttgatagagccaaaatacaccaggacctcgtgttccagtatgtcgaggatcccacaattgtaagaatcgagcccgagtggtcgatcgtttccggtaatactccgatcgctgtgtggggtacacacctagatctgattcaaaatccacagataagagcgaagcacgggggtaaggagcatatcaatatctgcgaggtacttaacgcgacagagatgacttgccaggctcctgccctcgccctaggccctgaccaccaaagcgatctgactgagcggccagaagagtttggctttatactggataatgtgcagtccctcctgatcttgaacaaaacaaacttcacctattatccaaacccagtgtttgaagctttcggcccatcagggatcttagagctgaagccaggtacccctatcatcttaaagggcaagaacctcattccgcctgtggcagggggaaatgtgaagttgaactacacagttctcgtcggagaaaaaccatgtactgtcacggtgtctgatgtgcaactgttgtgtgaaagccctaacctgattggaaggcacaaggttatggctagggtcggcggaatggagtatagcccaggaatggtgtatattgcacctgactctcctttgtcactgccggcaattgtgagcatcgcagtagcaggcggtttgttaatcatatttatcgtcgccgtcctcatcgcatataagcgtaagagtcgtgaatccgacttaacattgaagaggcttcagatgcagatggataatctcgaatctcgagtagctctggaatgcaaagaagcattcgctgagctacaaactgatattcacgagctgacaagcgatctggatggtgctggcattcccttcctcgattatcggacttacactatgagagtactcttcccagggattgaagatcacccagtactcagagatctggaggtgccgggttaccgccaggagcgcgtggaaaagggtctgaagttgtttgctcagttaatcaacaacaaggtgtttctgctaagcttcattcgcactctggaatctcaaagatctttcagcatgcgcgaccgcggaaatgtggcctcactcataatgactgttctccagtcaaagctggaatacgcgacagatgtcttaaagcagctgctggctgatcttattgataaaaacctagagagtaagaaccatccaaaattgctcctgcggcgtacagaaagtgtggccgaaaagatgctgacaaactggtttacatttctactgtacaagtttcttaaagagtgcgccggagaacccctcttttcactcttctgcgcaatcaaacagcagatggaaaaaggaccaatcgatgccattaccggagaggccaggtatagtttatccgaggataagctcatacggcaacaaatagactataaaacgttagtactgagttgtgtttcccctgacaacgccaactcccccgaggtccccgtcaaaatattgaattgtgatacaataactcaagttaaggagaaaatattggatgcaatttttaagaatgtgccatgcagccacaggcccaaggcagctgacatggacctggagtggaggcaggggtcaggagctcgtatgatattgcaggatgaggatatcacaaccaaaattgagaacgactggaaacggctgaacactttggcccactaccaggtgcccgatggcagtgttgtggcgctcgtttctaagcaggtgaccgcctacaacgctgtcaataattccacagtatctcgtacctcagccagtaaatacgagaacatgatccggtacactggctctccagacagtctcagatcacgaacccccatgatcacacctgacctggagtcaggtgttaagatgtggcatcttgtgaagaaccacgaacatggcgaccagaaagagggagatcgaggcagcaagatggtttctgaaatctacctcacaagactgctcgcaaccaaaggcacattacaaaagtttgtagatgacctgtttgaaacaattttcagcaccgcccacaggggcagcgctttgccactcgctattaaatacatgttcgatttcttggacgaacaggctgacaaacacggcatccatgacccacacgtgaggcacacttggaagtctaattgcttgcctctgcgcttttgggtcaacatgataaaaaatccccagtttgtttttgatatccacaaaaattccatcacagatgcatgcctatcagtagttgcccagaccttcatggactcatgttctacatccgaacacaggttgggcaaagattccccttccaataagctgctctatgccaaggatataccatcctataagaactgggtagaaagatactacagcgacatcggcaaaatgccagctattagtgaccaggacatgaatgcatatctcgctgagcagtccagaatgcatatgaatgaattcaataccatgtccgctttgtccgagattttctcgtacgtagggaagtattcagaagaaatccttggtcccctagaccatgatgaccagtgcggcaaacagaagcttgcatataagttggagcaggtgattaccctgatgtctttggatagcta

SEQ ID NO: 235239 - DNA, 5684 bp, Artificial Sequence
  Description of Artificial Sequence: Synthetic coding sequence
atgaaagcaatgccatggaattggacatgtctgctgtcgcatttattaatggttggtatggggtcgtccactctgctgacccgacagcctgccccactgagtcagaagcagaggtctttcgtgacttttcggggagaacccgcagagggctttaaccatttggtggtcgacgagcggaccggccacatttacctcggcgctgtcaatcggatttacaagttgtcctccgacttaaaagtgctggtgacccacgaaactggccctgatgaagataatcccaagtgctatcctcctaggatcgtgcagacatgcaacgagccactgactactacgaacaacgtgaacaagatgttactgattgattataaagaaaacaggctcatcgcatgcggatcgctctaccaaggcatctgcaaacttctgcgcctggaggacctcttcaaactgggcgagccctaccacaagaaagaacactacctgtcaggcgtgaatgagtccgggtccgtctttggagtgattgtgtcttattcaaacctcgacgacaagttatttatcgccactgcagtagatggcaagcctgaatacttccctactatatcctcccgcaagttgactaaaaatagcgaggcagatggtatgttcgcctacgtatttcacgatgaatttgtcgctagtatgatcaaaatcccttccgacacctttaccatcatcccggacttcgatatctactacgtgtatggattctcttcaggaaactttgtgtactttctcactctgcagccggagatggtaagccctccaggaagcaccacaaaggagcaggtctacacaagcaagcttgtgcgactgtgcaaggaggacaccgcattcaacagctatgtagaggtgcccatcggatgtgagagatctggggtggaataccgcctcctgcaggccgcttacctttctaaggctggggcagtgctgggcagaactctgggcgtacaccccgatgacgatttgttattcaccgtctttagcaagggccagaaaaggaagatgaaatcacttgacgagtctgcactttgtattttcatcctgaaacaaattaatgaccggatcaaggagcggctgcagtcctgctaccggggtgaaggaacgctagatctagcctggctgaaagttaaagacattccttgtagttcagccctactcaccattgatgacaacttctgtggcctagatatgaatgcccctctcggggtgagtgacatggtgcgcggaatacctgtttttacggaggatagagatcggatgacctccgtgattgcgtatgtgtacaagaaccacagcctggctttcgtgggtacaaaaagtggcaagctgaagaaaatccgggtggatgggccacgcggaaacgccctgcagtatgaaaccgttcaggttgtggaccctggcccagtcctgagggatatggcattctctaaggatcacgaacaattatatatcatgtccgagcgacaattaacccgcgtcccagtcgaatcttgcggccaatatcagtcgtgtggtgaatgcctgggctcaggcgatccccattgcgggtggtgcgttctccacaacacgtgcacaaggaaggagcgatgcgaaagatctaaagagcctagacgttttgcatccgagatgaaacagtgcgtgcgactgaccgtacatcccaacaatatctctgtcagccagtataacgtgctgctcgtgcttgagacctataatgtaccggagctatccgccggtgtgaattgtactttcgaggacttatccgagatggatgggctggtcgtgggaaaccagattcagtgttattctcccgctgccaaggaagtccctagaattatcactgagaatggggatcaccatgttgtgcagctgcagttgaagtcaaaagagacaggcatgacattcgccagcacttcatttgtgttctataactgctcagtgcataacagttgcctgagttgtgtggaatctccatacaggtgtcactggtgtaaatacagacacgtgtgcacacacgaccccaagacatgcagttttcaggaggggcgtgtaaaactgcctgaagattgtccacagctgctgcgagtggacaaaatccttgttcccgtcgaggttatcaagccaatcacactcaaagcgaaaaacttgccgcagccccagtctggccagcggggatacgagtgcatcctcaatattcagggttcagagcagagagtcccggctttaagattcaacagctcctccgtgcagtgtcagaataccagttatagctatgaaggcatggaaatcaataacctgccggttgagctgacagtcgtatggaacggccatttcaacattgataacccagctcagaataaggtgcacttatataaatgtggcgcaatgagggagtcttgcggtctgtgcctcaaggctgaccccgacttcgcttgcggctggtgtcaaggcccaggacagtgcactcttcgccagcactgtcctgcgcaggagtctcagtggctcgagttatcgggagccaagtcaaagtgcacgaaccccagaatcactgagatcattcccgtgaccggtcctcgcgagggcggaacaaaagtaacaattagaggtgagaatctaggcttggagttcagggacatcgcttcgcatgtgaaggtggccggtgtagagtgtagtcccctcgtagatggctacataccggctgagcagatcgtctgcgagatgggggaggcaaaaccttcacagcacgcagggttcgttgagatttgtgttgcagtctgtcggcctgagtttatggcacggagctcccaactctactatttcatgactctcactcttagcgatctgaaaccaagcaggggccctatgtctgggggtacacaagtcaccatcacagggacaaacttgaacgccggatcaaacgtggtggttatgttcggcaagcagccttgtttgttccaccggaggtcccctagctatattgtatgcaataccaccagctccgatgaagtcctcgagatgaaagtaagtgtgcaggtggatagggccaagattcaccaggacctagtgtttcagtacgtggaggatccaaccatagtgagaatcgagccggaatggagcatagttagtgggaacacccctattgccgtttggggaactcacttagacctgattcagaacccacagatccgggctaagcacggcggtaaggaacacatcaatatctgcgaggtacttaacgctactgaaatgacctgtcaggcacctgccctagccttaggacccgaccaccagtctgatctgactgagcggccagaagaattcggttttatcctggacaatgtccagagcttacttatcctcaacaagactaattttacctattaccctaatcctgtgttcgaggcattcgggccttctgggattttggaactgaaacctggcaccccgatcatcttgaagggaaaaaatctcatcccaccagttgccggtggaaatgtgaaattgaattacaccgttctggtcggagagaaaccctgtacagtgacggttagtgatgtgcaattgctgtgcgagagcccaaatcttatcggccgacataaagttatggccagagttggcggtatggagtacagcccaggaatggtgtacattgccccagacagcccgctctcactacccgcaattgtatccatcgcggtagctggaggtcttctcatcatatttatagtggcagtactgatcgcctataagaggaagagcagggaatctgatttgaccctgaaaagactacagatgcaaatggataacctggaatctcgtgttgctttggaatgcaaagaggccttcgccgagctacagaccgacattcacgaactgacatctgatctggatggggcaggcattccatttctagattatagaacctataccatgagggtgctcttccccggtattgaagatcaccctgtgctgcgggacttggaggtcccgggatacaggcaggagcgcgtggaaaagggcttaaagctgtttgcacagttgatcaataacaaagtattcttgctgtctttcatccgaaccctggaaagccagcgcagcttctccatgcgcgaccggggaaatgtggcaagcctgattatgacagtcttacagagcaagctggaatacgcaacagacgtgctaaagcagctccttgccgatttaatcgacaagaaccttgaatctaaaaatcaccctaagctgctactccgcaggacagagagcgtggccgagaagatgcttactaattggttcacctttctactctataagtttttgaaagagtgtgccggagaacccctgttctctctgttctgtgccatcaaacaacagatggaaaaagggcctatcgatgccataacgggtgaagcaagatattcactgtcagaagataaactaatcagacaacaaatcgactacaaaacattagttctctcgtgtgtgagcccagacaacgcaaacagccccgaggtgcctgtaaagattctcaattgcgatactatcacacaagttaaagagaaaatcttggacgcaatcttcaagaatgttccgtgctctcatagacctaaggccgctgatatggacctggagtggcggcagggttcaggcgctcggatgatcttgcaagacgaggacattacaactaaaattgagaacgattggaagcggctgaacaccttggcgcactatcaagtccctgacggatccgtcgtcgcgctggtatccaagcaggtgacagcctacaatgccgtgaataattctactgtcagccgaaccagcgccagcaaatacgaaaacatgatccgttacacaggctctccagatagcctcagatctagaactcccatgatcacaccagatctggagtcgggggtaaagatgtggcacttagtcaagaatcatgaacacggcgaccaaaaggagggcgatcgagggagcaaaatggtgtctgagatatacctaactcggcttctggccacaaagggtactctgcagaagttcgtggatgacctgttcgaaaccatttttagcacagctcaccgcggtagtgctctgccattggcaatcaagtacatgtttgactttctggatgagcaggcagataagcacgggatccatgacccgcatgtacggcatacttggaagagtaattgtctccccctgcgcttctgggtaaatatgattaaaaatccgcagttcgtgttcgatattcacaaaaattctataacggatgcttgcctgagcgtggtagcacaaacctttatggacagctgctcaacctccgagcaccggttagggaaggactccccatctaacaaattgctgtacgctaaggatatcccctcctataaaaactgggtggagaggtactactccgacatcggtaaaatgccagccatatcggatcaggatatgaacgcttacttggccgagcaatcacgcatgcatatgaacgagtttaataccatgagcgctctgagtgagattttctcttacgtgggtaaatatagtgaggagattctcggtcccttagaccacgatgatcagtgtggcaaacagaagctcgcctacaaactagagcaagtcataacactgatgtccttagatagcta

SEQ ID NO: 235240 - DNA, 1569 bp, Artificial Sequence
  Description of Artificial Sequence: Synthetic coding sequence
atgaaagcaatgccatggaactggacatgcctccttagccacctgttaatggtggggatgggcagcagtacactgcttacccgccaacctgctcctctgagccagaaacaaaggtccttcgtgacctttaggggggagcccgctgaggggtttaatcacttggtggtggatgagcgcaccggacacatttacctcggagccgtcaacagaatctacaagcttagttccgatctaaaagttcttgtgacccacgaaaccgggcctgacgaggataacccaaagtgctaccccccacgcatagtacagacatgtaatgaaccattgacgactactaataatgttaataagatgttgctcatcgattacaaagagaaccggttgatagcttgcgggagtctctaccagggcatttgtaagttactccggctggaggatctgtttaaactgggagagccatatcataagaaggaacattacttatcaggtgtcaacgagtccgggtccgttttcggtgtgatcgtctcctacagtaatctggacgataagctgtttatagctactgccgtcgacggcaagcccgagtatttccctaccataagctcccggaagctgaccaaaaacagcgaggcagacggaatgttcgcctacgtatttcacgatgagtttgtcgcctctatgataaagatccctagtgacacatttaccattattcctgactttgatatatattacgtatatggtttttcgtccggaaattttgtgtactttcttaccctgcagccagagatggtttcccctcccggatctaccaccaaggaacaagtgtatacgtcaaaacttgttaggttgtgtaaggaggacacggcttttaatagctacgtagaggttccaatagggtgcgagagatccggcgtggaatataggttgctgcaggctgcttacctgtcaaaagcaggtgccgtgcttggcaggacactgggcgttcatcctgacgacgatctgctcttcactgtgttcagcaaaggacaaaagagaaagatgaagagtctggatgaaagcgccctttgtatattcatactaaagcagatcaacgatcgaatcaaagagagactgcagtcttgctacaggggagaaggcaccctcgacttagcctggctgaaggtgaaagacatcccgtgtagttcggcattgctgacaattgatgacaacttctgcggccttgatatgaacgcgcctttgggagtgagcgacatggtcagaggtatccccgtttttaccgaggaccgggaccggatgacaagtgtaatagcctacgtatacaaaaatcatagtcttgccttcgtgggcacaaagtctgggaagttgaagaaatctttcgggactggaccccaggggggaatcactcaggaatggatcggcgtggagggtgaccccccaggggcaaacatagccagtcaggaacagatgctgtgcgtgtatctgcaatgttcaagtcacaaggcaatttcagatcagagagtgcagcccctgctgtgttgctttctcaatgtgccaggcaattcaagctag

SEQ ID NO: 235241 - DNA, 1479 bp, Artificial Sequence
  Description of Artificial Sequence: Synthetic coding sequence
atgaaggccatgccttggaactggacttgtctgctcagtcatctgttaatggtgggcatgggctccagcacactcctcacgcgacagcctgcccctctaagccagaaacaaagatcgttcgtgacttttaggggtgaacccgctgagggctttaatcatctggtggtggacgagaggaccgggcatatatatctcggagcagtaaaccggatatataaactctcatccgatttgaaggtgttagtcacacacgagacagggcctgacgaggacaatcctaagtgctatccaccacgtatcgtgcagacctgcaacgagccactgaccaccacgaataacgttaacaaaatgctcctcattgattataaggaaaatcggttgatcgcctgtggatccctgtatcaaggaatctgcaagctcctgagactcgaggatctttttaagctgggggagccttatcataagaaggagcactacctgtcgggcgtgaacgaaagcggttctgttttcggggtcattgtgtcctactccaacctcgatgacaagctgtttatcgccactgccgtggacggtaaaccagagtacttcccgaccatttcctcacgaaagttaacaaaaaactccgaagcagatggaatgtttgcttatgtgttccacgacgagttcgtagcatcaatgattaaaattccctccgatacctttaccatcatcccagactttgatatttactatgtgtacggatttagctccggaaactttgtgtatttcctgaccttacagcctgagatggtcagcccaccaggcagcaccaccaaagaacaggtgtacacctctaaactggtgcgcctgtgtaaggaggacacagcttttaattcttacgttgaagttccaatcggatgtgagaggtcgggtgtcgagtaccggctgctgcaggctgcatacctgagcaaagctggagcagtgcttgggaggactctaggggttcatcctgatgatgatctgctgtttactgtcttttcaaagggccaaaagcggaaaatgaaaagtctggacgagtccgcactttgcattttcatactgaaacagattaacgataggatcaaagaacgactacagtcatgctacaggggcgagggcactcttgacttggcgtggcttaaggtgaaagacattccatgctctagtgcgctgttaaccatcgacgacaatttttgcgggctggacatgaatgcgcctctgggggtcagcgatatggtcagaggcatccccgtcttcactgaggatcgcgatcgcatgacaagtgtgattgcctacgtgtacaaaaaccacagcctagcctttgtaggcactaagagtggtaagctgaaaaagatgcctggtacctctctgtgcccaactttggaacttcagacaggaccccgatcacaccgggctaccgtcaccctagagctccttttctcttcctgctctagtaattag

SEQ ID NO: 235242 - DNA, 5516 bp, Artificial Sequence
  Description of Artificial Sequence: Synthetic coding sequence
atggcgctgcagttatgggctctcaccttactggggctattgggtgccggtgcgtcactcagacccaggaagctggatttctttcgatctgaaaaggagctcaaccatctcgctgtcgatgaggcctctggtgtggtgtatctgggtgcagtaaacgcactttatcagctggacgcaaagctccagttagaacagcaagtggcaaccggaccagctttggataataaaaaatgcacacctcccatcgaagccagccagtgccatgaggcagagatgaccgataatgtcaatcagcttttgctgcttgaccctcccagaaagcgtcttgtggagtgcggttctctgttcaaaggaatatgtgctcttcgcgctctgagtaatatttccttgagactgttctatgaggatggcagcggggagaagtcttttgttgctagcaacgacgagggggtggctaccgtgggcctggtgtcttctaccgggccaggcggagaccgcgtgctgttcgttggcaaaggcaatggcccacatgacaatggaataatcgtgtccactaggttgctcgatcgcactgactcgcgggaagccttcgaagcatacaccgaccacgctacttacaaggccggttatctgtccacgaatacacaacagtttgtggctgcttttgaggatgggccttacgtgtttttcgtgttcaaccagcaggataagcacccggctcgcaacagaaccctattggcgcgtatgtgccgtgaagaccccaattactatagctacctcgagatggatctgcagtgcagggatcccgatatccacgcagctgcctttggcacctgtctggccgcatcagtggccgcacctggaagtggtagggtcctatatgcagtcttttcacgagatagtagatccagcgggggacccggagccggtttgtgcttatttcccctcgacaaggtgcacgcaaaaatggaggccaacaggaacgcttgctacacaggcaccagggaggcgcgtgatatattctacaagcctttccacggcgacattcaatgtggagggcacgctccaggttcgtcaaagagctttccctgcggtagtgagcatctgccttatcccctcgggtcccgggacggtctgaggggcaccgcagtgctccagcggggagggcttaacctcactgccgtgacggtggcagccgagaacaatcacacagtcgcattcctcggcacatctgacgggaggatcctcaaagtgtatctcacacccgacggtacctccagcgaatacgactctattttggtggaaattaacaagagagttaaacgcgacctggttctcagcggtgacctgggaagcctttacgcgatgactcaggataaggttttccggctgccagtacaagaatgcctgagttaccccacctgcacacagtgccgtgattctcaagatccgtactgcggatggtgtgttgtggaaggacgatgcacgcgcaaagccgaatgcccgagagccgaggaagcatcccactggctctggtcccggagtaaatcatgcgtcgctgtgacgagcgcacaaccacagaacatgagcaggagggcccagggcgaggttcaactaaccgtcagccctctgccagctctgtctgaagaggacgaactactgtgcctttttggtgagtctccacctcaccctgcgagagtcgagggggaggctgttatttgtaactccccatctagcattccagtcactccaccgggacaggaccacgtggccgtgacaatccaactgctgttgagacgtggtaatatatttctaaccagctaccaatacccattctacgattgccgacaggccatgagtcttgaggagaacctgccttgcatcagctgcgtgagtaatcgttggacgtgtcaatgggacctgcgctatcatgagtgtagagaggctagcccaaacccagaggacggcattgtgagagctcatatggaggattcttgcccgcaattcttggggccatccccgcttgtgatccccatgaatcatgagactgacgtgaatttccaggggaaaaatctggataccgtcaaggggagttccctgcacgttggttcagaccttctaaagttcatggaacccgttactatgcaggaatctgggacattcgccttcagaactcctaagctgagtcacgacgccaatgaaacactgccccttcacctatacgtcaagtcgtatggaaagaacattgactctaagcttcacgtgaccctgtacaactgttcattcggacgttccgattgttccctctgccgggctgcgaatccagactacaggtgtgcctggtgtggtggccagtcacgctgtgtgtatgaggcgttgtgcaacacgacaagtgagtgtcctcctcccgtgataacaaggatccagcccgagaccggtcctctgggagggggtattcggatcactattctgggatcgaacctgggcgtgcaggctggagacattcagaggatcagtgtggctggcaggaactgtagcttccagcccgagcgatatagtgtgagcacacgaatcgtgtgtgtgatagaggccgctgagacacccttcaccggtggagtcgaggtcgatgtcttcggaaagctgggtagaagtcctccaaatgttcagttcactttccaacaacctaagcctttaagcgtggaacctcaacaaggtccacaagctggcggtacaactctgactatccacggcactcatcttgacacaggctctcaggaagacgtgcgggtcacactgaacggcgtcccatgtaaagtgacaaagttcggagcccaacttcagtgtgttaccggccctcaggccaccaggggtcagatgctactggaagttagctacgggggatcaccggtgcctaatcccggaatttttttcacctaccgcgagaaccccgtccttcgggcattcgaacccttacgcagctttgcatctgggggaagatcaatcaacgtgaccggtcagggcttttcacttatccagcgttttgctatggtggtcatcgccgagcccctgcagtcttggcagcctcccagagaggctgagtcccttcagcccatgaccgttgttggtacagactacgtttttcataacgatactaaggtggtcttcctttcaccagctgtgcccgaggagcccgaagcttacaacctgactgtcttaattgaaatggatggtcatagggcccttttgcgtaccgaggcaggagcctttgagtacgtgcctgatccaacctttgagaacttcaccggaggtgtgaaaaaacaagtgaataagctgattcacgctagagggactaacttgaacaaggcaatgaccctgcaggaggcagaagctttcgtcggcgcagaaagatgcacaatgaaaaccctcacagagacagacctgtactgtgaacccccagaagtccaaccacctccaaaaaggcgtcaaaagagagacacaacccataacctgcccgaattcattgtgaagtttgggtctcgcgagtgggtcctcgggagggttgagtatgatacccgggtctcagacgtcccactctccctgatcctgcccctcgttattgtaccgatggtggtggtaatagcagtctcagtatactgttactggagaaagagtcagcaggctgagcgtgaatacgaaaaaattaagagccagctcgaggggctggaggagtccgtgagagaccgctgcaaaaaagaatttaccgatttgatgatagaaatggaggaccagaccaacgatgtgcacgaggctggcatccctgtgcttgactacaagacttacactgatcgggtctttttccttcctagtaaggatggcgacaaagatgtgatgatcacggggaagcttgacatacctgagcccagaaggccagtagtggagcaggctctatatcagttcagcaacctgctcaacagtaagtccttcttgatcaacttcattcacaccctcgagaatcagcgggaatttagcgctcgtgctaaggtgtatttcgcttcattactgactgtggctcttcatggcaagctcgagtattacactgatatcatgcataccctattcctggaacttctggaacagtacgtggtagccaagaacccaaagttgatgctgcgacgaagcgagacagtcgtggagaggatgctgtccaattggatgtctatctgtttataccagtacctgaaggactctgctggggaacctctctacaaactgtttaaagctatcaagcaccaggtagagaagggacctgtggatgccgtccaaaagaaggcaaagtacaccttgaatgacactggcctcctcggagatgacgtggaatatgcaccccttactgtatccgtgatagttcaagacgaaggggtagacgccatacctgtgaaggttttgaattgcgacaccatttcacaggtcaaggagaaaataatcgaccaggtgtataggggacagccctgttcttgttggccaaggcccgattctgtagtgctggagtggagaccaggaagtactgcgcagatcctgtctgatctcgacctgaccagccagagggaagggagatggaagcgagtgaacactctgatgcattacaacgtgagggacggagcgactctcatcctttctaaggttggtgtaagccagcaaccagaggactctcagcaggaccttcccggagaacgccacgcactacttgaagaggagaatcgcgtgtggcatctggtgcgccctacagacgaggtcgacgaggggaagagtaagcgaggtagcgtgaaagaaaaagagcgtaccaaagccatcacagaaatctacttaacaaggttactctctgtaaagggaactcttcaacagttcgtggacaatttctttcagagcgttctggcccctggccacgccgtaccaccagccgtgaagtatttcttcgattttctcgacgagcaggccgagaagcacaacatccaagatgaagacacaattcatatctggaaaacaaactccctgccacttcgcttctgggtgaatattcttaagaatccccacttcattttcgatgtgcatgtgcatgaggtggttgatgcttccctgtctgtaatcgcgcagacctttatggacgcctgcactcgaaccgaacacaagttaagcagggatagcccttccaacaagctactgtacgctaaggagatctctacttacaaaaagatggtcgaagactactacaagggaatccgacagatggttcaggtcagcgatcaagacatgaacacgcacctcgccgagatctctcgtgcacatactgatagcttgaacactctggttgctctgcatcagctgtaccagtacacgcaaaagtattatgatgaaattattaatgctctggaggaggacccagcagcacagaagatgcagctggcttttcgcctccagcagattgcggctgctctcgagaataaggtgactgatctata

SEQ ID NO: 235243 - DNA, 1044 bp, Artificial Sequence
  Description of Artificial Sequence: Synthetic coding sequence
atgcataccctcttccttgagctgctcgaacagtacgtggtggcgaagaaccccaaattgatgttgcgcagatccgagacagttgttgagcgtatgctcagcaactggatgtctatctgtctttatcagtatctgaaggattcagccggtgagcctctttataagctgttcaaggctattaagcaccaagtggagaaaggacccgtggacgctgtccagaagaaggcgaaatatacactaaatgacacaggcctgttgggcgatgacgtggagtacgcccctcttacagtgtccgtgattgtgcaagatgagggggtggacgcaatccctgtgaaagtgttgaactgtgatacaatttctcaggtgaaggagaaaataatcgatcaggtctacagaggccaaccctgcagctgcggccctgggcagacagcctggtcttggagtggcgtccgcgcaccacagcgcagatccgtgggacctgggcctgacgtcactgcaggagggcctgtcgaggcaagacagcacccttatgcactccaatgtcctggatggtcacatccccaccccgtgcaagggggagggcttccggcagcgggtgggcagccggctgggccagcttggagtgcaatgccgccagggggtggcgagcccggagttgcacccggagccgctgacagacggggaggcaggggccaggtgcaagagcggcaacgggaacgggagggggctgatgagggacaccacagagatttacctgacgctgccgcactgtcgcagggtcacactgcggctgtttgcgggcaacttctgcctgaacgcgcaggcgcatggcatgcggtgccgcctgccgttaagtacttcttcgacttcttggatgagcaggccgagaagcataacatccaggatgaagatacaattcacatctggaagaccaatagcctccccctgcggttttgggtaaatatccttaaaaatccccactttattttcgacgtgcacgtgacccggtggtggacacccagatgccagtcctctcgccgttag

SEQ ID NO: 235244 - DNA, 483 bp, Artificial Sequence
  Description of Artificial Sequence: Synthetic coding sequence
gggccagacgtgaccgcaggcggtcctgtggaagcccgacagcacccctacgcattgcagtgcccgggatggtcacaccctcaccctgtgcaaggcggaggactgcctgcagctggcggtcagccggcagggcctgcatggggcgcaccatgtccccctggcggtggcgagccaggtgttgcacctggtgccgctgatagaagagggggtcgcggacaggtgcaggaacgacagagggaaagagaaggagctgacgagggccaccatcgcgacctgccggacgccgctgccctgtcccagggccacactgcggcagtttgtggacagctgctgcctgaacgagcaggcttaggcacgcgttgccatctccagtcttccacttcctcaacctcgtggaccagtcggcagcggagtacaaccagcagaatgaaaaccccatctacgagtggacgcaggactgcttacaggtctggctctggctag

SEQ ID NO: 235245 - DNA, 1569 bp, Artificial Sequence
  Description of Artificial Sequence: Synthetic coding sequence
atggcgctgcagctgtgggcattgacgctgttagggttgctgggcgctggcgcttctctccggcctcggaagttggacttcttcagatctgagaaagagcttaaccatctcgctgtcgatgaagcttcaggggtcgtctacctcggagcagtcaatgccttataccagttggacgccaaattgcagctggaacaacaagtcgccaccggaccagccctcgacaataaaaagtgcaccccaccaatcgaagctagccagtgtcatgaagccgagatgaccgataatgtgaaccagctgctcctcttggacccccctcggaagcggctcgtggagtgtggctcattgtttaagggaatttgtgccctgcgagcacttagcaacatcagtctccgtttgttctacgaagacggctccggtgaaaagagctttgtggcgtctaatgacgagggtgtggccaccgtgggcctggtgagttctacagggcctggaggtgacagggttctgtttgttggcaagggaaacgggccacatgacaacgggattatcgtgagcacacgcctgttggataggacagatagcagagaggccttcgaggcctacacagaccacgcgacttacaaggccggatacctctccactaacacacagcaattcgtggcggcattcgaagacggaccctatgtgttctttgttttcaaccagcaggacaaacaccccgctcgcaacaggactttgctggctagaatgtgtcgcgaggatccaaattattattcttacctggagatggacttgcagtgccgcgatcccgacatacatgcagcggcattcggcacctgtcttgctgcaagtgtggctgctccgggatcgggacgagtcttgtacgccgtcttttctcgcgattctaggtcatccggcggacccggagcagggctctgcctattccctctggacaaagtgcacgccaaaatggaagctaacagaaacgcttgttataccggcacacgggaagctagagatattttctataaaccttttcacggggatattcaatgtgggggacacgctccaggaagttctaagtcattcccctgcgggagtgagcacctcccctacccccttggctcccgagacggcctgcgcggaacagcggttctgcaaaggggaggactaaatctgaccgccgttacagtggcggcagaaaacaaccacactgtggcttttctgggcacctcagacgggagaattctgaaggtatacttaacgcccgacggcactagttcagagtatgattccattttagtggagattaacaagagggtaaaacgtgatctggtgctgtccggtgatctcggctccctttatgccatgactcaagacaaggtttttcgtctgcctgtccaagagtgcctttcatatcctacatgcacacagcttcctccagctgccgagcccgcttcaggcgtccactgtcgcgtcagctctgacctcaaaatgtgtctcactctgccaaggtgggggcagctggcgtctgccagcgcgcacgcccctgccgcagccagcatgccatag

SEQ ID NO: 235246 - DNA, 489 bp, Artificial Sequence
  Description of Artificial Sequence: Synthetic coding sequence
atggcactccaattgtgggccctgacactccttggactcttgggggctggagcatcattgcgacccaggaagctagatttcttcaggtcagaaaaagaattaaaccaccttgccgtggatgaggcaagtggtgtggtctatttgggcgctgtgaacgccctctaccagctcgacgctaaactgcaactggagcagcaggtggcaaccggtcctgctctggacaataaaaaatgtacacctcccattgaagcctcgcaatgccacgaagcagaaatgacagacaatgtgaaccagctgctactgttggacccccctcgtaaacggctagtggaatgcgggtcgctgtttaaaggaatttgcgccctgcgcgcactgagtaacataagtcttcgcctgttctacgaagacggatctggggagaagtcttttgttgccagcaatgacgaaggtgttgcgacggttggccttgtaagctcaacaggtccatag

SEQ ID NO: 235247 - DNA, 1434 bp, Artificial Sequence
  Description of Artificial Sequence: Synthetic coding sequence
atggctctgcaactgtgggcactgacgctactgggcctcttgggcgctggggcatcactgaggccgaggaagctggacttttttaggtctgaaaaagaacttaaccatttggcggtagacgaagcctcaggagtggtgtatttaggcgcagtaaatgcattgtatcagttggatgccaagctccagctggagcaacaggtggccaccgggcctgccctggataacaaaaagtgtactcccccaatagaggccagccagtgccacgaggctgagatgactgataatgttaatcagctgctgttactggatcctcccaggaaaagacttgtcgagtgcggttctctgttcaagggcatttgtgccctgagagccctgtccaacattagtctgcgccttttctacgaggacgggagcggcgaaaagtccttcgtggctagcaatgacgagggtgttgctactgtgggtttagtgagcagcaccggcccaggaggagatagagttctgttcgttggcaagggaaacggccctcacgacaacggaattatcgtgtccaccaggttattggaccggactgacagtagagaagcatttgaggcttacaccgatcatgctacatataaggcaggctacttgtcaacgaatacccagcaattcgtggccgcatttgaggatggaccctacgtgttcttcgtgttcaatcagcaggacaagcaccccgcacgaaaccgaacccttctggctcgtatgtgtagagaggaccctaattactactcctacctggagatggacctgcagtgtagagacccagatatccatgccgctgctttcggcacatgtttagctgcctccgtagctgctcccggaagcggcagagtcctctatgctgtgttttcgcgcgattcccgaagcagcgggggacccggagccggtctttgtctcttccccctggacaaagtccacgccaagatggaagctaatcgaaatgcctgttacacaggtacaagggaggctcgcgacattttttacaagccatttcatggcgatatccagtgtggagggcacgcaccagggtcctccaaatcatttccttgtggatccgaacacttgccctatcctctggggtcccgcgacggattgcggggtactgccgtccttcagcgcggaggcctgaacctaactgccgtgacagtggccgctgagaataaccataccgtggccttcctgggcacctctgacggtcggatcctcaaggtatatctaacaccagatggtacctcctctgagtacgatagcattctcgtagaaatcaacaaaagggtgaagagagacctggtgctatcaggtgatctcgggtcactctatgccatgacgcaggataaggtgttccggctaccagtgcaggaatgcctttcctatcccacctgcactcagtag

SEQ ID NO: 235248 - DNA, 5516 bp, Artificial Sequence
  Description of Artificial Sequence: Synthetic coding sequence
atggccttacaactgtgggctttgacgctcctcggtttacttggagcaggcgctagcttgcgtcctcgcaaacttgacttttttcgctctgagaaggagctcaaccacttggccgtggacgaggcgtcaggcgtagtgtacttgggggctgtgaacgctttgtaccagctagatgccaagcttcaactggaacaacaggtggccactgggcctgctctcgataataaaaagtgtacccctccgattgaggcctcccagtgccatgaggctgagatgacagataacgtgaaccagcttttgctattagaccccccaagaaagcgcttggtcgaatgcggctctctgttcaaaggcatctgtgcactccgggctttgtccaacattagcctgagactattttacgaggatgggtcaggcgaaaaatcattcgtggccagtaacgacgagggagttgctactgttggacttgtgagttctaccggacctggaggagaccgggtgttgtttgttggaaagggcaacggaccccacgacaatggcattatagtctcaacaagactcttagatagaacagacagtagagaagctttcgaagcttacacggatcatgccacttacaaggctggatatctcagcactaacacccagcagttcgttgccgcatttgaagatggcccatatgtgttcttcgtgtttaatcagcaggacaagcaccccgctagaaatcgtaccctcctggctcgaatgtgccgagaggaccctaactactacagctacctggaaatggatcttcagtgtcgcgaccctgacatacacgcagctgcttttggcacctgtctggcagcatcggtggccgcacctggtagcggtcgagtgctctacgccgtgttttccagagatagtaggtcatccgggggaccaggggctgggctgtgtcttttcccactcgataaggtgcatgcgaagatggaagctaaccgaaacgcatgttacacaggcacccgtgaggcccgagatatcttctataagccgttccacggtgatatccagtgcggaggtcatgccccaggatcatccaagagttttccctgcggttccgaacacttgccctacccactgggatctagagatggcctgcggggaaccgcggttctacagcgaggcggtctcaatctcaccgccgtgactgtggcagccgagaacaatcatacagttgcctttttgggtactagcgatggaaggatcctgaaagtgtacctgacgcccgatgggacatcatccgaatacgacagcatcctggtggaaataaataagcgtgttaagagagatctggtattatcaggcgatctgggtagcctgtatgctatgactcaggataaggtgtttcgattaccagtccaggaatgcttatcctatccaacctgtactcagtgtcgggatagtcaggatccatattgcggatggtgcgtcgtagaaggccgttgtacgcgcaaagctgagtgtccacgagccgaggaggcctctcactggctctggagccgatcaaagagctgcgtggccgtcaccagtgcccagcctcagaacatgtcccgacgggcacagggcgaagtgcagctgactgtctctcctctacctgcactgtccgaagaagacgaactgctgtgcctcttcggcgaaagccccccacatccagctagagtggaaggcgaagccgtgatctgtaacagcccgtcaagcataccagttacccccccagggcaggatcacgtggcagtgaccattcagctccttcttcggaggggcaacattttcctgacgagctaccagtaccccttctatgattgtagacaggccatgtccctggaggagaacttaccatgtatatcatgtgtcagtaataggtggacttgtcagtgggatttacgctaccacgaatgccgtgaggcttctcccaaccccgaggatggaatcgtcagggcccatatggaggactcatgcccccagtttctcggccctagccctcttgtcattcccatgaatcacgaaaccgatgtgaacttccagggtaagaacctggacacggttaagggaagctcgctgcatgtgggcagcgatctcctaaaattcatggagcccgtcacgatgcaggaatctggaacatttgcttttcgtactcccaagctttcccacgacgcaaacgaaacacttccactgcatctctatgtgaagtcatatggcaagaatattgacagcaaactccacgttacgctctataattgtagctttggtaggagcgactgcagcctgtgtagagccgcaaatccggactacaggtgcgcatggtgcggcggtcaatctagatgtgtgtacgaggctttgtgtaataccacttccgaatgcccccctcccgttatcactaggattcagccggaaactggccctctgggaggcggaatcaggattacaatattaggaagcaatttgggcgtgcaggccggagatattcaacgcatctccgtggcaggacgtaactgtagtttccagcccgagcgctactctgtgtcgacccggatcgtctgcgttattgaggccgcagaaacacctttcaccggcggtgtggaagtggacgtgtttggtaaactagggaggtcacctcctaatgtccagtttacctttcagcaaccaaaaccactgtcggtggagccccaacagggccctcaggcagggggtactaccctcacaatccacggcacccacctggatacggggtcccaggaggacgtgcgcgtgacactgaatggcgtgccttgtaaagtaacaaaattcggtgcccagctgcagtgcgtcacgggaccccaggccaccaggggacagatgctgctcgaagtctcctacggcggatcacccgtcccaaatcctgggatcttcttcacctaccgtgaaaacccggtcctgagagcctttgagcccttgaggtctttcgcctctggtgggaggtctatcaacgtaactgggcaggggttttcgctcatccagcggtttgcaatggttgtgattgcagaacctctgcagagttggcagcccccacgggaggctgagtccttgcaaccaatgacggttgttggaaccgactacgtgtttcacaatgacactaaggtggtgtttctcagcccggcagtcccagaggaacccgaggcctacaacctaactgtgcttattgagatggatggccaccgcgcactgctgaggacggaagcaggcgcattcgagtacgtgcccgacccaactttcgagaatttcacaggaggcgtaaaaaagcaggttaataaattgatacatgcgaggggaaccaatctgaacaaagccatgacacttcaggaggcggaggcgtttgttggcgcagagaggtgcaccatgaagactctcacagagaccgatctctactgtgagccccctgaggtgcagccaccaccaaaaagacgtcagaagcgcgatacaacccacaacctgcctgaattcattgtcaaattcggtagcagggagtgggttcttggaagggtggagtacgacacaagggtgtctgatgtccctttgtcgctgattttgcctctcgtcattgttcctatggtggtcgttatcgccgtctccgtgtactgctactggagaaaatctcagcaggccgaacgcgaatacgaaaagatcaaaagccagctggagggtttagaggagtctgtaagagacagatgtaaaaaggaatttaccgatcttatgatcgaaatggaggatcagaccaatgatgttcatgaggctggtataccagtgcttgactacaagacatacactgaccgcgtattttttctccctagcaaggatggcgataaggatgtcatgataacaggaaagctagacattcctgagcccaggcggcctgtggttgaacaggcactctaccagttctcaaatctcctcaactctaagtcatttctcattaattttatacacacgctggaaaatcaaagagaattctcagctagggccaaagtgtattttgccagtctcttgacggtagcgctacacggtaagctggagtactacaccgacataatgcatacactctttctggaattgttggagcagtacgtcgtggcaaagaaccctaagctgatgctcaggcggtccgagactgtggtggaaaggatgctcagcaattggatgagcatctgtctttaccagtacttgaaagatagtgcaggagaaccattgtacaagcttttcaaggcgatcaaacaccaggtggaaaaagggcctgtggatgctgtccagaagaaggctaagtacaccctcaacgacactgggctgctgggagatgatgtggaatacgcgcctctcaccgtgagcgtaattgtgcaagacgagggagtggacgcaataccggtgaaggtgctgaactgcgacacgatcagtcaggtgaaggaaaaaattatcgatcaggtgtacagaggccagccctgcagctgttggcctagaccggatagcgtagtcctggaatggagaccaggctcgaccgcccagatcctgtctgatctggacctgacctctcagcgcgaaggcaggtggaagagagttaataccctcatgcactacaacgtcagggatggggctacattgattctatccaaggtcggggtctcccagcagcccgaagatagtcaacaggatctgccaggggaacgccacgccttgttagaagaagagaatagagtctggcacctggtgcgaccaaccgacgaagtggatgagggcaagagcaagcggggaagcgtcaaggaaaaggagcgcaccaaggcaattacggagatctacctgactcgcctgctgagcgttaaggggactttacagcagttcgtggacaattttttccagtcagtgcttgcccctggccatgccgtgcccccagctgtgaaatacttttttgactttctggacgaacaggccgaaaagcataacattcaagatgaggataccattcacatatggaaaacaaacagcctcccactgcgcttctgggtgaatatccttaaaaaccctcattttatcttcgacgtgcacgttcacgaagtggtggatgctagcttatccgttattgctcaaacctttatggacgcttgcactagaaccgagcacaagctcagccgggatagcccctcaaataagctcctctatgccaaagagatttcaacctataaaaagatggtggaagattactataagggcattcgccagatggtgcaggtgtccgaccaggacatgaacacacacctggccgaaatttcgcgtgctcataccgattcccttaacaccctggtggccctccaccagttatatcagtatacacagaaatattatgatgaaatcatcaacgccctggaggaggatcccgcagctcagaaaatgcaacttgcctttcgcttgcagcaaattgctgccgctctcgaaaataaggtgaccgacttgta

SEQ ID NO: 235249 - DNA, 5729 bp, Artificial Sequence
  Description of Artificial Sequence: Synthetic coding sequence
atgtgtcacgccgcacaagagacccctctgctccatcacttcatggcgcctgttatggccagatggcctcctttcggactgtgtctcctcctgctcctgctgtctccccctccattgccactgaccggcgcacatagatttagcgccccaaacactacactcaatcacctggccctggctcccggtcgaggtaccctatacgttggcgcagttaaccggctgttccagctatccccggaactccaactcgaagctgtggctgttaccgggcctgtgattgactcgccagattgtgtcccgtttagagacccagcggagtgcccccaagcccagttgaccgataacgctaaccagctgttgcttgtctcaagcagagcccaagagcttgtggcttgcggccaggtgagacaaggggtttgcgagactaggaggctcggggacgtggcggaggtcttgtaccaggccgaggatcccggagacggccagtttgttgcagcgaatacacccggagtggcaacggtgggattggttgtgcctctgcccggacgggatctgctattagtcgcccgaggcttggcaggaaaattgtccgctggggttcctcccctggccatacggcagctggccggaagtcagcctttctcttctgagggactcggtcggctggttgtgggagacttttctgactacaataatagctacgtgggagcgtttgccgacgcccgaagcgcgtatttcgtttttcggcgacgtggggcacgggctcaagcagaatatcgctcgtacgtggccagagtctgcctgggagataccaatctttacagctacgtagaggttcccctcgcttgccaagggcaggggctaattcaggcagcctttctggcgcctggaacattgctgggcgtctttgctgcaggcccacggggtacacaagcggctttatgcgccttcccaatggtggaattgggcgcatcaatggagcaagctcgtagactgtgctacactgccggaggacgagggccttctggcgctgaagaggcgacggtggagtacggagtgacatcccggtgcgtgacgctccccctcgattctcccgagtcctatccttgcggcgacgagcatacaccaagcccgatagctgggagacagccgttggaggtacagcccctactgaaattaggtcagcccgtaagcgctgtcgccgctctccaggccgatggccatatgattgccttcttgggcgatacccagggccagctatacaaagtgtttctacatggctctcaggggcaagtgtaccatagtcagcaagtgggcccacctggctccgcgatttcccctgacttactgctggacagcagcggctcccacctttacgtgctcaccgcccaccaggtcgatcgcatcccagtggcggcatgtccccagttccccgattgtgccagctgcctccaggcgcaggatcccttatgtggctggtgtgtgctgcaagggaggtgcaccaggaagggacaatgcggcagggcgggacagcttaaccaatggctgtggagctacgaggaagacagtcattgtctccacatacagagccttcttcctggccaccaccccagacaggagcagggtcaggtgacactatcagtccctaggcttccgatcctcgatgcagacgaatacttccactgcgcctttggagactacgacagtctggcgcacgtcgagggccctcacgtggcatgcgttactccgcctcaggaccaggtgcccctgaaccctcccggaactgaccatgtaaccgtgccacttgcactcatgttcgaagatgtgacggtcgcagccacaaacttcagtttctacgattgctcagcagtccaggcactcgaggccgctgcaccttgtagggcctgtgtggggtccatatggcggtgtcactggtgtccccagtcatcccattgtgtctatggcgagcattgtccagagggggagcgaacaatttacagtgcgcaagaggtggacatacaggttcgcggtcctggcgcatgtccacaggtggaaggactggccggacctcacttggtgcccgtgggatgggagagccacctagcccttagagtcagaaatttgcagcactttcgcggtttaccagcctccttccactgctggcttgaattgccaggggaactcaggggcctgcccgcaactctggaagagactgctggggatagcggcttgatccactgccaggcgcaccaattttacccttcaatgagccagcgagaattgccagtccccatatatgttacacaaggggaagcacagaggctggataacacccacgcactgtacgtgatcctgtatgattgtgccatggggcatcccgattgcagtcattgccaggctgctaatcggtctctaggttgcttatggtgcgccgacggacaaccagcctgccgctatgggccattgtgtcccccaggagccgttgagctgctgtgccccgcaccctcaatagacgctgtggaacccttaactggaccaccagaaggaggtttagccctgactattcttgggagcaatctaggtcgcgctttcgccgatgtgcagtacgcagtgtctgtcgctagccgcccttgtaatcccgagccttccctgtacagaacgtccgcacgtatcgtgtgcgtcacaagtccagctcccaatggaaccacaggccctgttcgtgtcgcaattaaatctcagccgcctggtatcagttctcaacactttacatatcaggacccggtattgctcagcctgagccctcggtggggaccacaggctgggggaacgcagttgaccatccgaggtcagcatctccagacagggggtaatactagcgcatttgttgggggacagccatgcccgatcctggagcccgtgtgcccagaggctatcgtgtgtagaactcgtccccaggctgcgccaggagaagccgctgtgctggtcgtgtttggacacgcacagaggaccttgttggcaagccctttccggtacactgccaatccccagctcgtggcagccgaacccagtgcctcgtttaggggtggcggacggttgatccgagtgcggggtaccggcctcgatgtggtccagcgtcccctcctgtcagtttggctcgaggcagatgccgaggtccaggcctcccgggcacagccgcaggacccacagccacggcgatcctgtggagcgccagcggctgatccacaggcgtgtatccagctgggtggaggtctgctgcagtgttctaccgtgtgttctgtcaacagctcttcactgctcctgtgccgttctcctgcagtccctgacagagcacacccacagagagtgtttttcacccttgataatgtgcaagtcgacttcgcaagcgcaagcggaggacaaggctttctctaccagcccaatccacggctggcacccctctccagggaaggaccagccagaccgtatagattgaaaccagggcacgtactggatgtagagggcgagggacttaacttaggaatttccaaagaagaagtccgagtgcacattgggagaggagaatgcttagtgaagacactgaccagaacacatctgtactgcgagccccctgcacacgcaccccagccagcaaacgggagtgggttaccccaattcgtcgttcaaatgggaaacgttcaactggcactaggacctgtacagtatgaagccgagccccctctgtctgcgtttccagtagaggcccaggccggagtaggcatgggtgcggctgttctgatcgcggctgttctgctactcactctgatgtacagacacaagagcaagcaggctttgagggattatcagaaggtcctggtacagcttgagagtctggagaccggtgtcggcgatcagtgccggaaggaatttacagacctgatgacagagatgacagacttatcgtctgaccttgagggatcagggattcccttcctcgactatagaacctacgcagagcgcgcatttttccccggacatgggggttgtccattgcagcctaaacccgaaggacccggtgaggacgggcactgtgccactgttcgccaaggccttactcagctgtcgaacttgcttaatagcaaactcttccttttgacactgattcacacgctggaagaacagccctcattttctcaacgagatagatgccacgtggcctctctgctgtccctagccctgcatggcaaactggaatatctaaccgacatcatgcgaacactgctaggcgatctagccgctcattatgtgcacaggaatcctaagctgatgcttcgtaggacagaaaccatggtggaaaagctgctaactaactggctgagcatttgcctgtacgcctttttacgcgaggtggcgggtgagccattatacatgttgtttcgcgctatccagtatcaggtggataagggcccagtcgacgccgtgacgggaaaggccaagaggactctaaacgatagccgcctgctaagggaagatgtcgagttccagcccctaactctgatggtactggtgggaccaggagccggaggcgctgccggttcaagcgaaatgcagcgggtgccagcaagggtactcgacacggacaccatcacacaggtcaaagagaaggttctcgatcaggtttataaaggtacgcctttttctcagcgtccttctgttcatgcattggaccttgaatggagatctggactggccggacacctaaccttgagcgacgaggatcttacttcagtgacgcagaaccactggaagaggcttaacacactccaacactacaaggtgccggatggggctacggttggactggtgcctcagttacatcgagggtccaccatcagccagtctctggctcagcgatgccctctgggagaaaacattcccacactggaagacggtgaggaggggggagtttgtttatggcacctagtcaaagcaacggaagagcctgaaggcgcaaaggtgcggtgcagttccttgcgtgaacgggagcctgcgcgtgcgaaggccatcccagagatttaccttacccggttactgtctatgaagggaacccttcaaaaatttgttgacgatacgtttcaggctatcctgtcagttaataggcccattcctatagctgtgaagtatttgtttgatcttcttgatgaattggcggaaaagcatggaatcgaggatccagggacactacatatttggaagactaatagcctgctgctgagattctgggttaacgcgctgaaaaacccccagctcattttcgatgttagagtgagcgacaacgtcgacgccatcctggccgttatcgctcaaacatttatcgacagctgcactacctctgaacataaggttggaagagattccccggtcaataagctgctttatgcgagagaaattcctagatataagcaaatggtagaacgctattacgcggacatcagacagagttctcctgcttcataccaggagatgaattcggccctggcagaactgtcagggaattacactagcgcaccacattgcctcgaggcgctgcaagagctctacaatcacatccataggtattacgatcagattatttcggctctggaagaggatcccgtgggccaaaaactgcagctggcttgcagactccagcaggtcgcagccctcgtcgaaaacaaagtaaccgatttgta

SEQ ID NO: 235250 - DNA, 777 bp, Artificial Sequence
  Description of Artificial Sequence: Synthetic coding sequence
tagagtctggagacaggcgtaggagaccagtgcaggaaggagttcacagatctcatgacagagatgaccgacctatcctctgacttagaggggtccggcataccttttctggactatcgtacctatgccgagcgcgcattctttccaggtcacgggggatgtccactacagcccaaacctgagggccctggggaggatggccattgcgcaactgttaggcagggcctgactcaactttccaatcttctaaactctaagctgtttttgctcacacttattcatacattagaagagcagcctagtttctcacagagggatcgttgtcatgtcgcttccttactgagcctcgccctgcacgggaagttggaatatctaaccgacatcatgcgaaccctgctgggagacctggcggctcactatgtacatagaaatcctaagctgatgctcaggaggacggagactatggtggagaaacttttgacaaattggctgagtatatgcctctatgcattcctacgagaagtggccggagaaccactgtacatgttatttcgggcaatccaatatcaggtagataaagggcctgtcgatgctgtgacagaatggcgtagcggcctggctggccacttaaccctgagcgacgaagatctgaccagtgtaacacaaaaccactggaaaaggctgaatacattacagcattacaaggtgcccgacggtgccaccgtggggttagtaccccagttgcaccgaggctcaactattagccaatctctatag

SEQ ID NO: 235251 - DNA, 531 bp, Artificial Sequence
  Description of Artificial Sequence: Synthetic coding sequence
tgagcttcccagggaactctacagaaatttgtggacgataccttccaggcaatcctctccgtaaacaggccgatcccaattgcggtgaaatacttgtttgaccttcttgacgagctggccgagaaacacggtattgaagatcccggaaccttacacatttggaagacaaacagcctgctgctgaggttctgggtcaatgccctaaagaacccgcagctcatatttgatgtgagggtaagcgataatgtggatgcaatcctggccgtaattgctcaaacctttatagacagttgcacgaccagcgagcacaaagtcggcagagtacgggcagtccctgccgcagccgcagggaggggtctgcgacggaaaggcctatggggaaagcctagggggctgtgcaccgagctgtgggtaggtagtggttcaatcatgggtgcaccaagtcccccatcatcctgtctggccccaccactgcctccagaacaagactctccagttaataagcttctgtacgctcgggagattccctag

SEQ ID NO: 235252 - DNA, 492 bp, Artificial Sequence
  Description of Artificial Sequence: Synthetic coding sequence
tgaaagcgcactttgaatgattcacgactgttgcgcgaagacgtggagtttcaacccttaaccctcatggttttggttggacccggagcaggcggagctgcaggttccagcgaaatgcagagagtgcccgcaagggtgttagatacagacaccataactcaagtgaaggagaaagtgctcgatcaagtgtacaagggcacccccttttcccaacgtcccagcgttcatgctttagaccttgagtggaggagcggacttgccggtcacctgactcttagtgacgaggatctgacaagtgtcacccagaaccattggaaacgtttgaacaccttacagcactacaaggtgcccgatggagccaccgtgggcttggtgcctcagttacaccgcggatccacgatatcccagtccctggcccagcgctgtccactgggcgaatcagagtccctgggccctgacctcggtcctctggaaagcaggctgggcagatag

SEQ ID NO: 235253 - DNA, 2967 bp, Artificial Sequence
  Description of Artificial Sequence: Synthetic coding sequence
atgtgtcacgcagcccaggagacacccctgttgcatcacttcatggacagcccagaaagttacccatgcggggacgagcatacccccagcccaattgcaggccgacagcccttggaagttcagcctctgctaaagttaggacagcctgttagcgccgtcgccgcactgcaggctgacggtcatatgatcgccttcctgggagatactcaaggtcagttgtacaaggtggatcgcatacctgtagccgcatgcccacagtttcccgactgcgcctcctgccttcaagcccaggatccactttgcgggtggtgcgtactccagggccgttgcacacgtaaaggccaatgcggacgggcaggccaattaaaccagtggctgtggagctacgaggaggactcccactgcttacatatccaaagtctgctaccgggtcaccatcctaggcaggagcagggtcaagtcaccctgagtgttccaaggctgccaatcctggatgctgacgaatatttccactgcgccttcggggactacgattcattagctcacgttgagggcccacacgtcgcctgtgtcactccacctcaggatcaggtgcccctcaatccacccggaacagatcacgtaaccgtacccttggcattaatgttcgaggacgtgacagtggccgctaccaattttagcttttatgattgtagcgctgtgcaggcgctggaggccgctgcaccatgtcgagcctgcgtgggaagcatatggcgatgccattggtgtcctcagtcctcccactgcgtgtacggtgagcactgtcctgaaggcgagagaactatatattctgcccaagaagtggacatccaggtccgaggaccaggggcatgtcctcaagtcgagggtctggcagggcctcacctagtgcccgtgggctgggagagtcatctcgctctgcgagtaagaaatctgcaacacttcaggggtctgcccgcttccttccactgttggcttgagctgcccggtgaactgcggggattgccagcgacgttggaggagacagccggagatagcgggctaattcattgtcaagcccaccaattttacccaagcatgagccaacgtgagctgccagttccgatctatgttacccagggtgaagcccagcgcttagacaacacccacgccctgtatgttattctgtatgattgtgcgatgggccaccctgattgcagtcattgtcaggccgctaatcggtctctcggatgcttgtggtgcgccgatggccagcctgcttgtaggtacggtccgttgtgcccgcctggtgctgtcgaactgctgtgccctgccccatcgatagatgctgtcgaaccacttacaggaccccctgaaggcggtctcgctctcaccatcctgggtagcaatctgggccgagcattcgcagatgtgcagtacgctgttagtgtggcatcccggccatgcaatccagaaccctccctctataggacatcagccaggatcgtctgcgtgacttccccagcccctaacggcacaactggcccagttcgagttgctattaaatctcagcctccagggatctccagccagcatttcacttaccaggatcctgtgttgttaagtctgagtcccagatggggcccacaggccggtggaacacaacttaccatcagaggccaacacctgcagacagggggaaatacatctgcattcgttggagggcagccctgccctatattggaaccagtttgcccagaggccatcgtgtgtcgaaccagaccacaagcagccccaggcgaggccgctgtccttgtcgtcttcggacatgcgcagcggaccctcctggccagtccttttagatacaccgcaaatcctcagctcgtggctgccgagccctcagcctcattccgagggggtggcagactgattagggtgcggggtactggcctcgacgtggtccagcggcctcttctatccgtgtggctcgaggctgatgcagaggtccaagcaagcagggcacagccccaggatccccagccaaggaggtcctgtggagcccctgcagcagacccacaggcttgtatacagcttgggggaggactgctgcagtgctccaccgtgtgttcagtcaacagttccagcctcctcctttgtcgatctccagctgtgcccgacagggcccaccctcagcgggtcttcttcactctcgataatgtgcaggtggatttcgcctcagcaagcggcggacaggggtttttgtatcagccaaaccccaggctggccccactctcaagggaaggaccagccagaccttacagactcaagccaggacacgtcctggatgtggaaggcgaagggctgaatctgggcatttcaaaggaggaggtaagagtgcatattggtcgcggagagtgcctggtgaagactctgacccgaacacacctgtattgcgagcctcccgcacacgcacctcagcctgcgaacggctcaggcctgcctcagttcgtggtgcagatggggaacgtgcagttggccttgggccctgtgcagtacgaggcagaacctcccctgtccgcttttccagtggaggcccaagccggagtcgggatgggggctgctgtgttaattgctgccgtgcttctgcttaccttgatgtaccggcacaaatcaaagcaagcactcagggactatcagaaggttctggtgcaactggagtcactggagactggggtgggcgaccagtgccggaaggagtttaccggcggatgtggcggaggaggcaccggataccccagaggactgaacagccatctgggggctagctggccacgcagacctcacgacggggatgacaggccacagcagcggccaggcggtcagcgtgaccctcttccaggactcccccatctccgcagggcccgactgctaccatggccttggagactccccgctgcagcccaagcctag

SEQ ID NO: 235254 - DNA, 675 bp, Artificial Sequence
  Description of Artificial Sequence: Synthetic coding sequence
atgtgccacgcggctcaggaaacccccctgttgcatcattttatggtggataggatccctgttgctgcctgtccacagtttcctgattgtgcatcctgccttcaggcccaggacccgctttgcggctggtgtgtcctgcagggccgttgtacacgcaagggccaatgtggtcgggctggtcagttgaatcaatggctctggtcctatgaggaagactctcactgcctccacatccaaagtttgcttcccggtcaccacccccgtcaggagcagggacaggtgacgctgtccgtccctcgactgccaatactggatgccgacgaatacttccattgtgcttttggtgattacgattctctggcgcacgtggagggcccacatgtggcttgcgttacaccccctcaagatcaggtgcccctcaatcccccaggcacagatcatgtgacagtgcctttggctcttatgtttgaggatgtcaccgtggctgctaccaattttagcttttacgattgcagtgctgtccaggctttggaggcggctgcccctgcctgtcttccaccaagtaccgccggttggtcctgcctggagaacttcggagactgccgcccaccttggagacgccagcagggcattcaggcctcctctacagcccgacctacacggtcttccccctag

SEQ ID NO: 235255 - DNA, 4689 bp, Artificial Sequence
  Description of Artificial Sequence: Synthetic coding sequence
atgtgccacgcagctcaggagacccccctcttgcatcacttcatggatagtcctgagtcctacccatgcggagacgagcatactccgagccccattgccggtaggcagccactcgaagtgcaacctctgctgaagctgggacagcctgtttcggccgttgcagcgctgcaggcagatgggcacatgatagcgttcctcggcgacacccagggtcagctgtataaggttttcctacatggtagccagggtcaggtgtaccatagtcagcaggtcggccctccaggctctgccatcagtccggacctgctcctcgatagcagtggctcccacttgtacgtgttaactgcccatcaggtggataggattcccgttgctgcctgtccccagttccctgactgtgcatcgtgcctgcaagcccaggatccactgtgcggttggtgtgtgttgcaggggagatgtaccagaaaagggcagtgcgggagggcgggacagctcaatcagtggctgtggtcctacgaagaagactcacattgcctgcacatccagtcactgcttcccggtcaccatccaagacaggaacagggtcaagtcactctgagtgtccctcgtctcccgattctggacgccgacgaatatttccactgcgccttcggagactacgactccctggcacacgtggagggtcctcacgttgcctgcgtcactccccctcaggaccaggtacctcttaatcctccgggaaccgatcatgtgactgtacctctagccctcatgttcgaagatgttaccgtcgccgcaaccaatttttccttctacgactgctctgctgttcaggccctggaggctgctgcaccatgtcgagcatgcgtgggatccatctggcgttgtcattggtgcccccagtcgtcgcactgtgtctacggcgagcactgtcctgaaggcgagcgaaccatatactcagcccaagaagtcgacatccaagtacgcggtcctggagcctgcccacaggtggagggtttagcaggccctcacctggtgcctgtgggttgggagtcacacctggccttgcgtgtccgtaacctgcagcattttcggggactgccggcttctttccactgctggctcgagctccccggtgaactgagggggctgcctgccaccctcgaggaaacagctggcgatagcgggcttattcattgtcaggcacatcagttctacccctcgatgtcccaaagggagctgcccgtcccaatctacgtgacccagggggaagctcagcgtctggataatactcacgcactttacgttattttatatgattgcgccatggggcatccggactgcagtcactgtcaagccgctaaccgttcccttggatgtttatggtgcgcggatggacagcctgcatgtaggtatggccctctgtgccctcctggcgctgttgagttgttgtgtccagccccttccatcgacgccgtcgaacctctgacagggcctcccgaggggggattggcactgacaattctggggagtaatcttggcagggcttttgccgatgtacagtatgccgttagtgtcgcctctaggccatgcaaccctgaacccagcctctatcgcacatctgctagaatcgtctgcgtaacatctcccgcaccaaacgggactactggcccagtgagagtcgcaattaagagtcagccgccaggcatttcctcccagcacttcacctaccaggaccccgtccttctgtcactctcacccaggtgggggccacaggcaggcggaacccagctcactattcggggtcagcacctgcagactgggggaaacaccagcgcctttgtgggcggacaaccttgtccgatacttgaaccggtctgccctgaggctatagtatgtcggacacgaccccaggccgcaccgggagaagccgcagttctggtagtgttcggtcacgcgcaaaggaccctgttagctagcccctttcgctatactgctaacccccaactggtggctgctgagccatcagcgagcttccgcggtggcggaagactgattcgtgtgagaggcacaggtcttgatgttgtgcagagaccactgctgagtgtgtggttggaagccgacgccgaggtgcaggcttcacgggctcagccacaggatcctcaacctagacgttcatgtggcgctccagccgcagaccctcaggcttgcatacagctcggcggagggctgctccagtgctctaccgtatgtagtgtgaattcctcatctctgttgctttgtaggtccccagccgtacccgaccgggcacatccccagcgcgtatttttcacacttgacaacgtccaggtcgattttgcatcagccagcggtggacaaggattcctgtaccagccaaaccctcggctagcccctctgtcacgagaagggcctgcccgtccatatcgcctaaagcccggacatgtgctggatgttgagggcgaaggactgaacctggggatctccaaagaggaagttcgagtgcacataggcagaggagaatgtctcgtgaaaacgctgacaagaactcatctctattgcgagcccccagctcatgccccacagcctgccaacggctcaggacttccccagttcgtggtgcaaatgggcaatgtgcaactggcactgggtcctgttcaatatgaggccgaacctccgctcagtgcctttcctgtggaagcacaagctggagtcggaatgggggcagcagtactgattgctgctgtgcttctcttgaccttgatgtacaggcataagtctaagcaggctctgagagactatcagaaggtccttgtgcagctggagagtctagaaacaggcgtgggtgatcagtgccgtaaggagtttacagacttgatgactgagatgaccgatctgagctcagacctcgaagggagcggcatcccttttttagactatagaacatacgcagagcgcgctttcttcccgggacacgggggttgcccgctgcaaccgaagcctgaaggacctggggaagatggccattgtgctacagtcagacaaggacttacgcagctttccaacctgctgaacagtaaactgtttctgctgactctgattcataccctggaggaacagcctagcttttcacaacgcgacagatgtcatgtggctagccttttgagtctggccttgcatggcaaactagagtacttgacggacatcatgaggaccttgctgggcgacctggccgctcactacgtacatagaaacccaaagctcatgctgcgacgcacagaaactatggtggagaaactgctgaccaattggctgtctatttgtctgtatgcattcctacgcgaagtagccggtgaaccactgtatatgcttttccgggcaatccagtatcaggtggataaagggcctgtggacgccgtgacaggcaaagccaagcgtacattaaatgatagccgactcctccgggaagatgtagaattccaacccttaaccctcatggtcttggttgggcctggcgctggaggtgccgcaggtagttctgaaatgcagcgggttcctgccagagtcctggataccgacacaatcacccaggtgaaggagaaggtgttagatcaagtgtacaagggcacaccgttcagccagcgaccaagtgtgcatgccctcgacctagaatggaggagtggcctggcgggtcacctgactctcagtgatgaagatttgacatctgtaacccagaaccactggaagaggcttaacaccctccagcactacaaagtgcctgatggcgcaaccgtcggtctggtacctcaactgcatcggggatccacaatcagccagagtctggcccagaggtgccccctgggcgaaaatatccctacccttgaggatggagaagagggaggggtctgcttatggcacctcgtaaaagccaccgaggagcctgagggtgccaaagtccgatgcagctctctgcgagagcgggagcccgctcgggctaaagccatccctgagatttatctcactaggctgcttagtatgaaaggcacactgcagaaatttgtagatgacacgtttcaggctatcttgtccgtgaatcggcctattcccattgcggtcaaataccttttcgatttgctcgacgaactggccgaaaagcatggaatcgaagaccctggcaccttacatatctggaagactaactctctcctgctgcggttctgggtgaatgcacttaaaaatccacagcttattttcgatgttagggtgagtgataacgtagatgctatcttggctgtcatcgcgcagacgttcatcgacagttgtacaacatcggagcacaaggtgggcagagatagtccagtgaataaactgctgtatgcccgagagatccccaggtacaagcagatggtggaacgctattatgctgatattcgccagtcttccccagccagctaccaggagatgaactccgccctggccgagctgagcgggaattacacctcagctccgcactgcctggaagctcttcaggagttatataatcatatccaccggtactatgaccagatcatcagcgcactcgaagaggatccagtgggacaaaagctgcagcttgcgtgcagactgcagcaagttgctgcactggtagaaaacaaagttactgatctctag

SEQ ID NO: 235256 - DNA, 5798 bp, Artificial Sequence
  Description of Artificial Sequence: Synthetic coding sequence
atggaactgacccctgccagcagtctaacgtgcagcctcctgtcccctcgactccctggaagctttccccaactcaggagagtgcccccttgcagtcgaccatggctgccaaaggcccctgttatggcacggtggcctccttttgggctgtgcttgctcctcctgcttctttctcctccacccctgcctctgacgggagctcatcggttttcagccccaaacaccactcttaaccacctagccctggctccaggtcgagggacactttatgtcggcgcagtgaacagactgttccagctgtcgcctgagctccagctggaggccgttgccgtaactggacctgtgatcgactccccagattgcgtgccgttccgcgatcctgcggaatgtccacaggcacagttgaccgataatgccaatcaattgctgcttgtgagttcaagagcgcaagagctcgtggcatgcggccaggtgaggcagggcgtgtgtgaaacccgtcggttgggcgacgtcgctgaggtgctgtatcaagccgaggacccgggagacggccaatttgtggcagcaaacactccaggcgtggctaccgtgggcctggtggtccctctcccgggacgcgaccttttgcttgtcgccaggggactggcagggaaattgtcagccggagtaccacctcttgcgatccgacagctcgctggcagccagcccttttcctctgagggactgggccgactggtggtgggagattttagtgactataacaacagttacgttggcgcattcgctgatgcacgcagtgcgtacttcgtgttccgaaggagaggagccagagcgcaggcggagtaccggagctacgtagcccgtgtgtgcctgggcgataccaacctgtactcttacgtggaggtccctctggcttgccaaggtcagggactcatccaggcagcatttctggcacccggtaccctgctgggcgtcttcgccgctggaccaagaggcacccaggctgccctttgcgcctttcccatggtagagctgggtgcctccatggagcaagcacgcagactgtgttatacagctgggggacggggaccgagcggtgccgaagaggcaacagtcgagtatggagtaacatcgagatgtgtgactctacccctcgatagtccagaatcctacccctgcggcgatgagcataccccatcccccatcgcgggacgacaacctctcgaagtccagccactgctgaaacttgggcagcctgtgtctgccgtcgccgcactgcaagccgatggacacatgatcgcctttcttggggatactcaggggcagctttacaaagtcttcttgcacgggagccagggtcaggtctatcatagccagcaggttgggcctccaggaagcgctatttcgccagatcttctgttagatagttccggaagccacctctacgtcctaaccgcacatcaggtagataggatcccggttgccgcttgcccgcaattcccagactgcgcttcatgcctgcaggcgcaggatcctctttgtgggtggtgcgttttacaaggaaggtgcacacgcaaaggccaatgcggacgggcaggccaactgaatcagtggctttggagttatgaagaagatagtcattgcctgcacatccagtcactgctgcctggccaccacccccgacaggagcaaggtcaggtaactctgtcggtgcccagactgccaatactggacgccgatgaatactttcactgtgcttttggggattacgactctctagcgcatgtggaaggacctcatgttgcttgtgttacccctccacaggatcaagtccccttgaatccacctggtactgaccacgttactgtaccactggctctgatgtttgaggatgtgacggtcgccgcaacaaactttagcttttacgattgctccgccgtgcaggccttggaagctgcagctccctgtcgagcgtgtgtgggaagcatttggcgatgtcactggtgtccccagtcaagtcactgtgtgtacggtgagcactgtccagaaggggagagaaccatatacagtgcgcaagaagtcgatatccaggtaagggggccaggtgcttgcccacaagtagagggtctcgcgggaccccacctcgtaccggtgggctgggaaagtcatcttgcactcagggtacgcaatcttcagcactttcgaggtctgccagcatcctttcattgctggcttgagctgccaggcgagctccggggtctcccagctactctggaagagaccgctggcgattcaggcctcattcattgccaggctcatcagttctacccttccatgagtcagcgggagctgccagtgcccatctacgtcacccagggggaagctcaaaggcttgacaatactcatgctctatacgtaatcctgtatgactgtgcaatgggacacccagattgctcccattgccaagcagcaaaccgcagtctcggatgtctgtggtgcgcagatgggcagcccgcttgtcgctacggacctctgtgcccacccggagccgtggagctgctttgtcccgctcctagcatcgatgcggtggaacctctgaccgggccacccgaaggcggtctggcactgaccatactgggctccaacctaggacgtgccttcgccgacgttcagtacgccgtctctgtggctagccgcccatgtaacccagagcccagtttataccgcaccagcgcaaggattgtctgtgtaacttcacccgctccaaacggcaccactggcccagtgcgggtggccataaaaagccagccaccaggaattagcagtcaacacttcacgtaccaggatccagtgttgctcagcttaagcccgaggtggggaccccaggccggtgggacccagctgactatccggggacaacacctgcagaccggcggtaacaccagtgcttttgttggcggtcagccatgtcccatcctggaacctgtgtgtcctgaggctattgtgtgccggactagaccacaggcggctccaggcgaggccgcagtcctcgtagtgtttggtcatgctcagcgaactctgctcgcttctccctttaggtacacagcaaaccctcaactggttgccgctgaaccttcggcatctttccgcggaggtgggaggttgatacgcgttagggggaccggcctcgacgtcgtgcagagaccattgctgagcgtgtggcttgaggcggatgccgaagtccaagcctcaagggcacagccgcaggaccctcagccccgacgcagttgcggggcaccagccgctgatccacaggcttgtatccagctgggtggtggattgttacagtgctccacagtgtgttcagtcaattcatcttcactcttgctgtgtaggtcccctgctgttccggatcgcgctcaccctcagcgggtatttttcaccctcgacaacgtacaggtggattttgccagcgccagcggaggccagggattcttgtatcaacctaatccccgactcgctcccctgagccgtgaaggaccagctcggccttacagactcaaaccaggccacgttctggatgtggagggggagggtctgaacctggggatatccaaagaagaagtgagagtgcacataggccgtggtgagtgtttagtcaaaactctaacgagaacccacctttactgtgagcccccagcacacgccccacagccagccaacggtagtggcctccctcaattcgtggtacagatgggaaacgttcagcttgccctcggtcccgtgcaatacgaagcagagccccctctgagtgctttccccgtcgaggcgcaggcgggagtgggcatgggagccgctgtactaatcgccgcagtgcttctcctaaccctcatgtatagacataagagtaagcaagcactgcgagactaccagaaggtgctagtccaattggagtcactggaaactggcgtgggagatcagtgcagaaaggagttcaccgacctcatgactgaaatgactgacctttcatccgatcttgaggggagcgggatccccttcttagactacagaacctacgctgagcgggcatttttccccggacacgggggttgtccgttacagccaaagcctgagggacctggtgaggacgggcactgtgctaccgtgagacaaggtttaacccagttaagtaatctgcttaattctaaactgtttctcttgacccttattcacactttagaggaacagccctcattcagtcagcgagatagatgccacgtggcctctttgctgtccctggcactgcatggaaaactagagtaccttacagacattatgaggacactcctcggggacctagccgcacactatgtacacagaaaccctaaattgatgcttcgtaggacagagaccatggtcgagaagctgctgactaactggctctctatctgcctgtatgctttcctgcgcgaggtcgcgggtgaacccttatacatgcttttccgtgccatccagtaccaggtggacaaggggccagtggacgctgtaaccgggaaggcaaaaaggacactgaatgactctcgcctgctgagagaggacgtagaatttcagccccttacgcttatggtgctggtcggccctggggctgggggagccgcaggatcctcagagatgcagagagtacctgcccgtgtgctggataccgacacaatcacccaggtcaaggagaaagtgttggatcaggtctataagggaaccccatttagtcagcggccatccgtccacgctctagacttggagtggagatcgggactggctggacaccttactctgtctgacgaagatctcacttctgtcactcagaatcactggaaaaggctgaataccttgcagcactacaaagtgcctgacggtgcgacagttggactcgtgccgcagctccaccgcggttccactatctcacaatcactcgcccagcggtgccccctgggcgagaacatccccacgttagaggacggagaggaggggggagtttgtctgtggcacctggtgaaggcaacagaggagcccgagggtgctaaagtcagatgctcatcactccgggaacgcgagccagcaagagccaaagccattcccgaaatatatctcactcggctgctcagcatgaagggcacactccagaagtttgtggatgacacctttcaagccattctgtcagtgaaccggcctattcctatagcagtgaagtacctgttcgatttgttggacgagctcgctgagaagcatggcattgaggatccgggaactcttcacatatggaaaactaacagtctgttgctgcgattttgggtcaacgccttaaaaaacccacagttaatttttgacgtcagggtaagcgataatgtcgacgctattctggctgtgattgctcagactttcatcgactcatgcaccacaagcgagcacaaggtgggtcgcgattcccctgttaacaaactgctttacgccagggagattccaagatacaagcagatggtggagaggtactacgccgatatccggcagtccagcccagccagctaccaagaaatgaactccgcactagccgaactctcgggtaattatacctcagcaccgcactgcctggaggcccttcaggagctatataatcatatccaccgttattatgaccagattatttccgcactggaggaggacccggtgggacagaaattgcagctggcttgccggctgcagcaagttgccgctctggtggaaaataaggtaactgacctgta

SEQ ID NO: 235257 - DNA, 5777 bp, Artificial Sequence
  Description of Artificial Sequence: Synthetic coding sequence
atggctccgcgtgccgctggaggcgcacccttaagcgccagagctgccgcagccagtcccccaccttttcagacccctccacggtgtccggtcccgctgttgctcctcctgttgctgggcgctgcccgagctggagccttagaaatccagcggagattcccatcccccacgcccaccaacaattttgcattggacggtgcagccggtacagtgtacctcgcggcagtgaacaggctgtatcagctctccggcgcaaacctgagtctggaggcagaggccgctgtcgggccagttcccgatagtcccctctgtcatgcaccgcaactcccgcaggccagctgcgagcaccccaggagattaactgacaactataataaaatccttcaactggatccaggccagggactcgtcgtggtttgtggatcaatttaccaaggattctgtcagttacgcagacgcggaaacatctcagctgtcgccgtccggtttccaccagcagccccaccagccgagcccgttacagtattcccttccatgctaaacgtcgctgctaaccatccaaatgcttccaccgtgggtcttgttcttcctcctgctgcaggggctggaggaagtaggctgttagtgggtgctacctacaccggctacgggtcctcattttttccacggaaccgctctctagaggaccatagattcgaaaatactcctgagatcgccattagatcactggatacacggggagatctcgcgaagctgttcaccttcgatctcaacccatcagatgacaatatactcaaaattaaacagggcgctaaggagcaacacaagttgggctttgtgtctgcttttctgcatccctccgatccacctcctggggctcagtcctacgcttatttggccctaaacagcgaggcccgtgctggcgacaaggagtcccaggccaggagcctgctggcccgaatatgcctcccacatggagctggcggagacgcaaaaaaactgacggagagctatatacagctggggctacaatgcgctggcggagccggacgtggcgacctttactcgaggctggtgagtgtgttccctgcccgagagaggctctttgcagtcttcgagagacctcaaggtagccccgctgcccgagccgcaccggctgccttgtgcgcgttccggtttgctgatgtgcgggctgccattcgcgcagccaggaccgcatgttttgtggaaccagccccagacgtggtggcagtgttggacagtgtggtgcagggaactggacctgcctgcgagagaaaactgaacatccaactacagccggaacaactggactgtggcgcagcccatctccagcatcccctcagcatcctccaacccctaaaggctacccccgtgttcagggcccctggcctcacttctgttgctgtggcgagcgtgaataactataccgcggtgttcttaggtacggtaaatgggaggctgttaaagattaatctcaatgagagcatgcaggtggtttctcggagagtcgtgactgttgcatacggcgagccagttcatcacgtcatgcagttcgatcctgccgattccggatatctgtacctcatgacctcccatcagatggctagagtaaaagttgcagcgtgtaatgtgcactcgacatgcggcgactgtgtgggagccgctgatgcatactgcggttggtgtgccctagaaacccggtgcactctgcaacaagattgcacaaattcgagtcagcaacacttttggacatccgcatcagagggtccttcacgctgtccagccatgaccgtgctgccttccgagattgatgtgagacaggaatatcccggaatgatcttacagattagcggctccctcccgtcactatccggaatggagatggcatgcgattatggaaataatattaggactgtcgcacgcgtgccagggcctgcctttggtcatcagatcgcctattgcaatctcctgccccgagatcagtttccgccttttccccctaaccaggatcacgtgaccgtcgagatgagcgtcagggtcaatggtcggaatatcgtgaaggcgaactttacaatttacgactgttcacgcacggcccaggtctacccacacaccgcatgcacaagttgtctgtccgcacagtggccctgcttctggtgctcacagcaacactcgtgcgtgtctaatcaaagtagatgtgaagcttcgcccaatcccacaagcccacaggattgcccgaggacattattgagccccttagcaccagtgcctacgggcggttcccagaatattctggttcctctggcgaacacggccttctttcagggcgcagccctcgagtgtagttttggtctggaggaaatttttgaggccgtctgggttaacgaatccgtggtccggtgtgaccaggttgtgcttcacaccactcgtaagtcacaagtttttccattgtccctgcagttgaagggtaggcccgctcggtttttggattccccggaaccaatgacagtgatggtgtacaattgcgcgatgggcagccctgactgttcccaatgcttgggcagggaagatctgggccacctgtgtatgtggagtgatggctgccgcctgcggggaccactgcagccaatggcaggaacttgccctgctcctgagatccacgctatcgagccactgtccggccctctggacggcggtacgctactaacgatccgcggacggaatctgggaagaagactctccgatgtagcccacggcgtctggatcggcggtgtggcttgcgagcctctcccagacagatacacagtgtctgaggaaattgtatgtgtgacaggcccagcccctggacctctttcgggcgttgtgaccgtgaacgccagcaaggagggaaagtccagggacagattttcctacgttctacccctggtgcactctcttgagcctaccatgggcccaaaggccggaggtacccggatcacaatccacggaaatgacctccacgtgggttccgagctgcaggttctcgtgaacgacaccgacccttgtacagagctcatgagaaccgatacgtctatcgcctgtacaatgcccgaaggggctctccccgctccagtacccgtgtgtgtgcggtttgaacgacgaggttgtgttcatggaaacctcaccttttggtatatgcagaaccctgtcatcacggcgataagccctcggagatcccctgtgagcggaggaaggacaataactgtcgctggagaaagatttcacatggtgcagaacgtgtcaatggccgtacaccacataggtcgggagccgaccctctgtaaagtcctcaattccactctaattacctgtccctcacctggagccttatccaacgcaagcgcacccgtcgacttctttataaatgggagggcctacgctgatgaggtggcagtggctgaagagctcctcgaccccgaggaggcacaaagagggagcagatttcgcctggattatctgcccaatccccagttctccaccgccaagcgcgaaaagtggataaaacaccatcctggcgaaccacttactctcgtgattcacaaggagcaggatagccttggcctccagagtcatgagtaccgcgtaaaaatcggacaggttagctgtgacatacagatcgtctctgatcgcataattcactgttccgtcaatgagagccttggggcagccgttgggcaactgcctattacgattcaggtggggaacttcaatcagacaatcgcaactttgcagctcggcggtagtgagacagcaattatcgtttccattgtcatctgtagcgtgctgttgctgctgtccgtggtggctctctttgtattttgcaccaaaagccgacgcgctgaacgatactggcagaaaactctgctgcaaatggaagagatggagtcgcagataagggaagaaatccgcaaaggcttcgccgagctgcagaccgacatgactgatttaactaaggaactgaacagaagtcaggggatcccattcctggagtataaacacttcgtgactcgcacattttttccaaagtgcagctccttgtatgaggaacgatacgtccttccatcacagaccttgaactcacagggttcgtctcaggcccaagagactcaccctcttcttggagaatggaagatccctgagagctgcaggccgaacatggaagaaggtatttcactcttctcttcgctcctcaataataaacacttcctcatagtgtttgttcacgccctggaacagcagaaagactttgccgtgagggataggtgttcccttgcctccttactcaccatcgccctgcatgggaagctggaatattacacctctatcatgaaagagctgctcgtggacctcatagatgcctctgctgccaaaaatccaaagcttatgctcagaagaaccgagtccgtcgtcgagaagatgctaacaaattggatgtccatatgtatgtactcttgcttgcgagagacagtcggcgagcctttcttccttctgctgtgcgcaataaagcagcaaattaacaaaggttcaattgacgccataacaggtaaagccaggtacaccttgagcgaagagtggctcctgagagagaacattgaggccaagccgagaaacctaaatgtgagcttccagggctgcggaatggactcactgtctgtgagggcaatggatactgatacactcacccaggtcaaagagaagatactcgaggcgttttgtaagaacgtcccttactctcagtggccaagagcagaagatgtagacttggaatggttcgctagttccacacaaagttacatacttcgggatctggatgacacatctgtggtcgaggatggccgtaagaaattgaatacactcgctcattacaaaattccggagggagcgagcttggccatgtcactgattgacaagaaggacaacacactgggcagagttaaggacttggacaccgagaagtattttcacctggtactgcccacagacgaactagctgaacctaagaaatcccatcgccagtcacaccgtaaaaaagtgctgccagagatatacctgactcgccttctcagcaccaaaggcactcttcagaaatttttagatgatctgttcaaagcaattctgtccatccgggaagataagcctccactcgcagtgaagtatttctttgactttctcgaagagcaagccgaaaagcggggaattagtgatcccgacacgctgcatatttggaagactaattccctgccacttcgattttgggttaatatcctgaaaaaccctcagtttgtcttcgatatcgataaaaccgaccacatcgacgcatgcctgagcgtgatagcccaggcattcatagatgcatgcagcatcagcgatctgcagctcggaaaagactctcccactaataaactactgtatgccaaggagatccctgaatatcgaaagattgtgcagcgctattacaaacaaattcaggacatgacgcccctgtccgaacaggaaatgaacgcccatctcgctgaagagtcacggaagtaccaaaacgagtttaatactaatgtggctatggcggaaatttataaatacgctaagagatatcgtccccagataatggcagccttagaggctaaccccacagcgaggcggactcaacttcaacacaagtttgagcaagtggtggccctgatggaggacaatatctacgagtgctactctgaggccta

SEQ ID NO: 235258 - DNA, 5357 bp, Artificial Sequence
  Description of Artificial Sequence: Synthetic coding sequence
atggccccaagagccgctggaggcgcaccactgtcggcccgagccgcagcagcctccccacctcccttccagactccgcctcgatgtccggtaccactcttgctgcttctgctgcttggagccgcacgggcaggagcacttgaaatccagaggcggttccccagtccaaccccgaccaataatttcgcactcgacggagctgccggtacagtctatctcgctgctgttaatagactctaccaattgtctggcgcaaacctgtcattggaggccgaagcagccgtaggaccagtgcctgatagccctctctgccacgccccacagctgcctcaggcttcctgcgagcaccctaggcgtctgacagataactacaacaaaatacttcaactggaccctggccagggcctcgtggttgtctgcggaagcatctaccagggattctgtcagctgcgtaggcgaggcaatatctccgctgtagccgttcgcttccccccagctgctccgcctgctgagcccgtgactgtgtttccaagtatgctgaacgtggcagccaaccacccaaatgcgtctactgtcggattagtgttgcctcctgctgccggtgctgggggaagcagactcctggtgggggcaacgtatacggggtatgggtcatcctttttccccagaaaccggtcattggaagatcatcgattcgaaaatacgcccgaaatcgccatccgaagcttggataccaggggtgatctggctaaactgtttacgttcgacctcaatccatcagatgataacatactgaagattaagcagggcgcaaaggagcaacacaagttgggattcgtatcagcattcctgcatccttcggatccacctccaggcgcacaaagttatgcttatcttgccctgaacagtgaggcacgggctggtgacaaagaaagccaagctagatctttgctggcccgaatctgtcttccgcatggcgctgggggagacgccaaaaaactaacagagagctatatccagctggggctccagtgtgctgggggtgccggacgaggggacctgtactctcgactggtaagtgtgtttcccgcacgagaaagattgttcgcagtgttcgagaggcctcagggaagcccagccgcacgagccgcacctgccgcattatgcgctttcaggtttgcggacgtacgggctgcaatcagagctgcgagaacggcttgctttgttgagccagctccagacgttgtcgctgttttagatagcgtcgtacaaggtaccggcccagcttgcgagagaaaactcaatatccagctccagccggagcagctggactgtggcgctgcccacttgcagcacccactgtctattctccagccattgaaagctacaccggtctttagagcccctggcctgacctcggtggccgtcgcttccgttaacaactatactgccgtcttcctcggcacggtgaatgggcgtttgctgaaaatcaacctgaacgagtctatgcaggtggtgagtagacgtgtggtaacagttgcgtacggagagcccgtgcaccacgtcatgcagtttgacccagcagattctggctacctctaccttatgacctcccatcagatggcaagggtcaaggtggccgcttgcaatgttcattctacgtgtggtgactgcgtgggggcagcggatgcctattgcggctggtgcgctctggagactagatgcactctccaacaggactgcaccaactctagccaacagcatttttggacaagtgccagcgaggggccaagcagatgcccggcaatgaccgtgcttccatccgaaatcgacgttaggcaggagtatcccggaatgattttacaaatttccggaagtctcccgtccctaagcggaatggaaatggcatgcgactacggcaataatatacgtacggtcgccagggtcccaggccctgccttcggtcaccaaatagcctattgtaatctgttgccgagggaccagtttcctccattccccccaaaccaggatcacgtcactgtggaaatgagtgtccgcgtgaatgggcgaaatattgtaaaggccaattttacaatatacgattgctctcggaccgcccaagtataccctcacactgcatgtacatcgtgcctctctgctcaatggccttgtttttggtgtagccagcaacactcctgcgtctccaatcagagtaggtgcgaggcgtccccgaatcctacatccccccaagactgtcccaggaccttattgtcaccgctcgcaccagtgccaactggcggttcccagaacattctggtgcctctggctaacactgccttctttcagggcgctgccctcgagtgcagctttgggctggaggagatcttcgaggccgtctgggtaaatgagtcagttgtgcggtgtgaccaggtagtccttcacacgactaggaagtcccaggtctttcccttgtcattgcagctgaagggacgccctgcacggttcttggattcaccagaacccatgactgtgatggtctacaactgcgccatgggcagcccggactgcagccagtgtctagggagagaggacctgggacacctttgcatgtggtctgacggctgccgactgcgcggaccattacagcccatggccggtacctgccctgcaccagaaatccacgccatcgagccgttaagcggaccactggacggaggcaccctgctgaccattcgcggtcgcaatctcggcagacggcttagcgacgtggcccatggcgtgtggattggaggcgtggcttgcgaaccactgcctgacaggtataccgtgtccgaagaaattgtatgtgtgacgggccctgcacccggtcccctctccggtgtggttacggtaaatgctagtaaggaaggcaaaagccgggaccgcttcagttacgtgctgcctttggtgcatagcttggagccgacgatgggaccaaaggccggaggaacacgcatcaccatccacggcaatgatctgcatgtgggttcggagctgcaagtgcttgttaacgacacggacccttgtaccgagctcatgagaacggacaccagcatcgcctgcactatgcctgagggcgcactgccagcccctgtgcccgtgtgcgtgcgatttgaacgtcgagggtgcgtccacggcaatttgacattctggtacatgcagaatcccgtcattacagccatttcgcccagaagatcgcctgtgtccggcggtcggacgataactgtcgcgggtgaacggttccatatggttcagaacgtgagtatggctgtgcatcatatcgggagagagcctacactctgcaaagtcctgaactccacactgattacttgccccagtccaggcgctttgtccaatgcctccgccccagtggactttttcatcaatgggcgagcttacgctgatgaggttgctgttgcagaagagttactcgacccagaggaagcccagcgcggatctcgcttccgattagattatcttcccaacccacagttctcaactgctaagcgcgagaagtggataaagcaccatcctggagagccgttgactcttgtgatccacaaggaacaagattctctgggtctgcagagtcatgagtatagagtaaagatcggacaagtgtcatgcgatattcagatcgtgagtgacagaataatccactgttctgtaaatgagagcttgggcgctgctgttggacagctgcctatcacgatccaggtcggtaacttcaatcaaaccatcgctactttacagttaggaggatccgaaacagcaattattgtttccattgtgatatgcagcgttcttctcctgctcagcgtcgtggcactgtttgtcttttgtacaaagagcagacgggctgaacggtactggcagaagaccctgctgcaaatggaggagatggagtctcagattcgtgaggagattcgaaaagggtttgccgagctccaaaccgatatgacggatctcaccaaggagctcaaccgtagccaggggatcccctttcttgaatacaaacatttcgtgacacgtaccttttttccaaagtgcagtagcctgtatgaggagagatatgtgctgccgtcacagaccttgaattcccaagggtcttcgcaggcacaagagactcaccctctgctgggagagtggaagatccccgagtcctgccgaccgaacatggaggagggaatatccctgttttccagcctgttgaacaataaacattttctcatcgttttcgtgcacgcgctggagcaacagaaggactttgccgtccgagatcgatgttcgctggcctcgcttttgaccatcgccttgcacggcaaactggaatattacaccagcattatgaaagagctactagttgatttaattgacgcctctgcggcaaagaacccaaaattaatgctgcggcgtacagagtctgttgtggagaagatgttaaccaactggatgtccatttgtatgtattcctgtcttagggagaccgttggagagccctttttcctgcttctatgtgcgattaaacagcagatcaataagggtagcattgatgccatcactggcaaggcacgatacaccctgtctgaggagtggttgctccgagagaatattgaagcaaagccaaggaatctcaatgtatcctttcaggggtgcgggatggactccttatcggtgcgcgcaatggacaccgataccctgacacaagttaaggaaaagatactggaggctttttgtaagaatgtcccttactcccagtggccacgtgctgaagatgtggacctcgagtggtttgcatccagcactcagtcctacattttacgggacctggatgatacgtctgtggttgaagacgggaggaaaaagttgaatacccttgctcactacaagatccccgaaggcgcatcgctggcgatgtcccttatcgataaaaaggataacactctcggtcgggtcaaagatttggacaccgaaaaatattttcacctcgttttgcccactgacgagctggcagaaccaaaaaagagccatcgccagtcccacaggaagaaagttctgccagagatctacctgactcggctgctcagcactaaggggactctgcagaaattcttggatgacttatttaaggctatacttagcatacgagaggataaacctcccctggcagtgaagtacttttttgattttctggaagagcaggccgaaaagcggggaatctccgaccctgacaccctccacatttggaaaacaaataggtggagaccaagcagtcccgtcctcggagaacaccccgaggagcctccggtgtgcttata

SEQ ID NO: 235259 - DNA, 1503 bp, Artificial Sequence
  Description of Artificial Sequence: Synthetic coding sequence
atgcgcggtgaactgtggttactggtgctggttttaagggaggcagcccgagctctctccccccaacccggtgccggacacgacgagggtcccggatctgggtgggccgctaagggcacggtgagagggtggaaccggagagcacgagaatctccaggccacgtatccgaacccgacaggacccaactcagtcaggatctggggggtggaaccctcgccatggacacgctgcccgataaccgcacacgcgtggtagaggataaccacagttattacgtgtcacgtctttacggcccttctgagcctcacagtcgcgagctgtgggttgatgtggcggaagccaaccgtagtcaggtcaagattcacacgatcctaagcaacactcaccgccaggcttcccgcgtcgtcctgtccttcgatttccctttctacggacaccccctgcgccagattacgatcgctacaggtggttttatattcatgggagatgtgatccacaggatgctgacagctacccagtacgtcgcacccctcatggccaactttaaccctggctatagtgataattcaactgtggtgtactttgataacgggaccgtgtttgtggtgcagtgggaccacgtttatttacaggggtgggaagacaagggatcattcacattccaggctgccctgcaccacgatggaagaatcgtgtttgcatacaaggagatcccaatgagtgtgccagagatcagttcttcccagcaccctgttaagaccggcttgagcgatgcattcatgatccttaacccgagccccgatgtcccggagagccggagaagaagtatcttcgaataccaccgtatcgaactggacccatcaaaagtgacatcaatgtctgccgttgagttcactcccctgccgacttgcctccagcatcggagttgcgatgcttgtatgtcaagtgaccttaccttcaactgcagctggtgccacgttctgcaaagatgcagcagtgggtttgataggtatcgtcaggagtggatggactacggctgtgcccaggaagcagaagggcgaatgtgcgaggacttccaggatgaagatcatgatagcgccagccccgacacaagttttagtccctatgatggggacctaacgacgactagtagctccctgtttatcgactcactgactacagaggatgacacaaagctgaatccctacgccggaggcgacggcctgcaaaataacttatctcccaagaccaaaggcactcctgtgcacctcggcacaatagtggggatcgtcctggctgttttactggtagccgcaatcatcttggctggcatctacataaatggccaccccacctctaatgccgcactgtttttcatcgaacggagaccgcaccactggcctgcaatgaagtttaggtctcatcccgatcactccacgtacgccgaggttgaacccagcgggcatgagaaagaagggtttatggaggctgagcagtgctag

SEQ ID NO: 235260 - DNA, 1014 bp, Artificial Sequence
  Description of Artificial Sequence: Synthetic coding sequence
atgcggggagagttgtggttgctggtgctcgttctccgggaggccgctagagccctgtcacctcagccaggggcaggccatgacgaaggccctggatctggatgggctgccaagggaaccgtccgcggatggaaccgcagagctagagagtcccctggccatgtgtccgagccggatcggacccagctgagtcaggacctgggaggaggcaccctcgctatggacacactccccgacaaccgaaccagagtggtggaggacaatcactcgtactacgtgagtaggctgtacggaccttccgagccgcactcgagagagctctgggtggatgttgccgaagctaatagatcgcaagttaagatacacaccattctgagcaacactcacagacaggccagccgggtggtgcttagtttcgacttcccattctatggacatccccttcgtcagattactatcgccacaggtggcttcatcttcatgggtgacgtcatccaccggatgttgacagctacacagtacgtggccccattaatggccaatttcaatccagggtactctgataactccacagtcgtgtactttgacaatggaacagttttcgtggtgcagtgggatcacgtctacctgcagggttgggaggacaaggggagtttcactttccaagctgcacttcaccacgacggtcggatagtctttgcatacaaagagatccccatgtccgtgccagagatctcaagcagccagcatcctgtaaaaactggcctatcagacgcattcatgatcctgaaccctagcccggacgttcccgaaagccgacggagatcaatattcgaatatcaccgcatcgagttagacccatctaaggtgacatctatgagtgccgtcgaattcacaccgctgcctacttgtctgcaacatcggtcatgcgatgcttgcatgtcttccgatctcactttcaactgttcctggtgccatgtcctgcagagccgcgatgaggtaagcccgtgctag

SEQ ID NO: 235261 - DNA, 1284 bp, Artificial Sequence
  Description of Artificial Sequence: Synthetic coding sequence
atggatacgctgccagataatcgcactcgggttgtcgaggacaatcactcctattacgtgtcccgcctatacggaccctccgagccacattccagagaactctgggtcgacgtggccgaggcaaaccgctctcaagtcaagatacataccatactctcaaacacccatcgccaggcaagtagggtggtgctcagcttcgatttccccttctacggccatcccctgagacaaattactatcgcgaccggcggatttattttcatgggtgacgtcatccatagaatgctgacagcaacgcagtacgtggccccactgatggctaacttcaatcccggatactccgacaactctacagtggtgtactttgacaatgggacggttttcgtcgtacagtgggatcatgtgtatctgcagggatgggaggacaagggaagcttcaccttccaggccgcactacatcacgatggtcgcatcgtgttcgcctacaaggaaattccaatgagcgtgccggagattagcagcagtcaacatccagtgaaaaccggcctttccgacgcctttatgattcttaatccatccccggacgttccagagagcaggagaagatcaatattcgaatatcatcggattgaattggacccctccaaggtcacctctatgtcagcagtagagttcacccctttgcctacatgcctgcagcacaggagctgtgatgcgtgtatgagtagcgacttgactttcaattgttcttggtgccacgtactgcagcgttctttgaataaccaagatgagaacacctacgtgaactgccttgatagccagcaatgtcacgggtcatcagaaagcaggcggccattccaagacgaggatcatgactccgcgtcgcccgacacttcttttagcccttacgacggtgaccttaccaccacttcctcctctttgtttatcgatagtctcacaacagaggacgacactaagttaaacccgtatgccggtggggatggtttgcaaaataatctctctcctaaaacaaagggtactcccgtgcacctgggaaccattgtcggaattgtacttgctgtgctgcttgtcgcggcaataattttagccggtatttacatcaatggccaccctacctcaaacgccgctctgttctttatcgagcgcagaccacaccactggcccgcaatgaagtttcgaagtcaccccgatcacagcacgtatgccgaggtcgaacctagcggccacgagaaggagggttttatggaagctgagcagtgttag

SEQ ID NO: 235262 - DNA, 375 bp, Artificial Sequence
  Description of Artificial Sequence: Synthetic coding sequence
atggacactctcccagataaccggacgcgggtggtggaggataaccacagctattatgtgagcaggctgtatggtccatctgaaccacactccagggagctatgggtggatgtggcagaagccaaccggagccaggtcaagatccacactatcttgagcaatacacataggcaggcttctagggttgtactgtctttcgactttcctttctacggacatcccctgcggcagatcaccatcgccaccggcggattcatcttcatgggggacgtgatccataggatgttgaccgccacccagtatgttgcacctctaatggccaattttaatcctggatactcagacaactcaaccgtggtctactttgacaactag

SEQ ID NO: 235263 - DNA, 669 bp, Artificial Sequence
  Description of Artificial Sequence: Synthetic coding sequence
atggacacactgcctgataaccgaacccgggtcgtggaagacaatcactcctactatgtctctcggttgtacggcccttccgaacctcatagcagggagctatgggtggatgtcgccgaggccaataggagccaggtgaagattcacactatattaagcaacacgcacagacaagcttccagagtcgtcctgtctttcgattttccgttttacggccacccattgaggcagataactatcgcaactggcggtttcatctttatgggtgacgtgatacaccgtatgttgaccgccactcaatatgttgctccactgatggccaactttaaccctgggtattctgacaactctaccgtcgtctattttgacaacggcaccgtgttcgtggttcagtgggaccatgtgtatctccagggctgggaggacaaaggtagctttacttttcaagcagccttgcaccatgacgggagaatcgtgtttgcctataaagagatccccatgtcagtgccagaaataagtagttcccagcatcctgtcaaaaccggcctcagcgacgcgttcatgattcttaacccttcccccgatgtgcccgaatccaggaggcgcagcatcttcgaataccatcggatcgaattggacccaagtaaagtgaccagcatgtccgcatag

SEQ ID NO: 235264 - DNA, 198 bp, Artificial Sequence
  Description of Artificial Sequence: Synthetic coding sequence
tgatcatttacctttcaagctgcacttcatcacgacggccgaattgtttttgcttacaaggagatacccatgtctgtgcctgagatctcctccagccagcaccccgtgaaaaccggtcttagcgacgcattcatgatccttaaccctagccccgacgtacctggcttcagcgctgaaagcgccaaacacttgtggtag

SEQ ID NO: 235265 - DNA, 1383 bp, Artificial Sequence
  Description of Artificial Sequence: Synthetic coding sequence
atggccctgagcgttcgaaccctaccgcttcgcggtttcctcgttccgcgtccacagcccactcgttcccaggacgcaccctccccgagactgcccctttctagcgctccagccccttgcagacacaaaaatgaagaagacaatcatagttattacgtgtccaggctatatgggcctagcgaaccccattcgagagagctctgggttgatgtggcggaggctaatcggtcacaggtgaagatacatacaattcttagcaatacccataggcaggcgagccgcgtagtgctgtcattcgattttccattctatgggcaccctctccgccagattacaatagccaccggtggctttatatttatgggcgacgtgattcataggatgctgactgctactcagtacgttgccccattgatggctaatttcaatcctggatacagtgacaatagcacagtagtatacttcgataatggcactgtatttgtggttcaatgggaccacgtgtatctgcaaggttgggaggataaaggatcatttacttttcaggccgcattgcaccatgacggcaggatcgtgttcgcttacaaggagatccctatgtccgtcccggaaatatccagctcacagcatcccgtgaagacaggcttgagtgatgccttcatgatattaaaccctagccccgacgtgcctgagtctcggagaagatcgattttcgagtatcacagaatcgagcttgatccaagcaaagtgacctctatgagcgcggtggaatttactccactccccacctgtctgcaacatcgctcctgcgacgcgtgtatgtcctcagacctgacattcaattgctcatggtgccatgttcttcagagatgctcttctgggtttgaccggtacagacaggaatggatggactatggctgcgctcaggaagccgagggacgtatgtgtgaagacttccaggatgaagaccacgactccgcctccccggacacgtccttcagcccatacgacggcgatctgaccaccacaagctcttctctgttcatcgattcattgacgaccgaggacgataccaagttaaatccctatgccggaggtgatgggctccaaaacaacctgtcacctaagactaaaggaacccctgtccatttgggaactatagtcggcattgtgctggccgttctgttggttgctgctattattttggccggaatatatatcaacgggcacccgacaagcaatgctgccctattctttatcgaacgccgtccacaccactggcctgccatgaaattccgttctcaccctgatcattccacatacgccgaggttgagccctccggacacgaaaaagaggggtttatggaggcagagcagtgttag

SEQ ID NO: 235266 - DNA, 723 bp, Artificial Sequence
  Description of Artificial Sequence: Synthetic coding sequence
atggacaccctacctgataaccggacccgcgtggttgaagataatcactcttactatgtttccaggctatacggaccctcggagccacactcgcgagagctctgggtagatgtggcagaagctaatcgcagccaagtgaagattcatacaattctgtctaacactcacagacaagcaagtcgggtggttctgagctttgatttcccgttttacggccacccactacgccagatcactatagctacggggggatttatcttcatgggggatgtgattcacaggatgctcaccgccacgcaatatgtggcacccctcatggccaattttaaccccggatatagcgacaactcgaccgtggtgtactttgacaacggcacagtgtttgtggtccagtgggatcacgtctacctacaagggtgggaagacaaaggtagcttcacattccaggcagccctgcaccacgacggtcgcatcgtgttcgcttataaagagatcccaatgtccgtccccgagatatcctcttctcagcacccggttaagaccgggttgagcgacgcctttatgatcctcaacccctctcccgatgtgcccgaatcacggaggagatcaatctttgagtatcatcggattgagttagacccgagtaaagtgacatccatgtccgccgttgagttcactccattgcctagccctagtactacccgcatgaagacaaggatgtag

SEQ ID NO: 235267 - DNA, 1179 bp, Artificial Sequence
  Description of Artificial Sequence: Synthetic coding sequence
atggagaaagacaaggtcaagatccacgggattctgtcaaacactcaccgacaggccgctcgggtcaatctgagttttgactttcctttttacggccattttctgagagagattacggtggcgaccggcggttttatttacactggcgaagtggtgcacagaatgctgacggctactcagtacatagcccctctgatggctaattttgaccctagcgtaagtagaaatagtaccgtgagatattttgataacggtacggccctggttgttcagtgggatcacgtacacctccaggacaattacaatttgggcagttttacctttcaagctacactactaatggacgggaggataattttcggatataaagaaatccccgttctggtaactcagatctctagtacgaatcatcctgtgaaagtgggactgtcagatgctttcgttgtcgtgcaccggattcagcagattccgaacgtcaggaggaggaccatttatgaatatcatcgggtcgagctgcagatgagtaagatcacgaacatctccgctgtcgagatgactcctttacctacctgtctccagttcaatcggtgcggcccatgcgtttctagccagatcgggtttaattgctcctggtgcagtaagttacagcggtgttccagtgggtttgacaggcaccggcaagactgggtggactcaggctgccccgaggagtcgaaggagaagatgtgtgagaacaccgaacctgtggaaacgagcagcagaacgaccaccactgtgggcgcaacaacaactcagttcagagtgctcacgacaaccaggagagccgtcaccagtcagtttccgaccagtctccccacggaggacgatacaaagatcgcgctgcatcttaaggacaacggagcttctaccgacgactccgcagccgaaaaaaaggggggtacactccatgcaggccttatcattggcattctgatcctggtactgatagtggcaaccgcgatcttggtgacagtgtacatgtaccatcatcctacaagtgccgcatccatcttctttattgagcgacgcccaagtcggtggcccgcaatgaagttccgacgcggatccggccacccagcgtatgccgaagtggaaccagttggcgaaaaagaaggattcatcgtgagcgagcaatgctag

SEQ ID NO: 235268 - DNA, 1443 bp, Artificial Sequence
  Description of Artificial Sequence: Synthetic coding sequence
atggcccgattccctaaggcagacctagccgcagctggtgtaatgctgctctgccacttcttcactgaccaattccagtttgctgacggcaaacctggtgaccagatcttggactggcagtatggcgtgacacaggcattcccacacaccgaggaggaagtggaggtcgattcccacgcttactcccaccgttggaagaggaatttagacttcctcaaggccgttgatacgaatagagcgagcgtcgggcaagatagcccggagccccgtagtttcacagacttattactggacgacggccaggataataatactcagatagagagggtcaacttaagttttgactttccattctacggtcatttcctaagggaaatcaccgtagccaccggcggattcatctacacgggcgaggtggtgcaccgtatgcttaccgccacccaatatattgctcccctcatggcaaactttgaccccagcgtgtcaaggaacagcactgtgagatatttcgataacggaaccgcactggttgtccagtgggaccacgtacacttgcaggataattacaacttaggaagttttacctttcaggcaaccctgttaatggatggccgaatcatctttggttataaagagattccagttctagtaacccaaatatcttcgactaaccacccagtgaaagtcggcttatccgacgcttttgtcgtcgtccatcgtattcaacaaatcccaaacgtccgaaggcgcacaatttatgaataccacagggttgagctccagatgtctaagattactaatatatccgctgttgaaatgacaccccttccaacatgcttgcagtttaatcgatgcggaccttgtgtgtcatcacagatcggtttcaactgttcctggtgtagtaagttacagcgctgtagctcgggctttgaccgtcaccgacaggactgggtagactctggatgccctgaagagtctaaggaaaagatgtgcgagaacacggagcccgtcgagacctcttcacggaccacgaccaccgttggggctacaaccacgcagtttcgggtgctgacaaccacacggcgtgccgtgacttcccagttcccgacttcgttgcctaccgaagacgataccaagatcgctctccacctgaaggataatggagcgtcaacggatgattctgcagctgaaaagaagggcggaacgctgcacgccggactgataattggaatcctcatactggtcctgattgtcgcgacagccatattggttacagtgtatatgtatcaccacccaacatcagctgccagcatcttttttatcgagcgtcgcccaagtcgttggcctgctatgaagttccggaggggaagcgggcatccggcttacgcggaggtggagcccgtgggtgagaaagaaggtttcattgtgagcgaacagtgttag

SEQ ID NO: 235269 - DNA, 1590 bp, Artificial Sequence
  Description of Artificial Sequence: Synthetic coding sequence
atggccagatttcccaaggctgacttagctgctgccggagtcatgcttctctgccactttttcacagatcagttccagtttgctgacgggaagccaggcgaccagatcctcgactggcaatacggcgtaacgcaagcatttccccatacagaagaggaagttgaggttgattcacacgcgtactctcatcggtggaagcgcaatctggacttcttgaaggccgtggatacaaaccgagcttccgtagggcaggacagccccgagcctcggtcattcaccgatctcctcttggatgatggccaagataacaatacccagattgaggaggacaccgaccataactattatatatcccgaatttacggccctagcgactctgctagcagagacctttgggttaatatcgaccagatggagaaggacaaagttaagattcatggtatcctgtcaaacacccaccgacaggccgcaagagtgaatttgtccttcgacttccccttttacgggcattttctgcgtgagatcacagtggcaaccggaggctttatatataccggagaggtcgtgcaccggatgctgacagctacccagtatatcgcaccactcatggcaaacttcgatcctagtgtttcccgaaattccacagtgcggtatttcgacaatgggacagcccttgtggtccaatgggatcatgtgcacttgcaggacaactacaacctggggagtttcacatttcaggccaccttactcatggacggccgtatcatttttgggtacaaggaaatccctgtgttggtgacccagattagctcaaccaaccacccagtcaaggtcggcctctctgacgctttcgtggtggtacacagaatccaacagataccgaacgttcgtaggcgcacaatttatgagtatcatcgcgtggaactgcagatgagcaagattaccaatatttctgctgtggagatgacccctcttcctacctgtttgcagtttaacaggtgtggcccttgtgttagctcacagataggcttcaattgcagctggtgtagtaaattgcagcggtgtagctctgggtttgatagacaccgccaagactgggtggatagcggttgccctgaggagtcaaaagagaaaatgtgcgaaaataccgagcctgtggagaccagtagtcgcacaaccaccactgtgggcgctacgaccactcaattccgtgttctgacgacgaccaggagagctgttacaagtcaatttcccacttccctgccgacagaagacgacacaaaaatcgctctgcacctgaaggacaatggtgcgtcaacagatgatagcgctgccgaaaagaagggcggtacactgcacgccggattgataatcggcatcctcattctcgtgctcatcgtagccaccgctatcctcgtaacagtgtacatgtatcaccatccaaccagcgccgcatctatcttcttcatcgaaaggaggccatctcggtggcccgcaatgaagttcagacggggatcaggacatccggcttacgccgaagtggagcctgtcggtgagaaggagggctttatcgtctccgagcagtgttag

SEQ ID NO: 235270 - DNA, 1548 bp, Artificial Sequence
  Description of Artificial Sequence: Synthetic coding sequence
atgctgttgtgtcacttcttcacagatcaattccagttcgcagatggtaaaccaggtgaccagatcctcgactggcagtatggcgtcacccaggcctttccacacaccgaggaggaggtcgaggtagactcccacgcttattcccatagatggaagagaaacctcgattttctgaaggcggtggacaccaatagagctagtgttggacaggacagtccagagcccagaagttttactgatctcctgctcgacgacgggcaggacaacaatacacagatcgaagaagacaccgatcataactattatatatcacgaatatacgggccaagcgactcagcttcccgggacctgtgggtaaacatcgaccagatggaaaaagataaagtaaagatacacggcatccttagcaatacacaccgccaggccgcacgggtgaacctgtcctttgactttccattttacggccactttttgagggagataaccgtcgccacagggggatttatctacacaggcgaagtggtccacagaatgctgactgctacacagtacattgcgcctctgatggccaattttgatccatcagtgagtcggaactccaccgtccgctactttgacaacggtacagccctggtggtgcagtgggaccacgtccacttacaggataactacaacctaggttccttcacatttcaggccacactgcttatggatggtagaatcatcttcggctataaggagatccccgtactcgtcacccagataagtagtacaaaccacccggtcaaggttggcctgagtgatgcctttgtcgttgttcatcggatccagcagatcccaaacgtccggaggcgaacaatttacgaataccatagggtggagctgcagatgagcaagatcaccaatatatccgctgtcgagatgacacccttgccgacgtgtctgcagtttaaccgatgcgggccttgtgtatcaagccagattgggtttaattgcagctggtgttctaagctgcagcgatgttccagcggttttgaccgtcacaggcaggactgggtggactccggctgccccgaggaatccaaggagaaaatgtgcgagaacacagaacctgtcgagaccagctcgagaaccaccacaacggttggcgctactacaacacagttcagagtactcactaccacccggagagctgtaaccagccaatttcctacatccctccccacagaggacgacacgaagatcgcgttgcatcttaaggataacggagcctcgacagacgactccgcagctgaaaagaagggtggcactctgcatgccggactgatcattgggatattaatcctggtccttatcgtggccacggcaattctggtgacagtttatatgtaccaccaccccacgagtgctgccagcatctttttcatcgagcgtagacctagtagatggccagccatgaagttccgcagaggctccggccatcctgcctatgcggaagttgagccagttggcgaaaaagagggctttattgtttccgaacagtgttag

SEQ ID NO: 235271 - DNA, 1581 bp, Artificial Sequence
  Description of Artificial Sequence: Synthetic coding sequence
atgaggtgcgctctagcgttgtcggctttgcttctcctcttatccaccccacccctgctgccgtcatcccctagtcctagccctagcccttcacagaacgctacgcagaccactactgattcaagtaacaagacagccccaactcccgcaagttctgtgaccattatggccacggataccgcccaacagagcaccgtcccaacttctaaggcgaacgagattttggctagtgtgaaagctaccactctgggcgtgagctccgattcccccggtaccaccaccctggcccagcaggttagcggccctgtgaatactacagtcgcccgaggaggaggatcagggaaccctactaccaccatagagtcccccaagtctacgaaaagcgcggatacgactactgtggccacttctaccgccacagctaagcccaatacaacgagctcccagaatggagccgaggacaccactaacagtggcggaaaatcttctcattcagtgacaacggacctgacatctaccaaagccgaacacctgacaactccgcaccctaccagtcccttgtcacctcgccagcctactagcactcaccccgtcgctaccccgacttccagcggccacgaccacctgatgaagatcagctcttcctccagtacagtggccatccctggctatacctttaccagccctggcatgactacaactctgccttcttctgtcatcagccagcgaacccagcagacaagctcccagatgccggcatcttccaccgccccaagtagccaggagacggtgcaacccacgagtcccgctacagcattgcgcacccctacactgcccgagaccatgagctcctctccaactgccgcatctacaacccaccgctatcctaagacaccgtctcctaccgttgctcatgaatccaattgggcgaaatgcgaggacctggagacgcagactcaaagtgagaaacagcttgtgctgaatttaaccggcaacacactttgcgcaggaggagcgagcgatgaaaaactcatttcgctgatctgccgggctgtgaaggcaacatttaatcctgcccaggataagtgtggaatcaggctcgcctctgtgcccggtagccaaaccgtggtggtcaaagaaattaccatacacaccaagcttcccgctaaggacgtctatgagcgcttgaaagataagtgggatgaactgaaggaagcgggagtctcagacatgaaactgggcgaccaaggccctcccgaagaggcggaggatcgattttctatgcctctaattatcacaatcgtatgcatggcgtccttcctgcttctagtggcggcattatacggctgttgccatcaacggctaagtcagagaaaagaccagcagcgactgaccgaggagttgcagactgtggaaaatggctaccatgacaaccccactctggaggtgatggaaactagctctgagatgcaagaaaagaaagtggtgagcttgaatggcgagctgggagactcctggatagtgccgttggataacttgacaaaagatgacctagatgaggaagaggacacccatctctag

SEQ ID NO: 235272 - DNA, 1677 bp, Artificial Sequence
  Description of Artificial Sequence: Synthetic coding sequence
atgagatgtgcgctggcactgtccgctctgcttctcctgctttcaactccacccctgttaccttcctcaccgagtccatccccaagtccttcgcagaacgcaactcagaccaccactgattccagtaacaagaccgccccaacgcccgcatcatctgtgactatcatggccacggacaccgcccaacagtccactgtccctacttccaaggcaaacgaaatcctggctagcgtcaaggccacaacgctcggagtctcttctgatagcccaggcactacaaccctcgctcaacaggtcagcggccctgtcaataccacagtggccagggggggtggatcaggtaaccctactaccacaattgagagccccaaatcaacaaaatctgccgacaccaccactgtcgcaacttccactgcaacggcaaagcccaacacaacatcatctcagaacggcgcagaggatacaactaatagtggtggaaaatcttcccactctgtgaccactgatttgacatccaccaaggccgagcacctgacaaccccccatccaacatcacccctgtctccgagacagcctactagcacgcaccctgtagcgaccccaactagtagcggacacgatcatctgatgaaaatttccagctcatcttctaccgtggccattcctggctacacatttaccagtccagggatgaccactacattgttagaaacagtttttcaccacgtgtctcaggccggacttgaactcctgacctctggggatctgcccactctggccagtcagtcagcgggaatcacagcatccagcgtaattagtcaaagaacccagcagacgagctctcagatgccagcttctagcactgcgccttccagccaggagaccgtccagccaaccagccctgccaccgccctgagaacacctaccttgcccgagacaatgagttcttcacctaccgctgcatcaacaacacaccggtatccaaaaaccccctcaccaactgtcgcgcacgaatccaattgggcaaagtgtgaagatctggagactcagactcaaagtgaaaagcagttagtcctcaacctgactggcaacaccctttgtgccggaggagcttcagatgaaaaacttatcagtctgatctgccgggcagtgaaggccacttttaaccccgcacaggacaagtgtggcattcgactggcctccgtccctgggtcccagaccgtcgtggtgaaggagattacgatccacactaaactgcctgcaaaggacgtgtacgagcgcctcaaagacaaatgggatgaactcaaagaagccggagtgagcgatatgaagcttggagaccaggggccacctgaagaggccgaggaccgcttctccatgccattgatcatcacaatagtctgcatggctagtttcctgctgttggtggccgctctgtatggctgctgtcatcaacggctcagccagcgtaaggaccaacaacgcctcaccgaagagctccagaccgtagagaacgggtaccacgataacccgacccttgaagtgatggagacgagttctgagatgcaggagaagaaggtggtgtcactaaatggcgaactcggagacagctggatcgtcccactcgacaacctgacgaaggatgacctagatgaagaagaggatacccacctctag

SEQ ID NO: 235273 - DNA, 1581 bp, Artificial Sequence
  Description of Artificial Sequence: Synthetic coding sequence
atgaggtgcgccctcgcactgtcggctttacttctgctgctgtcaacacctcccttgctcccatcttcaccaagtcctagtccaagccctagccaaaatgcaacgcagacaaccacagatagttccaacaagaccgcaccaacccctgcttcaagcgttaccatcatggccactgacaccgcccagcagagcaccgtcccaactagcaaagctaacgagatcctggcctccgttaaagcaactacactcggggtctcaagcgattcaccaggcacaaccacactggcccagcaggtgtcaggccctgtgaatacaacggttgcgagagggggtgggtccggcaaccctaccactacgatagagagccctaaaagcacaaaatctgccgacacaaccaccgtcgccacttccaccgccacggcaaagcctaataccacatcctcccagaatggggctgaagatacgaccaattcaggaggcaaatcctctcatagtgtcaccaccgacttgactagcactaaagctgaacatctgactaccccacaccccaccagccccctgagccctcggcagcctacctctacgcaccctgtggcaacccccacgagctcaggtcatgaccacctgatgaagatctctagtagctcttcaactgtcgcaatcccaggttacaccttcacctccccaggcatgaccaccaccctgccatcatccgtgatcagccaacgaacccagcagacttcatcgcagatgcccgctagttctaccgccccaagtagtcaggaaaccgttcagcctacatctcccgctacagctttgcgtacacctacactgcctgagaccatgtcttcgagccccacagcagcctccaccactcatcgatacccaaagactccatcaccaacagttgcacacgagagtaactgggttacccccgctggggtcggaacgcagactagagtggaggaggcgctgcgacaggcgctgactcactccctcttacctgctggaggggcatccgacgagaagctgatatctctgatctgtcgggcagttaaagccaccttcaatcccgcacaggacaaatgtggaattcgacttgcttctgtcccaggaagtcagaccgtggtggtaaaggagatcacgatccacacgaagttgccggcaaaggacgtatatgagagactgaaagacaagtgggatgagttaaaagaagccggagtatctgacatgaaactgggagaccaggggcctccagaggaagcggaggatcggttctccatgcccttgataattactattgtctgcatggccagcttcctgttactggtggcggcactatacggctgttgccatcagaggctttctcagcggaaggaccagcagcggctgacggaagagctacagacagttgagaacggctaccatgataaccccactctcgaggtcatggagacctcctcagagatgcaagaaaagaaggtggtctccttgaacggcgaattaggggactcctggatcgtcccacttgataacttgaccaaggacgatctagacgaagaggaggacactcacctctag

SEQ ID NO: 235274 - DNA, 1683 bp, Artificial Sequence
  Description of Artificial Sequence: Synthetic coding sequence
atgcgatgcgctttagcactcagtgccctcctcctcctgctgtcaacccccccactcctgccgtccagcccgtccccatcgccatccccttctcagaacgaaacggccacccaaaccactacggactcctcaaacaagaccgccccaactcccgcttcttcagtaaccattatggcaactgatactgcccagcagagcacggtccctactagcaaggctaacgaaatccttgcaagtgtaaaggccaccacacttggcgtgtcgagcgactcacctggcactacaactcttgcacaacaagtgtcgggccctgttaacacgaccgttgcacggggaggcggaagcgggaatcctaccaccacaatcgagagcccaaagtctacgaagtctgctgacaccaccaccgtggcgacctctaccgccacagccaaacccaacacaaccagttcacaaaacggtgccgaagacacaacaaacagcggaggcaagtcaagccacagcgtgacaacagatctgacctcaacaaaagccgagcatctgaccacaccccaccccacctctccactctcaccaaggcagccaacctctacacatcccgtggcaactccgacatcttcaggacacgatcatctgatgaagatatccagctctagttctactgtggctattccgggatataccttcacatctccaggcatgacaactacgctgctggaaaccgtttttcaccacgtttcgcaggctgggcttgaattactgacatctggggacttacccaccttagcctcacaatctgcaggtattaccgcatcttctgttatatcgcaaaggactcagcagacaagctcccaaatgccagcttcatccaccgcaccgtcctcacaagagacggtgcagccaacctcgcccgctactgcgctgcgaactcccactttacctgaaaccatgtccagttcaccaactgctgcatccacaacgcacagatatcctaaaacaccgagccctaccgtggcccacgagtctaattgggctaaatgcgaggacctcgaaactcaaactcagtctgaaaagcagctggttctgaacttaactggcaatactttatgtgccggaggcgcaagcgacgagaagttgattagtctaatctgccgcgctgtgaaggctactttcaaccccgctcaggacaagtgtggcatccggttggcgagcgttcctgggtcccaaaccgtggtggtaaaggagatcaccattcacactaagctgccggctaaagacgtttatgagaggctcaaggacaagtgggatgagctgaaagaggccggagtgtccgacatgaagctcggtgatcaggggcctcccgaagaagctgaggatcgtttcagcatgcccctgatcattaccattgtttgcatggcgagctttctgctgctggttgcagccctgtatgggtgctgccaccagcgcctttctcagcggaaagatcagcagaggttgaccgaagagttacagaccgtagaaaacggctaccacgacaatcccaccctggaggtgatggagacgtcctcagagatgcaggaaaagaaagtcgtctctctcaatggcgagctgggcgactcgtggattgtgccactggacaatctgacgaaagacgacctggacgaggaagaggatactcacctttag

SEQ ID NO: 235275 - DNA, 1551 bp, Artificial Sequence
  Description of Artificial Sequence: Synthetic coding sequence
atgaggtgcgcactggcactctctgccctgcttctgttgctttcaacttccccatctccatctcagaacgccactcagactactacagattcatcgaataagaccgctcctactcctgcgtcctctgtgaccatcatggccaccgacaccgcccagcagtcaacagtccccacctcaaaggctaacgaaattttggcctctgtcaaagccacgactctgggtgttagttcagattcccctggcaccaccactctggctcaacaggtcagcggtccagtgaacactaccgtcgccagggggggaggatccggcaatccaacaaccactatcgaatcgcctaaatccacaaagtcagcagacactacaacagtggcgaccagcactgccacagccaaaccaaataccacatcttcccagaatggcgctgaggatacaaccaattcggggggtaaaagctctcacagtgtaactacggacctcacaagtaccaaggctgaacaccttaccaccccccatcctaccagccctctgtctcctcggcagcccaccagcacacacccagttgcaacaccgacaagttcaggccacgaccacctcatgaagatcagttcaagttccagcacagtcgcaataccaggctacaccttcaccagtccgggaatgactacgacactgccttcttccgtgatttcccagcgtacacagcagacctcctcacagatgcccgctagcagtaccgcccctagcagccaggaaaccgttcaaccaacttctcccgcaacagctttgcgcacgccaacactgcccgaaaccatgtccagttcaccgacagctgcttctacaactcacagatatcccaagacacccagtccaacagtcgcccacgagtctaactgggccaaatgtgaggatctagaaacccagactcagtccgagaagcaacttgtgctaaatctaacagggaacaccttatgcgcgggaggcgcttcggacgagaaactgatatcattgatttgcagagccgtgaaagcaaccttcaatcctgcccaggataagtgtgggattcgactggcaagtgtgcccggaagccagacggtggtcgtgaaggagatcaccattcacaccaaactgccagcaaaagacgtgtacgaacgcctaaaggacaaatgggacgagctgaaggaggccggagtgtccgacatgaaacttggggaccaagggcctccggaagaggctgaggaccgctttagtatgccccttatcatcaccatcgtctgcatggcatccttcctcttgctggtggcagccctgtatggatgctgtcaccagcggttgtcccagcgaaaggatcagcagagactgactgaggagttacagacggtcgaaaatggttaccatgataaccccaccctcgaggtgatggagacatccagtgagatgcaagaaaagaaggtcgttagtctaaacggcgagctgggcgatagctggatagttcctctcgacaatctcaccaaggacgatcttgacgaagaagaggacacacacctctag

SEQ ID NO: 235276 - DNA, 1986 bp, Artificial Sequence
  Description of Artificial Sequence: Synthetic coding sequence
atggaaggggctagagcaaggggtgcccaacttagactcggcgagcgggtccgcccagtgggccgtcggtccgccccaggtcggtcccggtttcggcagccatggcgccctggagcctcagattctgccccacccgcaggcacgatggcacaatcccgggtattgctgcttctgctgctgctcccaccacagttacatctaggcccagttttagctgtgagggcacccggattcggcaggtccggcggacactctttgagcccggaagaaaatgaatttgctgaagaagagcccgtcctggtcctctcccctgaggaacctgggcctggccctgccgcagtgagttgccccagagactgcgcttgcagtcaagagggcgtggttgattgcgggggaatcgaccttcgtgagtttcccggagatcttcctgagcatacaaatcatctgtctcttcaaaacaaccagctggaaaaaatctaccctgaggagctttcaagacttcaccgcctggaaaccttgaatctccaaaataatcgactcaccagccgcggactgccggagaaagccttcgaacatctcacgaatctaaactacctgtacttggcgaataataagctcacactggcacccagatttctgcctaatgctttaattagtgtagacttcgcagctaactatctgaccaagatctacggtctcaccttcgggcagaagccaaatcttcgcagtgtgtacttgcataacaacaagctggcagatgccggattgcccgacaatatgtttaatgggagcagtaacgtagaggtactcattcttagctccaatttcctgcgtcacgtgcctaagcatctgccacctgcgctgtacaaactgcatcttaagaacaacaagcttgagaaaatccccccaggcgcattctctgaactctcaagcctgcgagagctttacctgcagaataattaccttacagacgaaggcttggacaatgaaacgttctggaaattatctagtctcgagtacctggacctgtcatctaacaatttgtccagagtgcctgccggacttcctcgatctctcgtgcttttacacctggaaaaaaacgcaatccgcagcgtcgatgccaatgtactgacccccatccgcagcctggaatatctgttgctccactctaaccagttgcgtgagcagggtatccatccactggcctttcaaggtcttaaaagactacacacagtgcatctctacaataacgccctcgagagagtcccctccggcctcccaagaagggttcggacattgatgatattacacaatcagatcaccggaatcgggagagaagacttcgccaccacttattttcttgaggaactaaacctttcctataaccgtatcaccagcccacaggtccatcgcgacgccttccggaagttgcggttgctgaggtcgctggacctctctgggaacagactccacaccctccctccgggtctgcccagaaatgtacacgtgctgaaggtgaagcgaaacgagctcgccgctcttgctcggggagcactggtcggcatggcccagctcagggaactctatcttacttcaaatcgcctgaggtcacgagcactcggcccaagggcgtgggtggatctggcacaccttcaactcctggacatcgctggaaaccagttaactgaaattccggagggactgcccgaatctctagagtacctctacctgcaaaacaacaaaatctctgcagtgcccgcaaacgccttcgatagcacgcccaacctgaaggggatctttctgcggttcaataaactcgcagttggcagcgtagtggattccgctttccggcgactgaaacacctccaggtgttagacatcgaaggcaacctcgaatttggcgacatctcgaaagaccgcggaagactgggaaaagaaaaggaggaggaggaagaagaagaggaagaggaggaggaaactaggtag

SEQ ID NO: 235277 - DNA, 1929 bp, Artificial Sequence
  Description of Artificial Sequence: Synthetic coding sequence
atggaaggcgaagaagccgagcagccagcatggtttcgacaaccttggcgacccggtgcttcagattcagcacctccagccggaactatggcacaatcacgcgtgctcctgctcctcctgctcctgcctccacagctgcacctggggcctgttttggctgtgagagccccagggtttggaaggagcggcggacactctctcagcccagaggaaaatgagtttgcagaagaggagcctgtgctcgtgctttctcctgaagagcccggtccagggccagcggcagtcagttgtccacgggattgcgcctgttcccaggagggcgttgttgactgtggcggtatagatttgagagagttccccggtgaccttccagaacacactaaccatctttcattacaaaataaccagctcgaaaaaatctatcccgaggaactgagccgtttgcataggctagagactctcaatctgcagaacaatcgcttgacctcccggggactacctgagaaagcttttgaacatctgaccaatttaaattatctctatctagccaacaataaattgactttagctccccgattcctcccaaatgccctgatatctgtggatttcgccgcaaactacctcacgaaaatctatggtttgactttcggtcaaaaaccaaacctgaggtctgtgtacctccataataataaactggcagatgctgggctgccagacaatatgttcaatggcagctctaacgtagaggtgctgatcctttccagtaatttcctcagacacgttccaaagcatctcccaccagctctgtacaaactgcacttgaagaacaacaagcttgagaagatcccacccggagcttttagcgaactgagttccctgagggagctgtatctgcagaataattacttgaccgacgagggattagacaacgagacattctggaagctgtccagcctggaatatctggacctcagttcaaataacttgtctcgtgtcccagcgggactccctagaagtttggttttactgcatcttgagaaaaacgctatccgctcagtggatgccaacgtgcttacccctatcagaagtcttgagtatcttctgctgcactcaaatcagctgagagagcagggtatacatccccttgcttttcaaggcctcaaaagactgcatacggtccacctgtacaacaacgccttggagcgagtgccctctggcctaccacgtcgggtgaggactctgatgatactgcacaaccagatcacggggatcgggagagaggattttgccactacatacttcctcgaagaactcaatctgagttacaaccggatcacctccccccaagtccacagggacgcttttcgtaagcttaggctgctgaggtcactagacctttctggcaatagacttcataccctcccccctgggctgcctaggaacgtgcacgttctgaaggtcaagaggaacgagctcgcagccctggcacgtggggcactagtgggtatggctcagctccgggagttatatctaaccagcaaccgactcagaagccgggcactgggccctagagcgtgggtagatcttgcacatctccaactcctggatattgcaggcaatcagctgacggagatccccgaaggactcccagaaagcttagagtatctgtatctgcagaacaataaaatctcagccgtgccagcaaacgctttcgattccacacctaacttaaagggaatttttctgcggttcaacaagctggcggtcggcagtgttgttgattctgctttccgcagattaaagcacttacaggtgcttgacatcgagggaaacctggagttcggagatatcagtaaagatcggggtaggcttgggaaagagaaagaggaggaagaggaggaggaagaggaagaagaggagacaagatag

SEQ ID NO: 235278 - DNA, 1560 bp, Artificial Sequence
  Description of Artificial Sequence: Synthetic coding sequence
atggaaggtgcacgcgctcgcggagctcagctgaggctgggcgaacgagtgaggcctgtgggaaggcgttcagcacctggaaggtcacgcttcagacagccgtggagaccgggagccagcgacagtgcgccacccgctggcacaatggcgcagagtagagtgctcctcttgctgctgctcctgccccctcaactacacctggggccagtgctcgccgtccgggctccaggattcggcagatcggggggacactccctgtcacccgaggagaatgagttcgctgaagaagagccagtgctcgtactgtccccagaagaacccggacccggtcccgcagcagtgagttgcccgcgtgattgtgcctgtagtcaagaaggcgtcgttgactgcggaggcatagatcttcgcgagtttccaggggacctacccgagcacacgaatcacctgtcactgcagaacaataaactcgagaagattccgccaggtgccttcagcgagctctcttctctcagggagctctatctccagaacaactacctgacagatgagggactcgataacgaaacattttggaaattatcctcgttggagtacctagatttaagctccaataacctatcccgagtgccggcaggactgccacggtcactagtgctcctgcatttagagaaaaatgccattcgctctgtcgatgccaacgtcctcacccctattaggtccctggaatacctgctgttgcatagcaatcaactgcgagagcagggcatccacccgctagcttttcagggattgaagcgtctacacactgtgcatctgtacaacaacgctctagagagggtgccatccggtctgcccagacgggtgcgaactctgatgattctgcacaaccagatcactggaattggtcgtgaagacttcgcaacgacctattttctggaagaattgaatctgagctacaatagaatcacctccccacaggtccatagggatgccttccgtaagcttaggctgcttcgctctctggatctttccggcaacaggctccatacgctgccacctggtcttccaagaaacgtgcacgtcctgaaagttaaaaggaacgagctcgcagcattagctaggggagctttggttggtatggcacagctcagggaactgtatcttacatcaaacaggctgcggagtcgagcccttggccctcgagcctgggttgatctggctcatctccagttgctggacattgctgggaaccagctgactgaaatccctgaaggcctgcctgaaagcctggaatacctgtacctgcagaataacaagatctctgctgtgccagcaaatgccttcgatagcactcctaatctcaagggcatcttcctgagattcaataagctggcagttggatcagtagtggactccgcgttccgccgtctcaagcatctccaggtactggacatcgagggtaatctcgagtttggcgacatctcgaaagatcgcggacgcctaggtaaggagaaagaggaagaagaggaggaggaggaagaagaggaggagacacgatag

SEQ ID NO: 235279 - DNA, 1095 bp, Artificial Sequence
  Description of Artificial Sequence: Synthetic coding sequence
atggctcgcgcaatggctgccgcttggcctctccttctggtggcactgcttgtgctgagttggccccctccgggaaccggagacgtcgtcgtgcaggccccaacacaggttccaggctttctcggggactccgtgacactcccttgttaccttcaggtccctaacatggaggtcacacacgtctcccagcttacgtgggcccgacacggcgaatccgggtcaatggctgtctttcaccagacacagggcccttcgtactcagagtctaagagactcgagttcgtcgctgcacggctgggcgctgagctgcgaaacgcatctctgcggatgttcgggctgcgggtcgaagacgagggaaattatacgtgcttgttcgtgactttccctcagggatctcggtccgtcgacatctggctgagagtcttagccaaacctcagaacaccgctgaagtacagaaggtacaattgacaggagaaccagtaccaatggctcgatgcgtatcgaccggaggaagaccccctgctcagatcacctggcactccgatctgggcggtatgcccaacacatcacaggtccccggttttctgagtggcaccgtgacagtcaccagtctgtggattctggtgccgagcagccaggttgacggaaaaaatgtgacctgcaaggtggagcatgaaagcttcgaaaaaccacaattactgacagttaaccttaccgtgtactaccctccagaagtaagtatttctgggtacgacaataactggtacctgggacagaatgaagccactctgacatgtgacgccagatcaaacccagagcctaccgggtacaactggtccaccactatgggtccactgcctcctttcgccgtggcacagggcgctcagttacttatcaggcctgttgacaagcctattaacaccaccctaatatgtaacgtgacgaatgctctgggtgccagacaagctgaactgactgttcaggtgaaaggcaccgaacacgcctctgcttcagctaatggccatgtcagctactctgcggtctctagagaaaatagttcttcccaggatccccaaaccgaggggactcgctag

SEQ ID NO: 235280 - DNA, 1119 bp, Artificial Sequence
  Description of Artificial Sequence: Synthetic coding sequence
atggcacgagctatggcggctgcatggcctttgctcctagtcgccctcctagtgctcagttggccaccaccaggcactggagacgtagtggtgcaagcgcctacacaggtacctggattcctcggcgactccgtcacgctcccatgctacctgcaagtgccaaatatggaggtgacccacgtcagccagcttacttgggcaaggcacggcgagagcggcagcatggcagtgtttcaccaaacccagggaccaagttatagtgagtcgaaacgcctggaatttgtggctgctcgattgggggctgaattgaggaatgctagcctgagaatgtttgggctgcgtgttgaggacgagggaaactacacatgcctgtttgtgacctttccccagggcagtcgttctgtagatatttggctccgcgtgctggccaaaccccaaaacacagcagaggttcaaaaggtgcaactgacaggggaacccgttcctatggccagatgcgtgtctactgggggtagacctcctgcacagattacatggcacagtgacctaggaggaatgccaaacacatcacaggtccctggctttttatcagggacggtgacagtcacctccctctggatcctggtaccttcctcccaggtggatggtaagaatgtgacctgcaaagtggaacacgagagtttcgagaagccacaactgctgactgtcaaccttactgtttactaccctcctgaggtgagtatctcaggctacgataacaattggtatctcggccagaatgaggccaccctcacatgcgacgccagaagcaaccccgaaccaaccggatataactggtctactactatggggccactgcccccatttgccgtcgcacagggcgcacagctactgatccgccctgtagacaaacctataaatactactctgatttgcaatgtgacaaatgccctgggggcaaggcaggctgaactgacagttcaagtgaaagagggaccgccatccgagcactccgggaccgagcacgccagtgcatctgccaacggtcatgtgagttactcagcagtctcaagagaaaactcgagctctcaggatcctcagaccgagggcactcggtag

SEQ ID NO: 235281 - DNA, 1179 bp, Artificial Sequence
  Description of Artificial Sequence: Synthetic coding sequence
atggcccgtgccatggccgctgcatggccactgctcctcgttgctctccttgtgctgtcgtggccacctccagggacaggagacgtagtagttcaggctcccacgcaagtgcccggattcctaggcgatagtgtgacgctgccctgttatctgcaagtacccaatatggaagtgactcacgtgtcgcagctgacttgggccagacatggagagtctggctccatggctgtgttccaccagacccaaggtccaagttacagtgaaagcaagcggctggagtttgtagccgctaggttgggtgctgaactgcgcaacgcctccctcagaatgtttggactgcgtgtggaggacgaaggaaactacacatgtttgttcgtgaccttcccacaaggctccagatcagtggacatctggttgcgggtactcgccaagccccagaatacagctgaggtgcaaaaagttcagttaaccggggagcctgttcccatggctcgctgcgtgagcactggcggacggccaccagcccagatcacctggcattcagatttgggtggaatgccaaatacttcccaggtaccgggatttctgagcggcacagtgactgtgactagcctgtggatcctcgtgccatcttcccaggttgacgggaagaatgtcacctgcaaggtggagcatgagagtttcgagaaaccccaactcctcacagtgaacctaaccgtctactatccccctgaggtgtccataagtgggtatgacaacaactggtatctcgggcaaaatgaggcgaccctgacctgtgatgccagaagcaaccctgaaccaaccggctacaactggagcactaccatgggacccctccctccttttgccgtcgcccagggcgctcagctgctgattcggccagttgacaagcccatcaataccacgctcatttgtaatgtaacaaatgctttgggcgctcgccaggcagagttgacagttcaggtcaaggaggggccaccatctgaacacagtggcattagcaggaatgcaattatttttttggtgctgggcatcttggtctttttaatcctcctgggtattggaatttatttttactggtccaagtgttccagggaagtcctgtggcactgtcacctgtgcccctcctccgagcatcaccagtcatgtagaaattag

SEQ ID NO: 235282 - DNA, 1254 bp, Artificial Sequence
  Description of Artificial Sequence: Synthetic coding sequence
atggctagagcgatggctgcggcttggccactcctgctggttgccttactggtgctgtcgtggcccccaccagggaccggagacgtggtggtgcaggctccaacccaagtccctggatttctcggggactcagtgaccttgccttgctacctgcaggtcccaaatatggaggtaactcacgtctcccagctaacgtgggctcggcacggtgaaagcgggagcatggcggttttccatcagacccaagggccaagttattctgagtccaagcgactggagtttgtagccgcaaggctcggagccgaactgcgaaatgccagtcttcgcatgttcggactgagggtagaggacgaggggaattacacttgtttgtttgtgaccttcccacagggaagccggtccgtcgatatatggcttagagtcctggccaaaccccagaacactgccgaggtacaaaaagtccagctgacaggggagccagtccctatggccaggtgcgttagtacaggagggaggccccctgcacagattacctggcacagcgacttgggcggaatgcccaatactagtcaggtgcccggattcttgtcgggcaccgtcactgtcaccagcctatggattctagtgcctagcagccaagtggatggtaagaatgttacttgtaaggtcgaacacgagagcttcgagaagcctcagctgcttacagtaaacttaactgtgtattacccacccgaggtttccatttccgggtatgacaacaactggtatttgggccaaaacgaggcgaccctgacttgtgatgccaggtcaaatcctgaaccaaccggttataactggtccacaacaatgggcccactgcctcccttcgctgtcgcccagggcgctcagctcttgatccggccagttgataagcccattaacacgactctaatctgtaatgttacgaacgcactgggggctaggcaggccgagcttacggtgcaggtgaaagaaggtccgccttctgaacatagtggaatatctaggaacgcaattatttttctcgtgctcggcatcctggtctttctcatcctcctgggtattggaatctatttctactggtccaagtgttctcgtgaggtgctgtggcattgccacctttgtccaagcagcactgagcacgcctcagcatcagccaacggccacgtgtcttactctgccgtgagccgggaaaatagctcttcgcaagatccccaaacagaagggacccgttag

SEQ ID NO: 235283 - DNA, 1554 bp, Artificial Sequence
  Description of Artificial Sequence: Synthetic coding sequence
atggcccgaatgggcttagccggtgctgccggacggtggtgggggttggccctcggtcttacagcgttctttctccctggcgtgcattctcaggtggttcaggtaaacgacagtatgtatgggttcatcgggacagatgtggtcctgcactgctcctttgcgaatcccctgccaagcgtgaaaattacccaggtaacctggcaaaagagcactaacggctctaaacaaaatgtcgccatctacaatcccagcatgggtgtcagtgttcttgccccttacagggaaagggttgagttccttcggccttcttttacggatggcactattagactgagccgacttgaactggaggatgaaggcgtctacatctgtgagttcgccacttttcccacgggcaatcgtgagtcccagctcaatttgactgtcatggccaagccgactaactggatagaaggtactcaggccgtattaagagcaaagaagggccaggatgacaaagttctcgtggccacatgtacatcggctaatggcaagcctccttccgttgtatcttgggagacgcggctcaaaggcgaggcggagtatcaggagattcggaaccccaacggaacagtgacagtgatcagcagatacaggctcgtgccttcccgagaagctcatcaacagtccctcgcatgcatcgttaattatcacatggatagatttaaagagtcacttacactcaatgttcagtacgaaccagaggtgacaatcgaaggcttcgacggcaattggtatttgcagagaatggacgttaaactcacctgtaaagccgacgcaaatccacccgctactgaatatcattggaccacgctcaacgggagcctgcctaagggcgtggaagctcagaatcgtactctattcttcaaagggccaatcaactatagccttgccggaacctacatctgcgaggcgactaaccccatcggaacgcgatctggccaggtcgaagtaaatatcaccgaattcccatacacaccgtccccgccagagcacggcaggagagccggaccggtgcctacagccatcattgggggtgtcgctggctctatcctgctggtgttgatcgtggtaggtggtatcgtggtggcactaaggcggagacgacacactttcaagggcgactactccactaaaaagcacgtgtacggaaacggctacagcaaagctggtattccccagcatcatcctcctatggcgcagaaccttcagtatccagatgatagcgatgacgaaaagaaggccggacccctggggggttccagttacgaggaagaggaggaagaggaggagggtggcggaggaggtgaacgaaaagttggcggaccacatccaaagtatgatgaggacgcaaaacggccatacttcaccgtggacgaagcagaggctaggcaggacggatacggggatagaacactgggataccagtatgacccagaacaattagacctagccgagaacatggtcagccagaacgacggttcattcatatcgaagaaagaatggtacgtctag

SEQ ID NO: 235284 - DNA, 1059 bp, Artificial Sequence
  Description of Artificial Sequence: Synthetic coding sequence
atggcgagaatgggcctggccggagccgcaggacgctggtggggcctggcgctcggattgacggcattctttctacctggggtccactctcaagtggttcaggtgaacgactccatgtatggctttatagggaccgatgtcgtgttgcattgtagttttgcaaatcccctcccgtctgtcaaaattacacaggtgacctggcagaaatccactaatggatctaagcagaacgtggcaatatacaacccttcgatgggagtatcggtgctagcaccctatcgtgaaagagtcgagttcctgcgtccctccttcacagatggcacaattcggcttagccgcctggagttagaagacgaaggtgtatatatttgcgaatttgccactttcccgacagggaacagggagtcacagttgaacttaacagtgatggcgaaaccaactaattggattgagggcacccaggctgtgttgcgggcaaaaaaaggccaagatgacaaagtgttggtcgctacctgcacttcagccaacggaaagccgccttccgtcgtttcgtgggagactcgactcaagggggaggcagaataccaggagattcgcaatcccaacggcaccgttaccgttatctcaaggtaccgattagtgccttctagggaggcacaccaacagagcctagcttgcatcgtcaattaccatatggaccgtttcaaagagtcacttacacttaatgtccagtatgagcctgaagtaaccatcgaagggttcgatgggaactggtacttacagagaatggatgtcaaactaacttgcaaagctgatgccaatccccctgccacagaatatcactggaccaccctgaacggctcgctccctaagggagtggaggctcagaaccgcaccctctttttcaaaggacctatcaattactcccttgcgggaacttacatctgtgaggccaccaaccctatcgggacacggtctggtcaggtagaggtgaacatcaccgccttttgccagctgatttacccgggaaaaggacgcacacgcgcaagaatgttttag

SEQ ID NO: 235285 - DNA, 1377 bp, Artificial Sequence
  Description of Artificial Sequence: Synthetic coding sequence
atggcaaggatgggcttggccggtgccgctggcagatggtggggacttgccctgggactgaccgcattttttctgcccggagtacactcacaggtggtccaggtgaatgacagcatgtacggctttatcggaaccgatgttgtgctacattgttcttttgcgaacccccttccatcagtgaagatcactcaggtcacatggcagaagtccacaaatggatcaaagcagaacgtagctatatacaatccgtccatgggcgtgagcgtgctggccccttatagagagcgcgtggaattcttgaggccttcatttacagacgggaccattaggctatctagactcgaacttgaggacgagggagtgtacatctgcgagtttgctacgttcccaactggaaaccgagagtcgcagctaaatttaactgtaatggcgaaaccaacaaactggatagaaggcacccaggccgttttgagagccaagaaaggccaggacgataaagtcctcgtggcgacgtgcacttcggctaacgggaaacctcccagcgtcgtgtcctgggaaactagattgaagggggaagctgagtatcaagagatccgaaatccaaacggaacagttactgttatctcacgctataggctggtgccaagtagagaggcccaccagcagagcttagcttgtattgtgaattatcacatggatcgttttaaagagtcactaacattaaacgtgcagtacgaacctgaggtgacgatcgaaggttttgatggcaattggtacttgcagcggatggatgtcaaattgacatgcaaggctgacgctaatcctcccgcaactgaatatcattggacaaccctgaatggctctttacccaaaggggtggaagcacaaaaccggaccctgttcttcaaagggcctataaactactcccttgccggaacttatatctgtgaagcaaccaatcctattggaacccgcagcggccaggtcgaggtaaatattacagaaaagcccaggcctcaacgtggtctgggctccgcagcccgactgttggcgggaacagttgccgtgttccttattctcgtggcggtactgaccgtgttctttctttacaaccgccaacagaagtcccctccagaaaccgacggcgctggtaccgaccagccattgagccaaaaacccgaaccaagcccctccaggcagagttcccttgtgcccgaggacatccaggtagtgcacctggacccgggaagacaacagcagcaggaggaggaagatcttcagaaattgtccctgcaacccccttactacgatctgggagtatctcccagctaccatcccagcgttcgaaccactgagcccaggggcgaatgtccctag

SEQ ID NO: 235286 - DNA, 1617 bp, Artificial Sequence
  Description of Artificial Sequence: Synthetic coding sequence
atggctagggccgctgcgttactgccaagcagatcaccacccactccactgctgtggcccttgctactcttgttgctgcttgagaccggcgcacaggatgtcagggtgcaggtgctcccagaagtccgcggacagctaggcggtacggtggagctaccatgtcacttgctgccacccgtgccagggctgtatatcagcctggtgacatggcagagacctgatgccccagccaatcaccagaacgtggcagccttccaccctaagatggggccttccttcccctcccccaagcctggatctgaaagactctcctttgtgtctgcaaaacagtccacgggccaggatacagaggccgagctgcaggacgctacgcttgccttgcacgggttaacagttgaggatgaaggaaattacacgtgcgagttcgctacatttccgaagggcagtgtaagggggatgacctggctgcgcgtaatcgcgaagcctaagaatcaagccgaagctcaaaaagtgacattctcacaggacccgacgaccgtggccctgtgcatctctaaagagggccgaccaccagccagaattagctggctttcttccctggattgggaggcaaaagagacacaggtgtctggcacattggcgggtacagtcactgtgacatctagattcacactggtcccctctggaagagccgacggggtgactgtcacgtgtaaagtggagcacgaatccttcgaggaacctgcattaatccccgtgacactgtccgtacggtacccccctgaggtctctataagcgggtacgatgacaactggtatttgggcagaaccgacgctaccctgagctgtgacgtgagatctaaccctgaacctactggttatgattggtccacaactagcggtacatttcccacgtcagccgtcgcacaaggcagccaactagtgatccacgcggtggactccttgttcaacacgactttcgtatgcactgtaactaacgccgttggcatgggaagggccgaacaagttatctttgtacgtgaaacgccaaatacagccggagctggagccactggagggatcatcgggggtatcatagctgccattatcgcaaccgccgttgccgctacagggatcttgatatgccgccagcagcgcaaagaacaaactctgcaaggtgcggaggaggacgaggatctcgagggacctccatcctacaagccacccacacccaaagctaagctggaggcccaggagatgccaagccagctctttacactgggggcttctgagcatagtccactgaaaacaccatatttcgacgctggagcgagctgcactgagcaggagatgccacgttaccacgagttgcccacgctggaagagcgaagcggccctctccatcctggtgccacctcgcttggctcgccaatcccagttccaccaggcccacctgcagtagaggatgtttccctagacctggaggacgaagagggggaggaggaggaggagtacctcgacaagatcaatccaatatatgacgcgctgagctatagttccccgtcagactcctatcaaggtaaaggatttgtcatgagcagggccatgtacgtctag

SEQ ID NO: 235287 - DNA, 1440 bp, Artificial Sequence
  Description of Artificial Sequence: Synthetic coding sequence
atggcacgagccgctgctctgctcccttcccgaagtcccccaacgcccttactttggcccctgctgttgctgttacttctcgagacaggcgcacaggacgtgagggtgcaggtcctgcctgaggtcagaggacagttaggtgggactgtggagctgccctgtcatctgctgccaccagtgccaggcctctacataagcctggtcacttggcagcgtcctgacgcacccgctaatcaccagaacgtggccgcattccaccctaagatggggcctagctttccttctcctaaacctggttccgagcgcctgtcatttgtctctgcaaaacagtccacgggccaggacacagaggctgaactgcaggatgccactctggcactgcacgggttaaccgttgaagacgaaggtaattacacctgtgagtttgcgacttttcctaaaggatccgttcgcggtatgacatggctcagggtaattgcaaagccgaaaaaccaggcggaggcccaaaaggtgacgttttcacaggacccgactacagtagctctgtgcatatccaaagagggtagaccccctgcacgtataagctggctctccagtcttgactgggaggccaaagagacccaggtaagcggaactttagccggtacggtaaccgtaacaagccggtttacactggttccaagcggcagagcggatggtgtgacagttacctgtaaagtggaacatgaaagctttgaagaaccggctttgatccctgtgaccctgtctgtcaggtacccgccagaggtgagtatttcaggctacgacgacaattggtatctcggaaggactgacgcaacattatcctgcgatgtcaggagtaaccccgaacccactggctatgactggtccaccacgtctgggacttttccaacttccgccgtcgcccaaggcagtcagctggtaatccacgctgtggactcacttttcaacaccacttttgtctgcaccgttactaacgccgtgggaatgggcagggctgagcaggtgatattcgttcgcgagaccccacgtgcctctcctcgagacgtgggccctttggtttggggggcagtcggtggcacactgttggttctgctgctcctggcagggggttccctggcttttatcttattgcgtgtcaggcggcgaaggaagtcacctgggggtgcaggtggcggtgcctctggagacggtggcttctatgaccctaaggctcaagtcctcggcaatggagatcctgtcttttggactcctgtcgttccgggacctatggaacccgacgggaaagatgaagaggaggaggaagaagaagaaaaggctgagaaggggctcatgctgcctccccctcccgcattggaagatgacatggaatctcaactagatggctctctgatcagtcgaagggctgtttacgtgtag

SEQ ID NO: 235288 - DNA, 1101 bp, Artificial Sequence
  Description of Artificial Sequence: Synthetic coding sequence
atggcaagaacactgcggccatccccactgtgtccgggtggaggcaaggctcaactgagtagcgcctcactgctgggagccggattacttctgcaacctcctacaccgcctcctttactgctgctcctatttccgttactgttgttctcgaggctatgcggcgctttggccggtccaatcatcgtagagccccacgttaccgccgtgtgggggaagaacgtcagcctgaagtgcttaattgaggtgaatgaaactataactcagatatcctgggaaaaaattcacggtaagtccagccagactgtcgcagtccaccacccgcagtatggattttccgtacagggcgaataccagggcagagtgttgtttaagaattactcacttaatgacgccacaattactctgcacaacatcggtttttctgattccgggaagtacatttgtaaagccgtcacattccccctgggaaacgcccagagctccacaaccgtgaccgtgttggtcgaaccgactgtgagcctgattaagggccctgactctctgattgatggcggtaatgagacggtagctgcaatctgcatcgcagccacgggcaagccagttgctcacattgactgggagggtgacttaggcgagatggaaagcacgactacttcattcccaaacgaaactgcgaccattatatcccaatataagctgtttccaacacgttttgctagggggagaaggatcacttgtgtagtcaagcatcccgctctcgagaaggatatccgatatagtttcatactggatatacagtacgctccagaggtctccgttacagggtatgatgggaattggttcgtaggacggaagggcgtgaatctgaagtgtaatgcagatgctaatccccctccgtttaagagtgtgtggtctaggctggacggacagtggccggacggacttctcgcttctgataacacactccattttgtgcatcccttgaccttcaattattcaggggtttatatttgtaaggtgactaattctctgggtcaacgctcggaccagaaagtgatctacataagtgcctacaactctgtcgcctcccttaactgctag

SEQ ID NO: 235289 - DNA, 1650 bp, Artificial Sequence
  Description of Artificial Sequence: Synthetic coding sequence
atggctcgcaccctgcggcctagccctctatgccctgggggaggtaaagcccagctcagctctgccagtcttttgggcgctggcttgttgttacagccgccaacccctccaccgctgctcttactcctgttccccctgctcctgttctcaaggctgtgtggggcactggcaggaccaatcatcgtggagccacacgtgactgccgtgtgggggaagaacgtgtcactgaagtgtcttatcgaagttaatgaaacaattactcaaatatcctgggaaaaaatccacggaaaatcttctcaaaccgtggcagttcatcacccccagtacggcttttcagtgcagggcgagtatcaggggagggtgctgtttaagaattacagcctcaacgacgccacaatcacgctgcacaatatcggtttctcagacagcggtaaatacatatgcaaagccgtcaccttcccactgggtaacgcgcaaagctccacaacagtgacggtcttggtcgaacccactgtgtctctcattaaagggcctgatagcctcatcgatggaggcaatgaaaccgtcgccgctatctgcatcgcggctaccgggaagcctgtggcacacattgactgggagggagacctgggcgagatggagtcaactactacaagcttccctaatgaaaccgcgacaattatcagccagtacaaactctttccgacccgcttcgcaaggggcaggagaatcacctgcgtggtaaaacacccagctcttgaaaaggacatcagatacagctttattttagatatccagtacgccccagaagtgtccgtgaccggttacgacggtaactggttcgtggggaggaagggagtcaatctgaagtgtaacgccgacgcgaacccccctcccttcaagtctgtctggtccaggcttgacggacagtggccagatgggctactggcctccgacaacaccttgcacttcgtgcaccctttaactttcaattacagcggcgtatatatatgtaaggtgaccaactctctcggccaacgctctgaccagaaggtgatctatattagcgacccgcctacaacgaccactcttcagccaacaatccagtggcacccatccaccgcggatatcgaggacctagctaccgagccaaaaaaactgcccttcccattgagcacgcttgcaactataaaggatgatacgatcgccacaatcattgcctctgtagttggcggagcgctcttcatcgtgctcgtgagtgttctcgcaggtattttttgctatcgcaggcggcgaaccttcagaggcgattattttgccaaaaattacattccaccttctgacatgcaaaaagaatctcagatcgatgttcttcaacaggatgaacttgattcttaccctgactctgtgaaaaaagaaaataagaaccccgtgaataatctcataagaaaggactacctggaagagccagagaaaacccaatggaacaatgtggagaatctgaataggtttgagcgtcccatggactattacgaggatttaaagatgggaatgaagtttgtttctgacgagcattatgacgagaatgaggacgatttggtttctcacgtggacggaagcgtgattagtcggagagaatggtacgtatag

SEQ ID NO: 235290 - DNA, 1464 bp, Artificial Sequence
  Description of Artificial Sequence: Synthetic coding sequence
atggcagaaggctggcgttggtgttttgtgagaaggacgcccggactgttaagaggacccctgcttcctcgtagcttttcaggcaatccgagagccctcgcagggcctatcatcgtggaaccccacgtaactgctgtttgggggaagaacgtgtctcttaagtgtctgatcgaggttaacgaaacaatcactcagatatcttgggagaaaatccacgggaagagctcgcagacagttgccgtgcaccacccgcaatacggattttctgtccaaggtgagtatcagggcagggttctgtttaaaaattattccctcaacgatgcaactataacgctgcacaatataggtttttcagacagcggaaagtatatctgcaaagctgtaacttttccccttggcaatgcacaatccagcactacagtcactgtgcttgttgaacctacggtaagccttatcaagggacctgactcgctgattgatgggggaaacgagacagtagccgctatttgtatcgctgcaaccggaaaaccggtggcccacattgactgggaaggcgacctcggcgaaatggaaagcactacaacatcattccccaacgaaaccgcaacaatcatctcccagtataagttgtttcccacccgattcgctagggggagaaggattacgtgcgtggtgaaacaccccgctctcgagaaggatattagatactccttcatcttggatattcagtatgccccagaggtgtccgtgacagggtatgacggaaattggtttgtaggcaggaagggggtgaacctcaaatgtaatgcagacgctaatccaccaccgtttaaatcagtctggagccgactggacggacaatggccagatggcttgttagcatccgacaacacactgcattttgtgcaccctcttacctttaattattctggagtttatatttgtaaggtaaccaattcactaggccagaggtctgatcagaaagtgatttatattagcgatgtgccgttcaaacagacaagtagcatcgctgttgccggagcagtgatcggagcggtcctagctcttttcattatcgcaatttttgtgaccgttctgctgactccaagaaagaagcgcccaagttacttggacaaagtgattgacttgcctccaacccataagcctcctcctttgtacgaagagagatccccaccacttccccagaaagacttgtttcagcctgagcacctgccccttcagactcagtttaaggagcgggaagtgggcaatttacagcacagcaacggcctgaacagccggtctttcgattacgaagacgagaacccagtgggcgaggacggcatccaacagatgtacccgctctataatcagatgtgctatcaggacagatcacctggcaaacatcaccagaacaacgacccaaagcgagtgtacatcgaccctcgcgagcactacgtgtag

SEQ ID NO: 235291 - DNA, 1533 bp, Artificial Sequence
  Description of Artificial Sequence: Synthetic coding sequence
atgcctctcagcctgggcgctgagatgtgggggccagaggcttggcttctgctccttttgctgctggcctcatttacagggaggtgtcctgccggtgaactcgaaacctctgacgttgtgaccgtcgtgctgggacaagatgctaagctgccatgtttttacagaggcgactcaggcgagcaagtgggacaagtggcctgggcccgtgtcgatgccggagaaggcgcacaggagctggccctcttgcactccaaatatggtctccacgtcagtccagcctatgagggccgtgtggaacagccaccacccccacgcaaccctcttgacggaagtgtgctcctcagaaacgccgtgcaggccgatgagggtgagtacgagtgtcgcgtcagcacgtttccagcaggttctttccaggccaggctccgtctacgcgtcctcgtgccccctctgccaagtttgaaccctgggccagccctggaagaaggccaaggactgactctcgcagcctcctgcactgccgagggtagtcctgctcccagcgtgacctgggacactgaggtcaaaggcaccaccagcagcagaagcttcaagcactccaggagcgcagctgttacctcagaattccacttagtcccaagcaggtccatgaatggccaaccgctgacatgtgtggtgtcacatccgggactgctgcaggaccagcggattactcatatactgcatgtgtcattcctggccgaggcatcggtgcgcggtctagaggaccaaaatctgtggcatatcggccgagagggggctatgctgaaatgtctttcggaggggcagccaccgccatcctataactggaccagactcgacggcccattaccctctggcgttcgggtggatggcgatactcttgggttcccccctcttactaccgagcactcgggcatttatgtgtgtcacgttagcaacgaattcagctccagggactctcaggttactgtagatgtgctagatccacaggaggactctgggaaacaggtcgaccttgtttctgcatctgtagtggtggtcggggtgatcgccgctctgttgttttgcctgctggtcgtcgtggtggtgctgatgtctaggtaccataggcggaaggcacagcagatgactcagaaatatgaggaagagctgacattaactcgcgagaatagtattcggagacttcacagccaccacacggacccaaggtctcagcccgaggaatctgtgggtctgcgggcagagggccatccagattcactgaaggacaactcatcctgcagcgttatgagcgaggaacctgaaggacgctcctactctactctcaccacagtaagagagatcgaaacgcagacagaattgctctctcccggatccgggagggccgaagaggaggaagaccaggacgaagggattaagcaggccatgaaccactttgtccaagagaatggtacacttagggcaaaacccaccggaaatggtatctatattaacggcagagggcacctggtgtag

SEQ ID NO: 235292 - DNA, 660 bp, Artificial Sequence
  Description of Artificial Sequence: Synthetic coding sequence
atgcttaagtgcttatcagaaggacaacccccaccctcctacaattggacaaggctcgacgggcctttaccttcgggagtgagggtggacggggatacactcggattccctccactgaccacagagcacagcggaatctatgtgtgtcacgtttccaatgagttcagctcaagggactcgcaggtgacagtggacgttctggacccacaggaggacagcggcaagcaggtggatctggtctctgcatccgtggtggtggtgggtgtgatcgccgctctgctgttctgccttctggtggtggtcgtcgtgctgatgtctaggtatcaccggagaaaagcacagcagatgacccagaagtatgaggaagaactgacactgacgagggagaactctattaggagactgcacagccatcacacagatcctaggagccagtcggaggagccagagggcagatcttactccactttgactaccgtgcgcgagattgagacccaaaccgagttgctctcccctggatcaggtcgcgctgaggaggaggaagaccaggacgaggggattaagcaggcaatgaatcactttgtgcaggagaacgggacactccgggcaaagcctacggggaatgggatctacatcaatgggagagggcacctggtgtag

SEQ ID NO: 235293 - DNA, 2058 bp, Artificial Sequence
  Description of Artificial Sequence: Synthetic coding sequence
atggagctgcttaggaccatcacataccaacccgctgcttctacaaagatgtgtgagcaggcccttggaaaaggctgcggagccgacagtaaaaagaagaggccccctcaacctccagaagaatctcagccaccccagtcccaggcccaggtcccccctgcagcgccacaccaccaccatcatcattctcatagtggcccagaaatcagcaggattatagttgacccaactacggggaaacgttattgcaggggcaaagtcctgggaaagggcggatttgcaaagtgctacgaaatgacagacctcaccaataataaagtttacgccgcaaagataattcctcatagtcgggtcgccaaacctcaccagcgtgagaagattgacaaggagattgagctccaccggattttacaccacaagcatgtggtacagttctaccactacttcgaggacaaagaaaatatatatatcctactcgaatattgttcccggagaagcatggcccatatcctaaaagccagaaaagtgttaactgaaccagaagtcaggtattatttacggcagattgtatccgggctcaaatacctgcacgagcaggagatccttcatagggatctgaagttgggcaacttttttatcaacgaggctatggagctcaaggttggcgatttcggccttgctgcacggctagagcctctggagcaccggcgacgcaccatttgcgggacacccaactacctctctccagaggttcttaacaaacagggccacggatgtgagtccgatatttgggctcttggttgcgtgatgtatacaatgctcctgggaagacctccgttcgaaacaactaatctgaaggagacatatcggtgtattagagaagcgaggtacacaatgccaagctccctactcgctcccgcaaagcacctcattgcaagtatgctgtcaaagaatcctgaggatcgcccttctctggatgatattattcgtcacgactttttcctacaaggatttacaccagatcgcttgagttcctcttgttgtcacacagtgccagactttcatttgagttcaccagccaagaacttttttaagaaagccgcagcggctcttttcggcggtaaaaaggacaaggccaggtatatcgacactcataatcgggttagtaaggaagatgaggatatctataagctgcgccacgatttgaaaaagacctcaattactcagcaaccctctaagcaccggactgatgaggaactgcagccccctacaactactgtggcaaggtctggcactccagcggtggaaaacaagcaacagattggcgacgctattcggatgatagttcgcggaacactgggatcctgctcaagcagctccgagtgtctagaggactcgaccatgggatcagttgcggacacagtggcacgcgtgttgcgtggatgcttggagaacatgccggaggcggattgtattcccaaggaacagctcagcactagttttcaatgggtgactaagtgggttgactatagcaataagtatggcttcgggtatcagctttcagaccatacagtaggtgtgttgttcaataacggagcacacatgtcactgctccctgataagaaaacggtccactactacgccgaactcggacagtgttccgtatttcccgctacagacgccccagaacagttcatctcccaggtgacagtgctgaaatatttcagccattacatggaagagaacttaatggacggcggagaccttccgtctgtgacagatatcagacggccacgcctgtacttattgcagtggttaaagtctgataaagctctgatgatgctgtttaacgacggaacattccaagttaacttctaccatgatcacactaagatcattatatgctcccagaatgaggaatacctgttgacctacattaatgaggatcggatctcaacaactttcaggcttacaaccctactcatgagtgggtgcagctccgagctaaaaaatagaatggaatatgcgctgaatatgctgctgcagcgctgtaactag

SEQ ID NO: 235294 - DNA, 1164 bp, Artificial Sequence
  Description of Artificial Sequence: Synthetic coding sequence
atggaattactgagaacaattacgtaccaacctgcagcctccactaagatgtgcgagcaggcactggggaaagggtgcggcgcagatagtaagaaaaagcggccacctcaaccccctgaggaaagccagcccccacagtcccaggcgcaggtccctccagagattagtcggattattgtggatcctaccaccgggaagcggtattgtcgcggaaaggttcttgggaaggggggatttgccaaatgttacgaaatgacggatctgacgaacaacaaagtatatgcagccaaaatcattcctcacagtagggtggcgaaacctcaccaacgggagaagatagacaaggagatagaattgcaccgtatactgcatcacaagcatgtcgtgcagttctatcactacttcgaggacaaggagaacatctacatcctcctcgagtattgttcaaggcgcagtatggcccacatacttaaggcacgcaaggtgttgaccgaaccagaagttagatattacctacgacagatcgtatccggcttaaagtacctgcacgagcaggaaatcctccatcgcgaccttaaattgggaaatttctttataaatgaagctatggagttgaaggtaggggatttcggcctggccgctcggctcgaaccactcgagcaccgcaggagaacgatctgtggcacgcctaattacttatcaccagaggtgcttaacaaacaggggcacggatgtgaatccgacatttgggctttgggttgcgttatgtataccatgttactcggcagacccccattcgaaacgaccaatttgaaggaaacctatcgctgtatcagggaggccaggtacactatgccaagctcccttctggcaccagccaaacatctaattgcttcaatgctctccaagaaccccgaggacagaccgagtctcgatgatattattaggcatgattttttctgtagggcttcactgcgaaccgattgcctgttagccgttgtgattcagttccagatatcaacttatcaggctcagctgcggatcagtcttcggaaacagttacttctcttcctggtggctaaaaagacgaagcaagatatcctgactcacattatagagtgcctgaagaagatgaagacctccacatccctgggcatgatttag

SEQ ID NO: 235295 - DNA, 1140 bp, Artificial Sequence
  Description of Artificial Sequence: Synthetic coding sequence
atggagttgctgcgcacaataacttaccagcccgcagcatccaccaagatgtgtgagcaagctctgggaaagggctgtggagccgactcaaagaagaagagacccccacagcctcccgaagagagtcaaccccctcaatcccaagcccaagttccccctgcagccccacaccaccatcaccatcacagccattccggcccagagatcagtaggatcatcgtggatcccacaactggcaaacggtattgtcggggaaaggtgttgggtaaaggagggtttgcgaaatgttatgagatgactgatttgacgaacaataaggtgtatgccgcaaaaatcattccccatagccgcgtggctaagcctcaccaacgcgagaaaattgacaaagaaatcgaattgcaccgcatcctccatcacaagcacgttgtgcaattctaccattactttgaggataaagagaatatatacatattgctcgagtattgcagcagaagatctatggcccatatcctaaaagccagaaaagttcttacagagccggaagtgcggtactacctgaggcagatcgtttccggccttaaatacctgcatgagcaggagatcctccatagagatctcaagttaggcaatttttttattaacgaagcaatggagcttaaggtcggtgacttcggcctggccgcaaggcttgagcctctggaacaccgccgacggactatctgcggaacacctaactatttgagcccggaagtgctcaacaagcaagggcacggctgcgagagtgatatctgggccctcgggtgcgtcatgtatacaatgctgctgggccgaccccctttcgaaactactaatctgaaggagacttatagatgcataagggaagcgaggtacacgatgcctagcagtctgcttgcaccagcaaagcatctgatcgcatccatgctgagtaagaaccccgaggaccgcccttctctcgatgatatcattcgacatgatttctttctgcagggctttaccccagatagactgtcctcctcatgctgccacaccgtgccggactttcatctcagctcccctgcaaaaaatttttttaaaagggccgctgaacacattataagtgtgggtcaccaaatggggtag

SEQ ID NO: 235296 - DNA, 1476 bp, Artificial Sequence
  Description of Artificial Sequence: Synthetic coding sequence
gtagatctgttaagagctggagaagtgcccaaaccatttcctactcattacaaggatctgtgggacaataaacacgtcaagatgccctgtagtgaacagaacctctaccctgtcgaagacgaaaacggggagcgtacagccggttctcggtgggaactgatccagacagcactcttaaataaattcacccggccacaaaaccttaaggacgcaattttgaagtacaacgtggcctactctaagaaatgggattttacagctcttatcgacttctgggacaaagtgctggaggaagccgaggcacaacatctgtatcagtctattctccctgacatggtcaagatcgcgctatgtctcccaaatatctgcactcaacctatcccccttctgaagcagaagatgaatcactccattacaatgagccaagagcagattgcaagtctactagccaacgcttttttctgcacattccccaggcgcaacgcgaaaatgaagtctgaatattcgagctatccggacattaatttcaaccgacttttcgaagggcgatcaagccgcaaacccgaaaaactgaaaactctcttctgctacttcagacgagtcaccgaaaaaaagcctacagggttggtcacttttactcgacagagtctggaggatttccccgagtgggaaagatgtgaaaaaccactcaccaggctgcacgtcacctatgagggcactattgaagagaacgggcaaggcatgttgcaggtcgactttgcgaaccgcttcgttggcggaggtgtaactagcgccggtcttgttcaagaggaaatacgcttcctcatcaaccccgaattgatcatctctagactcttcactgaggttcttgaccacaatgagtgtcttataatcaccggtacggagcaatactcagagtatacgggttacgccgagacttaccggtggtcacgatcccacgaggatgggagtgagagagatgactggcagcggaggtgcactgaaatcgtggcgattgatgctttgcacttcagacggtatttggaccagttcgtccctgaaaagatgaggagagaactaaacaaagcttattgtggtttcttgagaccaggcgtgtccagcgagaacctgagcgctgtggcaacaggaaattggggatgcggagctttcggcggagacgctcggcttaaagccctaatacagatcctggcagctgctgccgctgagagggatgtggtttatttcacctttggcgattccgagttgatgcgggacatctattcaatgcacatcttcctcacagagcgtaagctcacagtgggcgatgtttataaactgctcctgcggtactacaacgaggagtgccgtaactgttccactcctggtcccgacatcaaactctatccctttatttatcacgccgtggagagctgtgctgagacagcagatcattcaggtcaacggacggggacctag

SEQ ID NO: 235297 - DNA, 579 bp, Artificial Sequence
  Description of Artificial Sequence: Synthetic coding sequence
tgaaccgagcagtattctgaatacacagggtatgctgagacatacaggtggagcaggagccacgaggatgggtcagaacgagatgactggcaacgacgttgcacggagatcgtagctattgatgcactccattttaggcggtacctcgaccagtttgtaccagagaagatgcgaagggaattgaacaaggcttattgcgggttcttaaggcctggagtctcgagcgagaatctgagcgccgtggctacgggcaattggggctgtggcgcttttgggggagatgccagattaaaagcacttatccagattctcgccgcagcagccgcagaaagagatgttgtgtactttacctttggggacagcgagctcatgcgtgatatctatagcatgcatatcttcttgactgagcgcaaactgaccgtcggagatgtctacaagctgttgctgcggtactacaacgaagaatgccgtaactgcagcacccccggtccagacataaagctttatcccttcatttaccatgccgtggagtcttgcgcagagaccgctgaccactccggccagagaactggcacttag

SEQ ID NO: 235298 - DNA, 468 bp, Artificial Sequence
  Description of Artificial Sequence: Synthetic coding sequence
atggcagagtccagcgataaactgtatagggtggaatatgctaaaagtgggagagcctcatgtaaaaaatgttctgagtccattccaaaggattctctgagaatggctataatggtgcaatcccctatgtttgatggcaaggtgccacattggtatcattttagctgcttctggaaggttggacacagcatccgacaccccgacgtggaggttgacggcttctcagaactgagatgggacgaccaacagaaagtgaaaaagactgctgaggctggaggagtgactggggtgtacattctgggccagcacggccactctgcccctacattaaagctgcccggtgggccaagattgcgggagcagtctaaacctccgcctgcatgtcctctcccccacgtccaaattaaaagaatggtaccaatgcttttccaacaacacttgctggactctgcaagcagcgtggcgtag

SEQ ID NO: 235299 - DNA, 327 bp, Artificial Sequence
  Description of Artificial Sequence: Synthetic coding sequence
atggccgagtcgtctgacaaactgtacagggtggaatacgctaagagcggcagagcttcctgcaagaagtgtagcgagtcaattccaaaggattctctcagaatggcgatcatggtgcagagcccaatgttcgacgggaaagtgccacactggtatcacttttcgtgcttctggaaagttgggcacagcatccggcaccctgacgtcgaggtggacggtttctcggaactcagatgggatgatcagcagaaagtgaaaaaaaccgctgaggccggaggcgtaaccgagcctcctatcccctgcggtattgaagtgatgggacgctag

SEQ ID NO: 235300 - DNA, 327 bp, Artificial Sequence
  Description of Artificial Sequence: Synthetic coding sequence
atggctgagtcatccgacaagctttatagggtggagtacgcaaagtcggggcgtgcaagctgtaagaagtgctccgagtcaatcccaaaggatagcttgcgcatggcgattatggtccagtctcctatgtttgatggaaaagttccccattggtaccacttctcctgcttctggaaagtcggacactccatccgccaccccgatgtcgaagtcgacggcttcagcgagcttaggtgggatgatcagcagaaagtgaagaaaacagcagaagccggaggagttactgagcccccaatcccctgcggaattgaagtgatggggcgatag

SEQ ID NO: 235301 - DNA, 3045 bp, Artificial Sequence
  Description of Artificial Sequence: Synthetic coding sequence
atggcggagagctctgataagctgtacagagtcgagtacgccaaatccgggagagcctcctgtaaaaagtgtagtgaatctatacctaaggacagcttgagaatggccattatggtgcaatccccaatgttcgatggtaaggtgccccactggtaccatttctcttgcttttggaaggtcggacattcaatcaggcatcccgatgtggaggtcgatggcttttcggagctgcgctgggacgatcagcagaaagtgaaaaagacagccgaggccggaggagttactggtaaggggcaggacggaatcggaagcaaagccgaaaagacgctgggagattttgccgcagaatatgcgaagagcaaccgttccacttgcaaagggtgcatggagaaaatagaaaaaggccaagtccggttgagcaaaaagatggtggacccagagaagccgcagctgggcatgatagatcggtggtaccacccaggatgcttcgtgaagaatagagaggaactcggattccgccctgagtatagtgcatcacagcttaagggattcagtttactggccacggaggataaggaggccctgaagaaacagttacccggtgtcaagtcagagggtaaaaggaagggcgatgaggtggatggcgttgacgaagtggcaaaaaagaagagtaagaaggaaaaggacaaagatagcaagctggaaaaggctctgaaggcacagaatgacctgatctggaacattaaggacgagcttaagaaagtgtgcagcacgaatgacctcaaggaactccttatcttcaataagcaacaggttccctcgggcgagtctgcgattctcgacagagtagccgacggaatggtgttcggggctctcctcccctgcgaagagtgctcagggcagttggtgtttaaaagcgacgcgtattattgtactggtgatgtgacagcctggacaaaatgtatggtcaagactcagacaccaaataggaaggagtgggtcactccgaaagagttcagggagatctcatacttgaaaaaactgaaggtcaaaaaacaagacaggattttcccgcctgagacctctgcctccgtggccgctactcctccaccgtccaccgcctccgctccggctgctgtcaacagttccgcatcagcagacaaaccccttagcaatatgaagatacttacattgggcaaactcagtcgcaataaagacgaggtgaaggctatgatcgaaaaactcggcggaaaactcactggtaccgcaaataaggcttccctgtgcatctccaccaagaaggaggtggaaaaaatgaacaaaaaaatggaagaggtgaaagaagcaaacatacgcgtggtcagcgaagacttcctgcaggacgtttcagcctcaactaaaagcctgcaggagctgttcctggctcacattctgagcccttggggggcagaggtaaaagccgaacccgtcgaggtggtggcgcctcgaggcaagtctggcgctgctctctccaagaagtcgaaggggcaggttaaggaggaagggatcaataagtccgagaagcgcatgaagctgaccctgaaagggggagccgcagtggatccagacagcggcctggaacattccgcccatgtcttggagaaaggcggaaaggtgtttagtgccaccctgggtttagtggatattgtgaaaggcactaattcatactacaagctgcagttgctggaggacgacaaggagaaccggtactggattttcaggtcttggggcagggtagggactgtgataggttccaacaaactggaacagatgcccagtaaagaagacgccatagaacactttatgaagctctacgaggaaaaaactgggaacgcctggcatagtaaaaactttactaaatacccaaagaagttctatccgctcgagattgactatggccaggatgaggaagccgtcaagaagcttactgttaacccgggaactaagtccaaactgcctaaacccgtccaagacctgatcaaaatgatatttgacgtggagtcaatgaaaaaagcgatggtagagtatgagatcgatctgcaaaagatgccactggggaaattaagtaagaggcaaattcaggcggcttattcgatcctgtccgaggtgcagcaggccgtaagccagggcagctctgattcacagattctcgacctgtctaacagattctatactctcattccacacgattttggaatgaagaagcctcccctcctaaataacgcagattccgttcaggccaaagttgagatgcttgacaacctcctcgatattgaagttgcctactctctgctgcggggagggagcgacgatagttcaaaggaccctatcgatgtcaactatgaaaagctgaaaaccgacattaaggttgtggatagagacagcgaagaggcggagattatcagaaaatatgtgaagaacacacacgcaacaacacataacgcatacgacctggaggtgattgacatatttaagattgaacgcgaaggcgagtgtcagcggtacaaacccttcaaacaattgcataataggagactgctttggcacggaagtcgcacaaccaacttcgcaggaatactgtcccaaggactgcggatcgcccctccagaggcccctgtgacaggttatatgttcgggaaaggcatctacttcgcagatatggtgagtaaatccgcgaactactgtcacacatcccaaggcgaccctatcggcctcatccttctgggtgaggtcgcgctgggtaatatgtatgagctcaaacacgccagtcatatcagtaagctgccaaaaggtaagcatagcgtaaaaggacttggaaagaccacccccgacccctcggccaacattagcttagatggcgttgatgtccctctgggcactggtatctcctctggtgtgaacgatacctccctgctctacaacgaatatattgtctacgacatcgcccaagtgaacctcaaatacctcctgaaacttaagtttaactttaagacatctttatggtag

SEQ ID NO: 235302 - DNA, 753 bp, Artificial Sequence
  Description of Artificial Sequence: Synthetic coding sequence
atggcagaatcaagcgacaagttgtatcgagtcgaatatgctaaatctggcagagcaagctgcaaaaagtgttccgagtcaatacccaaagattccctgcgcatggctatcatggtccagtcgccgatgttcgatggcaaagtgccccattggtatcacttctcttgcttttggaaagttggacactccatcaggcaccccgacgtggaggtggatggcttttcagagctgcgctgggacgaccagcagaaggtgaaaaagacagccgaggccggaggcgtgactggcaaaggccaagacggcattggcagcaaggctgagaaaaccctaggagatttcgcggcagaatacgccaaaagcaataggagcacctgcaagggctgcatggagaagattgagaagggccaggtgagattatctaaaaagatggtcgatcccgaaaaaccccaactcggtatgattgatcgttggtaccaccctgggtgttttgtgaaaaatcgagaggaactcggcttcaggccagaatactcagcttctcagcttaagggctttagtttgttggctacagaggataaggaagctctgaaaaagcagctccccggagtcaaaagtgagggcaaaaggaagggggacgaagtggacggggttgacgaagtcgccaagaaaaaatccaagaaggagaaagataagaagaaaaagaaaaagaagaaaaaggaaagaaaaaaaaagaaaaaaaaacgcaagaaaaagtag

SEQ ID NO: 235303 - DNA, 2133 bp, Artificial Sequence
  Description of Artificial Sequence: Synthetic coding sequence
atggatttctcaatggtggccggagccgcagcatataacgaaaagtccgaaaccggggctctgggggagaactattcctggcagatccccattaaccacaatgatttcaagatcttgaagaataatgagaggcaactatgcgaggtgcttcagaacaagttcggatgtattagtaccctcgtgtctcccgtgcaagagggcaattctaagtctctgcaggtctttcgtaagatgcttacacccagaattgaactgtctgtttggaaggacgacctcaccacccacgcagtcgacgccgtggtaaatgccgcaaacgaggacctgcttcacggtggcggactggccctcgccctggttaaagcaggcggattcgagatccaggaggagtctaagcagttcgtggcacggtatggtaaagtgtctgctggagagatagcggtgaccggagccggaagactgccatgtaaacagatcatccacgctgtgggccctcgttggatggaatgggacaagcagggatgcaccggtaagttgcaacgtgccattgtgtctatattgaactatgttatctacaaaaacactcatattaagactgtagccattcctgccctgagttcaggcattttccaattccctctcaacttgtgcaccaagacgattgtagaaacaatccgggtgtctctgcaaggtaaaccgatgatgtcaaacctaaaagaaatacacttggtctccaatgaggaccctaccgtcgctgcttttaaggcagcctccgagttcattttgggcaaatcagagctgggccaggaaacaactccctctttcaatgctatggtggtgaacaacctcacgctgcaaatagttcagggtcatattgaatggcagactgccgacgtgatcgtgaactcagtcaaccctcatgacatcactgtagggcctgtggctaaatcgatcttgcaacaggctggggtcgagatgaagtccgagtttctggccaccaaagcaaaacagtttcaacgctctcagcttgtccttgtcacaaagggattcaatctcttttgcaaatacatctaccatgtcctatggcatagtgaatttccaaagccccagatcctgaagcacgccatgaaggaatgtcttgagaaatgcattgagcagaatattactagtatttccttccccgctcttggtaccggcaatatggagatcaaaaaagagaccgctgcggagatcctttttgatgaagtgctgacgtttgcgaaagaccacgtaaagcatcagctgaccgttaagttcgtgatttttccaactgatctggaaatttacaaagcgttttcctcagaaatggcaaaaagatctaagatgctgagccttaataactatagcgtccctcagagcactcgcgaagagaagcgggagaacggtcttgaggctagaagccctgcgatcaacctgatggggttcaatgtagaagaaatgtacgaggctcacgcatggattcaaaggattctaagcctccaaaatcaccatattattgaaaacaatcatattctgtacctcggaaggaaggagcacgatatccttagccagctgcaaaaaacatcttccgtttcgattaccgaaatcatctctccgggaaggactgagctcgagatcgaaggagcacgggctgatttaatcgaagtcgtgatgaatatcgaagatatgttatgcaaggtgcaggaggagatggctaggaaaaaagaacggggtttgtggaggtcgttgggccaatggacaattcaacagcagaagacccaggacgagatgaaggagaatataatttttctgaagtgtcctgtgccgccaactcaggagctcctggaccaaaagaaacagttcgagaagtgcggattgcaggtgctgaaggtggaaaagatcgacaatgaggtattgatggctgcattccaacgaaagaagaaaatgatggaggagaagctacatcgtcagcccgtgtcgcaccggctgttccagcaggtcccctatcagttctgcaatgtggtatgcagagtgggatttcaaaggatgtacagcacaccctgtggaagatgccagtgtttgatcattggagccaccctgtggaacctagtgagttag

SEQ ID NO: 235304 - DNA, 2460 bp, Artificial Sequence
  Description of Artificial Sequence: Synthetic coding sequence
atggacttttccatggttgccggtgctgccgcttacaatgaaaagtctgagacgggtgcacttggcgagaactactcttggcagatccccatcaaccacaacgacttcaagatcttgaaaaataacgaaaggcagctctgcgaggtgctgcagaataagttcggctgcatttccacactggtctcccctgtccaggaagggaatagcaaaagccttcaggtctttcgaaagatgctaactcctagaattgaactctccgtctggaaggacgaccttactacgcacgctgtggacgccgtggttaatgcagctaacgaggaccttttgcacggcggtggacttgctctcgctttggtgaaggcaggcggattcgaaattcaggaagaatccaagcagtttgtcgcccgatatgggaaggtgagcgccggtgagatagcagtgaccggcgctggtcggctcccctgcaagcagatcatccatgcagtcggcccaagatggatggagtgggacaaacagggctgtaccgggaagctgcagcgagcaatcgttagcatcctgaactatgtgatttacaagaacacacacattaaaacagtagccatccctgcactgagtagtggcatctttcagtttcccctaaacctctgcactaaaaccatcgtggaaacgatcagggttagtctgcagggcaagcctatgatgagcaacctcaaagagatccaccttgtaagtaatgaggatccgaccgtggcagccttcaaagctgcgtccgagtttattcttggcaaatccgaacttggtcaagaaactactccctcgttcaacgccatggtggtaaataacctgacactgcagatagtccagggccacattgaatggcagaccgcggacgtgattgtaaactctgttaatcctcatgatattacagtggggccagtcgcaaagagcattctacaacaggcaggtgtcgaaatgaagtcagaatttcttgcaacaaaagctaagcagttccagaggtctcagttagtcctggtcacaaagggctttaacttattctgtaagtatatttaccatgtactgtggcattctgaattccccaagccgcagatcctgaagcacgctatgaaagagtgtcttgaaaaatgtatagaacaaaacataacctccattagttttccggcactaggtacaggaaacatggagattaaaaaggaaactgcggcagaaattttgttcgatgaggtcttgacctttgccaaagatcacgtgaaacatcaactgaccgttaagtttgtcatattccctaccgatctagaaatctacaaggcattttcgtctgagatggctaagagaagcaagatgctgtcactgaacaactatagtgtccctcagtctacgagagaggagaagcgagagaacggcctggaggctcgtagccctgccatcaacttaatgggtttcaacgttgaagagatgtatgaggcacatgcttggatccaaaggattctgtctctgcagaatcaccatatcatcgaaaataaccatatactgtacctcgggaggaaagagcatgacattctgagtcagttacaaaaaaccagttctgtctctatcaccgagatcattagccccggaaggaccgagctggagatcgaaggggcaagagccgacctaatagaggtagtgatgaatatcgaggatatgctgtgcaaagtgcaggaggaaatggctcggaaaaaggagcgaggattatggcggtcccttgggcaatggaccatccagcagcagaaaacccaagatgagatgaaggagaatattatattcctcaaatgccccgttccgccaacacaggaactactcgaccagaagaagcaattcgaaaagtgcgggttacaagtgctcaaggtggaaaagatcgataacgaggtgcttatggcggcatttcaacgaaagaagaagatgatggaggaaaagctgcatcggcagcctgtctcccaccgattattccagcaggttccttatcagttctgtaatgtggtgtgtcgggtcggcttccagaggatgtactcaactccctgtgaccccaagtacggcgcaggcatatattttacaaagaacctcaaaaacctggcagaaaaggccaaaaaaatctctgcagccgacaaactaatttacgtctttgaggccgaagttcttacaggtttcttctgccagggacaccctctgaacatcgtgcctccccctctgtctcccggagctatagatggccacgactcagtcgtcgataacgtcagcagccccgagacattcgtgattttctcaggcatgcaggccatacctcagtatctgtggacctgcacacaggaatacgtacagtcccaggactactctagcggccctatgcggccatttgcccaacacccatggagggggttcgcgtctggatctcccgtagattag

SEQ ID NO: 235305 - DNA, 2106 bp, Artificial Sequence
  Description of Artificial Sequence: Synthetic coding sequence
atggcccaagctggcgttgttggggaagttacacaagttttatgtgcagccggaggagcccttgagttgcccgaactgcgacggaggctgcggatgggactgtcagctgatgcccttgaaagactgctgaggcagcggggacgcttcgttgttgcggtccgcgctggtggcgcagcagcggcacctgagagggtcgtcttggccgcatcacctttaaggctatgtcgcgctcaccaggggtctaaacctggatgtgttggtttgtgtgctcaactgcacctgtgccggttcatggtgtacggcgcatgtaaattccttcgcgcaggcaaaaactgccgtaattcacacagcctgaccacggagcataatctcagtgtcttacgcactcacggggtggaccatctgagctacaacgaattgtgccagctgctgtttcagaatgacccatggctactccccgagatctgtcagcactacaataaaggcgatggacctcacggaagctgcgcattccagaagcaatgtattaagttacatatttgtcagtacttcctccagggggagtgtaagttcggcacttcatgcaagagatcacatgactttagcaactctgagaatctggagaagctggagaaactcggaatgtcctcagacctggtgagtagactgccaactatctaccggaacgcacacgatattaaaaataagtcttccgcccctagtcgagttccgcctctattcgtcccacaagggacctccgagcgcaaagactcatctggatctgtttcccccaatactctgtcccaagaggaaggcgaccaaatctgtctataccacatccgaaagtcatgttcatttcaagataagtgccatcgagtgcactttcacctgccatatcgctggcagtttctggacaggggcaaatgggaggatctagacaacatggagctcatagaggaagcctactgtaacccaaagatcgagcgaatcctgtgcagtgagagcgcatctacattccactcgcattgcctgaactttaatgcgatgacgtatggggcaacacaggcacggcgtctgagcacagcttcctcagtcaccaagccccctcatttcatcctgacaaccgactggatttggtactggagtgatgaatttggctcttggcaagagtacggccgtcaagggaccgtccatcctgtgacgacggtctcaagcagtgacgtcgagaaagcatatctcgcatactgtactcccggaagtgacgggcaggcagccaccttgaaattccaagccggaaagcacaactacgaattggattttaaggccttcgtacagaagaacctcgtctatgggacaaccaaaaaagtatgcaggagaccaaagtacgtgtcgccccaggacgtaaccaccatgcagacatgcaataccaaattccctgggccaaaatctatcccagactactgggatagttcggctcttcccgacccaggctttcagaagatcacacttagttccagctctgaggagtatcagaaggtctggaacctgtttaataggacgctcccattttactttgtacaaaaaattgaaagagtgcagaatctggccctgtgggaagtgtaccagtggcagaaaggtcagatgcagaagcagaatggtggaaaggccgtagatgaacgtcagctctttcatggaacatcagcgatcttcgtggatgctatatgccagcagaacttcgattggcgggtgtgcggagtacacgggacaagctacggaaaagggtcctacttcgctagagatgctgcgtatagccaccattactctaaatcagatacccaaacacatacgatgtttctcgccagggttctggtcggcgagttcgttcgtggcaacgccagctttgttcgacctcctgccaaggaaggatggtctaacgctttctatgattcttgtgtgaactctgtctcggacccctctatatttgtgattttcgagaaacatcaggtgtatcccgagtatgtgatccagtataccacatctagtaaacctagcgtgaccccctctatattattagcacttgggtcactcttttcaagccgacagtag

SEQ ID NO: 235306 - DNA, 393 bp, Artificial Sequence
  Description of Artificial Sequence: Synthetic coding sequence
atgtttttggccagggtgctcgttggggaattcgtgagaggaaacgccagcttcgtgaggcctcctgccaaggagggatggtctaatgctttttacgattcttgcgtgaattctgttagtgatccctccatatttgtaattttcgaaaagaccagatccacacagagcatgagttcctctacaccacctcctccctccccccgatcacatcctccctcatgctggccttgggcaccctgcagcgccgctgactcggaaaggactggtgtcttccaggccttccacttgctgtgcctcgagatggcaatatgggccttcccgtttctcttcaaacagaagctgttaatgaactgttcgcttaatattgatctttccatgaagctgtgttcttag

SEQ ID NO: 235307 - DNA, 849 bp, Artificial Sequence
  Description of Artificial Sequence: Synthetic coding sequence
atgtcaaaactggctagctttctagggttcagcaagcagtccccccaaaaaaaaaaccatctagtgcttgaaaagaaaaccgaatccgccacattccgagtctgtggcgaaaatgtgacatgcgtcgaatacgccatcagctggttacaggatctcatcgagaaggaacagtgcccatacacatctgaggacgagtgcattaaagactttgatgagaaagagtatcaggaactgaatgagctccagaagaagctcaacataaatattagtctggatcataaacggcctctaatcaaggtgctgggaattagtagagacgtaatgcaagctcgagatgaaattgaggccatgattaagagagttcggttagcaaaagagcaggagtcaagagcggattgcatatcagagttcatcgagtggcagtacaacgacaacaacacctctcactgctttaataagatgaccaatcttaagctcgaggacgcgagacgcgagaaaaagaagacagtcgatgttaaaatcaatcacaggcactatacagtgaacctgaatacctataccgcaactgatactaagggccactccctctcagttcaacgcctgacaaaaagcaaagtcgacatccctgcacactggagcgatatgaaacagcagaatttctgcgtagttgagctcctccctagtgatccagaatataacactgtcgctagcaaatttaaccagacttgttcccactttcggattgagaaggtcaacgttatgataagagcgtgctcaccgtcctattgggaagcagaagtagagggcttacacgaaccaaggagcttgactccagtttgggttacgtag

SEQ ID NO: 235308 - DNA, 2394 bp, Artificial Sequence
  Description of Artificial Sequence: Synthetic coding sequence
atgtatctgcggaggctgcttcggccactgcagatgctcctggtgaaagaaggggtgcaaaatgccaagactgacgtcgttgtgaattccgtgccattggatctcgtattatcccggggtccgttatcaaaatctctgctcgaaaaggctggccctgagctacaggaggaactcgatacagtgggccaaggcgtcgcagtcagtatgggcactgtcttgaaaacaagtagttggaatcttgactgccgctacgttctgcacgtggtggctcccgaatggagaaatggaagcacaagctcgctaaaaatcatggaagatatcatccgagaatgcatggaaataacagaatccctgtccttaaagagcattgcctttcccgcaataggtaccggtaacttgggtttccccaaaaatatctttgccgaattaatcatctcggaggtgttcaagttttcctccaagaatcagcttaagaccctgcaagaggtccatttccttctgcatccctcagaccacgaaaacatacaagccttctctgacgagttcgccaggcgcgcaaatggcaacctggtttcagacaagatcccaaaggcaaaggacactcagggtttctacggcacagtttcgtccccagattcgggagtctacgaaatgaaaattggcagcattatatttcaggtggcttcaggcgacatcactaaagaagaggctgatgtgattgtgaacagtacttcaaattcattcaatttgaaggcaggagtgagcaaggctatcctcgagtgcgctggtcagaacgttgaacgagagtgttcccaacaggcacaacagaggaaaaacgactatattatcaccggtggcggtttcttgcgctgcaaaaatattatccacgtgataggaggaaatgatgtcaaaagcagcgtgtcctccgtgttgcaagaatgcgaaaaaaaaaattatagttcaatctgcctccctgcaattggcactggtaatgcgaagcaacaccccgataaggtagctgaagctatcattgacgcgatcgaagatttcgttcagaaaggaagcgcccagagcgtgaaaaaggtgaaggtcgttatattcctgccccaggtcctagacgtattctacgctaacatgaaaaaaagagaaggcacacaattgtcttcgcagcagtccgtgatgtccaaactagcatccttcctgggtttctccaagcagtcccctcagaaaaaaaaccatctcgttttagaaaaaaagaccgaaagtgccaccttcagagtctgtggcgagaatgtgacatgtgtcgagtacgccataagctggctccaggacctgatcgaaaaggaacagtgcccgtacaccagtgaggatgagtgtatcaaggactttgacgaaaaggaataccaagagctcaacgagttgcaaaaaaagctgaacataaacatatcgctggaccacaaaagaccgctgatcaaggtgttgggtatatccagggatgtcatgcaggccagagacgagattgaggccatgatcaagcgggtgcgactggccaaagagcaggaaagcagggccgattgtatcagcgaattcatagagtggcagtataacgataacaatacatcccattgttttaacaagatgaccaaccttaaacttgaggacgccagacgagagaagaagaagacggtagacgtgaaaatcaatcaccgccactacaccgtcaatctcaacacatacaccgccaccgataccaaagggcactctctaagtgttcagcgactaactaagtcaaaagtggatatccctgcacactggtccgacatgaagcagcagaacttttgcgtggtggaattgctgcctagcgatccagagtataacacagtggcctccaagtttaatcagacttgctctcactttcgaattgagaaaatcgaaagaatccagaaccccgatctgtggaatagttatcaggccaagaaaaagaccatggatgcgaaaaatggtcaaacaatgaacgagaagcagcttttccacggcacagacgcagggtccgtgccgcacgttaatcggaacgggttcaatagatcatacgcgggaaaaaatgctgtggcatacggcaaggggacgtacttcgcggtgaacgcaaattactccgccaatgatacttactctaggcccgatgcaaatgggagaaagcacgtgtattacgtccgcgtgcttaccggtatttacactcacgggaatcactcattgattgtgcctccttctaagaacccacaaaaccctactgacctgtatgataccgttaccgacaacgtacaccaccccagtctcttcgtggccttttacgactaccaagcctacccagaatacctgatcactttcaggaaatag

SEQ ID NO: 235309 - DNA, 5162 bp, Artificial Sequence
  Description of Artificial Sequence: Synthetic coding sequence
atggcagtcccaggaagctttccactcctcgtagaaggcagctggggtcccgatcctccaaagaacctaaatactaaattgcagatgtacttccaaagtcccaaaaggtctggaggcggagaatgtgaggttcgtcaggacccaagatcacccagccgattccttgtgttcttctatcccgaggatgtgcgacagaaggttcttgagcggaaaaatcacgaactcgtgtggcagggtaaagggaccttcaagcttacggtccagcttcccgcaactcctgacgagatcgaccatgtttttgaagaggaactgctgaccaaggaatctaaaaccaaggaggacgtcaaagagcctgatactataagattcgtggatgactgcacaaaacaccactctatcaaacaactgcagctcagtccgcgtctcttggaggtgaccaatacgattagagttgaaaacctgcccccaggggctgacgactactcactgaagctatttttcgaaaacccctacaatggaggcggtcgcgtcgcaaatgtcgagtattttccggaagagtcctccgcgctgatagaattcttcgataggaaggtgcttgatacgattatggctacaaaactggactttaataagatgcctctctcggtcttcccatactacgcttcgctcgggacagctttgtacggaaaggagaagccactcatcaaactgcctgcccctttcgaagagagccttgatctgcccctgtggaaattcctgcagaagaagaatcatcttattgaagagataaatgacgagatgcgtagatgccattgtgagcttacttggagtcagctctcaggaaaggtgaccatcaggcccgctgcaaccctggtgaacgaggggaggccgcgtataaagacctggcaggctgataccagcaccactctctcttctattcgaagtaaatataaggttaatcccattaaagtagaccctacaatgtgggatacaatcaaaaatgatgtcaaggatgatcggattttaatcgagttcgacaccctaaaagaaatggttattttggctggcaagtcagaggatgtgcagtccattgaggtgcaagtcagagaactcattgagtctacaacccagaaaatcaagcgggaggagcaatcgctgaaagagaagatgatcatttccccaggccgatatttcttactgtgccacagctccctcctggaccacctcctgactgagtgccctgagatcgaaatttgttacgaccgcgtaacacagcatttgtgcctgaaaggaccgagcgctgacgtgtacaaagctaagtgtgaaatccaggaaaaggtatatacaatggcccagaagaacatccaggtgtcccctgaaatattccagttcctgcagcaggtaaattggaaggaatttagtaagtgcctgttcattgctcagaagattctcgctctctacgagcttgagggaaccactgttctcctgactagttgcagtagtgaagcgctgctagaggccgaaaagcagatgttatcggccctcaattacaagagaatcgaggttgagaataaggaagtactgcacgggaagaagtggaaaggcctgacccacaatctgctgaagaaacagaacagttctcctaacactgtgattatcaacgagctgaccagcgaaactaccgccgaagtaatcatcaccggttgcgtgaaagaggtcaacgagacctacaagctcctgtttaacttcgtggagcagaatatgaagatagagcgactggtggaagtcaagccatccttggtgatcgactaccttaagactgagaagaagttgttctggccaaaaatcaagaaggtcaatgtgcaggtgtcctttaatcctgagaacaagcaaaaggggatcctgttaactggctccaagacagaggtcctaaaggcagttgacatcgtaaagcaggtgtgggactctgtctgtgtcaagtctgtccacaccgacaaaccaggagctaagcaattctttcaggacaaagccagattctaccagagtgaaatcaagcgtctgtttggatgctatatagaactgcaagaaaacgaagtaatgaaagaaggtgggtcccccgctggacaaaagtgtttttcccggacagtgttggcccctggtgtagtgctgatcgtgcaacagggggacctggcgagactcccagtagatgtggttgtgaacgccagtaacgaggatttgaagcattatgggggactggcggctgcgctttcgaaggccgcaggccctgagctccaggcagactgcgatcaaatagtgaaaagagaggggagactgctgcccggaaatgctactatctccaaggctggtaaacttccctaccatcatgtgatccacgcagtgggccctcgatggagcggatacgaagccccaagatgtgtctacctgctccgcagggcagttcagctgagcctttgtctggccgagaagtacaagtatcgctccattgcaatccccgcaatcagctcgggcgtgtttggatttcctctgggccgttgtgtcgagacaatcgtgagcgcaatcaaggagaacttccaatttaagaaggacggacactgcctgaaggagatatacttggtggatgtctccgaaaagacagttgaggcctttgccgaggctgttaaaacggtcttcaaagcaacattgcccgataccgccgcaccgcctggactgccccctgctgccgcaggcccagggaagacttcgtgggaaaaggggtcccttgtctcccctggaggattacaaatgcttcttgttaaggagggcgtacaaaacgccaagaccgatgtagtagtgaacagcgtcccgctcgacctggtcttgtctcgcggtccgctgtccaagtcacttctagaaaaagccggaccagagctccaagaagaactcgatacagtaggacaaggggtcgccgtgtctatggggaccgtgctgaaaacttcgtcatggaatctggactgccgatatgtgctacacgttgtggcccctgagtggcgcaacggcagcacatctagcctgaagatcatggaggacattatccgggaatgtatggagataacagagtctctctcgctcaaatctatcgcgtttcctgctattggtactggaaatttgggctttcctaaaaacatctttgcagagcttattatcagtgaggtgtttaaattcagcagtaagaaccagttaaagaccttacaggaagtccacttcctcctccatccatccgaccacgagaatatccaggcgttttccgacgaattcgccaggcgcgcaaatggcaacctcgtgagcgataagatcccaaaggctaaagacacccagggattctatggcaccgtgtcctctccggactctggcgtctacgagatgaagatcggaagtattatattccaagtggccagcggcgacatcactaaagaggaagcggacgtgatcgtgaattctacctccaatagcttcaacctgaaagtgggggtctctaaagctattctggaatgcgccggacagaacgtagagcgagaatgctctcagcaagctcagcaaagaaagaatgattacatcatcacgggcggtggcttcctcaggtgtaagaacattatccacgtcattggtggcaacgacgtgaaaagttccgtgagctccgtgttgcaggagtgtgaaaaaaagaattattcctccatatgtttaccagctatcggcacagggaacgcgaagcagcatcctgacaaggtagccgaggctataattgacgcaatcgaggactttgtacagaaggggtccgcccaaagtgttaagaaagtgaaagtggtcatcttcctgccacaggtgttagacgttttctatgcaaatatgaagaagcgcgagggcacgcagctctcctcacaacagtccgtaatgtccaaattagcatcattcctcggtttttctaagcagagccctcagaaaaaaaatcacctagtgctggagaaaaagactgagtcagcaaccttccgtgtttgtggcgagaacgtgacatgcgtcgagtacgccatttcatggctccaggacttaatcgagaaagagcagtgcccttacacttccgaagacgaatgtataaaggatttcgacgagaaagaataccaggaactaaacgaattgcagaagaagctgaatattaatatctccctagaccacaagagacctcttataaaagttttgggaatcagtcgggatgttatgcaggccagggatgagattgaagcaatgatcaagcgcgtgcgcctggccaaagaacaagagagcagagccgactgtatcagtgagttcatagagtggcagtataacgataataacacctcccactgttttaataaaatgacaaatcttaaactcgaggatgcccgaagagaaaagaaaaagactgtggacgttaagattaaccacagacattatactgtcaatctgaacacgtacaccgcaaccgacaccaaaggccacagcctgagtgtccaacgactgactaagtctaaagtggatatacctgcccattggtctgatatgaagcaacaaaacttttgtgtggttgagctactgccttccgaccccgaatacaataccgtggcctctaagtttaatcagacctgcagccactttcgaatcgagaagattgagagaattcagaatcccgatttgtggaattcatatcaggcgaaaaagaaaacaatggatgccaagaacggtcagactatgaatgaaaaacagctttttcatggaaccgatgctggctcggtgccccatgtcaatagaaacggcttcaataggtcttacgcaggcaagaacgcagtggcctacggaaaaggtacctatttcgcagtgaatgctaactattccgctaacgatacttattcccgacctgacgccaacggacggaaacacgtgtattacgttagggtgcttaccgggatctacactcacggtaatcatagcctgattgtgccccctagcaaaaatccccagaaccccaccgatctgtatgacactgtgacggacaacgtgcaccacccatctctgtttgtcgccttctatgactatcaggcctatcccgaatacctcatcacattcaggaagta

SEQ ID NO: 235310 - DNA, 5405 bp, Artificial Sequence
  Description of Artificial Sequence: Synthetic coding sequence
atggccgtgcctggatccttccctttactggtagagggctcatggggccctgatccgcctaagaacctgaacaccaaattgcaaatgtatttccagagtcctaaacggtccgggggtggggagtgcgaggttaggcaggaccccaggagtccgtccagatttctcgtgtttttttaccccgaggatgtccgtcagaaagtactcgagcgtaagaatcacgagctagtatggcaaggcaaaggcacattcaagctgacagtccagctccccgcaacacctgacgagatcgaccacgtatttgaagaagaactgttgactaaggagtcaaagacaaaggaggacgtgaaagaacctgacgtttcagaagagctcgacaccaaacttccactcgatggcggattagacaagatggaagacattccggaagaatgtgaaaatatatccagcttggtcgctttcgaaaacctcaaagctaatgtgacagatattatgcttattctactggtggagaatatctccggactttccaatgacgactttcaggtcgaaatcatccgagattttgatgttgccgtggtaactttccaaaaacatattgacaccataagattcgtcgacgattgcacaaagcaccattcgatcaaacagctgcagctcagccctcgcctgctggaagtaaccaatactatccgcgtggaaaatttaccccctggcgctgacgattattcactgaagctgtttttcgagaacccgtacaatggcggagggagggttgcaaatgtggagtatttcccagaagagtccagcgcactcattgagttttttgacaggaaggtattggacaccatcatggctacaaaactggacttcaacaagatgccactctcagtctttccttattacgcctctctcggaacagccctgtacggaaaagaaaagccattgatcaagctgcccgcacctttcgaggagtcgctcgacttaccactgtggaagttcttgcagaagaaaaatcacttgattgaggagatcaatgacgagatgaggcgctgccactgcgaactgacgtggtctcagttgtcaggcaaggtgactattcgcccagccgcaactctggtgaatgaaggaagaccacgcataaaaacctggcaagccgatacatcaacaacgttgagttctatcaggtctaagtacaaagtcaacccgatcaaagtggacccaaccatgtgggatactatcaaaaacgacgtgaaggacgataggatcctgatcgagttcgacacattgaaagaaatggtgatcctcgccggtaagagcgaagatgtgcaatctattgaggttcaggttagggagttaatcgaaagtaccacccaaaaaatcaagagagaagagcagtcgctgaaggagaagatgataatctcgccaggtcgctactttctactctgccattcctctttgctggaccatctattgactgaatgccccgaaatcgagatttgttacgatcgagtgactcagcatctatgtttgaagggaccctctgcggatgtgtacaaggccaagtgcgagatacaagagaaagtgtataccatggcccaaaaaaacatccaggtgtcaccggagatctttcaattcctacagcaggtgaactggaaggagttctccaagtgtctcttcattgcccaaaagatcttggctctctatgagctcgagggaaccaccgtgctactgacatcctgctcgtccgaggcccttctagaggctgagaaacagatgctgagtgccctgaactacaaaagaattgaagtcgaaaataaagaggttctccatggcaagaaatggaaaggactcactcataacctacttaaaaaacaaaattcaagccccaacactgttatcatcaacgaattgacctccgagacgaccgctgaagtgattataaccggatgtgtgaaagaggttaatgagacctataagctcctgttcaacttcgtggaacagaatatgaagattgagaggctggttgaagtaaaaccttctctggtgatcgattatctgaagactgaaaagaaactcttctggcccaagatcaagaaggtgaacgtccaggtatcattcaatcctgaaaacaagcagaaaggcatactcctaaccggatccaaaactgaggttctgaaggctgtggatatcgtgaagcaggtgtgggattctgtctgtgtgaaatccgtgcacaccgacaagcccggagccaagcagttttttcaagacaaagcccgtttctatcagtctgagatcaagagactgttcggttgttacatcgagctacaggagaacgaagtgatgaaagagggcggttcccctgcaggccagaagtgctttagtagaacagttctggcacccggagtagtcctgatcgtgcagcagggagatctggccaggctgccggtggacgtcgttgttaacgcatccaatgaggacttgaagcactacggcggattagccgctgccttaagtaaggcggcaggccctgagctccaggcagactgcgaccaaatagtaaagcgcgagggacgactacttcctgggaatgccactataagcaaagccggaaaattgccttaccatcacgtcattcacgcagtagggccacggtggtcgggctacgaagctccaaggtgcgtgtacctgctgcgcagagcagttcagttgagcctgtgtttggccgagaagtataagtatcggagtatcgccatcccagcaatcagtagcggagtgtttggctttcccctgggaaggtgcgtggaaactatcgtctccgcaatcaaggaaaacttccagttcaaaaaagatggacactgcctcaaggagatttatctcgtcgacgtctccgaaaagactgttgaagcattcgctgaagcagtgaaaacagtgtttaaggcgacactgccagatacagcagcacctcctggtcttcctccagccgcagcaggcccaggaaagacatcctgggagaaggggtcattggtgtcacccggaggactacagatgctgctagtgaaggaaggggtacagaacgcaaagacagacgtggtcgtgaatagtgtgcccctggacctggtcctgtccaggggccctcttagtaaatcacttctggagaaagctggacctgagcttcaggaagagcttgataccgttgggcagggcgtcgctgtgtcgatgggcactgtgcttaagacctcttcttggaatctggattgtagatacgtgctgcacgtggtcgcccctgaatggaggaacggatccacaagctccctgaagattatggaggacattatccgggagtgcatggagattaccgagagcctttcactcaaaagcatagcttttccggcaattggcacgggtaatctcggattccctaaaaacatttttgctgagctgatcatttctgaagttttcaaattttccagtaagaatcagctgaagacgctgcaggaagtgcacttcctgttacatccctccgaccacgaaaacattcaggctttcagtgatgaattcgcaagaagggcgaatggtaacttagtttccgacaagatccctaaggcaaaagatactcaggggttttatgggacagtatctagtccagatagtggcgtctatgagatgaagattgggagtattatattccaggttgcctcaggcgatattaccaaagaggaggccgacgtcatagtaaactcaacctccaactcctttaatctcaaggccggtgtaagcaaagctattctcgagtgtgctggccagaacgtcgagcgtgaatgcagccaacaggctcagcagagaaagaacgattacattatcacaggcggtggctttttacgatgtaaaaatatcattcatgtaattggagggaatgacgtgaagagcagcgtctccagcgtgctacaagaatgtgagaagaagaactactcgtccatttgtttacccgctatcgggaccggaaatgctaagcagcatcccgacaaggtggccgaagcaattatcgacgcaatagaagacttcgtgcagaagggtagtgcacagagtgtcaagaaagtaaaggtggtcatcttcctgcctcaggtccttgacgtgttctacgccaatatgaaaaagagggaggggactcagctgtcatctcaacaatcagttatgtcaaagcttgcatcctttctcgggttttccaaacaatccccccagaaaaagaaccacctggtactcgagaagaagaccgagtctgccacattcagagtgtgcggcgaaaacgtgacttgtgtcgaatatgccatctcttggctgcaggatctcattgagaaagagcagtgcccctatacgagcgaggacgagtgtattaaggactttgacgagaaggaataccaagagctgaacgaattgcagaagaaactgaatatcaatatcagccttgatcataaacgaccactgatcaaggtactaggcatttcaagagacgttatgcaggcacgggatgagattgaagccatgattaagcgcgtgcgcctggcgaaggagcaggagagccgagccgactgcattagtgaatttatcgagtggcaatacaacgacaacaacacctctcactgtttcaataagatgacaaacctgaagttggaagacgccaggagggagaaaaaaaagaccgtagacgttaaaatcaaccatcgccattacacagtgaatctcaatacttatacagctactgacactaagggtcactccctgtccgtccagcgactcaccaagagcaaagtggacatccccgcacattggtcagatatgaagcaacagaatttttgcgttgtggagcttctgccatcggaccccgagtacaataccgtggcctccaagttcaaccagacctgttctcatttcaggattgaaaagatcgagcgcatacagaatccagatctttggaacagctatcaggcaaaaaaaaagacgatggatgcgaaaaacggccagaccatgaatgagaaacaattattccacggcacggacgctggatcagtgccccacgttaacagaaatgggtttaatcggagttacgccggaaaaaacgctgttgcatatgggaaaggcacctactttgccgtgaacgctaattatagtgctaacgatacgtacagtaggccagacgctaacggacgcaaacatgtttattacgtccgggttctcacaggcatatatacacacggcaatcactccttaatcgttcccccttcaaaaaacccccagaatcctaccgatctgtatgatactgttacggacaatgtgcatcatccctcgttatttgtagcattttacgattaccaggcctaccctgaatacctgataacctttcgaaagta

SEQ ID NO: 235311 - DNA, 585 bp, Artificial Sequence
  Description of Artificial Sequence: Synthetic coding sequence
tgagtcaggaggcgagctgaactcaggatggccgtcccaggctctttcccattactcgtagaaggaagctgggggccagatccccctaaaaacctcaatacaaaactgcagatgtacttccagtcgcctaagcggagtggcggtggtgagtgtgaagtcaggcaggaccctcgatcccccagtcgtttcctggtatttttttaccctgaggatgtccgccaaaaggtgctggaaagaaaaaaccatgagctagtgtggcaaggcaaaggaactttcaagctgacagtgcagctcccggctactcctgacgagattgaccatgtgttcgaggaagaactcttgacaaaggaatccaaaactaaagaggacgttaaggaacctgataccatccgcttcgtcgacgactgtactaaacaccactccatcaaacagttacagctaagcccccgtcttctggaagtgaccaacactatacgggtggaaaacctgcccccaggagctgatgactactcactgaaacttttctttgagaatccttacaatggaggaggaagagttgccaatgttgaatacttcccagaatag

SEQ ID NO: 235312 - DNA, 1335 bp, Artificial Sequence
  Description of Artificial Sequence: Synthetic coding sequence
atgctccagagaatagggttgatatttctgcataacattgttgtggttagcaactgcttttattttcaggccttcttggatgaatttacaaactggagccggatcaacccgaataaggctaggattcctatggcaggcgacacccagggcgtggtgggcacagtgtccaagccctgcttcacagcatacgagatgaaaatcggcgctattaccttccaggttgcaaccggcgacatcgcgactgaacaggtggatgttatagtgaatagcacagctcgtacatttaatcgcaagagtggtgtgtccagggccatcctagaaggtgcaggtcaagcagtcgagagcgagtgtgcagtgttggccgctcaaccacacagagactttatcatcacacctggcggatgtctgaaatgtaaaattattattcatgtacctggcggaaaggacgtgaggaagacagtaacttccgtactggaagagtgcgagcagcgtaaatacacgagcgtgtctctgcctgccattgggactggcaacgccggaaaaaatcctataaccgtggcggacaacattattgacgctattgtggattttagcagccagcacagtacaccaagcctaaagaccgttaaggtggttatttttcagcctgaattgctcaacattttttatgactccatgaaaaaacgggatctgtcagcgagcctcaatttccagtccaccttctcaatgaccacctgcaaccttccagaacattggactgatatgaatcaccagctgttttgcatggttcaactggaaccaggccaatctgagtacaacaccatcaaggataaattcaccagaacgtgttctagctatgcaattgaaaaaatcgagcgaatccaaaacgcatttctttggcagtcctaccaggtgaaaaagaggcagatggatatcaaaaacgaccataaaaacaatgaacgcttattgtttcacggaacagacgccgattctgtcccttacgtgaaccagcacgggtttaacagatcttgcgctgggaagaacgcagtgagttacggaaaaggaacatattttgcagtggatgccagctattcagctaaggatacatactctaagcccgacagtaacggacgtaagcatatgtatgtggtcagggtgcttactggagtctttacaaaaggcagagcaggtctagtaaccccacccccaaaaaaccctcacaatccaaccgatctgttcgattcagtcacaaataatacaagatcacctaagctgtttgtggtctttttcgacaatcaggcatacccagaatatctcataaccttcacggcctag

SEQ ID NO: 235313 - DNA, 2037 bp, Artificial Sequence
  Description of Artificial Sequence: Synthetic coding sequence
atggccgctcctggcccactgcccgcagctgcacttagccccggagccccaacgccccgtgagcttatgcacggtgtggccggtgtgacgtctcgggcaggacgtgaccgcgaggcgggttccgtgcttcctgccggtaatcggggagctagaaaagcttccaggcgctcatccagccgctctatgagtcgggataataagttctcaaagaaggattgtttatcgatccgcaatgtagtagctagtattcaaaccaaagagggcttgaatcttaaactgatttcaggcgatgtgctctatatatgggctgacgttatagtcaacagtgtccccatgaacctgcagctgggcggaggaccactaagtcgagctttcctccagaaggctggtcctatgctgcagaaagagctggatgaccggcgacgcgagaccgaagagaaagtgggaaacatttttatgaccagcggctgcaatctcgactgcaaggccgtgttgcacgctgttgccccttactggaacaacggtgcagagacctcatggcagatcatggccaacattatcaagaaatgtctcacaacagtggaggtgctatcgtttagctctatcacttttccgatgatcgggaccggatctcttcagttccccaaggccgttttcgctaagctgattttatcagaagtattcgagtattcaagctccacccgacctatcacatctccactacaagaggtgcacttcctggtgtataccaacgacgacgaggggtgtcaggcatttcttgacgagttcactaattggtccagaattaatcctaacaaagctcggatccccatggcaggcgacacacaaggagtggtgggtactgtgtccaaaccctgctttactgcatacgaaatgaaaatcggagcaatcactttccaggtcgcaacaggggacatcgcgaccgaacaggtggacgtgatcgtgaactctaccgccaggacctttaatcgcaaatccggcgtgagtcgagcaatcttggagggagccggacaagccgttgaatctgagtgcgccgtcctggctgcccagcctcacagagatttcatcatcacccctggcggttgcctcaaatgcaagatcatcatccacgttcctggcggtaaagacgtgcgaaaaacagttacatccgtgcttgaggaatgtgaacagaggaaatatacttctgttagcctccctgctatcggtactgggaatgccggtaaaaacccaatcaccgtagcggataacattatcgacgccatcgtggacttctcatcacaacacagtacacctagtctcaagacggttaaggtcgtgatattccagcccgaacttctgaacatcttttacgactctatgaagaaaagagacctttcggcatccctgaacttccagagcacattctccatgacaacatgtaatctccccgagcactggacagacatgaaccaccagctattctgcatggtgcagttggagccgggacagtccgagtacaataccataaaggacaaatttactagaacttgttcatcatatgctatcgagaaaatcgagagaattcaaaacgctttcctgtggcagtcttatcaggtgaagaaacgtcagatggatataaagaacgaccacaaaaacaacgaaagactcctgtttcacggaactgacgcagatagcgtaccatacgttaatcagcacgggtttaataggtcctgtgcaggcaagaacgccgtgtcctacggaaagggtacatacttcgccgtcgacgcctcctactcagctaaagatacatacagcaagccggactctaacggcagaaagcacatgtatgtggtgagggtactgacaggggtgtttacaaaagggagagcaggactggtgaccccccctccaaagaacccgcacaatcccaccgacctttttgactccgtaaccaataatacccgctctccaaagcttttcgtcgtgttcttcgacaaccaggcctacccggaatacctaataaccttcactgcttag

SEQ ID NO: 235314 - DNA, 1278 bp, Artificial Sequence
  Description of Artificial Sequence: Synthetic coding sequence
atgaagcatacagccttcctggatgaatttacgaactggagtaggatcaatcccaataaagcacggatccctatggccggagacacgcagggagtggtggggacagtgtccaagccatgcttcactgcctacgagatgaaaatcggggctatcaccttccaggtggcgaccggcgatatcgccacagagcaggtggatgtgattgtgaatagtaccgcgcgtaccttcaatcggaagagtggcgttagccgagctattctcgaaggagcaggccaggccgtcgaatcagagtgtgctgtgctcgcggctcagccacatcgcgactttatcatcacccccggaggttgtttgaagtgtaaaattataattcacgtgcctggcggtaaagacgtccggaagacagtgaccagcgtgctcgaggaatgcgagcaacgaaagtacacatctgtatcgctacccgctattggaaccggcaatgccggaaagaatccgattactgtggcagacaacattatcgacgcaattgtcgacttctcgtcccagcactcaacaccttcccttaaaacagtcaaagtagtcatttttcaaccagagttgctgaacatcttctatgactccatgaagaagagggatttgtctgcttcgctgaacttccagtctaccttttccatgacgacttgcaatctacccgagcactggaccgatatgaaccaccagctcttttgtatggtgcaactcgagcctggccaatccgaatacaacaccattaaggataagtttacaaggacctgttctagctacgctatagaaaaaatcgagaggatccaaaatgcctttctgtggcagtcataccaggtgaaaaagagacagatggatatcaagaatgaccacaagaacaacgaaagactgctgtttcacggaacagatgccgactcagtaccctatgtcaatcagcatgggtttaataggtcatgcgccggaaaaaacgcggtgagctacggtaagggcacctacttcgctgttgatgcttcctattcggccaaagacacgtacagcaagcctgactcgaatgggagaaagcatatgtacgtggtcagggtgctcactggggtgttcactaagggtagggcgggactggtgacaccacctccaaagaatccacacaatcccaccgatctgtttgacagtgttacaaataacaccagaagtcccaaactgttcgtggtattcttcgacaatcaggcatatccagaataccttataaccttcaccgcctag

SEQ ID NO: 235315 - DNA, 2565 bp, Artificial Sequence
  Description of Artificial Sequence: Synthetic coding sequence
atggacttttccatggtggccggagccgctgcctataacgaaaaatccggcaggattacatctctttctctactgtttcagaaggtgtttgcccaaatattccctcagtggcgcaagggaaatacggaagaatgtctcccctacaaatgcagcgagaccggagcactaggtgagaactattcctggcagatcccaatcaatcataacgatttcaagattctgaagaacaacgagcggcagctttgtgaagtcctccagaataaatttggctgtatcagtacactggtctcaccagtccaggaagggaactccaaatcacttcaagtgtttcggaagatgctgaccccacggatcgagctgtcagtgtggaaagatgacttgaccacccatgccgtggatgccgtggtcaacgccgcaaacgaggatttacttcacgggggaggactagccttggctctggtcaaagcagggggtttcgagattcaggaagagtccaagcagtttgtcgcgagatacggcaaagtgtcagccggagaaattgcagtgactggggctggcaggctgccctgtaagcagatcatccatgctgtgggcccaaggtggatggagtgggacaagcagggttgcaccggtaaactgcagagagcgattgtgtctatccttaattacgttatctacaaaaacactcacattaaaaccgtcgcaatcccagcactctcaagcggcatttttcagtttcctctgaacctgtgcactaaaaccatagtggaaaccattcgcgtctcccttcaaggtaagcccatgatgagcaatctaaaagaaatccatctcgtgtcaaacgaggatcctacggttgccgcattcaaagcagcttctgaattcattttaggaaagagcgaacttgggcaggaaaccacacccagttttaacgcaatggtggtcaacaacctgacccttcaaattgtccagggccacatcgagtggcagacagccgacgtgatcgtcaatagtgtaaacccacacgatattacggtcggcccagtggctaagtctatcctccagcaggcgggtgttgaaatgaaaagcgagtttctggccacgaaggcgaaacagttccagcgcagccagttagtgttagttaccaagggttttaacttgttctgcaagtacatttaccatgtgctttggcactccgaatttccaaagccgcaaattcttaagcatgcaatgaaagaatgtctggaaaagtgcatcgagcagaatataacatcaataagtttcccggctttaggcaccgggaacatggaaatcaagaaagaaaccgcagcagaaattctgtttgatgaagtactgactttcgcgaaagaccacgtaaaacaccagctaactgtgaaatttgtcattttcccaactgacctcgagatctacaaagctttcagcagcgagatggctaaacggtctaagatgctgtctctgaataattattccgtgcctcagtctactcgcgaggagaaaagggaaaatggactggaggctaggtcccctgctatcaatctcatgggtttcaatgtagaggagatgtatgaagctcacgcttggattcaaaggatcttaagtctgcagaatcaccatatcatcgagaacaaccatatcctataccttggacggaaggaacatgacatactctcacagctccagaaaaccagtagtgttagcattacagaaatcatctccccgggtcgcacagagcttgaaatagaaggggcaagagcagacctgattgaggtggtgatgaacatcgaggatatgctttgcaaagtgcaagaggaaatggctcgcaagaaggagagaggactatggcggtctcttggccaatggaccattcagcagcagaaaacgcaagatgagatgaaagaaaacataatattcctgaagtgtcccgttcctccgacgcaggaactgcttgatcaaaagaaacagttcgagaagtgcggactgcaggtgctcaaggtggaaaagatcgacaatgaggtactgatggctgcgtttcagcgcaagaaaaaaatgatggaggagaaactgcataggcaaccggttagccaccggctgttccagcaggtgccatatcagttctgtaatgtggtgtgtagggtcggcttccagagaatgtattccactccctgcgacccaaaatacggcgctggaatctattttaccaagaacctcaaaaatttagccgagaaagcgaagaagatctccgctgccgacaagttgatttacgtcttcgaggcggaagtgctcaccggtttcttttgtcagggtcacccattaaatatcgtgccaccacccctgtccccaggtgccatcgatggacacgatagtgttgtagacaatgtgagctcccccgaaacctttgtgatcttctcaggaatgcaagccattccacagtatctctggacctgcactcaggagtatgtgcaatcccaggactactccagtggacccatgagacccttcgcccagcacccctggagaggctttgcctctggatcaccagtggactag

SEQ ID NO: 235316 - DNA, 2334 bp, Artificial Sequence
  Description of Artificial Sequence: Synthetic coding sequence
atgtccgtttcctgcgtgaagagctctagaatttccttagcagtgtccctcccctggtctctccaattcaggaaagcaaccgccaatctgtgtgtgtttcggaaaatgctcaccccgcgtatcgaactgagcgtttggaaagatgatctgacaacacatgctgtggatgccgtggtcaatgccgcaaacgaggatctgctgcatggtggcggactcgcgctggctctcgtgaaggctggagggtttgagatccaagaagaaagtaagcaattcgtggctcgctatggcaaagtgtctgccggtgagattgctgttacaggggcaggcagattgccatgtaagcaaatcatccacgccgtcggcccacgatggatggagtgggacaaacagggctgtactgggaagctgcagcgggcaatcgttagcatcctgaattatgttatctataaaaatactcatattaaaaccgtcgccatccccgcactgagctccggtatttttcagttccctctgaacctgtgtacaaagacaattgttgagaccatacgagtgtctctccagggcaagcccatgatgagcaatcttaaggaaattcacttggttagtaatgaagaccccacggtggccgctttcaaagcggcaagcgaatttattctggggaagtcagaactgggccaggaaactacgccttcctttaacgccatggtggtgaacaatctgacacttcagattgtgcagggccacatcgagtggcagaccgcggacgtgatcgtgaactcagtcaacccacatgatattacagtcggacccgtggctaagtctattctacagcaggcaggtgtggagatgaagtcggagttccttgctaccaaggctaaacagttccagagatctcagttggtcttagtaacaaaaggctttaatctgttttgtaagtacatctaccacgttctatggcactctgaattccctaaaccccagatcctgaagcacgccatgaaggagtgtctggaaaaatgtattgagcaaaatatcacttccatttcctttccagctctgggaaccgggaacatggagattaagaaggagacggccgctgaaatcctgtttgacgaagtcttgacctttgcaaaggatcacgttaagcaccagctcacagtcaagtttgtgatattccccactgacctagaaatctacaaggcatttagtagtgagatggccaaaaggagcaagatgctgtctttgaacaattattcagtaccacagtccaccagagaggaaaagcgcgagaacggactggaggcccgatctcctgcgatcaatctaatgggttttaacgtggaagaaatgtacgaggcacacgcgtggattcagcgcatcctatccctccaaaatcaccatattatcgaaaataatcacatcctttacctgggcaggaaagaacacgacatcctgtcccagctgcagaaaacctcttctgtctccatcacggaaatcataagccctgggagaaccgagctcgaaatagagggagcaagggccgatttgatagaggtggtgatgaatatcgaggacatgttgtgtaaagtccaggaagagatggctcgcaagaaggaacgaggcctgtggagatctttaggtcagtggaccatccagcagcaaaagacacaggatgagatgaaggagaacattattttccttaagtgccctgttcctcccactcaagagttgctcgatcagaagaaacagttcgaaaagtgcggtctccaggtgcttaaagtggagaaaattgataacgaggtgctcatggctgcctttcagcgtaagaagaagatgatggaggaaaagctccatcgacagcctgtgagccacaggctgtttcagcaggtaccttatcagttttgtaatgtcgtttgtcgagtgggctttcagagaatgtatagcactccctgcgaccctaagtatggagctggtatctatttcaccaagaacctgaagaacttggctgagaaagccaagaaaatcagcgctgctgacaaattaatctatgtgtttgaggccgaggtactgactgggtttttctgtcaaggccatcctctgaatattgtacctcctccattatctcccggagctatagacggacacgactccgtggttgacaatgtttcctcccccgagacatttgtgatcttttcagggatgcaggctatcccgcaatacttgtggacgtgtactcaggaatacgtccagtcccaggactattcttctgggcctatgcggcctttcgctcagcatccctggagagggttcgcgagtggatcccccgtggattag

SEQ ID NO: 235317 - DNA, 2460 bp, Artificial Sequence
  Description of Artificial Sequence: Synthetic coding sequence
atggacttcagcatggtggctggagccgctgcatataacgagaagtctgagactggggctctgggggagaactacagctggcagatcccaattaaccataacgatttcaagattcttaaaaacaacgagcgccaactgtgtgaggtccttcagaacaaatttggctgtatcagtacacttgtgtccccggtacaggagggcaactccaagagcctccaagtatttcgtaagatgctgacaccacggattgaactgagcgtctggaaggacgatctgactacacatgccgtcgacgctgtagtaaacgcagccaacgaagatttgctccacggcggaggattggccctggcacttgtgaaagccggtgggttcgagatccaggaagagagcaaacagttcgtggccaggtacggaaaagtcagcgccggtgaaattgccgtgactggggctggcaggttaccctgtaagcagatcatacatgcggtgggacccagatggatggaatgggataagcagggctgcaccggaaagcttcagcgtgcaattgtctctatattgaattacgtgatttataagaatactcacattaagacagtcgcaattcccgcactcagtagcggaatattccaatttcccctcaatttatgcacaaagaccattgtcgagacaatcagggtctccctgcaggggaagcctatgatgtctaacctgaaagaaatccatttagtttccaacgaagaccccactgtggccgcattcaaggctgcatccgagttcatcctggggaagtcagagctcggtcaggagaccactccctctttcaacgcaatggtcgtgaataatctgacactacaaatcgtgcagggtcacatcgaatggcagacagctgacgtcattgtaaattccgttaacccccatgacatcaccgtgggacctgtagccaaaagcattctgcagcaggccggagtggagatgaaatcggagttcctggctacaaaagcaaaacagttccagaggtctcaactcgtgcttgtgactaaggggtttaatctgttctgcaaatacatctaccacgtgctatggcactccgagtttcctaaaccacagattcttaagcacgccatgaaagaatgcctcgaaaaatgcatcgagcagaacattacttctattagtttccccgctctaggaaccggaaacatggagattaaaaaagagactgccgctgagatcctgtttgacgaggtgttgacttttgctaaagaccacgtgaagcaccagctaaccgttaagtttgtcattttcccgaccgacctggagatctacaaagcttttagttcagagatggccaaacgcagtaaaatgctcagtttaaacaattattcagtgccacagagtacccgggaggagaagcgagagaacgggctggaggccagatcccctgccatcaacctcatggggttcaatgtagaggagatgtacgaagcgcacgcgtggattcagcggatcctaagtctgcagaaccatcatataattgaaaacaatcatattctctacttaggtcggaaggagcacgacattctgtcgcagctccagaagacgtccagcgtgtccatcacagagatcataagtcctgggagaactgagttggaaattgagggggctagagccgatctcatcgaggtggtcatgaatattgaagatatgctctgcaaagtgcaggaagaaatggctaggaaaaaggagagaggtctctggagaagccttggacagtggactattcagcagcagaagacgcaggacgaaatgaaggaaaacatcatatttctcaagtgccccgtcccacccacccaggaactgctcgaccagaagaaacagtttgaaaaatgtggactacaggtgctgaaggtggaaaaaattgataacgaggtcctgatggcagccttccagcggaagaaaaagatgatggaagagaagctgcacagacagccagtaagccaccggctcttccagcaggttccataccagttttgtaatgtggtttgcagggtcgggtttcagagaatgtatagtactccctgtgatcctaaatacggtgcagggatctacttcacgaaaaacctgaagaatctggcagagaaagcaaaaaagatttccgctgcggacaaattgatttacgtattcgaagccgaagttcttacaggatttttttgccagggccaccccttgaacattgtacctccacctctgagtccaggagccatcgatggacatgattcggttgtggataacgtcagctcgcctgaaacctttgtgattttctccggcatgcaggccatcccacagtatctttggacatgcacacaggaatatgttcaaagccaagattattcctctggccctatgcgtccttttgcacagcacccctggcgaggcttcgcatccgggagcccggtggattag

SEQ ID NO: 235318 - DNA, 1440 bp, Artificial Sequence
  Description of Artificial Sequence: Synthetic coding sequence
atgtccgatggctttgatcgagctccaggggctggaagaggacgttcacgaggccttgggaggggcggaggaggtcctgaaggcggtggcttccccaacggcgcaggacctgcagaaagagccagacatcagccgccacagccaaaggcgccaggcttcctacagccgcctcctttgagacagccaaggaccactccaccgcctggcgcacagtgcgaagtcccagcatctccccagaggcctagtcgcccaggggcactgccggaacaaaccagacccctgagagccccaccttcaagtcaggacaagattcctcaacagaattcggaatcagcaatggcaaagccacaggtcgtggttgcaccagtcctaatgagcaaactaagcgtcaacgctcccgaattttacccgtcagggtattcgagctcctacacggaaagctacgaggacggttgtgaggattatcccacattgtcagagtacgtgcaggattttctcaatcatctcactgaacagccaggttcctttgagacagaaatcgagcaatttgccgagacactaaacggatgcgtgaccacagacgacgctctccaagagcttgtagaactcatttaccagcaggccacctctatacccaactttagctatatgggcgctcgcctatgcaattatctgtctcaccatctgaccatcagcccccagagcggcaactttaggcaactgttgctgcaacgctgtcgtactgagtatgaggtaaaggaccaggccgctaagggggacgaagtgactcggaaaagattccatgctttcgtgcttttcctgggagaactatacctcaacttggaaatcaagggaaccaacggccaggtgacacgggcagatattctgcaagtgggcctgagggagcttctgaacgctttgttttcgaatccaatggacgataacctgatctgcgccgtcaaactcttaaagctaacaggttctgtcctggaagatgcctggaaggagaaggggaaaatggatatggaggagattatacagcgcattgagaatgtcgtattggacgccaactgcagcagggacgttaaacagatgctgcttaagctggtggaactgcgaagtagcaactgggggcgagtccacgcaacctcaacttatagagaggccactccggaaaatgaccccaactatttcatgaacgagcccaccttttacaccagcgatggtgtgccattcacagccgctgatccagactatcaggaaaagtatcaagaactcctggaacgggaggatttcttcccggattacgaggagaacggcaccgacctctctggcgcaggggatccctacctggacgatatcgatgacgaaatggaccccgagatcgaggaagcctatgagaagttttgcctggaatcagaaagaaagcgtaagcagtag

SEQ ID NO: 235319 - DNA, 1104 bp, Artificial Sequence
  Description of Artificial Sequence: Synthetic coding sequence
atggcgaaacctcaggtagttgtcgctccagttctaatgtccaagttaagcgtgaatgcgccagaattctaccctagcggatactcctcatcctataccgagtcctatgaagacggttgtgaggactaccccaccttgtccgaatacgtgcaggattttttgaaccatttgactgagcagcccggttcctttgagaccgagatcgagcagttcgccgagacgctcaatgggtgtgtgaccaccgacgatgctctgcaggaacttgtggaactaatttaccagcaggccacttctatcccgaatttcagttatatgggtgctcggctgtgtaattacctctctcatcacctaactatctccccacagtcaggtaacttcagacagctgctgctacagagatgccgaaccgagtacgaagttaaggaccaggccgcaaagggagatgaagtgactagaaagcgttttcatgcatttgtgcttttcttaggcgagctgtatcttaatctagagattaaaggcacaaacggccaggtgacacgggctgatattctgcaagtgggccttcgagagctccttaacgcactattttcaaatccaatggatgacaatctcatttgcgcggtcaaattgttaaagcttaccggctctgtgctggaggatgcttggaaagagaaggggaagatggacatggaggagatcattcagaggattgagaatgtggttctggacgctaactgctccagagacgtaaagcagatgctccttaagctcgttgagcttcgttcctcgaattggggtcgcgtgcacgctacaagcacctatcgggaggctacccctgagaatgaccctaattactttatgaatgagcctacattctacacttccgacggagttccgtttactgccgctgaccctgactaccaggagaagtaccaggagcttctggagcgagaggacttcttccctgattacgaggaaaatggtacagacctcagtggcgcaggggacccttacctcgacgacatcgatgacgagatggatcctgaaatcgaggaagcatatgagaaattctgcctcgagtccgaaaggaaacggaagcagtag

SEQ ID NO: 235320 - DNA, 1203 bp, Artificial Sequence
  Description of Artificial Sequence: Synthetic coding sequence
atgagtgacggctttgaccgtgcccctgagcaaaccaggcctttacgggctccaccatcctcccaggacaagatccctcagcagaacagtgagtccgctatggcaaaaccccaggtcgttgtggcccctgtcttaatgagtaagctgtccgtcaatgcgccagagttttacccttccggatactcgagtagctacacagaaagttatgaggatgggtgcgaggattatcccaccttatcagaatatgtccaggatttccttaaccacctgaccgaacagcctggttcctttgagaccgaaatagagcagtttgcagagacactaaatgggtgcgtgaccaccgatgatgctttgcaggaacttgtcgaactgatctatcagcaagctacttcaatccctaatttctcgtacatgggtgcaaggctgtgtaattacttgtcacaccacctgactatcagccctcagtctgggaattttcgacagctgctgctgcagagatgtagaaccgagtatgaggtcaaagatcaagcagctaaaggcgacgaagtgaccagaaaacgcttccatgcttttgttctttttttaggcgagctctacctcaaccttgagattaagggaacgaacggccaggttactagggcagacattttgcaagtcggattgagggaactgctgaatgctctgttctccaaccctatggacgacaacctgatatgtgcagtgaagctgttgaagctcacaggctccgtgctcgaagacgcgtggaaggaaaaagggaaaatggatatggaggaaatcatccagcggattgaaaacgtggtgctagacgccaattgctcccgggatgtcaagcagatgctgctcaaactggtcgagctgcggtcctctaactggggcagggttcatgccaccagcacgtaccgagaggctacaccggagaacgatccgaattattttatgaatgaacccaccttctacaccagtgacggcgtccctttcacggccgctgatcccgattatcaggaaaaataccaagagctcctggaaagggaggacttcttccccgactatgaggagaacggcactgatttgtcaggggctggggatccctatctggacgacatcgacgacgagatggacccagaaatcgaggaggcctatgaaaagttctgtcttgagtccgaaagaaagcgcaagcagtag

SEQ ID NO: 235321 - DNA, 507 bp, Artificial Sequence
  Description of Artificial Sequence: Synthetic coding sequence
atggccaaaccccaagttgtggtagctccggtgctgatgtcgaaattgtccgtgaatgccccagagttctacccttccggctatagctcctcttatacagagagttacgaggatggctgtgaggactaccctaccctcagcgaatatgttcaggacttccttaatcacctcacggaacagccgggaagcttcgagacggagatcgaacaatttgcagagacactcaatggatgcgtaactacagacgatgcactgcaggaactggtggagctcatttaccaacaggccacgtccatcccgaattttagttatatgggagcgaggttatgtaactatctgtcacaccacttgaccatctctcctcagtcaggcaatttcaggcaattactgctccagagatgtagaaccgaatacgaggtcaaagaccaggccgctaaaggtgatgaggtgaccaggaagcggttccacgcattcgtgctgtttcttggagagttatatctcaattag

SEQ ID NO: 235322 - DNA, 603 bp, Artificial Sequence
  Description of Artificial Sequence: Synthetic coding sequence
atggccaagccgcaggtggtggtggcccctgtgctcatgagcaagcttagtgtgaacgcaccggagttctacccatctggctattcttcctcttacacagaaagctatgaggacgggtgcgaagattaccctactctctcagagtatgtacaggattttctgaaccacctgacggagcagccaggctcgtttgaaaccgaaatagagcagttcgccgaaacgcttaacggatgcgttactacggatgatgccctgcaggagctcgtggagcttatttatcagcaggccaccagtatccccaacttcagctatatgggcgcaaggctttgcaattacctgagtcaccatctgactatatccccccagagtggaaacttcaggcagctgcttcttcagcgatgtcgcactgagtacgaggtgaaagaccaggccgctaaaggagacgaggtcacaaggaaaaggtttcacgccttcgtcctttttcttggggagctgtacctcaatctagagatcaaagggacaaacgggcaggtgactcgagctgatatccttcaggtggggctcagagagctcctcaatgccttgttttccaaccccatgtag

SEQ ID NO: 235323 - DNA, 1056 bp, Artificial Sequence
  Description of Artificial Sequence: Synthetic coding sequence
atgtccgatggcttcgaccgggctcccgaacaaacacgccctctgcgagctcccccttcaagtcaggataagattcctcagcaaaacagcgaatcagccatggccaaacctcaagtggtggtggctcctgtgctgatgagtaaactgagtgtcaacgctcctgaattctatccatcagggtacagctcctcctacaccgaaagttacgaggatggatgcgaagattatcccacactcagcgaatatgtgcaagactttctaaaccatctgaccgaacagccaggcagcttcgagaccgaaattgaacagtttgccgagacgctaaacggctgcgtcacgacagacgatgccctccaggagctggtagagctaatctatcaacaagctacctccatcccaaatttttcctatatgggggcacggctgtgcaactacctgtctcaccacctgacaatttctccacagagcgggaacttccgccagcttctgctacagaggtgtcgtactgagtacgaggtgaaggatcaagcagcaaagggagacgaagtgacccgcaagaggttccacgcattcgtcttattccttggggagctatatctcaatctggaaatcaaggggacaaacgggcaggttacccgggctgacattctgcaggttgggctgagagagttgttgaacgcactgttcagcaatccaatggacgacaacctcatctgcgccgtaaagctgctgaagctcactggctctgtactggaggatgcatggaaagagaaggggaagatggatatggaagagatcattcaacgaatcgaaaatgtggtgttggacgctaactgctctagggatgtgaagcaaatgctgcttaagctagtggagctgcggtcgtctaactgggggagggtgcacgccaccagcacatatcgtgaagccacgccagagaacgatcccaactactttatgaacgagccaacattttacacctctgacggggtgccatttactgccgctgatcccgacacttggatgatcttgatgatgcggtggacacagaggtag

SEQ ID NO: 235324 - DNA, 288 bp, Artificial Sequence
  Description of Artificial Sequence: Synthetic coding sequence
atggcgaagccccaggtcgtggtggctccagtcttaatgagcaagctgtccgttaatgctccagagttttacccgtctggctatagcagcagttacaccgaatcctacgaggacggctgtgaggattatcccactttatcggaatacgtacaagacttcttgaaccaccttactgaacaacccggatcattcgagacagagatcgagcagttcgcggagaccttgaacgggtgtgtgacaacagacgacgcactgcaggagctggtggagctgatataccagcagtag

SEQ ID NO: 235325 - DNA, 384 bp, Artificial Sequence
  Description of Artificial Sequence: Synthetic coding sequence
atgaaagatccatcccgatctagcactagtccaagcataatcaatgaagacgtgatcattaatggacacagccatgaggatgacaatccattcgctgaatacatgtggatggagaacgaagaagagttcaatcggcagatcgaggaggaattatgggaggaggaatttattgagcgatgttttcaagagatgttggaagaggaggaagaacatgagtggttcataccagcccgagaccttccccagactatggatcagatccaagaccagtttaacgacttggtgatttccgacggctctagcctggaagatctggtcgtaaaatcaaacctaaacccgaatgcgaaggaatttgtccctggagttaagtatggaaacatatag

SEQ ID NO: 235326 - DNA, 384 bp, Artificial Sequence
  Description of Artificial Sequence: Synthetic coding sequence
atgaaggatccgtcccgctcttccacgtcacccagtatcatcaatgaggacgttatcatcaacggtcacagccacgaggatgataaccctttcgcagagtatatgtggatggagaacgaggaggaatttaacaggcagatagaggaggaactgtgggaggaggaattcatcgagaggtgcttccaagaaatgcttgaagaggaggaggagcacgagtggttcatacctgcgagggacctcccccagaccatggaccagatccaggatcagtttaacgacctcgtcatcagtgacgggtcatccctcgaggacctggtggttaaatccaaccttaacccaaacgcaaaggagttcgtgccaggggtaaaatacgggaacatttag

SEQ ID NO: 235327 - DNA, 282 bp, Artificial Sequence
  Description of Artificial Sequence: Synthetic coding sequence
atgaaggacccaagcaggtcttctacttcacccagtataataaatgaggatgtcatcataaatggccattcccatgaagacgacaacccattcgcggagtatatgtggatggagaacgaggaggagttcaataggcagattgaagaggaactgtgggaggaggagtttattgaacgctgctttcaggaaatgctcgaggaagaggaagagcatgagtggttcatcccagctcgtgatctcccacagactatggaccagattcaggatcagtttaacgattag

SEQ ID NO: 235328 - DNA, 384 bp, Artificial Sequence
  Description of Artificial Sequence: Synthetic coding sequence
atgaaagatccctccaggagttccacctcccccagtattattaacgaggacgtgataataaatggccactcccacgaggacgacaacccttttgctgaatacatgtggatggagaatgaagaagagttcaaccgtcagatcgaagaggaattatgggaggaggagttcattgagcgatgtttccaggaaatgcttgaggaggaagaggagcatgagtggttcattcccgctcgtgacctgccacagaccatggatcagattcaggaccagtttaatgacctcgtaatctcggacggcagtagcctcgaggacctcgtagttaaaagcaatctgaaccccaacgctaaggagtttgtccctggcgtaaagtatggaaatatctag

SEQ ID NO: 235329 - DNA, 372 bp, Artificial Sequence
  Description of Artificial Sequence: Synthetic coding sequence
atgaacggcagtaatatggccaacacgagcccctctgtaaaatccaaggaagaccaagggctgtccgggcacgacgagaaggagaatccattcgccgagtacatgtggatggaaaatgaggaagattttaacaggcaggtagaagaggagctgcaggagcaagacttcctggatcgctgttttcaagagatgctcgacgaagaagatcaggactggtttataccctcccgcgatctgcctcaggcaatgggccaattgcagcaacagctgaatgggctttcagtgtcggaaggacatgacagtgaggacatactgagtaaaagcaatctcaatccggatgctaaggaatttatccccggtgaaaaatactag

SEQ ID NO: 235330 - DNA, 1896 bp, Artificial Sequence
  Description of Artificial Sequence: Synthetic coding sequence
atgaaccccagcaccccttcctatcccacagcaagtctctatgtcggtgatctgcaccccgatgtgaccgaggcgatgctttatgagaagttttctcctgccggacccattctgtctatccggatctgtagagatcttatcactagcggttcttctaattacgcctacgttaatttccagcacacaaaggatgcggaacatgctttggatacaatgaatttcgatgtgatcaaaggaaagccggttcgaatcatgtggagccagcgcgatcctagcctgaggaaaagcggagtgggcaacatttttgtgaaaaacttggataaatctattaataacaaggctctctacgacactgtgtcagcattcggtaatatattaagctgtaacgttgtgtgcgacgagaacggctccaaggggtacggatttgttcattttgaaacccatgaagccgctgaacgagctatcaaaaaaatgaatggaatgttgcttaacggtcggaaggtgttcgttggtcaatttaaatctagaaaggaacgagaggccgagctcggggctcgggcaaaggagtttccgaatgtttacattaaaaactttggcgaggacatggacgacgaaagactaaaggacctctttggcaagttcggccctgctctctctgtgaaagtcatgaccgacgaatccgggaaatcaaagggctttggattcgtgtcctttgaacgccatgaggacgcccagaaagcggtagacgaaatgaatggtaaagaacttaacgggaagcagatctatgtcgggagggcacagaaaaaggttgaacgacagaccgagctgaaacggaccttcgagcagatgaaacaagatcgcataacgaggtaccaggtggtgaatctctatgtaaaaaacttggacgacggcatagatgatgagagactaagaaaagcattttcaccctttggtacgattacatccgcgaaagtcatgatggaaggaggaagaagcaagggttttggattcgtctgttttagcagcccagaagaagctacaaaggccgttacagaaatgaacgggcgaatcgtggcaactaagccactctacgtggccctggcccagaggaaggaggagaggcaggcatatttgacgaatgaatacatgcagagaatggcatctgttcgagccgtccctaatcaacgggctccaccatctggatatttcatgacagcggtgcctcagacgcagaatcatgccgcttattaccctccaagtcagatcgccagacttagaccaagcccccgttggactgcacagggggcacggcctcacccattccagaataaacctagcgccattcggccaggagcccctagagtgcccttctccacaatgaggcccgcatcttcacaggttccccgagtaatgagtacccagagggtggccaatactagcactcaaaccgtagggccaaggccagccgctgcagctgccgctgctgccaccccggctgtacggacggtgccaaggtacaagtatgcggctggcgttcgtaacccccagcagcaccggaacgcacaacctcaagtcacaatgcagcagctagctgttcatgtccagggacaggagaccctcaccgccagtaggctagctagtgctccaccacaaaagcagaaacaaatgctgggtgagcggttattccctctgattcaggcgatgcaccctaccctggcgggtaagatcaccggcatgttactggaaattgacaacagcgagttgctgtacatgttagaatctcccgagagcttacgttccaaagtcgatgaggcagtggcagtcctccaggcccaccaggcgaaggaggcaacgcagaaggctgtgaactcggcgaccggggttcctaccgtgtag

SEQ ID NO: 235331 - DNA, 1896 bp, Artificial Sequence
  Description of Artificial Sequence: Synthetic coding sequence
atgaacgccgcagcgagctcatatccaatggctagtctgtacgttggagacctacacagtgatgtcactgaggcaatgctttatgagaagttcagtcccgcagggcctgtcctgagcatcagggtctgccgggacatgattaccagacgcagtctcggttacgcctacgtgaactttcagcagcctgcggatgcggaacgcgctctcgacacaatgaatttcgacgtgattaaaggcaagcccattcggataatgtggtctcagagagacccatccctgagaaaatcgggggtaggaaatgttttcattaaaaatctggataagtcaattgataataaggcgctgtatgacacctttagtgcatttgggaacatcttgtcttgcaaggtggtgtgcgatgaaaatggttcaaagggatacgcctttgttcatttcgagacacaagaagccgctgataaggccatagagaaaatgaacggcatgcttctgaatgacagaaaagtctttgtcgggagattcaagagtcgcaaagagagagaagccgagctcggggctaaagcaaaagaatttaccaatgtctacatcaagaatttcggggaagaggtcgatgacgaaagccttaaggaattgttttcccagtttgggaaaaccttatcagtgaaggtgatgcgcgatccaaacggcaagagtaaaggtttcgggttcgtttcctacgagaagcacgaagacgcaaataaagcagttgaagagatgaacgggaaggaaatctctggaaaaattatattcgtggggagagctcagaaaaaggtcgagaggcaggctgaacttaaaagaaagttcgagcagctgaagcaggagcgaattagtcgttaccagggtgttaatctctatatcaaaaatcttgatgacacaattgacgatgaaaagctgagaaaagagttcagtccattcggctctatcactagcgccaaggtaatgctcgaagatggaagaagcaagggttttgggtttgtctgttttagcagcccagaagaggcgactaaggcagtaacagaaatgaacggtcgaattgttggctccaagcctctttatgtcgccttagcccagcgaaaggaggagcggaaggcgcacttgacaaaccaatatatgcagagggtcgctgggatgagagctcttccagctaatgctatcctaaaccagtttcaacccgctgctggcggttatttcgtaccggcagtgccacaggcacagggtcggcctccctactatactcctaaccagctcgcacagatgagaccaaacccgaggtggcagcagggcggacgccctcaagggtttcagggcatgccaagcgccatcagacagtctggacccagacccactctcagacatctggcccctacaggtaatgcgcctgccagccggggactgcccaccaccacccagcgggttggggtacctacagctgtacaaaatctggcacctcgtgcggctgttgctgctgccgctccacgtgccgtcgcgccatataaatatgcttcctccgtacggtctccacacccggctattcagccactacaagccccacagcctgctgtccacgtgcagggtcaggagccattgacagcgagtatgttggctgcagcgcctccacaggagcaaaagcagatgttgggagagcgcttgttcccccttatacaaacaatgcacagcaacctagccggaaaaatcaccggcatgctgctggaaattgataactctgagcttctccatatgctcgagagtccggagagcctgcggtcaaaggtagacgaagctgtcgcagtgctacaggcccaccacgctaaaaaagaggcagcccaaaaggtcggagcagtggccgcagccacttcatag

SEQ ID NO: 235332 - DNA, 1935 bp, Artificial Sequence
  Description of Artificial Sequence: Synthetic coding sequence
atgaacgctgctgcatcctcataccctatggcatcactgtacgtcggcgacttacacagtgatgttactgaggctatgctgtacgaaaagttctctccagcaggaccggtgttaagcatcagagtctgcagggatatgataactagaagaagcctgggatatgcctacgtgaacttccaacaaccagcggatgcagagcgagcccttgatactatgaactttgatgtgatcaagggaaaaccaattcgtattatgtggagccagcgcgatccttcactgaggaaatcaggggtggggaacgtgtttataaagaacctcgacaagtccatcgataacaaagcgctgtatgatacttttagtgcctttggcaacatccttagttgtaaggtggtctgtgacgagaacggtagcaagggctacgcattcgtccacttcgagactcaggaggccgctgataaggccattgagaagatgaatgggatgctactcaacgacaggaaggtatttgtgggtagatttaaatcaagaaaagaacgggaggccgagctgggcgctaaggccaaggagttcacgaatgtctatattaagaactttggggaggaagtagacgacgagagtctcaaagaacttttctcccagttcgggaaaacactatctgtgaaggtaatgcgagatcccaacggcaaaagcaagggatttggtttcgttagctacgagaagcacgaagacgccaataaagctgtggaggaaatgaatgggaaagaaatcagcgggaagatcatattcgtgggtcgagcccagaagaaggtcgagcgccaggcggaactcaagcggaagttcgaacaactgaagcaggagagaatttctcggtatcagggagtaaatctgtatataaagaatttggacgacaccatcgacgacgagaaattacgtaaagaattttctccctttgggagtatcactagtgccaaggttatgttagaggatggccgttccaagggatttggcttcgtgtgcttctcctcacccgaggaggctacaaaggctgtgaccgagatgaacggcagaatagtcggatccaaaccattgtacgttgcccttgcccagcgtaaagaagagcggaaggcccacctcactaaccagtacatgcagcgtgtggccggtatgcgggctctccccgctaacgccatcctgaaccagtttcagcctgccgctggtgggtactttgtccctgctgtgccacaggctcagggtaggccaccatactacactcctaaccagttggcgcagatgcgcccaaatccccgttggcagcaaggcggtcgcccacagggatttcagggcatgccgtcagccatacggcagtcaggccctaggcccacactccggcatctagcaccgaccggctctgagtgccctgacagactggccatggattttggaggcgctggagccgctcagcagggacttaccgacagttgtcagagcggcggagtgcccaccgcagtccagaacctggccccaagggcagccgtggccgcagctgcgcctcgcgcagtagctccttataagtatgctagcagcgtgcgctcgccccaccccgcaatacaaccactacaggccccacaacccgcagtgcacgtacagggacaggaacccctcacggcgtcgatgctggctgccgctccccctcaggagcaaaagcaaatgcttggcgagagactgtttccactgattcagacaatgcatagtaacttggccggaaagattacaggcatgcttctcgagattgacaactcggaactgctgcatatgcttgagtccccggagtcgcttcggtcaaaggtggacgaggctgtggcggtcctccaggcccaccatgcgaagaaggaggccgctcagaaggtgggtgccgtggcagccgcaacatcatag

SEQ ID NO: 235333 - DNA, 1983 bp, Artificial Sequence
  Description of Artificial Sequence: Synthetic coding sequence
atgaatgctgccgcttcttcctaccctatggcttctttatacgtcggagaccttcattcggacgtcaccgaggctatgctgtacgaaaaattttcaccagctggaccggtcttgtctattagagtgtgcagggatatgattaccaggagatccctgggttatgcctacgtgaactttcagcaacccgcagatgccgagcgggcactggacaccatgaatttcgacgttataaagggtaaaccgatccggattatgtggtcccagagagatccctccctgcgaaagagtggcgtcggcaacgtctttatcaagaatctggacaaatctattgataataaggctctctacgatacattcagcgcgtttggaaatatcctgtcctgcaaagtggtctgtgacgaaaacggatcaaaaggatacgcatttgtgcacttcgagacacaagaagcggctgacaaggctatcgagaagatgaacggaatgctgctgaatgatcggaaagtttttgtgggcagattcaagtcgcgaaaggagcgtgaagctgaactaggagcgaaggccaaagagtttaccaatgtgtatatcaagaactttggagaggaagtggacgacgagagtctcaaggagctgttttcccagttcgggaagaccctgtccgttaaagtaatgcgggatcctaacgggaaatcgaagggctttggctttgtgagctacgagaagcacgaagatgcaaacaaggccgtagaggagatgaatggtaaggagatcagtggaaagataatcttcgtcggcagggcgcaaaaaaaggtggagcggcaggctgagctgaagagaaagttcgaacagctcaagcaggagcggatcagtcggtaccagggcgtcaatctgtacatcaaaaacttggatgacactatcgacgacgagaaactgcggaaagaattcagtccttttggatcgatcaccagtgcaaaagtgatgctggaggatgggcgatccaagggctttggcttcgtttgttttagcagcccagaagaagctaccaaggccgtgaccgagatgaacggccgtatagtgggaagtaaaccactgtatgttgctcttgcacagagaaaggaggagaggaaagcccatctgacaaaccagtacatgcaaagagtggccggaatgagggccctacccgcaaatgcaattctcaaccagttccagcctgccgcaggtggttatttcgtgccggctgttccacaggctcagggtaggccgccttattacacaccaaatcagcttgcccagatgcggcctaatccccgatggcagcagggaggcaggccccaggggtttcagggtatgccatcagcgatacgacagtccggccctcgccctactctgcgccatctcgccccaaccggcaatgcacccgcatctcgtggactgcctaccacaactcagcgagttggtagtgagtgtcccgaccggttggccatggattttgggggtgccggagcggcacagcaggggcttacagattcctgccagagcggcggagtgcctacagcggtccaaaacctggccccaagggccgctgtggctgccgcagctccacgggcagttgccccttataaatatgccagctctgtgaggtctccacacccagccatacaacctcttcaagcccctcagccagcagtgcatgtgcaaggccaggaacccctgaccgcttctatgttagccgctgctccaccacaggagcagaaacagatgttgggggagcgcctgtttcccctgatccaaacaatgcattccaatcttgccggtaaaattacgggcatgctgctggaaattgacaactccgaactgctgcacatgcttgagtcaccagagtccttgaggagtaaggtcgatgaggccgtcgctgtgttacaggctcaccatgccaagaaggaggcagctcagaaagtaggcgctgtggctgccgctactagctag

SEQ ID NO: 235334 - DNA, 390 bp, Artificial Sequence
  Description of Artificial Sequence: Synthetic coding sequence
atgaacgctgccgcttcttcttaccccatggcttcactgtatgtgggggatctgcacagcgatgtgacagaggctatgctgtacgaaaagttctcgcctgccggtcctgtgctgtccatccgtgtttgtcgcgacatgatcacacgacgatcgttgggatatgcatatgttaactttcagcaacccgctgatgccgaaagggccttggacaccatgaattttgatgtaatcaaaggtaaaccgatccgaattatgtggagccaaagagacccatctttgaggaagagtggggtcggcaatgtcttcattaagaatcttgataagtctatcgacaataaggctctctatgataccttttccgcctttggaaatattctctcttgcaaatag

SEQ ID NO: 235335 - DNA, 207 bp, Artificial Sequence
  Description of Artificial Sequence: Synthetic coding sequence
taactcatccagacgatgcatagtaatttggccggaaagataactggcatgctgttggagatcgacaacagcgagctgctgcacatgcttgagtcccccgaatccctgcgaagtaaggtcgacgaggctgtcgccgtcttgcaagcacaccatgcaaagaaggaggccgctcagaaagttggagcggtcgctgctgctacttcatag

SEQ ID NO: 235336 - DNA, 120 bp, Artificial Sequence
  Description of Artificial Sequence: Synthetic coding sequence
atgaacgccgcagcctcaagttaccctatggctagcttatacgtgggagatctacattctgacgtgaccgaggctatgctgtatgaaaagttctcgcctgctgggccagtactctcttag

SEQ ID NO: 235337 - DNA, 1149 bp, Artificial Sequence
  Description of Artificial Sequence: Synthetic coding sequence
atgggaagcggcgaacctaacccagccggtaagaagaaaaagtacctcaaagcagccctatacgtgggcgatctcgatccagatgtcacggaggatatgttgtacaagaagtttcgccctgccggaccactgaggttcacacgcatatgtcgggatcccgtgacccgaagtcctctgggatatggatatgttaatttcagattccccgcagatgccgaatgggcgctcaataccatgaatttcgacctcatcaatggtaagccattcagactgatgtggtctcagccagacgacagattgcgcaagtcgggggtcggaaatatttttattaaaaacttagacaaaagtatagacaaccgggcactgttctatttgttcagcgcgtttggcaatatcctgtcctgcaaagttgtatgtgatgacaatggatctaaagggtatgcctacgttcactttgactccctggccgctgccaatcgcgctatctggcacatgaacggggtgagactgaacaaccggcaggtgtatgtaggtaggttcaaatttccggaggagcgagccgctgaagtacggaccagggaccgagctaccttcacaaacgtgttcgtgaagaacatcggcgatgacatagacgatgaaaaactcaaggaactcttttgtgagtacgggcctacagaatctgtaaaggtcattcgagacgcttcagggaagagcaaaggcttcggattcgtccgctacgagactcatgaagctgcgcaaaaagcagttctggaccttcatggtaaatcaatcgatgggaaggtcctgtacgtggggagggcccagaagaagatcgagaggctcgcggagttaaggcggagattcgagcgactccgccttaaggagaagagtcgccctcccggtgtgcccatctacattaaaaacctggacgagacaatcaacgacgagaagctcaaagaggaattttcctccttcggttccatctcaagagcgaaagtaatgatggaggtgggtcagggaaaaggtttcggtgtcgtgtgtttctcctccttcgaggaggccactaaggccgttgacgagatgaacgggagaattgtaggcagtaagccgctgcacgtgacactaggacaggcaaggcgacgctgctag

SEQ ID NO: 235338 - DNA, 657 bp, Artificial Sequence
  Description of Artificial Sequence: Synthetic coding sequence
atgaatggagtgcggctgaataaccgacaggtgtacgtgggccgattcaagtttcccgaggaacgggcagccgaagtgcggacacgcgatcgagccacatttaccaatgtttttgtgaaaaacattggggacgatatcgacgatgagaagcttaaggaacttttttgcgagtacggccctaccgaaagcgttaaggtcattcgcgacgccagtggcaagtcaaagggcttcggattcgtgcggtacgagactcacgaagccgctcagaaggcggttctggacctgcatgggaagagcattgacgggaaggtcctgtacgtgggacgcgcacagaagaaaattgagcgtcttgctgagttaagaagacgtttcgagcggctgcgcctgaaagagaagagtaggccacccggtgttccaatctatatcaagaacctggatgagacaatcaacgatgaaaagttgaaagaggaattttcctccttcggatccatttcgcgggcaaaagtgatgatggaagttggccagggtaagggattcggagtggtctgcttttcgagcttcgaggaggctacaaaggctgtcgatgaaatgaatggaaggatcgtaggttctaagcccctgcacgtgactctgggacaggctagaaggaggtgctag

SEQ ID NO: 235339 - DNA, 1053 bp, Artificial Sequence
  Description of Artificial Sequence: Synthetic coding sequence
atgctatacaagaagtttagacctgctggccctctccggtttacccgtatctgcagggacccggtgactaggtccccgctcggctacggctatgtcaatttccgattcccagcagatgcagagtgggcactgaatacaatgaattttgatctgattaacggcaaaccctttaggttaatgtggagccagccagacgatagactgaggaaatcaggggtaggtaatatcttcattaaaaatctggataagagcatcgacaacagggccctgttttacctgttttcagcttttggtaatatccttagctgcaaggttgtctgtgacgataacggttcgaagggctacgcatacgtgcattttgatagtttggccgctgcaaatagggccatctggcacatgaatggggtacgcctgaataacaggcaagtgtacgtcggaagattcaagtttcccgaagagcgggctgccgaggtgcggactcgcgatcgcgctaccttcaccaatgtattcgttaaaaatataggtgacgacatcgatgatgagaagctgaaggaactgttctgcgagtacggccctaccgagtcagtgaaagttattcgcgatgcaagcggcaagtccaaggggttcggttttgtacgttatgagacccatgaggccgcacagaaagcagtgctcgaccttcatggaaaaagtatagacggcaaggtactgtacgtaggcagagcacagaaaaagattgaacggctggccgagctcaggcgcagattcgagcggttgaggctgaaagagaaaagtagacctcctggcgtgcccatctacattaaaaatctggatgaaactataaatgacgagaagctgaaggaagaatttagttctttcggatctataagccgtgctaaggtcatgatggaagtcgggcagggcaaaggatttggggtcgtgtgttttagcagctttgaggaggccacaaaagctgtggacgaaatgaacggacgtatcgtcggttccaaaccccttcacgtgactttgggccaggccaggcgacggtgctag

SEQ ID NO: 235340 - DNA, 957 bp, Artificial Sequence
  Description of Artificial Sequence: Synthetic coding sequence
atgcccaaacggggaaagaagggagctgttgcagaggacggcgatgagcttcgcactgagcctgaggctaaaaagtcaaagactgcagcaaagaaaaatgataaggaagccgcaggcgaggggccagctctctatgaggaccctcccgatcagaagacatcgccatcgggtaaaccggctacacttaagatttgctcttggaatgtagatgggttgagagcgtggattaagaagaaggggctggactgggtgaaggaggaggcacctgacatcctgtgcctacaggaaaccaaatgtagtgagaataagcttcccgctgagctccaggaactgcctggactgtcacaccagtactggagcgcaccctctgacaaggagggatactctggcgtgggcttattaagcagacagtgtccgctgaaggtgtcgtatggaataggggatgaagagcacgaccaggaaggtcgcgtgatcgtggctgaattcgattccttcgtgcttgtgaccgcatacgtccccaacgccggtcgaggtcttgtacgattggaatatcgtcagcgctgggatgaggcttttcgtaagtttcttaagggcctcgctagcagaaagcccttagtgctctgtggcgatttaaacgtggcacacgaggagatcgacctgcgtaaccccaaagggaacaagaaaaacgccggattcacaccacaagagcggcagggcttcggcgaactgttgcaggcagtgccattggcagatagttttcggcatctttatccaaacaccccttacgcatataccttttggacttacatgatgaatgccaggagtaagaacgtcgggtggcgcctggattattttctgctttcccattccctactgcccgctctgtgtgactccaaaatccgcagtaaagcactaggctctgaccactgcccaatcactctctaccttgctctgtag

SEQ ID NO: 235341 - DNA, 891 bp, Artificial Sequence
  Description of Artificial Sequence: Synthetic coding sequence
atggcagctgccgcagcagccgcagcagcggctggggcagcgggaggcaggggatctggcccaggcaggaggcgtcatctggtgccaggcgctggaggagaggcaggagagggagcccctgggggtgccggagactacggcaatggattagagagcgaggagctggagccagaagagttactgctggaacctgagccagagccagagcctgaagaggaacctccccgacctagagcccctcctggcgcacctggcccaggacctgggagcggtgccccagggagtcaagaggaagaagaagagccgggtctagtggagggggatccaggcgatggcgctattgaggaccccgagctagaagcgattaaggccagagtgagagagatggaggaagaggccgagaaactgaaagagctgcaaaatgaggttgaaaagcagatgaatatgagcccccctccaggaaacgcaggccctgtgatcatgtccatcgaagagaagatggaagctgatgccagaagcatatatgtagggaacgtggactatggggcaaccgctgaagaacttgaggctcacttccatggttgtgggtccgtaaacagggtgacaattctttgcgataaatttagtggccacccgaaggggttcgcctacattgagttctccgataaagagtccgtgcggactagtctggctctggacgagagccttttccggggacgtcagatcaaagttatccccaagcgtactaaccggcctgggatttccaccacagatcgcggttttcctcgggctcggtatagagccaggactactaattacaattctagccgatcaagattctattcgggctttaactcaagacctcgtggccgtgtgtatcgttcggggtag

SEQ ID NO: 235342 - DNA, 1557 bp, Artificial Sequence
  Description of Artificial Sequence: Synthetic coding sequence
atgtcatgtgtgaagctgtggccctctggcgctcctgctcccctagtcagtatcgaagaactggagaatcaggaactcgtgggtaagggaggattcggaactgtatttagggcccagcaccgaaaatggggctatgacgtcgctgttaaaatcgttaattctaaggcgatctctagagaagtgaaggcaatggcctccttagacaacgaattcgtcctcaggctggaaggcgttattgaaaaagtgaattgggatcaggaccctaaacctgccctcgtgaccaagttcatggagaatgggtcgctgtcgggcctgctgcagtctcagtgtccaagaccttggcctctgctttgtagacttctgaaagaggtggtgttgggcatgttctacctccacgaccagaaccctgttcttctccatcgcgatctcaagcccagcaatgttctgctggatcccgaactgcacgtgaagctcgccgactttggactgagtaccttccaggggggatcccagagcggtaccgggtctggtgagcccggaggaaccctggggtatctggcccctgagctcttcgtcaatgtgaatcggaaagcaagtactgccagcgacgtctacagctttggcattctcatgtgggccgtgttagctggcagagaagtggaactgcccacagaacctagtctggtgtatgaggccgtgtgtaaccggcaaaaccgcccaagtctggcagagctcccccaggcaggcccagaaacaccagggctggaaggcctgaaggaactgatgcagctctgttggagctctgaacccaaagatcgtccatccttccaggaatgcctgcctaagaccgatgaagtctttcaaatggttgagaacaatatgaatgcagctgtgtccacagtgaaagatttcctgtctcagcttagaagtagcaaccggcgattttctatacccgagagcgggcaaggaggcaccgaaatggatggtttccgtcgtacaatcgagaaccagcactcccgcaacgacgtcatggtctccgaatggctcaacaaactaaaccttgaggaacccccttcctctgtcccgaagaaatgcccatcactgactaaacggagccgggcacaggaagaacaggtaccgcaggcctggaccgccggaacgtcttcagactccatggcgcaacctccacagacccccgaaacgtccacgttccggaaccagatgccttctccgacctcaacaggcacaccctctccaggtccgagagggaaccagggagcagagaggcaaggcatgaactggagctgcaggacccctgaaccaaatcccgtcacgggccgaccgctggtgaacatctataattgttcgggcgtgcaggtaggcgacaacaactatttgacaatgcagcagacgaccgccttaccgacatgggggctggccccaagcggaaagggacgcggactgcaacatccccctccagtagggtcccaggaggggccaaaggatcctgaggcgtggtcacgcccacagggatggtacaaccactctgggaagtag

SEQ ID NO: 235343 - DNA, 2223 bp, Artificial Sequence
  Description of Artificial Sequence: Synthetic coding sequence
atgctcggacgccgaggaagtgactgggcagttccagcaccagagaccatgccattcccagttaccacccaggggtcacagcagactcagcctcctcagaagcattacggaatcaccagcccaatcagtctggcagctcctaaagagactgactgcgttctgacacagaagttgatcgagacattgaaacctttcggcgtttttgaagaagaagaggaactgcagcgtagaattcttatcctcggcaagttaaataatctggtgaaagaatggattcgagagatcagtgaatctaagaacctgccacagagcgtcatagaaaatgtgggcggaaaaatttttacctttgggtcttaccggctgggtgtgcacacaaaaggcgcagatatcgacgcactgtgcgtcgcacctaggcatgtcgatcggagcgattttttcacgtccttctacgacaaattgaagctacaggaggaggttaaagatctcagagccgtcgaagaagccttcgttccggtgatcaagctgtgttttgacggcattgagatagatatactcttcgcccgtcttgccctgcagactattcctgaagacctggacctgagagatgattccttgctcaaaaacctggacataagatgcattaggtccctcaacggctgccgcgttacagacgagattttacatctcgtccctaacattgacaactttcggctgaccctccgtgcaataaagctgtgggctaagaggcacaacatttacagcaacatcctaggctttctgggcggtgtatcttgggccatgctggtagccaggacgtgccagctgtaccccaacgcaatcgcctcaaccctggtgcataagttctttctagttttcagtaaatgggagtggcctaacccagtcctcttgaaacagcctgaggagtgtaaccttaatttgccggtgtgggatcccagggtcaatccctcagatcgctaccacctaatgccaataattaccccggcttatcctcagcagaattcaacatataatgtgagcgtatccacccggatggtgatggtcgaggagttcaagcagggattggctatcacagacgaaattctgctgagcaaggctgaatggtccaagctgttcgaggctcctaacttctttcagaagtacaagcactacatcgtcttgctcgccagcgcaccgactgagaaacaacgcctggagtgggtgggacttgtcgaatcgaagattcgaatccttgtgggaagcctggagaagaacgagtttattacactggcccacgtaaacccccagtccttccctgcaccaaaggagaatccggataaggaagagttccgaacaatgtgggtgatcgggctcgttttcaaaaaaacagaaaactcggagaatttgtctgtagacctaacctacgatatccagtctttcacagacactgtgtaccggcaggcaatcaattcgaagatgttcgaggttgacatgaaaattgctgcgatgcacgtgaagcgtaaacagctgcatcaactcctaccgaaccatgttttgcagaaaaaaaagaaacactccaccgaaggcgtcaaactcactgccctaaacgactcctccctcgatctcagcatggactccgataactctatgagcgtaccttctcccacatctgccacaaaaacatccccacttaatagcagcgggtcatcgcagggcagaaacagtcctgccccagcggtgacggctgccagtgtgaccaacatccaagccactgaagtcagcgtgcctcaggtcaattcctcagagagtagcggtggtaccagctccgagagcatcccacaaaccgctactcagcccgcaatatccccccctcccaagccaacagttagtagagtggtatctagcacaaggctggtcaacccgccaccccgaagctcaggtaatgccgcaacctcaggcaatgcagcgacaaaaatcccaaccccaattgtcggcgtgaagagaacctcctccccacacaaagaagaatcacccaagaaaaccaagacggaggaagagcagctggacactgagacctccacgacccaaagcgagaccatacaaacagcggcttccctgctcgccagccagaagacctcttccactgatctctcagacatccccgctctgccagctaatccaatccctgtgataaagaacagtattaagctcagattgaatcgttag

SEQ ID NO: 235344 - DNA, 858 bp, Artificial Sequence
  Description of Artificial Sequence: Synthetic coding sequence
atgccgtttcctgtcacaacacagggaagtcaacagacacagcccccacagaagcactatggtatcacgagcccaattagtttagccgctcccaaggaaacagactgcgttctgacgcagaagctgattgagaccctcaagcccttcggcgtttttgaggaggaggaagaactgcagcggaggattctcatcttggggaagttgaacaacctggtaaaagagtggatccgcgaaatctccgaaagcaaaaacctgccccagtctgtgatcgaaaatgttggaggaaaaatttttacttttggcagctaccgacttggagtgcataccaagggggcagatattgatgccctgtgcgttgcacctcgacacgtggatcgttctgacttcttcaccagtttctacgacaaactgaaactgcaggaagaggtcaaggacctcagagccgtggaggaagccttcgtccccgtcatcaaactgtgcttcgacggaatcgaaatagacatcctcttcgccaggttagccctgcagacgattcctgaggacctggacttgcgggacgacagcctgctgaaaaatctggacatcaggtgtatcagatctctgaatggctgcagagttacggacgagattctgcacttagttccaaacattgacaactttcgattgaccctgcgtgcgataaagctctgggcgaagcggcacaatatttatagcaatatccttggattcttgggcggagtatcgtgggctatgctggtcgcacgcacttgtcagctatatcctaacgcaatcgctagcacccttgttcataaattttttttggttttcagcaagtggtacgtgttcaggctctactag

SEQ ID NO: 235345 - DNA, 1911 bp, Artificial Sequence
  Description of Artificial Sequence: Synthetic coding sequence
atgccttttcccgtgacaacacaaggtcccccacagcctgcacctccgcctaacaggtacggcgtctccagtcctattagtctcgcagtcccaaaagagacggattgtctgctcactcaaagactgatcgagactctgcgtccctttggagtgttcgaggaagaggaggagttgcagaggcgaatactcgtgctggagaagctgaataatttagttaaagaatggatccgcgaaatcagcgagagcaaatctcttccccaatccgtcatagaaaatgttgggggaaaaatctttacgttcgggagctatcgactgggggtgcacactaagggagccgacatagacgccctgtgcgtggcaccctctcacgtcgatagatccgacttttttactagcttctacgccaaactgaagctgcaggaggaggttaaagacctcagagctgttgaggaagcgttcgtgccggtgattaagctgtgtttcgatggtattgaaatcgacatcttgtttgctcggttggcattacaaaccatccctgaggacctggatctgcgcgatgattctttgctgaaaaacctggatattcggtgcataagatccctgaatggctgcagagtgaccgatgagatcctacaccttgttcctaatatcgacaacttccgactgaccctgcgggctatcaaactttgggcgaagtgccacaacatctacagcaatattctgggatttctaggcggtgtgtcctgggctatgcttgtcgcccgtacttgtcagttgtatcccaatgctgtggccagtaccctggttagaaagttttttctcgtcttctccgagtgggagtggcctaatcctgttttacttaaagagcccgaggaacgtaatttaaatctgccggtttgggacccaagagtgaatccttctgatcgctaccacctgatgccaatcattacaccagcttacccacagcagaatagcacttacaatgtgagtattagtacacggatggtaatgatcgaagagtttaagcagggcctggccatcacccatgagatcctcctgagtaaagccgagtggtctaagctgtttgaggcgccatccttttttcagaaatataaacattatattgttctactagcaagcgctagcacggaaaaacagcatttagagtgggtcggactggtagagagtaagatccggatactagtgggttccttagaaaagaacgagttcatcaccctcgcccatgtgaacccgcagtccttcccagcgccaaaggaaaacccagacatggaagagtttaggaccatgtgggtcattggcctaggactgaaaaaaccggataattccgaaatcctgtccattgacctgacttacgatatacaatctttcactgacaccgtgtatcgccaagcagtgaactctaagatgttcgaaatgggcatgaaaatcactgccatgcatctcaggaggaaagaattgcaccaactgttgcctcaccacgtgttacaggacaagaaagcccacagcaccgagggcagacgtctgactgacctgaatgattcaagcttcgatctttcggcaggttgcgagaactcaatgtcagtgcctagctccacttctacaatgaagactgggccactcatttccagctcgcaaggacgtaactcacccgctctggctgtgatgactgcctccgtagctaatatccaggccaccgagttcagccttcagcaggtgaataccaacgagagcagtggggttgctcttaacgagtcaatcccccatgcggtatcccaacccgcaatttcaccttctcctaaagctatggtcgccagagttgtgtcctcgacatgcctgatatcccatcctgatctgcaggagacgcagcagcaaacgtacctcatactatag

SEQ ID NO: 235346 - DNA, 1737 bp, Artificial Sequence
  Description of Artificial Sequence: Synthetic coding sequence
atggacttcctactgtttcagttcggtttatgtacctttaaatacgactacacggatagcaaatatatcacaaaatccttcaacttctacgtatttcccaagcccttcaataggagcagtcccgacgttaaattcgtatgccagtcttccagtattgatttcctggcctcccaaggttttgactttaacaaagtcttcaggaatgggatcccctatctgaaccaagaagaggaacgccagctacgggagcagtatgatgaaaaacggtcccaggccaacggggctggcgcactttcgtatgtaagcccaaatacttcaaagtgcccggtgacaatccccgaggaccagaagaaatttatagaccaggttgttgagaaaatcgaggatttacttcagtcagaggagaacaagaacctggaccttgaaccttgtacggggttccaacgaaagttaatttaccagaccctgagttggaaatatcctaaggggatccacgtggagacattagagacggaaaagaaagagcgttacattgtgatctctaaagtggacgaagaggagcggaagcgacgagagcagcagaagcatgctaaggaacaggaggagctcaatgatgcggtgggcttttctagagtgattcatgctattgctaattctggtaagctagtaataggacacaatatgctgctggacgtgatgcatactgttcatcagttctactgtccactgccagcagatcttagtgagtttaaagaaatgactacctgtgtgtttccaagactgctggatactaagctgatggccagcacgcagcccttcaaagacatcattaataacactagtcttgccgagttagagaagcgacttaaagagactcccttcaacccacccaaagtagaaagcgccgaaggctttcccagctatgacacagcttcagagcagttgcatgaagcgggatatgatgcttacattaccgggttatgttttatttccatggcaaattacctcggcagcttcttatcaccaccaaaaatacatgtctccgctaggagcaagctgatcgagcccttcttcaataaactctttctgatgcgagtgatggatataccctatctgaacttggaaggtccagacttgcagcctaagcgcgatcatgtgcttcatgtaactttccccaaggagtggaagaccagtgacctgtaccaactgttctccgcgttcggaaacatccagattagctggatagacgatacgtccgccttcgtcagtctttcgcaaccagaacaagtcaaaatcgcagtaaataccagtaagtatgctgaatcctatcgaattcagacttatgctgagtatatgggaagaaaacaggaagagaagcagattaaacggaaatggaccgaagatagctggaaggaggctgacagtaagcgcttgaaccctcagtgcatcccctacaccctgcagaatcattactatcgtaataacagctttacggcccctagcacagtgggaaagcgtaatttgagtccgagtcaggaagaggccggtcttgaggatggcgtgtcaggggagatcagtgacaccgagctggaacagaccgactcatgtgccgagcccctgtccgaagggagaaagaaggccaaaaagttgaaaaggatgaaaaaggagctgtcaccagcgggttctatttccaaaaactcacccgcaactctgtttgaggtgccagacacctggtag

SEQ ID NO: 235347 - DNA, 1782 bp, Artificial Sequence
  Description of Artificial Sequence: Synthetic coding sequence
atggagataatccgctcgaactttaaaagcaatcttcacaaagtgtatcaagctatcgaggaagcagactttttcgccattgatggtgaattctcaggcatctcggatggtcccagcgtgtccgcgttgaccaacggattcgatactcccgaggagcggagtagccccgacgtgaagtttgtgtgccagtccagttccatcgactttctagcctcccagggtttcgacttcaataaggtcttcaggaacggcataccctacctgaaccaggaggaagagaggcaattgcgggagcagtatgatgaaaaacgaagccaggcaaacggtgctggagccctgagctatgtgtctccaaacaccagcaagtgtcccgtcacaatccctgaagatcagaaaaagtttattgaccaagtggtggaaaagattgaagatctgctccaatcggaagagaacaaaaatctggatctggaaccctgcacaggattccagcgcaagctaatctaccaaacgctctcatggaagtaccctaaaggcattcatgtggagaccttggagaccgagaaaaaagaacgatacatcgttatctctaaggtcgacgaagaggagcgtaagcggcgagagcagcaaaaacatgcaaaggagcaagaggaactaaatgatgcggtgggcttctcccgggtgatccacgctatcgcaaactcaggaaaactagtgatcgggcacaatatgctgcttgatgtgatgcacaccgtgcaccaattctactgcccactgcctgcagatttgtctgaattcaaagagatgaccacctgtgtctttccccgactgcttgacacaaagctgatggcgtcgacacagccttttaaagacatcattaacaataccagtttagccgaactggaaaaaaggctgaaggaaacacccttcaaccccccaaaggtggagtctgcagaaggattcccatcctacgacaccgcatcggagcagttacacgaggctggatatgatgcttatatcacaggcttgtgcttcatctctatggctaactatctgggcagctttctgagcccaccaaagattcatgtaagcgcccgaagcaaactgattgagcccttcttcaacaaactctttttgatgagagtcatggatatcccttacctgaaccttgaaggaccagatcttcagccaaagagggaccatgtgctgcacgtgacttttccgaaggagtggaaaacatctgacctctaccagttgtttagcgcattcgggaatattcaaataagctggattgatgatactagcgccttcgtgagtctcagccaaccagaacaagtgaaaattgccgtgaatacttcaaaatacgcagaatcctaccggatccaaacttacgcagagtatatgggaaggaagcaggaagaaaaacagatcaaaagaaagtggacagaagactcctggaaagaagctgatagtaagcggctcaacccacagtgtatcccttataccctgcagaatcattattacaggaataattctttcactgcccctagtaccgtgggaaaacgaaacctatcgccctctcaggaagaggctggattagaggacggtgtgagtggggaaattagcgacactgagttagaacagaccgatagctgcgcagagccgctgagcgaaggaagaaaaaaggcaaaaaaactgaagcgaatgaagaaggaattatcccctgcaggctccatttcgaaaaacagcccggcaaccctgttcgaggttcctgatacttggtag

SEQ ID NO: 235348 - DNA, 1920 bp, Artificial Sequence
  Description of Artificial Sequence: Synthetic coding sequence
atggaaatcattcggagtaattttaaaagtaatcttcacaaagtttaccaggcgattgaagaggcagatttctttgccatcgacggagaattcagtggcatctcagatgggcctagcgtgagcgccctcacaaatggtttcgacacgcccgaagagaggtaccaaaagctgaaaaagcactcaatggattttttgctttttcaattcggtctatgtacgtttaaatatgattataccgacagcaaatatattaccaaatcttttaatttctatgtgttccctaagcctttcaacaggtcttcccctgatgtgaagtttgtgtgccagtcttcgtctattgacttcctggcctctcaggggttcgactttaataaggtcttccgcaacggcatcccttacctcaatcaagaggaagagcgccagttgcgggagcagtacgacgaaaaaaggagccaggctaatggcgctggcgctctgagttatgtgtcacccaatacgtccaaatgccccgtaacaatccctgaagatcaaaaaaagttcatagatcaggttgtcgaaaagatcgaggatctcctccaaagtgaggagaacaagaatctggacctcgagccttgcactggtttccagagaaaactgatttatcagactcttagctggaaatatccgaaagggatccatgttgagaccctcgagaccgaaaagaaggaaaggtatatcgtcatcagtaaagttgatgaagaagagcgcaaaaggcgcgagcagcagaagcacgccaaggaacaagaggaattgaacgatgcagtcggcttttcacgagtgatacacgccattgccaattctggcaagctagttatcggccacaacatgctgctggacgttatgcacactgtccatcagttctactgtcctttgcccgcagacctgtcagaattcaaggagatgaccacctgcgttttccctcgactgttggacaccaagcttatggctagcacacagccttttaaagacatcattaacaacactagcctggcggaactagagaagaggctcaaagaaacaccgtttaatcccccaaaagtagagagcgcggaagggttccccagctacgacactgccagcgaacaactgcacgaagctggttacgacgcttatataaccggcctctgtttcatcagcatggcaaactatcttggctcctttcttagccccccaaaaatccatgtctcggccaggtcaaagctaatagagccattctttaacaagttgttcctcatgcgtgtgatggacattccttacctgaatcttgaaggcccagacctgcagcccaaacgggatcatgtgctgcatgtgacatttcccaaagagtggaaaactagtgacctgtatcagctcttctccgcttttggtaatattcagattagttggatcgacgacactagcgctttcgtcagcctctcacagcctgagcaagttaaaatagctgttaatacaagtaaatacgcagagagctacagaatccagacctatgccgaatacatgggcagaaaacaggaagagaagcagattaaaagaaagtggaccgaagattcctggaaagaagctgactctaaaagactaaatcctcaatgcatcccttataccttgcaaaaccattattatcgcaataattccttcacagctcctagtacagtcggaaagcgcaatctcagtccaagtcaggaagaagccggactggaagacggcgtgtccggcgagattagcgataccgagctcgaacagacagattcttgtgccgagccactgtctgaagggcgaaagaaagccaagaagctgaaaaggatgaagaaagaactgagccccgctggttccatttcaaagaattcccctgctacattatttgaggtgccggatacctggtag

SEQ ID NO: 235349 - DNA, 624 bp, Artificial Sequence
  Description of Artificial Sequence: Synthetic coding sequence
atggagattattaggtctaactttaaatccaacctccacaaggtgtatcaggctattgaagaggccgacttttttgcaattgatggcgagtttagcggcatttccgatgggcctagtgtatcagctctgaccaatggatttgatactcctgaggagagataccaaaagctgaagaagcactccatggacttcctcctgtttcagttcggcctgtgcacatttaagtacgattataccgactccaagtccagtcccgatgtgaagttcgtgtgtcagagcagcagcatcgacttcctagcgagccagggcttcgatttcaataaagtgtttcggaacggaatcccctacctgaatcaggaagaggaacggcagctgcgcgagcaatacgatgaaaagagatctcaggcaaacggggctggagccctgtcctatgtgtcgcctaataccagtaagtgccctgttacaatcccggaggaccagaagaagttcatcgaccaggttgttgagaagattgaggatctactccagagtgaggaaaataaaaacctggaccttgaaccatgcaccggatttcagcgcaaactcatttaccagacactttcgtggaagcggagcgatatctag

SEQ ID NO: 235350 - DNA, 1395 bp, Artificial Sequence
  Description of Artificial Sequence: Synthetic coding sequence
atggaaattattagaagtaactttaaaagcaacttgcataaggtgtaccaggccatcgaagaggccgatttctttgccatagatggtgagttcagcggaatctctgacggccctagcgtgtcagcactgactaacggattcgacactccggaagaaagataccaaaaactgaagaaaaaagagcggtatattgtgatttcaaaggtcgatgaggaagagcggaagaggcgcgagcaacagaaacacgccaaggagcaagaagagctaaacgacgcggtgggcttttcccgagtcattcatgccattgcaaactccggtaaactggtaatcggacataacatgctgctggacgtcatgcataccgtccaccaattctattgtccactcccagctgatctttctgaatttaaagagatgacgacttgtgtttttcctagactcttggatactaagctaatggctagcactcagcctttcaaagatatcataaacaatacctctctagcagagttggagaagcgcctgaaggaaactccctttaatccccctaaggtggaatccgccgaggggttcccctcatacgacacagctagcgagcagttacacgaggccggatatgacgcatatattacaggtctttgctttatcagcatggctaactatctgggttcatttttatcacccccaaaaatccatgtgtcagccaggagtaaattgattgagcccttctttaacaagctctttctgatgcgcgttatggacatcccctacttgaacctagagggcccagatctgcagccaaaacgcgaccacgtgctccatgtgacattcccgaaagaatggaagactagtgacttatatcaactgttcagtgcgttcggtaacatacaaatcagctggatcgacgacacctccgcatttgtgtcactttctcaaccagagcaggtaaagatcgctgtcaacacctctaaatacgccgagagctatcggattcagacatacgcagagtatatgggcagaaagcaggaggagaagcagattaagcggaaatggactgaagattcgtggaaggaagcagattccaagagactcaatcctcagtgcatcccgtacaccctgcagaaccattactacaggaataacagctttactgccccttcaaccgttggcaagaggaacttgtccccaagccaggaggaggcaggcctggaggacggtgtctccggtgaaatctctgacacagagttggaacagaccgacagctgcgctgagccactgtctgaaggacgtaagaaggccaagaaactgaagagaatgaagaaggagctgtctcccgcagggagcatatcaaaaaactctcccgctaccctgtttgaggttccagatacttggtag

SEQ ID NO: 235351 - DNA, 1071 bp, Artificial Sequence
  Description of Artificial Sequence: Synthetic coding sequence
atggacgcaggtgtcacagagagcggattgaatgtcactttgactatcagactgctgatgcatggaaaggaagtcggctccataatcggcaaaaaaggtgaaagcgtgaaaaggatccgggaggaatcaggcgctcgcatcaacatcagcgaaggcaactgcccggaacgcattattactttgactgggcctactaatgctatcttcaaagcctttgcaatgattatcgataagctagaggaggatatcaactcatcgatgaccaattcaactgccgcttcccgcccacccgtgactctgagattggttgtccccgcaacacagtgtggctcgctcatagggaagggcggatgcaagattaaggagatccgagagagtaccggagctcaggtccaagtggccggagacatgctgcctaatagtaccgagagggccattactattgcaggcgtgccccagtctgtgaccgagtgcgtgaagcagatttgtctagtgatgctggaaacgctgtcacagtccccccagggacgcgtgatgactattccttaccagccaatgccagcctcttcccctgtgatttgcgccggaggacaggatagatgtagcgacgcagccggatacccccacgccacgcatgatctggagggccctccccttgacgcttactccatacagggtcagcacaccatctcgccattagatctggctaaactcaatcaggttgccaggcagcagagccatttcgctatgatgcacggcggtaccggattcgccggaatcgattcgagtagccccgaggtgaaaggctactgggcctctctggacgcttccacacaaactacgcatgaactcactatcccaaacaacctgattggctgcatcatcggtagacagggagctaatattaatgaaattcgtcagatgagcggagctcagatcaaaatagcgaacccagtggagggttcgagtggaagacaggtaacgataacgggctctgctgcaagcattagcctggctcagtatctgatcaacgcacgcctgagctccgaaaaagggatgggctgttcgtag

SEQ ID NO: 235352 - DNA, 957 bp, Artificial Sequence
  Description of Artificial Sequence: Synthetic coding sequence
atggacacgggcgtaatagaaggcggtcttaatgttactctgacaattcgcctcctgatgcatggcaaagaagttggtagcattatcggaaagaagggagaaagtgtaaagaagatgagggaagaaagcggtgcacggattaacatttccgaaggtaattgtccagaaaggatcattaccttagccggacctactaatgccatcttcaaggccttcgcgatgataatcgacaaactcgaagaggacatctcttcatccatgaccaacagcactgctgcctctcggcctcctgtgacattacgcctagtcgtgccagcatcccagtgcggatcccttattggcaagggagggtgcaagatcaaagagatccgggagtcgacaggcgcacaggtgcaggttgcaggggatatgctgcccaattccactgaaagagctatcaccatcgccggaatcccacagagtatcatagaatgcgtgaagcagatttgtgtggtcatgttagaaagccccccaaagggtgtgactattccttacagaccaaaaccttccagttccccagttattttcgctggaggacaggcctatactatccaaggccagtacgccattccccagccagacttaaccaagctccaccagctggctatgcagcaaagccactttcctatgacacacggcaatacaggtttttccgccggactcgatgcctctgctcagactacttcccacgagctgacaatccctaacgatctcattggttgcatcatcgggagacagggtgctaaaatcaacgagatccgacagatgagcggagcgcagataaaaatagccaatcctgtcgagggatctactgaccgtcaagtcaccattaccggttccgcagcatctatttcattagctcaatatctgattaacgtccgtctgagttcagagacgggcggtatgggctcttcctag

SEQ ID NO: 235353 - DNA, 1098 bp, Artificial Sequence
  Description of Artificial Sequence: Synthetic coding sequence
atggacactggggtgatagagggcggtctgaatgtcaccctgaccatccgtttactgatgcatggcaaagaggtgggctccatcatcggcaaaaagggtgaatccgtgaagaaaatgagggaggaatccggggcaaggattaacatcagcgaaggcaactgccctgagcgaatcatcaccttggcgggtcccaccaatgctatcttcaaagcttttgccatgatcatagataagctggaagaggacatttcaagttctatgactaatagtacagccgcaagccggcctcccgtcactctgcgtctggtagtgcccgctagccagtgcgggtcactgatcggcaaggggggatgcaaaatcaaagagatacgggagagcacgggggctcaggtccaagtggctggagacatgcttcctaattcaacggaacgagccattacgatcgctgggattcctcagtccatcatcgaatgcgtcaaacaaatctgtgtcgtgatgctggagacactgagccagagccccccaaaaggagtaacaataccttatcgcccaaagccttcctcctcccccgtgatctttgctggaggccaggacagatactctaccggcagcgattcagcaagttttccccataccaccccgtccatgtgtctgaaccctgacctggaaggacctcctcttgaggcctataccatccaaggccagtacgccatccctcaacccgatctgacaaaattgcatcaactcgctatgcagcaatcacatttccccatgactcatggaaatactggctttagcggcattgaaagttctagtcccgaggttaaggggtattggggattagatgcttcggcgcagactacctcgcatgaattgaccattcctaacgaccttatcggttgtatcatcggacggcagggcgcaaagatcaacgagatacgtcaaatgagcggggctcagataaaaatcgctaatcccgtagaggggagcactgatcgacaggtaactattacaggcagcgccgcatcgatatcactcgcacagtatttaattaatgtgcgcctgtcatccgaaaccggagggatgggcagctcttag

SEQ ID NO: 235354 - DNA, 1008 bp, Artificial Sequence
  Description of Artificial Sequence: Synthetic coding sequence
atggacacaggcgtgattgaaggcggtctgaacgttaccctgaccatcagactgctcatgcacggcaaggaagtcgggtccattataggcaaaaagggtgagtcagtgaagaagatgcgcgaggaaagcggtgcccgaatcaatatctctgaaggcaattgccccgaacgcatcatcactctggccggacctaccaacgcaatcttcaaggccttcgctatgattatcgacaagctcgaggaagatattagtagttcaatgaccaattcgacggctgcctcaagacctccagtgaccttgagactggtggttccagcgagtcaatgcggcagcctcatcggcaaaggaggatgcaagatcaaagagatacgcgagtccactggcgctcaggttcaggtggccggtgatatgctccccaattcaactgaaagggccataaccatagctgggattccgcagtccattattgaatgtgtcaagcagatctgtgtggtcatgctggaaaccctgtctcagtctcccccaaagggcgtgacaattccttaccgacctaaaccctctagctctccagttatcttcgctgggggtcaggcctacaccatacagggacagtacgccatcccccaaccagatctcacgaagctacatcagctcgctatgcaacagagccattttcctatgactcatgggaacactggcttttccggtatcgagagctcatcacccgaggtgaaaggttattgggccggtctggacgcctccgcccagacgacttctcatgagctaacaatcccaaacgacctgatcggttgcatcataggccgtcagggtgccaaaattaatgagatccgtcagatgtccggagcccagatcaagatcgctaaccccgtggaaggctctactgaccgacaggtgacaattaccgggtctgcggcaagtattagccttgcccagtacctgatcaacgtgcgactaagcagtgaaacgggcggaatgggctcgtcatag

SEQ ID NO: 235355 - DNA, 906 bp, Artificial Sequence
  Description of Artificial Sequence: Synthetic coding sequence
atggatacaggcgtgatcgaggggggtctgaatgtgactctgaccattcgtttactgatgcacggcaaggaggtaggttcaataataggaaaaaagggagagtcagtgaaaaagatgcgggaagagtctggagctagaattaacatatcggagggaaactgccccgagagaattatcaccttggctgggcctaccaacgccatattcaaggcgtttgctatgatcattgataagctggaggaagatatatcctcctctatgactaactctacagctgcctcccgacccccagtgacactccggcttgtggtgcccgcatcccagtgcggaagcctgatagggaaaggcggatgcaagatcaaggagatacgagagtccactggcgctcaggtgcaggtggccggagatatgctgcctaatagcactgaacgggctattaccatcgccggtattccacagtctataatcgagtgcgtcaaacagatctgtgtagtgatgctggagagtccacccaagggcgtcactattccttatcgacccaagccaagctcctccccagtaatcttcgcgggaggccaggatcgctactctacaggtagcgactctgcatcctttccgcacactacaccttcaatgtgtcttaatcctgacctagaagggccacctcttgaggcctacaccattcagggtcagtacgcaatcccccaaccagaccttacaaaactgcaccagctcgctatgcagcagagtcactttccgatgactcatggtaataccggttttagtggaatggacactagtgtgtttatctccgtgagatgcagtgcacgagagcggcctgtcccacgttcacagctcgacatttgtcttaagcagacttccctgtcatcaatcttgctcgtttag

SEQ ID NO: 235356 - DNA, 1089 bp, Artificial Sequence
  Description of Artificial Sequence: Synthetic coding sequence
atggacacaggcgtcatagaagggggtctgaatgttactcttacaattcgactgctgatgcatggaaaggaggtcggctccattattggaaagaaaggcgagagcgtgaaaaaaatgcgtgaggaatccggtgcccgaattaatatctccgaaggtaactgccctgagagaattatcacactggctggacccactaatgcaatctttaaagcattcgctatgatcatagacaaactggaagaggatatctcttctagcatgacaaactcaacagccgctagtaggccccctgtgacattgcggctggtggtgcctgcgtctcagtgcggcagccttatcgggaaagggggttgcaagattaaggaaatcagagagtcaacaggcgcacaagtgcaagtcgccggagacatgctcccaaactcaacagagcgagcaattactattgctgggatccctcagagtataattgagtgcgtgaagcagatttgtgtcgtcatgctcgagtcacctcctaaaggcgtgacgataccgtaccgtcctaaaccctctagttctccggtcatcttcgcagggggtcaagataggtatagcaccggatccgactctgctagcttcccacatacaaccccgtccatgtgccttaatccagacctcgaggggcctccattagaggcttacactatacagggccagtacgctattcctcaaccggacctaacaaagctccaccagcttgctatgcaacaatcacattttcctatgacgcacgggaacacaggcttttcaggtatcgaaagctctagccccgaggtgaagggatattgggcaggccttgacgcaagcgcccaaacaacaagtcatgagttgaccattcccaacgacctaattggctgtattatcggcagacaaggtgcgaagattaacgaaataagacagatgagcggagcccagatcaaaattgccaacccagtggagggatctacggaccgccaggtcaccatcacagggtccgccgcatcgataagcttggcccagtacctcataaatgtgagactgtcctccgagacgggcggaatgggctcgagctag

SEQ ID NO: 235357 - DNA, 996 bp, Artificial Sequence
  Description of Artificial Sequence: Synthetic coding sequence
atggacacgggcgtaatcgaagggggtctcaatgtgactctcacgattcgccttctgatgcacggaaaagaggtgggcagtatcatcggtaaaaaaggggagtctgttaaaaaaatgagagaagagtcaggcgcacgaatcaatatcagcgagggcaactgccccgagcgtatcattacattggcaggtcccactaacgcgatcttcaaagctttcgcaatgatcattgataagttagaggaagacatctcttcttccatgactaactctacagccgcatcccgtcctccggtaacactgaggttagttgtgcccgcttcccagtgtgggagcctgatcggaaagggaggatgcaagatcaaggaaattagagaaagcacgggcgcacaggtacaagtcgcaggcgacatgttgccgaacagtactgaaagagccatcaccattgccggaatcccacagtccattatcgagtgtgtcaaacagatctgcgtggtgatgttggagtctcctcctaaaggcgtgaccattccttaccgccctaaacctagctcctctcccgtgattttcgctggagggcaggcctatactatacagggccaatacgcaatcccccaaccggatctgaccaaattgcatcagctcgctatgcaacaatcacacttccctatgacacacggtaatactggtttctccggaatcgaatcgtcctctccagaagtcaagggatactgggccggactcgacgcctcagcgcagacaaccagtcacgagctaaccattccaaacgatctaattggttgtataatcggaagacagggcgcaaaaattaacgaaatccgtcaaatgtccggagcacagatcaaaatcgctaatccggtagagggaagcactgacaggcaggtgacgatcactggctctgccgcatcaatttctctcgcccagtacttgataaatgtgcggctgtcatctgagaccgggggtatggggtctagttag

SEQ ID NO: 235358 - DNA, 1101 bp, Artificial Sequence
  Description of Artificial Sequence: Synthetic coding sequence
atggacactggtgttattgaggggggactcaatgtcacgctgacgatccgacttctgatgcacggtaaagaggtaggaagcatcattggcaagaagggcgagtcagtgaaaaagatgagagaagagtccggtgcgcgtatcaacatcagtgagggtaactgtcccgaaagaataatcaccttagcagggccaaccaatgcaatttttaaggcattcgccatgataattgataagctggaggaggatattagttcttccatgacgaactccactgctgcatctcgcccacctgtcacactcagactggttgtgccagcctcccagtgtggcagtctcatcgggaaaggcggatgcaaaatcaaagagattagggagagcactggagcacaggtgcaggtggccggtgacatgctcccgaatagcaccgaacgcgcaatcactatcgcaggtattccccaatccattatcgaatgtgttaagcaaatttgtgtagttatgctcgagactctcagccaatccccccctaagggagtgacaattccatatcgccctaagccatccagcagtcctgtcatcttcgctggaggacaggaccgctacagtacagggtcagactctgccagcttcccccatactaccccctctatgtgcctgaatcccgacctggaggggcctcccctagaagcttacaccatccaggggcagtacgcgattcctcagccggacttaacaaaacttcatcaactggcgatgcagcagagccattttcccatgacacatggtaacaccggcttcagtgggatcgagtcatctagtcctgaggttaagggatactgggcaggcctcgacgcatctgcccagaccacaagccacgagctgactattccaaacgacctgatcgggtgtatcattggacggcagggtgccaaaataaacgaaataaggcaaatgtccggcgctcaaattaagatagccaaccccgtcgagggatccacagaccgccaagtgacaatcaccgggtctgctgcgagcatttctctggcccagtacttgataaatgtgagactcagctctgagacagggggtatggggtcatcttag

SEQ ID NO: 235359 - DNA, 1086 bp, Artificial Sequence
  Description of Artificial Sequence: Synthetic coding sequence
atggacactggcgtgattgaggggggactgaatgtcaccctgaccatcagactgctgatgcacgggaaggaagtggggagcattattggcaagaaaggcgagtccgtgaagaaaatgcgggaggaaagcggggcaaggattaacattagtgaaggcaattgccccgagcggatcatcaccctcgcgggtcctacaaacgctattttcaaggcatttgctatgatcatcgacaagctagaggaggatatatcgtccagcatgacgaactcaacagccgcatcacgccctcctgtaacgctgcggctagttgtgcctgcctcccagtgtggctcactcattggcaaagggggatgcaaaatcaaagaaatcagagagagtacaggggctcaggttcaagtggctggggacatgctgccaaactccactgagagggcaattaccatcgccggaatcccccaatctatcattgagtgcgtcaagcagatttgcgtggtaatgctagagtctcctccgaagggggtcacgataccctatagacctaagccttcgagttcacctgtcatcttcgcgggtggccaggaccgttatagcactggaagcgacagtgcgtcctttcctcacactacgcctagcatgtgcctcaatcccgacctggaaggaccccctctggaggcttacacgatccagggccaatacgctatccctcagcccgacctcactaagctgcaccagctggccatgcagcagtctcacttcccaatgacccatggtaatacaggctttagcgggattgagagctcttccccggaagtgaaagggtattggggactggacgctagcgcacagactacatcacatgagctgactattcctaacgacctcatcgggtgcatcatcgggcgacaaggtgctaaaattaacgaaatccgccaaatgagcggggctcagataaagattgccaatccagtcgaaggatctaccgacagacaggtgaccattacgggctcagccgcatccattagtttagcgcagtatctgattaacgtcaggctcagctccgagacggggggtatgggctccagttag

SEQ ID NO: 235360 - DNA, 1056 bp, Artificial Sequence
  Description of Artificial Sequence: Synthetic coding sequence
ctgagccccggtgacgctttctgggctccatccgtgctaccccactcaacactgtcaacactctctcaccacccacagccccaatttgggaggcgtatggaaagcaaagtgtctgagggcggacttaacgtgactctcaccattaggctcctcatgcatgggaaggtgcgcggagcggcaatagtgtctaagggcgaaactgtcaagaagatgagggaagagagcggtgcccgaatcaacattagtgaaggaaactgtccagaaagaatcgtcaccattaccggaccgacagatgccatcttcaaggcgttcgccatgatcgcgtataaatttgaggaggacatcatcaacagcatgagcaactctcccgctactagcaagccgccagtgacattgcgcctggtcgtgccggcttctcaatgtgggagcctgatcggcaaggggggaagcaaaattaaagagatccgggagagcacaggagcccaggtccaggtagccggtgatatgctccccaacagtacggaacgtgcggtgactatatccggtacacccgacgccatcattcagtgtgtcaagcaaatttgcgtggttatgttggagtcgccgcctaagggagcaaccataccataccgaccaaaaccagcatctacccccgtgatttttgcgggaggccaagcctataccattcaggggcaatatgcaattcctcaccccgatcagctgacaaagttacaccagctggccatgcagcagaccccgttccccccacttggacagaccaaccctgcctttccaggcctggatgcgagtccccctgcatctacacacgagctgacaattcccaacgatttaattgggtgtattatcggacggcagggaacgaaaattaatgagattcgccaaatgtccggcgcacagataaagatcgccaatgctacagaaggtagctctgagcgtcaaattacgatcacaggcactcccgcaaatattagcctggcccaatacctgatcaacgctaggcttacttcagaggtgacggggatgggcactctctag

SEQ ID NO: 235361 - DNA, 969 bp, Artificial Sequence
  Description of Artificial Sequence: Synthetic coding sequence
ccacaaccacagttcggccgaaggatggaatccaaggtgtcagagggaggactcaacgtgaccctgactattaggttacttatgcatggcaaagaagttgggtctattatcggaaagaaaggcgagacagtgaagaagatgcgggaagaaagtggagctaggattaacatttcggaaggaaattgtcctgagagaatcgtgacaatcaccgggccaactgacgctatttttaaagccttcgcgatgattgcgtacaaattcgaagaggacatcattaattctatgagtaactctccagccacaagcaagccacccgtgacgctcaggctggtcgtcccagcctcccagtgtggctcgctgatcggcaagggagggagtaagatcaaggagatccgcgagtcaaccggagcgcaggtgcaagtggctggagatatgctgcccaactctacagagcgcgcagtgaccatctctggcactccagatgctataatccagtgtgtgaaacaaatctgtgtggtgatgctggaggcttacacaatccaggggcagtacgctatcccacacccagaccagctgaccaaattgcaccaactcgcaatgcagcagactccgtttcctcccctcggacagactaaccccgcattccccggagagaagctgcctctacactcatctgaggaggcccaaaatctgatgggccagtcctccggcctggatgccagcccccctgcctccactcatgagctgacaattccaaatgaccttattggctgcataattgggaggcaggggaccaaaattaacgaaattagacagatgtctggagcacagattaagattgctaacgcaaccgaaggtagctcagagagacagattactattaccgggacgcccgcaaacatttccctggcgcagtacctgatcaatgcacggttaactagcgaagtcacagggatggggacgctctag

SEQ ID NO: 235362 - DNA, 1038 bp, Artificial Sequence
  Description of Artificial Sequence: Synthetic coding sequence
atgggcgaaggggacgctttttgggctccctctgtgctcccacacagcacactcagcaccctttctcatcacccccagccccagtttggccgacggatggagagcaaagtatcggagggcggtctcaatgttacgctgactatcagacttctcatgcacggtaaggaagtcggatccatcatagggaaaaagggagaaaccgtcaagaaaatgcgtgaggaatcgggagcaaggattaatataagcgaaggcaactgccccgaaaggatagtgacgattaccgggccaaccgacgctattttcaaagcctttgccatgatcgcgtacaaattcgaggaggatatcatcaactcgatgtctaacagtccagcgacatctaagccacccgtgacattgcggctggtggtgccggcttctcagtgtgggtcattgatcggcaaagggggatcgaagatcaaagagattagagaatctaccggcgctcaggtgcaggttgcaggcgatatgttgccgaactcaacagaaagggccgtaaccatctccggaacccccgatgccattattcagtgcgtgaagcagatttgcgtggtgatgttggaagcatacaccatccagggtcagtatgctattccacatccagacttgactaaactgcaccaacttgccatgcagcagacccccttccccccacttggccagactaatccagctttccctggtgagaagttgcccctgcactcatccgaagaggctcagaatcttatggggcagtccagtgggctggatgcatcgcctcctgctagtactcacgagctcactatacccaatgatctgatcggctgcatcatcgggcgacaggggactaaaattaacgagattcgccaaatgagcggcgctcaaatcaaaatcgcaaacgctaccgagggctctagcgagcgccaaatcacaattaccggcacacctgccaatatttctctggcacaatatctaatcaacgcaaggctgacgtccgaggtgacaggtatggggacactgtag

SEQ ID NO: 235363 - DNA, 1113 bp, Artificial Sequence
  Description of Artificial Sequence: Synthetic coding sequence
atgggcgagggtgatgccttctgggcaccttcagtccttccccacagtactctgagcaccctgtcacaccatcctcagccacagttcggccgacgcatggagtccaaggtatcagaggggggacttaatgtgaccctcacaatacgtctgctgatgcacggaaaggaagtcggctccatcatcggcaaaaagggcgagaccgtcaagaaaatgcgggaggaatccggggctcgaatcaatatctctgaaggaaactgtcctgagcgaattgtgaccatcaccgggcctacagatgcgatcttcaaggcatttgcaatgatagcatacaaatttgaagaggacataatcaactctatgtccaatagtccggctacgtctaagcctcccgtgactctgagactcgtcgtgcctgcatctcagtgtgggagcctaatagggaaagggggttccaaaattaaggaaatacgggaatccacgggtgcccaggtacaagttgctggcgatatgctgcctaacagcacggagagagccgtaaccatctcgggtacacctgatgccatcattcagtgcgtcaagcagatttgtgtggtgatgctcgagagcccgccaaagggcgctactattccttaccggcctaagcccgcttccactccggtgatatttgctgggggacaagcttacactatccagggccagtatgccattccccatccagatctgaccaagttacaccagctggcaatgcaacagacacccttccctccattgggtcagacaaacccagcatttccaggcgaaaagctccccctgcattcaagcgaggaggcccagaatctgatgggccagagcagtggacttgacgcatcaccccctgccagtacccatgagttgaccatccctaacgatctgatagggtgtatcattggtcgacaaggaacgaagatcaatgagatacggcagatgagcggcgctcagatcaaaatcgccaatgctacggaaggctcctccgagagacaaataaccatcacaggaacaccagccaacatctcccttgcacaatacctgatcaatgccagattgacttcagaagtgacaggcatgggaaccttgtag

SEQ ID NO: 235364 - DNA, 1056 bp, Artificial Sequence
  Description of Artificial Sequence: Synthetic coding sequence
atgggtgaaggcgatgcattctgggcaccaagtgtgctgcctcactcaacattgtctaccctgtcccatcaccctcaaccacagttcggacgccgaatggagtctaaggtgagcgaagggggtttgaacgtcactctcaccataagattattgatgcatggaaaagaggtgggaagtatcattgggaagaagggagaaacggtgaagaagatgcgggaggagagcggtgcacgtattaacatctctgaggggaattgcccagaacgtatcgtcaccatcactggccctacagacgcgattttcaaggcctttgctatgattgcctataaatttgaggaggacattataaatagtatgagcaatagcccagcaactagtaagcctcccgtgaccttgcgccttgtggtacctgcctcccagtgtggctctctgataggcaaaggtgggagcaagatcaaggagatcagggaaagtacaggagctcaggtacaggtcgccggtgacatgctcccgaacagcacagagcgggctgtgaccattagtggaacgccggacgcaatcatccagtgcgtgaaacagatctgcgtggtcatgctggaaagtccgccaaagggcgcaaccataccatacagacccaagccagcgagtaccccagtcatttttgcgggaggccaggcctacactatccagggccagtacgctattccacatcccgatcagctgaccaagcttcatcagcttgccatgcagcagaccccctttcctcccttagggcagactaaccctgcctttcctgggttagacgcatctccacccgcttccacacacgagctcacaatacctaacgatctgattggatgcatcatcggtcgacaggggacaaagattaacgagatccgtcagatgagtggagcacagatcaagatcgcaaatgcaacggagggctcttcggagcgtcagattacaattactggtacacctgcaaatatctccctcgcacaatacctcatcaacgcacgcctgacaagtgaagtgacaggaatgggcaccctgtag

SEQ ID NO: 235365 - DNA, 1116 bp, Artificial Sequence
  Description of Artificial Sequence: Synthetic coding sequence
atgggagagggtgacgccttctgggccccttcagttcttccccactccaccctcagcaccctctcacaccaccctcagccccagtttgggcgtcggatggagagcaaggtttcagaggggggacttaacgtgactctgactattcgcctgcttatgcacggaaaggaggtgggcagcattattgggaagaaaggggagactgtcaagaagatgagggaggaaagcggagcaagaattaatattagcgaagggaactgcccagaaaggattgtcaccattactggtcccactgatgctatctttaaagcatttgcaatgattgcctacaagtttgaggaggacatcatcaactcgatgagcaactcaccagcaacttctaaaccgccagtgacactaagattggttgtacccgcttctcagtgtggctccctgataggcaagggaggatcaaagatcaaagagatacgcgaatcaaccggggcacaagtccaggtcgctggagatatgcttcccaacagcacagagagagcagtgactataagtggcacccctgatgcaatcatccagtgcgtgaagcaaatctgcgtggttatgctcgaatcaccccctaagggagccacaataccataccgacccaaaccagcaagtaccccagtgatcttcgcgggaggtcaggcctacactatccagggccagtacgctatccctcaccccgatcagttgacaaagctccaccaattagccatgcagcagactccgttcccacctctggggcagaccaatccggcattccctggagagaagcttcccttacatagctcagaggaagctcagaatcttatgggtcagagctcagggttggatgcgtccccgccagcttcaacccacgaattaaccatacctaatgacttaatcggatgcatcattggaaggcaggggacgaaaatcaacgaaatccggcaaatgtctggtgcacaaatcaagattgccaatgccaccgagggatcctcagagcgccagatcacaatcactggaaccccagcaaacatttctctcgcacagtatcttattaatgccaggctgacctctgaggtgacgggcatgggtaccctgtag

SEQ ID NO: 235366 - DNA, 1116 bp, Artificial Sequence
  Description of Artificial Sequence: Synthetic coding sequence
atgggagaaggagatgcgttctgggcaccatctgttcttccacatagcaccctctcaactctgagtcaccacccacagcctcaattcggcaggcgcatggagtccaaagtcagtgaaggcggactgaatgtgacactcaccatcaggttactgatgcacggtaaggaggttgggtccattatcggtaaaaaaggcgaaacggttaagaagatgagggaagagtctggagccagaattaacatctcagagggaaattgtcctgagagaatcgtgactatcactggtcctactgacgccatttttaaagccttcgccatgatagcctacaagtttgaagaagacatcatcaattccatgagcaacagtccggcaacctccaaacctccagtgaccctccgtctggtcgtgcccgcttctcaatgtggatccctgataggtaaaggcggatctaaaatcaaagagattagggagtctaccggcgctcaagtccaggtggccggtgacatgcttcccaattctaccgaacgcgcagtcaccattagcgggacccctgatgctatcatccaatgtgtcaaacagatttgcgtcgtcatgttagaatcgccaccaaaaggagctacaataccctatcggcctaagccagcgtccactcctgtcatattcgccggaggtcaggcttataccatccaggggcagtacgcgatcccacatcctgaccagctgacaaaattgcatcagttggccatgcagcaaacacctttccctccactcgggcagaccaatccggcttttcctggggagaagctccccttgcatagttccgaggaagctcagaatcttatgggtcagtcttcaggtcttgatgctagccccccagcaagtacccatgagttaactatacctaatgacctgatcgggtgcattattggcagacagggcacaaagattaacgagattagacagatgtccggggcacagatcaagatagccaacgcaaccgagggtagttccgaacgtcagatcactattacaggaacccctgctaatatatccctagcccagtatctgatcaatgcacgcctcaccagcgaggtcaccgggatgggcaccctctag

SEQ ID NO: 235367 - DNA, 18 bp, Artificial Sequence
  Description of Artificial Sequence: Synthetic coding sequence
atggagagtaaagtctag

SEQ ID NO: 235368 - DNA, 5070 bp, Artificial Sequence
  Description of Artificial Sequence: Synthetic coding sequence
atgggaagtaaaagaagaagagcaaccagtcccagctctagcgtctcaggtgattttgatgatggtcatcactcagtgtctaccccaggaccctccagaaagaggcggcgattatccaatctccccacagtggacccaattgcggtttgtcacgaactgtataacaccattcgagattacaaagacgaacagggtagactcctctgcgagttattcattcgcgctccgaaaagaaggaatcaacccgattattacgaagtcgtctcacaaccaattgatctgatgaagatccagcagaagctcaagatggaagagtatgatgacgtgaacctgctgactgctgattttcagctgctgttcaacaatgccaagtcgtactataagccagatagtcccgagtataaggccgcttgtaagctgtgggatctctacctccgaaccaggaacgagtttgtccagaaaggcgaagctgatgacgaggacgatgacgaagatggccaagacaatcagggaactgtcaccgagggatcttcacctgcatacctgaaagagattctcgaacaattactggaggcaattgtcgtggccactaacccgtccgggagactgatcagcgagctgtttcaaaagctaccttctaaagtgcagtatcccgattactacgcaatcataaaagaacctattgacctgaaaaccatcgcacagcggatccaaaatggtagctacaagtctatccacgccatggcaaaagatatcgatcttctagccaagaatgccaagacctacaacgagccaggcagccaggtctttaaagatgccaacagtattaaaaagatcttctatatgaaaaaggcggagattgagcaccacgaaatggctaagagtagtctgcgaatgaggaccccctccaacctggctgccgcacggctcaccggcccaagtcattccaaagggtccctgggggaagagagaaaccctaccagtaaatactacagaaacaaacgcgcagtgcaaggtgggcgtctgtcggccatcactatggccctgcagtacggcagtgagtctgaggaagatgcagctttggccgctgctcgctacgaggaaggcgagtctgaggctgagagcatcacttcttttatggatgtgtccaaccccttctatcagctgtacgatacggtccggtcgtgccgcaataatcaggggcaactgattgctgaacctttttaccacttgcctagtaagaaaaagtatccagactactatcagcaaataaagatgccgatcagcctgcagcagataagaaccaaattaaagaatcaggagtatgaaacactcgaccacctggagtgtgacctgaacctgatgttcgagaacgcaaaaagatacaacgtacccaatagcgccatttacaaacgcgtcttaaaactccagcaggtgatgcaagcaaagaaaaaagagcttgctagacgggacgacattgaagacggtgattccatgatcagttcggccactagtgataccggcagcgccaagcggaaaagtaagaaaaatattagaaaacagcggatgaaaatcctgttcaacgtggtgcttgaggctagagaacccggaagtgggaggcggctttgcgacctgtttatggtcaaacccagcaaaaaagactaccctgactattataagatcatactggagccaatggacctaaagattatcgagcacaacatcagaaatgacaagtacgccggtgaggagggaatgattgaggacatgaaacttatgtttcgcaatgcgagacactataatgaagagggaagccaagtctacaatgatgcccacatcctggagaaattgctgaaagagaaacggaaagagttgggtcccctccctgacgacgatgatatggcctctcctaagcttaagctcagccggaagtccgggatctctccaaagaagagcaaatacatgacaccgatgcaacaaaagctcaatgaagtgtatgaggcagttaagaattataccgacaagcggggtcggagactgtcagctattttcctccgcctaccttctaggagcgaacttcctgactactatctgaccatcaaaaaacctatggacatggagaagatccgaagccacatgatggctaacaagtaccaggacatcgattcaatggtggaggattttgtcatgatgtttaacaatgcttgtacctataacgaaccagagagcttgatatacaaagacgccctagttctgcataaggtgctgctcgagacgagacgggatctggagggggacgaggattcccacgttcctaatgtcacacttctgattcaggagttgattcacaacctctttgtttccgtgatgtcacaccaggacgacgaaggtcgttgttatagtgactctctggctgaaatcccagctgtggatccgaattttcccaacaagcctcccctgactttcgacatcatccgaaaaaatgtggagaacaaccgttaccgtcgacttgatctatttcaggagcacatgttcgaggtactggagcgcgcacgcaggatgaacaggactgactcggagatctatgaggatgctgtggagctgcagcaattcttcatcaaaatccgggacgagttatgcaaaaacggcgagattttgctaagcccagccttgtcttacaccaccaagcacctgcacaacgacgtggagaaagagcgcaaggagaagctccctaaggagattgaggaggataagcttaagagagaggaggagaaacgcgaagcagaaaaatcagaggactcctcgggcgctgccggtctctccggacttcatagaacatactcacaagattgctcatttaagaacagcatgtaccacgtgggagattacgtatatgtggagccagccgaagccaatcttcagcctcatattgtctgcatagagagactgtgggaggacagcgctggagagaagtggctgtacggttgctggttctaccggccaaacgagacttttcacctcgccacgcggaaattcttggaaaaggaagtatttaaaagcgactattacaataaggtgcccgttagcaaaattcttggtaaatgcgtggttatgttcgtcaaggagtatttcaagttatgccctgaaaatttcagggatgaggacgtattcgtgtgcgaaagtcgctattcagcaaaaactaagagcttcaagaagatcaagttatggaccatgcccatttcctccgtgcgttttgtgccacgagatgttcctctgccggtggtgcgcgttgcctccgtcttcgcgaatgccgacaaaggagatgacgaaaagaataccgacaactctgaagacagtagggccgaggataatttcaacctggagaaagagaaagaagacgttccggtcgaaatgtccaatggcgagcccggatgtcactatttcgagcaactgcactacaacgacatgtggttaaaagtcggcgactgcgtatttatcaaatctcatgggctagtgcggccaagagtcgggagaatcgaaaaagtttgggtccgagacggcgcagcatacttttacgggcctattttcatccaccctgaagaaaccgaacacgagccaacaaagatgttttacaaaaaagaggtattcttaagtaacctggaagaaacctgcccaatgacatgcatcctgggcaaatgcgctgtgctgtccttcaaggattttctctcttgtcgacccacagagatcccggaaaatgacatcctcctctgtgagagcagatataatgagtctgataagcaaatgaaaaaatttaaagggcttaagcgcttcagtcttagcgccaaggtcgtggatgatgagatctactattttagaaaaccaatcgtccctcagaaggaaccttctcctctcctggaaaaaaagattcagctcctcgaagcaaaatttgccgaactggagggcggtgatgatgatatcgaagaaatgggcgaggaagatagcgaggtgatcgagcctccttcgcttccccagctgcagacccctttggccagcgagctggatcttatgccttacacccccccacaaagcacacctaaatctgccaaggggagcgccaagaaggaagggtcgaaacgcaagattaacatgagcggctacattctcttcagctcggagatgagagcagtgatcaaggcgcagcatccggattattccttcggcgagctgagccggttggtcggaacagaatggcgaaatctcgagaccgccaagaaagctgaatacgaggaaagggcagcgaaggtggcagaacagcaggaaagggagagagccgctcagcagcagcagccgagcgcgtccccacgtgccggaactcctgtgggggcactgatgggcgtggtcccaccaccaaccccaatgggcatgctcaatcagcagctgacgcctgttgccggtatgatgggaggctacccacctgggctaccccctcttcagggccctgtggacggcctggtgagtatgggttcgatgcaacctctgcatccagggggaccaccccctcaccatctgccaccgggtgtgccgggactccccggtattccccctcctggcgttatgaaccaaggagtggcaccaatggttggcacccccgctccaggaggaagcccttatggccagcaagtgggagttctggggcctccaggacaacaggcgcctcccccttatcccggtcctcatcccgctgggccaccagtgatccaacagcccaccaccccgatgttcgtcgccccaccgccaaagacccaacgcttgctccattcagaggcataccttaagtatattgaaggcctcagtgccgagtccaactccatctcaaagtgggaccaaacactcgctgcaagacgaagggatgtgcatttatctaaagagcaggagtctcggctgccatcccattggctgaagtcaaagggtgctcacaccaccatggctgatgctctgtggaggttaagagacctaatgctccgggatactctcaatatccgccaggcctataacctcgagaacgtttag

SEQ ID NO: 235369 - DNA, 4749 bp, Artificial Sequence
  Description of Artificial Sequence: Synthetic coding sequence
atgggaagcaagcgcaggcgggcaacgtctccttcctcttctgtgagcggagacttcgacgatggccatcactctgtaagcacgcccggaccctcccgcaaaagacgtaggttgtccaacctgcctacagtggacccaatcgccgtgtgccacgaactttataacaccatccgggattataaggacgagcagggtcggctcctctgcgagttgtttattcgtgccccaaagaggcggaaccaaccagactactacgaagtggtctcacaaccgatcgacctcatgaaaattcagcagaagctaaaaatggaggagtacgatgacgtcaacctcctgaccgcggatttccaactcttgtttaataacgccaaaagctattacaagccggatagcccagaatataaggccgcttgtaaactatgggacctctatctccggaccaggaacgagttcgttcagaagggtgaagccgatgacgaggacgacgatgaggatggccaggataatcagggcacagtcactgaaggcagttcaccagcctaccttaaggaaatccttgaacagctgctagaggcaatagttgtcgcaactaatccctctggcaggctgatctctgaactgtttcagaagctgcccagcaaagtccaatacccggactactacgctattatcaaggaaccgatcgacctgaaaaccatagcccagcgcatccagaatggttcctacaagagcatccacgcaatggctaaagatattgatcttctggctaaaaatgctaagacatacaacgagcccggatctcaagtattcaaagatgccaacagtatcaagaagattttttatatgaaaaaggccgaaatcgaacaccatgagatggcaaagagtagcctacgaatgcggacaccctcgaatcttgctgccgctcgcttaacgggcccatcacattctaaaggatccttgggcgaagagaggaaccctacttctaagtattaccgcaataagagggccgtgcaggggggtcgactgtccgccataacgatggctctgcagtacggcagtgagtctgaggaggatgctgctctcgcggctgcaaggtacgaagaaggggaatccgaggcagaatccattaccagcttcatggacgtctcaaacccattttaccaactgtacgacacagtgaggagctgtcgcaacaatcaaggacaactaattgcggaaccattttatcacttgccttcgaagaagaagtatcccgactactatcagcagattaagatgcctatcagcttacaacaaattcgcactaagttgaaaaatcaggaatacgaaactttagaccatctggaatgtgatctaaacctgatgtttgaaaatgctaaacgctacaatgtgcccaacagcgctatttataaacgggtgcttaaacttcagcaggttatgcaggcaaaaaagaaagagttggccaggcgcgacgacatcgaggacggcgattcaatgatatcctctgcgacaagcgacaccggatccgcaaagcgtaaatctaaaaagaatatccgcaaacagagaatgaagatactcttcaacgtcgtgctggaagcacgggagccgggtagtgggagacgcttgtgtgacttgtttatggtgaagccaagcaaaaaggactatccagactactataaaatcatcttggaaccgatggacctaaagattatcgagcacaacataagaaatgataagtatgcgggagaagagggtatgatcgaggatatgaagctaatgttccgaaatgccagacactataacgaagagggcagccaggtctacaacgacgcgcacatccttgagaagttattgaaggagaaacggaaggaactgggtccactgccagacgatgacgatatggctagcccaaaactgaaattgagccgcaagtctggcattagtcctaagaagtcgaaatatatgaccccaatgcagcagaaactcaatgaggtgtacgaggctgttaaaaattatactgacaagcgcggtaggcgtctaagcgcaatctttttgcgtttaccctcaagatctgaactgcctgattactatctcactatcaagaagcccatggatatggagaagatacggtcgcacatgatggccaacaagtatcaagacatcgactccatggtggaggacttcgtcatgatgttcaataatgcctgcacatacaacgaacccgagagccttatctataaggatgctttagtcctgcacaaggtgctcctagagacaagacgagatctcgaaggcgatgaagactctcatgtccccaacgtgaccctgctaatccaagaactgattcacaacctttttgtatccgtgatgagtcaccaagatgatgaaggccgatgttatagtgactctctagctgagatccctgcggtggatccgaatttccccaataagcccccattgactttcgatataatcagaaagaatgttgagaacaatagatacaggcgcttagatctctttcaggagcacatgttcgaggttctggagcgggctaggcggatgaacaggaccgactccgagatctatgaggatgcagttgagctacaacagttttttataaagatccgcgacgaactctgcaagaacggggaaatccttttatcccccgcactttcgtatacgacaaaacatctccataatgacgtcgagaaggagcggaaagaaaaactgcctaaagagattgaggaggacaagctgaagcgggaggaagagaagcgcgaggcggaaaaatcggaggactcgagtggcgcagcgggtctgtctggtctccaccgaacttattcccaagactgttcgttcaagaattccatgtaccacgtcggcgattacgtttacgttgagcccgctgaagccaatctgcaaccgcacattgtgtgcattgagagactgtgggaagattccgccggtgagaagtggctatatggatgctggttctacaggccaaatgaaacgttccacctagctacacgcaaatttcttgaaaaagaggtgtttaaatccgactattacaataaggtgcctgtgtctaagatcctgggtaagtgtgtggtgatgtttgtcaaggagtactttaaactgtgtcctgagaattttcgtgacgaggacgtgtttgtttgcgagtcaagatatagcgctaagactaaaagtttcaagaagatcaaactttggaccatgcctatttctagcgttagattcgtgccacgagatgtacccctgcccgtggtgagagtcgcctccgtgtttgccaatgctgataagggggacgatgagaaaaatactgataactccgaggactcacgagcagaggacaatttcaatttagagaaagaaaaagaggacgtgccggttgagatgagcaacggcgaacctggctgtcattactttgaacagctgcactacaatgacatgtggctgaaagtgggcgattgcgttttcatcaaatctcacgggcttgtaagacctcgcgtcggacgcattgagaaggtgtgggtgcgagacggcgctgcttatttctacgggcctatttttatacacccggaagaaaccgagcatgagcctacaaagatgttttataagaaagaggtcttcctttcaaacctagaggaaacttgtccgatgacatgtatcctgggcaagtgcgctgtactgtcttttaaagatttcctgtcctgccggccaaccgaaatccccgagaatgatattctgctgtgtgagtcccggtataacgagagcgacaagcagatgaaaaagttcaaaggtttgaaacggttctcactgtctgcaaaggtcgtcgacgacgaaatctactactttagaaagcctattgttcctcagaaagaaccaagccccctattggaaaagaagatacagctcctggaagcaaaattcgccgagttggaaggtggcgacgacgatatcgaagagatgggcgaggaggacagcgaagtgattgagccgccatctcttcctcagttacagactcccttggcatctgagctggacctgatgccatatactcctccccagtctacaccaaaaagcgccaagggtagcgccaaaaaagaaggctcaaaaaggaaaattaacatgtccggatatatcttgttcagcagcgaaatgagagccgtcattaaggcacaacaccccgattactctttcggcgagctgagtagattagtcggtacggaatggagaaacctggagacagccaaaaaagctgaatatgaaggggttatgaatcagggggtcgctcccatggtcgggacaccagcacccggtggctcaccttacgggcagcaggtaggggtgcttggtccacctggacagcaagcacctcctccataccccggaccccaccccgctgggccaccagtgattcagcagcctaccacaccgatgtttgtggcaccaccacctaagacccagaggctgttgcatagcgaagcatatctgaagtatatcgagggcctgtccgccgaatcaaatagcatctcaaaatgggatcagacactggccgctcggagacgcgacgttcacctttcaaaggagcaggaatctagactgcccagccactggttgaagtcgaagggtgcccatacaacgatggctgatgctctctggcgacttcgtgacttgatgctgcgagacacccttaacatacgccaggcctacaatctggaaaatgtatag

SEQ ID NO: 235370 - DNA, 4808 bp, Artificial Sequence
  Description of Artificial Sequence: Synthetic coding sequence
atggggagtaagcggcgacgtgctacttcccccagttcttcagtctcaggagacttcgacgacggacatcacagtgtgagtacccctggccctagtaggaagcgtaggcgtctcagtaatctcccgactgttgatcctattgcggtctgtcacgagctgtataataccatccgagactacaaagacgaacagggccgattactgtgtgaactgttcatcagagccccaaaaaggcgaaaccagcccgactattacgaggttgtcagccagccaatcgacctgatgaagattcagcagaaactcaagatggaagaatatgatgacgtgaacctccttacagcagactttcagttactgttcaataacgcaaagagttattacaagcccgacagtccagagtataaagccgcatgtaagctgtgggacctgtacctgcgtactcggaacgagtttgttcagaagggagaagcagacgacgaagacgatgacgaagacgggcaagacaaccaggggaccgtaacagaagggagctcgccagcgtacctgaaagaaatattagagcagctcctggaagctatcgtggtcgccactaaccccagtggacggctgatctcagagctgttccaaaaactacccagtaaggtacagtatccagactactacgccattattaaggagcctatagatctgaagacaattgcgcagcggattcagaacggatcctacaagtctattcacgcgatggccaaagacattgatctactcgctaagaatgctaaaacctataatgagccaggatcacaagtattcaaagacgccaatagtattaaaaaaattttctacatgaaaaaagccgagatcgaacaccacgagatggcgaaatcctccctgcgcatgtctaacaagcgcgctgtccaagggggtcgcctttcggccatcaccatggccctacagtatgggtctgaatccgaggaagacgcggctctagccgcagcacggtacgaagagggggaatccgaggccgagtcgattacatccttcatggatgtgtcaaatcctttttaccaactttatgacaccgtaagaagctgcaggaataatcagggccagttgattgccgaacctttctatcacttaccaagtaagaaaaagtatccagactattaccagcaaattaaaatgccgatcagtctacagcagatacggaccaagcttaaaaatcaggagtatgaaactctcgaccatctggaatgtgacttaaatcttatgttcgagaacgcaaaaagatataacgtcccaaactccgccatttacaagagagtgctgaaactgcagcaggtgatgcaggccaaaaagaaggaattagcccgtagagatgatattgaagacggggacagtatgattagttcagccacttccgacactggaagtgcaaagagaaaatcaaaaaagaatattaggaaacagagaatgaaaattctcttcaatgtcgttctcgaggccagggaacccggtagtggtcgcagactctgtgatctgtttatggtgaaaccaagtaaaaaagactaccccgactactataaaattatcctcgagcctatggatctcaagattatcgaacataatattcgcaacgacaagtatgctggggaggagggcatgatagaagacatgaaactgatgtttcgcaacgccaggcactacaatgaggagggctctcaggtgtataacgatgcacatatattggagaagctcctgaaggagaaacgaaaggaattgggaccactcccggatgacgatgacatggcttctcccaaacttaagctaagtagaaaaagtggtatatctccaaagaagagtaagtacatgaccccaatgcagcagaaactgaacgaggtatatgaagctgtcaaaaactataccgacaaacggggacgccgactgagcgccattttcctgagactccctagcagatcggaattgccggattattacctgacgatcaagaagcccatggacatggagaagatccggtcccacatgatggccaataaatatcaggatatcgacagtatggtagaagattttgtgatgatgtttaataacgcatgcacatataatgagcctgagtccctgatctacaaggacgcactggtgttacacaaggttctccttgaaacacgcagagatctggaaggcgatgaggactcccatgtccctaatgtgacccttttgatccaggaacttatccacaatctgtttgtctcggtcatgtctcaccaggatgacgagggacgctgctattccgactccttagctgaaatccctgctgtggacccaaattttcctaataagccacctttgacctttgacattatccgaaagaacgtcgagaacaataggtaccgtcggctggacctctttcaggagcacatgttcgaggtactggagcgtgcccgacgaatgaacaggacagattccgagatttacgaggacgccgtcgagttgcagcagttttttataaagatccgggacgagttgtgtaaaaacggagaaatattgctctccccggcactgtcatataccaccaaacacctgcataacgacgtcgagaaagaacgtaaggaaaaactccccaaggaaatcgaagaggataaattaaagagggaggaggagaaaagggaagctgagaaaagtgaggactccagcggcgcagctgggctgtccggattgcaccgcacctatagccaggactgctctttcaaaaacagcatgtaccatgtcggcgactacgtgtacgtagagccagctgaggctaatttacagccccatatcgtttgcatagaacgactgtgggaagattcggcaggcgaaaaatggctgtacggctgctggttttacaggcctaatgagaccttccatctagcaacccgcaagttcctggaaaaggaagtgtttaagtcagattactacaataaggttcccgtctctaaaatcctgggtaagtgcgtcgtgatgtttgtcaaagagtatttcaagctttgccccgagaactttagagatgaggacgtgtttgtgtgcgagagtaggtactcagccaaaacaaaaagcttcaagaaaattaagctctggacaatgcccatctcttcagtgcggtttgttcctagagacgtgcctctccccgtggtacgagtagcgagtgtattcgcgaacgctgacaaaggagatgatgagaagaatactgataattcggaggattcaagggccgaggataattttaacctggagaaagagaaagaggatgttcccgtggagatgagtaacggcgaaccaggttgccactactttgagcagctgcattacaacgatatgtggctgaaagtgggcgattgtgtgtttatcaagagccacggcctggttcgcccaagagtcggacggatcgagaaggtgtgggttagagacggcgcagcctatttttacgggcctatcttcatccacccggaggagacagagcacgagccaaccaagatgttctataaaaaagaggtcttccttagcaatcttgaagaaacctgcccaatgacctgcattctgggcaaatgcgccgtgttgagttttaaagatttcctgtcgtgccgtcctacagaaatcccagaaaacgacattttattatgtgagagccggtacaatgagtcagacaaacagatgaaaaagttcaagggcctgaagcgattcagcctgtccgcaaaagtagtggacgacgagatttattatttcaggaagcccattgtgcctcagaaagaaccctcgccattgttggaaaaaaaaattcaactcttagaagccaaattcgcagagctggaaggaggagacgacgatatcgaggaaatgggggaagaagactccgaggtcattgagcccccatcactgcctcagctgcagaccccactggctagcgaacttgatctcatgccgtatacccccccacagtctacgcccaagagtgctaaaggatcagccaaaaaggaaggctctaagcgtaagatcaatatgtccggatacatcctgtttagtagcgaaatgcgagcagtcatcaaggctcaacatcctgattattcatttggcgagctttcaagattggtagggaccgaatggaggaacctggagaccgcaaagaaggcagagtatgaggggatgatgggcggttatcctccagggctgcctcctcttcaggggccagtcgatggacttgtgtctatgggcagcatgcaacctttgcaccctggtggtccgcctccccatcaccttcctcccggagtacccggactgcctggcatcccccctcccggtgtaatgaatcagggggtggcccctatggttggaactccggctcccggaggatccccttatggacaacaggtgggcgtcctaggaccgccaggccaacaggcacctccaccttatcccggaccacatccagccggtccaccagtcattcagcagccaaccacccctatgttcgtagccccaccccctaaaacgcagcggctcctccacagcgaggcttacctaaaatacattgagggactgtcagctgagtctaactctattagcaaatgggaccagaccctagcggctagacgtagagatgtgcacctgagcaaagaacaggagtccagactcccttcgcactggctgaagtccaagggggctcataccaccatggctgatgctctttggaggctgagggacctgatgctgcgcgataccctgaacataagacaggcctacaacctcgagaacgttta

SEQ ID NO: 235371 - DNA, 4749 bp, Artificial Sequence
  Description of Artificial Sequence: Synthetic coding sequence
atgggatccaaacggagacgagctacgtccccttcatccagcgtgagtggagatttcgatgacggccaccattcagtatccacacccggacccagccgcaaacggaggagactgagcaatctccccacagtggacccaatcgctgtgtgtcatgagctatataataccatcagggattataaggatgagcagggtagactgctgtgcgagttgttcatccgggcaccaaagaggagaaatcagcccgactactatgaagtggtgagtcaacctattgatctcatgaagattcagcagaaactaaagatggaggagtatgatgatgtgaatctgctcacagcagatttccaacttttattcaacaatgctaaatcttattataaaccagacagccccgaatacaaagctgcctgcaaactgtgggacctttacttacgcacccgtaatgaatttgtacagaagggggaggcagacgacgaagacgatgatgaagacggacaagacaaccaaggcaccgtaactgaaggctcgagtccagcctatttgaaggaaatacttgagcagctccttgaggccatcgttgtcgccaccaatcctagtggacgtttaatttctgagctattccagaaactcccatccaaggtccagtatccagattactacgcaattatcaaggaacctattgaccttaaaacaattgcacagagaattcagaacggttcctataaatccatccacgccatggcaaaagacatcgacctgctggcaaagaacgccaaaacatacaacgagcccggaagtcaggtgttcaaagacgcaaattctatcaaaaagatcttttacatgaagaaagcagaaatagagcatcacgaaatggcgaagagtagccttcgcatgcgcaccccaagcaaccttgccgcagcgagactaacgggcccatcccattcaaaaggatccctgggagaggaaagaaaccctaccagtaaatattaccgaaataagcgagccgttcaaggaggcaggctctctgccataaccatggcgctgcagtatgggtctgaaagtgaagaggatgcagccctggctgccgcacggtatgaggagggcgagagtgaggccgaaagcattacttccttcatggatgtctctaaccctttctatcagctctacgatacagtgcgatcatgccggaataaccaggggcagctgattgccgagccattctatcacctgcccagcaagaaaaaataccctgactattatcaacaaattaagatgccaatatctctgcaacagattcggactaagctgaaaaatcaggaatacgagaccctggaccatttggagtgcgatttaaacctcatgtttgagaatgctaaaaggtataacgtcccaaatagcgcgatttataagagagtccttaagctccagcaggtgatgcaggctaagaagaaggagctggcccgacgtgacgacatcgaggacggagactctatgatatcaagtgccacctcagacaccggcagcgccaagcgcaagagcaaaaagaacattcgtaaacaaaggatgaaaatcttgtttaacgtggttctggaagcgcgtgagcctggatcagggaggcggttgtgtgatctgttcatggttaaacctagcaaaaaggactacccagactattacaagataattctggaacccatggacctcaagattatagaacacaacatcagaaacgacaagtacgcaggcgaagaaggcatgattgaagatatgaaattgatgtttcgcaacgccagacactataatgaagaaggatcacaggtgtataatgacgcgcacatactcgagaaactgctgaaagagaaacgcaaagagttagggccattgccagatgatgacgacatggctagcccaaagctgaaactcagcagaaaaagtggcatatctccgaagaaatctaaatacatgacccctatgcaacagaagctgaatgaggtgtacgaggccgtcaagaactataccgataagcgcggacgtcgattgtccgcgatctttctccggcttcccagcaggagtgaactgcccgactactacctcacaataaagaagccgatggacatggagaaaatccgttctcacatgatggctaacaagtaccaggacatcgacagcatggtcgaagatttcgtgatgatgttcaacaatgcgtgcacctataacgaaccggagagcctgatatacaaagacgctctggtgctgcataaagtgcttctggaaacccgacgcgatttggaaggcgatgaggattctcatgtgccaaacgtgaccctgctgatacaggaactcattcataatctctttgtttctgtgatgtcccaccaggatgacgaagggaggtgttattccgactcccttgccgagattcctgctgtcgaccccaacttcccaaataagccacccctgaccttcgatattatcaggaaaaatgtggaaaacaacaggtatcgacgcctggacctgttccaggagcacatgtttgaggtactggaacgggcacgacggatgaaccgaacagacagcgagatctacgaggacgcggtggagctgcaacaattttttatcaagattcgagatgagctctgcaagaacggggagatactgctgtccccagcactgagttatacaaccaaacacctccataacgacgtggaaaaggagaggaaggagaagttgcccaaggaaattgaggaggacaagcttaaacgcgaagaggaaaaaagagaagccgagaagtcggaggatagttcaggcgcagcaggcctgtctgggcttcacaggacatattcccaggattgtagttttaagaattcaatgtaccatgttggcgactacgtttacgtagagcccgcagaagccaatctgcagcctcacattgtgtgtatcgagcggctgtgggaagacagtgcggaaaaggaagttttcaagagcgattactacaacaaggtccctgtatcaaaaattctgggcaagtgcgtggttatgttcgtgaaggagtactttaaactgtgtccagagaactttagagatgaagacgtctttgtctgtgaatcccggtactcagcaaagactaaaagttttaaaaagatcaaactttggactatgcccattagcagtgttaggtttgtgcctcgcgacgtgcccctgcccgtcgtgcgtgtggctagcgtctttgcaaatgccgataagggggacgacgaaaagaacaccgacaacagcgaggactctcgcgcagaagacaactttaacctggagaaggagaaagaggatgtccctgtagaaatgagcaatggagagcctggatgtcattattttgagcagttgcactataacgatatgtggttaaaggttggggactgcgtgtttattaaatcacacggcctggtgaggccacgggtgggacgaatcgagaaggtgtgggtccgtgacggagctgcatatttttacggcccaatatttatccacccggaggagaccgagcatgagccaaccaaaatgttttacaagaaagaggtcttcttaagtaacttagaggaaacgtgccctatgacctgcatcctgggcaagtgcgccgtgctctccttcaaggactttttgagttgtcgcccaacagaaatccctgaaaacgacatcctgttgtgcgaatcaagatacaatgagtcagacaagcaaatgaaaaaatttaaggggctgaaaagatttagtctttcggcaaaagttgtggacgacgagatctactattttcgaaagccaattgtgccccagaaggaaccctccccacttttggagaagaagattcagctgcttgaggctaagttcgctgagttggaggggggagatgatgacatcgaagaaatgggtgaggaggacagcgaatctacccctaaaagtgccaagggtagcgctaaaaaggaaggatccaagaggaagatcaacatgtccggctacattctcttcagttccgaaatgcgggcagtcataaaagcacagcatcctgattactcttttggagagctgagccggctagtcgggacagaatggcgaaatcttgagacagccaaaaaagctgaatacgaaggcatgatgggcggttatccccctggtctgcccccactgcagggacctgttgatggccttgtgagcatggggagcatgcaaccacttcaccccggaggtccaccccctcaccatctacctcccggagtgccaggtctgcctggtatccctccgccaggagtaatgaaccagggcgtggccccaatggttggcaccccggctccgggtggttcaccctatggacagcaagttggcgtgttgggccctcccggtcagcaggcccctcctccttatcctggaccccatccggctggacccccagtgatccagcagccgacaacccccatgttcgtcgcccctcccccaaaaacgcaacggctgctccactctgaggcatacctgaagtacattgagggtttgagcgcggaatccaattcaatcagtaaatgggatcaaaccctagccgctagacggagagacgtgcacctatcgaaggagcaagagtctcggctcccttcccactggctgaagagcaagggcgcacacacaactatggccgacgcactgtggagactgagggatctcatgttgcgcgacacattaaatatcagacaggcgtacaacctcgagaacgtgtag

SEQ ID NO: 235372 - DNA, 4905 bp, Artificial Sequence
  Description of Artificial Sequence: Synthetic coding sequence
atgggcagcaagcggcgacgcgcaacgtcgccaagttcttccgtgtcaggagatttcgatgacggtcatcactcagtatctaccccagggccaagccggaaacggcgaaggttgtcaaatttgcctaccgtcgaccctatcgccgtttgccacgaactgtacaacactattcgggactataaggacgaacaggggagactcctctgtgaactgttcattagggcccctaagcgcagaaatcagcctgactattatgaggtcgttagtcagcctatcgacttgatgaagattcaacagaagctgaagatggaggagtacgatgacgtcaacctgctgacagctgacttccagctcctcttcaataacgccaaatcttattataaacctgactcgcccgaatataaggccgcttgtaaattatgggacctttatctgcgcactagaaacgaattcgttcaaaaaggtgaagcagacgatgaagatgacgacgaggacgggcaagataatcagggcacggtcaccgaggggagctcaccggcttaccttaaggagatccttgagcaactcctagaggcgatcgttgttgccacaaatccttcaggtcgtttgatctccgaactgtttcagaagttgcctagtaaagtacagtatcctgactactacgctataattaaggaacctatcgacttgaagacgattgcccagcggattcaaaacggctcatataaatctatccatgccatggctaaggacattgatcttctggctaaaaatgccaaaacatataacgagccaggaagtcaagtgttcaaagatgccaactctatcaaaaagatcttctacatgaagaaagcagagattgaacaccacgagatggcaaagtcttctctcagaatgcgcaccccctcaaacctagctgcagccagactgacagggccatcacattctaagggctccctcggagaagaacgtaatcctaccagcaaatactatcgcaataagcgcgctgtgcaaggcggtagactgtccgccatcaccatggccttacagtatggatctgaaagcgaggaggatgctgcactcgcagcagcaagatacgaagaaggagaatctgaggctgagagcatcacttccttcatggacgtgtccaatcctttctatcagttgtatgacaccgtcaggagttgtcggaataatcaggggcaactgatagctgagccgttctatcatttgccctcaaagaaaaagtaccctgactactatcagcagattaagatgcccatttctttacagcagattagaaccaagctcaagaaccaggagtacgaaactctggatcatctcgagtgtgacttaaatctgatgttcgagaacgccaaaaggtacaacgtgcccaactcagcaatatataagcgcgtgctgaagctgcagcaagtaatgcaagcaaaaaagaaggaactggcccgtagagacgacatcgaggacggggacagcatgatttcatccgctacctctgacaccggaagcgccaagaggaagtcaaagaagaacattaggaagcagcgaatgaaaatacttttcaacgtcgtgctggaggccagagaaccaggatccgggcgacgcctgtgcgaccttttcatggtcaagccttctaagaaagactatccggactactataagattatccttgagccaatggacctgaaaatcatcgaacataacatccgcaatgacaaatacgctggtgaggagggcatgatcgaggacatgaaactcatgtttcggaacgctaggcactataacgaagagggcagccaggtgtacaacgacgcgcacattctggagaaactgcttaaggagaaacgcaaagagctgggaccgctccctgacgacgatgacatggccagcccgaaacttaaactgtcccgaaagagtggaattagcccaaagaaatccaagtacatgacccctatgcagcaaaaactgaatgaagtatatgaagcagtgaaaaattataccgacaagcggggtagaaggctgtccgcaatttttctaagactgcccagtagaagcgagctgccagactactacttaaccatcaagaagcctatggacatggagaagatcagaagtcatatgatggcaaacaagtatcaggacattgactcgatggtggaggatttcgtcatgatgttcaacaacgcgtgtacctataacgaaccggaatctctgatctacaaggatgcactcgttctgcacaaagtgctgctggaaacccggagggatcttgagggcgacgaggactcccatgtgcctaacgttaccctgctgatccaggagctgatccacaatctttttgtaagcgttatgagtcaccaagacgatgagggaagatgctacagcgatagcttagcggagatacccgctgtggacccgaatttccccaacaagccacccctgacgttcgacataatccggaaaaacgtagagaataataggtataggaggctggatctgtttcaggaacacatgttcgaggtcctggagcgggctaggcggatgaaccgcacagacagtgagatctacgaagatgctgtcgaactgcagcagtttttcatcaagataagagacgaactgtgcaagaacggtgagatcctgctatcacctgctctgtcttacactacaaagcacctacacaatgacgttgaaaaagaacgcaaggaaaagctgccaaaggaaatcgaggaggataagctgaagcgggaggaagagaaacgagaagccgagaagtccgaagatagctcaggtgccgcaggcctctccgggctgcatcgcacgtactcccaggattgctcttttaagaattctatgtatcacgtgggggactatgtctatgtggaaccagccgaggcaaaccttcaaccgcacatcgtttgcattgagcggttgtgggaggatagtgctggcgaaaagtggctgtacggttgctggttttaccgtcccaatgagaccttccatttggccacgaggaaatttctcgagaaggaggtgttcaaatcagactattacaataaagttcctgtttctaaaattctgggtaaatgcgtagttatgtttgtgaaggagtactttaaattatgtccggaaaatttcagagacgaagatgtatttgtttgtgagtctagatactctgccaaaaccaagtcattcaaaaagatcaaactgtggacaatgcccatcagctcagtccggttcgtaccccgtgacgtcccactgcctgtcgttcgcgtcgctagcgtgtttgctaacgcagacaagggcgatgacgaaaaaaacactgataactcggaagatagcagggccgaggacaatttcaaccttgaaaaggagaaagaggatgtccctgttgagatgtcgaatggagaaccaggatgccactatttcgagcagttacactacaatgacatgtggctgaaagtgggagactgtgtgtttattaaaagccacggcctcgtaagacctcgagtggggaggatcgagaaagtctgggtgagagatggcgctgcttatttctacggcccaatttttattcaccccgaggaaactgagcacgagcctacaaagatgttctacaaaaaagaagtctttctctccaatctggaagagacctgtcccatgacctgcattcttggcaaatgcgccgtcctgtcatttaaggattttctgagttgccgtccaacagaaattcccgaaaatgacatcctgctgtgcgagtcaagatacaatgagtcagacaaacagatgaagaaatttaaaggtcttaagagattttctctgagcgccaaggtcgtcgatgatgagatctactattttaggaagcccatcgttccccaaaaagagccctccccgctgctcgaaaagaaaatccagctgctggaggcgaagtttgcagaactggagggaggggacgacgacatcgaggaaatgggcgaggaggactctgaggtcattgagccccctagtctgccacaactgcagactccactggcctcagaactcgacctgatgccttacactcctccacagagcaccccaaagagtgctaaaggatctgcaaagaaagaagggtcgaaaagaaaaattaacatgtctggatacatcctctttagttctgagatgcgtgccgtgatcaaggctcagcatccagattactccttcggtgagttgtcccgtttggtgggaacagaatggagaaatctcgagaccgccaagaaagctgagtatgaaggtatgatgggtggctatcctcctggtctgccccctcttcagggccctgtggatggcctcgtatctatggggagtatgcagcccctccatccaggaggtccccctccacatcacctgccaccaggcgtcccagggctacccggtatcccacctcctggggtcatgaaccagggcgtcgctccgatggtggggaccccagcccctgggggaagtccgtacggtcaacaggtgggagtcctgggtcccccagggcaacaggcgcctcccccataccccggacctcaccctgcaggaccgccagtcatccaacaaccgaccacccccatgttcgtcgccccacctcccaagacacagcgcctcctccacagcgaggcttatctgaagtacattgagggcttatcggccgaatccaactcaatcagcaagtgggaccagaccctcgctgccagaaggagggacgtccacctgagcaaagagcaagagtcccgactgccaagccactggctgaagagcaagggggctcatacgacaatggctgatgccctgtggcgcttacgggatctgatgttgcgggacacactcaacattaggcaggcgtataacctggaaaacgtgtag

SEQ ID NO: 235373 - DNA, 459 bp, Artificial Sequence
  Description of Artificial Sequence: Synthetic coding sequence
atgggatccaaacggcgaagggcaacctcgccatctagcagcgtgtccggcgactttgacgatggccatcacagcgtgtctacccctggaccttctcggaaacgtcgcaggctgagcaacttacccactgtggaccctatcgccgtgtgccacgaactatataatacaattcgcgactacaaggatgagcaaggacgtctcctatgcgagctttttattcgagctcctaaaaggcgcaaccaacctgattactatgaggtggtctcacaacccattgatctcatgaagatccaacagaaattgaagatggaggaatacgacgatgtcaacctgttaaccgctgatttccagctgctgtttaacaacgcaaagtcatactataagccagacagtcccgaatacaaggctgcctgcaagctatgggacctatatctcagaactcgcaatgagtttgtctag

SEQ ID NO: 235374 - DNA, 81 bp, Artificial Sequence
  Description of Artificial Sequence: Synthetic coding sequence
atggggagcaaacgcaggcgggctacatccccaagtagcagcgtctccggcgattttgacgacgggcatcattcagtgtag

SEQ ID NO: 235375 - DNA, 693 bp, Artificial Sequence
  Description of Artificial Sequence: Synthetic coding sequence
atgggctccaaaagacgaagggctacaagcccgtcttcaagcgtctccggcgacttcgacgatgggcaccatagcgtgagcacacccggtcctagccgcaagcgcagacgcttatcaaacctgcctaccgtggacccgattgctgtgtgccatgagctatacaacaccattcgggactacaaagacgagcagggcaggttactatgcgagctgtttattcgcgctcccaagcggaggaaccagcctgattattacgaggtagtctcccagccaattgatctcatgaagatccaacagaagctgaaaatggaggagtacgacgacgttaatctgcttaccgctgattttcagctgttattcaacaatgcaaagtcttactataagcccgactcaccggaatataaggctgcctgtaagctgtgggatctttaccttcggacaagaaatgaattcgtgcagaagggggaggcggacgacgaggatgatgatgaggatggacaggacaatcagggtactgtcaccgagggctccagccctgcttaccttaaggagattctggaacagctgctcgaggctatcgtggttgccaccaacccatcaggacgactcatatcagaacttttccagaaactcccgtcaaaggtccagtatccagactattacgccattattaaggagcccatcgacctgtag

SEQ ID NO: 235376 - DNA, 132 bp, Artificial Sequence
  Description of Artificial Sequence: Synthetic coding sequence
atgggatcaaagaggcgaagggcgaccagccctagtagcagtgtcagcggcgattttgacgacgggcaccatagcgtgtcaacgcctgggccttcacgaaagcggagaagactgtccaatcttccgacatag

SEQ ID NO: 235377 - DNA, 357 bp, Artificial Sequence
  Description of Artificial Sequence: Synthetic coding sequence
atgggtagcaagcggagacgagcaacctccccaagctcttcagtatcgggggactttgacgatggtcaccatagcgtttctaccccgggaccctctcgcaagaggaggaggctgtctaatctgccaaccgtagaccctatagccgtgtgccatgaactttacaatacaattcgggactacaaagatgagcagggtcgtcttctctgcgaacttttcattagggccccaaagcgacgtaatcagccagactattatgaggtcgtcagtcagccaattgatcttatgaagatccagcagaaactgaaaatggaagagtacgatgacgtgaatcttctgaccgccgactttcagctatag

SEQ ID NO: 235378 - DNA, 264 bp, Artificial Sequence
  Description of Artificial Sequence: Synthetic coding sequence
atgggttccaaacgtagaagagctacgagtcctagcagctcagtctcaggagattttgatgacgggcaccattccgtgtcaacgcctgggccaagcaggaagcggcgacgactctctaacttgccaactgtcgatcctatcgctgtttgccacgagttgtataataccataagagattacaaggatgaacaggggaggctgctgtgtgaactgtttatcagagcccctaagcgccgtaaccagccagattactacgaggtatag

SEQ ID NO: 235379 - DNA, 132 bp, Artificial Sequence
  Description of Artificial Sequence: Synthetic coding sequence
atgggcagtaagaggcggagagcaactagcccttcttcctcagtctccggtgacttcgatgacggccatcactcagtctctactcctggtcctagtcgcaaacggagaagattgagcaatttacccacatag

SEQ ID NO: 235380 - DNA, 828 bp, Artificial Sequence
  Description of Artificial Sequence: Synthetic coding sequence
atggagggcgtcgctgtagttacagccggatcggtgggtgccgctaagactgagggcgctgctgccctgccgcctccccctcctgtttcaccaccggctctcacaccagccccagccgcaggggaagaggggccagcaccactttccgagaccggagctcccggatgctcgggttcgcggccaccagaacttgagcctgaaaggtcccttgggagatttcggggaaggttcgaggatgaagatgaggaactggaggaagaagaggaactggaggaggaagaagaagaggaggaagaggacatgtcgcacttctcactgaggttggaaggcggacggcaggactccgaagatgaagaagagcggctgatcaacctgagtgaactgacaccatacattctgtgttcaatctgtaaaggctacctcattgacgcaacaaccataacagaatgcctccacaccttttgcaagtcctgtatcgttaggcatttctattactccaatcgctgtcccaagtgtaacatagtggtgcaccagacacagcccctgtataacatctccgccaacgaaggaacgggacatttcaagcctttggaaaagaaattcgttcgtgtctctggagaagcgactatagggcatgtcgagaagttcctccggagaaaaatgggactggaccctgcatgccaggtcgacatcatctgcggcgatcacctgctggagcagtatcagacgctccgagagatccggagggcgatcggggacgctgctatgcaggacggactgctggtattgcactacggtttggtggtctcgcccctgaagattacgtag

SEQ ID NO: 235381 - DNA, 1053 bp, Artificial Sequence
  Description of Artificial Sequence: Synthetic coding sequence
atggaaggtgtggctgtggtgacggccggaagcgtcggggctgctaagaccgagggggcagcagccctcccacctcctccacctgtgagtcccccagctctcacacctgcgcctgccgcaggagaggagggcccagctcctctttctgaaactggcgctcccggatgtagtggcagtcgtccgcctgaattagaacccgaaagatctttaggcagattcagaggccgttttgaggacgaagacgaggagttggaagaagaggaagagctagaggaggaggaagaggaagaggaggaggatatgagccacttctccctaaggctggagggaggtcgacaggacagtgaagacgaggaggagaggctgattaatctgtctgaactaactccatatatcctctgttcaatctgcaaaggctatctcatcgatgccaccactataacagagtgtcttcacacgttttgtaaatcctgcattgtacgacatttctactacagcaaccgctgtcctaaatgtaacatcgtggtgcaccagacgcaaccgctgtacaatatccggctggataggcagctgcaggacatagtctacaaattggtcattaacctggaggagcgcgagaaaaagcagatgcatgatttctacaaggagaggggtctcgaggtcccaaaacctgctgtcccacagcccgtaccgagctccaagggtcgaagtaagaaggttctggagagcgtgttccggattcctcctgagttggacatgagccttttactcgaatttattggggcaaatgagggtacagggcacttcaaacctctggagaaaaaattcgtgcgcgtgagcggcgaggccactattggccacgttgagaaatttctgcgcaggaagatgggactggatcctgcttgccaggtggacatcatatgtggtgatcacctcctagaacaataccagactctgcgagaaataaggagggcaatcggcgacgccgctatgcaggacggtctcctggtacttcactacggcctcgttgtgagtccattgaagatcacttag

SEQ ID NO: 235382 - DNA, 10191 bp, Artificial Sequence
  Description of Artificial Sequence: Synthetic coding sequence
atgaccgcatggttgatttctcttatgagcatcgaggtgctcctacttgccgttaggcacctctccctgcatattgagccggaggaaggaagtctcgccggaggaacctggattacagtgatctttgacggcctggaacttggcgtgttatacccaaacaatggctctcagttagagattcacctggtgaatgtcaatatggtggtaccggctctgcgatcggtcccgtgtgatgtctttcctgtttttctcgacctccccgtagtcacctgccggacccggtccgtgctcagtgaagcccacgaaggactgtattttttagaagcctattttgggggacagttggtcagtagccctaatccagggccaagagattcatgtaccttcaaattcagcaaggcccagacaccaatcgtgcaccaagtgtatccgccaagcggggtaccaggaaagctgatccacgtgtatgggtggattatcactggtaggctcgaaacattcgatttcgatgctgagtacatcgattctccagtcattctggaggcccaaggcgacaaatgggtaacgccatgctcactcatcaatcgccagatgggtagctgttatccaattcaagaagatcacggactgggtaccttgcagtgtcatgtggaaggtgactatattggatctcaaaacgtatctttctccgtcttcaataagggcaagtccatggttcacaaaaaggcctggctgattagtgctaaacaggatctcttcctttaccaaacccattccgaaattctgtctgtttttcccgaaacaggctctctgggaggaaggaccaatattactatcactggcgatttctttgataacagcgcacaagtgacaatagcgggtattccatgcgatatccgccatgtttctccacggaaaattgagtgcaccaccagagctcccggtaaggacgtgaggctgacgactcctcagcctggcaatcgcggtctgctgttcgaggtgggcgatgccgtagagggactggaacttactgaagctaccccgggatatcgctggcagatcgtgccgaatgctagtagcccttttgggttctggtcgcaggaaggccagccattccgcgctcggctgtccggcttctttgtggcacctgaaactaataactacaccttttggattcaagccgattcccaggcctctctacacttttcatggagcgaagaaccccgtaccaaggtcaaggtcgcgtctatttctgttggtactgctgactggttcgattcatgggagcagaaccgcgacgagggcacctggcagcaaaaaacaccgaaacttgaactgctgggcggtgctatgtactacttggaagccgaacatcacggtattgcccctagccggggaatgcggatcggtgtccagattcacaacacgtggctgaaccctgacgtagtgaccacttatctcagggagaaacaccagattcgcgtccgcgcacagcggctcccggaagtgcaggtgttaaatgtcagcgggagaggcaacttctttttgacatgggacaatgtctctagccagcctatccctgccaatgccaccgcccaccttatccagactaccatcgaggagttactggctgtgaaatgcaaactagaaccactgtggtcaaacattctgctcaggctgggctttgagcgaggacccgaggtgtccaattcagacggagatttaacatctgggacggaacccttttgtggccgattttctctgcgccaaccacggcacttggtgctgacaccccctgctgcacagaagggctaccggctggatcaatatacccatctctgtttagcctacaagggccacatgaataagattctcaaaatgatagttagcttcacgataggttttcagaatatggtcaagaacacaacgtgtgattggagcctcacccgcacttcacctgagtcatggcagttcgattgtactgatctgtgggagacatgcgtccggtgttttggagacctgcagccaccacctgcaaattcacctgtgctcgttcaccagatcaatctgcttcccctggcccaggagaccggccttttttatgtggacgaaatcataatcgccgacactaacgtgacagtgtctcaggcggatagcgggacggccaggcccggtgggaacttagtggagtctgttagcgtggtgggtagtccaccggtgtacagcgtgacgtcctggttggcgggttgcggaacagagctccccctgattactgcccgatctgttccaaccgaaggcacggaagaaggctcaggtttggttcttgtgacgacacagcgtagacagaggacgtcccccccactgggaggccacttccgcattcagctgcccaacacagtgatcagtgatgtacctgtgcagatctcggcccaccatttgcaccagttacttcagaacaatgccgacgacttcaccagccggtacctgaacgctagcgatttcaccgtgaaagaggacttgtacacctgctacgagcatgtttggacactttcgtggagcactcaaataggtgacctcccgaattttatcagggtatccgacgagaatctaactggtgtgaaccctgccgcagccaccagagtggtatacgacggtggagtctttttaggaccaattttcggagatatgcttgccactgctaaccagcatacccaggtcgtggtgcgggttaatgacgttccagcacattgccctgggtcttgttccttccagtacctgcaagggagcacaccttgtgtacactccgtttggtattccatcgatggggacattaacctgatgatctatattaccggcacaggcttctcaggggactctcagtttttgcaggtcaccgtgaacaagacttcatgtaaagtgatcttcagtaaccagactaatgtggtttgtcagaccgacttactgccggttgggatgcaccgaatactgatgctggtgagaccttcaggtctggcgatctccgccacgggggaagaccttttcctaaatgtgaaaccaagactggacatggtcgagccctcccgggctgcggatattgggggtctgtgggcgactattaggggttcctctctggagggtgtttctctcatcctgttcggttcctactcttgtgccattaacgtagccacctcaaattcttcgcggattcagtgcaaggtgcctcctagaggcaaggatggtaggatagtgaacgtgaccgtgattagaggggattacagtgccgtactcccacgggcatttacctacgtttccagcttgaaccccgtgatagtgaccctcagccgcaacatttcaaatattgccggaggggagactctcgtaatcggggtggcacggctcatgaattacacggatctggacgttgaggtgcacgtacaggatgcccttgcgccagtgcacacccaaagtgcctggggcctcgaggtcgccctgcccccactgcccgcaggcttgcaccggatttccgtctctataaatggtgtaagcatccacagccagggcgtcgacctgcatattcagtatctgacagaagtgttttccatcgaaccttgttgtggctcacttttgggcggaactatcttgtccatcagcggcattgggttcagtagggaccccgctttggtttgggtcctcgtggggaaccgcagctgcgatatagtcaatctaaccgaggcaagtatttggtgcgaaactttgcccgctccgcagatcccagatgctggggctccgacagttccagccgctgtcgaggtgtgggcgggaaatcggttttttgcccgaggcccttcacccagcctggtcggcaagggattcaccttcatgtacgaggctgcagctacacctgtggtgactgctatgcaaggtgaaatcactaattcctccctgagcctgcacgttggaggctccaatttgagcaattctgtgattctgctggggaatctgaactgcgacgtcgaaacccagagctttcagggaaatgtgagcctctcagggtgtagtatccccctccattctctggaagcagggatctaccctctccaggttcgacagaaacagatgggcttcgctaacatgtccgttgtcctccagcagtttgctgttatgccacgaataatggccatctttccttcacagggaagcgcatgtgggggtacaatactcaccgtacggggtcttttactcaacagtaggaggcgatcagtccgcgtggacctttcgggacccttcacctgcgtgatactctctctcggcgatcacacaatcctttgtcaggtcagcctagaaggcgaccccctacccggtgccagcttttctctgaacgtgacggtcctagtaaacgggttgacctcagagtgccaaggaaactgcacactcttcatacgtgaggaagccagccccgttatggacgctctttccaccaacaccagcggcagtctgactacagtgttgattaggggtcaacgactagccacaacagccgacgaaccaatggtctttgtggatgatcagctcccatgcaacgtgacattcttcaacgcgtcacacgtggtatgtcagactcgggatctggctccagggcctcactatcttagcgtcttttacaccagaaatgggtatgcatgcagcggcaatgttagcaggcacttctacattatgccgcaggttttccactactttcctaagaatttcagtttgcacgggggttcactgcttactattgaaggcacaggcctccgcggacagaacaccacctcagtgtacatcgatcaacagacttgcctgacagtgaacataggagcagaactgattcgctgcattgtcccaactgggaatgggagcgttgcgctcgaaattgaagtcgatggactgtggtaccatatcggggttattgggtataataaggctttcacccccgagttaatcagcattagtcagtcggatgacatactcacttttgcggtggcccagatttccggtgcggcaaacattgacattttcatcggaatgagtccttgcgttggggtgtctggtaatcatacagtcctacagtgcgttgtgccttccctgcccgctggcgaataccacgtccgcggatacgactgcattcgagggtgggccagtagcgccctggtctttaccagtcgtgtgatcattacggctgttacggaaaattttggctgcctgggaggtcggctggtgcatgtgtttggcgcaggctttagccctggcaacgttagtgctgctgtatgtggcgctccttgccgagtgctggccaatgccactgttagtgccttttcctgcctggtcctcccactggacgtaagcttggccttcctgtgcggcttgaaacgggaagaagattcctgtgaggctgccaggcacacatatgtacagtgcgatttgacggttgctatggccacagaacagttgttagaatcttggccttacctctacatttgtgaagagtcatctcagtgtctgtttgtgcccgatcattgggcagagagcatgttcccctcgttcagcggattgttcatctcccctaaactggagcgggacgaggtgttgatatataatagctcttgtaatatcaccatggaaacagaggccgagatggagtgtgaaactcctaatcagcccataacagtgaaaatcaccgagattagaaagcgctggggacagaatacacaggggaatttttcgctacagttctgcaggcggtggagtaggacccacagttggtttcccgagagacttcctcaggacggggacaacgttacagtggaaaatggtcagttgctcctgctggataccaatacctctattctgaacctgctgcatattaagggcggtaagttgattttcatggctcctggacctatcgaattaagagctcatgccattctggtttcagatgggggagagttacggatcggcagtgaagataagccgttccaaggtagagcacagatcacattgtatggtagcagttacagtacacccttctttccctacggagtgaagtttctggctgttagaaacggaaccctctctctccacggctccctccctgaggtcatagtgacatgcctgcgggcaacagctcatgcattggacacggtgctcgctctggaggacgctgtcgactggaatcccggtgacgaagtggtcatcatcagtggaaccggcgttaagggggcaaagcccatggaggaaattgtgaccgtggaaacagtacaggatacggacctctatttgaagagtccattgcgatattctcataattttactgaaaactgggtggcaggtgaacaccatatcctcaaggcaaccgtggccttgctgtcccgcagcatcaccattcagggcaatctcactaatgaaagagagaagctcctggtaagttgccaggaggcaaacgccccagaagggaacttacaacattgcctttatagcatgtctgagaagatgctaggctccagggatatgggcgctcgtgtcattgttcagtcattccccgaagaaccaagccaggtgcagcttaaaggtgtgcaattccaggtgctggggcaggcttttcataagcatctgtcttcactaaccctggtcggagccatgcgtgagtcttttattcaggggtgcaccgttcgaaattcattcagcagagggttatccatgtgcgggaccctggggctgaaggtggatagcaacgtgttctacaatattttgggccacgctttattagttggaacttgcacagaaatgcgctatatctcttgggaggccatacatggtcgcaaggacgactggtctggccatggtaatattatcagaaacaacgtgataattcaagtgtcgggcgctgaggggctcagcaatcctgagatgctcaccccaagtgggatttacatctgttcacccacaaacgtcatcgaagggaatcgcgtgtgtggcgctgggtatgggtactttttccatctgatgacgaatcagacctcacaggctccattactctcttttacccagaatatagcccactcatgtactagatatggcctgtttgtgtaccctaaattccagcctccatgggacaatgtaacagggaccaccctgttccagtcattcaccgtctgggaaagcgcaggtggcgctcaaatctttcgcagcagcaacctccgtctcaagaactttaaggtgtactcctgccgggactttggcatagatgtgttggagtccgatgcaaatactagcgtgactgactctctgttactgggccatttcgctcataaaggtagcctgtgtatgagctctggcattaagacaccgaagcggtgggagctgatggttagtaacactaccttcgtgaacttcgatctaattaactgcgttgccatcaggacatgttctgactgctctcaggggcagggtgggtttaccgtaaagacttcacagctaaagttcacaaactcatcaaacctggtggccttcccttttcctcatgccgcaatcctcgaggacctggacgggtcattgagcggcaaaaacagatcgcacattttggcctctatggaaaccctgagtgcgagctgtttggtgaatagctctttcggacgcgtcgtgcatgggagcgcttgcgggggtggggtcttgtttcaccgaatgtccatagggcttgctaatacaccggaggttagttacgacctaacgatgacagacagtcgtaacaaaacgacaactgtgaactacgtgcgggataccctgtctaacccaagggggtggatggctctgttgttggatcaggagacctatagccttcagtcagaaaacctgtggatcaatcgaagcctccagtattccgcgaccttcgacaactttgcacctggaaactatctcttactggtccatacagacctgcctccatacccggatatcctccttaggtgcggttcacgggtggggctctcttttccgtttctgcctagtccaggccagaaccagggctgcgattggttcttcaattctcagctgagacagctcacttatctggtttccggagagggacaggtgcaggtcattcttcgcgtgaaggaggggatgccaccgacaatttccgcctcaacatcagccccagagtcagccctgaagtggtccctgcctgaaacatggcagggcgtggaagaaggctggggcggatacaataacaccatccccggaccgggagacgacgtgcttatcctgccgaaccgaacggtgcttgtggacacagacctcccatttttcaaaggtctatacgtgatgggaacactggactttccggttgacaggagcaatgtcctgtctgtagcttgtatggtgattgcgggaggggagctgaaagtgggcacactcgaaaatccactcgagaaggagcagaagctactcattctcttgagagcctcagaaggcgttttttgtgataggatgaatgggatacatattgatccagggacgataggggtctacggtaaggtccacctatacagcgcttatcccaaaaactcgtggacccaccttggggctgatatcgcttctggaaatgagcgtattatcgtggaagacgctgtagattggcgccctcacgataaaatcgtgttgtctagcagcagttacgaaccccatgaggcggaggtgttaaccgtcaaggaagttaagggccaccatgtcaggatatatgagcgcctgaaacatcgtcacatcggtagcgtgcatgtgacagaagacggacggcacatccggctggcagctgaggtgggacttctgacaagaaacatccagatccaaccagacgtctcttgtcgaggcaggttatttgtgggcagctttaggaagagttctagggaggagttctctggcgtgctgcagctcttgaatgtagagattcagaactttggatcgcccctgtatagttctgtcgaattttctaacgttagcgcgggtagctggatcatttcgagtacgctgcaccagtcttgtggcggaggcattcatgcagccgcatcacatggcgtgctgctcaacgataatatcgtgtttggtacggctggccacggcattgacttggaggggcaggcttataccgtgactaataatttagtggtcctgatgactcagccagcatggtcaactatctgggtggcagggataaaggtgaatcaggtgaaagacatcaacctgcacggaaacgttgtagctggcagtgaacgccttggttttcatatcagaggtcacaagtgctcatcatgtgagctgctgtggagtgacaacgttgcccactcgtctctccatggactccacttgtacaaggagtccggcctggacaattgtacaaggatttctggtttcttggcttttaaaaacttcgactatggagcaatgctgcatgtggagaactctgtagagattgaaaacatcactctggtagataatactataggattgctagcagtcgtatacgtattctccgccccacagaactctgtaaaaaaagtgcaaatcgtactgcggaattccgttattgtcgccacatcttccagtttcgactgtatccaggacaaggtcaaaccccattctgccaacctgacttcaacagaccgggcaccttcaaatccacgcggtggcaggattggaattttgtggcctgtgtttacaagtgagcccaatcagtggccacaggaaccttggcacaaagtgcgaaacgaccactcaatctcgggtataatgaaacttcaagatgtgactttttctagctttgtgaagtcctgctactctgatgacctggatgtgtgtatactgccaaacgcggaaaactcaggaattatgcatcccataaccgctgagaggacccgaatgctgaaaatcaaggacaagaacaaattctactttccctccctacaaccacgcaaggatctgggcaaggtagtgtgtcctgaactggattgtgctagtcccaggaaatacctctttaaagacctggacgggagagccttaggattgcctcccccagtgtcagtgttcccaaaaaccgaggccgagtggaccgcgagcttttttaacgctgttacgacagaacaggcacttaagatctctgagtag

SEQ ID NO: 235383 - DNA, 12225 bp, Artificial Sequence
  Description of Artificial Sequence: Synthetic coding sequence
atgactgcctggctcataagcctcatgagcatcgaggtcctactgttagcagttcggcatctcagccttcatattgaacctgaagagggatccctcgcaggcggaacatggatcacagtaatttttgacggattggagttgggagtgctgtatcctaacaacgggtctcagcttgagatccacttggtgaacgtaaatatggtggtgccagccctccggtcagtgccttgcgatgtatttcccgtgtttctggatcttcctgtcgttacttgtcggacacgctcggtattgagcgaggcccacgagggcctgtacttccttgaggcgtactttgggggtcagctcgtctccagccccaacccgggtcctagggatagctgtacattcaagttctccaaggctcagaccccaattgtccaccaggtttaccctccctctggtgtgccagggaaattaattcatgtctatgggtggatcatcactggacgtctggagacatttgatttcgatgccgaatacatagatagccctgttattctcgaagcccaaggcgacaagtgggtgacaccttgctcattaattaataggcagatgggctcctgctatcccattcaggaagatcacggccttggcacactgcagtgtcatgtggagggcgactacattgggtcacagaacgttagcttcagcgttttcaacaagggaaaaagcatggtgcataagaaggcctggcttataagcgctaagcaggacctgttcctataccagacacactcagagatcctttccgtgtttccagaaacaggctctctaggcggtcgcacaaatattaccatcactggggacttcttcgacaacagtgctcaagtcacaatagcgggaattccttgtgacatccgtcacgtttctccacgaaaaatagaatgtaccacccgggcacccggtaaggacgttcgcctgaccaccccccagcctgggaatagaggtctcctctttgaggtgggggacgccgttgaaggcctggaactgacagaggccacaccgggttataggtggcaaattgttcctaatgcctcatcaccttttggcttctggtcgcaggaaggacaaccattcagagctaggttgagtggcttcttcgttgcccctgagacaaataactacacattttggattcaggcggactcccaggctagccttcatttttcttggagcgaggagccgaggaccaaagtgaaagttgctagtatctccgtggggacagccgattggttcgatagttgggagcaaaaccgagatgagggcacatggcagcagaaaacaccaaagctcgaactgctggggggtgcgatgtactacttggaagccgaacatcacggaattgctccatccagaggaatgcgaataggagtgcaaatacacaatacatggcttaatcctgatgtggtaaccacctatcttcgggaaaagcaccagattcgtgtgcgcgcacagagactgccggaggtgcaggtgttgaacgtgtccggccgtgggaacttcttcctgacttgggataacgtctcttcacaaccaatcccggctaacgcgactgcccacctgatccagacaacaatcgaggagcttttggctgtcaagtgcaagcttgagcccctgtggagcaacattctgctgcgtctaggctttgaaagaggccctgaggtttccaattccgatggcgatctgacgtccggcacagaacctttctgtggtcgcttctctttgcgacagccgagacacctcgtcctgactccacctgccgctcagaagggctacaggctggaccagtatacccacttgtgcttggcttacaaagggcatatgaataagatattgaagatgatcgtgagctttactatcgggtttcaaaacatggtgaagaacactacatgcgactggagccttactcggacgtcacctgaatcatggcagtttgattgtactgacctgtgggaaacttgcgtccgctgttttggcgatctgcagccgccaccagccaacagcccggtcttggttcatcaaatcaatctgttacctctggcccaggaaacgggcctgttctacgtagatgaaatcatcattgctgacaccaacgtaaccgtgagtcaagctgactccggaacagctcggccagggggtaaccttgttgaaagcgttagcgtagtcggcagtccacccgtttactccgtgaccagctggcttgccggttgtgggactgagctgccactaattaccgcgcgatcggtccctaccgaaggcaccgaagaaggaagcggcctagtgttagtcaccacacagaggcggcagagaacaagtcccccattggggggtcatttccgaatacagttgcccaacactgttatcagtgatgtccctgtccagatcagtgctcaccatcttcaccaactgctgcagaacaatgctgacgattttaccagtcgatatctgaacgcttccgacttcaccgtgaaagaggacctgtacacctgttacgaacatgtttggaccttgtcttggagtacccagattggcgatttaccgaactttatccgggtgagcgacgaaaacctcacaggcgtcaacccagcggcagccacccgcgtggtgtatgacggcggagtcttccttggcccaattttcggggatatgcttgccaccgccaaccagcacacccaggtagttgtgcgcgtgaatgacgtgcccgcacattgtcccggtagctgtagcttccaatacctgcagggctctaccccatgcgtacattccgtgtggtactcaattgatggtgacatcaacctgatgatttatatcaccggtacgggattctctggtgactctcagtttctgcaagttaccgtgaataaaacctcctgcaaggtcattttttccaaccagactaatgtcgtttgtcagacagatttgctacccgtggggatgcatcgtatcctgatgctcgtcaggccatccggcttggctatctccgctacaggcgaggatttattcctcaacgtgaaacccagattggacatggtggaacctagtcgcgctgcagacattggcggactctgggccacgatcagaggaagttccctggaaggagtttccctgattctttttgggtcctacagctgtgctatcaacgttgcaactagcaactccagcagaatccagtgcaaggtcccgcctagagggaaagatgggaggatcgtgaatgtgaccgtgatcagaggggactacagtgccgtgcttcctcgtgcatttacctatgtgtcttcactgaaccctgtgatcgttaccctcagtcggaatatatccaatatagcagggggagagacactggtaataggtgttgctaggcttatgaattacaccgatttggacgttgaagtacatgtgcaggacgcactcgctcctgtgcacactcagagtgcatgggggctggaagtggcccttccgcctctgccggctgggctgcatcggatttccgtatctataaacggggtgagcatccattcccaaggcgtcgatctgcatatacaatatttaaccgaagtcttttccatcgagccatgctgtggttcacttctaggcggtacgattctgtcaatcagcgggattggattcagtcgcgacccggcactggtgtgggtgctcgtcgggaatcggtcctgtgatatcgtgaacctgaccgaagcctcaatatggtgtgaaaccttgccagccccacagatccccgacgcaggcgcacccacagtgccagctgcagtggaagtctgggccggaaaccgctttttcgcgcgaggcccttctccttcactcgtgggtaagggttttaccttcatgtatgaagcagcagcaacacctgttgtgaccgctatgcagggagagatcacaaactcgtccctatctctgcacgtggggggttcaaatttaagcaattctgtaatcctactggggaaccttaactgcgatgtggagactcagtcttttcaaggaaatgttagcctgagtgggtgcagtatccctcttcacagtttggaggcagggatttacccacttcaggtgcggcagaagcagatgggcttcgcaaacatgtcagtagtgctgcagcagttcgccgtgatgccccgaataatggccatctttcccagccaggggagtgcctgcgggggaaccattctcactgtaagggggcttctcctgaactcccgaagaaggtcagtccgggtagatctgagcggcccttttacatgtgttatccttagcttgggcgaccacactatcctttgccaggtgagcctggaaggagaccccttgccaggcgcttctttctcgctgaacgttactgtcctggtcaatggccttaccagtgagtgtcaaggaaactgcacgttatttatcagagaggaggctagtcccgtgatggacgctctgtctaccaatacctctggctcattgactactgttctaatcagggggcagagactggccacaactgcagatgagcccatggtgttcgttgacgatcagctgccttgcaacgtcactttttttaatgcatctcatgtagtgtgtcagactcgtgacttagcccctggtcctcattacctgagtgtgttttatactcggaacgggtacgcttgcagtgggaacgtaagcagacatttctacatcatgccccaggtattccattactttcctaagaattttagtttgcatggagggtccctgctgaccattgaaggtactggcctgaggggacaaaacactacatccgtttatattgaccaacagacttgcctgaccgtcaatatcggcgcagagttaatacgatgcatcgttccaacaggcaacggcagtgtcgctctcgagattgaggtggacggcttatggtatcatatcggagtgatcggctataataaggcgtttacaccggagcttatcagtatctcccaatccgacgacattctgaccttcgcagtagcacagatcagtggcgctgccaatattgacattttcatcgggatgtccccctgtgtgggcgtgtctggcaaccacacagtgctacagtgcgtggtgcctagccttcccgctggagagtatcatgtacgagggtatgattgtatccgcggttgggccagctccgcccttgtattcaccagtcgcgtgattattaccgctgtcactgagaattttggctgcttgggcggtagactagtgcacgtgttcggcgcaggattctctccaggtaacgtaagtgctgcagtgtgcggagccccttgccgagtgttggcaaacgctaccgtctccgccttctcctgcctggttttaccacttgacgtgagtctcgctttcctgtgcgggctgaagagggaggaggactcctgtgaagctgccagacacacttatgtgcagtgtgaccttacggtggccatggccaccgaacagctgctcgagtcctggccatacctctacatctgtgaggagtccagtcaatgtctgttcgtacctgaccattgggccgaaagcatgttcccaagcttcagtggccttttcatcagccccaagttggaaagagacgaagttctgatctacaactcttcttgcaacatcacgatggagaccgaagccgaaatggaatgcgaaactcccaatcaacctattacagtgaagattaccgagataaggaaaagatggggacagaacacccaaggcaacttcagcctgcagttctgcagacgatggtctcgaacccactcatggttccccgagagactgcctcaagatggcgacaacgtgacggttgagaatgggcagcttctcctccttgataccaacacctctattttaaatttgcttcatatcaaagggggtaagctcatatttatggcccctggtcccatcgagctgcgcgcacacgcaattctggtgtctgacggtggggaacttcggatcgggtcggaggacaagcccttccagggtcgtgctcagatcacactttacgggtcctcatacagtaccccattcttcccctacggggtcaagtttctcgcagttcggaatggcaccctgagtctccatgggtccctgcctgaggtcatcgtcacatgtctgcgggcaacagcccacgcgttagatacagtcctcgcactggaagacgcggtagactggaacccgggagacgaggttgtgatcatatcgggcaccggggtgaagggcgctaaacccatggaggagatagtaaccgttgaaactgtccaggacactgatctatatctcaaatcccctctgcgctattcccataacttcactgaaaactgggtggctggggagcaccacatactgaaggcaacggtggccctcttgagccggtccattaccattcagggtaatctgactaatgagagagaaaagctgctcgtttcctgtcaggaagccaacgccccagagggtaacttacagcactgtctgtacagcatgtcggaaaaaatgcttggcagccgggacatgggagcaagagtcatcgttcagtctttccccgaggagccctcgcaggtgcagctcaagggcgtacagttccaggtgcttggccaagccttccataaacacctgagctctcttacactggtgggggcaatgcgcgagagctttatacagggctgtacagtgcgcaattccttctcgagaggcttgagcatgtgtggcactcttgggctcaaagttgactcaaacgtcttctacaatattctgggtcatgcactgcttgtgggcacctgtacagaaatgagatacatatcatgggaggcaatacacggcaggaaggacgactggagtggacacgggaatatcatccgaaacaacgtgattatccaggtgtctggcgctgaggggttgagtaaccctgagatgcttactccatcagggatctacatctgtagccctactaacgtcatcgaaggcaacagagtgtgtggagctggatatggatacttctttcaccttatgactaaccaaacaagtcaggccccactcttgagcttcactcagaatattgctcactcttgcaccagatatgggttgtttgtttatcccaagtttcagccaccgtgggacaatgtgaccggcactaccctcttccagtccttcaccgtctgggagagtgccggtggtgcacagattttccggagcagcaatcttagactcaaaaatttcaaagtatactcttgccgcgacttcggcattgacgtgctggaatcggacgctaacacatctgttactgattctctgctattgggacatttcgcacacaaggggagtctttgcatgtccagtggtatcaaaactcccaagagatgggagctgatggtatctaatactacatttgtgaactttgacctcattaattgtgtcgctatcaggacatgctctgattgctcccaaggacagggcggtttcacagtgaaaacctcccagctgaaatttactaatagcagcaacctggtggcattcccttttcctcatgcagccattctcgaggacctcgatggatccttatcgggaaagaacaggtcacacatcttagcctcaatggaaactctttctgcctcatgtcttgtgaactccagctttgggcgagttgtacacggaagcgcctgtggagggggtgtgctgttccacaggatgtctatcggccttgccaataccccagaggtcagctacgatttgacgatgaccgacagcaggaataagaccacaactgtgaattatgtcagagacacactgagtaatccgcgaggttggatggctctgctactcgaccaagagacctactctctgcagtccgaaaacttatggattaatagatccctgcagtattcggcgacattcgataactttgctccaggtaactacttgctcctggtacatactgaccttccaccgtatcccgatattctcctccggtgtggctctcgggtaggcctgagcttcccatttctccctagccctgggcagaatcagggctgtgattggttcttcaacagccagctcagacagcttacttaccttgtgtcaggggaagggcaagtccaggtcattctgcgagtgaaagagggcatgccccctacaatttctgcatcaacgtccgccccagaaagcgcgctcaaatggtcactgcccgagacgtggcagggagtggaagagggctgggggggttacaataatacgattcccggaccaggcgacgacgtcttaatcttgcctaacagaaccgttctagtggacacagacttgcccttcttcaaaggtttatacgttatggggacactggattttcccgtggaccgtagcaacgtcctgagtgtggcatgtatggtcatcgctggtggagaattgaaggtaggcacactggagaacccgttggaaaaagaacaaaagctcctgattctgttgcgcgcttctgaaggggtgttctgtgaccgtatgaacgggatccacatcgatccgggaacgatcggggtgtacggcaaggtgcacctgtactccgcttaccccaagaattcatggactcacctcggggcagacattgcatccggtaacgaacggatcattgtcgaggacgccgttgattggcggccacatgacaagatagtcctgagcagctcttcttacgaaccacatgaggctgaagtgctgacagtgaaggaagtgaaagggcaccacgttcgcatttatgagagactgaagcaccgccacattggaagcgtgcacgtgaccgaagacggcaggcacatccgcctggccgctgaagtggggctgcttactcgcaatattcagattcaacctgacgtctcctgtcgcggtaggttattcgtggggtcatttcgtaaatcaagtcgagaggaattttcgggtgtgctccaactgcttaatgtcgagattcagaatttcggctccccactttactcgagcgttgagtttagcaacgtgtcagccggatcctggatcatatcttcaacactacaccagtcctgcggagggggaattcacgccgctgcctcccacggggtgttgctgaacgacaacattgtctttggcactgccggacatggcattgatctggaagggcaagcttatacggttaccaacaacctggtggtgctcatgactcagcctgcttggtctaccatctgggtggccggaataaaggtcaatcaggtgaaggatattaacctccacggcaatgtggtggccggatcagagaggctgggatttcacattcggggacacaagtgctcaagctgtgaactactatggtccgacaatgttgcccatagttctctgcacggcctgcacttgtacaaggagagtgggctggataattgtacccgtatttccgggttcttggccttcaaaaattttgactacggcgctatgttgcacgtggaaaacagtgtggagatcgagaacattaccctggttgataacacaatcgggctactggctgtggtctatgtgttcagtgcaccacagaatagtgtgaaaaaagtacagatagtgctgcgcaacagcgtcattgtcgccaccagctccagctttgattgtatccaggataaggttaagccccacagcgcaaacctgacctccaccgacagggccccttcaaatccacgtggaggcagaatcgggatcctgtggcctgtctttaccagtgagcctaatcaatggccacaggagccatggcacaaagtgcgaaacgaccatagcatttcaggaatcatgaagttgcaggacgtcaccttctcttctttcgtgaagagttgttatagtgacgatttggacgtatgtatcttgccaaacgccgagaacagcggaataatgcatccgatcaccgcggagcggacccgtatgttgaagatcaaagacaaaaacaagttctactttcccagcctgcagccacgcaaagatctgggaaaggtggtgtgtccagaactggattgcgcttcgccgcgaaagtacctgtttaaggacctggatggtcgggctctcggactgcccccacctgttagcgtgtttccaaagacagaggctgaatggacagctagtttcttcaacgcagggacatttcgcgaggagcagaaatgtacttaccagttcctgatgcagggatttatttgcaagcagaccgaccaagtggtgctgatactggactctgcagatgcaatatgggccattcagaagctatatcctgtggtgtccgttacgtccggattcgtcgatgtctttagcagtgtgaacgccaacatcccttgttctactagtgggtcagtctccaccttctatagcatcctgcctattcgccagattacaaaggtatgtttcatggaccaaactcctcaggtcttgcgctttttcctgctgggaaacaagagtacctcaaaactgttgttagccgtgttttatcacgaactgcagtcaccacatgtgttcctcggagaatcctttatcccacctaccctcgtccagtcggccagcttactgctgaacgagagtatcggagccaactattttaacatcatggataatctgctctacgtggtgcttcagggggaggagcctatagaaatccgaagcggcgtgagcattcatctagccttaaccgtcatggtttcagtgctggagaagggatgggaaatcgtgattctggagcgactgacaaattttctgcagatcggacagaaccagatccgcttcatccacgagatgcctggtcacgaggaaaccttaaaagccatcgccgacagccgagctaaaaggaaacgcaactgtccgaccgtgacctgtacctctcactatagacgcgttggccagcgcaggcccctgatgatggaaatgaactcacatcgcgcatcacccccaatgaccgtggagacaatttctaaggttatcgtaattgagataggcgatagtcccactgtccgatccactggcatgatcagctccctatccagcaataaactccagaacctggcacacagggtgatcactgctcaacagacaggcgtcttggagaacgtgctgaacatgaccattggtgccctgcttgtgacgcagagcaaaggcgtcatagggtacggcaatacctcatccttcaagactggaaaccttatatatattaggccctacgccctgtcaatcctggtgcaaccttctgacggcgaagtggggaatgagctgcctgtgcagccacagttagtattcttggatgagcagaatagacgggtggaatctcttggccctccaagcgagccctggacaatttctgcctcactggaaggggcttcagacagtgtactaaaggggtgcactcaggcagaaacccaggacggatatgtgtccttctataacctggctgtccttatatcaggttccaactggcacttcatattcacagtgacgagcccccctggcgtgaattttaccgcgcgatccaagccctttgctgtattgcccgtaacccgaaaagaaaagagcaccataatcctcgctgcatccctttcatccgtcgcctcgtggcttgccctttcttgcctggtctgctgctggctgaaacggagtaaatctcggaaaaccaagcccgaggaaattccggaatcacaaaccaacaatcagaatattcacattcacatcagctcgaagcggagagagagccagggaccgaagaaagaggacaccgtggttggagaagatatgaggatgaaggtgatgctcggtaaggtgaatcaatgcccacatcagctgatgaatggagtttctcggagaaaggtgtctaggcatatcgtccgggaggaagaggctgccgtgccagcccctgggaccactgggatcacttcccacggacatatctgcgctcccggagctcccgctcagcaggtgtatctccaggagactggaaactggaaggagggtcaggaacagctgttacgataccagctggctggccaaaatcaactcctcctgctgtgccctgactttaggcaggaacgacagcagctgcccggtcagtcaagactctcaaagcagtcgggcagcctcggcttatctcaggaaaagaaggcatcatgcggagctactgaggcattctgcctccactccgtgcaccccgagaccattcaggaacaattgtaa

SEQ ID NO: 235384 - DNA, 10190 bp, Artificial Sequence
  Description of Artificial Sequence: Synthetic coding sequence
atgactgcatggttgatttccctgatgtccatcgaggtcctgctgcttgctgtgcgccacctaagcctccacatcgaacccgaggagggctccctagcagggggaacatggataactgtgattttcgatggactggagctgggagtgctttaccctaataacgggagtcaactggaaatccaccttgtcaacgtgaatatggtggttcccgcactaaggagtgtgccctgcgatgttttcccagtgtttctcgacctccccgtggtcacgtgtcgaactcgtagcgtgctgtctgaagctcatgaaggcctctatttcctcgaagcatattttggagggcagttggtgagttcgcccaacccaggcccacgcgattcttgtacattcaaatttagcaaggctcagaccccgatcgtgcaccaggtgtatccacccagtggggtgcctggtaagttgattcacgtgtacggatggatcattacaggtagacttgagacctttgactttgatgccgagtacatcgattcccctgtaatccttgaagcccagggcgataaatgggtcactccctgttctctcattaataggcaaatgggcagctgctatccgattcaagaagaccacggcctgggcactctgcaatgtcacgttgagggagactacataggctcacagaacgtaagtttttccgtcttcaacaaggggaaaagtatggtgcataagaaggcgtggctgataagcgccaaacaagacctgttcctgtaccagacccattctgagatattgagcgtcttcccagagaccggcagcctggggggtagaactaacattacaataactggcgattttttcgataactccgctcaggttaccatcgcaggcatcccctgcgacatccgacacgtctctcccaggaaaatcgaatgtactacccgtgctcctgggaaggatgtgcgtcttaccactcctcagcctggcaacagaggtctgttatttgaggttggtgatgccgtggaaggcctggaactaactgaagcaacccccggatacagatggcagatcgtccccaatgcctcaagtccgtttggtttttggagtcaagaaggtcagccattccgcgcacgtctgagcggcttctttgtggccccagaaactaataattacacattctggatacaggcagactcacaggcttccttgcactttagctggtcggaagaacccagaaccaaggtgaaagtggctagcatctccgtgggcacagctgactggttcgatagctgggagcagaatcgggacgagggtacatggcagcagaaaacacccaagctggaattgcttgggggagcgatgtactaccttgaagcggaacaccatggaatcgcccctagtcgagggatgaggataggtgtgcagatccacaatacctggcttaacccggatgtggtgaccacttacctgagggaaaaacatcagatacgcgttcgggctcagagactgccagaggttcaggtgcttaatgtatctggacgcggaaattttttcctgacttgggataacgtgtcctcacagcccatccctgccaacgctactgcccatcttatccaaaccaccatcgaagaactattagctgtcaaatgtaagctcgagcctctgtggtcaaacatcctgcttcgactgggcttcgagagaggaccagaagtcagcaacagcgacggtgacctgacctccggtactgagccattttgcgggaggttctcactgaggcagccacggcacctggttctcacccctccagcagcacaaaaaggctataggctggaccagtatacccatctttgcctggcttataaaggtcatatgaataaaatcctcaagatgatcgtatcatttacgattggttttcaaaacatggtgaaaaacacgacctgtgactggagtttgacacgcacctccccagaatcatggcagttcgattgtactgatctgtgggaaacctgcgttaggtgctttggcgatttacaacccccacctgctaattctcccgtgctagtgcaccagatcaacctactccccctggcccaggagaccggcctgttctacgtagacgagatcatcattgctgacactaacgtgacggtatctcaggcggactccggtacagcccgaccagggggtaatctcgtggagtcagtgagcgtggtcggaagtcctcctgtatactccgtcaccagttggcttgccggatgtggaacagaattgcccctcataacagcacgtagcgtgccaaccgaaggtaccgaagagggatcgggccttgtgctcgtaactacccagcgaagacaacggacctctccgcctctgggagggcacttcaggatccagctcccgaacactgtgatcagtgacgtgcctgtccagatcagtgcccatcatttacaccagctgttacagaacaatgccgatgattttacatcgcgctatctgaatgctagcgatttcacagtgaaggaggatttgtacacctgctatgagcatgtgtggacactaagctggtctacccagattggagaccttcctaattttatccgcgtctcagacgagaacctgacgggtgtcaatcctgccgcagcaacccgagtggtttatgacggcggagtgttcctgggtccaatcttcggagacatgctcgccactgctaaccaacatacacaggtggtggtacgggttaacgatgtccctgcccattgtcccggatcgtgctcctttcagtatttgcaaggatctacaccatgtgtgcactctgtgtggtatagcattgacggagacattaatttgatgatatacattaccggcacaggtttctctggggacagtcagttcttacaagttacagtgaacaagacaagttgtaaagtgattttttctaaccaaaccaacgttgtatgtcagacggatctccttcctgtcggaatgcatcgcatactgatgctggttagaccatccggcctggccatcagcgctacaggtgaggacttgttcctgaacgtcaagccacgcttggatatggtggaaccttcccgagcagctgatatcggaggtctttgggcgacaatacgaggtagctctctagagggagtgtctctgattctatttggatcttactcttgcgctataaacgtagctacatcaaattccagtaggatccaatgtaaagtgcctcctcgcggtaaggacggtagaattgtgaacgtgaccgtgatacggggagattattcggctgtcttgccccgagcattcacctacgtgtccagcctcaacccagtgatcgtcaccctcagccgcaacatctccaacatcgccggtggggagacattagttatcggcgttgcgagactgatgaactatacagatctggacgttgaagtccatgtacaggacgcactggctcccgtgcatacccagagcgcctgggggctcgaggtggcattgcctcccctgccagcaggtctgcacaggatctccgtcagtattaacggcgtcagcatccatagtcagggagtggatttgcatatacagtacctgaccgaggttttttcaatagaaccatgctgcggctcattgctcggtggcaccatcctgagtatctccgggatcggattctctcgcgacccagccttggtttgggttttagtgggcaatcggagttgcgacattgtgaacctcaccgaagccagcatttggtgcgagaccctgccagcccctcagatcccagacgcgggagcccctacagtgccagccgcagtggaggtttgggcaggtaacaggttctttgcgcgaggcccttctccttcacttgtgggaaagggcttcactttcatgtatgaagccgcagctacccccgtggttaccgctatgcagggcgaaatcactaactctagcctgtccttgcatgttggcggttctaacctcagcaacagcgtcatcctgttgggaaacctcaactgtgacgtagagacccagtcattccaggggaatgtcagcctgagcggctgtagtatcccattgcacagcctggaggccggaatctatccacttcaggtaagacagaagcagatgggcttcgccaacatgtctgtagtgctccaacagtttgcagtgatgccgcgaattatggccattttccctagccagggttcggcatgcggcggtacaatactgacagtgcgcggactgctcctgaactctcgacggaggtcggttcgagtcgacctgtccggtccattcacatgcgttattctgagtctgggcgatcacactattctgtgtcaggtgtccctggaaggcgacccgttgcccggtgcctctttcagtctgaacgttacagttcttgtgaatggcctgacatctgaatgtcagggaaactgtacgctcttcattcgcgaggaggccagcccggtgatggatgcactttctacaaacacctccgggtccttaactaccgtacttatccggggacagagactggccactactgccgacgaaccaatggttttcgtggacgatcagctgccttgtaacgtcaccttttttaacgcttcgcatgtcgtgtgccagacaagagacctggcacctggccctcactatctcagcgtcttctatacccgcaacggatacgcctgctctgggaacgtgtctcgtcacttttatattatgccccaggtgtttcactactttccaaaaaatttttccctgcacggcggtagcctgctgaccatcgaggggacaggactccgtggacagaatacgacaagcgtttatattgatcagcagacctgcttaaccgttaatatcggagcggaactcattaggtgcatcgttccgactggcaatggaagcgtggcgctggaaattgaagtcgatggcttatggtaccatatcggcgtgatcgggtataataaggccttcacccctgaactgatcagcattagtcaatccgatgacatcctgactttcgctgttgcacaaatctctggtgccgctaacatagacatcttcatcgggatgtctccgtgtgttggcgtctccgggaaccacaccgtcttacaatgcgtagttccaagtctgccagctggggagtatcacgtgcggggatatgactgcattcggggttgggcatcatcagcactggtcttcacatccagagtcatcataacggcagtgacggagaactttgggtgcctgggtgggagactcgtgcacgtcttcggcgctggcttttcccccggaaatgtcagtgctgccgtatgcggcgctccatgtcgggttttggccaacgcgacagtgtctgcattctcctgtctcgtgctccctttagacgtgtcactggcttttctatgcggcctaaaaagggaagaagatagctgcgaggcggcacgacacacctatgtgcagtgtgaccttacagtagccatggccacagaacagctgttggaatcttggccctacctgtatatctgtgaggagtctagccagtgcctcttcgtccctgatcactgggccgaatcaatgttcccatccttttcagggttgtttatcagcccaaagctcgagcgagatgaggtgctcatctacaacagctcatgcaacatcacgatggaaaccgaggctgagatggaatgcgagacccccaaccagccaattactgtgaagataaccgagataaggaaaagatggggacagaacacacagggtaattttagcctccagttttgtcggagatggtcgaggacccatagctggttcccagagagactgcctcaggacggggataatgttaccgtggaaaatgggcaattgttgctacttgacaccaacacttcaattctgaatctgctgcacattaagggtgggaagcttatttttatggcccctggacctattgagctcagggcccacgccatccttgtgagtgacggaggagaactccggatcggcagtgaggacaaaccattccaaggacgcgctcagattacgctctatggctcatcctactctacccccttttttccatacggcgtaaaattcttagcggtgagaaatggaaccctgagtctccatggctccctgcctgaagtgatagttacttgcctgcgagccacagcgcacgccttggacaccgtcctagccctcgaggacgctgtcgattggaaccctggtgatgaggtggttattatttcaggaaccggggtgaaaggggcaaagcccatggaggagatcgtgaccgtggagaccgtccaggatacggacctctaccttaagtcccctctgcgttactcccataattttactgaaaactgggttgctggggaacaccacatactgaaggctacggttgcactgctgtccaggagtatcactatccaggggaatttaaccaacgagcgcgagaaattactagtttcttgccaagaggcgaatgcgccagaaggaaacctgcagcattgtctgtatagcatgtccgagaagatgctcggctcccgggacatgggcgcacgggtcatcgtgcagtcattccccgaggaaccctcacaagttcaactaaagggagtgcaattccaggtgctagggcaggcgtttcacaaacacctgtcaagccttacattggttggggctatgagggagagtttcattcagggttgcactgtgaggaattctttttcccgagggctcagtatgtgcggtactctgggactaaaagtagactccaatgtgttttataacatcctcggccatgcccttttggttggaacgtgtactgaaatgcgatacatcagctgggaggcaatccatggaagaaaggacgattggtccggacacggaaatatcattcgcaacaatgtaattattcaggtgtctggggctgaagggttatccaatcctgagatgttaacaccgtctggaatatatatttgctctccaactaacgttattgagggcaatagggtgtgtggtgccggttacggatatttcttccacctgatgaccaaccagacatcccaagcacctttgttgtcattcacacaaaacattgcacattcatgcacgagatacggcttgttcgtgtacccgaaattccagcctccctgggacaatgtcaccggaacaacgttgttccaaagctttaccgtgtgggagtctgccggaggcgctcagatttttcgctcgagcaacctgaggctcaaaaacttcaaggtatacagctgccgggattttggtattgatgtcttggaatcggacgcgaacactagcgtcaccgacagtcttttactggggcactttgcacacaagggcagcctctgtatgagctcgggtattaagactccaaagagatgggagctgatggtgagcaacacaactttcgtcaacttcgaccttataaactgtgtagcaattaggacctgttccgactgtagccagggccagggaggattcactgttaaaacgagtcagctgaagtttaccaactcaagtaacctcgtcgcttttccctttccccatgccgcaatcctagaggacctcgatggttcgctttctggtaagaatcgttcccacatactagctagcatggaaacgctttccgcttcttgtctagtgaactcgagctttggccgagtggtgcacggaagcgcgtgtggtgggggtgtgttgttccaccgaatgtcgatcggcttggctaacactcctgaagtatcatatgatttgaccatgactgattcaaggaataagacaaccacagtgaattacgttagggatacactgagtaatccaagaggttggatggccctattgttagaccaggagacctattccctgcaatcagagaatctctggatcaataggtcactgcagtactccgctaccttcgacaatttcgcccctggcaattatctcctgttagtacatacagatctgcccccttacccagatatcctccttcgatgtggttccagggtgggcctctcatttcctttcctgccatcccccggacagaatcaggggtgcgattggttttttaactcccagctgcgtcagctcacgtacctggtgtcaggcgaaggccaggtgcaggtcatcctcagggtaaaagagggtatgccacctaccatttctgcatccacgtccgcccctgagtcagcattaaaatggtctttgccagagacatggcaaggggtggaagagggttggggtggctacaacaatacgataccaggtccaggcgatgacgtactcatcctgcccaaccgaaccgtactcgtggacacagacctccccttcttcaaaggcttgtatgtgatgggtacacttgatttccctgtggaccgttccaacgtgctgagcgtggcctgcatggtcatcgctgggggtgagctgaaagtgggcaccttagaaaatcccctggagaaagaacagaagctcctgatccttctccgagcatctgagggagtcttctgcgacaggatgaatgggatccatattgatcccggtactattggcgtgtatgggaaagtacacctatacagtgcttaccctaaaaatagctggacccacttgggggcagacattgcctcaggaaacgaacgaatcatcgtggaggacgccgtggactggaggccacatgacaaaattgtcctctcttcctcttcctacgaaccacatgaggccgaggtgctgaccgtcaaagaggtaaaaggtcatcacgttaggatctatgagaggctgaagcatagacatatcgggagcgtgcatgtcaccgaagatggcagacatatcaggctagccgcagaggtcggcctcttaactcgaaacatccaaatccagcctgatgtgtcgtgtcggggacggctcttcgtcgggagcttcagaaagtcatccagagaagagttttccggtgtgctgcagctgctgaacgtcgaaatccagaactttggaagccctctctactcaagcgtggaattctcgaatgtatccgccggaagctggattatttcaagcactctacaccagtcctgcggcggaggaatccacgcagccgcatcacacggcgtattacttaatgataacattgtcttcgggacggcgggacatgggatagacctcgaaggacaggcttatactgtgactaataacctagtggtcctcatgacccagccagcctggtccaccatatgggtggccggtattaaagtgaaccaggtcaaggatatcaatctccacggcaatgtggtagccggtagcgagagactggggttccacattcgcggacacaagtgctcttcttgtgagctgctgtggtctgacaatgtggcccactcgtccctgcacggtctacacctgtacaaggagagcgggttggataactgcacaagaatatctggcttcctggcattcaaaaacttcgattatggggcaatgctgcatgtggaaaattcagtggaaatcgaaaacattaccctcgtggataacaccattggcctgctcgctgtcgtgtatgtgttctccgcgccacaaaattcagtgaagaaggttcaaattgttctcagaaatagtgttatagtagcgacaagcagctcttttgactgcattcaggataaagtgaagcctcattccgctaatttgacatctacagaccgggctccctccaatccgcgaggaggacggattggaatcctctggcctgtgttcacatcagagccaaaccagtggccccaggaaccatggcataaggtacgtaacgaccattcaatctctggtattatgaagctgcaggatgttaccttcagctcctttgtgaaatcgtgttattcggacgatctggacgtgtgcattttgcctaacgcggagaacagtggcatcatgcatcccattactgccgagcggacccggatgctgaaaattaaagacaagaacaagttttattttccctcgctgcagccacgcaaagacctcggcaaggtcgtgtgtcctgaactcgactgtgcatcaccaaggaaatacctgttcaaagatttggatggccgagcccttggcctccccccacccgtgtccgtctttccaaagactgaagcagaatggactgcttcgttcttcaatgctggtacgaaagagcagtcaatcgagatcaacgttta

SEQ ID NO: 235385 - DNA, 12732 bp, Artificial Sequence
  Description of Artificial Sequence: Synthetic coding sequence
atgggacacctgtggctgcttggaatctggggcctttgtgggctattgctctgtgcggcagaccccagcaccgacgggtcccaaatcataccaaaagttaccgaaatcatcccaaagtatgggtctatcaacggagccacccggcttacgatcaggggcgaaggcttctcccaggccaaccaattcaactatggggtagacaatgcggaactgggaaactctgtccagcttatttcttctttccaatctatcacatgcgatgtggaaaaagacgcttcacactcgacgcagattacttgttacaccagagcaatgcccgaagactcctacactgtgcgggtgtcagtcgatggggtgccggtgacagaaaataatacgtgcaagggtcatattaactcttgggagtgcaccttcaatgccaaatcattccggacacccactattcggagtattactcctctgtctggtacacccggaaccctcataacaatacaaggtagaatttttaccgacgtgtacggatccaacattgctctgtccagcaatggtaaaaatgtgcgcattcttcgcgtttatattggcggaatgccgtgtgaacttttaattccacagtctgataatttatatggcctgaagttggaccatcccaatggggacatgggtagcatggtgtgcaagactaccggcacattcatcggtcaccataatgtgagctttatccttgataacgactatgggcgttcattcccgcaaaaaatggcgtacttcgtctctagcctgaacaaaattgctatgtttcagacgtatgcagaggtgactatgatttttccctcacagggaagcattaggggcggtacgacgttgacaatcagcggtcgtttttttgaccagacagacttcccggtacgagtcctggtaggaggcgagccgtgtgatatattgaatgtaacggagaattccatttgctgtaagacgcctccaaagccccatatcctgaaaacagtgtatcctggaggacggggacttaagttggaagtctggaacaattcgcgccctattcgcttggaggagattctggagtataacgagaagacccctggttatatgggcgctagctgggtggactccgcttcctacatatggctgatggaacaggacacatttgtagcacgcttttctggctttctcgtcgcgcctgactccgacgtctatagattctatattaagggagatgaccggtatgctatctattttagtcagactggcttgcctgaggataaggtgagaatcgcttaccattccgccaacgccaattcgtacttctcttccccaacccagcgttcggacgacatccacctgcagaaggggaaggaatactacatcgagatcctgctgcaggagtacagactgtccgcattcgttgatgttggcctttaccagtacagaaacgtctatacggaacagcagaccggcgacgcggtaaacgaagagcaagttatcaagtcccagtcaactatcctgcaggaagtgcaggtgatcaccttggaaaattgggagactactaacgccatcaatgaggtccagaaaattaaggtgaccagcccctgtgtagaggccaattcgtgctcactgtaccagtatcggctgatctacaacatggagaagactgtttttctcccggctgatgcctccgagtttatactgcagtccgctctcaatgatctttggagcatcaagcctgacactgtgcaggtaatcagaacccagaaccctcaatcctacgtctatatggttaccttcatcagcaccagaggcgactttgacttgttaggctacgaagtcgtcgaaggcaacaacgttaccctggacattactgagcagactaagggcaaacccaacctggaaacattcactcttaattgggacggcatagcatcaaaacccctcacactttggtcctctgaggcagaatttcagggggctgtggaggagatggtaagcacaaaatgtcccccacaaattgccaacttcgaagagggttttgtggtgaaatacttccgggattatgagaccgattttaatctggaacatatcaatcgaggccaaaaaaccgcagaaactgatgcttactgcggacgttattccctgaaaaatcccgctgtcctgtttgactctgccgatgtaaaacccaaccgacggccatatggcgacatacttctgttcccctacaaccagctatgtctggcatataagggctttctggcgaactacatcggtcttaaatttcaatatcaggacaatagcaaaatcactagaagcacagacactcagttcacttacaactttgcctatggcaacaattggacatacacttgcatcgatttgctcgacctagtgcgtacgaaatatactggcacaaatgtatcgctgcagcgaattagtcttcataaagctagtgagagccaaagcttctatgttgacgttgtctatattgggcatacttcaaccataagtacactggatgaaatgcctaaacggagactgccggcacttgccaataaaggaatctttctggagcactttcaggtgaatcaaacaaaaactaacggaccaaccatgacaaaccagtactctgtgactatgacctcctataactgttcttataacattccaatgatggcggttagctttggacagattatcacccatgagaccgaaaatgaattcgtgtaccggggaaacaactggccgggagagagtaagatccatatccagcggattcaggcagcctcccctccactctcaggatcttttgacatccaagcatatggccacatcctgaagggtctgcccgcagccgtcagcgccgcagacctccagttcgctcttcagagtctggaaggtatgggaaggatctcggtgaccagggaaggcacgtgcgccggatatgcttggaacataaagtggcggtccacctgtggaaagcaaaacctactgcaaattaatgacagtaacatcataggtgagaaagcgaacatgaccgtgacaagaatcaaggaggggggtctctttcggcagcatgtactaggtgacctgttgaggactcctagccaacagccgcaggtcgaggtgtatgtaaacggcatccccgcaaagtgctcaggggattgtggcttcacgtgggattcaaatattacccctctcgttctggccattagtccctcccagggatcctatgaggaggggacaatcctgacaattgtcggctctgggttcagcccctctagcgcagttacggttagcgtggggcctgtcggctgttccctactgtcggtcgacgagaaggaactgaagtgtcagattctgaacggttcagctggccatgctccagtagcagtgtctatggcggatgttggcctagcccagaatgtggggggagaggagttctactttgtctaccagtcgcagatttcccacatctggccagactcaggatccatcgcgggtggcacattactcacactcagcggatttggttttaacgaaaattccaaagtcttggtcgggaatgagacatgcaatgtgatagaaggcgacctgaaccgaattacttgccgaacccccaaaaagactgaaggcactgttgacattagcgtgactacaaacgggtttcaagctaccgcgcgagatgccttctcctataattgtctccagacacccatcattaccgatttcagcccgaaggtccgtacaatcctgggtgaagtgaatctgacgataaagggctacaattttggaaatgaactgacacaaaatatggctgtgtacgtcggcggaaagacatgccagatacttcactggaattttaccgacatcaggtgtctgctccctaaactgagcccagggaaacatgacatctacgtggaggtgaggaactgggggttcgccagtaccagggataagctaaacagctcaattcagtatgtcttggaagtcacgtcaatgttcccacagcggggttccctcttcgggggtacagaaatcaccattaggggtttcggtttcagcaccattcccgcagaaaatacagtcctcctcggcagcatcccatgcaacgttacatcatccagcgagaatgtgattaaatgtatcttgcactctaccgggaacatattcagaattaccaataatgggaaagatagtgtccacggcctgggctacgcttggtcaccacccgtgctcaatgtctccgtgggcgatactgtggcttggcactggcagactcatccgttcttaagagggatcgggtaccggatcttctcagttagctctcctggctcagttatttacgacggcaaggggtttacctccggcagacagaaaagtaccagcggaagctttagctaccagttcacgtccccaggcatccactattacagttctggctacgtcgacgaggcccactcgatcttcttgcagggagtgataaacgtgctgcccgctgaaacacggcatatcccattgcacttgtttgttggtcgtagcgaggcaacctacgcttatgggggaccagaaaacctgcatctgggttcttccgtggctgggtgcctcgcgactgagcccctgtgtagcctgaacaatacacgagtgaagaactctaaaagactgctgtttgaggtgagctcctgtttttccccttctatctccaacatcaccccctcaaccgggactgttaatgagctgatcacgataattgggcacgggttttccaacttgccttgggctaacaaggtgactattggctcttatccttgtgtggtagaagagagctccgaggatagcattacatgccacatcgatccacagaactccatggacgttggaatcagagaaacagttaccttgaccgtgtataacttggggactgccattaacaccttgtccaacgaatttgatcgcagattcgtgcttctgcctaacatagatctagtcctgccgaacgctggatccacaacaggcatgacatccgtgaccattaagggctccggctttgcagtcagctctgccggtgtgaaggtactcatgggacacttcccttgcaaggtgctgagtgttaattacaccgccattgagtgtgagacgtcacctgctgcccagcaattagtggacgtagacttactgatacacggggtacctgcgcaatgccagggcaattgcacgttcagctatttggagtccataaccccatatatcactggagtgtttccaaattctgttattggtagcgtcaaagtactgattgaaggcgagggcctgggaaccgttctggaggacattgccgtcttcattggcaaccagcagtttcgggcaattgaggtgaacgagaacaacatcacggctcttgttacccccctgccggtggggcatcattctgtgtcagtcgttgtcggctccaagggcctggccctgggtaacctgaccgtgagcagtcctccagtcgcatctctatcacctactagcggctccatcggaggcggaacgacccttgttataaccggcaacggcttctatcccggaaatacaactgttacgatcggcgatgaaccttgccagatcatttccatcaacccaaacgaggtctactgtagaacgcccgcaggcactacaggtatggtggacgtcaagatcttcgtgaacacaatcgcctatccaccccttctttttacatatgcgttagaagataccccatttctccgcggaatcatcccaagccgaggtccccctgggacagagattgagataaccggaagcaactttggattcgagatcttggagataagtgtcatgatcaacaacatacagtgtaatgttaccatggcgaatgacagtgttgtccagtgtattgtgggggaccacgctggtgggacttttcctgtaatgatgcaccataagaccaaagggtccgctatgagcaccgtggtgttcgagtacccactgaacatccaaaatatcaatcctagccagggtagttttggcggtggtcagactatgaccgtgactgggacaggattcaaccctcagaactcgatcatcttggtatgtggctcagagtgtgcaatagaccggctgaggtccgattacacgactttgctctgtgaaattccttccaacaatggtacaggcgctgaacaagcctgtgaggtgtctgttgttaacggcaaggatttgagccagtcaatgaccccctttacctacgctgtctccctaacacctctgattacggctgtatcaccgaagcggggaagcactgctggcggtacgcggcttaccgtcgtgggatcaggatttagcgagaatatggaggacgtgcacatcaccattgccgaggcaaagtgcgacgtggagtactccaataagacgcacataatttgcatgacagatgctcacaccctctcaggctgggcgcctgtgtgtgttcacattcggggagtggggatggccaaactggataatgctgattttctgtacgtggacgcctggtcttccaatttcagttggggaggcaagagtccccctgaagaaggaagtctggtggttattacaaaggggcaaacaattctgctagaccagagcacccctattctgaagatgctgctcatccagggcggtaccttgatctttgacgaggcagacatcgagctgcaggcagagaatatcctcattacagatggaggcgtcctccagatcggcactgagacatctccatttcaacacaaggccgtgattacgcttcatgggcacttgagaagccccgagttaccagtctacggagccaaaacactggccgtgcgcgaaggaattttggacctccatggcgtgccagtcccagtaacctggactagactcgcccatactgccaaggccggtgaacggatccttatcctgcaggaagccgtgacatggaaacccggagacaatatcgtgatcgcctcgacgggccaccgacactcacagggagaaaacgaaaagatgactatagccagtgtctcagctgacggaatcaacattacattgagcaatcccttgaactacacccacctgggcataacagttacactcccagatggtacactgtttgaagcacgtgctgaggtggggatcctcactaggaatatcctgatccggggtagtgataacgtcgaatggaataataaaatacctgcctgtcccgacgggttcgacaccggagagttcgcaacacaaacgtgcctccagggaaaattcggtgaggagattggaagtgaccaattcggtggctgcgtcatgtttcacgcaccagtccctggcgctaatatggtaacgggcagaatcgaatacgtcgaagtgttccacgccggacaagccttcaggcttggcaggtatcccattcactggcacctgctgggcgaccttcagttcaagtcatacgtcaggggatgtgctatccaccaggcttacaaccgcgctgtgaccatacataacactcatcatctcctagtagagaggaacatcatctatgacatcaaggggggagcctttttcatagaagacgggatcgagcatggaaatatcctacagtacaatctggccgtattcgtgcagcagtcaacatcactcctgaacgatgatgttacgccagctgctttctgggttacaaaccccaacaataccatacgtcacaatgccgtcgcaggcggtacgcattttggtttctggtacagaatgaacaaccatccggacggcccatcttacgataggaatatctgtcagaaaagagttcctttgggtgagttctttaacaatactgttcacagccaggggtggtttggaatgtggatttttgaggaatattttcctatgcagactggcagctgcacgtcgactgtcccggcacctgctattttcaacagcctgacaacttggaactgtcagaaaggggctgaatgggtgaatggaggagcactccagttccacaatttcgtgatggtgaacaattacgaagcaggcatagagactaaacgcattctggctccttatgtggggggttggggagagactaatggtgcggtcatcaagaacgccaaaattgtaggccacttagacgaactgggtatgggtagcgctttttgcacagccaagggtctggtgctgcccttttcagagggtttgacagtgtcatctgtgcactttatgaattttgacaggcccaactgcgtcgcgctcggcgttacctcaatctcaggtgtatgcaacgaccggtgtggcggttggagcgcaaaattcgtcgatgtgcagtactcccacacccccaataaggcaggctttcgttgggagcacgagatggtcatgattgacgtggacggatcccttaccggacacaagggccacactgtcattccacattcatcactgcttgacccatcacactgcactcaagaagccgagtggagcattggctttcccggttcagtttgtgacgcgtccgtgagcttccacagactggcatttaaccaacccagccccgtttccttgttagagaaggacgtcgtgctatctgacagcttcggtactagcattattccttttcagaagaagaggttaacccatatgagcggttggatggcactcatccctaatgcaaaccacatcaactggtacttcaagggagtcgaccatatcactaatatctcttatacttctacattttacggctttaaagaggaggactacgtcataatcagccacaacttcactcagaacccagatatgttcaatatcattgatatgagaaatggcagttctaacccattgaactggaacactagtaaaaacggcgactggcatcttgaggccaatacatctactctctattacctggtatctggccgaaatgatctgcatcagtcacaactgataagtggaaatctcgaccctgacgttaaggacgtggtaataaacttccaagcttattgctgcatactgcaagactgctttcccgtgcatccgccttcgaggaaacccatccctaagaagagacctgccacttataatttgtggtctaatgacagcttctggcagtccagtcgggagaacaattacaccgtcccacaccccggagccaatgtcattatccccgagggtacttggatagttgccgacatagatatgcccagtatggagagactgatcatttggggggtccttgaactggaagataagtacaatgtcggtgcagctgagtcatcttaccgcgaagttgtgctgaatgcgacatacatatccttgcagggtgggagactcataggtgggtgggaagataatccgtttaagggcgacctgaagattgtgctgcgtgggaaccacacaactcaagactgggccctgcccgagggccctaatcaaggtgccaaggttctaggcgtcttcggagagctggatctgcacggaatcccacactctatttacaaaacaaaactcagcgagactgcattcgctggttcgaaggtcttgtcgctgatggacgctgtagactggcaagagggggaggagatagtgatcaccacaacttcttatgactttcatcagaccgagactagatctatcgtaaaaatcctgcacgatcacaagatcctgattttgaacgatagtttgtcttacacccatttcgccgaaaaatatcacgtgccaggcacaggggagagttatactttggccgctgatgtgggaatcctttcccggaacattaagatcgtgggagaggactatcccggttggagcgaagatagcttcggcgctcgcgtgttagtaggctcattcaccgagaacatgatgaccttcaagggaaacgccagaatttctaacgtagaattctatcactcagggcaggagggcttccgagactctaccgaccctagatatgccgtgactttcctgaatctgggccagatacaggagcacggctcaagttatatacgcggatgtgcatttcaccacggtttctctccggctatcggagtgtttggaactgacggcctggacatcgatgataacatcatccattttactgtaggtgaaggtattagaatatggggcaacgcgaatcgtgtgcgcggtaatttgatcgccctgtcggtgtggcctgggacctaccagaataggaaagatttgagcagtaccctgtggcatgccgctatagagataaataggggcactaataccgtgcttcaaaacaacgtggtggcaggattcggcagggccggatacaggatcgacggtgagccttgtcccggacagttcaacccggtggagaagtggttcgacaatgaggcgcatggtgggctctatggcatttatatgaatcaggatggcctgcccggatgttctcttatccagggatttacaatatggacttgttgggattacggaatatatttccaaacaaccgaaagcgtacacatctacaatgtaactctcgtcgacaacgggatggcaattttccccatgatttatatgccggctgccattagccacaagattagttctaagaacgttcagatcaagtctagccttattgtcggatcttcacccggattcaattgctctgatgttttgaccaacgacgacccaaacatcgaacttactgccgctcaccgctcacctcgtagccctagcggcggtaggtcaggcatttgttggcctactttcgcctctgcacataatatggcgccacgaaaacctcacgctggaataatgagttacaatgcaattagcggactgctggatatcagcggctccacatttgtggggttcaagaatgtatgcagtggtgaaaccaacgtgatttttatcacaaatcctctcaacgaggatctgcagcatcccatccacgtgaagaatattaaactggtggacaccacagagcaatccaagattttcatccatcgccctgacataagcaaggtgaatccaagcgactgcgtcgacatggtgtgcgacgccaagcgaaagagtttcctgagagacatcgacggcagctttctcgggaacgctggcagcgtgatcccccaggcagagtatgaatgggacgggaactcacaggtaggcatcggtgattacagaattcctaaagctatgctgacattcctgaatggatcgaggatacctgtgactgaaaaggctcctcacaaagggatcatccgagactctacatgcaagtatctacctgaatggcagagctaccagtgctttgggatggaatatgcaatgatggttatagagagcctcgaccccgacacagaaactaggaggttgtcgcctgtggccatcatgggcaatggttacgtggaccttattaacgggccacaggatcacggatggtgtgcagggtatacttgtcagcgaagactgagtctttttcacagtattgtcgccctgaataagtcttatgaggtctacttcacaggaacttccccccagaatttacgcctgatgctgctgaacgttgaccacaacaaggccgtgctggtgggtatatttttctctacactccagcgcctcgatgtgtatgtgaacaacctcctggtctgtcccaagacgactatctggaatgcccagcaaaaacactgcgaactgaacaaccacctatacaaagaccagtttcttcccaatttagatagtacggtgctgggcgagaactatttcgatggaacttaccaaatgctatatctcctagttaaggggacaatcccagttgaaattcacacagcgacagttatttttgtttcatttcagcttagcgtggccacagaggatgacttttacacatcacacaatctggtcaaaaacttggctttgttcctaaagattcccagcgacaagatccggatttctaagatacgcggaaagtcacttaggcggaagcgctccatgggatttatcattgagattgaaatcggagatccaccgatccagtttatctcaaatggaacaacagggcaaatgcagctgagcgagttgcaagaaatcgccggttctttaggccaagccgtcattctggggaacatctcttcaatactgggttttaacatctcatcgatgagcattaccaacccccttccaagccccagcgattccggatggatcaaagtcactgcgcaaccagtcgagcgctcagctttcccggtacaccacgtcgctttcgtgagtagcttattagtgattacacagccagtcgctgcccagcctggtcagccttttccacagcagccctcggtcaaggccaccgattctgatgggaattgtgtgtccgttggaatcaccgcgcttactctcagggctatactcaaagacagtaacaacaaccaggtcaacgggttgtctgggaatacaaccattcccttcagtagctgctgggccaattatacggatctgacacccctgcgcacaggcaaaaactacaagattgaatttatacttgataacgtggtcggagttgaatcccgaactttttcactgctggctgagtcagtgagttcgagcgggagttcctcctctagtaatagcaaggcgagcaccgtcgggacgtatgcacagatcatgacagtggtcatctcttgcctggtgggtcggatgtggctgctggagatcttcatggctgcagtttctacacttaacataactctcagaagctactat

SEQ ID NO: 235386 - DNA, 6762 bp, Artificial Sequence
  Description of Artificial Sequence: Synthetic coding sequence
atgagacctgggcctgctttactcctcctgggggtgggactatccttgtccgttggccgtctccctctccctcctgtccccaggggcgctcaggctgccgtctccggggcaccgggagggcttctgcgcggagctcccggactgggcgtgagaggcggaagggctttgctgtctctgagacctagtgccgtccgcgctggtggcgcagtcctgtctggaagaggttctctctgcttcccccatggcggaacagggaggcggtggtattgcctggacttaagggtgttactgtcagcccagcgcttaccttggccagcggctccggcactggccctggttgacctgcagttgtccgctcgcggagggcgtctgtccctaacctggtctgtcaggctgcccagatcacctggacgcctggcctgggcctttagactgcgacttctcgggcctggggctgctcgcccagcgtctcccgcagcaagagtctcacctcgatctgcagcccctggaccaaggccccaacagggtttcgtcgcaaggaccgagtgtccaacagacggtcccgcacgagtgatgctacaggcagtgaacagctccagtcacagagctgtggagagcagtgtgtcctgtcagatcaacgcatgtgttatccagcgtgtgcgcatcaatactgatcagaagggtgctcccgtccggctcagcatgcaggccgaagccaccatcaatgcttcagtgcagctggactgtccggctgccagggcaatagcacaatactggcaggtcttcagtgttcccgctgtaggccaggctcccgattggactcagcccctggacctacctcaattggagattcgaaactcgcctctttttatccatattccaaacaactccttgcaatggggggtgtacgtatttaactttaccgtttccatcaccactgggaaccccaagatgcccgaagtgaaggattctgacgccgtatatgtttggatcgtgaggagttccttgcaggcagtgatgcttggggacgctaacattacagccaactttaccgagcagctgatcctggacggatcaacatccagcgacccagacgccgactcccccctccaaggccttcagttcttctggtactgtacaacagaccctaggaattatggcggagaccgaattatcctgggctcgaaggaagtgtgtcacccagagcaggcaaacttaaagtggccatgggcttccggcccagttctgactctgctgccagaaacactgaagggagatcacgtttactttttcagaatggtgattcgcaaggattcccgcaccgccttcagcgataaacgagtgcatgtgctccaaggcccaaaggccatcgcccatattacttgcatcgagaattgcgagagaaatttcatcgtgtccgatcgattttccctgtttttgaactgcaccaactgcgccagtcgcgatttctacaaatggtctattctgtcctcaagtggcggagaaatgcttttcgactggatgggggaaaccgtcaccgggcgtaacggggcatacctctccattaaggccttcgcattccggcactttctggaggccgagtttagtatatccttgtatttggcttgctggtcaggcgtgacctctgtgttccgccacagcttcataatcaaccatgggcctcaaatcggggagtgcaaaatcaaccctgcaaagggcattgcactgattacaaaattcgttgtgcagtgcagcaatttccgcgacaaacatgtaccgctaacctacaaaatcattgttagcgaccttcactccgtcggcgagatttcctcggtgaaagaaaacaccttggggacaattttgtatttgggccctcagagcaccgtgccaccctccttcttgcctgttgggatgctggcctcccaatacgggcttaagatctatgcacaggtgtacgattccctgggggcattctcccaggtaacactgcacgccaccgctcaagcacccacagacaagaatagctctaagacagtcctgaaccagctgttatcttttacagtcgggccatcgagcctgctgagtacactgatacagaagaaagattttcttccagccggttatctgctgtatatagttgcctctgtgctgaacaacatgaagacagaacttcccctgagagacgaccgtgtgaacctcagaaagcacctcatcgatcagtcctttttgcttccagtgtccacgcttgttgaaatagggcaagtggtcatgacaataactaagctgacacagaaacctagcgagttcacgtgggacgctcagaagagagctacaatgcgagtgtggcaggccaatcaggctctgcaggaatatcagcaaaaggataaaagattcaggagcgagcagatagagatcgtatcaactgggatccttatgtcactgagtaatatccttaaaatgacttctccgcaccaggtcgtcaaggaccctttctatgtcatcgaaagtctctctgacacaatcctggcgaataaagttcctgggaataaaactacgagcatgcgaacaccgaattttaacatgtatgtgaaaaaggtggagaaatgggggattaaccagcttttcagaaacgaaaagcattgtcggaattgcttttacccaaccctcaacgtctcgagcgtcccaggattgtctgcaaatggtcctatttccaccatgttctgcgacttcaccaacgacttgtttccttggctcaatgatcaagaaaacaccagtgttgaagtgtcaggtttccgaatgactggcgtggctgacaacggatctgtcctggagattacacccgacgtggctgaagtgtatctcgtgcggaaaaaccttacattcgccgcattcaaccttacggtgggaccgaatagtgaagtcgatggtagcttaaagaagacaactggtgggttcagcttccaagtggatagcaccgtgctgagagaagttctggtgcacatcgttactgaagtgatggtgctttttaccgtgctggtctacacaggtagtcaaatcacacccactgcccttgttgcgacctttctcgtgccacatgacataccgccattcgctagccaatccgccttgttcgacccggcttgcaccgttaaaaaggccagagtcgtctgcctgccagtatcactccttcagctaattgcgcagcactctcacagcccccactgcactgtgtctatagtgcttcaagccccacgcttcgtgatgaaactcaatgataaactggtccggatctctatcttttccgttcagtgcctcgacatgtatggcatccagagtgagtggagagaaggttactgtatcctgggagaaaaaacctcatggtatgaagtccactgtatatgcaagaatgtagttcgagcgagaagacagctggggaccattggcttaaccgggatccatctacatacgcactacgtcatggctaaagtgattgttatccctaaccctgtcgatcttcggttaaacataattaaaagtcttcatcagaatcccgttactctgtttaccgtcttgtttatcattctactgtacgtgggacttgctttctgggccctgtaccgcgatgagatggaccaacatctgaggggccacgtgatcgtactccctgacaacgacccctatgacaacctttgttatctcgtcaccatattcactgggagcaggtggggctcagggacgcgggcaaatgtttttgttcagcttcgcggtacagtgtccacgagtgacgtgcattgcctgtcccatccccacttcaccaccctctataggggatccatcaatacgttcttgctgaccacaaaatcagacctcggcgacatccactctattcgggtgtggcataataatgaaggtcgctcccctagctggtatctgagcaggattaaagtggagaacttgttctctcggcatatttggctatttatctgtcagaaatggctgagtgtggatacgactttggatcgaacctttcatgtgacccatcctgacgaaaggttgactcgaaaagactttttctttatcgacgtctcgtccaatctcaggaaaaaccacatgtggttcagcatatttgccagtgttgtcgccaaaacctttaatcggctgcaaagacttagttgctgcttggccatgctactctccagcctcctgtgtaacataatgttttttaatttgaacagacaagaacagaccgagtctcgtgaaaggaagtatatgaggagcatgatgatcggtatcgagtccgtgttaattacaataccagtccagctactcatcacatttcttttcacatgctcccagcggaaaccccaggctgacttaaaagaggtctctcctcagaaacaccccttgatgtccgaggcctcggagcactgggaggaatatctccgcaagtggcatgcctacgagactgcgaaagtccaccccagagaggtcgctaagcccgctagcaagggtaaacctagactccccaaggcatcccccaaggccacatcaaagcccaaacaccgtcaccgcaaggctcaaattaagactccggagaccctgggccctaacacaaactctaataataatatcgaagatgaccaggacgtccatagcgaacagcacccatcgcagaaagacctgcagcaacttaagaaaaagccgagaatcgtgcttccatggtggtgtgtttacgtagcctggttcttggtgttcgcaacttcgtcgatctcctccttctttattgtgttctacggactaacttacggctatgataaaagtatcgaatggttgtttgccagcttctgctctttttgtcagagtgtgctactggtacagccttctaaaataatcctgctctctggcttcaggactaacaagcctaaatactgcaaaaacttaagctggagcactaagtataaatataccgaaatacgactggacggaatgcggatgcacccagaagaaatgcaacggatccacgaccagatcgtcagaattcggggtacccggatgtaccagcccctgaccgaggacgagatcagaatctttaagagaaagaagcgcattaaaaggcgcgctctcctttttttatcgtacatcttaacccacttcattttccttgccctcctgttaattctgattgtgctgcttcgtcatacagattgcttctattataatcagttcatccgcgataggttttctatggacctggccacagtgacgaagctggaggatatctaccggtggctgaactcagtgctgctaccgctgctccacaatgacttgaacccgaccttcctgcccgaatcatctagtaaaattctcggactgcctctgatgcggcaagttcgagccaaaagtagcgagaagatgtgcctgcccgctgaaaagttcgttcagaactctattcgacgagagatacactgccatccaaagtatggaatcgacccagaagacactaaaaattacagcggattctggaatgaagtggataaacaggcaattgacgagagcacaaacggtttcacgtataagcctcagggaacacagtggctgtactattcttacgggctgcttcacacttacgggagcggcggttatgcactgtacttcttccctgaacaacagagatttaattccactctgagactaaaagagctacaggaatcaaactggctggatgagaaaacttgggctgtggtgctagagttgaccaccttcaacccagatattaacttattctgttctattagcgttatcttcgaagtgtcacagctcggtgtggtcaatacctctattagcctccacagtttctcattggctgacttcgacagaaaggcgagcgctgagatctacctgtacgttgccattctaatttttttcttggcatacgtcgtggatgagggctgtattataatgcaagagcgcgcttcctacgtgaggtctgtctacaacctcttgaacttcgccctgaaatgtatcttcacggttctgatagtgctcttcctccggaagcacttcttggccaccgggatcatccgtttttacctatccaacccagaggacttcataccttttcatgccgtcagccaggttgatcacatcatgagaataattcttggctttctgctgtttcttactattctcaagaccctgaggtacagccgcttcttctatgacgttcgcctggctcaaagggcgatccaggctgccctcccaggtatttgccatatggccttcgtggtcagtgtttacttctttgtgtacatggcatttggttacctagtgttcggacaacacgaatggaactactctaatctgattcactcaacgcaaaccgtgttttcgtactgtgtgtctgcctttcagaacaccgaattttctaataacaggatactgggcgtactttttctctcgtcgttcatgctggtgatgatctgcgtcttaattaacctgttccaggccgtgatcttaagcgcttacgaggagatgaaacagcctgtctacgaagaaccttccgacgaggtagaggcaatgacatacctgtgtcgtaaacttcggacgatgttctctttcctcacctcacagtctaaagcgaaggacgaaccagagttctttatcgatatgctgtatgggcagcccgagaagaattcgcaccggtacctgggtctaaagacccggaatatcaatggtaagaagatggtctatctcgtcgtgtac

SEQ ID NO: 235387 - DNA, 12912 bp, Artificial Sequence
  Description of Artificial Sequence: Synthetic coding sequence
atgccaccggctgcacctgcgaggctcgcccttgccctaggcctaggcttgtggttaggcgctttggccggaggccctggaaggggatgtggcccttgcgagcctccttgcctgtgcggcccagccccaggcgctgcctgtcgtgtcaactgcagtggaagaggcctgagaacactggggcctgctcttcgcattcctgccgacgctactgcactcgacgtgtcacacaacttgcttagagccctcgatgtaggattactggcgaacttgtcggctctggctgaactggatatttctaacaataaaatcagtacactggaggagggaatcttcgccaatctgtttaatctttcagaaataaacctctcaggaaatccttttgaatgcgattgcgggctggcttggctgccacgctgggctgaggagcagcaagtacgagtggtccagcccgaggccgctacctgcgccggacccggtagtttggccggacagccgcttttgggaatccccttactcgattccgggtgcggcgaggagtacgtcgcctgtctgccggacaacagttcaggcacagttgccgcagtgagcttctcggcggctcacgaagggctgctccagcccgaggcttgctctgcattttgtttcagtactggccaggggctggcggctctctccgagcagggctggtgcctgtgtggcgcagcacagccttcctccgcttctttcgcctgtctctcactgtgttcaggcccaccaccgccacctgcccctacatgtagaggacctactctcctccagcacgtgttcccagccagcccaggggctaccctggttgggcctcatggcccactggcctccgggcaactggctgcctttcacattgcagcccctctgcccgtcaccgccactcgctgggattttggcgatggatctgctgaggtggacgcggcagggcctgccgcttctcatcgctacgtgctgcctgggagatatcatgtaacggcagtgttggctctaggcgcagggtctgcgctgcttggcaccgatgtccaggtcgaggcggctccagcagcactggaactggtttgtccatccagcgttcagtccgacgagtcattagacctttccatccagaacagaggcggatctgggctagaagcagcttacagtatcgtggccctgggcgaagagcctgctagggctgtgcaccccctatgcccctccgacactgagatctttcccggaaatggccattgttaccggcttgtagtggagaaagccgcatggctccaggcccaggagcaatgtcaggcctgggccggagctgctctagctatggtggatagcccagctgtgcagcgcttccttgtttcacgtgttaccagatcattagatgtgtggattgggttctccactgtccagggggtagaggtgggccctgctccgcagggagaggcattttctctcgagagctgccagaattggctgccgggagagcctcacccagcgacggcggaacactgcgtgagactgggcccaacaggatggtgtaacaccgacttgtgctcagcaccacattcctatgtgtgcgaactgcagccagggggtcccgttcaggatgcggagaacttgctggtaggagccccaagcggagacctgcaggggccactcactcctctagcccaacaggacggactgtctgcacctcatgaacccgtggaagttatggtattccccggactcagactcagccgtgaggcatttctcacgaccgcggaatttggcacacaggagcttagacgacctgcgcagttgaggctccaagtgtatcgtttactgagtaccgcaggcacccccgagaatgggtcagagcccgagtcgcggagcccagataatcgcacacaactcgcccctgcttgcatgcctggcggacgatggtgcccaggcgcaaatatctgcttgcctctagatgccagctgccatccccaggcttgcgctaatggctgtacatcagggcctggactgccaggagccccatacgctctgtggcgggagtttctgttctcagtgcccgctgggcctccagcccaatattcagtgactcttcacggtcaggatgtactaatgcttcctggggacctggtaggactccagcacgacgctggccctggcgctctgcttcactgttcccctgccccaggccatcctggtccacgcgctccctatctgtctgcgaacgcctcatcatggctgccccacctccccgcacagcttgaagggacttgggcctgtccggcatgtgcccttcggctcctcgctgccactgaacagttgacggtgctgctcggactgcggccaaaccctggactgcgactacccggacgctatgaagtccgagccgaagtcgggaacggggtctcccgtcataacctgtcttgtagcttcgatgtggtttctccagttgctggcctacgggtcatataccccgctcctcgcgacggaagattatacgtgcccaccaatgggtccgccctggtgttgcaggtggactctggagccaacgcaacggcgacagcccgatggcctggaggctcggtctctgccagattcgagaacgtctgtcctgcccttgtcgcaacttttgtccctgggtgcccgtgggagaccaacgacacactgttcagtgttgtggccctcccgtggctaagcgagggcgagcatgtggttgacgtggtggtggagaacagcgcaagtagggctaacctgtctctcagagtcactgctgaggagccaatctgtggattgagagcgaccccctccccagaggcacgagtgcttcagggcgtgttggttaggtatagccctgttgtggaagccggatcagatatggtgttccggtggacaatcaacgacaaacaatccctgacatttcagaatgtagtgtttaatgtcatttaccagtcagctgcagttttcaagctgtctttaacagctagcaaccatgtgagtaatgtcacagtgaactacaatgtgaccgtagaacgtatgaataggatgcagggcttgcaggtgagtactgtgccagcagtcttgagtccaaatgccactctggccctgacagcgggtgtgctggtggactctgccgtggaggtcgccttcctatggacgttcggtgatggcgagcaagcccttcaccaatttcagcctccatacaacgaatctttcccagtccctgatccctccgtagctcaagtcctagtggaacacaacgtcatgcatacgtatgccgcaccgggagaatatctattgacagtgctcgccagtaacgcctttgaaaatctgacccagcaggtgcctgtctccgtccgcgcatccttgccaagtgttgccgtcggcgtaagtgatggagtactagtcgcaggccgtccagtaactttttacccacatccgctgccctctcccggaggagtgctttatacatgggacttcggtgacggctctcctgtcctgacacagagccagcctgctgctaatcatacgtatgcgtccaggggaacgtaccatgtccggttggaagtgaacaataccgtgtctggtgctgcggcacaggctgatgtacgggttttcgaggaattgagaggcctgagcgtcgacatgtccctggcagtcgaacaaggagcgcctgtggtcgttagcgccgctgtccagaccggagacaacatcacttggacattcgacatgggcgatgggactgttttatccggtccagaggcaaccgtcgagcacgtctatctccgtgcccagaactgtactgtgacagtgggcgcagcgtcccctgcgggtcatctcgcgaggtctttgcatgtgcttgtattcgttcttgaagtattgcgcgtggaacccgctgcttgcattcccacacagccggacgcaagactaaccgcttatgtcacaggaaaccccgcacattatctgtttgactggactttcggagacggttctagtaacacaaccgtgcgtgggtgccccactgtgacccacaatttcacccgctccgggaccttcccactcgctttggtcctgtctagccgagtgaaccgtgcccactattttacctcaatctgcgtggagcctgaagtgggcaatgtcactctccagcccgaaagacaattcgtgcagctgggcgacgaagcttggctggtcgcctgcgcctggccaccattcccatatagatatacctgggatttcgggacagaggaggctgctccgactcgtgcgaggggtcctgaggtcactttcatctacagggaccccggatcgtacctcgtgaccgtcaccgcatctaataacattagcgccgcaaacgatagcgccctcgtcgaggtccaggaaccggttctcgtgacctctataaaagtcaacggctcccttggtttggagctgcagcagccttatcttttttcagcagtcggcaggggtcggcctgcctcctatctctgggacctcggcgatggaggctggttggagggaccagaggtgacccatgcctataattccactggtgacttcaccgtgagggtggctggatggaatgaggtaagtaggagcgaagcctggctgaacgtcacagtaaaaagaagagttcgcggtctggtggtgaatgccagccgaactgtggtgcctctgaacgggagcgtctcattcagtacctctctcgaggccggttctgatgtgcgatattcctgggtgctgtgtgacaggtgcacacccatccccggtggaccaactatttcttacacttttcggagtgtcggtacatttaatatcatcgtgactgccgagaatgaggtgggaagcgcacaagactccatatttgtctacgtacttcagctgatagaggggcttcaggtggtgggcggtggaagatactttcccacgaaccatacggtccagcttcaggcggtcgtccgcgatggaacaaacgtgtcttattcgtggaccgcttggcgagaccggggacctgctctggctggctcaggcaagggattcagtctgaccgtgttggaggctggcacctatcatgtgcagctcagagccacaaacatgctcggcagtgcttgggccgactgtactatggactttgtggagcctgtggggtggctcatggttgctgcctcacctaatccagccgcagtgaatacatctgttacgttaagtgccgaactggcgggaggctctggtgtcgtgtacacgtggagccttgaagagggtctgtcatgggaaaccagcgagcccttcacaacacatagctttcctactccaggactacacttggtcactatgacagctggcaatccacttggaagcgctaacgccaccgtcgaggtggatgtgcaggttcccgtctccgggctttctatcagggcctcggagcctgggggaagcttcgtggctgccggttcatctgtaccattctggggtcaactcgctacggggaccaacgtctcttggtgctgggctgtgccaggcggttcaagtaagcggggtccgcatgtgacgatggtgttcccagatgcgggtaccttcagtattagactgaacgccagcaacgcagtgtcatgggttagtgctacttataatctgactgctgaagagcccattgtagggctggtgctatgggcttcttctaaggtcgttgctcctggccaactcgtccacttccagattctgcttgcagcaggatccgcggtgacattcagactccaggtgggcggtgccaaccccgaagtgctgcctgggccaaggttctcccactcattcccccgtgtgggtgatcacgtggtgtccgtccgcggaaagaatcacgtgtcctgggcccaggctcaggtgcggattgtcgtgttggaagctgtttctggtcttcaggtccctaactgctgtgagcccggaattgccacggggactgagcggaatttcacggcacgagtacaaagggggtcccgtgttgcctatgcgtggtacttctctcttcagaaagtgcaaggtgactccctagtcatcctgtcaggtagagacgtgacatataccccggtcgccgctgggctgctggagattcaagtccgcgcttttaatgcgctggggtctgagaatcgaacgctcgtgcttgaagtccaggacgcagtgcagtatgtggcactacagtccggaccctgtttcacgaatagatccgcacagttcgaagcagccactagcccatccccacggagagtcgcctatcactgggacttcggcgatgggtccccaggccaggacacggatgaacccagggccgagcacagttacctccgcccaggcgattatagggtgcaggtgaacgcttcgaacctggtgtcttttttcgtggcgcaagcgacggtgactgtgcaggttttagcttgcagagaacccgaggtggatgttgtcctccccctccaggtgttgatgagaagatcacagcggaattatcttgaggcacacgtggatctcagggattgtgtgacttaccagaccgagtaccggtgggaggtctacaggacggcttcctgccagcgccctggacgaccagccagggtcgctttgcctggggtggatgtctcaagacctagattagtcttgcccagattggcccttccggtgggccattactgcttcgtatttgttgtgtccttcggagatacaccgctaacacagtctattcaagccaacgtgactgtggctcccgaacgcctggttcctattatagaagggggtagctatagagtatggagcgatacacgcgacctggtgttagacggatccgagagctatgaccccaatcttgaggacggtgaccagaccccccttagctttcattgggcttgtgtggccagcacccagagagaggcaggtggatgcgccctgaacttcggacccagaggcagtagcacggtcactattcctcgcgagagactggcagccggtgtggagtacacattttcactcacagtgtggaaggccggaaggaaagaggaagctacaaaccagaccgttctcattcgatctggtagggtgcctatcgtgagtctggaatgcgtgtcatgtaaagctcaggccgtctatgaagtcagcagatcttcatatgtgtatcttgaaggtcggtgcctgaattgctctagtggcagcaagcgaggcaggtgggctgcaagaacattctcaaacaagacactggtccttgacgaaaccacgacatccacaggtagcgccggtatgcgcttagtgttgcgcagaggagtgttgcgtgatggtgaaggctacacgttcaccctgaccgtgctgggccgttccggcgaagaggagggctgcgcttccatcagattaagcccaaatcgcccacccctcgggggatcttgcagactttttcccctcggcgcagttcatgctctgaccacaaaagtgcactttgaatgtacgggatggcatgatgccgaagatgctggggcacctttggtctatgctctgttgcttcggaggtgtagacagggccactgcgaggagttctgtgtgtataaaggatcacttagttcatacggagcggtgcttcctccaggcttccgccctcattttgaagtggggctggccgtggtggtgcaggaccaactaggcgcagcagttgtggcactgaaccgcagcttagccatcactctcccggaacccaatgggtcagccacggggttaacggtgtggctgcatgggctcacagcgtctgttctccctggactgctgcggcaggccgacccccagcacgttattgagtactctctcgctttggtgaccgtcctcaacgagtatgagcgcgcactggacgtcgccgcagagcctaagcatgaacgccagcatagggcacagatacgcaagaatatcacagagacactggtgtctctccgggtacacaccgtggatgatatccagcaaattgccgcagctctggcacaatgcatgggtcccagcagagaattagtgtgtaggtcttgcttgaagcagactttacacaagcttgaggccatgatgttgatactgcaggccgaaactaccgctgggaccgtgacacctaccgctatcggcgactccattttgaatatcaccggtgatctaattcacttagcctcttccgatgtacgggcacctcaaccatctgagctgggcgcagagagcccgtctcgcatggtggcctcccaggcatacaacctgacctccgctctgatgcgcatcttgatgagaagcagagtgctcaacgaagaaccgctgaccctggcaggggaggaaattgttgcccagggtaagaggtccgatccgagaagcctactgtgttacggtggcgctcctggccctggctgtcattttagcatacccgaggcctttagtggggctcttgccaatctgtctgacgttgttcagctaattttcctagtggatagtaacccctttcctttcggatacataagtaattacacagtgtctactaaagtcgcttccatggccttccaaacacaggctggggctcagattcctatcgaaaggctggcttctgagagagctattacagtgaaggttcccaataacagcgactgggccgcacgcggacacagatcatctgcaaacagcgctaacagcgtcgtggtgcagccccaggcatccgtgggagccgttgtaacacttgattcatcaaatcctgctgctggcctgcacctccaattgaattacaccttgcttgacggtcattatctctcggaggaacccgaaccctacctggcagtttacctgcatagcgagccaagacccaacgagcacaattgttccgcaagcaggcgcatcaggccggagtccttgcagggcgcagatcatcggccatataccttctttataagtcccggatcccgggatcccgctggctcctatcacttaaacctgtccagtcactttagatggtctgctcttcaggtgagcgtcggactgtacacctcgctgtgtcagtatttttctgaagaggacatggtctggcgcacagagggtcttttgcccctggaagagacatcccccagacaggcagtgtgtctgactcgccatctgaccgctttcggcgctagcctgttcgtgccaccttctcatgtgcgcttcgtcttccccgagcccaccgccgacgttaactatatcgtgatgctcacctgtgctgtctgcctggttacctacatggtgatggcggcaatactgcataagctggaccagctcgacgcttcaaggggacgggctatccccttctgtggccagcgagggcgatttaagtacgagattcttgtgaaaacaggctgggggcgaggatccggtacaaccgcacacgtgggtattatgctgtacggagttgatagccgtagtggtcatcggcatttagatggggaccgcgctttccaccggaatagcctcgatatcttcaggattgctactcctcactccctgggttccgtttggaagatccgcgtctggcatgacaacaaggggctgagcccagcatggttcctgcagcacgttatcgtcagggacttacaaactgcccgaagcgcctttttcttggtgaatgactggctttctgtcgagacagaagccaacggcggactggtggaaaaggaggtgttggccgcaagtgatgccgcactcctccgcttccgccgtttgctcgtggccgaactgcagcggggattttttgataaacacatctggctctccatctgggaccgcccacccaggagccgattcacccggatacagagagccacatgctgcgtgcttctgatctgtctgtttctgggagccaacgcggtatggtacggcgctgtaggcgactctgcgtacagcacaggccatgtttcacggctatcccctctaagcgtggatactgttgccgttggcctggtgagctctgtggtggtttacccggtgtaccttgctatcctgttcctattcagaatgtcaaggtctaaagtagcagggtccccgtcgcccacgcccgcagggcaacaggtcctggacatcgacagctgtttggattcctccgttctggacagtagttttcttacattctccgggctgcatgccgaacaggccttcgttggccagatgaaatcagatttattcttggatgattctaagagccttgtgtgctggcccagtggggaaggcacactcagctggcccgacctcttgtcagatccctccatcgtgggtagcaatcttcgccagctggctaggggccaagcaggtcatggtttgggtccagaggaggacggtttttctttggcaagcccgtatagccccgctaagtctttctccgcctctgacgaagatcttatccaacaggtgctcgccgagggggtgtcaagccccgcacctacacaggatactcatatggaaaccgacctgctttcatcgttgtcctctacacccggagaaaagaccgagacgctggccctccagcggctaggcgagttaggtccccctagtcccggtttgaactgggagcagccccaggcggcaaggctatcccgcactggcttggttgaggggctacggaaacggctgttacccgcatggtgtgcttccttagcacatggcttaagtttgctgctagtggccgttgcagtagccgtgagcggctgggttggggcaagcttccctccgggagtaagcgtagcttggctgctgagctccagtgcttccttcctcgccagcttcctaggatgggagcccctgaaagtactgctggaagcactttactttagcctcgtggctaagcggctgcaccccgatgaagatgataccctggtcgaaagtccggctgtaacacctgtaagcgctcgagtgcccagagttcgacctccacatggcttcgccctttttctggctaaagaggaggctcgtaaagtgaagcggttacatgggatgctgcgatcacttctggtgtatatgttgttcctgctggtcacattgttagcctcctacggagatgctagttgtcatgggcacgcgtataggttgcaatcagccatcaaacaggaactgcattcacgagccttcctggctataactcgatctgaagaactgtggccatggatggcccacgtcctgctgccctatgtgcatgggaaccagagttcccctgagcttgggcctccccgacttcgacaggtaaggctgcaggaggctttgtatcctgacccaccagggcctagagtccacacctgtagcgctgctggaggattctccacaagtgactacgacgtggggtgggagagcccacataatggttccggcacttgggcttacagcgccccagatctgctgggcgcatggtcctggggtagttgcgctgtgtacgactccggtggatacgttcaagaactggggctcagcctcgaagaaagcagagacagactgcgtttcctccaactgcataactggctcgataatagatccagagccgtgttcctcgagctgactcgatactccccggctgtcggtcttcatgcggcagtgactctccgcctcgaatttccagccgctgggagggcactggctgccctttccgtccgccctttcgctctgcggaggctgagtgcaggcctgtccctgcctctgttgacttctgtctgtctgcttctgtttgctgttcactttgcagtggctgaggccagaacttggcaccgtgaagggcgatggcgagtgctcaggctcggtgcctgggccaggtggctactggtcgcacttaccgcggctaccgcccttgtacgtcttgcacagctcggtgctgctgaccgccaatggactcgcttcgtgcggggtcgccctcggcgatttacatcctttgaccaggttgctcaactctcttcagcggctagaggcttggcggcaagcctgctgtttcttctgttagtcaaggccgctcaacaactgcgattcgtgcggcaatggtctgtgtttggtaagacgctatgcagggctctccccgaattgctgggcgttaccctagggctggtggtgcttggcgtcgcatacgcccaactcgctatcttactcgtgtcttcctgcgtagattctctctggtcggttgcccaggctctattggtgctgtgtcccggaacaggtctgagcaccctttgtccggctgagtcatggcatcttagccctctcctttgcgtgggtctatgggcgttaagactgtggggcgcactgaggctgggcgcagtgatactgaggtggcgttatcatgctctcaggggtgagctgtaccgaccagcgtgggagccccaggattacgagatggttgagctatttctgagacgtctgcgcctatggatgggcctaagcaaagttaaagaattccggcacaaggtaaggttcgaaggaatggagcctttgccgtctaggtcctcccgcggatcaaaagtgtcaccagatgtgccacctccctctgctggcagcgatgcaagtcatccaagcacatcttcctcccagctagacggactgtcggtctctctcggcaggttaggtacccgctgcgagcctgaaccctcacgcttgcaggccgtgtttgaggccctcttgactcagttcgaccggctgaaccaggctacagaggatgtgtaccagttggaacagcagctccactcactccaagggagaagaagcagccgagctcctgccggtagctctcggggaccgtcaccagggttacggccagctttgccctctagactggctagggcctcccggggagttgacttagccaccgggccatcaagaaccccccttagagccaagaataaagtgcatccttctagtacctat

SEQ ID NO: 235388 - DNA, 10914 bp, Artificial Sequence
  Description of Artificial Sequence: Synthetic coding sequence
atgcctcctgccgctccagctcgcctggctctcgccttgggtctagggctgtggttaggcgcactggccggtggcccaggacggggatgcggcccatgcgaacccccatgtctgtgtggcccagctcctggagccgcatgtagagttaactgtagtggcagggggctgcgcaccttgggccctgccttacggattcctgccgacgctaccgctctgaccgctatggcaaaagctgatggagatgtcaaaaaatacggaagcaagcgcggagccctggccctcacacacggccactccctgcttcgggacgtaagccataacctgttgagagccctcgacgtcggcctgctcgctaatttatcagcactggccgaactggacattagcaataataaaatctccaccctcgaggagggcatctttgccaacctttttaacctctcagagatcaacctgtctggaaacccttttgaatgtgactgtgggctggcatggctcccaaggtgggcggaggagcagcaagtgcgcgtggtgcagcccgaagccgcaacctgcgctggacctggctcgctggctggtcaacctctgttaggaataccactccttgacagcggttgtggtgcaaccctggtgggtccccatggccctcttgcctccgggcagcttgcagccttccacatcgcggcaccactgcccgtcaccgccaccaggtgggatttcggagatggatcggccgaagtcgacgctgcgggtcccgctgccagtcaccgttatgtgcttccaggcaggtatcacgtaaccgccgtgttggctctgggcgctgggtcagctctccttggaaccgacgtgcaagtcgaagcagcccctgctgccctggaactggtctgtcccagttccgtgcagagtgacgagtcactggacttgtccatccagaacagaggtggcagcggcctcgaagccgcatacagtatcgttgcgcttggcgaagagccagctcgggctgtgcaccctctctgcccaagcgatacggaaatatttccaggaaacggacactgctatcggctggtggtcgaaaaggctgcttggttacaggcacaagaacagtgccaggcgtgggccggtgccgcactggccatggttgacagccctgccgtacaacgatttctggtgtctcgtgttactcgaagcctggacgtctggattggcttttctaccgtacagggcgtcgaagtgggacctgctcctcaaggagaggctttttcccttgaatcctgccagaattggctccctggggagccacatccagccacggccgagcactgcgtgcggctcggtcctactggctggtgtaacacagacctctgcagcgcgcctcacagctacgtgtgcgagcttcagcccggaggacccgtgcaagatgcagaaaatttgctcgtaggagccccaagtggcgatctacagggaccccttacccctctggcccagcaggacggcctctctgcccctcacgagcctgtcgaagcaggcatggggtccgtggagctgaggcggccacccgctcaccaggtgatggtcttccccggactaaggctatctagagaggcctttttgaccaccgcggagtttggaactcaagaactgagacgacccgcacagttaaggctgcaagtttaccgcctcctttccactgctggtacgcccgagaatggctccgaacccgagtcacggagcccagataaccgcactcagctagccccagcatgtatgccaggtggaagatggtgccccggagccaacatatgcctgcccctggatgccagctgtcatcctcaggcctgcgctaacgggtgcacagagggggagcacgtcgtagacgttgtcgtggagaattccgcatctcgggctaatctcagcttacgggtgaccgccgaagaacctatctgcggtctgagagctacaccttcacccgaggctcgagtgctgcagggcgtgctggtccgctacagcccggtggttgaggctggctcagatatggtgttccgatggaccatcaatgacaaacagtctctcacctttcaaaatgtagtcttcaacgtgatctaccagtcggcagccgtgttcaagctctcccttacagccagcaaccatgtgagcaacgtcacagtgaactataatgtgacagtggagcggatgaatcgcatgcagggcctacaggtcagcaccgttcccgctgtcctaagccctaatgctactctcgccctcacagctggggtgctggtggatagtgcggttgaggtcgcttttctttggacgtttggggatggcgagcaggccctgcaccagttccagccaccctataacgaaagttttccggtcccagatccaagtgttgcccaggtacttgtcgagcacaatgtcatgcacacgtacgccgctccaggggagtatttactgacggtgctggcctcaaacgcttttgagaatctgacccagcaggtgccagtcagcgttcgggcatcattgccttcagtagctgtgggggtgtcagatggcgtcctctctcaaccagctgctaatcacacatatgcctccagggggacctatcacgtgcgactggaggtgaataatactgtgtcaggggcagcggctcaggccgacgtgcgtgttttcgaagagctccggggtctgtctgtcgatatgagccttgctgtggagcagggggcaccagtggtagtctctgcagctgtgcagacgggcgataatatcacatggacattcgacatgggagatggcacagtcctttctgggcctgaagcgacagtggaacacgtatatctccgcgcacaaaactgcactgttactgtaggcgcagcaagccccgcaggacatctggcaagatctctgcacgtgctggtctttgtgctcgaagtgttaagagtggagccagccgcttgtatacccacacagccggacgcacggctcaccgcctacgttacaggcaatcctgcccactaccttttcgattggacctttggagacggttcctcaaatactactgtgcgcggatgccccaccgtcacacacaacttcaccaggtccggcaccttcccactggcacttgtgctctcaagtagggtcaaccgagctcattacttcacctctatttgtgtcgaacctgaagtggggaatgtgacactgcagccagagaggcagttcgtacagcttggtgacgaggcgtggctcgtggcctgcgcttggccgccatttccctacaggtatacctgggactttggcaccgaggaagctgcccctactcgcgctcgtggaccagaggtcacttttatttacagggaccctggctcatatctggtgacagtcaccgccagcaacaacataagtgctgccaacgattctgctctcgttgaagtccaggaacccgtgcttgttacgtccatcaaggttaacggaagcctgggactggagcttcagcagccctatctgttctccgctgtgggcagggggaggcctgcctcttacctgtgggacctcggggatgggggatggctggaagggccagaggtgacacatgcttacaacagcaccggtgatttcaccgggcctgggccaggtcgccagaggcagcgactgctggctcatcgtgaggccggtacttaccatgttcagctaagagccacgaatatgctcggaagcgcctgggcagactgcacaatggatttcgtcgagccggtgggttggcttatggtagctgctagtccaaatccagctgcagtgaacacctccgtcacactaagtgctgagttggccggaggatctggggttgtctatacctggtccctggaagagggattaagctgggagacctccgagccttttactacccatagctttccgactcccggtctgcacctggtcacaatgacagccggaaatcctttgggcagtgctaacgccaccgtggaggtggacgtgcaggttccagtcagcgggctgagtattcgcgcaagtgaacccggtggttccttcgtcgccgctggttctagtgtgccgttctggggtcaattggctacagggactaacgtctcctggtgttgggccgtgccaggcggtagcagcaaaagaggtccacacgttacgatggtttttccagatgccggtacctttagcatccgcttgaatgcttcaaacgccgtaagctgggtctcagctacttacaatctcacggctgaagagcccatcgtaggcctggtgctctgggcaagcagcaaggtggtggctccagggcagctggtgcacttccagatcctgctggccgcaggaagcgctgtgacatttcgcctgcaggacaccgatgagccaagagccgagcactcatacctgcggccaggcgactacagggtgcaggtgaacgcatctaaccttgtcagcttcttcgtggctcaggctactgtcacagtgcaggtgttggcttgtcgcgagcctgaagtggacgtggtgctgcccctgcaggtcttaatgcggaggtctcagagaaactatctcgaagcccatgttgacttgcgtgactgcgtgacataccagaccgaatatcggtgggaggtttatcgcacggcatcttgccagcggcctggcaggccagctcgggtcgccctgccgggagtggatgtgtctcggcctcggttagtactcccgcgactggctctcccggtgggacactattgctttgtttttgtcgttagtttcggggatacgccgctgacccagtctattcaggcaaatgtgacagtggccccagagcgcctagtccctataattgaggggggtagctaccgggtgtggtcggacacacgagatctggtattggacggctcagagtcttacgaccctaatctcgaagacggcgaccaaacaccattgtcgttccactgggcttgtgttgcctccacccagagggaggccggtgggtgtgccctcaattttggacctcgcggaagcagcacggtcaccatcccacgggaacgactcgctgccggagttgagtatacctttagtttaacagtgtggaaggcgggaagaaaggaagaggctactaaccagaccgtgctaatcagatctgggagggtccccatagtgtccttagagtgcgtcagctgcaaagctcaggccgtctacgaggtatcacgatcgtcatacgtgtacctcgaaggtagatgtctgaactgcagctctgggagtaagcgcggacgctgggctgccagaactttctcaaacaagaccttagtcttggacgagactaccacaagcaccggatccgcagggatgcgcctcgtgttgcgtcggggagttctcagagatggagagggatacacattcactctgactgtcctcggcagatcaggggaagaggagggatgtgcttccatccgtctcagccctaatcgcccacccctcggcggatcttgcaggctctttcctctgggggctgttcacgctctgacaacgaaggtacatttcgagtgtacggggtggcacgatgccgaagatgccggagctcccctcgtctacgcccttcttctccgtagatgcagacagggtcattgcgaggaattctgtgtttacaaggggtccctgtccagttatggagctgtgctcccacccggattccggcctcactttgaggtcggactggcggttgtggtccaagaccagctcggtgctgctgtggtggctcttaatcggtcattagcgataacgcttccagaaccaaatggaagcgccaccggactgacagtgtggctccacgggctcactgcatctgtcttgccagggcttctccgccaggctgacccccaacatgtaatcgaatattccctcgccctagtgacagtcctgaacgagcatcgcgctcagatccgcaagaacattacagaaacattggtgtctctgcgcgtgcataccgtggatgatattcaacagattgccgctgctttagcccagtgcatgggaccctcaagagagcttgtctgtagatcttgccttaagcagaccctccacaagcttgaagccatgatgttaattctgcaggccgagacaaccgccggaactgttacccctaccgcgatcggagattccatcctgaatatcacgggtgatttgattcacctggccagtagcgacgtcagagcccctcaaccatccgaactcggagctgagtcgccgtccaggatggtggcctcacaggcctataacctcacgtccgccctcatgcgcattttgatgcgcagcagggtactgaacgaagaaccccttacactggcaggcgaagagatcgtggcccagggcaaacggagcgatcctcggagcctgctttgctacggcggagccccagggccagggtgtcatttcagcattccagaggcattcagcggtgcactggccaacctgtcagatgtggtccagctcatatttctggtggattcaaaccctttccccttcgggtacatctccaactacacagtatcaaccaaggtcgcatctatggcctttcagacacaggctggagcccagattcctatcgagcgactggcttcagaaagggccatcacggtgaaagtcccaaacaattcagactgggcagcgagaggccaccgatcgtcagcaaactccgcaaattcagttgtggtgcagccccaggctagtgtgggagccgtggtgacgctggactctagtaaccctgccgctggactacatctgcaattaaactatacgctactggacggccattatctgtcagaggaacccgaaccctatcttgcagtgtacttgcatagcgaacctcggccaaacgagcacaactgtagcgccagtagaagaattcgaccagaatccctacaaggtgctgatcataggccctacacgttttttatcagtccaggctccagggaccctgccggatcataccacctaaatctgtcgtcacatttccgctggtccgcccttcaggtgtcagtgggactgtatacttccctctgtcagtatttttctgaggaagacatggtctggcgtactgaaggactgctgcccctggaggaaacctcccccagacaggccgtctgcctgaccaggcatctaacagcattcggggcttcgctcttcgtccctccctcacacgtaagattcgtattccccgaacctaccgccgacgtgaactacatcgtgatgttgacatgcgccgtctgcttggtcacgtacatggtgatggccgcaattttacataaactcgaccaacttgacgctagtcggggtagggctataccattttgtggacagaggggacggtttaaatatgagattttagtcaagacaggatggggcaggggctcaggcacgactgctcatgtgggcataatgctgtacggcgtggattctcgaagcgggcaccggcaccttgatggcgatcgcgctttccaccggaactccctggacatcttccgaatcgctacccctcatagcctgggatccgtctggaagattagggtttggcatgacaacaaggggctcagccccgcttggtttttgcagcacgtcatcgttagagatctgcagacagcacgatcggcattcttcctggtgaatgattggctatctgttgagaccgaggccaatggaggtttagtggaaaaggaggtgctggctgcgagtgatgctgctttactgcgattccgccgactgttggtcgctgagctgcagcggggtttttttgataagcatatctggctgagcatttgggatcggcctccgaggagccggttcacccggatccaaagggcaacttgctgtgttctattaatatgtttattcctaggcgctaacgctgtgtggtatggggctgtgggggacagcgcttattccactgggcacgtgagccgattgtcccctttatcggtcgacaccgtcgcggtgggtcttgtgagctcggtcgttgtttaccccgtatatctggccatcttgtttctgtttcggatgagccgcagcaaggtggctgggagcccttcccccacgcctgctggccaacaggtactggacattgacagttgcctggacagttctgtcttggactctagctttctgaccttttcaggactgcatgctgaggccttcgttggccagatgaaaagcgacttgttcttagacgattctaaatcactggtttgctggccttctggggagggaacactctcctggccggacctgctctcagatccctccatcgtcgggtcaaatctgcggcagctggccagaggccaggctggtcatggcctgggaccggaggaggatggtttctctctggccagtccttattcacccgcaaagtcattcagtgcctcagatgaggatctgatacagcaggtgctggctgagggcgtgagttcaccagcacctactcaggatacccacatggagactgacctgctcagcagcctgagctcaacaccaggggagaaaacagagacactcgccctgcagcgtttaggagagctcgggcctccgtctcctggcctgaattgggaacagccccaggctgccaggctatcgcggaccgggctggttgaaggcttacggaagaggctccttccagcctggtgtgcatcactggcccatggtttatccctgttgttggttgccgttgctgtggcggttagcgggtgggtgggtgcctcattcccaccaggtgtgtctgttgcgtggctcctgtcctcaagcgctagttttttggcttctttccttggatgggagccactcaaggtcctgctcgaagcactttacttctccctcgtggcaaagcggttgcacccagacgaagatgacactctggtagaaagcccagcggttactcctgtcagtgcccgagtaccaagagttcgcccaccgcacggcttcgctctgttccttgccaaagaggaagcaagaaaagtgaagagactccacgggatgctccgaagcctgcttgtgtacatgctgtttcttctggtcaccctcctggcctcttacggtgatgcgagttgccacgggcacgcataccgcctccagtcggcaataaaacaggagttacactcaagagcttttctcgccataactaggagtgaggaactgtggccatggatggctcacgtactgctcccctacgtgcacggtaaccagtcaagcccagagctcggccctcccaggcttcgacaagtacggctccaggaagctctgtaccccgacccccctgggcctcgggtccacacttgttcagcagccggaggtttctcaaccagcgactatgatgtggggtgggagtcgccccacaacgggtcaggaacgtgggcttatagtgctccggaccttttaggcgcttggtcatgggggtcctgcgctgtttatgacagtgggggatatgtgcaggaactcggcttatcattagaggaatctcgtgaccgtttacgctttctgcagcttcataactggttagataaccgatcccgagctgtgttcctggagctgacccgatactctcctgccgtgggcctgcacgccgctgtgacactccgcttggaatttcctgccgcaggaagagctctggccgcattaagtgtccgtccgttcgcacttagacgcctctcggcgggtctcagcctgcccctgctgacttctgtctgtctgcttttgtttgccgtgcacttcgccgtggctgaagcaaggacttggcaccgcgagggtcgctggcgcgtgctgcgattgggcgcatgggcgcgatggttgctcgttgcattgactgctgcgacagccttggtccggctggcccagctgggagcagccgatcgtcagtggacccggtttgtgcggggtagacccaggcgctttacatcttttgaccaagtggctcagctgtcatcggcagcaaggggtctggctgcgagcctgctgtttctattgctcgtgaaagcggcacaacagctgagattcgtccggcagtggagcgtattcggtaagacgctgtgccgagccctgcccgagctgctaggcgtgactctcggccttgttgtactgggagtagcatatgcccagttggccattctactggtcagtagttgcgtcgacagcctgtggtctgtcgctcaggccttgctggtattgtgccctgggactggcctgtctactttgtgtcccgctgagtcatggcacctgagtcctctcctgtgtgtgggtctttgggccctacggttatggggggcactcaggttgggcgcagtgatccttagatggcgataccacgccctgcggggagaattgtataggcctgcctgggagccccaagattatgagatggttgaacttttcctgaggaggcttaggctttggatgggcctgtcaaaggttaaggagtttagacacaaggtaaggtttgagggcatggagcccctgccgtcacgcagtagtcggggtagcaaagtctcgccagatgtgccgcctcctagcgccggaagtgatgccagccaccccagcacaagttcatcccaactggacggattgagtgttagcctcgggaggcttggcaccagatgcgaaccggagccctccaggctgcaagcggtgtttgaggctttgttaacgcagtttgacaggctcaaccaggcgaccgaggacgtctaccagctggagcagcagctgcactcacttcaaggtagaagaagttctcgagcaccagccggatcaagccggggtccttcccccggattacggcctgcgttgccctctcggcttgctcgtgcctcaaggggcgtggatttagctactggcccaagccgtacacctcttcgagcaaagaataaggttcacccatccagcacctag

SEQ ID NO: 235389 - DNA, 3692 bp, Artificial Sequence
  Description of Artificial Sequence: Synthetic coding sequence
atggtggctgcatcccctaatccagccgcagtgaatacatccgtcaccctgagcgccgaacttgcagggggtagcggtgtagtgtatacatggtcccttgaggaggggttgagctgggagacatcggaaccttttaccacacacagttttcccacgcctggattgcacctggtgaccatgactgctggaaacccactgggtagtgccaacgctaccgtggaagtggacgttcaggtaccggtaagcgggttgtctatcagagcgagtgaacccggtgggtcatttgttgccgctggatctagtgtgccattctgggggcagctcgccacggggaccaacgtcagttggtgctgggccgtaccaggcggttcgtccaagaggggccctcacgtgacgatggtatttcccgacgcaggtacattcagtattcggttgaatgccagcaatgccgtgtcatgggtgtctgctacctataatctcacggctgaagaacccatcgtaggactagtactttgggcgagctccaaggtggtcgcccctggacagctggtgcatttccagatactgctggctgcgggtagtgccgttacatttcgactgcaggttgggggagccaatcctgaggtgctacccggaccacgtttcagccattctttcccaagagtgggcgatcacgtggtgtctgtgcgcggaaaaaaccacgtctcctgggcccaggctcaagtgcgaatagttgtgttagaggccgtttcagggctccaagttcctaattgctgcgaaccaggaatcgcaacgggaactgagcggaactttaccgccagagtccagcgtggttcgagagttgcatatgcatggtacttttcccttcagaaggtgcaaggtgattcattagttattttatccgggcgagatgttacctacaccccagtggccgctggcctgctagaaatccaggtgagagctttcaacgcgctgggttccgaaaaccggacactggtgctcgaggtccaggatgctgtgcagtatgtggcactccagtccggcccatgctttaccaaccgcagtgctcaatttgaagcagctacatcacccagtcccagacgagttgcttaccactgggatttcggagacggttcacccggtcaggatacagatgagccacgcgctgaacattcctacctcaggcccggagactatcgagtacaggtcaacgcatccaaccttgtatcattctttgtggcacaggcaactgtgaccgtccaagtcctcgcatgtcgcgagcctgaggtggacgttgttctacctctgcaggtgcttatgaggagaagccagcgaaattatctggaggctcatgttgacctccgagattgcgtcacatatcaaacagagtaccggtgggaagtgtatcgcactgcttcctgtcagaggcccggacggccagcaagagtcgcattgcctggagtggatgtctctaggcccaggttggtcctgccgaggcttgcactgccggtaggacattactgttttgtgtttgtagtgagctttggagatacccccctcacacaatctatccaggcaaacgtcacagtggcacccgaaagactggttcctattattgagggcggaagctaccgcgtgtggagtgacacaagggacttggtgctcgacggtagtgagtcatacgacccaaatctcgaagatggcgatcagactcctcttagttttcattgggcttgtgtcgcttctacgcagcgcgaggccggaggctgcgctttgaattttggcccacgcggttcaagcacggtgactatccccagggagcgcttggcagccggtgtggagtacacgttttctctgacagtctggaaagcgggacgaaaagaagaggccacaaaccaaactgtgctcatccgtagtggcagggtccccattgtttccttggagtgtgtctcctgtaaggcccaggcagtttacgaagtatccaggagctcatatgtgtaccttgaagggagatgtctgaactgttccagcggcagcaaaagaggacgatgggccgctaggacattttcaaataagacactagtgttggatgagactaccacttctactggaagtgcaggtatgaggttggtcctgcgacgaggcgtcttgagggatggagaaggctataccttcacgctaactgttctcggtcggagcggcgaggaagaaggatgtgcttcaatccggctttcccctaacaggcccccattgggaggaagttgccggctctttcccctcggagccgtgcacgccctcaccacaaaggtgcacttcgagtgcacggggtggcacgacgcagaagatgcaggcgctcctctggtctacgccctgctgctgcgcagatgtcgacaggggcactgcgaggaattctgcgtctacaaaggctcactgtcatcctatggcgctgttttaccccctggtttccgcccacatttcgaagtgggactggccgtggtcgtgcaggaccagctcggcgcagccgtggtggccctgaatagaagcctggcaataaccctgcctgagcctaacggttccgcaacagggctaacagtgtggctgcacggacttaccgcttctgttttaccgggtctcctgaggcaggccgacccacagcacgtaattgagtactcattggccttggtgactgtgttaaacgaatatgaaagggccctcgatgtggctgctgagccaaagcacgaaagacagcatagggcgcaaattcgcaaaaacataactgaaacactcgtgtcccttagggttcacactgtggatgatattcaacaaatagctgcagcgctcgcccaatgcatgggtccctcacgtgagttggtttgccgaagctgcttgaagcagacccttcataagttagaggcgatgatgctaattctgcaggcggaaaccactgcaggaacagtgacccctactgctatcggcgattcaatcctgaacattaccggggacctgattcaccttgcgagcagtgatgttagggctccgcagccaagcgagcttggcgctgaatcacccagtcgcatggtagctagtcaggcctacaacctaaccagcgctctgatgaggatcctgatgagatctagggtgcttaatgaggaacctttgactttggcgggagaggagatcgtagcccagggaaagagatcagacccaagatctctcctttgttatggaggcgctcctggccctggctgtcacttcagtatccccgaagcgttcagtggggctttagctaacctgagcgatgtggtgcagctaattttcttagttgattctaacccttttccattcggatacatctcaaattatactgtgagtactaaggcaccccctacacctcctacccccctgtggtccagtccaagaccgccttcagtcctttggagcccatggacagcagccactctacgcccaggctgcatctgctcatcaaccattcgctgctggactgctacaacctgcctgcgtaacttaagtccaacatggcaaagtacctatacacgatcacccggacccatgagcactactgccagactagctggaggctccgcacagagccattcccgagtgttgaccacagggcctacccccagtagttttcctagaggggctgaaacccagaggggtgtgacaattta

SEQ ID NO: 235390 - DNA, 12909 bp, Artificial Sequence
  Description of Artificial Sequence: Synthetic coding sequence
atgccacccgctgctccagctcgcttagctcttgccctgggacttggactttggctgggggcactggcgggtggccctggccgaggctgcggtccatgtgaacccccttgtctttgcggccctgcaccgggtgccgcttgcagggtgaactgtagcggcagggggctgagaactctcggtccagcactgcggatacccgctgatgcgacggcattggacgtttctcacaatctgctccgcgctctggacgtcggtctgttggctaacctgtccgctctggctgagctcgacatcagcaacaataaaatttccactttggaggagggaatatttgccaatctcttcaatctttctgagatcaatctatctggaaaccccttcgaatgcgattgtggcctcgcttggctgcccagatgggctgaggagcaacaggtgagggtggtccagcctgaggccgcaacttgcgcgggtcccggatcactggccggacagccactgcttggcatcccactgcttgattccggctgtggagaggaatatgtggcatgcctacccgataatagctcaggtacagtcgccgctgtctccttcagcgccgcacatgaggggcttctgcaacccgaggcttgttccgcgttttgcttttctaccggccagggcctggctgctctcagcgaacagggttggtgcctttgtggagccgcacagccctccagtgcaagcttcgcctgtctctctctatgtagcggcccacctcctcccccagcaccaacctgccgcggaccaacattactgcagcacgtgtttcccgcttctcctggcgctacattagtcggtcctcatgggccattagcttccggacaactggccgcatttcatatcgcagctcccctgccggtcaccgcaaccaggtgggactttggtgacggaagtgctgaagtagacgccgcaggccctgccgcttctcaccgttatgtgcttcccggaagatatcatgtgaccgctgtgctggctctgggagccggtagtgcactcctgggaaccgatgtccaggtggaggcagctccagccgctctggagctcgtatgcccttcctccgtgcagtcagacgaatctctggacttaagtatccagaacagaggaggcagcggactggaggctgcatacagcatcgtagctctgggagaggagccggcacgagcagtgcaccctctgtgcccatcagatacagaaattttccccggtaatggtcactgttaccgtttagttgtcgagaaggccgcatggctgcaggctcaggagcagtgtcaggcttgggcaggagctgcccttgccatggtagactcaccagccgtgcagcgattcctggttagtcgggtgacccggtctttggatgtttggatcggtttttcaacggttcaaggggttgaagtgggacctgcccctcagggcgaggcttttagcctggagtcatgtcagaactggcttcccggtgagcctcaccctgccacggccgaacattgtgtgaggctgggcccaacgggatggtgtaatactgacttgtgcagtgcccctcactcatatgtatgcgagcttcagccagggggtccagtgcaagacgcagagaatctgctggtgggtgccccatccggtgacttgcagggcccattgacgcctcttgctcagcaggatgggctcagcgctccacacgagcctgttgaagtgatggtgttccccggtctgaggctaagtcgtgaggcctttctgactaccgccgagttcgggacccaggaactcagaagaccggcacaactgcggctccaggtgtaccggctgctgtccacagccggtacccctgaaaatggatcggaacccgaatcacggtccccggacaatcgaacccagctcgcacccgcttgtatgcccggtggtcggtggtgtcctggtgcaaacatttgcctgccgctggatgcctcctgtcacccccaagcttgtgcaaacggatgcacctccggtccagggctgcccggagcaccatatgcactctggcgcgaatttcttttttcagtgcctgccggaccaccagcccaatatagcgtcaccctgcatggtcaggatgtgctgatgctgcctggggacttagttgggttacagcacgatgctggcccaggagccctccttcattgttctcccgcacctggccaccctggacctcgcgcaccctatctgtccgctaatgcctcctcctggcttccacaccttcccgctcagctggagggtacctgggcatgccctgcatgtgctctccggttactggccgctaccgaacagctcacagtactgctgggcctcagacctaatcccggactacggctgcctggtcgctacgaagtgagagctgaagtcggtaatggggtaagtcgccataacctctcttgttcttttgacgtggtcagccctgtcgcaggcctgcgcgtaatatatcctgcccctcgggatgggagactgtacgtgcccacaaatggaagtgcccttgtccttcaggtggactccggcgctaatgctaccgctactgcgaggtggcctggcggttccgtgagcgccagatttgaaaacgtgtgtccggctctggtcgccactttcgtccctggctgcccttgggaaaccaatgacacactgtttagtgtggtggccctgccatggctaagtgagggagaacatgtggtagacgtggtcgtcgagaactctgcctcgagagccaacctttccctgcgcgtaacagctgaggagcccatatgcgggttacgagccacaccatcccctgaggcccgagtactccagggagtcctcgttaggtactccccggtggtagaggcgggttccgacatggtgttcaggtggaccatcaacgacaaacagtctttgacctttcagaacgtggtcttcaatgtgatttatcagagcgccgctgtgtttaagctttcactaaccgccagcaaccacgtatctaatgtgactgtgaattacaatgtgacagtggaaagaatgaatcgcatgcagggactgcaagtctctaccgtgcctgcagtcctatctccgaatgctacactggctcttactgctggtgtgctggttgattctgctgtcgaggtagcatttctgtggacattcggtgacggggagcaggctctgcaccagtttcagccaccatacaatgagtcttttccggtgcctgatccgtccgtggctcaggttctagtggagcacaatgtgatgcatacatatgcagcgccaggtgagtatctgttaaccgtgctggccagcaatgcgttcgaaaacctgacccagcaggtgccagtttctgtccgagcctcattgccaagcgtcgccgttggggtatcagatggggtgcttgtggcagggagacctgtcactttttaccctcacccactcccctctcctggcggagtgctgtacacttgggatttcggagatggttccccggttttaacccagagccagcctgctgcaaaccatacttatgcaagccggggaacctatcatgtgagactggaggtgaacaacacagtgagtggggctgctgctcaggctgacgtgcgggttttcgaagagctgcggggattatccgtggacatgtcacttgccgtggaacagggcgcaccagtcgtagtctcagcggctgtgcaaactggagataatatcacttggactttcgacatgggggatggaaccgtgcttagcggcccagaagccacagttgagcacgtttacctgagggcgcagaactgtactgtgacagtgggtgctgccagtcccgctggccaccttgctcgtagcttacacgtcctcgtctttgtcctcgaggtcttgcgtgtggagcccgctgcttgcatcccaacccaacccgatgctcgcctcaccgcctacgtgaccgggaaccccgctcattatctgttcgactggaccttcggggatgggagctcgaacaccaccgtgcgaggctgcccgacggtgacccacaactttacacgaagtggcacatttccactggcccttgttctctcctcacgagtcaaccgggcacactactttaccagtatttgtgtagaacccgaagtggggaatgtgaccctgcagccagagcgtcagtttgtgcaattgggggacgaggcctggctcgtggcctgcgcctggcctccttttccctatcgctacacgtgggacttcggtaccgaagaggctgcacctactagagctcgtggacccgaggtaacctttatttatcgggacccaggttcgtacctggtgaccgtgacggcatccaataatattagtgcggcaaacgactccgctttagtggaggtgcaggagcctgtgctggtgacatccattaaggtcaacggctccctcggactagagctccaacagccatatcttttcagtgccgtcggtcgcggacgaccagcctcatatctttgggacctgggagatggcggatggcttgaagggcctgaagtgacccatgcctataattccacaggagattttacagttagagtggccggttggaatgaagtatctaggtcggaggcctggctcaatgtgacagtgaaaagaagggttcgtggtctggtggtgaatgctagtcggactgtcgtgccgctgaacgggagcgtgtcattctctacttcccttgaagcgggtagcgacgtgcgctacagctgggttctctgtgatcgatgcacccccatacctggaggcccaacaatctcctacacttttaggtccgtgggtacattcaatataattgtaacggccgaaaacgaagtgggcagcgcacaggactcgatctttgtttacgtgctgcaactcattgaaggactgcaagtggttggtggcggaaggtacttccccacaaatcacactgtgcagctgcaagcagttgtccgggacgggaccaacgtgtcttacagctggacagcttggcgggacagaggacctgcattggctggatctgggaaagggttcagtcttacagtactggaagccggtacataccatgtgcagctcagggccacaaatatgttgggctccgcatgggctgattgcaccatggatttcgtggaaccggtaggctggctgatggtggcggcttccccgaatcccgctgccgttaacacatctgtgactcttagtgccgaactggccggtggatccggagtggtgtatacatggtccctggaggagggcttaagctgggaaacaagcgaaccatttacgacccactcctttccaacacccggtctgcacttggtcactatgacggcaggaaaccccctaggctccgcaaacgccacagtggaggtagatgtgcaggttccagtctcaggactgagcatccgggctagcgagcctgggggaagttttgtcgccgctggctcctccgttccgttctggggccagctcgccaccggaactaacgtcagttggtgctgggccgtcccaggcggatctagtaagaggggccctcatgttacgatggtatttccagatgctggtactttctccattcgattaaatgcaagcaacgccgtgtcctgggtgagcgccacctacaaccttacggccgaggaacctattgtaggtctagtgctatgggcctctagcaaggttgttgccccagggcagctggtgcatttccagattctgttggctgctggctcagccgttacgttccgtctgcaggtagggggagccaatcctgaggtcctccctggccctagattttcgcatagtttcccgcgtgtgggagaccatgtggtgagcgtgcggggaaagaaccacgtatcgtgggcccaagctcaggttaggatcgtggtgttggaggccgtgtctggactgcaggtgccaaactgttgcgagcccggaattgccactggaacagagcgtaactttactgcgagggtgcagcgcggatctagagtagcctatgcctggtatttcagtttacaaaaagtgcagggtgacagcctcgtaatcttatccggccgtgatgttacctacacacccgttgccgctggtttgctggagattcaggtgcgcgctttcaatgccctgggaagtgagaataggaccttggtgctggaagtgcaggatgccgttcaatacgtcgccttacagtccggcccatgtttcactaatagaagtgcacagttcgaggccgctacctctccctccccgagaagagtagcctatcattgggacttcggcgacggctcaccaggccaagatactgatgagcccagagccgagcattcctacctccgacctggagactatagagtgcaggttaacgcctcaaatcttgtgagtttcttcgtagcccaggctacagttactgtgcaggttctcgcctgcagagagcctgaggtggatgtagttctcccattgcaggtgcttatgaggaggtcacagaggaactatttagaggcacacgttgacctcagagattgcgtcacataccaaacagagtatagatgggaagtttacagaactgcttcatgccaacgccctggtcggcctgctagagtagcccttccgggtgtcgacgtctctaggcctagactggtgctccccagactggctctccccgttggccattattgcttcgtcttcgtcgtgtcattcggggacactcctcttacccagagcatacaggctaacgttacagtggcaccagaacgcttagtgccaataattgaaggaggcagctatcgggtctggagtgacaccagggacctggttttagacggaagcgaatcctatgatcccaacctcgaagatggtgatcagacccccttaagtttccactgggcatgtgttgcttcaacacagagagaagcgggaggatgcgcgctgaatttcggaccacggggaagcagcactgtgacaatccctagagaaaggctggctgctggagtcgagtatactttttcgttgaccgtgtggaaagccggtagaaaggaggaggcaacaaatcagacagtgctgatccggagtggcagggtgccgatagtctcattagaatgtgtgtcttgtaaggcccaggcggtctatgaggtctcacgcagctcctacgtgtacctggagggccgatgcctgaattgttcctccggaagcaagcgcggtcgttgggccgctcggacattttctaataagacactggtgttagatgaaactactacaagcaccggttctgccggtatgcgcctagtgctgagacgcggagtgttaagagatggcgaaggctacacgtttaccctcacagtgctcggtagaagcggcgaggaggaaggctgcgcatctatccgcctgagtccaaatcgccctccgttgggtggttcatgtcggctttttcccttaggcgcagtacacgctcttacaactaaagtgcactttgagtgcaccgggtggcatgacgccgaggacgccggtgcacccctggtatatgccctgctactgcgccgatgtaggcaggggcattgtgaggagttttgcgtttacaaggggtctctgtcctcctatggggcagtgcttccgccagggttccgccctcactttgaagtaggactggccgtcgtagtgcaggatcagttgggcgctgcggtcgtggccctcaatcggtcgctggccataacactacctgagccaaacggatccgccaccgggcttacggtgtggctacatggcctcactgcttccgtactaccgggattattgcggcaagccgacccccaacacgtgatagaatatagcctcgccttggtgaccgtgttgaacgagtatgaaagggctctggacgtggccgcagagcccaaacatgaacgacagcaccgtgcgcagatcagaaagaatatcaccgaaaccctcgtgtccttgcgtgtccacacagtggatgacatacaacagattgctgctgccttagcccagtgcatggggcctagtcgcgaactcgtctgtcgcagctgcttaaaacagacgttgcacaagctggaagctatgatgcttatcctgcaggctgagaccacggccggtaccgtcacaccaactgccattggagacagtattctcaacataaccggcgatctgattcacctcgcgtcttctgacgttcgggctccccagcccagcgagttaggcgcagagtcgcccagcagaatggtggctagccaggcctacaatctgacttcagccctgatgagaatcctcatgaggtctagagtcctgaacgaagagccactgaccctcgcgggagaagagatcgttgctcaaggcaaaagatcagatccacggagtctcctgtgctacgggggagctcctggacccggttgtcactttagcatccccgaggcattttcaggggcactagccaatctaagtgatgtcgtgcagttaattttcttagtagactctaatccgttccccttcggttacatctcgaactacacggtgtcaaccaaagtggccagcatggcatttcagacacaggcaggtgcacagattcccattgaacgattggccagcgaacgcgctatcactgtgaaggttcctaacaattcagactgggctgccaggggtcaccgaagctccgccaattccgctaatagtgttgtagtccagccacaagcaagtgtcggcgcagtggtgactctggattccagtaatccggcagccggtctgcacctccagttgaattacacactgctagacggccattacctctctgaggagccagaaccttacctggctgtgtatctacactctgagccaagaccaaatgagcataattgctcagccagtcggagaattcggcctgaaagtctgcagggcgctgaccacaggccctatacgttctttatttctccgggatctagagatcccgcagggtcataccaccttaacctcagcagccattttaggtggtcagctctgcaggtctccgtggggctgtacacatcactttgtcaatatttcagcgaggaggacatggtgtggcgaacagagggactcctgcccctcgaagaaacaagtcctcggcaggccgtgtgtctcaccagacatcttacggcctttggcgcatctctgttcgtgccaccgagccatgtgcgcttcgtgtttccagagcctaccgcagacgttaactatatcgttatgcttacatgcgcggtatgcctggtgacttatatggtcatggctgctattctgcataaactcgaccaactcgatgctagccgtggcagagctattcctttctgtggccagcgcggaagattcaaatacgagatcttggttaagaccggctgggggagaggaagtggaacaactgcccacgtcggaataatgctgtacggagtggactcgcgctctggccatagacacctagatggggatagagcattccacaggaatagcctggatatctttcgcatcgccactccccacagtctcggatctgtgtggaagataagagtgtggcatgacaataagggcctttctcccgcatggtttcttcagcacgttatcgtgcgcgaccttcagacagctcgctccgcatttttcctagttaacgactggcttagtgtggagaccgaggctaatggtggactggtggagaaagaagtgctggctgctagcgatgccgcattactgcgatttcgacgcctgttggtggccgagctgcaacgaggctttttcgacaagcatatctggctctccatctgggaccgaccccctaggtcacgattcacaaggattcagcgagccacttgttgcgtgctgttgatctgtctgtttctgggggctaacgccgtgtggtatggcgcagtgggggactcagcctactcaaccggacacgtatcccgcctcagccctctgagtgtggacacagtggctgtgggcctcgtctcttctgtcgtggtgtatcctgtgtacctcgccatactgtttctattccgcatgtctaggagcaaggtagccggttcgccctcccccacaccggcaggtcagcaagtgctcgacatcgatagttgtctggatagttcagtgctggattcaagcttcctcactttttccggcctgcatgccgaggcttttgtgggccaaatgaagtcagatctgttcttggacgactcgaaatccttggtctgctggccctctggcgaaggcactctttcatggccggatttactctccgacccttccatcgtgggatccaatcttagacagttggccaggggacaggctggacatggactcgggcctgaggaagatggatttagtctggcctccccatatagcccggctaaaagtttttcagcgagcgatgaggacctgatccaacaggttttggccgagggagtgtcgagccccgctccgacacaagacacacatatggagacagatctcctatcttccctttcctctacacccggagaaaagacagaaacactcgccctccagcggctcggggagttaggtccaccgagtccaggccttaattgggagcagccacaggctgctaggctctcaagaactgggctggtggagggcctccgaaagcgcctgttacctgcttggtgcgcttctctcgcccatggactttcccttttgctggttgcagtcgctgtggccgtgagtggctgggtaggcgcatcattcccccctggtgtctccgtcgcatggctcctttcatctagtgcttcatttctcgcgtcatttctggggtgggaacccttaaaggtgcttctggaagctctgtacttctccttagtagctaagcggttacacccagacgaggatgatacactcgttgaatcacccgcagtcactcccgtgtctgcaagggtgccacgggtacgcccaccccacggctttgcactcttccttgccaaagaagaggctaggaaggttaaaagattacacgggatgctgcggagcctcctcgtgtacatgctcttcttattagtgaccctcctagcatcttacggcgatgcgagctgtcacgggcacgcatacaggctccagtcagcgatcaaacaagagttgcactcccgagcattcctagcaattacacgatcagaagagctctggccctggatggctcacgttctgctcccttacgtacacggaaaccaaagctctccagagcttgggccacctagactgagacaggtcagactccaagaggctttgtacccagacccgcctggccctcgcgtacatacatgctccgccgcaggaggcttcagcacgtctgattacgatgtcggatgggagagtccccacaatgggagtgggacctgggcttattctgctcctgacctcttaggcgcatggtcatggggcagctgcgctgtatatgacagtggaggatacgtgcaagagctggggctgtccctcgaggagagtcgggaccgcctccgctttcttcagttgcacaattggctggataacaggagccgagctgtgttcctcgaattgacacgctactccccagcagtaggccttcacgcagcagtgactcttcggctcgagttccctgccgcaggacgcgcactcgctgccttgagtgtgcggcctttcgccctgagacggctatccgccggtttgagtttgccccttttaacttctgtttgcctgctgctgtttgctgttcactttgcagtagctgaagctcgcacctggcatagggagggcaggtggagagtccttaggctgggggcatgggcccgatggcttctggttgctctgacagccgctacagcacttgtcagattagcacagctcggtgcagccgaccgccaatggactcgtttcgtgcgaggtaggcctcggagattcaccagctttgatcaggtggctcaactctcctccgccgctcgcggactggccgcttccctgctttttctgctgctcgtcaaggctgctcaacagttacgtttcgtacggcagtggagtgtgtttggcaagacactgtgtcgtgctctgcctgagctccttggcgtaacactgggtttggtcgttctgggggtggcctacgctcagcttgctatcctcctcgtaagcagttgtgtggacagcttgtggtctgttgcacaggcccttttggtgctttgtcctgggacaggtctgagtaccctgtgtccagccgagtcctggcatctatctcctctgctatgcgtgggtctttgggccctccggctttggggcgctctgcgactgggggcagtaattcttcgttggagatatcacgctctgaggggcgaactgtatcgcccagcttgggaacctcaggattacgaaatggtcgaactgtttttgcgccgactgcgcctatggatggggctgtctaaggtgaaagagttccggcacaaggtacgtttcgaaggcatggaacccctgccctctcggtcctcccggggttcgaaggtgagtcccgacgtgccccctccatccgctggctccgacgcctctcacccttctacttcctcttcccaactagacggactgtccgttagtctggggaggctcggcacccgctgcgagccagaacccagcagattacaggctgtgtttgaggctctgttgactcagttcgatcgcttaaatcaggccaccgaagacgtgtaccagctcgagcagcaactgcactcccttcagggcagacgatcttcccgagctccagccggatcaagtcgtggtccttcccctggactgcgcccagccttgcccagccgactggcaagggcctcgcggggagttgatctggcaacgggcccatcgcgtaccccactccgcgctaaaaacaaggtgcacccctcttctacctag

SEQ ID NO: 235391 - DNA, 8550 bp, Artificial Sequence
  Description of Artificial Sequence: Synthetic coding sequence
atggctgaggaggcagcacaaaacattagtgacgatcaggaaaggtgtctgcaggccgcatgctgtttgagctttggcggagagctgtcagtcagtacagataagtcttggggtctgcacctgtgctcctgctctcctcctggtggcggactttgggtcgaggtgtatgctaaccacgtgttgctcatgtcagatggcaaatgcggctgcccatggtgcgccttaaacgggaaggccgaagatagggaaagccagagccccagttcatctgcctctcgtcagaagaacatctggaagacaaccagtgaagctgctctctcagtggtgaatgagaaaactcaggcggtggtgaatgaaaaaacacaggcacctttagactgtgataacagcgcggaccggatcccccacaaacccttcatcattatagcccgtgcctggagtagcggcggtcctaggttccaccatagacgtctgtgcgcaacgggcaccgccgactccactttttctgctttgttgcagctccagggcactacctccgccgcagccccatgtagtctgaagatggaggccagctgttgtgttttgcgtttactctgctgcgccgaggacgtggctacaggattgctgcccggaacggtcacaatggaaacccctacaaaggtggccaggcccactcagacctcaagtcaaagggtgccgctctggcccatatctcatttcccaacatctccaaggtcaagccacggcctaccccctgggattccccgaacgccaagcttcacggcgtcacagtcgggctcagagattctgtatccccctactcagcatccccctgtggccatcctggcacggaattcggacaacttcatgaatcccgtgctgaattgttctttggaagtggaggccagggccccacccaacctaggcttccgggtgcatatggctagcggagaagctctctgcctgatgatggatttcggggactcctcaggagtggagatgaggcttcacaacatgagtgaggctatggctgtgacagcttatcaccagtactcaaagggcatctttttccacctcctgcactttcagttagatatgtcgacctataaggaggccgaaacccagaatacaaccttaaatgtctacctgtgccagagcgagaattcatgcctcgaggattccgacccaagcaatctcggctatgaattaattagcgcctttgtgaccaagggcgtgtacatgctgaaggctgtgatctataatgagttccatggcacggaggttgagctgggtccttattacgtggagatcggtcatgaggcggtgtccgcctttatgaactccagtagtgtgcacgaggacgaggtgctggtcttcgctgatagccaggtgaaccagaaaagcacagttgtaattcatcattttcccagcattccttcttataacgtgtccttcatctctcagactcaagtgggcgactctcaagcgtggcacagtatgacagtttggtacaagatgcaaagcgtgtctgtctacaccaacgggactgtatttgctactgatactgacattactttcactgctgtcacaaaagaaacgattcccctcgagttcgagtggtacttcggagaggatccgcctgtacgcaccacctcccggtctatcaaaaagagactgagcatcccacagtggtatcgtgtgatggtgaaggccagcaatcgaatgtcatctgtcgtctctgaaccccacgtgattcgcgtccaaaagaagatcgtggcaaatcgcctgactagtcctagttcagctttagtcaacgctagcgtggcattcgagtgctggatcaacttcggtacagatgtcgcttatctttgggattttggagatggcaccgtgtccttaggcagttcttcatccagtcatgtgtattctcgcgagggcgaatttacagtggaggtcctcgcatttaataatgtctccgccagtacacttcgtcagcaactgtttatagtatgcgagccctgtcagccccctctggtcaaaaatatgggccctggcaaggtgcagatatggaggtcccagccggtacggttaggggtcacattcgaagctgccgtgttttgtgacatctctcagggcctgagttacacatggaatctcatggacagcgagggcctccccgtgagtctccctgctgcagttgacacgcaccggcaaaccctgattcttcccagccacacactggagtatggcaactacacagcgctggcaaaggtacaaatagaggggtctgtcgtgtactctaactattgtgtgggtttggaagtccgtgcccaggcacctgtaagtgtgattagcgaggggacacacctgtttttctcgaggactactagctcgccgattgtcttgcggggaacccaaagcttcgaccccgatgacccaggtgctacattgcggtaccactgggagtgcgccaccgcaggcagcccggctcacccgtgtttcgacagcagcacagctcatcaactggatgccgctgccccaactgtctcttttgaggcccagtggctgagcgatagctacgatcaatttctggtgatgctgagagtttcgagtgggggtcggaacagttctgagaccagggtgttccttagcccttacccagatagtgccttccggtttgtacacatctcgtgggttagcttcaaagatacatttgtgaattggaatgacgaactgtctttacaggccatgtgcgaggattgcagcgagattccaaacctctcctactcatgggacctgtttctagtcaatgcaaccgagaaaaatagaattgaagttccattttgtcgggtcgttggcctgttgggttctctggggctcggagctatctcagaatctagccagttgaaccttttacctaccgaacccggaacagctgatcccgacgctacaaccacaccctttagcagagaaccctcacccgtcactctgggccagcccgcaaccagcgcccctcggggaacgcctacagaaccaatgaccggggtgtactggatcccgcctgctggagactctgccgtcctgggtgaggctcccgaagagggctcattagatctggagccaggcccacagagcaaaggctccttaatgaccggtaggtccgagagaagccagcctactcacagtccagacccccatctctctgattttgaggcctactatagcgacatccaagaagccatcccctctggcggtcgccagcctgcgaaagataccagcttccccggttctgggcctagtttgtccgcggaggaatcaccgggtgatggcgataatctggttgatcccagcctcagcgctggcagagcagagcccgtgcttatgatcgactggccaaaagctctgctcggtcgtgctgttttccagggatattcttctagtggaataaccgagcagaccgtcaccatcaagccttacagtctgtccagtggcgagacctacgtcttacaagtcagcgtggcctcaaaacacggcctgctagggaaggcccagctctacttgaccgtcaatcccgctccacgtgatatggcctgtcaggtgcagcctcaccacgggctcgaagcacataccgtgttttctgttttttgtatgtcgggtaaaccggacttccattatgagttttcttaccaaattggcaataccagtaaacataccttgtatcatggcagagacacccagtactacttcgtcctgccagcaggagaacatctggacaattacaaagtcatggtttccacagaaattacagacggtaagggttccaaagttcagccctgcacagttgtcgttacagtgttgccacgttaccatggcaacgactgcttgggagaagacctgtacaatagctcacttaagaacttatccacccttcaactgatgggatcctacactgagattcgcaactacataaccgttatcacacgcatacttagtcgtttgagtaaggaggacaagaccgctagctgcaatcagtggagcagaattcaagatgccctgatctcttctgtctgtcggctcgccttcgttgaccaggaggagatgattggatcagtgttgatgctgcgggatctggtgtcctttagtaataagttaggcttcatgagtgcagtgctcatcttaaaatataccagagcccttctggcgcagggtcagttcagcgggccattcgtgatagacaaaggagtgcggctagagctgattggattgatctcgagagtctgggaggtgtcagagcaggagaactccaaagaagaggtctatagacatgaagaaggcatcaccgtgatttcggatttgctgctgggatgcctcagcctgaaccatgtgagcaccggtcaaatggaatttaggactctcctgcactacaacttgcagagctctgtccaaagcctgggcagtgtgcaggttcacctgcctggagatctggctggacactctcccgcaggtgccgagacacagtccccgtgttatatctctcagctcatccttttcaagaaaaacccataccccggatctcaagccccaggccagattgggggagtcgtgggcttgaacctctatacctgttcaagccgcagaccaattaatcgccaatggctcaggaaaccagtcatggtggagttcggagaggaggacggtctagataaccgtcggaataagacaacatttgtgctcctccgggataaggtgaatttacaccagtttacagagctcagcgaaaatccccaggagtccttgcagattgagatcgaattttcaaaaccggtgacaagagcattccccgttatgttgttggtgcgtttcagcgaaaaaccaacccccagtgacttcctcgtgaagcagatctacttttgggacgagagtatagtccagatttacattccggcagcttcccaaaaagatgcatcggtagggtacctgtccttactcgacgccgattatgaccggaaaccccctaaccgctatctggccaaggcagtgaactacacagtccatttccagtggatcaggtgcctcttttgggataagagggaatggaagagtgagaggttttctcctcagcccggaacttcacctgagaaggtcaactgttcataccacaggctcgccgcttttgcactgctccggcgtaagctgaaagcatcctttgaggtcagtgatatttccaaacttcagtctcatcctgagaacctgctcccatccatctttatcatgggcagcgtcatactatacgggtttttggtggccaagagccggcaagtggaccatcatgagaaaaaaaaggctggatacatatttcttcaggaggcgtctctgcctggacaccagctctacgcagtggtgatagacaccgggtttagggctcccgctaggctgaccagtaaggtgtacatcgtgctctgcggggacaatgggctgtccgagacaaaggaactgtcctgtcccgagaaaccactcttcgaacgaaacagccgtcacacttttatcttatcagcacccgctcagctgggcctactgcgtaaaatcaggctatggcatgactcccggggaccttctcccggatggttcatcagtcacgtgatggtgaaagagctgcacactggacaggggtggttcttccccgctcaatgttggctttcagccggacggcacgacggcagagtagagagagagttgacctgcttgcaagggggactcggttttcggaagctgttttattgcaaatttactgagtatctagaagatttccacgtttggctgagcgtgtatagtcgaccgtcttcctctcgctatcttcacacaccacggctcacagtttcttttagcttgctttgtgtctacgcctgtttgaccgcgctggtggccgcaggaggccaagagcagcctcacttggatgtgagcccaacattggggtcattccgtgttggcctcctctgtaccctgctcgctagcccaggggctcagctcttgagcctgctctttcggctttccaaggaggcccctgggagcgcgagagttgaaccacactctccccttcgcggaggtgcacaaaccgaagcaccccatgggccaaacagttgggggagaattccagacgcacaagagcctcgaaaacagccggcttctgccatcctcagcggaagtggacgggctcaaaggaaggctgcttccgacaatggcactgcctgtcctgcgcctaagcttcaggtccacggtgccgatcactctcggacgagcctgatgggaaaatcccactgctgcccgccacacacacaggctcctagctcaggtctcgaaggtcttatgccacagtggtcccgagcactgcaaccgtggtggtcttccgcagtttgggccatttgcggaactgcatctctcgcttgctccttaggtaccggcttcctcgcctatagattcgggcaggaacaatgcgtccaatggcttcaccttctctcattatccgtggtgtgctgcatcttcatcacacagcctcttatggtgtgtctgatggcccttggcttcgcctggaagaggcgagcagataaccacttttttacagaatccctctgtgaagctacccgtgacttggactcagaactggccgagcgaagttggacccggcttccctttagctcttcctgctctattcctgactgcgctggcgaggtagagaaagttttggctgcgaggcagcaggctaggcatctgcggtgggcacaccccccttcaaaagcccaacttcggggaacacgacaacgcatgagacgggagtccagaactcgtgctgccctcagagatatctccatggatatcctcatgttgctcctgctgctttgcgtcatttatggcagattctcgcaagacgaatactcccttaatcaggccatccgaaaagaatttacccggaatgcgagaaattgtctcggagggctgcggaacatcgccgattggtgggattggagtctcaccactctgctcgatgggctatacccagggggaacgccctccgcgagagttcctggagcccagcccggagccttgggcggaaagtgctacctgatcggttcttccgtgattcgccagctgaaagtttttccaagacacctctgcaaacctcctaggccgttttctgccctgatcgaagactccatccctacgtgctctcccgaggtgggaggccctgagaatccatatttgatcgaccctgagaatcagaatgtcacactcaacggtcctggcggatgcggaacccgcgaggattgtgtgttatctttagggagaactcgcactgaagcccataccgctctgtccaggctgagagcctccatgtggatcgataggtccactcgcgctgtcagtgtgcactttacgttgtacaatcctccaacgcaactgttcacgagcgtgtccctccgtgttgaaatcctgccaactggctccctcgtgccttcatctctggttgagtcattcagcatatttagatcggacagcgccctgcagtatcatctcatgctccctcagctggtattcttagcactctcactgattcacctctgtgttcagctgtacaggatgatggataagggcgtcctatcctactggaggaaaccgaggaactggctggagctcagtgtggtgggagtaagtctgacatactacgctgtgtcaggacatttggtgaccctggctggcgatgtcacaaaccaatttcacaggggcttgtgcagagcttttatggatcttaccctgatggcgagttggaaccagagagccaggtggctgagaggcatactgctgttcctgtttaccctgaaatgcgtctatctgccgggtattcagaacacgatggcatcctgtagcagtatgatgaggcattccctcccctctatcttcgtagccggactggtcggagctctcatgctggctgcattgtctcacctccacaggtttttactgagcatgtgggtcttgcccccaggaacattcactgatgcattccccggtttgttgttccacttcccacgccgatcgcagaaggactgcctccttgggttgtccaaaagtgatcaacgggctatggcgtgctactttgggatcttactgattgtctctgctacactttgtttcggaatgctccgaggttttttgatgactcttccccagaagcgcaagtcttttcaaagcaaatcttttgtccgattaaaggacgtcaccgcatacatgtgggaaaaagtactgacttttcttcggctggaaacccccaagctggaggaggcggagatggtagaaaatcacaactattatttggatgagtttgcaaacctcctcgacgaattgctgatgaagataaatggcttaagcgactccctgcagttgccactgctcgagaaaacctcaaacaataccggtgaagctaggactgaagaaagccccttagttgacatatctagctatcaggccgcagaacccgcagatatcaaagatttttag

SEQ ID NO: 235392 - DNA, 495 bp, Artificial Sequence
  Description of Artificial Sequence: Synthetic coding sequence
taggtcgggggacctgagaatccttatctgattgacccggagaaccaaaacgtaacactgaatgggcctgggggatgtgggacgcgtgaggattgtgtcctaagcctggggcgaactcgcactgaggcacacaccgctttgtcacggctcagagctagcatgtggatcgaccgttctactcgtgcagtctctgtccattttaccctgtacaatcctcctacccagttgttcacgtctgtgagcttgagggttgagatcctgcctacgggttctctggttccaagcagtctggtagaaagtttttctatattcaggtccgatagtgctttgcagtatcatctaatgcttccacagctggtctttctggccctgagcttgatccacctgtgtgtgcagctttatagaatgatggacaagggtgtgctttcatattggcggaaacccagaaattggctggaagttgcatccttggtgagcttctcttttgaaaagtag

SEQ ID NO: 235393 - DNA, 2907 bp, Artificial Sequence
  Description of Artificial Sequence: Synthetic coding sequence
atggttaattcaagccgggtacagccacagcagcccggtgatgccaagaggcctcccgcacctagagccccagaccctggcagactgatggccggttgtgctgccgtcggtgcttcactagctgcccctggtgggctgtgtgagcaaagagggttagaaattgaaatgcagagaatccgacaagctgctgcacgcgacccccctgccggtgcggctgcctcaccttcacctcccctgtcctcttgttccagacaggcgtggtcccgcgataatccagggttcgaagctgaggaagaagaggaggaggttgaaggagaggaaggaggtatggtcgtcgagatggacgtggagtggcgacctggatcaagaaggtctgcagccagtagtgccgtaagctccgttggcgctaggtcaagaggtctcggagggtaccacggagctggccatccttccgggcgtcggagacgaagagaggatcaggggcctccttgccccagcccagtgggagggggagatcccctgcaccgccacctaccactggaggggcagccaccgagagttgcttgggcagaacggctggtccgcggtcttcgcggtttatgggggaccaggttgatggaagagtcctctactaatagagaaaagtatcttaaaagcgttctgcgggagctcgttacatatctcttgttcttaatagtgctgtgcatccttacttacggaatgatgtcgagtaatgtatactactatactaggatgatgtcccagctgtttcttgacacccccgtgtcaaaaaccgagaagaccaattttaagacactgagctcgatggaggatttttggaagtttacagaagggtccttgctggatggcctttattggaaaatgcagcctagcaatcagacggaagctgataatcgcagcttcattttctacgagaatctactcctcggggttcccagaatccggcagctcagggtcaggaatggatcttgcagcatcccacaagacctaagagatgagattaaggaatgctacgacgtctatagcgtttcaagcgaggaccgtgcaccgttcggaccacggaacggaaccgcctggatatatacctccgagaaagacttgaacggatcttcacactggggcatcatagccacctactcaggcgcaggctactacctggacctgtcaaggactagggaagagaccgcagctcaggtagcttctctcaaaaagaatgtgtggctggaccgaggcacacgtgctaccttcatcgatttttctgtgtacaatgccaatatcaatctgttctgcgtcgtacggttgctggtggaattccccgcaactggcggagtgattccttcttggcagttccagccgctcaaacttatcaggtacgtgaccacctttgacttctttttggccgcttgcgagatcatcttctgtttcttcattttttactatgtagtggaggaaatcttggaaataaggattcacaagctgcactactttcgaagcttctggaactgcctagatgtcgtcattgtcgtgctctccgtggtcgcaatcggcataaacatttaccgaactagtaatgtggaggtcttactgcagttcctggaggatcagaatacttttccaaactttgagcacctggcctactggcagatccaattcaacaacattgcggcagttaccgtcttctttgtctggattaaattgtttaagtttataaattttaacagaaccatgagtcaactgtccactaccatgagtcggtgcgctaaagatctcttcgggtttgcaattatgttcttcatcatctttctagcatatgctcagctggcctacctggtttttggaacccaggttgatgacttctcgactttccaggaatgtatattcacgcagttccgaatcattttaggtgacataaatttcgccgaaattgaagaggccaatagagtgttgggaccaatctatttcaccaccttcgttttttttatgttttttatactgttgaatatgtttctggcaattatcaacgatacatacagtgaagtgaagtctgatctggcacagcagaaagcagagatggagctcagcgacctgataaggaaagggtaccataaggcattagtcaaattaaagctaaagaaaaatacagtggacgatatatctgagtctctgcggcaaggaggaggcaagctcaacttcgacgagctccgccaagatcttaagggtaagggtcacacagatgctgagattgaggcaatatttaccaaatatgatcaggacggagaccaggagttgacagagcatgaacatcagcaaatgagggacgatttagaaaaagaaagagaagaccttgatctggatcactcctcattgcccaggccaatgtcgagtagatcattccccagatctctggatgattcggaggaggatgatgatgaggattcaggacattccagccgcaggaggggaagtatttcttccggcgtgagttatgaggagttccaagttctggtgagaagagtggacagaatggaacactccataggaagcattgtgtcaaagatagatgcagtgatcgtgaagctggaaattatggagagagccaagctgaaacgcagagaagtgcttggccgattattggatggagtagctgaggacgaacgcctcggcagggattccgagattcaccgggagcaaatggagcgactggtgagggaagagcttgagagatgggaatctgacgacgctgcgtcccagatctcgcacggactgggcacccctgtgggattgaacggacagccacgtcctaggagcagcaggcctagttcctcacagagcactgaggggatggaaggagccggtggaaacggttccagtaatgtccatgtgtag

SEQ ID NO: 235394 - DNA, 1161 bp, Artificial Sequence
  Description of Artificial Sequence: Synthetic coding sequence
atgagtcagctctccactaccatgagtcgctgcgctaaggatctgttcggcttcgcaataatgttttttatcattttccttgcatacgcacagctggcatacctcgtgttcgggacgcaggtggatgacttttccacgtttcaagaatgcatttttacccagttcagaatcattcttggtgatatcaatttcgctgagattgaggaagccaaccgggtactggggcctatatattttaccacattcgtattctttatgttttttatcctcctgaatatgtttttagccatcataaacgatacttatagcgaggttaaatcagacctcgcccagcaaaaggcggaaatggaattgtctgatctcattcggaagggataccacaaagccctagttaaactcaaacttaagaagaacactgtcgatgatatcagcgagagtctgcggcagggaggaggcaagcttaatttcgacgaactgaggcaagatctgaaaggcaagggtcacacagacgctgagattgaggctatatttaccaaatatgatcaggatggcgatcaagagcttaccgagcacgaacatcagcaaatgcgagatgacctagaaaaagaaagagaggatttggacctggaccactcctccctgccaagaccaatgtctagtcgcagcttcccacgcagcctggatgactccgaggaggatgatgatgaggacagcggccactcttcacgccgtcgcggaagcattagctcaggggtctcgtatgaagagttccaagtcctcgtgcggagggtcgatagaatggaacactctatcggaagtattgtgagcaaaatagacgccgtgattgtgaaactggagataatggagagggccaagctgaaaagacgagaagtccttggcagactcctggatggggtggcagaggacgaacgcctaggcagggatagtgaaattcaccgagagcagatggagcgtctcgttcgggaggagctggaaagatgggaatcagatgatgcagcgagccagatttctcatggacttggcacacccgtggggctcaacggacagcctcggccacggagctcccgcccatcttcttcccagtccaccgagggtatggaaggcgcaggcggaaatggatcctcaaatgtacatgtctag

SEQ ID NO: 235395 - DNA, 1161 bp, Artificial Sequence
  Description of Artificial Sequence: Synthetic coding sequence
atgagccagttgtcaaccactatgagtcggtgcgccaaggatcttttcgggtttgcaattatgtttttcatcattttccttgcctatgcccagcttgcatatttggtcttcggaacccaggtggatgacttctctacattccaggagtgtattttcactcaattcaggattattctcggcgatataaactttgcggagattgaggaggctaatagagtgctcggacctatctatttcactacattcgtgttttttatgttttttattctgctcaacatgttcctggctattattaatgatacctatagcgaggtaaagtcagatctcgctcaacagaaggcggaaatggaactctcagacttgattaggaagggatatcataaggcactggtcaaactgaagctaaaaaaaaacaccgtggacgatatcagtgaatccctgagacaaggcggagggaagttgaatttcgatgagctccgccaggacctaaagggtaaaggccacacagatgccgaaatagaggccatattcaccaaatacgaccaggatggagaccaagaactcaccgagcacgagcaccagcagatgcgagacgatctggagaaagaacgggaagatctcgacttagaccattcatcactgcctcggccaatgtcctccaggtcctttcctcgaagcttggatgactctgaggaggacgatgatgaagactcaggacatagttctcggagaaggggctccatctcctctggagtctcctacgaagagttccaggtgctggtgcgtcgggtggatcgcatggagcatagcattggctctatcgtctcaaaaatcgacgccgtgatcgtcaaactggagattatggaacgggcaaaacttaagagacgagaggtcttgggaagactgctcgacggagtcgccgaggatgagaggctaggcagggacagcgaaatacaccgcgagcagatggaaagactggtacgcgaggaactggaaagatgggaatctgacgatgcagccagccagatcagccacggactcgggacccccgtggggctcaacggacagcccagacccaggagctccaggccatctagcagtcagtctacagagggtatggagggggcagggggtaatgggtccagtaacgtgcacgtttag

SEQ ID NO: 235396 - DNA, 2418 bp, Artificial Sequence
  Description of Artificial Sequence: Synthetic coding sequence
atgaatgctgtcgggtcccctgagggacaggagttacagaagttgggctccggtgcatgggataatcctgcttacagcggcccacccagtccgcacggaactctgcgggtgtgcaccattagtagcacaggccctctgcagccacagcccaagaagcctgaggacgagcctcaggagactgcatatagaacccaggtgtcctcatgctgtctacacatctgtcaggggattagaggcctgtggggcactaccttgacggagaataccgcggagaacagggagctgtacatcaaaaccacccttagagaactgctggtgtatattgtttttctcgtcgacatctgtcttctgacatatgggatgacctcaagtagtgcctactactataccaaggtgatgagcgagctttttctccataccccttccgataccggggtgagctttcaggcgatctctagcatggctgacttctgggactttgcccaggggcctctactcgattctctgtattggacaaaatggtataacaatcagtcacttggccacgggtctcacagcttcatatactacgaaaacatgctgcttggtgtccctcgtctgaggcagctgaaagtgcgaaacgactcatgtgtggtgcacgaagatttcagggaagatatcctgagttgctacgacgtgtacagccctgataaagaagaacagttgccgttcgggcctttcaatggcactgcatggacctaccatagccaagacgagctggggggtttctcccactggggccgtttgaccagctatagcgggggtggatattatctggatttgccagggtcacggcagggaagtgccgaggccttaagggctctccaggaaggcctgtggctcgataggggtacaagagtagtgtttatcgatttcagcgtgtataatgccaatattaacctgttctgcgtcctaaggctggtagtggagttccccgctaccgggggagcgatcccctcatggcagatccggactgtcaagttaattagatacgtgagtaactgggattttttcatcgtaggatgtgaagtgatcttttgcgtattcatattttattatgtcgtggaagaaattctggagttgcacattcacaggctgagataccttagctccatatggaatattttggacctagtcgtaatcctcctctccatcgttgcagtgggttttcacatttttcgaacactagaggtgaatagactgatggggaagttactgcagcagcctaatacgtacgccgacttcgagttcctagccttttggcaaacccagtacaacaatatgaatgcagtgaacctgttcttcgcctggatcaaaatattcaagtacatctccttcaacaaaacgatgacccagctgagcagtactcttgctcggtgtgccaaagatattctgggctttgccgtcatgttctttatcgtgttttttgcttacgcacagctgggatatctgctgtttgggacccaggtagaaaacttcagtaccttcattaagtgcatctttacccagttcaggattattcttggggatttcgattacaacgcgatcgacaatgccaaccgtattctgggcccagcgtactttgtgacctacgtcttcttcgtcttctttgtgcttctgaatatgtttttggcgataatcaatgacacttattccgaagtgaaagaagaattggcgggtcagaaggacgagcttcaattgagcgacttactgaaacagggctataacaagaccctcttacgtctgaggcttcggaaagagcgcgtttcagacgtgcagaaagtcctccaaggcggtgaacaggagatacagtttgaagattttactaacacactcagagagctggggcacgccgaacacgagatcaccgagctcacggcaacattcactaaattcgacagagatgggaatagaattctggatgagaaggaacaggaaaagatgagacaagacctggaggaagagcgggttgcactgaacactgagatcgagaaactgggcaggagtatcgtgagttccccacagggaaagagtggacccgaggcagctcgcgctggcggttgggtctcaggagaggaattttacatgctaactaggcgagtcctgcagttagaaacagtcctggagggagtcgtgagccagattgacgctgttggaagtaagttgaagatgctagagagaaagggctggttggcaccatcccctggggtgaaagaacaggccatctggaaacacccacagccagcccctgctgtgaccccggacccctggggagttcagggtgggcaggagtcagaggttccgtataagcgggaggaggaagctctggaagaacggagattgtctcggggagaaattcctactctccagagatcatag

SEQ ID NO: 235397 - DNA, 2193 bp, Artificial Sequence
  Description of Artificial Sequence: Synthetic coding sequence
atgaacgcagtagggagtcctgagggacaggaactgcagaagctcggaagcggggcatgggacaatcctgcctattcaggccctccatctccccatggcacactgagagtttgtacaatttccagcaccggacccctccaaccacagccaaagaagcccgaggacgaaccccaggagacggcctacagaacccaggtgtcttcttgctgtctgcatatatgccagggcattcgaggcctgtggggcacaacgctgaccgagaacaccgctgaaaatagggaactctacataaagacaactctgagagagctcttagtgtatattgtcttcctggtcgacatttgtctgctgacatatggtatgaccagttcatccgcgtattattacactaaggtcatgtcagagttgttcttacacacacccagcgataccggtgtaagttttcaggcaatctcttctatggcagacttttgggattttgcacagggtccccttctggattccctctactggaccaagtggtacaacaaccagtctctcgggcatggatcccactctttcatatattatgagaatatgttgctgggtgtacccagactgaggcaactgaaggtacgcaacgattcctgcgtcgtccacgaagattttcgtgaggatattctgtcctgttatgatgtctattctcctgacaaggaggagcagctgccgttcgggccatttaacgggaccgccttggtcgtggagttccccgctaccgggggagcaatacctagctggcagattcgaacggtcaagcttataagatacgtttctaactgggatttcttcattgtgggctgtgaggtgattttttgcgtctttattttctactacgtagtggaagaaatcctcgagctgcatatccacaggctgaggtatctcagtagtatctggaacatcttagatcttgttgtgatcttgctcagcatcgtggccgtcggctttcacatattcaggactcttgaggtgaatagactcatgggtaaactccttcagcagcccaacacatacgccgacttcgagttcctggcattctggcagactcagtacaataacatgaacgctgtaaatctcttctttgcctggataaagatatttaaatacatcagcttcaataaaaccatgactcagctgagctccaccctagccaggtgcgcaaaagatattctcggattcgccgtaatgttctttattgtcttcttcgcgtacgcccaactgggctacctccttttcgggacacaagtggaaaactttagcactttcattaagtgcattttcacccaatttcggataatactgggggacttcgattataatgctatcgacaatgcaaaccggatcctggggcctgcctacttcgttacatacgtcttttttgtgttcttcgttctgttaaacatgttcctggccattattaatgatacctattccgaagtgaaagaggaattggcgggacagaaagatgagctacagctttccgatctcctcaagcagggatataataagactttgctgaggctgcgtttgagaaaggaacgcgtttctgacgtccagaaggtgttacaggggggtgagcaggaaattcagttcgaggacttcaccaacactttacgagaactaggacatgctgagcatgagataactgagttgaccgcaacgttcacaaagtttgatcgggacgggaaccggattcttgacgaaaaggagcaggagaaaatgcggcaggatctcgaagaggaaagggtggccctgaacacagagattgagaagctaggtaggtccattgtgtcctcacctcagggaaagtccggacccgaagccgcaagggcgggtgggtgggtatcgggggaggagttttatatgctcacccgccgagtcttgcaactcgaaactgtccttgaaggcgtggtgtctcagattgatgctgtcggtagcaaactcaaaatgttggagcgcaagggctggctagctccaagtcccggtgtcaaagaacaggctatctggaagcacccccagccagcgcctgcggtgacccctgacccctggggggtacaggggggacaggagagtgaggtcccatataaacgtgaggaagaggctctcgaagagcgccgactgtcgcgcggagaaatcccaactctccagaggagttag

SEQ ID NO: 235398 - DNA, 2328 bp, Artificial Sequence
  Description of Artificial Sequence: Synthetic coding sequence
atgaatgccgtgggttcaccagaagggcaggagctgcagaaactggggtccggagcctgggacaatcctgcttatagtggacctccatcccctcacggcacattgagggtgtgcacaatttctagcaccgggcctctccagccacagccaaagaagcctgaggacgagcctcaggaaacagcctatagaacccaagtatctagctgctgtcttcacatttgccaaggtatcagaggactctggggcacaacactcaccgaaaacacggctgaaaatagagaactgtatattaaaacgacacttagggaactgctcgtctatatagtctttctggtggacatctgccttctcacatatggcatgaccagttctagcgcctattattatactaaagtgatgtcagaactattcctgcatacccctagcgacacgggtgtgagctttcaggctataagctctatggcagacttttgggactttgcacaaggtccactgttggatagcctgtactggactaaatggtataataatcagagcctggggcacggctctcacagcttcatatattacgagaatatgcttcttggcgtgccgagacttcgccagcttaaagtcaggaacgactcctgtgtggtccacgaggacttccgtgaagacatcctttcatgttatgatgtgtattccccagacaaggaggaacaactaccattcggaccatttaacgggaccgcgtggacctatcattctcaagacgaacttggagggtttagtcattggggacgtcttacttcctacagcggaggcggatattatctggatttgcccggatccaggcagggatccgcggaagccttgagagcactgcaggagggactgtggttggaccgaggtacccgggttgtcttcatagacttttctgtttacaacgccaacatcaatttattttgcgttctccggttggttgtggaatttccagccaggagatgtcaccccatcttagccaatcctcactcacaggccgatcccctctgccagcaactattcttcatcgtcggctgtgaggtgattttctgtgtgtttatcttttactatgtggtggaagaaatcctcgagctgcatattcatagactcaggtacttatcttcaatctggaacatactcgatctggtggttattctgctttccatcgtggccgtgggattccacatattccggaccttagaggttaatcgccttatgggtaagctgttgcagcagcccaacacctacgccgacttcgagttccttgccttctggcagacccagtacaacaacatgaacgctgtgaacctgtttttcgcttggatcaagattttcaaatatatcagctttaacaagaccatgacccaactttcgagcacactggccagatgcgctaaggacattctggggttcgctgtgatgttcttcattgtattctttgcctacgctcagctaggttatctcttattcggaacccaggtagagaacttttctaccttcatcaaatgtatttttactcagttccgtatcatcctgggcgattttgactacaatgctattgacaacgccaaccgaattctgggcccagcctactttgtgacatatgtcttttttgtgtttttcgtgctgctgaacatgtttttggcgataattaacgatacctacagcgaggtgaaggaggaactggcaggccagaaagatgagcttcagctgtctgacctcctcaaacaaggctataacaagactctactgaggcttagacttcgtaaggagcgcgtgagtgacgtgcagaaagtgcttcagggaggcgagcaggaaatccaattcgaagacttcacaaataccctgagggaactgggtcacgccgaacacgagattaccgaattaacagcgacttttactaaatttgatagagatggcaacagaattctcgacgagaaagaacaggagaagatgcgccaagacttagaagaggaacgcgtggctctcaatacggaaatcgagaagctgggccgttctattgtttcttcacctcagggcaaaagcggtcccgaggccgctcgggctgggggttgggtgagtggcgaggaattctatatgctcacacggcgtgtgttgcaactcgaaactgtgctggagggggtggtttctcagatcgatgccgtcggatcaaaactgaaaatgctcgagagaaaagggtggcttgcccctagccccggagtgaaggagcaggccatttggaagcacccacagcccgcacccgcagtgacccctgatccttgggggccaggctgggcgggagagtag

SEQ ID NO: 235399 - DNA, 2283 bp, Artificial Sequence
  Description of Artificial Sequence: Synthetic coding sequence
atgaatgcggttgggtctccggagggacaggaattacaaaagcttggctcaggcgcatgggataacccggcatactctggcccaccatctccccacgggaccctaagagtatgcacaataagctctacgggacctctgcaacctcagcctaagaagccggaggacgagcctcaagaaaccgcctacagaacccaggtgtcttcctgctgtttgcacatctgtcaaggtattagggggctgtggggtacgacccttaccgagaataccgccgagaatagggagctgtatatcaagacaaccctgcgcgaactgctcgtgtacatcgtattcctggtggacatctgccttttgacctacggaatgacgtcaagcagtgcatattactataccaaggtgatgagcgagctcttcctacacacccccagcgacaccggcgtgtcatttcaggcgataagctctatggccgatttctgggattttgcccagggccctctcttggactctctctactggactaagtggtataacaatcagtccttgggtcatggtagccactccttcatctattatgagaacatgctgctgggcgtcccacggctccggcagttaaaggtgcgtaatgactcgtgcgtggtgcatgaagattttcgcgaggatatcctgagctgctacgacgtatacagcccggataaggaggagcaactcccatttggccctttcaacggaacggcctggacatatcattctcaggatgaactgggcggttttagccattggggcagactgacaagttatagcggcggaggatattaccttgatttgccaggatccaggcaagggtcggctgaagcattgcgcgctctccaagaaggtctgtggctcgatagaggcacacgggtcgtgttcatcgacttctctgtctataacgcaaatattaacctattctgcgtgttgaggctagtcgtggaattcccagcaaccggaggggcaatcccctcatggcagattcggacagttaagttgataaggtacgtctcaaactgggatttcttcattgtcggttgtgaggtcatattctgcgtgtttattttttattacgtggtggaggagattctggagctacacattcacaggctgcgttacctgtcctccatctggaatattctcgacctcgtggtgatactgttgagtatcgtggctgttggtttccacatattccggacactggaggttaatcgattgatggggaagctactgcaacagcctaatacttacgcagactttgagttcctcgccttctggcagactcagtataataatatgaacgcggttaacctcttctttgcatggatcaagatctttaagtacatctcgtttaataaaaccatgacccagctctccagcaccctggcccgatgcgctaaagatattctgggcttcgctgtgatgttctttatagtttttttcgcttatgcacagcttggctatctcttatttggcactcaagtggagaacttctccacatttatcaagtgcatcttcacccagttccggatcattctcggggatttcgactataatgctattgacaacgctaatagaattctggggccagcgtatttcgtgacatacgttttttttgtcttctttgtgctcctgaacatgttccttgcaatcattaatgatacttatagcgaggttaaggaagagttagcgggacagaaagacgagctccagctctccgacctgctgaagcagggctacaataagaccctactccgtctccggctgcggaaggagcgggtctccgatgtgcaaaaagtgctccagggcggtgaacaggaaatacagttcgaggatttcacaaatacgctgcgggagctggggcacgccgagcatgagattaccgaacttacagcaacttttactaagtttgatagggatggtaaccggatactcgacgaaaaagagcaggaaaagatgaggcaggaccttgaggaggagcgggtcgctttaaatactgaaatcgagaagttgggtagaagtattgtgagttctccccagggtaagtccgggccagaagccgctcgcgctgggggatgggttagtggggaggaattttacatgctgacacggcgtgttctgcagttagaaacagtgctggagggggtcgtgtctcagattgatgccgtcggatccaaactgaaaatgctggagagaaaagggtggctggctccaagtcctggggtgcgctttcccattaaagagaagcgcaaaccgtag

SEQ ID NO: 235400 - DNA, 1842 bp, Artificial Sequence
  Description of Artificial Sequence: Synthetic coding sequence
atggctgaggccagccggtggcacagaggaggcgctagtaaacacaaattgcattatcggaaggaagtcgaaatcaccacaaccctccaggagctgttactgtacttcatctttctcatcaatttgtgtattctgacatttggaatggtgaacccacacatgtattacctgaataaagtgatgtcttctctgttcctggacacgagtgttccaggagaggagcgcacaaacttcaagagtatcaggagtatcaccgacttctggaagttcatggagggccctttgctcgaaggcctctattgggactcttggtataataaccagcagctgtataatttgaaaaattctagccgcatatattacgagaatatcttactgggtgttcccagggtcagacaactaaaggtgcgaaacaatacatgtaaagtgtactctagttttcagtccctgatgtcagagtgttatgggaagtacacctcagcaaatgaagatctctccaattttgggctgcagatcaataccgaatggcgctactctacttccaatactaatagtccttggcattggggctttctcggagtctaccgcaacgggggttatatcttcacattatcaaaatccaaatctgagacaaaaaataagtttattgacttacgcctgaactcctggattacgagaggcacaagggtgattttcattgatttcagtctctacaatgccaatgtcaatctcttttgcatcattaggctcgttgccgagttccccgctaccggtggaattctgacttcctggcagttctacagcgtgaagttgctccgctatgtctcctattatgattactttatcgccagttgtgaaattacattttgcatcttcctgtttgtgtttaccacacaagaagtaaaaaagatcaaggagttcaaatccgcctacttcaaatcaatttggaattggctggagctgctccttctcttgctctgtttcgtggccgtgtcatttaacacatactataacgttcaaatctttcttctgctgggacagctcctgaagagcacagaaaagtatagtgacttttacttcctggcttgctggcatatctattataataacatcatcgcaatcacaattttttttgcgtggattaagatcttcaagtttattagctttaataagactatgagtcagctgtcaagcaccctgagccgatgcgtaaaagacattgtgggattcgccataatgttttttataattttttttgcctatgcacagctcggattcctggtgtttgggtcccaggttgatgactttagtacatttcaaaattcgatttttgcacagttcagaattgttttgggggatttcaactttgcagggatccagcaggccaatccgatcttgggccctatatatttcatcacttttatcttttttgtgttcttcgttctgcttaacatgtttttagcaatcatcaatgacacatatagcgaggtgaaggccgattatagcatcggccgacggctcgactttgagctcggaaaaatgattaagcagagttacaagaatgttctggagaaattccgattaaagaaggcacagaaagacgaggacaagaaaactaagggatctggagacctggcagagcaggcacgccgtgaggggtttgacgaaaacgagattcagaatgccgagcagatgaagaagtggaaggagagactggagaagaaatactatagtatggaaattcaggatgattatcagcccgtgacacaggaggagttccgcgatggcacgaccaccaagtacaaaatgaggtttagcgaatgcctgacaaaaagaatttag

SEQ ID NO: 235401 - DNA, 1773 bp, Artificial Sequence
  Description of Artificial Sequence: Synthetic coding sequence
atggctgaggcaagcaggtggcataggggtgtaaccttcggtatggtgaacccacatatgtactacctgaataaagtcatgtctagtctgtttctggacacatccgtgcctggcgaagagcgaactaattttaaatctattcggtcaatcacagacttttggaaatttatggagggccctctgctggaaggtctgtactgggattcttggtataataaccagcagttatacaatcttaagaatagctccaggatatattatgaaaatatcctgctcggcgtacctagggtgagacaactgaaggtgagaaacaacacctgtaaggtgtattccagcttccagagcctcatgagtgagtgctatggaaagtatacctccgccaacgaggatctgagcaacttcggcctgcagatcaataccgaatggaggtattctacttcaaacaccaacagcccttggcactggggatttttgggagtctatcggaacggtggctatatcttcacattgagtaaaagcaaatcagaaactaaaaacaagtttatcgacctgcgactaaattcctggattacacggggtaccagggttatctttattgacttctccctgtacaatgccaatgtgaaccttttctgcatcattagactcgtagccgagtttccagcaaccggcggaattctaacctcctggcaattctattctgtgaaacttttgcgctatgtctcctattacgactacttcatcgctagttgtgagattactttctgtattttccttttcgtcttcaccacacaggaggttaaaaaaatcaaagagtttaagtcagcctactttaagagtatttggaactggctggagctactcctactgttactgtgttttgtggctgttagtttcaatacctactacaatgtccagatctttctacttctcgggcagcttctgaagtccactgagaagtatagcgacttctatttcctcgcatgttggcacatctactataataatatcatcgcgatcacaatcttttttgcatggatcaaaatatttaagtttatatccttcaacaagacaatgagtcaactgtcctcgactctatcccgctgcgttaaagatatagtcgggtttgccattatgtttttcattatttttttcgcttacgcacagctgggcttcctggtattcggctcccaagttgatgactttagtacattccagaacagtatctttgcccagtttagaattgtacttggtgacttcaacttcgccggaatacagcaagcaaaccctatcctgggcccaatctatttcattacgtttattttcttcgttttctttgtgctgctgaatatgtttttagctatcattaacgacacatattctgaggtgaaggccgactactcgattggaaggaggttggactttgaacttgggaaaatgatcaagcagagctacaaaaatgttctcgaaaaattccgccttaaaaaggcacagaaggatgaagacaaaaagaccaagggctctggagatttagcggagcaagctagaagggaagggttcgacgagaatgaaatccagaatgccgaacagatgaagaagtggaaggagcggctcgaaaaaaagtattatagcatggagatccaggacgactaccagccggtaacacaggaagagttccgggagctttttttgtacgccgtggagctcgagaaggaacttcactatatcaacctgaagctaaaccaagtggtgaggaaggttagcgctctatag

SEQ ID NO: 235402 - DNA, 1875 bp, Artificial Sequence
  Description of Artificial Sequence: Synthetic coding sequence
atggcagaggcttcaaggtggcaccggggaggtgcgagtaagcataagttgcattataggaaggaggtcgagattaccactactctacaggagctcctcctctatttcatctttctgataaacctctgtattttaacctttggcatggtcaaccctcacatgtactatcttaataaagtaatgtcttcgttattcctcgacactagcgtacccggagaggaaagaactaatttcaaatctatccgatctattaccgacttctggaagtttatggagggccctctgcttgaggggctttactgggatagctggtacaataatcaacagctgtacaatttgaagaatagctcgcgcatttattacgaaaatatcctccttggagtgcccagggtcaggcagcttaaggtgcgcaataatacttgcaaggtgtattcttcttttcaaagtctaatgtccgaatgctatggcaaatatacgtccgccaacgaagatttaagtaatttcgggctccagatcaacacggagtggaggtattctacatctaacacaaattccccttggcactggggctttctcggagtctaccgaaacggcggatacatcttcactctgagcaagagtaagagcgaaaccaagaacaaatttattgacctccggttgaacagctggataactaggggtaccagagtgatctttatcgatttttctttgtacaatgcaaatgtgaacctgttctgtatcattcgcctcgtggccgagtttcctgctacgggaggcattctcacaagctggcagttttatagcgtcaaattattgaggtatgtttcctattacgactactttatcgcctcatgcgagatcaccttctgcatcttcctcttcgtgtttacgacgcaggaggtgaaaaagatcaaagaattcaagagtgcctacttcaagtcaatttggaactggttagaactcctactgttgctcctatgtttcgtggctgtgagctttaacacttattataacgtgcagatctttcttctgttaggccaacttcttaagagcaccgagaagtattccgatttttactttctcgcatgttggcatatctattataacaacatcatcgctattacaatatttttcgcatggataaagatttttaagtttatttccttcaacaaaaccatgagccagctgtcgagcactctttcgcggtgtgtgaaggacatcgtaggattcgctattatgtttttcatcatcttcttcgcatacgctcagctgggcttcttagtctttggcagccaagtcgacgatttcagcactttccagaatagcatctttgcccagttcagaatcgttctgggtgacttcaacttcgcaggaatacagcaggccaacccaatattagggccaatctacttcattacctttattttttttgtgttttttgtgttactcaacatgtttctcgccatcatcaatgacacatactccgaggtgaaggcagactactctatcggccgacgcctggactttgagctggggaaaatgatcaaacaatcgtataaaaacgtcctagagaagtttcgcctgaagaaagcacagaaagatgaggacaagaaaaccaaaggatctggcgacctggcagagcaggcacgacgggaaggctttgatgagaatgagatacaaaatgccgagcagatgaaaaagtggaaagaacgcctcgagaagaaatactactccatggagatccaagacgactatcagccggttacacaagaggaatttcgtgaattgtttctttatgcagtcgagttggagaaggagctgcattacatcaatctcaagctgaaccaggtggtgaggaaagtttccgctttgtag

SEQ ID NO: 235403 - DNA, 1809 bp, Artificial Sequence
  Description of Artificial Sequence: Synthetic coding sequence
atggccgaagcctctcgctggcatcgcggaggggcatcaaagcataaacttcactatcggaaggaagtcgagatcaccaccacgctgcaggaacttttgctttacttcatcttcctcatcaacctgtgcattctgacgttcgggatggtgaaccctcacatgtactatctgaacaaggtaatgtcgtctctgtttctggacaccagtgtgccaggagaagaaagaacaaattttaagagtatccgctcaattactgatttttggaaatttatggaaggaccgctgttggaaggactgtactgggactcctggtataataaccagcagctgtataacttgaagaattcatccagaatttattacgagaacatcctactaggtgttccaagagtccggcagttgaaagttcgaaacaacacctgcaaagtgtactcttctttccagtcacttatgagtgagtgttacgggaaatatacttccgccaacgaagacttatccaattttggacttcagattaatactgagtggcgatattccaccagcaataccaattctccctggcactggggcttcctcggggtgtacagaaatggcggatatattttcacccttagcaagagcaaaagtgagaccaagaacaaattcattgatttgagattaaactcttggatcacccggggaacacgcgtcatattcatcgacttctctttgtacaacgctaacgtcaatcttttttgtattattcggctggtggccgaatttcctgcgacagggggtatcctcacctcttggcaattctacagtgtgaagttgctgaggtacgtgtcatactacgattacttcatcgcatcatgcgagattactttttgcatcttcctgtttgtgttcaccacacaggaggtgaagaaaatcaaagagtttaagagcgcctatttcaagtccatctggaattggctggaattattactgctgcttctgctgaagagtaccgaaaaatacagcgacttctacttcctagcgtgctggcatatttactacaacaatattatagccattacaatttttttcgcatggatcaaaattttcaagttcatctcttttaataaaacaatgtctcaactgagcagcaccctgtctcgttgtgtcaaggacattgtaggattcgccatcatgttctttataatattcttcgcttacgcccagctggggtttctcgtgttcggttcccaggttgacgacttttccaccttccagaactccatctttgctcaattccgaattgtactgggagatttcaatttcgctggtatccagcaggctaatcctattctgggacctatttattttatcacctttatcttcttcgtgtttttcgttcttctcaacatgtttctcgcaattatcaacgatacctactcagaagtaaaggcagactacagcataggcaggcgcctggactttgagctcggcaagatgattaagcagtcctataagaatgtgctggagaaatttagacttaagaaggcacagaaggatgaggataagaagacgaaaggctccggggacttggcagagcaggctcgccgagagggattcgatgagaatgaaatacagaatgccgaacaaatgaaaaagtggaaggaacggcttgagaagaaatattactcaatggagatccaagacgactatcagcctgtaacccaagaagagttccgcgaacttttcctgtatgcagtcgaactggagaaggagttgcactacatcaatttgaagcttaaccaagtggttaggaaagtctctgcactgtag

SEQ ID NO: 235404 - DNA, 1572 bp, Artificial Sequence
  Description of Artificial Sequence: Synthetic coding sequence
atggctgaggcctcgcgctggcataggggaggggcttccaaacacaagcttcactaccgaaaggaagtagagatcacgacgaccctgcaggagctcctattatactttattttccttatcaacctgtgcatcctgacctttggcatggtcaatccccacatgtattaccttaataaagtcatgtcaagtctgttcttagacacaagcgttccaggcgaggagcggactaatttcaagtccataagatcgatcacagatttttggaaattcatggagggacctctcctcgaaggcctgtattgggattcatggtacaacaatcagcagctgtataacctgaaaaactcatcgcgcatttattacgaaaatatcctcctaggggtacctagagtgcgtcaattgaaagtgcgaaataacacctgtaaggtgtattcctccttccaatccctgatgagcgagtgttatggcaaatacacttcggctaatgaagaccttagtaactttggcctccaaattaatacagagtggaggtactctacttctaatacaaacagtccctggcactggggttttctcggagtatatcgcaacggcggttacatctttacgctgtccaaatccaagagcgaaacgaaaaacaaatttatcgatctgcgactgaactcctggatcactcggggtacacgggtgatcttcatcgatttttctctctataatgctaacgtgaatcttttttgtattatacgcctcgtagctgaattccccgcaacgggaggtatcctgacttcatggcagttttactcagtgaaactgctgcggtatgtttcctactacgactactttatagccagttgcgaaatcaccttttgcatctttctcttcgtgtttaccacccaggaggtgaagaagataaaagagttcaagtccgcgtattttaagagtatttggaactggctggagctgctcctgttgttgctgtgtttcgtggccgtctccttcaacacctactataacgtgcaaatttttctgctgctgggccagctgcttaaatccaccgaaaaatattctgacttctactttctagcgtgttggcacatttactacaacaacataatcgccatcaccattttctttgcttggatcaaaaacatgttcctggcgatcataaacgatacatattctgaggtgaaagccgattattccataggacggagactggacttcgagctgggaaagatgattaaacagtcctacaagaacgtgctggagaagtttcgtctgaaaaaagcgcagaaagatgaggataaaaaaacaaaagggagcggtgacctagccgaacaagccaggagggaggggttcgacgagaacgagatccagaacgccgagcaaatgaaaaaatggaaggagagactggaaaagaagtactattcgatggaaatccaggacgattatcagccagtaacacaggaagaatttcgcgagctgtttctatatgcagttgagctggagaaagagcttcactacattaatctgaagctcaaccaggtagttcgaaaggtatctgccttatag

SEQ ID NO: 235405 - DNA, 1836 bp, Artificial Sequence
  Description of Artificial Sequence: Synthetic coding sequence
atggaggaactcgtcgtagaggtgagggggagtaacggagccttttataaagcctttgtgaaggacgttcatgaagacagtatcacggtggcttttgagaataattggcagcctgatcgtcagatacccttccacgacgtgcggtttcctcccccagtgggttacaataaggacattaatgagagcgatgaggtggaagtctatagtcgggcaaacgaaaaagagccatgctgttggtggctggcgaaggtgaggatgataaagggcgagttctacgtgattgaatatgccgcttgcgatgccacttacaacgagatcgtaacaatagagaggctacgcagcgttaatcccaataagcccgcaaccaaggatacctttcacaagatcaaattggacgttcccgaagatctacgccagatgtgcgccaaggaggccgctcacaaggactttaagaaggctgtgggagctttctccgtcacgtacgaccctgaaaactaccaactggttatcctctcaattaatgaggttacatcaaaacgtgcacacatgctcattgatatgcatttcagaagccttcgcaccaagttgtcattgattatgcgcaatgaagaagcgtcgaagcaacttgagtcctccaggcaattggcctcacgctttcatgagcagtttattgttcgagaagatctgatgggtctggccatcggcacacacggggctaacatccagcaagcgagaaaggtacccggtgtgacagccatagacctggacgaagacacttgtaccttccacatctacggcgaagaccaggatgcggtcaaaaaagcacgatcattcttagaatttgctgaggacgtcatccaggtccctcgcaatttggtgggcaaggtgattgggaagaatggaaagcttatccaggagatcgtggacaagagcggagttgtgcgagtccgaatagaggcagagaacgaaaagaacgtgcctcaggaggaggagatcatgccacccaatagtctgcctagcaataattcccgggtcgggcctaacgcgcctgaggagaagaagcatctcgacatcaaggagaattcaactcacttttcacaacccaattccaccaaggtgcagaggggaatggtaccctttgtcttcgtgggaactaaagatagcattgcgaatgccactgttctgctagattaccatctgaactacctgaaggaggtggatcaactgcggctagaaaggctccaaatcgacgagcagttgaggcaaattggcgcatcctcaaggcccccacctaaccgcactgataaagagaaatcatatgtaacggacgacggtcagggaatgggcagaggaagcaggccctatcggaatagggggcatggcagaaggggccctggctatacctcggggaccaatagcgaggcaagtaacgcatcagagactgaatcggaccacagggatgagctgagcgattggagcctcgcaccaaccgaagaggaacgcgagagctttctccgtagaggcgacggtcggagacgaggcggaggcggtcgcggacaaggaggcagaggtaggggtggcggtttcaagggtaatgatgaccatagccgaacagacaataggcccaggaacccaagggaagcaaagggcagaactaccgacggttcgttacagattagagttgattgtaataatgaacggagtgtgcatacaaaaactctgcagaacacttcttccgagggttccaggcttcggacaggaaaggatcgcaaccagaaaaaggaaaaaccggactcggtagatggccagcaacctcttgtgaacggtgttccgtag

SEQ ID NO: 235406 - DNA, 513 bp, Artificial Sequence
  Description of Artificial Sequence: Synthetic coding sequence
atgccactgcccgtggctctgcagacaaggctggcgaagagagggattctaaagcatttagaacccgaacctgaagaagaaattattgccgaagactatgacgatgatcctgtggattatgaagctactaggctcgaaggcctacccccatcctggtacaaggttttcgatcctagctgcggtctgccctactattggaatgctgataccgacctggtctcatggctctctccccatgatcctaactcagtggtgactaaatcggctaagaagttgcggtctagcaacgcagccgttagtagaaaagatgaggaattagatccgatggatccttcatcatactctgatgcaccaaggggcacatggtctacaggcctacccaagcgcaacgaggctaaaacaggggcagacacaaccgcggcaggaccgctgttccagcagagaccttatcccagccctggcgctgtgctgcgggcaaacgccgaggcctcacgcaccaagcagcaggattag

SEQ ID NO: 235407 - DNA, 204 bp, Artificial Sequence
  Description of Artificial Sequence: Synthetic coding sequence
atgccattgcccgtcgctctgcagacgcgtctggctaagcgcggtattctgaagcacctggagcctgagccagaggaggaaatcatcgctgaagattacgacgatgaccccgttgactacgaagctaccaggctggagggccttccaccaagctggtacaaggtttttgacccttcctgccccggttggagcgcgatggtgtag

SEQ ID NO: 235408 - DNA, 798 bp, Artificial Sequence
  Description of Artificial Sequence: Synthetic coding sequence
atgccactcccagtggcacttcagactcgactggccaagcggggaatcctcaagcacctggagccagaaccagaagaagagataatagccgaggactatgacgacgatccggtagactacgaagccacacggcttgaaggattaccccctagctggtacaaggtcttcgaccccagctgtggactcccgtattactggaatgcagacactgatctggtttcttggttgagcccacacgatccgaatagtgttgtaaccaagtcagcaaagaaactacggagttcaaatgcggacgctgaggagaagctagataggtctcacgataagtctgacagagggcacgacaagtcagataggtcgcatgaaaagctggatcggggtcatgataaaagtgacagaggacacgacaaatcagatcgagacagggaacgaggctacgataaagtagacagggaacgggagagggatcgcgagcgggaccgcgaccggggttacgacaaggcagaccgcgaagaaggaaaagagagacggcaccatagaagggaagaactggccccttacccaaaatccaagaaggcagtgagtagaaaagatgaggaactggatccgatggacccctcttcctacagcgatgctcccaggggcacttggagcaccgggctcccgaaaaggaacgaggccaagactggggcagacactaccgctgccggaccgctctttcaacagcggccatacccaagtccaggcgcagtcttgagagccaatgcggaggcctcaaggacaaagcagcaggactag

SEQ ID NO: 235409 - DNA, 513 bp, Artificial Sequence
  Description of Artificial Sequence: Synthetic coding sequence
atgccgctcccagtagcactgcagacccgtctggccaagcgcggaatccttaaacatctggaacctgagcctgaagaggaaattatcgcagaagattatgacgatgaccctgtggactacgaggccacgcgcctcgaggggttgcccccaagctggtacaaagtgtttgatccttcctgtggtttgccctattattggaacgctgacacagatctggtgagttggctttctccccatgaccctaattccgtggtcaccaagtctgctaaaaagctccggtcttccaatgcagccgtttcacggaaggatgaagagctggatcctatggacccatcatcctactccgatgcccctagaggaacctggagcactggcctccccaagcgtaacgaggctaaaaccggggcagacactacagctgcagggcctttgtttcaacagcggccatatccaagtccaggcgctgttctgcgggctaacgctgaggcaagcaggacaaagcagcaggactag

SEQ ID NO: 235410 - DNA, 798 bp, Artificial Sequence
  Description of Artificial Sequence: Synthetic coding sequence
atgcctctaccggtcgcacttcaaacccgactcgcaaagcgaggcattctgaaacatttggagcctgagccagaagaggagatcatcgccgaagattacgatgacgacccagtggattatgaggccacaagactggagggcctcccgccaagctggtacaaggtatttgacccgagctgcggcctcccttattattggaacgctgacacagatctggtgagttggttgtctcctcacgaccccaacagcgtagttaccaaatccgccaagaaactgcggtcatccaatgcagatgctgaggaaaaactggataggtcacatgacaaatctgatcggggtcatgacaagtctgacagatcacatgaaaagctggacagagggcacgataagagcgaccgcggacacgacaagagcgatcgggatagagaaagggggtatgacaaagtggacagagagcgggagcgtgaccgcgaacgcgatagagacaggggttacgacaaggccgatcgagaggagggcaaagaacgcagacaccaccggagggaggaactggctccttatccgaagtcgaaaaaagccgtttcacgcaaagacgaggagcttgatcctatggacccaagtagctacagcgatgctcccaggggcacatggtcgactggcctgccaaagaggaatgaggccaaaactggtgcggatactacggcggctggacccctgttccagcaacgcccttatccgtccccgggagccgttcttagagccaacgccgaagcatcccgtactaagcagcaggattag

SEQ ID NO: 235411 - DNA, 642 bp, Artificial Sequence
  Description of Artificial Sequence: Synthetic coding sequence
atgccgctgcccgtagctctgcaaactcgcctcgctaagaggggaattctgaagcaccttgagcctgagccggaggaggagatcattgccgaagactatgatgatgatcccgtggattacgaggccactcggctggaaggccttccgccaagctggtacaaggttttcgacccttcatgcggcctgccatattattggaacgccgacactgacttggtgtcctggctgtccccccatgatcctaattctgtggtgacgaagtcagcgaagaagctgcgcagttccaacgccgatgcagaggagaaactggatagaagccacgataaatcagatcggggacacgacaagagcgatcgcagtcacgaaaagcttgaccggggacacgataagtccgatcgcggacatgataaatctgacagagacagagaaagagggtatgataaggtggatcgcgaaagagagagagacagggagcgtgatcgagacagggggtacgataaagcggaccgagaggaaggcaaagaaaggcggcatcaccgacgggaggagctggctccttaccctaaatctaaaaaagcagtgagccgcaaggacgaagaattggaccccatggatccttctagttactcggatgccccatag

SEQ ID NO: 235412 - DNA, 798 bp, Artificial Sequence
  Description of Artificial Sequence: Synthetic coding sequence
atgcccctgcccgtggcgctgcaaacaaggctcgccaaacgaggcattctgaaacatctcgagcctgagccggaagaagaaatcatagccgaagactatgacgacgaccctgtggactacgaagccacgaggctggaagggctgccccctagctggtataaagtttttgaccccagttgtggattaccatactattggaacgcggatacggatctcgtgtcttggctgtcaccacacgatccaaattccgtggtaactaagtctgccaagaagttacggagcagcaatgccgacgccgaggagaagctggatcggagtcatgacaagtctgatcgcggtcatgacaaatctgatcgctcccacgagaagctcgataggggacatgataagagtgaccggggtcatgataagtccgatcgggaccgggaacgcggatatgataaggttgatcgagagcgagagcgggatagagagagggacagagatcggggatacgataaggcagatagggaggaagggaaggagcgacgacatcatcgacgggaagaattagctccctatcccaagtcaaaaaaagctgttagccggaaggatgaggagttggacccaatggatccaagctcatatagcgacgccccacggggtacgtggtctaccggcctgcctaaaagaaacgaggctaagacgggagccgacacgacggccgctgggcctctctttcaacagcgtccctacccttctccaggcgcagtgctcagggccaacgccgaggcctctcgcactaaacagcaggactag

SEQ ID NO: 235413 - DNA, 453 bp, Artificial Sequence
  Description of Artificial Sequence: Synthetic coding sequence
tgaattgccacctacctcctgcacctcctggtgcagcccgaggaggagataatcgcagaagattatgacgatgaccctgttgactatgaggcgacccggctggagggtctgccaccctcatggtataaagtgtttgatccatcctgcggccttccatactattggaatgctgataccgacttggtgtcctggctctctccccatgaccctaactccgtagtaaccaagtccgcaaagaagcttagaagctctaatgccgcagtatcccgaaaagacgaagagctcgaccccatggatccgtcctcatattctgacgctcctcgcggtacttggtcaactggcctcccaaagcgtaatgaggctaagactggtgcagacaccactgcagcagggcctttgtttcagcagaggccttaccccagccctggcgctgtacttcgagcgaatgcatag

SEQ ID NO: 235414 - DNA, 699 bp, Artificial Sequence
  Description of Artificial Sequence: Synthetic coding sequence
atgggatcagtcttgtcaactgactccggaaaaagtgccccagcatctgccaccgcacgcgctctcgaaaggcgcagggatcctgagctcccggtgacatccttcgattgtgcagtgtgtctcgaggtactgcaccagcctgtgagaactagatgtgggcacgtgttttgtcgtagctgcatagccacaagcttgaaaaataataagtggacttgtccctattgtcgggcttacttgccttctgaaggggtgcctgctactgacgttgccaagcggatgaagagcgagtacaagaattgcgccgagtgtgatactttggtatgtctgtctgagatgcgggcacatatccgtacgtgccaaaaatacattgacaaatacggccctttgcaggagctggaggagaccgccgctcggtgtgtgtgcccattctgccagcgagagctgtatgaggactcattactagaccattgtattacccaccataggagcgagcgaaggcctgtattttgccccctctgccggctgatccccgatgaaaacccctcttctttctcggggtctctaatccgccatctgcaggtcagccacactcttttctatgatgatttcatcgattttaacatcatcgaggaggccctaataaggcgagtgctagatcgatccctcctagaatatgtgaatcatagtaacacaacatag

SEQ ID NO: 235415 - DNA, 1986 bp, Artificial Sequence
  Description of Artificial Sequence: Synthetic coding sequence
atggaaaaactgggagtggaacctgaggaagaggggggaggcgatgatgacgaagaggacgcggaagcatgggctatggaactcgccgacgttggcgctgctgcttcttcccaaggggtgcacgatcaggtcttacctacgcccaatgcatcctctcgcgtaatcgttcacgtggatctggattgtttctacgcccaggtggagatgatttcgaatcccgaactcaaagacaaacccctgggagtccagcagaaatatctggtcgtaacttgtaactacgaggctagaaaactgggggtcaagaaattaatgaatgtgagagacgcaaaagagaagtgtccccagctcgtactcgtcaatggcgaggatctcaccaggtatcgggagatgtcatacaaggtgacggagctgctcgaggagtttagcccagttgtggaacgcttaggctttgacgagaactttgtggacctcaccgagatggtcgaaaagcgcctccaacagcttcaatctgatgaattgagcgcggtcactgtcagtggacacgtgtataacaaccagtgtatcggctataaaaccgccaaatgtctggaggcactggggatcaacagcgttcgcgacctgcagacgttctctccgaaaattcttgagaaggaattggggatcagcgtagcccaacgcatccagaaactctcctttggcgaggacaatagccctgtcattttaagcggtccaccccaaagttttagcgaggaggattcctttaaaaagtgctcttccgaggtagaggcaaaaaataaaattgaggagttactggcctctctgctaaaccgcgtgtgccaagatgggaggaaaccacataccgtgagactgatcatccgcaggtacagcagcgagaaacattatggcagagagtcccgacaatgcccaatccctagccacgtgatacagaaattgggcactggcaactatgatgttatgactccgatggttgacattctgatgaaactcttccggaatatggtgaacgttaagatgccatttcatctgactttgctatccgtttgcttctgcaaccttaaagccctcaatacggcaaagaaagggctgattgattattacctgatgccatccctctccaccaccagcaggtccgggaagcattcatttaagatgaaggacacacatatggaggactttccaaaggataaggagactaacagagatttcttgcccagcggccgaattgagtctacccgcactagggaatcccctctggacaccaccaatttctctaaagaaaaggatatcaatgagtttcccctgtgcagccttcctgaaggcgtagaccaggaagtcttcaagcagctgcccgtggatattcaggaagaaattctcagtggtaagagcagagagaagttccagggcaagggctctgtgtcctgcccactccacgccagccgcggagtgctcagcttcttctctaagaagcagatgcaggacattcctattaatccacgggaccacctgtcctcatccaagcaagtgtcttctgtaagcccctgtgagcctgggacttctggtttcaactcctcaagtagttcctatatgtcttcccaaaaggactattcctactaccttgacaatcggcttaaggacgagagaatatcacaggggccaaaagaaccacaaggctttcattttaccaattccaacccagcagtctccgccttccattcattccccaatttacagtctgagcagctgttttctcggaatcatacaactgactcccataagcagaccgtggcgacggattctcatgaaggtttaacggagaaccgcgagcccgatagtgtcgatgagaaaatcaccttcccatcagacattgatcctcaagttttctatgagctgcctgaagccgtgcagaaggagctcctggcagaatggaaacgggcaggttccgactttcatattgggcataagtag

SEQ ID NO: 235416 - DNA, 2223 bp, Artificial Sequence
  Description of Artificial Sequence: Synthetic coding sequence
atggaaaagctgggggtggagccagaggaggagggcggaggtgatgatgatgaggaggatgctgaggcctgggccatggaactggcagatgtaggagccgctgcttccagccagggagtccacgaccaggtcctccccacacccaatgcctcctcgcgtgtgattgtgcacgtggacctggattgtttttacgcccaagtcgagatgatcagcaaccccgaacttaaggacaagcccctgggggtgcagcaaaaatacctggtggtgacttgtaattacgaggccaggaagctaggcgtcaaaaaacttatgaacgtgagagacgccaaagagaagtgtcctcagcttgtactggttaacggcgaagacctgactaggtacagagagatgtcctataaggtgactgagctactcgaggagttttcacctgtggtcgagagattgggattcgatgaaaacttcgtggatctgaccgaaatggtggaaaaacggctccagcagctgcaatcagacgaactctctgcggtgaccgtgtccggacatgtgtataacaaccagtcaattaatctactcgacgtgctccatatccggctcttggtcggatctcagatcgccgctgaaatgagagaggcaatgtacaatcagctgggtctcaccggatgtgctggcgttgcttccaataagcttctggctaaattagtgtcaggagttttcaagcccaaccaacagactgtcctgcttccagagtcttgccagcatctgatccattctctcaaccacatcaaagaaattcctggtatcgggtacaagacggcgaaatgtctggaagccctcggaattaacagcgtgagggatctgcaaactttttcacccaaaatcttagaaaaggaactcggcatttcagtagctcaacggatccaaaagctctctttcggagaagacaactcccccgttattctgtcagggccaccacagtccttttcagaagaagactccttcaaaaagtgttcttctgaagtcgaggcaaagaataaaattgaagagcttctggcgtcactgttaaatcgcgtgtgccaggatgggaggaaacctcacaccgtgcggctgataatccgaagatactcatccgaaaaacactatgggagagagtctcgacaatgccctatcccttcccacgtcatacaaaagctgggaactgggaattatgacgttatgacgccaatggtggacatcctgatgaagttgtttaggaatatggttaacgtgaagatgccattccatctgactctgctcagcgtgtgcttttgcaacctcaaggctctcaacacagccaagaaggggcttatcgactactacctgatgccttccctatctactaccagccgctcaggaaagcatagtttcaagatgaaggatacacacatggaggattttccaaaagacaaggaaaccaacagagactttctcccgtcaggcaggatcgagtctactagaactcgagaatctcccctcgatacaacgaactttagcaaagaaaaagacattaatgagtttccgctgtgttccctgcctgaaggggtcgaccaggaagtcttcaagcagttaccagtggacatccaggaagaaatcctctctgggaaatctcgcgaaaaatttcaggggaagggctctgtgagctgtcctctgcatgcatcaaggggagtcttgagctttttttccaagaagcagatgcaggacatcccgataaatccacgagaccacctcagcagttctaaacaggtgtcatcagtatctccgtgcgaacctggtaccagtgggtttaacagctcctcttcaagctatatgtcctctcagaaggattacagttactatctggataaccgactcaaggacgagcgcatatctcaggggcctaaggagccacagggattccactttaccaacagcaacccggctgttagtgcgttccactccttccctaacctgcaatctgagcagctcttctctagaaatcatactaccgattcacacaaacaaaccgttgcaactgattcacatgagggtttgaccgaaaatagagaaccagactccgtggatgagaagattacattccccagcgatatcgacccacaagtgttctacgagctgccagaggccgttcagaaggagctgctcgcagaatggaagcgtgccggatcagactttcatataggccataaatag

SEQ ID NO: 235417 - DNA, 2613 bp, Artificial Sequence
  Description of Artificial Sequence: Synthetic coding sequence
atggacagtaccaaggagaagtgtgacagctacaaggacgatcttctgctgcggatgggactgaacgacaacaaagccggaatggaggggcttgacaaggagaaaattaacaagatcattatggaggccaccaagggctccagattttatggcaacgagttaaaaaaagaaaagcaagtgaaccaacgcatcgagaacatgatgcaacagaaagcccagattacctcccagcagctgcgcaaggctcagctgcaggtggatcgatttgctatggagctagagcaaagcaggaacctcagcaacactattgttcacattgacatggacgctttttacgccgctgtagaaatgcgggataacccggaactcaaagataagcccatcgcagtcggcagcatgagcatgctgtccacaagtaattatcacgccagacgtttcggcgtgcgcgcagccatgccaggctttatcgccaagagactgtgcccacaattgatcatcgttcctcctaattttgacaaataccgggcagtcagtaaggaggtgaaagagatcctggctgattatgacccgaatttcatggccatgagtttggacgaggcttatctgaatatcaccaaacatctggaagaacgtcagaattggccggaggataaacggagatacttcatcaagatgggatcctccgtggagaacgataatcccggaaaagaagttaacaagttgagtgaacacgagcggagcatttctccactcctgtttgaggaaagcccttctgacgttcagcccccaggcgatccttttcaagtgaactttgaggaacaaaacaacccacagatcttgcagaacagtgtcgtcttcggcacctcggctcaagaagtggtgaaggaaatccggttccgaatagagcagaaaacaacgctcactgcatccgctgggatcgcccctaacacaatgctagcgaaggtctgttctgataagaataaacctaatggacaatatcaaatactgcctaacaggcaagcagttatggatttcatcaaggatcttccgattcgaaaggtgtctgggatcgggaaagtgaccgagaagatgcttaaggcgttgggtataattacatgcaccgaactctaccagcagcgggctctgctttctctgctgttttctgaaacctcatggcactatttcctgcatatctccctgggcctgggcagcacacacctgacacgggacggcgagcgaaaaagcatgagcgtagagaggaccttcagtgagatcaacaaggcggaggagcaatattcactgtgccaagaactgtgctcagagctggctcaggacttgcagaaagaacgtttaaagggaagaactgttactataaagctgaaaaatgtaaactttgaggtgaagactagagccagtaccgtgagctccgttgtcagcaccgcggaagagattttcgccattgccaaagaactgctgaaaactgaaatcgatgctgatttcccccacccattgcggctccgcctgatgggcgtacgcatctctagcttccctaacgaggaagatcgcaaacaccagcaacggagcatcattggttttcttcaggcaggaaaccaggccctgtccgccaccgagtgcaccttggagaaaaccgacaaggacaaattcgtcaagcccctggagatgagccacaaaaaaagcttctttgataagaaaagatctgagagaaagtggtcccatcaggatacttttaaatgcgaggcggtgaataagcagagtttccagacatcacagccctttcaagtactgaaaaaaaaaatgaacgagaatctggagatcagtgagaacagcgacgactgtcagatcctcacatgccctgtatgcttcagggcccaggggtgtatttccctggaagcgttgaacaaacatgtcgacgagtgcctggacggccctagtatttccgaaaattttaagatgttctcatgttcacacgtctccgccactaaggtgaacaagaaagagaatgttcccgcttccagtctctgcgagaaacaggactacgaagcccacccgaaaatcaaagaaatctctagcgtggattgcatcgcactggttgataccattgacaattccagcaaggctgaaagtatagatgccctgagcaataaacatagcaaggaagagtgcagttcactccctagcaaatcctttaatatcgagcactgccatcaaaattcctccagcacagtgtccctggaaaacgaggatgtaggtagctttcgccaggaataccggcagccgtacttgtgcgaggtaaaaaccggccaggctctcgtttgccctgtttgcaatgtggagcaaaagaccagcgatctcacgctgtttaatgtccacgtggatgtgtgccttaacaaaagctttatccaggagctacgaaaggataagtttaatcctgtgaaccagcctaaggaaagtagcaggagcacgggttcttcttctggtgtacagaaagccgtgaccagaacaaagcgtcctggtctgatgaccaagtactctacttctaagaagatcaagcctaataacccaaagcatactttggacatcttctttaagtag

SEQ ID NO: 235418 - DNA, 2019 bp, Artificial Sequence
  Description of Artificial Sequence: Synthetic coding sequence
atggactcgaccaaagagaagtgcgattcgtataaagatgatctcctactccggatgggcctgaacgataacaaagcaggcatggaaggcctggataaggaaaagataaacaaaatcattatggaagcgactaagggcagccgcttctatgggaatgaattgaaaaaggaaaagcaagtgaatcaacgcattgagaacatgatgcagcaaaaagcccagatcaccagtcagcagctgcggaaggcacagcttcaagtggataggttcgccatggagctggaacagtctcgcaatctgagtaacacaatagtccatatcgacatggatgcattttatgcagctgtggagatgagggataaccccgagcttaaagacaagccaatcgccgtcgggtcaatgagcatgctgagtacctcaaactaccatgcaagaagatttggagttcgggctgctatgccagggtttattgccaaacgattgtgtccgcagttgatcattgtgcccccaaatttcgacaagtaccgggcagtgtcaaaggaggtgaaagagatccttgcagactacgaccccaatttcatggcaatgagcttggacgaagcttatttaaacatcacgaagcatttagaagaaagacaaaactggcccgaggataaacggaggtattttattaaaatgggatcaagcgtggaaaacgacaacccaggaaaggaagtcaataagctgtctgaacatgaaagaagtatctccccgctgctgtttgaggaaagtcccagcgatgtacagccgccaggggaccctttccaggtaaacttcgaagagcaaaataacccccagattctgcagaactcggtagtgtttggcacatcagcgcaggaggttgtgaaggaaatcagattccgcattgagcaaaaaaccactctcacagcaagtgccggagtgcgtatttcctcttttcctaacgaagaggatcggaaacatcagcagcggtcgatcattgggtttttgcaggctgggaaccaggcactatccgccacagagtgcaccttggagaaaacagacaaagacaagtttgttaagcctctggagatgagccataagaagtcatttttcgacaagaaacgatcggaaagaaaatggagccatcaggataccttcaagtgtgaggccgtgaataagcagagcttccaaacctcacagccgtttcaggtgctgaagaagaagatgaatgagaacttggaaatctccgagaactcagacgactgccaaatcttaacctgcccagtgtgttttcgagcccagggatgtatttccctggaggccctgaataaacacgtcgatgagtgcttagatggcccttctatctccgagaattttaaaatgttctcttgttcccatgtgtctgcgacaaaggtaaataaaaaggaaaatgtccccgcttcgtctctttgtgagaaacaggactatgaagctcacccaaaaatcaaagagataagtagtgtagactgcatcgccttggttgacaccatcgacaattccagtaaggcagaatccatcgatgccctgagcaacaagcactcgaaagaagagtgcagctccctcccctctaagagctttaatatcgagcattgccaccagaactcatcctccactgtgtctttagagaatgaggacgtgggctcctttagacaggagtataggcagccttatctctgtgaggtgaaaaccggccaagcattggtctgcccagtctgcaatgttgaacagaagacatccgacctaaccctcttcaacgtacacgtggatgtctgtctgaataagtcatttatccaggagttgagaaaggacaagttcaaccctgttaatcagccgaaagagtccagccggtccactggctcaagctccggagtgcaaaaagcggtgaccagaaccaaacgcccaggactgatgactaagtactcaacatcaaagaagattaagccaaataaccctaaacacactctggacatcttctttaaatag

SEQ ID NO: 235419 - DNA, 2343 bp, Artificial Sequence
  Description of Artificial Sequence: Synthetic coding sequence
atggaactagagcagtctcgcaatctgtcaaacaccatcgtgcacatcgacatggacgccttctacgccgcagttgagatgcgcgataacccagagctgaaagataagccaatcgcagttggcagcatgagcatgctaagtacatcgaactaccatgcccgaaggttcggtgtaagggcagcaatgcccggtttcatcgccaaacggctatgtcctcaactgatcatcgtgccccctaacttcgataaataccgagcagtttctaaagaggtgaaggagatactcgccgattacgacccgaactttatggctatgagcctggacgaggcctacttgaatataacaaaacacctggaggaaaggcagaactggccagaagacaagaggcggtatttcatcaagatgggtagttcggtcgaaaacgacaaccccggtaaggaggtgaataagttatctgagcacgaacgctctatctctcccctcctatttgaggaatccccttcggatgtccagccccctggagatcccttccaggtaaattttgaagaacaaaataacccacaaatcctgcagaatagcgtcgtgttcggaacttcggctcaggaggtggtgaaagagatcaggtttcggatcgaacagaagactacactcactgccagcgcaggtatcgctcccaacactatgctggccaaagtgtgcagcgataagaataagccgaacggccaatatcaaattctgcctaaccggcaggctgtgatggatttcatcaaagatttgcctatccgtaaggtatccggaatcggaaaagtcaccgaaaagatgttgaaggctctgggcatcattacctgcaccgagctttaccagcagcgcgctctcctatcgctccttttctctgaaacatcttggcattattttctccacatttcccttggcctgggcagtacacacttaacgagagatggagagcgaaaatcaatgtctgttgaacgcactttcagtgagatcaacaaagctgaagagcagtactccttgtgtcaggagttatgctcagaactggcccaagatctgcagaaagaaaggctaaaagggaggacagtgaccattaaactcaaaaacgtgaattttgaagtgaaaacccgcgctagtacggttagcagtgtagtctccacagccgaggagatttttgctattgccaaggagctgctgaagactgagatcgatgccgacttccctcaccccctccgacttcgcttgatgggggtgcggatctcctctttccctaatgaagaagaccggaagcaccaacagcgttcaatcattggctttctgcaggccggtaaccaggccttaagcgccacagagtgcacattggagaaaaccgacaaggataagtttgtgaaacctctggagatgagtcataagaagtcttttttcgacaagaaacgctcggagaggaaatggtcccaccaggacacgtttaagtgcgaggccgtgaacaagcagtcattccaaacttcccagccatttcaggtgttaaaaaagaaaatgaacgagaatctagagatctccgaaaattccgacgattgtcagattctaacctgtcccgtctgtttcagggcccagggctgcatcagcctggaagccttgaacaagcacgtggatgaatgcctggacggcccttccatctccgaaaattttaagatgttttcctgctcccatgtgtcggccacgaaagtcaacaaaaaggaaaatgttccagcctcaagcttatgtgagaagcaggactacgaggcccatccaaaaattaaagagattagctccgtggactgtatcgctctggtggataccattgataacagctcaaaggctgagagtattgacgctctgtcaaataagcacagcaaagaagagtgctcaagcctgccgagtaagtcttttaacatagaacattgtcatcaaaattccagctcaaccgtgtccctggagaatgaagatgtgggctcttttagacaggagtatcgccagccttacttatgtgaggtgaaaacaggccaggcccttgtatgccccgtgtgcaatgtcgagcagaagaccagtgacctgactctgttcaatgtccacgttgacgtgtgcctcaataagagctttatacaagagttgagaaaagacaaattcaaccccgtgaatcagcctaaggagagcagccggagtaccggatcttcatctggcgttcagaaggccgttacccgtacaaaacgaccgggtctcatgaccaagtacagcacatctaaaaaaatcaagcccaacaatcccaagcatacattggatatattctttaagtag

SEQ ID NO: 235420 - DNA, 1386 bp, Artificial Sequence
  Description of Artificial Sequence: Synthetic coding sequence
atggattctacaaaggagaagtgcgactcttacaaggatgacctgctcctgaggatgggcctgaatgacaataaggccggaatggaagggctcgacaaggagaagatcaacaaaataatcatggaggccacaaaggggtctcgattctacggcaacgagctcaagaaagaaaaacaagtgaaccagcggattgagaacatgatgcagcagaaggcccaaatcacctcacaacagcttcggaaggctcagctgcaggtggataggtttgcaatggagctcgaacagtcgaggaatctgtccaacactatcgtgcacattgacatggatgccttctatgcggcagtcgagatgcgcgataatccagaactgaaggataagccaattgctgttggtagcatgtccatgttgtctacctcaaactaccacgcacggaggttcggagttagggccgcaatgccagggtttattgcaaagagattgtgccctcaattgatcatcgtgccccctaactttgacaaatacagggccgttagcaaggaagtcaaagagatacttgccgattatgatcccaactttatggcgatgagtctcgatgaagcatacttgaacatcacaaaacacctggaagaacgccaaaactggccagaagataagaggagatatttcatcaagatgggctccagtgtcgaaaatgacaaccctggcaaggaggtgaacaagctcagcgaacatgaaagatcgatcagccccctgctcttcgaggagagcccctccgatgtccagcctcccggagatccgtttcaggtgaacttcgaggaacagaataatccgcaaatcctgcagaattcagtggtgttcggcacatcggctcaggaagtggttaaagaaatcaggtttcggattgagcagaagacgacacttacagctagcgccggaattgcacccaacacaatgctggcgaaagtttgcagtgataaaaacaagccaaacggccagtaccagatacttccgaataggcaggccgtcatggatttcatcaaggatctccctattcgcaaagtgtctgggatcgggaaggttacagaaaagatgctgaaagccctggggatcataacttgcactgaactgtatcagcagagggccctgctgtcactccttttctctgaaacttcctggcactacttcctccatatatcactcggactcggctctacgcatttaaccagagacggcgagagaaagtccatgtcagtcgagagaacctttagtgagatcaacaaggctgaggagcagtatagtttgtgtcaggaattgtgttctgaacttgcccaggatttgcagaaggaacggttgaaggtcgcccaggtggagtacagacggctgtag

SEQ ID NO: 235421 - DNA, 2019 bp, Artificial Sequence
  Description of Artificial Sequence: Synthetic coding sequence
atggactctaccaaagagaaatgcgatagttacaaagatgatctcctgctcaggatgggtctcaatgacaacaaggccggtatggagggactcgataaggagaagattaacaagataatcatggaagcgaccaagggcagtagattctatgggaatgaactcaagaaagaaaagcaggtgaatcaacgaattgagaacatgatgcagcagaaagcacagattacctcgcagcaattgagaaaggcccagctgcaagttgatcggttcgccatggagctagagcagtcacgaaatctctccaatacaattgttcatattgacatggatgcgttttacgctgctgtggagatgagagataatccggagttgaaagacaaacctatcgcagtgggttcaatgagcatgttgtccacgagcaattaccatgcaagaaggttcggcgtgagggcagccatgcccggattcatcgctaagcgactgtgcccccagctcattatcgtgccacccaatttcgataagtaccgagccgtctcaaaagaggtgaaggagattctcgccgattatgatccgaactttatggccatgagtctcgacgaggcatacctgaacattactaaacacctggaggaacgccagaattggccggaagataaaagacggtattttatcaaaatgggctcctcagtggaaaatgacaaccccggtaaggaagttaacaagttgagtgaacacgaaaggtcaatatcaccgcttctatttgaggaaagcccatcggacgtgcagcccccaggagatccgtttcaagtgaacttcgaagaacagaataacccccagattctgcagaactccgtagtgttcggcacgtctgcccaggaagtggtgaaagaaatccgatttagaatcgaacagaaaaccacacttactgcctcagccggagtacggatcagcagtttccctaatgaggaggatcggaagcatcagcagaggtcaattatcggcttcctccaagccggaaatcaggctctttcagcaacagagtgtaccctggagaagactgacaaagacaagtttgtgaagccactggagatgagtcataaaaagagctttttcgacaagaaacggagcgagaggaagtggtcacaccaggacacgttcaagtgtgaggccgtcaataagcaatcatttcagaccagccagccatttcaggtcctcaagaaaaagatgaatgagaatcttgagattagcgagaactccgacgactgccagatattgacctgccctgtgtgctttagggcacaaggctgcattagcttagaagcattgaacaagcatgtagacgagtgtcttgacggcccatctatttccgagaatttcaaaatgttctcgtgtagccacgtgagcgcaaccaaggtaaataaaaaagaaaatgtccctgcctcttccctttgcgagaagcaggactacgaggcacatccgaaaataaaggagatcagctcagtggactgtatcgcactagtcgacaccatcgacaactcctcaaaagccgagtctattgacgctctgagcaataagcatagcaaggaggaatgttcttccctgccttccaaatcttttaacatagagcactgtcatcagaattccagtagcactgtatcccttgagaacgaggacgtgggcagctttcgacaggaatatcggcaaccttatctgtgtgaggtcaagaccggtcaggcgcttgtctgtccggtttgtaatgtggaacagaagacttccgacctgacactgttcaacgtgcatgttgatgtttgtctcaacaagtcttttatccaagaactccggaaagacaagttcaatcctgtgaatcaaccaaaggagagttccaggtctacgggttcgagcagcggtgtgcagaaggccgtcacgagaactaaacggcctggactcatgactaagtactccacttctaagaagattaagcctaataacccgaaacataccctggatatcttcttcaagtag

SEQ ID NO: 235422 - DNA, 1470 bp, Artificial Sequence
  Description of Artificial Sequence: Synthetic coding sequence
atggattcaactaaggagaaatgtgactcatataaagacgacctgctcctgcgcatgggtttgaacgataacaaagcgggtatggaaggtctggataaggagaagattaataagattatcatggaagccaccaagggaagtaggttctatggcaatgagctcaagaaagagaaacaggtaaatcagcggatcgaaaatatgatgcagcagaaagcccagattacctcccagcagctcaggaaagcacaacttcaggttgaccgcttcgctatggagttggagcagagtcgcaatttgtcgaacacgatcgtccatatcgacatggatgccttttatgctgcagtggagatgagagacaaccccgagctgaaggacaaacctattgcggttggatcaatgtccatgctgagtacatcaaactaccacgcaaggcgatttggcgttagagcagctatgccaggttttattgccaaacgtctctgccctcagctgattatcgtgcctcctaattttgacaaatatcgtgcagtaagcaaggaagtcaaagagatactggcagactacgatcctaatttcatggccatgtctcttgacgaagcctatctaaacatcacaaagcatcttgaggagaggcagaactggcccgaggataaacgtagatatttcatcaagatgggatcaagtgtggagaacgataaccccggaaaggaggttaataaactgagtgagcacgagcgaagcatatctcctctcctgttcgaggaatctccttctgacgtccagccgcctggggatccattccaggttaacttcgaggagcagaacaacccccagattttgcagaactctgttgttttcgggacatcagcacaggaagttgtaaaagagatcagatttaggattgagcagaaaacaacgctgaccgccagtgccggaattgccccaaatacaatgttagctaaggtctgcagcgataaaaacaagccgaacggacaatatcaaattctgcccaatcgtcaggccgtgatggacttcataaaagatctcccgattaggaaagtgtcagggatcggcaaggtgactgagaagatgctgaaagccttaggcattataacttgcacagagctttaccagcaaagagctctgttaagtctgctgttttctgagacatcctggcactactttctccacatctccttaggcttaggaagcacacacctgacccgcgacggggagagaaaatccatgagcgtggaacgcacgttctccgagatcaataaggccgaagagcaatacagcttgtgtcaggagctatgttctgaattggctcaggacctacagaaggaacgccttaaggtatttgggtacctggtcttccctatgaagaggactggcaacaccaataagggagcccttcttgctttttaccgtttagaaaccaaaccgtgccaaccactcagtgttcattag

SEQ ID NO: 235423 - DNA, 426 bp, Artificial Sequence
  Description of Artificial Sequence: Synthetic coding sequence
atggattccactaaggaaaagtgtgactcctataaggatgatctgctgctgagaatgggattaaacgacaacaaagccggaatggaggggctcgataaggagaaaatcaataagattataatggaggccactaaagggtctaggttctacggtaatgagttgaaaaaagagaaacaagtgaaccagcgtatcgagaacatgatgcaacagaaggcacagattactagccagcagctcaggaaggctcagttgcaagtggataggttcgctatggagctggagcaatctcgcaacctctccaatacgatcgtgcatatagacatggatgccttctatgccgctgtcgaaatgagggataatcctgagctgaaagataagcctattgcggtggggtccatgagcatgctgtcaaccagtaattactag

SEQ ID NO: 235424 - DNA, 1419 bp, Artificial Sequence
  Description of Artificial Sequence: Synthetic coding sequence
atggatagtaccaaggaaaaatgcgactcttataaagacgatctcctgctccgaatgggcctcaacgacaacaaagccggtatggaagggctcgataaagagaagataaacaaaataattatggaagctacaaaggggtccaggttctacgggaatgaactgaagaaggaaaaacaggtcaatcagaggatcgagaacatgatgcagcagaaggctcaaataacttcacagcaactcaggaaggcacagctccaggttgatcggttcgcaatggagctcgagcagtcccgaaatcttagtaatacaattgtgcatattgatatggacgcgttttatgcagctgtcgaaatgcgggataatccggagcttaaagataaaccaatcgccgtgggctccatgtccatgctgtccacgtccaattatcacgccaggcgttttggagtgcgggcagccatgccaggcttcatagcaaagcgcctgtgccctcaactgataatagtgccgccaaatttcgataaataccgagctgtgtctaaggaggttaaggagattctggcagattacgatcctaacttcatggccatgagcctcgatgaagcctacctaaacatcacaaagcacttggaagagaggcagaattggccagaagacaagaggaggtacttcatcaagatgggaagctccgtagagaatgacaatccgggtaaggaggtgaacaagttgagtgaacacgaaaggagtatcagtccactcctcttcgaagagtcgcctagtgacgtccaaccaccaggtgaccccttccaggtgaacttcgaggaacagaacaatccccaaatactccagaatagcgttgtgttcggaacaagcgcccaagaagttgtgaaggagattagattccgaatagaacagaaaactactttaacagcgtctgccggtattgccccaaataccatgctggcgaaggtctgttccgataagaataagccaaatggccagtaccaaatactgcctaataggcaagcggtgatggattttatcaaagacctgcccatacggaaggtctcgggaatagggaaggtcacggagaagatgttgaaagctttagggataataacctgcactgagctttatcagcagcgcgcactactttccctgcttttctccgagacatcctggcactatttcctgcacattagtcttggcctgggctccacccacctgacacgcgacggagaacggaaaagcatgagcgtagaacgcactttttcagagatcaacaaggcggaagaacagtactcactgtgccaggaactgtgcagtgaactggctcaggacctgcaaaaggagcgcctcaaagtgctgtactttgatatggtgtcgctggtgttcaagttctttaacagcaagatgctgccgtag

SEQ ID NO: 235425 - DNA, 1911 bp, Artificial Sequence
  Description of Artificial Sequence: Synthetic coding sequence
atgaagtgtaagtgtcccgtgatctgcttcaacgcgaaggactttgtgcgaatcgtgttgcaatttttcggcaatgatggctcttggaagcatgtagccgacttcattggcttggaccccaggatcgccgcttggttaatcgacccgtccgatgccacaccctccttcgaggatctcgttgaaaagtactgcgaaaagtccattacggtcaaggtaaactcaacatatggcaatagttcgcgaaatatcgtgaatcagaacgttagagagaatctgaagactctgtacagattgactatggacctctgttccaagcttaaggattacgggctgtggcaactgtttcggactcttgagctgcctctgatccccattcttgcagtgatggagtctcacgcaattcaggttaacaaagaagagatggagaagaccagcgcattactaggagcgcgactcaaggagctggagcaagaggcccactttgtcgcgggtgagcgtttcctgatcactagcaacaaccagcttcgggagatcctctttggaaagctgaaactgcacttactcagtcaacgtaattccctccctcgaacggggctccagaagtacccttccaccagcgaagccgtcctcaacgcccttagagacctccaccccctgccgaaaattattttggagtacaggcaggttcacaaaatcaaatcgacgttcgtcgatggtctacttgcttgcatgaaaaaagggagcatcagttcgacctggaatcagacagggacagtaaccggaaggttatctgctaagcaccccaatatacaggggatttctaaacatcctattcaaatcacgacccccaaaaactttaaaggcaaagaggacaagatcctcacaatcagtccccgagcaatgttcgtatccagcaaggggcatacctttctggccgctgatttctcgcagatagagctgcggatcctcacccatctgagtggagatcccgaactgttaaaactgttccaggagagcgaacgagacgatgttttttctacattgacaagccagtggaaagacgtacctgtagagcaggtgacacatgctgaccgggagcagactaagaaggtagtgtacgccgtcgtgtacggcgctggaaaagaacgcctcgccgcatgtctaggggtgcctatccaggaggcagcgcagtttttggaaagttttctacagaagtataagaaaataaaggacttcgccagagccgctatcgctcagtgccaccaaactgggtgtgtcgtttcaataatgggacgcaggcggccacttcccaggatccatgcgcatgaccaacagcttcgcgctcaagcggagaggcaggccgtgaatttcgtcgtgcagggctctgcagcagacctctgcaagctcgctatgatccatgtcttcacagccgtggctgcctcccatactctgacagcccgacttgttgcacagatccacgatgaactgctgttcgaggtggaagacccacaaattcctgagtgcgccgcattggtacgcagaacgatggagagcctggagcaggtgcctctgaaggtatctctatctgcgggacgatcatggggacatctcgtccccctccaggaagcttggttaagacaggcccatgtcgcgctctcccttcctgccaccgcctggctgccgctcggccctctccccgctccgagcccccatccttgcatatttagactccactttgtatgtagccccaggcagcagtgggaagagcgtaccggcttccagcaatccatcgtctggcctagtccgaggagtcctgccctgtatgcgcctggaaggatcaacccactaggcctcggttggccggcaattccttggagcaagtgtttatgcaaagcccttctgattctgtag

SEQ ID NO: 235426 - DNA, 936 bp, Artificial Sequence
  Description of Artificial Sequence: Synthetic coding sequence
atggcggtgggttcccaggactatggtttgtggcagctctttcgcacactcgaactgcccctgattcctatcttggccgtcatggagtctcacgcaatccaggttaacaaggaagagatggagaaaacttctgccctactcggcgcaaggctgaaagagttggagcaggaagcccactttgtcgcgggagaacgatttctgattacaagcaataatcagctgagggagatcctctttgggaaactaaagctgcacctgctctcgcagagaaatagcctccctcggactgggctccaaaagtatccgtcgacctctgaagcagttaatattcaggggatctcgaaacaccctattcagatcactacgcctaagaatttcaaaggaaaggaggataagattctgactatcagcccacgtgccatgttcgtaagctccaagggtcacacttttttggccgctgattttagtcagattgagcttcgaatcctcacacacctgtcaggcgaccctgagctcttaaaactatttcaggagtcagagcgagacgatgtgttttcaactcttacaagtcagtggaaggatgtgccggtggagcaggtgacgcacgcagacagagagcagacaaaaaaggtagtttacgccgtagtgtatggtgcgggaaaagagagactggcggcttgtcttggtgttccaatccaggaggccgcacagtttctagaatcatttctccagaagtacaaaaaaatcaaggatttcgcacgggcagcaattgcacagtgccatcagacaggctgcgtcgtctctattatggggcgtagacgacctttgcccaggatccatgctcacgatcagcagcttcgcgctcaggctgaacgccaggcagtgaattttgtggttcaagctcagagccagcatctgtgtgtggaggtcccatag

SEQ ID NO: 235427 - DNA, 2703 bp, Artificial Sequence
  Description of Artificial Sequence: Synthetic coding sequence
atggagaattacgaagccctggtcggatttgacctgtgcaacacgcccctgagttccgtggcccaaaaaatcatgtctgctatgcactccggcgatctggtggatagcaaaacatgggggaagagtacagagaccatggaagttataaataagtccagtgtgaagtacagtgtgcaactggaagatcggaaaacgcagagcccagagaagaaagatcttaaatccctgcggagccaaactagccgtggtagcgctaagctgagccctcaatcattttccgttagactgaccgaccagcttagcgccgaccagaagcaaaaatctatttcttctctgaccctaagtagttgtctgatcccccaatacaaccaggaagcgtccgtgttgcagaagaaggggcacaagagaaaacacttcttaatggagaatattaataacgagaataaaggcagtataaacctgaagaggaaacacattacatataacaatctatctgagaaaactagcaaacagatggccctggaggaagacaccgatgacgccgaaggctacctcaactccggtaactcaggggcattgaagaaacatttctgcgatatccgtcacctggatgactgggctaagtcccagcttatcgagatgctaaaacaggccgcagccttggttatcaccgtcatgtacaccgatggttctacccaactgggggcagaccagacccctgtaagcagcgtccgcggtatcgtggtcctggttaagcggcaggctgagggcggacacgggtgcccggatgccccagcctgtggcccagtcctcgaaggcttcgtttccgacgatccctgcatctatatccagattgaacactctgccatatgggaccaagagcaggaggcgcaccagcagttcgctcgcaatgtactttttcaaaccatgaagtgtaagtgtcctgtgatttgttttaacgcgaaagacttcgttcgcatcgtcctgcagttctttggcaatgacggctcttggaagcatgtggccgactttattggactcgaccccagaatcgcagcttggctgattgaccctagcgatgcgactccgtctttcgaggatctggttgagaagtattgcgaaaaaagtatcaccgttaaagtcaactctacatacgggaactcttctcggaatattgtgaatcagaatgtccgagaaaatctgaagacactataccgactgacgatggacctgtgctctaagctcaaggactatgggctgtggcagttatttaggacccttgagctgcctctgattccaattctggctgtcatggagtctcatgcaatccaggtcaacaaagaggaaatggaaaaaaccagcgcattgctaggtgctagacttaaggaactcgagcaggaggcacatttcgtcgcaggagaacgctttctgatcactagcaataatcagctgcgggaaatcctcttcggcaagctgaagcttcacctgctatcccagcgcaattccctcccccgaacaggtttacagaagtacccctcaactagcgaagccgtgctgaatgcactgcgcgaccttcatccccttcccaaaatcatcttggaataccgccaagtacacaaaataaagtccacatttgttgatggcctgctagcctgcatgaaaaaaggcagcatcagctctacatggaatcaaactgggacggtgaccggcagactgtccgccaagcaccccaatattcagggaatctctaagcatcctatccagatcactacgcccaaaaactttaagggcaaagaagacaagatcctgaccatatctccacgtgcgatgttcgtgagttctaagggacacacatttttagcagccgatttctctcagatcgaattaaggattctcactcacttgagcggcgatccggagctgttaaagctgttccaggaatctgaacgcgatgacgtgttttccacgctgacctctcagtggaaagacgttccggtggagcaggtcacacacgccgatcgcgagcaaactaaaaaagtggtctatgcagtggtctatggggcaggtaaagagcgactggccgcttgtctgggcgtcccaatccaagaggctgctcaatttctggaatctttcctgcaaaaatataagaaaattaaagatttcgcccgagcagctattgcccaatgccatcagactgggtgtgtcgttagcataatgggccgtagacgacccctgcctagaatacacgctcatgaccagcagctgcgcgctcaggcggagcgccaagcagtgaactttgtggtacagggcagcgctgccgacctgtgcaagttagctatgatccacgtgttcactgcagtggcagcttctcacaccttgactgccaggttggtggcccagattcacgacgaactcctgtttgaggtggaggacccccagattcctgagtgtgccgcactggtcagacgtacgatggagtcgctggagcaggtgcaagctttggaattacaactgcaagtgcctcttaaagtcagcctctctgccggtcgctcgtggggtcacctggtcccactacaggaagcatgggggccacctcctgggccttgtcggaccgagtcaccaagcaactccctagccgcacctggaagccctgcctctacccagcccccacccctgcacttttctccctccttttgtttatag

SEQ ID NO: 235428 - DNA, 2703 bp, Artificial Sequence
  Description of Artificial Sequence: Synthetic coding sequence
atggaaaactatgaggccctcgtggggttcgacctgtgtaatactccactgagcagcgtggcccagaaaatcatgagcgccatgcacagcggagatctcgtggattcaaagacctgggggaagtcaaccgaaaccatggaggtaatcaataaaagtagcgtcaagtattccgtgcaactggaggatcgcaaaacccagtctcctgaaaaaaaggatctcaagtccttgaggagtcagaccagccgaggctctgccaagttgtccccacaatctttcagtgtgaggctgacagaccagctgtccgctgatcagaagcagaagtcaatatcaagtctgacgttgtccagttgtttaattcctcagtacaaccaggaagccagcgtgctccagaagaaggggcacaaaaggaagcacttcctcatggaaaacatcaacaatgagaacaaagggtccatcaatctgaaaaggaagcacattacgtacaataatctgtccgaaaaaaccagcaagcagatggctttagaggaagatactgacgacgccgaaggttatcttaatagtggcaatagcggcgctcttaaaaagcatttttgcgatatacgccacctcgacgactgggcaaaaagccaactgatcgagatgctaaagcaagcggctgccttagtgatcaccgtgatgtacaccgacgggagcacacaactgggagcggaccagacccccgtgtcttctgtcagagggattgtcgtgctcgtgaaacggcaagccgagggcggacacggctgcccagatgctccggcttgtggacctgtgctagaagggttcgtctctgacgatccatgtatttacatacagatcgaacacagcgctatttgggaccaggaacaggaagctcaccagcagttcgcccgaaatgtcctttttcagaccatgaaatgcaagtgtcccgtgatttgtttcaatgccaaagatttcgtgcgaatagttctccagttttttggtaacgacgggagctggaaacatgtagcggatttcatcggactcgatcctaggattgccgcttggctcatcgatccaagcgacgcaaccccgtcttttgaagacctggtagaaaagtactgcgagaagagcataacagtgaaagtgaactctacgtatgggaacagttcaaggaacatcgttaatcagaacgtccgggagaacttgaaaacgctgtaccggctgacaatggatctgtgctccaagctcaaagattatggcttgtggcaacttttcagaactttggaactacccctgatcccgatactagccgtgatggaatctcacgcaatacaggttaacaaggaggagatggaaaagaccagcgccctcctaggcgctaggttaaaagaactggagcaagaggcccactttgtggcaggtgaacggttcctgatcacatccaacaatcagcttcgagaaatcctgttcggaaagctgaagctccaccttctgtcccagcgtaactcactcccacgcactggactgcaaaagtatcccagcacaagtgaggccgtgctgaacgccctacgagacctacacccgctcccaaaaatcatcctcgagtaccgccaggtgcataagattaagagtacattcgttgacggcctgttggcatgtatgaaaaagggatctatctcctctacctggaatcagacagggactgtgactggaagattgagcgccaaacaccctaacatacagggaatcagcaagcacccgatacagataactacgcccaagaactttaagggaaaggaggataagatcttgacaatttccccccgagctatgttcgtttcatcaaaaggacacacgttcttggcagccgacttttcacagatcgagctccggattttaacacatttgtctggtgatcctgaactcctgaagctgtttcaggaatccgagcgagacgatgtcttcagcacactgacatcccagtggaaagacgtcccagtggagcaggtgacgcacgccgatagagagcagacaaaaaaggtggtctacgctgtcgtgtacggcgcaggcaaggagcgccttgctgcatgcctaggcgttcccatccaggaagcagcacaattccttgagtccttcctacagaaatacaagaagattaaagactttgctcgtgccgctatcgcccaatgccaccagaccggatgcgtggtgtctattatggggagaagaaggcctctgccacggatccacgcccacgaccaacaactaagagcccaggccgagcgacaggcagtgaatttcgtcgttcagggctctgccgctgatttgtgcaaactggcgatgatccatgtgtttacagccgtggcagcaagccatactcttaccgccaggctggtggcccaaatccatgatgagctgttgtttgaagtggaagacccacaaatcccagaatgtgcagccctggtccggaggacaatggagtccctggagcaagtgcaggccctggagcttcagctccaggtgccactgaaggtgtcactgtccgccggacggtcttggggtcacctagttcccctgcaggaggcatggggacccccacccggaccctgccgtaccgagtctccatcgaacagtttggcggcacctggcagcccagcatcaacacagccaccacctctccacttttctcctagtttctgcctctag

SEQ ID NO: 235429 - DNA, 3033 bp, Artificial Sequence
  Description of Artificial Sequence: Synthetic coding sequence
cgtatggatggcaaaaggcgccctggccctgggcctggagtgcccccaaagagagccagagggggattatgggatgacgacgacgcccctaggccgtctcagttcgaggaagatttagcactgatggaagagatggaggccgagcaccggctacaggagcaggaggaggaggagttgcagtctgtcttagaaggagtggccgatggtcaggtgccacccagcgccattgatccaaggtggctgcggccaactccacctgcgctggatccacagaccgaaccactcatatttcaacagctggaaatagaccactacgtgggccctgcgcaaccagtccctgggggtcctcctcccagccgtggcagcgtgcctgtgctgcgggctttcggcgtgacagacgagggcttcagcgtctgttgtcacattcacgggtttgctccctacttttacacccccgcaccccctggatttggaccagagcatatgggcgatttgcagcgggaactgaacctggcaatttcccgggattcacggggtggcagggagctgactggcccagcggtgctcgccgtggaactctgtagccgagaatcaatgtttggctaccacggccacggaccatccccctttctgcgcatcacagtcgcactgccacgactcgtcgcccctgctcgcagactcctagagcaggggatacgcgtagccggtcttggaacgccctcttttgccccttatgaggctaacgtagatttcgagattcgatttatggttgacaccgacatcgtggggtgtaactggctggaactgcctgcaggtaagtatgcactaaggttgaaggagaaagcaacacagtgtcagttggaagctgatgtgctgtggtctgacgtggtctcacaccctccggaggggccttggcaacggattgctccactgcgagttctgtcattcgacattgaatgcgccggaaggaaaggaatctttccggagcctgagagggatccggttattcagatttgctccctcggacttcgctggggagaaccggagccattcctaaggcttgcgttgacactccggccatgtgcaccaattttgggcgctaaagtccaatcttacgagaaggaagaagatctgctgcaagcttggagcacattcatccgtattatggaccctgatgtgattacgggctacaacatacaaaactttgaccttccttatctgatcagtcgagctcagactctgaaagtccaaactttcccttttctgggtagggtcgctggcctttgctcaaacatcagggatagttcttttcaatctaagcaaactggcagacgagacacaaaggtagtgtctatggtcggacgggtccaaatggacatgctgcaggtattgctcagagagtataaactgcgaagctacactttgaacgccgtctcattccactttctgggggagcagaaggaggatgtacaacacagtatcatcaccgacttgcagaatggcaacgaccagacgaggcgacgcttagccgtgtactgtttaaaggacgcctatctgcctctacgacttctcgagcgtctgatggtactggtcaatgccgtggaaatggcccgagttaccggcgtgccactatcttacctcttgtctcgaggtcagcaggtgaaggtggtatcccaactactcaggcaggccatgcacgagggactgctgatgcccgtagtgaagtccgaggggggtgaggactataccggagcaaccgtcatcgagccactcaaaggttattatgacgtgcctatcgccacgttggatttctcatcactatatcctagcattatgatggcccacaacctctgttacactacactactgagaccgggtacagcccagaagctggggttaaccgaggaccagtttatccggaccccgaccggcgacgaatttgtaaaaacttcggtgagaaagggcttgctcccacagatactcgaaaacctgctgagtgccagaaaacgcgctaaggctgaactcgcaaaagagactgatccattgaggaggcaagttcttgacggtcgccaattggccctcaaggtgtcagcgaatagcgtgtacggcttcacaggggctcaggttggtaaacttccttgtttggaaatcagtcaaagcgtcactggctttggcagacagatgatcgagaagaccaagcagctggtcgagtccaaatacaccgtcgaaaacgggtactcaacttcagccaaggtcgtctatggagataccgattcagtgatgtgtcggtttggcgtcagctccgttgccgaggccatggccctcggcagggaggcagctgattgggtgtccggccactttccttctccaatacggctcgagttcgaaaaagtttatttcccatacctcttaatctcgaaaaagcgctacgccggtctgttgttcagcagtcggccagatgcacacgaccggatggattgcaagggcttagaggcagttagacgagataattgtccattggtcgccaatcttgttacggctagcctccgcaggctgctcatcgaccgcgatcctgagggggcagtcgcccacgcacaggacgtgatatcagatctgctctgtaacaggatcgacatatctcagctggtgattactaaggagctcactagggccgcttcagattatgccggaaaacaagcacatgttgagttagccgagagaacacgctgctcctgttggtcgaccgcatgtcctctgacacgctctacaacttggtcatcatcctggccaagcccctcctgtgctagtagttcaccgtcttgggctagggccgtcccacggctctgctattgtggcggtaccacgagggccgctcgacgatgcagtcgcgcaaggtgggcggcttcctggccctctccaaacgccgcaaccgccgcactcgcggctgcacagtgttcagcgaccagggagccctgcgttagctcggctagtcctggatctttatcatgcattagacggcgttaccctatatag

SEQ ID NO: 235430 - DNA, 3324 bp, Artificial Sequence
  Description of Artificial Sequence: Synthetic coding sequence
atggatggaaagaggagaccagggcctgggccaggggtccctcccaaacgggctcggggagggttatgggatgacgacgacgcacctcgcccaagtcagttcgaagaggatctagctctgatggaggaaatggaggctgaacatcgcctgcaggagcaggaggaagaggagttgcaatcggttcttgaaggcgtggccgacgggcaggtgcccccatcagccatcgatcccagatggctgcggcctaccccacctgcgttagatccacagactgagcccctgatctttcaacagctcgagattgatcactacgtgggtcccgctcagcctgtccctggtgggccacctcccagccgaggtagcgtccctgtgttgagagcattcggcgtcaccgacgaaggatttagtgtttgttgtcatattcatggctttgcaccttatttttacacgccagcccctccaggctttggccctgagcacatgggcgacttacagagagaactcaacctggccataagccgtgacagccggggtggccgagagctgaccgggccagcagttctcgcggtcgaactgtgttctcgggagagtatgtttgggtatcacggtcacggtcccagcccattcctccgcataacagtcgcccttcccagattggtggccccagcccgtcgacttctggaacagggcatcagagttgccggactgggcacaccaagcttcgctccctacgaggccaacgtagattttgaaattcggtttatggtggataccgatatcgtaggatgtaactggcttgagctccctgctggaaaatacgctctgagacttaaagagaaggcgactcagtgtcaattagaggcggatgttctctggtcggacgttgtgtcacatccacctgaaggaccttggcagcgcatcgcacctctgcgcgttctgtcctttgacattgagtgtgccggaagaaagggtatatttccagagcctgagagggatcccgttatccagatttgttcccttggccttagatggggcgaaccagaaccctttctgagactggccttgacactgcggccatgcgcaccaattctgggtgcaaaggtccagtcttatgaaaaagaagaagatctgctgcaggcttggtccacctttatacgcatcatggatcccgacgtgataactggatataacatccagaatttcgaccttccttatctgatatccagggctcagaccctgaaagtccagacatttccatttctgggccgagtggctggcctttgctcaaatatacgcgattcgtcctttcagtcaaagcaaaccggtaggagggacaccaaggtggtctcaatggtgggtcgggtgcagatggatatgctgcaagtgctgctgcgagaatacaaacttaggagttacaccctgaacgctgttagcttccactttctaggcgagcagaaggaggatgtccaacattcaatcattacggatctgcagaacggaaatgatcaaacccgtcggagactcgctgtgtattgcctgaaggatgcgtacctccctctgcgcctgttagagcgtttgatggttctagtcaatgccgtcgagatggcaagagtcaccggtgtgcccctttcatatctgctgtccagagggcagcaggtaaaagtcgtgtcccaactcctaagacaggcgatgcacgaagggctgctgatgccagtggtgaaaagcgaaggcggagaagactatacaggagctacagttatcgagcctctgaaaggctactacgacgttccaatcgctaccctcgacttttccagtctttatccatccatcatgatggcacacaacctgtgctatactactctgttgcgccctgggacagcccagaaattggggctgactgaggatcaattcatcagaacccctacgggcgatgagtttgttaagactagtgtacggaagggccttttgcctcagatcctggaaaaccttctcagcgctcgaaagagagcaaaagcggaattggcaaaggagaccgatccattacgacgtcaggtgctcgatggcaggcagctcgccctaaaagtgagcgctaactctgtgtatgggtttacaggggcacaggtaggcaaacttccttgtctggaaatctcacagagcgtcaccggctttgggcgacagatgattgaaaaaactaaacagctggtggagagcaaatataccgtcgagaatggctacagtacctccgccaaggtggtgtatggggacacagatagcgtaatgtgtcgctttggtgtgagtagtgtcgccgaagcaatggcccttgggagagaagcggctgattgggtgagtgggcatttcccctcgcccattaggctggagtttgagaaagtctattttccgtatttgctcatatctaagaaacgctatgcaggactgctgttctcaagtcggccagatgctcacgataggatggactgtaagggcctcgaggccgtgaggcgcgacaactgccccctggtggccaatctggttaccgcgtctttacgacgcttgttgatcgatcgggatcccgagggtgctgtggcccacgcccaggatgttatttctgatctcctctgcaaccggatcgatattagccaactcgttatcacgaaagagttaacacgcgcagcttcagattatgctggaaaacaggctcatgttgagctggccgagcggatgcgcaaacgcgatcctggatcggctccttctctgggggatcgggtaccatacgtgattatttcagctgccaagggtgtggccgcttatatgaagtcagaagatcccctgtttgtattggaacacagtctacctatcgatacccagtactacctggagcagcagctggctaagcccctgctgaggatctttgagccaattctgggggaaggcagggctgaggcggttctgttacgtggcgatcacacccggtgcaaaaccgtcttgaccggcaaggtaggaggcctgctcgcatttgcgaaaaggcgaaactgttgcatcggctgtaggaccgtattgtcccaccagggagctgtgtgcgagttctgccaaccacgggagtccgaactgtaccagaaagaggttagccaccttaatgcgttagaggagagattctctagactgtggacgcagtgtcagcgttgccaggggagtttgcatgaggatgtgatctgcacatctcgggactgccccatattttatatgcgtaagaaagtgcgtaaagatctcgaggaccaggagcagctcttgcgcaggtttggaccacctggaccggaagcatggtag

SEQ ID NO: 235431 - DNA, 1410 bp, Artificial Sequence
  Description of Artificial Sequence: Synthetic coding sequence
atgttcagcgagcaagcggctcagagagcccatacgctcctttcccctccatccgctaataatgctacttttgccagagttccggttgccacctatactaactcaagccagccattcaggctaggtgagaggtcctttagcaggcagtacgcacatatttacgctactcgcctcatccagatgcggccattcttggagaacagagcacagcagcactggggatccggcgtgggcgtcaaaaagctgtgcgaactgcaacccgaagaaaagtgttgcgtggttgggacactcttcaaggcgatgccgctgcagcctagtatcctccgggaagtcagtgaagagcataacctgctgccccaacctccacggagtaagtacatccatccggacgatgagcttgttctcgaggatgagcttcagagaataaaacttaaagggaccatagatgtatctaagctggtcacagggacagttctcgcagtgttcggttccgtgcgagatgacggtaagtttctcgtcgaggattactgcttcgccgacctggcacctcaaaaaccggctccccctctggacacagacaggtttgtgctgctggtatcaggtttgggcctgggcggaggcggtggggaatccctgctgggcacacagcttctagtagatgttgtgaccggacagcttggagatgagggcgagcaatgtagcgctgcccatgtctccagagtgatcctcgctggtaatttactgtctcatagcactcagagccgcgattcgataaataaagccaagtaccttaccaaaaaaacccaggccgcatcagttgaggctgtgaaaatgctggacgaaatcctgctgcagctgtccgcctctgtgcccgtcgacgtgatgcctggcgaattcgaccccactaactatactctgcctcaacaacctctgcatccctgtatgtttcctctagctactgcctatagcaccctgcagcttgtcaccaacccttatcaagccactatcgacggcgtccgattcctgggaacaagcgggcagaatgtctctgacatttttcggtacagtagcatggaggaccatctggaaattcttgagtggacacttagagtcagacacatctctccaacggccccagataccctaggatgctaccccttctacaaaacggatcccttcatctttccagagtgtccacatgtgtacttctgtggcaacacaccctccttcggctcgaaaatcattagggggccagaggaccagactgtgctgctggtcacggttcccgattttagcgctacgcagacagcttgcctcgtgaacctccgaagtctggcatgccagcctatttcattcagtggtttcggtgcggaggacgacgatctcgggggactcggccttggcccatag

SEQ ID NO: 235432 - DNA, 447 bp, Artificial Sequence
  Description of Artificial Sequence: Synthetic coding sequence
atgttcagtgagcaggctgcccagagagcgcatactctactgtcaccgcctagtgctaataatgcgacgttcgcaagggttcccgtggctacctacaccaattcatcccaaccctttagacttggggagcgaagcttcagccggcagtatgctcacatttatgccaccaggctgattcagatgcgaccctttctcgagaatcgagcccagcagcattgggggtcaggagtaggagtgaagaaactttgtgagctacagcccgaggagaagtgctgtgttgttgggactctgtttaaggccatgcccctgcagccctccatcttacgtgaggtttccgaagagcataacctcttgcctcagccacctcgatccaagtacatacaccccgatgacgagctggtcctggaggatgaactacagcgaatcaagctgaagggcacaatctag

SEQ ID NO: 235433 - DNA, 663 bp, Artificial Sequence
  Description of Artificial Sequence: Synthetic coding sequence
atgttttcagaacaggcagcgcagagggcacacactctcctgtctccaccttcggccaataacgcgacattcgctcgcgttccagtggccacctatactaattcttcccagccttttagactcggcgaacggtcatttagccgacagtatgcacatatctacgcaactaggttgatccagatgaggccatttctggagaaccgagcccagcaacactggggctctggtgtgggagttaaaaaattgtgtgagctgcagccagaagagaaatgttgcgttgtgggtacactgtttaaagctatgcccttgcaaccatctatactgcgggaggtgtctgaggagcataatttactgcctcagccccctcgctccaagtacattcacccggacgacgagttggtgctggaggacgagttgcaacgcattaagctgaaggggactatcgacgtgtcaaagctcgtaaccggcaccgtcctagccgtatttggctctgttcgtgatgatggtaagttcctggtggaggactattgctttgcagacctcgctccgcaaaagccagcccctcccttagacaccgaccgattcgttctactggttagtggcttagggctggggggagggggaggagaatccctattggggacacagttgctggtcgattag

SEQ ID NO: 235434 - DNA, 1410 bp, Artificial Sequence
  Description of Artificial Sequence: Synthetic coding sequence
atgttttctgagcaggcagcccagagggcacacactctcctgtcccctccgagcgccaacaacgcaacgttcgccagggttcctgtcgctacttatactaattcatctcagcctttcaggctcggtgaaaggagcttctcacgacagtacgctcacatttacgccactcggctcatccagatgcgaccctttctggagaatcgggctcagcagcactggggtagtggcgtgggggttaagaaactctgcgaacttcaaccagaagaaaaatgctgtgtggtcggtactctcttcaaggccatgccccttcagccatccattctgagggaagttagcgaggaacataaccttctcccccagccccctcgatcaaagtacattcatcccgacgatgaattggtgttggaagatgaactgcagcgcattaaactgaaaggcaccatcgacgtgtcgaagttggtgacgggtacagtactggcagtgtttgggtccgtccgggacgatggcaaatttttggtggaagattactgcttcgcggatctggctccccagaaacctgcgccacctctagatacagacagattcgtgctgctagtgtcaggactcgggttggggggtggtggcggtgagagcctccttggtacccagctgttggtcgatgttgtgacgggccagctcggcgatgagggggagcagtgcagcgcggctcatgtatctcgggtgatcctcgccggaaatcttttgtcccattcaacccagagccgggactccatcaacaaagcgaaatacttgaccaaaaaaacacaagctgccagcgtcgaagccgtcaagatgttagacgaaatcctcctacagctgagcgcaagcgtgccagtggacgtcatgcctggtgaatttgaccctacgaattacaccctgccccaacagccactgcacccatgcatgttccccttagctacggcgtactcaactctccagttagtgaccaacccataccaggctaccatcgacggggtgagattccttggcacttctggacagaatgtttcggacatcttccggtatagtagtatggaggaccaccttgaaattcttgagtggaccttgcgcgtcaggcacatctcacccacagccccagacacactcggctgttacccattttataaaaccgatcccttcattttcccggaatgccctcatgtgtacttttgcggtaatacacctagctttgggtccaaaattattcgtggtcccgaggatcaaaccgtccttctggtgaccgtgcctgatttctcagccacacagacggcctgtcttgtaaatctgagaagcttggcatgccagcccatctctttcagcgggttcggcgctgaagacgatgatcttggcggactgggtttgggtccctag

SEQ ID NO: 235435 - DNA, 468 bp, Artificial Sequence
  Description of Artificial Sequence: Synthetic coding sequence
atgttcagcgagcaggccgcacaacgcgcacacactctccttagccccccatcagctaataacgccaccttcgcacgcgtgccagtcgctacctacactaacagcagtcaaccttttcgcttaggagaaagaagtttctcacggcagtatgctcacatttacgccacgcggttaatccagatgcggccatttctggaaaacagggcacaacagcattggggctctggggtaggtgtgaaaaaactgtgcgagctacagcccgaggaaaagtgttgtgtggtaggaactctgtttaaggccatgcccctgcaaccgtctatactgagagaagtgtctgaggaacataaccttctgccacagcctcctcgcagtaagtatatacaccctgatgacgagctcgttttggaggatgaattacaacgcatcaagctgaagggaaccattgatgtgagcaaactggtgacctag

SEQ ID NO: 235436 - DNA, 771 bp, Artificial Sequence
  Description of Artificial Sequence: Synthetic coding sequence
atgtttccagtgctgccaggctctcatttgctgctgaataaccctgcacttgaatttattaaatacgtgtgcaaagttttaagcttggatacaaatatcaccaaccaggtgaataagttgaatcgggatctgctgaggcttgtggacgtgggagagttttctgaggaggcacaattccgcgacccctgtaggagctacgtgcttcccgaggtgatctgtaggtcttgcaacttctgtcgggatctggatctttgtaaagattcttcattctcagaagacggggctgttttaccccagtggctctgttctaattgccaggctccttacgatagcagtgcgatcgaaatgaccttggtcgaggtactgcagaagaaactaatggcttttacccttcaggacttgaaagaggcagatacccccaaatgcgaggagaaggagagacgaaagagagagctgcattcttccgctacaggaagatcctgtcgcggtgccagtgaacagcgcttgggcgatgcaccctcttgcagagtcgtggtacacggggtgcaagcttgtaggatggaaggtgtctgtctcaagtgccgtggcgtgaaagagaccagcatgccagtttattgcagttgcgcgggagacttcgccctgaccattcacactcaggtttttatggaacagatcggcatcttcaggaacatcgctcaacactatggaatgtcctatctactcgaaacactagagtggctgttgcagaaaaatccccagttgggccactag

SEQ ID NO: 235437 - DNA, 6860 bp, Artificial Sequence
  Description of Artificial Sequence: Synthetic coding sequence
atgagcctgcgctcaggtggacgacgcagggccgatccaggtgcagacggggaggcctcccgcgatgacggcgctaccagttccgtgagcgctctgaagcgactagagcgttcccagtggaccgacaagatggatctgaggtttggctttgagcggttgaaagagcccggtgagaaaaccgggtggttgattaacatgcatccgaccgagattctagatgaggataagagactcggtagcgctgttgattactacttcattcaagatgacggtagtcggtttaaagtggccctcccatacaagccgtatttttacatagctactagaaaaggctgtgagagagaggtgtcgtcattcctttctaagaaatttcaaggcaaaattgccaaggttgagacagtacctaaggaggacctagatcttcccaaccacctcgtcggcttgaagcggaactatatccgcttaagtttccataccgtggaggacctggttaaggtgagaaaagagataagtccggctgtaaaaaagaaccgagagcaggatcacgcatcggacgcttataccgccctgctgtcttctgtcctgcagcggggaggggtgatcaccgacgaggaggaaaccagcaaaaagattgccgaccagcttgacaacatcgtggatatgcgggaatacgacgtaccgtatcacattcgcttgagtatcgatctgaagatccatgtcgcacattggtacaatgttagataccgaggaaatgcttttcccgttgagattactcgcagagacgatctcgtggaacgcccagaccccgttgtgctggcgttcgatatcgagaccacgaagctgccccttaagtttccagatgcagagactgatcagatcatgatgatatcttacatgattgatggccagggctacctcatcactaaccgcgagattgtatccgaagatatcgaggacttcgaattcaccccgaaacctgaatatgagggaccattctgtgtgttcaatgaacctgacgaagcacatctcatccagaggtggttcgaacatgtacaggagaccaaacccactattatggtgacctacaatggagatttcttcgattggccgttcgtggaggcgcgtgccgcagtacatggattatctatgcagcaggaaataggcttccagaaggattctcagggtgagtataaagcaccccagtgcattcatatggattgcttgcgctgggtgaagcgggatagttaccttccagtgggctcccacaacctcaaagctgctgctaaagcgaaactgggatatgatcctgtagaattagatcctgaggacatgtgcagaatggccacagagcaacctcagactctggcaacctactccgtttccgatgccgtcgctacgtactatctgtacatgaagtacgtgcacccttttatcttcgcattatgtacaatcatcccgatggagccggacgaagtcctgagaaaagggagcggcacattgtgtgaggccctcttaatggtgcaagctttccatgcaaatatcatcttccctaacaaacaagagcaagagttcaacaagttaaccgatgatggtcatgtgcttgattccgaaacctatgtcgggggacatgtggaagcactcgagagtggggtttttcgcagcgacattccgtgtcgttttcgcatgaatccagctgcctttgactttctccttcagcgggttgagaagacattgcgtcatgctctggaggaggaggaaaaggtgcctgttgaacaggtgacgaatttcgaagaagtctgtgatgagattaagtctaaacttgcctcccttaaggacgtgccttctcgaattgaatgcccactgatctatcatctggacgtcggggcaatgtaccccaatataatcctcactaacaggctgcagccatcagccatggttgacgaagctacttgcgctgcctgcgatttcaataagcccggtgccaattgccagcgaaaaatggcgtggcaatggagaggcgaatttatgccggcttctcggagcgagtaccatcgtattcaacaccaactcgaaagcgagaagttcccgccactgttccccgaaggcccagctcgggcattccacgaactgagcagggaggagcaagcgaagtacgagaagcggagactggccgattactgccgaaaagcatataagaagatccacattaccaaggtcgaagagcgccttactaccatctgccagagggagaactctttttacgtcgataccgttcgggctttccgcgaccgtcggtacgaattcaagggattgcacaaagtctggaaaaaaaaactcagtgctgccgttgaagtcggagatgcagccgaggtgaaaagatgcaaaaatatggaagtgctgtacgactccctgcagcttgcacacaaatgtattctgaattcattctatgggtacgtgatgaggaagggagctagatggtatagcatggaaatggctgggatcgtttgtttcaccggggctaacatcattacgcaggctagagagcttattgaacaaatagggcgacccctggagctcgataccgatggcatctggtgcgtgctccctaattcgtttcctgagaattttgtgttcaagaccacaaatgttaagaaaccaaaagtcaccatttcttaccctggcgcaatgcttaatattatggtcaaggaagggttcacaaacgaccagtaccaggagctcgccgaaccctccagcttgacttacgtgacaagatctgagaacagcatcttttttgaggttgatggaccttaccttgctatgattctcccagccagcaaggaagaagggaagaagctcaagaaacgttacgcagtttttaatgaggatggatcactggcagaactgaaaggattcgaggtgaagcgtcgcggtgaattgcaactgatcaagatcttccagtcctctgtgtttgaagcctttcttaagggaagcacgctggaagaggtttatgggtctgtggctaaagtcgccgattattggttggatgttctgtattcaaaagcggctaacatgccggatagcgagctctttgaactaatctccgaaaacaggtccatgtcacgtaagttagaagattacggggaacagaaatcaacatccatcagcactgcgaaaagactcgctgagtttctgggtgaccagatggtgaaggatgccggactgtcgtgcaggtacattatctccagaaagcctgagggctctcccgtgactgagcgggctatacctctggcgattttccaagcagagcctactgtgagaaagcactttctgcggaaatggctgaagtcttcctctcttcaagatttcgacatcagagcaatcttagattgggactattacatcgagaggctgggctccgccatccagaagattatcaccatcccggctgcactacagcaggtcaaaaatcctgtgcctcgggtaaaacacccggattggctgcacaagaagctgttggaaaaaaatgatgtgtataagcaaaagaagatttcagagctgttcacgctcgaagggaggcgccaggtgactatggctgaggccagcgaggattccccacggccttcagccccagacatggaggacttcggtctggtgaagttaccccatcctgcggctccagtgaccgtgaaacgcaaaagagtgctgtgggagagccaagaagaatcccaggatcttacgccaactgtcccttggcaggaaatattaggccaaccacctgcattaggcacatcacaggaggaatggctggtctggctcaggtttcacaaaaagaaatggcagcttcaagcccgacagaggctggctcggagaaaaagacagcgactggaatccgccgaaggagttctgcgacccggagcaatacgcgacggccctgctacaggactggggagcttcctgcgccgtacagcccgatcaattctggaccttccatggcagatcgttcagatctctgagacctcccaggccggactgtttcgactttgggccctggtcgggagcgatttgcattgtataaggctctctatcccacgggtgttctacgtcaaccaacgcgtggccaaggccgaggaaggagcttcttaccgaaaagtgaatcgagtgttacctaggtccaacatggtttataatctgtatgaatattctgtacctgaggacatgtatcaggaacatattaacgaaatcaatgccgagctctccgcccctgatatagaaggcgtgtacgaaacccaggtgcccctgttatttcgggcactggttcacttagggtgcgtctgcgtggtgaacaaacagctagtaagacacctctctggatgggaagcggaaacatttgcactggaacacctcgagatgcgcagcctggctcagttttcatacctggaacctggatctatccgccacatttacctatatcaccacgcccaggcccataaggctctattcggaatattcatcccaagtcaacgaagggcctctgtctttgtgctcgatacggtgaggtctaatcagatgcctagcctgggtgcactgtactcagccgagcacgggctgttgttggaaaaagtcgggcctgagctgctcccgccacccaaacacacgttcgaggtccgggctgagacagacctcaagaccatctgccgggctattcaaagatttctgctagcgtataaggaggagcggagaggtcctactctcatcgcagtgcagtcctcctgggagctcaaacgtcttgctagcgagatccctgtactggaagagtttcctctcgtcccgatatgcgttgccgataagatcaattatggcgtcctagattggcaacgccatggcgctcggcgaatgatccgccactacctcaatcttgacacctgccttagccaggcctttgaaatgtccagatatttccacatacctatcggaaatcttcccgaggatatctctacctttggttctgatctcttcttcgccagacatctgcagaggcacaatcatctcttatggctgagcccgactgcaagaccagacctagggggaaaagaagccgacgacaactgtctcgtgatggagtttgatgaccaggcaacggttgaaataaacagctcaggctgctactctaccgtatgcgttgaacttgatctgcagaacctggccgttaatactatactgcagtctcaccatgtgaatgatatggagggggcagactctatgggaatcagcttcgatgtgatccagcaggcctctttggaggatatgattactggcggacaggctgctagcgcccctgccagctatgacgagactgctctctgctctaacacgtttcgaatcctcaagagtatggtcgtcggatgggtgaaggaaatcacacagtatcacaatatttatgccgacaatcaagtcatgcacttttaccggtggctccggtcgccatccagtctgcttcacgaccctgcactccaccgtacgctgcataacatgatgaagaaactgttcttgcagctcattgccgagttcaagaggctcggctctagcgtcatctacgcaaatttcaacagaatcattctctgtaccaagaaacggagagtggaggatgctattgcctacgtggaatacattacaagctccatccattctaaagagacattccattcacttaccatttctttcagcaggtgttgggagttcttgttatggatggaccctagcaactacggtggcatcaaaggaaaggtgtcaagccggatccactgtggcctgcaggactcccagaaggctggcggagccgaggacgagcaagaaaatgaggacgacgaggaggagagagacggggaagaggaggaggaggccgaagagagcaatgtggaggacctcctcgagaataattggaacatacttcaattcctgccccaggcggcatcctgtcagaattattttcttatgatcgtctcagcctacattgtggccgtgtaccattgcatgaaagatgggctgcggcgaagtgctcctgggagtaccccagtgagacggcgaggcgcttctcagctctctcaggaggcagagggagccgtgggagcgcttccgggaatgatcaccttttctcaggattatgtcgccaatgagctgactcagagctttttcaccattactcagaagatacagaagaaagttactggcagcaggaatagtacggagctgagcgaaatgttccctgtcttgcctggaagtcatttgctgttaaataacccagctctcgagtttattaagtatgtgtgtaaggtgctgagcctggatacaaacattactaatcaggttaataaattaaaccgggacctgctgaggctggtggatgtgggcgagttttctgaggaagcccagtttcgcgatccatgccgctcttatgtgttgcccgaggtgatctgcaggagttgcaacttctgtcgggatctcgacctgtgcaaagattcttcttttagcgaggatggcgcagtactcccccagtggctatgtagcaattgtcaggcaccctatgactcatcagcgattgaaatgactctggtcgaggtccttcaaaaaaaactcatggcctttaccctgcaagacttggtgtgcctgaaatgtcggggtgtaaaggagacttctatgccagtgtattgttcttgcgccggtgacttcgcactgaccatccatacgcaggtattcatggagcagattgggatctttaggaacatagcacaacactatgggatgtcctacctcttggagactctcgagtggctgctgcagaaaaaccctcagctgggacacta

SEQ ID NO: 235438 - DNA, 3330 bp, Artificial Sequence
  Description of Artificial Sequence: Synthetic coding sequence
atgcacccgacagagatactggacgaagacaaacggctgggctccgccgtcgactactattttattcaggacgatggtagtagattcaaagtggccctgccctacaagccttacttctatatcgccactaggaaagggtgcgaacgtgaggtctcctccttcctgagcaagaagtttcagggcaagatcgctaaggtagaaacagtcccaaaagaggatcttgatctacctaatcacctagtgggcctgaaacgaaattacatcaggctcagcttccacacagtcgaggatctcgttaaggttagaaaggagattagtcccgctgtgaaaaagaatagggaacaggaccacgcttctgacgcgtataccgcgctactctccagcgtcctgcagaggggtggtgtcattaccgacgaagaagagacgagtaagaagatcgcggatcagcttgataatatagtggacatgagagagtacgatgttccctaccacatacggttgagcatcgacctcaaaatacatgtggcccactggtacaacgtgcgctacagaggaaatgcttttcctgtggagatcaccaggcgagacgacctcgtggagagacccgatcctgtcgttctggccttcgatatcgaaactaccaagctacctctcaagttcccagacgccgagacagaccagatcatgatgatcagttatatgatcgatggccagggttacttgatcaccaatcgggagatagttagcgaggatattgaggattttgagttcacaccaaaacccgaatacgaggggcctttttgtgtcttcaacgagcctgacgaggctcacttgattcagcgttggtttgagcatgtgcaggaaactaagcctactattatggttacttacaacggtgacttcttcgactggcccttcgtcgaggccagggcggctgtgcacgggttgtccatgcagcaggagatcggttttcaaaaagacagtcaaggtgagtataaagctccccagtgtattcatatggactgtttgaggtgggtgaagcgtgactcctacctccccgttggctctcataaccttaaagccgctgctaaagccaaattaggttatgaccccgtggaactggacccggaggacatgtgtaggatggcaacagagcaaccacagacattagcaacctactcggttagcgacgcggtggctacctattacctgtacatgaaatatgtccacccattcatctttgccctgtgcacgattattccaatggagcccgacgaggtcctaagaaaggggagcggcaccctctgtgaggcgctgttaatggttcaggcatttcatgccaacatcatctttcctaataagcaggagcaagagtttaacaagctgacagacgatggccacgttcttgactctgaaacatacgtgggtggtcatgtggaagccctggagtccggggtgttccgtagcgacattccttgcagattccggatgaaccccgcagcatttgatttcctgttacagcgtgtggagaagacgctacggcacgctctggaggaggaggagaaggtgcccgtggaacaagtaaccaacttcgaagaagtctgcgatgaaatcaagtctaaactggcctccttgaaggatgtgcctagtagaatcgagtgtccgctaatttaccacttagacgtgggagccatgtatccaaatataatcctgaccaataggttgcaaccgagtgctatggtggacgaggccacatgcgctgcatgcgactttaacaagcccggagccaactgccaaagaaagatggcgtggcaatggcgtggggagttcatgcccgcttcgaggagcgagtaccatagaatccagcaccagctggagtccgaaaagttcccacctttattccccgaaggaccggcaagagctttccatgagctgagtcgtgaagaacaggcgaagtatgagaaacggagattggcagactactgcaggaaggcttataagaagattcatatcacgaaggttgaggaaaggttgacaacaatctgtcagagagagaactcattctacgtcgacacagtgcgcgcatttagagacagacggtatgaattcaaaggattgcacaaggtttggaaaaaaaagttgagcgccgctgtagaagtgggtgatgccgcagaagtgaaacgctgcaaaaacatggaggttctatatgacagcctgcaactcgcccacaaatgcattcttaactccttctacggatatgtgatgcggaagggggcacggtggtactctatggagatggccggtatcgtctgttttaccggcgcaaacatcatcacgcaggctagggagctgattgagcagattggacgccctttggaactcgacacggatggtatttggtgcgtccttcccaattcctttccagagaactttgtattcaaaaccaccaatgtcaaaaagccgaaggtgaccatctcatacccaggcgcaatgctaaacataatggttaaagaagggtttacgaatgatcagtaccaggaactggccgaaccatcctcacttacttacgtgacgcgctccgagaattcaatctttttcgaagtggatggaccgtacctggcgatgatactaccggcatcaaaagaagaggggaaaaagctgaaaaaacggtatgccgttttcaacgaagacggttcattggccgagctgaaaggctttgaggtgaaaaggcgcggagaactccagctcatcaaaatcttccagtcttccgtgtttgaggcattcctcaaaggcagcacactggaggaagtgtatggcagtgtggccaaggtggccgattattggctggacgtgctgtattccaaagcggctaacatgccagactcagagctattcgaactgatctcagagaaccgaagtatgtctagaaagctggaggactatggcgaacagaaatctacaagcatcagcacagcgaagcgcctggcagagtttctcggggaccagatggtcaaggacgctggcctcagctgtaggtacattatatcccgcaagcccgaaggaagccctgtgaccgaacgggcaatcccattagccatcttccaggcggaacccactgtgcgtaagcacttccttcgaaaatggctgaagtcctcgtctctccaggacttcgacataagggctattctggactgggactactacattgaaaggctgggtagtgcgatccagaaaatcatcactatccctgctgcacttcaacaggttaaaaacccagtgcctcgtgtcaagcacccagattggttacacaaaaccgccggagaggaatag

SEQ ID NO: 235439 - DNA, 1491 bp, Artificial Sequence
  Description of Artificial Sequence: Synthetic coding sequence
atggagggcatccttaaaagcatggtcgtgggatgggtgaaagagatcacccagtatcataatatttatgctgataaccaggtgatgcatttttaccgttggctgcgctcccccagcagtttgctgcatgaccccgctctacaccgtactctgcacaacatgatgaaaaagttattcctgcaactcatcgcagagttcaaacgacttggatcctctgtgatttacgctaacttcaatcggattatcttatgcactaaaaagaggcgtgtagaagacgcaatcgcgtacgtggagtacatcacctcaagtattcacagcaaagaaacatttcattctctgacaatttctttttccagatgctgggagtttttgctctggatggatccttcaaactacgggggtattaagggaaaggtgtctagtcgaatccactgtggcctccaggattcccagaaggcgggtggagcagaagatgaacaggagaatgaggacgacgaagaagagagagatggagaagaagaggaggaggcggaagaatccaacgtggaggatcttttagaaaacaattggaatattctgcagtttctgcctcaggccgcatcttgtcaaaattactttttgatgatagtctctgcctatatcgttgcagtgtatcactgtatgaaggacggcctgcgtagaagtgctccaggctcgaccccggtccgaagacgtggagcaagccagttgtcgcaggaggctgaaggcgctgtgggggctctccccggtatgatcactttttctcaggattatgttgccaacgagctgactcaatcatttttcactatcacccagaagatccagaaaaaagttacaggctctcgcaactcaacggaactcagtgagatgttccctgtcctccctggcagtcacctcctgttaaacaatcccgcactggagtttatcaagtatgtgtgtaaagtgctatcactagataccaatattacaaatcaggtgaacaagctgaatagggatctcctacgcttagttgatgttggagagttcagtgaagaagcccagttccgtgatccctgccggtcatacgtgctgccagaggtcatttgccgcagttgtaacttctgtagggatctggacctttgcaaggattccagcttttcagaggacggcgctgtgctgccacagtggctctgtagcaattgccaagccccttatgactcatcagccatcgagatgacactggtggaggtcctgcagaaaaaactgatggcgttcaccctacaagacttagtctgcctcaagtgcaggggcgtgaaggaaacgtcaatgccggtatactgctcttgtgcaggtgactttgccctgaccattcatacgcaggtgtttatggaacaaattggtatttttcgaaatatcgctcagcattatggcatgagctacctattagaaaccttggaatggcttttgcaaaagaatcctcaactgggacattag

SEQ ID NO: 235440 - DNA, 6893 bp, Artificial Sequence
  Description of Artificial Sequence: Synthetic coding sequence
atgtccagacctctgggccttaaaagctttccccgacacaagcaggcccctctgcctttatctctcacctttcacggctgccttctattaagacgtgatgacggtgcaactagctcagtgtctgccctgaaaagactggagcgtagccagtggaccgataaaatggacttaagatttggcttcgaacgcctgaaagaacccggtgaaaaaactggttggcttataaacatgcatccgaccgagatcttggatgaggataagcggctcggaagcgcagttgattattattttatccaagacgatggttcacggttcaaggtggcactgccatacaaaccttatttctatatcgcaacaaggaagggttgtgagcgagaggtctcaagctttctttcgaagaaattccagggaaagatcgcaaaggtcgaaactgtgccaaaggaagatcttgacctccctaaccatctagtggggctcaagaggaattacattcgcctgagcttccataccgttgaggaccttgtgaaggtacgtaaggaaatttctcccgcagtgaagaagaatagagagcaagatcatgcttctgatgcgtatacagctttgctgtccagcgtgttgcaacgaggtggagtgatcaccgatgaggaggagacaagtaaaaagattgcagatcagctggacaatatcgtggatatgagagagtacgatgtaccctaccacatacgcctgagcatcgacctgaaaattcacgtcgcccactggtacaatgtgcgatatagggggaacgccttccctgtggaaattacccgccgtgatgatctagtggagcgtcccgatcccgtggtacttgcttttgatatcgaaaccacaaagctacctctgaaattcccagacgccgagaccgatcagattatgatgatttcttatatgatagacggccaggggtatctgatcacgaatagggaaattgtatcagaggacatcgaagacttcgaatttaccccgaaacccgagtacgaagggccattctgtgtcttcaatgaaccagatgaagcgcatctgattcaacgctggttcgagcatgtgcaagaaacaaaaccaaccattatggtgacttacaatggggacttttttgactggccatttgttgaggcgagagcagctgtgcatggcctgtccatgcaacaagagattggctttcagaaggatagtcaaggtgaatataaggcccctcagtgcatccacatggactgcctgagatgggtgaagcgggattcctatttgcctgtcgggtcacacaacctgaaggccgctgctaaggccaagctcgggtatgatcccgtggaactggaccctgaggatatgtgtcgtatggccacagaacagcctcaaacactggctacctactcagttagcgacgcagtagcgacatactatttgtacatgaagtacgttcacccgttcatctttgccctctgcactatcattcctatggagcccgacgaggtattgcgcaaaggtagcggcaccctgtgtgaggccctgcttatggtgcaggcctttcatgccaatatcattttcccaaacaagcaggaacaagagtttaacaagctgacagatgatgggcacgtgctggatagcgaaacatatgtcggcggacacgttgaagctttggagtccggtgtgtttagatcggatataccttgcagattccgaatgaacccagccgcattcgatttcctcctccagagggttgagaagacactgaggcatgctctagaggaagaagagaaggtccctgttgagcaggtgacaaatttcgaagaggtttgcgatgaaattaagtccaagctggccagcctgaaagacgtgccctctcgtatcgaatgccccttgatctatcatctcgacgtgggtgccatgtaccccaacattatcctgaccaaccgactgcagcccagtgcaatggtggacgaggctacatgtgccgcttgtgatttcaacaagcccggagccaattgccagaggaaaatggcttggcagtggagaggtgagttcatgccggcatcccggtccgagtatcataggatccagcaccagttagaaagcgagaaattcccccctttgtttccggagggacccgctcgcgctttccacgagctgtctagggaggagcaggctaaatacgagaaacgacgcctggcggactattgtcgcaaggcttataaaaagatccatatcaccaaggtagaggagaggcttacaactatatgtcagcgggaaaattctttctacgtggataccgtgcgggcatttcgagatcgaaggtacgaattcaagggtctgcacaaagtgtggaaaaagaagcttagtgccgcagtcgaggtcggtgacgccgctgaagtgaagagatgtaaaaatatggaagtgctgtatgactcactgcagttggcacacaagtgcattctgaattctttttacggttatgtaatgcgtaagggagctcgttggtatagcatggagatggccggtattgtgtgtttcacgggcgcaaacattatcacccaggccagagagctaatagaacagatcgggagaccgctggagctggacacggacggcatttggtgcgtgcttcccaactcattccctgaaaattttgtgtttaagaccactaacgtgaaaaagccgaaggttaccatatcctaccctggggctatgctgaacatcatggtcaaagagggtttcacaaacgatcagtatcaggagctggccgaacccagctccctgacctacgtgacgaggtccgagaactctatcttcttcgaggtcgatggaccgtatttggccatgattttgcctgctagtaaagaagaaggaaagaaactgaaaaagaggtacgcggtctttaatgaggacggcagcctcgctgaactgaagggctttgaggtgaagcgacgaggcgaattgcagctgatcaaaatttttcagtccagcgtgttcgaagcctttctcaaaggcagcactttggaggaagtttatggtagtgtggccaaggtggctgactattggcttgatgtgttgtattctaaggcagcaaatatgcctgacagcgaactgttcgagcttatctcagaaaatcgcagcatgtcccgaaaactggaagactatggtgaacagaaatccaccagcatatcgactgcaaagagacttgcggagttcctcggggatcagatggtcaaagacgctggattaagttgccgatacattatctcccgaaagcccgagggatcccctgtcacagaaagggccatccccctggctatcttccaagccgaaccgacggtgagaaaacatttcctgcgcaaatggctcaagtcaagctccttgcaagactttgacatccgggctatactagactgggattattacatcgagcggcttggttctgcaatacagaagattattactattcctgccgcactgcagcaggtgaagaacccagtgcccagggtgaaacaccccgactggttacacaagaaactcctggaaaaaaacgacgtttataagcagaagaaaatcagtgaactgtttaccttagaaggcagaagacaggttactatggcagaggccagcgaggattccccgaggccatcagcccctgacatggaggactttgggctcgttaaattgccacacccagccgctcctgtcactgtgaaacggaaacgtgttctgtgggaaagccaggaggagtctcaggatcttacaccgactgtaccctggcaagaaatcttagggcaaccaccggctctcggcacctcccaagaagagtggctggtttggctgaggttccataagaaaaagtggcaactgcaggcccgtcagcggctggccagacggaaaagacagcgccttgagtcggcagaaggggtattgcgccctggggctatacgcgacggccctgctactggcctgggttccttcctccgcagaacagcaaggtcgatactcgacctaccgtggcagatcgtgcagatatcagaaaccagccaagcagggctgtttaggttgtgggctctcgtgggatctgatttgcactgtattcgcctgagcattcctcgcgttttctacgtgaatcagcgggttgccaaggccgaagaaggagcttcctacagaaaagtaaatagggttctccccagaagcaacatggtgtacaacctctacgaatactctgtgccagaagacatgtaccaggagcacatcaacgagataaatgccgagctgtcagctcccgacatcgaaggagtgtatgagacacaggtgcccctgttgttccgggcattggtgcatctcggatgcgtgtgtgtcgtaaacaaacagctcgttagacatcttagtggctgggaagcggagacatttgctttagagcatctggagatgcgctcgttagcccagttctcctatctagaacccggatccatcagacacatttacctgtatcaccacgcccaggcccataaagcgctgttcggcatttttatccccagtcagaggcgcgcatctgttttcgtcttggatactgtgcggtcaaatcagatgccaagcctaggcgcactttactcagccgaacacggactcctgctggaaaaggttggcccagagctgctgcctcctcccaagcacacatttgaagtgagagctgagacagatcttaagaccatctgtcgggctattcagcggtttttacttgcttacaaagaggaacggagggggccaacattgatcgccgttcagagttcatgggaattaaagaggctcgcttcggagattcccgtgttggaggagttcccactggtgcctatctgtgtggcagacaagattaattacggagtcttggactggcagcgacatggagcccgtcgtatgatccggcactacctcaatttagatacctgtctaagccaggccttcgagatgtccagatatttccatatccccatcggcaacctgcccgaagatatctcaacatttggcagcgatctctttttcgcgcgtcatctgcagagacacaatcacctcctgtggttatcaccaactgctcgtccggatttgggcggaaaagaagccgatgataactgtcttgttatggaattcgatgaccaagccactgtcgagataaattcaagtggctgttactcaactgtgtgcgtggagctcgacctccagaacctagctgtgaacaccatcttgcagtcgcaccatgtcaacgacatggaaggcgctgactctatggggatctcttttgacgtgatccagcaggctagcctcgaggatatgatcaccgggggacaggctgcctccgccccagcttcttacgacgaaactgcactttgtagtaatacatttaggatactgaaatccatggtggtgggctgggttaaggaaatcacacagtatcacaacatctacgccgataaccaggtgatgcacttttacagatggctgagatccccaagctccttgctgcacgatccagccttgcataggaccttgcacaatatgatgaaaaagcttttcttgcagctgattgcagaatttaaacggcttggatcttccgtcatctatgccaacttcaaccgtattattctgtgtactaagaagcgaagggttgaggatgccatcgcttacgtggaatatatcactagttcaatccacagtaaagagactttccacagcctgaccatcagcttctctagatgctgggagttcctgctgtggatggacccctctaattacggcggaataaagggcaaggtttccagcaggattcattgcggcctccaggacagccagaaagctggtggcgcagaggatgagcaggaaaatgaggacgacgaagaggagcgagacggcgaagaagaagaagaggcagaagagtctaatgtggaggatctgctggaaaacaattggaatattctacagttccttccccaagcagcatcttgccaaaactacttcctgatgatagtttctgcttacattgtggccgtgtaccactgtatgaaggatggtctgcgacgcagcgccccagggtcgactcccgtgagacggagaggcgcttcgcagctgtcccaggaggccgagggagccgttggggcacttccgggtatgatcacttttagccaggattacgtggctaatgagcttacccagagcttcttcacaatcacgcagaaaattcaaaagaaggtgacaggctccagaaattccactgagctgtccgaaatgttcccagtgctgccgggaagccacctgctcttgaacaatccagctctggaattcatcaagtacgtgtgtaaagtgctcagcctggatacgaatattacaaatcaggtgaataaactgaaccgcgacctgctgcgccttgtcgatgtaggagagttcagtgaagaagcccagttcagggacccctgcagatcttacgtcctgccagaagtaatttgcagatcttgtaacttttgtagagatctcgatttatgtaaggacagctcattcagtgaggatggtgccgtgctccctcagtggctgtgctccaactgccaggcaccctatgacagcagcgccatcgaaatgactctggtcgaggtgttgcagaagaagctgatggcgttcacgttgcaagacctggtgtgcttgaagtgtagaggcgtcaaagagaccagtatgcctgtgtactgtagctgtgccggagactttgcgttgactatccacacacaagtcttcatggagcagatcggaatcttccgtaatatagcccagcactacggtatgtcctatctgctcgaaaccttggagtggctgcttcagaaaaatcctcaactcggccacta

SEQ ID NO: 235441 - DNA, 6779 bp, Artificial Sequence
  Description of Artificial Sequence: Synthetic coding sequence
atgagcctgcggtcagggggacgtcgaagggccgatcctggcgctgatggcgaggcaagtcgggacgacggagctaccagcagtgtgtctgccctaaagaggctcgagcgcagccagtggaccgataaaatggacctgcggttcggttttgagaggttgaaggagcccggagaaaaaaccggatggctaatcaatatgcatcctgtcgctctaccatacaagccatacttctacatcgccacgcggaaaggttgcgaacgggaagtgtctagttttctctcaaagaaatttcagggcaagatagctaaagtcgaaacagtaccgaaggaggatcttgacctcccgaatcacctggtaggcctcaagagaaactacatacgccttagcttccatactgtggaggacctcgtcaaggttaggaaagagatctcacctgcagttaagaaaaatcgggagcaggatcacgcttcagatgcctacactgccctcctcagcagtgtgctgcagaggggaggggtaatcacggacgaagaagagacctccaagaagatcgctgaccaactggacaacatcgttgacatgcgggagtatgacgtgccttaccatatccgactatcaattgaccttaagatccatgtagcccactggtacaacgtgaggtacagagggaatgccttcccagttgagattacacggcgagatgatttggtagagcgtcccgacccagtggttttagcatttgatattgaaaccacgaagttgccactgaagttcccagatgcggaaacagatcagattatgatgatcagctatatgattgacggtcagggatacttaataaccaatcgcgagatcgtaagcgaggacatagaggacttcgagttcacccccaagcctgaatatgagggtccattctgcgtttttaatgagcccgatgaagcccacctgatccagaggtggtttgaacacgtgcaggaaaccaaacctaccatcatggtcacctataatggtgattttttcgattggccctttgtcgaagccagggctgccgtgcacggtctcagtatgcagcaggaaataggttttcaaaaagactctcagggagagtacaaagcacctcaatgtatacacatggattgtcttcgatgggttaaacgcgactcatacctccccgtggggagccataatcttaaagctgccgctaaggccaagctgggctatgatcccgtggagctggacccagaggacatgtgtaggatggctacggaacagcctcagacactcgccacctattcagtgtccgacgcggtcgcaacttattatctgtatatgaagtatgtccatccgtttatcttcgccctctgtacaataatccctatggagccggatgaggttctgagaaagggaagtggaacgctgtgcgaggccctcctcatggtccaggcattccacgcaaatatcattttccccaacaagcaagaacaggagttcaataagctcacagatgatggacacgtgttggactcagaaacttacgtcgggggacacgtggaggctctggagtctggcgtgtttagatcagatatcccctgccggttcagaatgaacccagcagcgttcgatttccttctgcagcgagtagagaaaaccttaaggcatgccctggaggaggaggagaaggtgccagtggagcaggttaccaattttgaggaggtctgcgatgaaattaagtcgaaactggcctcccttaaggacgttccatctcgaatcgagtgtccactcatctaccaccttgacgttggcgcaatgtaccccaacattatattaaccaaccgattgcagccgtcggctatggtagacgaggcaacatgtgccgcttgcgatttcaataaaccaggggctaattgtcaaaggaagatggcttggcagtggcggggagagttcatgccagcatcgcggagtgaataccaccgtattcagcatcagttggaatctgaaaagtttccacccctgtttcctgaaggacccgcacgggcttttcacgagctgagtcgcgaagagcaggcgaaatatgagaaacgcagactcgccgattactgcagaaaggcttacaagaaaatacatatcaccaaggtggaagagcgcttgacaaccatatgtcagcgcgaaaactccttctacgtggacacggtacgcgcttttcgcgaccggagatatgaatttaagggactgcacaaggtctggaagaagaagctctccgccgcagtggaagtcggggacgctgccgaggtcaagaggtgtaagaatatggaagttctctacgactcactccagctcgcgcacaagtgcatcctgaacagcttttacggctatgtcatgcgcaagggcgcacgctggtatagtatggagatggctggcatagtgtgctttacaggagcaaacatcattacccaggcccgtgagttgattgagcaaatcggccgtccactggagctggataccgacggaatctggtgtgtactacctaattcattccctgaaaatttcgtttttaagactaccaacgttaagaagcctaaggtgaccattagctaccctggggctatgctgaatattatggtcaaagaggggtttaccaacgatcagtatcaagaacttgccgaaccaagtagccttacctatgtcacacgttccgaaaattcgatctttttcgaggttgatgggccatacttggccatgattctgccggctagcaaagaagaagggaaaaaattaaagaagcgctacgccgtgttcaatgaggacggttctttggcagaactcaagggcttcgaagtgaagcgtcggggagagctgcagctgatcaagatattccagtcatctgtgtttgaagcttttctaaagggcagtacactggaggaggtatacgggagtgtggccaaagtcgccgactactggctggatgtgctctattcaaaggctgccaacatgccggattccgagctctttgagttgatcagcgagaataggagcatgagtcggaaactggaggactacggcgaacaaaaatctactagcattagtaccgccaaaaggctggcagaatttctaggcgaccagatggtgaaggacgctgggcttagttgccgctatatcatttcaaggaagcccgagggcagtccagtgactgaacgcgcaatacctttagccatattccaagcagagccaaccgtgcgcaaacatttcttgcgaaaatggcttaagtcctctagcctgcaggacttcgacatccgagctatcttagattgggattattatatcgagaggctcgggtccgccatccaaaagattattaccatcccagcagccctgcaacaggtcaagaatcctgtgccacgagtgaagcacccagactggctgcacaagaagttgctcgagaaaaacgacgtatataagcagaaaaaaatatcagaactgttcacactggaaggcagaaggcaagttacgatggcagaggcctccgaggactccccaagacctagcgcgcctgatatggaggattttggcctggttaagcttccccatccagctgcacccgtcaccgttaaacgaaagagagttctctgggagagccaagaggagagtcaggatcttaccccgacagttccttggcaggagatcttgggccagccacccgcactgggtacttcacaagaggaatggctggtctggttgagattccacaagaagaaatggcagctccaggctcgccagcgtcttgcccgacgcaagaggcagaggctcgagtcagcggaaggtgtgctccgccctggcgcaatcagagacggacccgctacagggttaggcagcttcctccgaaggactgctagatcaatcctggatctgccgtggcagatagtgcaaatctctgaaacatcccaagcaggcctgtttagactgtgggcattggtgggaagtgacttgcattgtataagattgagcattcctcgcgtcttctacgtgaatcagcgcgtcgccaaggctgaggaaggggcatcctacaggaaagtcaacagggtattgcctagatcaaatatggtctataacttatatgagtatagcgttcccgaggacatgtaccaggaacacataaacgaaatcaacgccgaattgtcagccccagacattgagggggtctatgagacacaggtaccactgctgtttagagccctcgtacacctgggctgtgtgtgtgttgtgaataagcaactcgtcaggcatttgtctggatgggaggctgaaactttcgctctggagcatttagagatgcggagtctggcacagttctcatatctagaaccgggaagtatcaggcacatctacctatatcatcacgcacaggcacacaaagctctcttcggaatcttcattcccagtcagaggagggccagcgtctttgttctggatacagtgcgctcaaatcagatgcccagtctcggagcactgtacagcgccgaacacggattattgttggaaaaggttggaccagagctgctgcctcccccaaaacacacattcgaagtgcgagccgaaacagatctcaaaaccatttgccgggctattcagcgctttcttctggcgtacaaagaggagcgtaggggtcctactttaatcgctgtacaatcatcatgggagttgaagcggctggccagcgagataccagtgttggaagagttcccattggtccccatctgcgtagcagacaagatcaactatggagtattggactggcagcggcatggagccaggagaatgatcagacactacctgaacctcgatacttgtctgtctcaggcatttgagatgtctaggtatttccacatacctattgggaatctaccagaagatatctctactttcggatccgatctattctttgcccgtcacctgcagcggcacaatcatctgctgtggcttagccccacagctcggcctgacttggggggaaaggaggcggacgacaactgcctcgtcatggagtttgatgaccaggcaacagtggagattaactcctcgggctgctattccaccgtgtgtgtggaattggacctgcagaatctggccgttaataccatcctgcagagccatcatgtcaatgacatggaaggcgctgactcaatggggatcagcttcgatgtgattcaacaagcttcactcgaggatatgatcactggcggacaggccgcatccgccccagctagctacgacgagactgcactttgttccaacacgttccgcatactgaaaagtatggtggtgggatgggtaaaggagatcacacagtaccacaacatctacgccgacaatcaggtcatgcacttctatcgctggctgcggagcccctcgtctctgctgcacgatcccgcactccacaggactttacataatatgatgaaaaaactgttcctccagcttatcgctgagttcaaacgcctgggatccagcgtcatttatgccaatttcaaccggattattctgtgtactaagaaacggcgagttgaggatgctatcgcctatgtcgagtacataacttcttccattcacagcaaggagacgtttcattcactgaccatatcattttctcgttgttgggaattcctgctgtggatggatccctcgaactatggaggtatcaagggaaaggtgtcctcacggatccactgtgggttacaggattctcagaaggccggaggtgccgaggacgagcaggagaatgaggacgatgaagaagaaagagacggcgaagaagaagaggaggccgaggaatcgaacgtggaggacctgttagaaaataactggaacattctgcagttcctgcctcaggccgctagttgtcaaaattacttcctgatgatagtgagtgcttatatcgtggctgtctatcattgtatgaaggacggtcttcgacgctctgcccctgggtctacccctgtccgcaggcgcggagcatctcagttgtcacaagaagctgaaggagccgtcggtgccctgcccggtatgattacattctcccaagattacgtggccaatgagcttactcagtcatttttcaccatcacacagaagatccagaaaaaggtgaccggatcccggaacagcaccgaactgtctgagatgtttccggttctcccagggtcacacctgttactcaataatccagctctagagtttatcaaatacgtatgcaaggttctctctctagatacgaatatcacaaatcaggtgaacaagctcaaccgtgatctgctcaggctagtggacgtcggggagttttccgaggaggctcagttcagagatccatgccgctcctacgtgctgccagaggtcatctgtcgatcttgcaacttctgcagagatttggacctttgcaaggatagctctttctccgaggatggagccgtgcttcctcagtggctgtgctctaactgccaggctccttatgatagcagcgctatagagatgacgttggtggaggtgctccagaagaaactgatggcattcacccttcaggatctggtatgcctaaaatgccggggagtaaaggagaccagtatgcccgtgtattgtagctgcgcgggtgatttcgccctgacaatacacacccaggtcttcatggaacagatcggcatttttcgcaatatagcacagcattacgggatgtcctacttgctggaaaccctggaatggcttctccagaaaaatcctcagcttgggcacta

SEQ ID NO: 235442 - DNA, 480 bp, Artificial Sequence
  Description of Artificial Sequence: Synthetic coding sequence
atgattaagttctttttgatggtgaacaaacagggccagactcgtctgtccaagtattatgaacacgtggatattaacaagcgtacattgctcgagaccgaggtcattaagagctgcctcagccgtagcaatgaacaatgctccttcatcgaatataaggacttcaaacttatttataggcagtatgccgctcttttcattgtcgttggggtgaacgataccgaaaacgagatggcgatttacgagtttattcataatttcgtggaggtcctggatgaatattttagtagagtgagcgaattggatgtgtccttctttaacactgtgtttcacagcacttggcagatgcactccggcccttatcaggaacccatagacgaattgccgaagatctgcagtgcactggaacctcagcagacttgcttttcgcccgatagcagctccttcaagggcgcagcctcaacgaccccaatatattag

SEQ ID NO: 235443 - DNA, 1506 bp, Artificial Sequence
  Description of Artificial Sequence: Synthetic coding sequence
atggcccctgaacggctccggtcacgggctttgagtgcctttaaactacggggactgttgttaaggggggaggccattaaatatcttacagaagcccttcagtcgattagcgagctcgagcttgaggataagctcgaaaagatcataaacgccgtggaaaagcagcccctctcatctaatatgattgagaggagcgtggtcgaggcggctgtgcaagagtgtagccagagcgtagatgaaaccatcctcctcatgacaaaccatccggctcctaacctgtttgggacacccagagacaaggcggagatgtttcgtgagcggtatactatcctccaccagcgtactcaccggcacgaactatttacgccgccagtcatcggtagtcaccctgacgaaagcgggagcaagttccagctgaaaactattgaaactctcttggggagcacgacaaagattggcgacgcaattgtgcttggcatgataacacagcttaaggaggggaaattttttctcgaagacccaacaggtacagttcagttagacctgtccaaagcgcagttccacagcggcctgtacaccgaggcttgcttcgtactggccgagggttggttcgaggaccaggtgttccacgtgaatgcttttggcttccctcctacagaacctagtagcacaacacgcgcatactatggcaatatcaactttttcggcggtccgtcgaatacttctgtgaagacaagtgccaagctgaagcagttagaggaggaaaacaaggatgcgatgtttgtatttctcagcgacgtttggctggatcaggtggaagtgttggagaaactcaggattatgtttgctggctattcaccggcaccccctacctgcttcatcctctgtggtaacttcagctcggccccttacggcaaaaatcaggtgcaggcgcttaaggattcactcaagacactggctgacattatttgtgagtacccagatatccatcagtcctcccgctttgtatttgtaccaggacccgaggacccgggattcggcagcattctgccacggccacctttagctgaatctattacaaatgaatttagacagcgggtgcctttctccgtcttcaccaccaatccctgcaggatccagtactgtacccaggaaattaccgtgttcagagaggatctggtgaacaagatgtgccggaactgcgtcaggtttccctcctctaatctggcaatacctaatcattttgtgaagacaattctgtctcagggccatctgacaccgctccctctttacgtttgccccgtctactgggcctacgattacgccctcagagtgtaccccgtacccgacttgctagtgatcgcagataagtatgacccgtttacgacaacaaacactgagtgtctgtgcattaaccccggaagcttccctcgtagtggcttctcttttaaggtgttctatcccagcaacaaaactgtggaggattctaagttgcagggcttctag

SEQ ID NO: 235444 - DNA, 1509 bp, Artificial Sequence
  Description of Artificial Sequence: Synthetic coding sequence
atggcacccgagaggctgagatctcgcgctctgtccgcttttaaactgcgaggcctgttactcaggggagaagccatcaagtatctaaccgaagccctgcagtcaatcagcgaactggagttagaagacaaactggagaagatcatcaacgccgtcgagaaacagcctttgtcctcaaatatgatagaacgttcagtggtggaggccgctgtgcaggaatgtagccagtctgtggatgagactatagagcacgtgtttaacataataggcgcatttgatatccccaggttcgtatacaattccgaaagaaagaagttcctgccattgctcatgacaaatcatcccgcaccgaacctgtttgggaccccacgtgataaagccgaaatgttcagggaacgctacacaatccttcatcaacgtactcacaggcatgaactgtttactccacctgttatcgggtcccacccggacgaatccgggtcaaaattccagctgaaaacaatcgagactttgcttggtagcaccaccaaaattggcgatgctatagtgttgggcatgattacccagctgaaggagggaaagtttttcctggaggacccaaccggcacagtgcagctggacctatctaaagcccaattccactcgggactgtacacagaggcttgcttcgtgctggctgaggggtggttcgaggaccaggtgtttcacgtgaatgcctttggctttccaccaactgaaccttctagtaccacaagagcctattatggcaatatcaactttttcggaggaccctcaaacacctccgttaaaacctctgctaagctgaaacagctggaagaggaaaataaggatgctatgtttgtcttcctgagcgatgtatggctggatcaggtggaagtgctcgagaaacttagaattatgtttgctggatattccccagctccaccaacctgttttatcctctgcggaaatttttcttctgccccttatgggaagaatcaggtacaggctctcaaagatagcttgaagacattggctgatatcatttgtgagtacccggatattcaccaaagctcaaggttcgtctttgtgccagggcctgaggaccctgggttcggtagtatcctgcctagaccccctctcgccgagtccatcaccaacgagttccggcagcgcgtaccattcagtgtctttacaacaaatccatgtagaatccagtactgcacccaggagatcactgtatttagggaggacctggtgaacaagatgtgtaggaattgtgttaggttccccagcagtaacctggcaattcccaatcactttgttaagactatcctttcacaagggcacctgactccgcttccactttacgtatgcccagtctattgggcctacgattacgccctgcgcgtgtaccctgtccctgacctgttggtgatcgcagacaaatacgacccattcaccacaaccaacacggaatgcctctgcattaatcctgttagaatgtag

SEQ ID NO: 235445 - DNA, 444 bp, Artificial Sequence
  Description of Artificial Sequence: Synthetic coding sequence
atggcggaaagaccagaggacctgaatctaccaaacgccgtcatcacacgcatcattaaagaagctctgcccgacggagtaaatatatcaaaagaggccagatctgctatttctagggctgcgagtgtgttcgtcctctatgccactagctgcgctaataattttgctatgaagggaaagcgcaagacgctgaatgctagcgacgttctgagtgccatggaggaaatggaatttcagaggttcgtcacgcccctgaaagaggccctagaagcgtataggagggagcagaaaggtaaaaaggaggcatccgagcaaaaaaagaaagacaaagataagaagacggatagcgaagaacaggataagtctagagacgaggataacgacgaggacgaagagcggctcgaggaagaggagcaaaatgaagaagaggaggtggacaattag

SEQ ID NO: 235446 - DNA, 444 bp, Artificial Sequence
  Description of Artificial Sequence: Synthetic coding sequence
atggcagagcgaccagaagacttaaatcttcctaatgcagtgatcacgcggatcatcaaagaggctctgcccgatggcgtgaatatctcgaaagaagcgcgtagcgctatttcgcgagccgcttccgttttcgttttgtacgccacctcctgtgctaacaattttgccatgaagggcaaacgtaagaccctcaatgcttccgacgtgctctccgcaatggaggaaatggaattccagcgcttcgtgacgcctctcaaggaggccctggaagcctaccgacgcgaacaaaaaggtaagaaagaagcctccgagcagaagaagaaagataaagataagaagaccgactccgaggagcaggacaagtcaagggacgaagataatgacgaagacgaagaacgtctcgaagaggaggagcaaaacgaggaggaggaggttgataattag

SEQ ID NO: 235447 - DNA, 1245 bp, Artificial Sequence
  Description of Artificial Sequence: Synthetic coding sequence
atggctaccgggcaggaccgagtcgtcgcactggtggacatggattgcttctttgtgcaggtggaacagagacaaaatccgcatctgcgcaataaaccgtgcgcggttgttcagtataagtcctggaagggcggaggtatcattgctgtgtcttatgaagcgagagcatttggagttacccgctctatgtgggccgacgacgccaaaaagctatgtccagatctgctgttggcacaggttagagagagtcgcggtaaagccaacctaacgaagtaccgggaggccagtgttgaggtgatggaaatcatgtcccgcttcgcagtgatcgagagggctagtattgatgaagcctatgtggacctgacatccgccgtacaggaacgtttacagaagctacagggtcagcctatctccgctgatctgctcccgtctacttacatcgagggtctaccccaggggcctacaaccgctgaagagaccgtgcagaaggaaggcatgcgaaaacagggtctgttccagtggttagacagcctgcagattgataacctgactagtcctgacttgcagctgactgtcggcgctgtgattgtggaagagatgagagccgcaattgaaagagagacaggcttccagtgctccgccggaatctctcataacaaagtgctcgctaaactggcctgcggcctgaacaaacctaaccgccagacccttgtgagccacggaagtgtccctcagttgtttagccagatgccaattaggaagattcggagcctgggaggcaagctgggtgcctccgttatcgagatcttgggcattgaatatatgggtgagctgacacaattcaccgaatcacagttacagtctcattttggcgagaagaacgggagctggctgtacgccatgtgccgcggtattgaacacgatccggtcaagcctcggcagctgccaaagaccattgggtgcagcaagaacttcccaggcaaaaccgctctggccacccgcgagcaagttcaatggtggctactgcagcttgcccaggagctggaagagcgcctcaccaaagatcggaacgataatgatagggtggctacccagctggttgtgtccatccgggtacaaggcgataagagactttcttctttacgcaggtgctgtgccctcactcgttatgatgcccataaaatgtcccatgacgccttcactgttatcaagaattgtaacacaagcggaatccagacagagtag

SEQ ID NO: 235448 - DNA, 2142 bp, Artificial Sequence
  Description of Artificial Sequence: Synthetic coding sequence
atggcaactgggcaggaccgggtggtggcgctggtcgatatggactgcttctttgttcaggtggaacagcgacaaaatcctcacctcaggaacaagccatgtgccgtggtgcagtataagagctggaaggggggagggatcatcgccgtgagctacgaggctagagccttcggtgtcacacgtagcatgtgggctgacgatgccaaaaagctgtgcccagacctgcttctggcccaagtacgcgagtctagggggaaggctaatttgacaaagtatcgggaagccagcgtcgaggtgatggaaattatgagtcgattcgctgtcatcgagcgtgcctctattgatgaggcgtacgtcgatcttaccagcgccgttcaggagcgtctgcagaagctccagggtcagcctatttcagccgatttgttaccgagcacctatatcgaggggctcccacaggggcctaccaccgccgaggaaaccgttcagaaagaggggatgcggaagcagggcttattccagtggctcgactctttacagattgataatctcaccagcccagatttgcaactgactgtcggagctgtgatagtggaagagatgagagccgctattgaacgagagacaggcttccaatgcagcgccggaataagccacaataaggttctcgccaagttggcgtgtggcctcaacaagcctaatcgacagactctcgtgagccatgggtctgtcccacagctcttttcccagatgcctatcagaaaaattcgttctctcgggggtaaattaggtgcaagcgtcattgagatcctcggcatagagtacatgggcgaactgactcagtttactgagtcgcagctgcaatcacactttggagaaaaaaacggaagctggctttacgccatgtgtaggggtattgagcatgaccccgtgaaaccgagacagttgccaaaaactatcggctgcagcaagaactttccaggcaaaaccgcgttggctacaagggaacaggtccagtggtggctgctccagctggcgcaagagcttgaggagaggcttactaaggatagaaacgacaatgaccgcgtggccacgcagcttgtggttagcatcagagtgcagggggacaagaggttatcttccctgcgaagatgttgcgccttgacccgttacgatgcacataagatgtcacacgatgcctttactgttataaaaaattgcaacaccagcgggatccagaccgaatggtccccccctctcaccatgttatttctctgcgctactaagttctccgcttctgccccttcatcatctacagatattacgagctttctgagcagtgacccctctagcttaccaaaagtccccgtaacctcgagtgaggcaaagacacagggatctggtccagcagtcactgcgactaagaaggcaacaacttccctggaaagcttcttccagaaggctgccgagaggcagaaagtgaaagaggctagcctgtctagtctaacggcgccaacccaggcaccaatgtccaattctccttctaagccttcactgccgtttcagaccagtcagagcacgggaaccgagcctttcttcaaacagaagagcttgttactgaagcagaagcagctgaataacagctctgtgagctcaccacagcagaatccatggtctaattgcaaggctctgcccaatagtctgcccacagaatatcctggttgtgtccctgtgtgtgagggagtctcaaagctggaggaaagcagtaaggcaacaccagccgagatggacctagcccacaatagtcaatcaatgcacgcatcctctgcatctaaatctgtccttgaagtgacacagaaggcaacaccaaatccaagtttgttggccgctgaggaccaggtcccctgcgagaagtgcggtagcctggtgccagtgtgggacatgcctgaacacatggattaccatttcgccctggaactccagaagagctttctgcagcctcattctagtaatcctcaggtggtcagcgcggtctctcaccagggcaaacggaatccaaagtctccactcgcgtgtacgaacaagcgcccaagaccagaggggatgcagactcttgagtcttttttcaagcccttaacgcactag

SEQ ID NO: 235449 - DNA, 219 bp, Artificial Sequence
  Description of Artificial Sequence: Synthetic coding sequence
atgtgggcggatgatgccaaaaagctctgccctgatctgttgctagctcaggtgagagagagcagggggaaagccaatcttaccaagtatagagaagcatctgtggaagtcatggagattatgtctagattcgcagtcatcgaacgggctagtatcgacgaggcttacgtggatctgacatctgccgtccaagaaaggctgcagaagctccagggttag

SEQ ID NO: 235450 - DNA, 1956 bp, Artificial Sequence
  Description of Artificial Sequence: Synthetic coding sequence
atgtgggccgatgatgctaaaaagctttgtcccgacttgctgctggcacaagtgcgggagtcaagaggtaaggccaatttgactaagtaccgcgaagcttcggtggaggtgatggagataatgagtcgcttcgctgtgatcgaaagagccagcattgatgaagcttacgttgacctcacttcagccgtgcaagagcgccttcaaaaactgcagggacaaccgatcagtgccgatctccttccatctacttatatcgaagggctcccacagggcccaacaaccgctgaagagactgtgcagaaggaaggaatgaggaaacagggcttgtttcagtggctggattctctgcaaattgataatctgacatcacctgatctccaacttacagtaggagctgtgatcgtagaagagatgcgcgcagccatcgagagagagaccggattccaatgctctgccggaatttcacataacaaggtcctggcaaagttggcgtgcggcctgaacaaacccaaccgccaaacactggtgtcacacggaagcgtaccacagctgttttctcaaatgccgatccgcaagattcgtagcctggggggaaagcttggcgcatccgtgattgaaatactggggatcgagtacatgggtgagctaacgcagttcacagaatcccagttgcagagtcactttggagagaagaacggcagctggctgtatgctatgtgtcgaggcattgagcacgatcctgtcaaacctcgccaactgccgaaaaccatcgggtgttccaagaattttcccggtaaaactgctctcgctacaagggagcaggtgcagtggtggctgttgcagcttgcccaggaattagaagaacggctgaccaaggaccgcaatgacaacgatagggttgccacccagctggttgtttcaattcgggtgcaaggggataagcgtctttcatcgctgcgaaggtgttgcgcccttaccaggtacgacgcgcacaagatgagtcacgatgcgtttaccgttatcaaaaactgcaacacctctggaattcagacagagtggagccccccattaactatgctgtttctgtgcgctactaagttttccgcgagcgccccttcatcctccacagacattaccagcttcctgtctagcgatccaagctccttacccaaagtgcccgtgacaagttctgaggctaagacccaggggagcggcccagccgtgacagccactaaaaaggccaccacgagcctggaaagcttctttcagaaggcagccgagcgacagaaagttaaggaggcatctctttctagcctgaccgctcccacccaggctccaatgtccaattcaccctccaaaccctcattgccattccagacttcgcagagcactggtaccgagccattctttaaacagaagtccctgctgctcaagcagaaacagctcaacaacagttctgtctctagcccacagcaaaatccctggtctaactgtaaggcattacctaacagcctacctactgagtaccctgggtgcgtcccagtctgtgagggcgtttctaagctcgaagagtcaagcaaggccacccctgccgaaatggatctggcccataattcccagtccatgcatgccagctcagcgtccaaatctgtgctggaggtcacccagaaggccacaccaaaccccagcctcctcgctgccgaggatcaggtcccatgcgagaagtgtggtagcctggtgccagtgtgggatatgcccgagcatatggactaccactttgccctggaactacagaagtccttcctgcagccacatagctccaacccccaagtggtgtccgctgtcagccaccagggaaaacgaaatcccaaaagccccttagcttgcacaaacaaaaggccacggcctgagggcatgcagaccttggagagcttctttaagccactcacacattag

SEQ ID NO: 235451 - DNA, 3720 bp, Artificial Sequence
  Description of Artificial Sequence: Synthetic coding sequence
atgtccagattgctgtggcgaaaggtggccggagcaactgtgggcccagggcctgtgccagccccaggccgatgggtgtccagcagtgtgccagccagtgacccttctgacggacaacggaggaggcagcagcaacagcagcagcagcagcaacagcaacagcagccccagcagccacaagtgttgtcgtcagagggtggacagctgaggcacaatccacttgatatccagatgctgtccagagggctgcatgagcagatcttcggtcagggcggagaaatgcctggagaggctgcagtgagacggagtgtcgaacatctgcagaagcacggactttggggacagccagctgttccactcccagacgtcgaacttcggctgcctccgttgtacggcgacaacctcgatcaacatttcagactgctggcccagaagcagtcattgccctacctcgaggccgctaatctcttgctgcaggcccagctgcctcctaaaccacccgcatgggcgtgggccgagggctggactaggtatggccctgagggtgaagcagtccccgtggccatcccagaggaacgggcattagtgtttgatgtggaggtctgtctcgctgaaggcacttgcccgactctcgctgtcgcaattagtccctcagcttggtattcttggtgctcacaaaggcttgtggaggaacgttattcctggacgagtcagttaagcccggcagatcttattcctctcgaggtgcctactggagcaagctctcccacgcagcgggactggcaggaacagttggtagtgggacacaatgtgagctttgatcgcgcacatatccgcgaacaatacctgatacaagggagcagaatgaggtttctggacaccatgagcatgcatatggccatatccgggctgtcctctttccagcggtcgctgtggatagctgccaagcaggggaaacacaaagtacagccccctaccaagcaaggtcagaagtcgcagagaaaagcccgtcgcggacccgctatcagctcttgggactggctggatatctcctcagtgaatagtctagctgaggtgcatcggctgtacgtgggaggaccccctcttgagaaagaaccaagggaactctttgtgaagggtactatgaaggacattcgcgagaatttccaggacctgatgcagtattgtgcgcaggatgtttgggctacgcatgaggtgttccagcagcagctccccctgttcttggagaggtgcccccatcccgtgacactggctggtatgcttgagatgggggtgtcatacctgccggttaatcagaattgggagcgatatttggcggaagcacagggcacatacgaggaacttcagcgcgagatgaagaaatccctgatggatttggctaatgacgcatgtcaactcctctccggagaaaggtacaaggaagatccctggctgtgggacttggaatgggatctgcaggaattcaagcagaaaaaagctaagaaagttaagaaagaacccgctactgccagtaagctgccaattgagggcgctggcgcacccggagaccctatggaccaggaagaccttggaccgtgctccgaggaggaagaatttcagcaggatgtaatggcccgagcatgtctccaaaaactcaagggcacgaccgaactgctgccgaagagacctcagcatcttccgggacaccccggatggtatcggaaattatgccccaggctggacgaccccgcatggacccctggaccatccctgttatcgctgcagatgcgggttacacctaaattgatggcactgacgtgggacggattcccactccattactcggagaggcacggctgggggtatctggtgccagggaggcgggacaatctcgccaagctgcccactgggacgactcttgaatcagctggggttgtctgtccataccgcgctatcgagtccctttatcgaaagcactgtcttgagcaaggtaagcaacaactcatgccccaagaggcagggctcgctgaggaatttttgttgactgacaattctgccatctggcagaccgtcgaggaactcgattatcttgaggtcgaagcagaggccaagatggaaaatcttagagctgctgtgcccggtcagcctctggcactgaccgccagagggggtcctaaagatacccagccaagctatcaccacggaaatggcccttataacgacgtggacattccagggtgctggttctttaagctgccccacaaggacggcaactcctgcaatgtaggttcccctttcgccaaggactttcttcctaagatggaggacggcacattgcaagctggaccaggtggcgcaagcgggcctcgcgctcttgagatcaacaagatgatatctttttggagaaacgcgcacaagcgcattagcagccaaatggtagtgtggctgccaagatcagccctgcctcgggctgtgatacgccatccggattatgatgaggagggcctgtacggggctatcttgccccaggtggtcactgccggaacgatcacccgacgggctgtggagcccacatggttgactgcttcaaatgccagaccagatcgagtggggagtgagctgaaggctatggtgcaggccccaccaggctataccctggtgggggcagacgtggattcccaggagttatggattgccgctgtcctgggagacgctcacttcgccggaatgcacggttgcactgccttcgggtggatgactctgcagggcaggaaatctcggggaactgacttacattccaagacagcaaccacggtcggaatctctagagaacatgccaagatttttaactatgggcgaatttatggcgctggccagcctttcgcagagagactactcatgcaattcaatcacagacttactcagcaagaggcggctgagaaggctcagcagatgtacgctgccacaaagggtctcagatggtacaggctgagcgatgaaggcgagtggcttgtcagggagctgaacctgcccgtggataggaccgaaggcggatggattagcctgcaggacctgcggaaggtccaaagagagacagccagaaagtctcagtggaagaaatgggaggtcgttgctgagcgcgcttggaaggggggaaccgaaagtgagatgttcaataagctcgaatccatagccacttctgatatcccacgcaccccagtcctgggctgctgtatcagtagagcactggagccaagcgccgttcaagaggagttcatgacctctcgagtgaactgggtggtacagtcctcggcggtggactatctgcacttgatgttggtcgccatgaaatggctttttgaggagttcgccatcgatggcagattctgcataagcatccatgatgaggtgagatatctggtccgggaagaggatcgttacagagctgcgctggccctccagatcaccaacctgcttacccgctgtatgtttgcctacaaactgggcctcaacgatttgccccagagtgtcgccttcttctccgctgttgacattgaccgatgcctaaggaaggaagtcactatggattgtaagacacctagcaaccccactggcatggagcgaagatatgggattccccagggggaagccttggatatctatcagataatcgaactcacgaagggcagtctggagaaacggtcacaaccaggtccctag

SEQ ID NO: 235452 - DNA, 3720 bp, Artificial Sequence
  Description of Artificial Sequence: Synthetic coding sequence
atgtcacgcctgctttggcgaaaagtcgccggagctactgtcggacctgggcctgtccctgcaccagggaggtgggtcagtagtagcgtccccgcttcggaccctagcgacggacaaagaaggcggcagcagcagcagcagcagcagcaacagcaacaacaacagccacagcagccacaagttctctcatcagaaggcggtcaactcaggcataatcccctcgacattcagatgctcagtcgtggcctgcacgaacaaatatttgggcagggaggagagatgccaggggaggccgctgtacggcgttccgtggagcatttgcagaaacatggactatggggtcaacctgccgttcccttgcccgatgtggagctgcgactaccacctctgtacggggacaatcttgaccagcatttcaggctgctcgcccagaaacagtccctgccgtacctagaggccgctaacttattactccaagcgcaactgcctcccaagcctccagcatgggcttgggctgagggttggacccgatatggaccagaaggcgaggcagtgcctgtcgcaataccggaggaacgagccttagtatttgacgtcgaggtttgcctggccgaaggcacatgccctactctggccgtggccattagtccttccgcttggtactcttggtgttcccagcggctggtcgaggagcggtactcttggacatcacaactctctccagctgaccttatccccctggaggtccccactggcgcaagcagtccaactcagagggactggcaggaacagctagttgtcggtcataatgtgtcatttgacagagcccacattcgcgagcagtacctcatccaaggatcgcggatgaggttcttggacacgatgtccatgcatatggcgatcagcggcctgagcagctttcagcggagcctgtggatcgctgcgaagcagggtaaacacaaggtgcagcccccaaccaagcaaggccagaagtcccagcgcaaggcgcgacgaggccctgccatcagtagctgggactggctcgacatttcttccgtaaatagcctggctgaagtgcacaggttgtacgtcggaggacctcccctggagaaagaaccgagagagctatttgtcaaaggcaccatgaaggatatcagggaaaacttccaagatctgatgcagtattgtgcccaggatgtgtgggcaactcatgaggtgttccagcagcagcttcctttgtttctggagcggtgcccccatcccgtgaccttagccggaatgctggaaatgggcgtatcttacctgcctgtgaaccagaattgggaacgctatctcgctgaggcccaaggcacatacgaggagctgcaacgggaaatgaagaagagtcttatggatctcgctaacgatgcgtgtcagctgcttagcggggaacgttacaaagaagacccgtggctctgggatctggagtgggatcttcaggagtttaagcagaagaaagctaaaaaggtgaaaaaggaacctgccactgcatctaagctgcctattgagggagctggcgctcccggtgatcccatggatcaggaagatcttggcccatgcagcgaggaggaggagttccagcaagatgttatggctagggcatgcttacagaaactgaaaggaaccactgagttattgcctaaacgtccccagcacttacccggtcaccccggatggtacaggaagctgtgtcctaggttggacgacccagcatggactccagggccttcacttctgtccttacagatgagggtgacaccgaagctgatggccctcacttgggacggattccctctgcattactctgagagacacggatgggggtaccttgtgccgggacggcgtgacaatctggcaaaactaccaacaggtaccaccctggaatcagctggtgtcgtatgtccttacagggcaatcgagagcctgtacagaaaacattgcctggaacagggaaagcagcagttaatgccacaagaagccggtctggccgaagagttccttttgaccgacaattccgccatatggcagacagtcgaggaacttgattaccttgaagtcgaagccgaagccaaaatggagaacctgcgagcagccgtgcctggccagcccctggcactgactgcaagaggaggaccaaaagacactcagccatcctatcatcacgggaatggcccttacaatgacgttgacattccagggtgttggttctttaagctgccgcataaagacgggaattcgtgtaatgtgggctcgcccttcgctaaagatttcttacccaagatggaagacggtaccctgcaggccggaccagggggagcatccggcccaagggctctggaaataaacaagatgattagtttttggcgcaatgcccacaagaggatttcctcacaaatggttgtctggctgccccgaagcgctctaccaagagctgtgataaggcatccggactatgacgaagaaggcctgtacggagccattttgccgcaggttgtcactgccggaaccataacccggagagccgtggaacctacctggctgaccgcctccaacgccaggcctgatcgggttggatcggaattaaaagccatggtgcaagcaccccctggttatacattggtcggcgcagatgtcgattctcaggaattgtggatcgctgctgtgctgggcgatgcccacttcgctggcatgcacggatgtaccgcatttggatggatgacactacagggacgcaaatctcggggaaccgatctgcactcaaagactgcgacaacagtgggtattagcagggagcacgcaaaaatctttaattatggtcgcatctatggcgcaggacagccattcgcagagcgcctgctaatgcagtttaatcatcggttaactcagcaagaagccgcagaaaaggcacagcagatgtacgctgccacaaagggcctccgttggtacaggcttagcgatgaaggggaatggctagtgcgagaactgaatttgccagtcgatagaacagaggggggatggatttcactccaggacctgcggaaggtgcaaagggaaaccgcaagaaagagtcagtggaaaaagtgggaggtcgttgccgagcgcgcttggaagggtgggacggagtcagagatgttcaataaactcgaatctatcgccacatcggacatcccacgaacacccgtgcttgggtgttgtattagcagagccctggagccatccgctgtgcaggaggagttcatgactagtcgcgttaactgggtggtgcaatcatctgcggtggactatctgcatctgatgctggtggccatgaagtggctcttcgaggagttcgctatcgatgggaggttttgcatctccatccacgacgaagtgagatacctggttagagaggaggaccgctatcgggctgctctagcgctgcagatcactaaccttttgacaagatgtatgttcgcgtacaagctgggcctcaatgatctaccacaatctgtggcgtttttcagcgcagttgacatcgatcggtgccttcgcaaagaggtgacaatggactgtaagacaccaagcaatcctacagggatggagaggcgatatggaatcccccagggagaagcactggatatctatcagataattgagcttacaaaaggcagccttgagaagaggagccagcccggaccctag

SEQ ID NO: 235453 - DNA, 1458 bp, Artificial Sequence
  Description of Artificial Sequence: Synthetic coding sequence
atgcgttcccgtgtggctgtgcgcgcatgtcacaaagtctgccggtgcctcctgtctgggttcggcggaagggtggacgccggacaacctgagctgctgaccgaaagaagctcaccgaaagggggtcacgtcaaaagccacgccgagctcgaaggcaacggggagcatcccgaggcccctggctccggggagggatccgaagcactgctggaaatatgccagcgcagacacttcctctccggatccaaacaacagctgagtcgggacagcctgttgagcggctgccatccagggttcggccctctaggggttgagcttaggaagaacctggcagctgaatggtggacatccgtcgttgtcttcagagaacaggtgtttcccgtagatgcactccaccacaagcccggaccactgcttcccggagacagcgccttccggctggtatccgcagagaccctccgtgagatattacaagataaagaactgtcaaaagaacagctggttgcctttctggaaaacgttcttaaaacaagcggaaagttgcgcgaaaatctgctgcatggggctttggagcactatgtgaactgtctcgacctcgttaacaagcgtctgccatacggcctcgcccagataggagtgtgttttcaccccgtgttcgacacgaaacaaatccggaacggtgtaaagtccatcggcgaaaagactgaagcctctctggtgtggtttacgccccctcgcacctccaatcagtggctagatttttggctaagacacagactacagtggtggcggaagttcgcaatgtcgccctcaaatttcagcagtagcgattgtcaggacgaggaaggcaggaagggaaacaagttgtactataactttccctggggcaaagagctgattgagacactgtggaacttgggtgatcacgagttgttgcacatgtaccctgggaatgtcagcaagctgcacggacgggatggcagaaaaaacgtggtgccctgtgtgctaagtgtgaacggtgacctggacaggggaatgctagcctacctatatgattcatttcagctaacggagaactccttcacgaggaagaagaatctccataggaaggtgctgaagctccatccctgcttggcccctatcaaggtggcactggacgtgggacgtgggccaacattggaactgaggcaagtatgtcaaggcttgttcaatgagcttctggagaacggtatttctgtgtggccgggatatttggaaactatgcagagcagcctggaacagttgtatagtaaatacgatgaaatgagcatcctattcaccgtgctggttactgagaccaccctggaaaacgggttgatccatttacggagccgtgacacgacaatgaaagaaatgatgcacatcagcaaattgaaggattttcttattaagtatatatcatccgctaaaaacgtgtag

SEQ ID NO: 235454 - DNA, 7773 bp, Artificial Sequence
  Description of Artificial Sequence: Synthetic coding sequence
atgaacctgctgcgccgttctggaaaacgcagacgctctgagagcggttctgatagcttctccgggtccgggggtgacagctcggcttccccccagtttctgagcggttctgttttgtccccgcctccagggctcggcaggtgcctgaaggctgccgctgcaggtgagtgtaagccaaccgttccagactatgagagggataagctgctgctcgccaactggggacttccaaaagcggtgcttgagaagtatcactcctttggtgtgaaaaagatgtttgaatggcaggccgaatgcctgctgttaggccaagttctggaggggaaaaaccttgtctactctgcccctacaagcgcgggaaaaactctcgtggcggagctgctaattctcaagcgcgtactggaaatgcgtaaaaaggctctgtttattctgccattcgtttccgtcgccaaagaaaaaaagtactacttacagtcattatttcaggaagtgggaataaaagtcgacggctatatgggtagtacttctccctcgcgccacttttcaagtttggatattgcggtctgcaccatcgagagggccaatgggctgattaaccgtttaatcgaagagaataagatggatctactcggtatggtcgtggtagacgagctgcatatgctgggcgattcccatcggggttacctcctagaactgctactgaccaagatctgctacattacaagaaagagcgcatcctgccaagccgatctggcttcatcactcagcaatgccgtgcagatcgtcggcatgagcgctactctacccaatctagagttggtcgccagctggctgaacgccgagttgtaccatacagactttcgtcctgtgcctttgctggaaagtgtgaaggtcggcaatagcatctacgacagtagtatgaagttggtcagggagttcgagcctatgcttcaggtgaaaggagacgaagaccatgttgtatccctatgctacgagacaatatgtgataaccattcggtgcttctgttctgtcccagtaagaagtggtgcgaaaaactggccgatattattgccagggaattttataacctgcaccatcaagctgagggcctagttaagccttctgagtgcccccctgtgatcctggagcaaaaggaactgctggaggtaatggaccagctccgcagattgccatctggcctggattctgtcctccagaaaactgtgccctggggggtggcttttcaccatgctgggctgaccttcgaggaacgggatatcatcgagggcgctttcaggcagggcctgattcgggttctggctgcaacgtcaacacttagctcaggtgtgaatcttccagcacggagagtgattatccggaccccaatcttcgggggaaggccactggatattctcacgtacaaacagatggtggggcgtgctgggagaaagggggtggatacagtcggcgagagcattcttatatgcaagaatagtgagaagtctaagggcattgctttactgcaaggtagtttgaagcctgtgagatcttgcttacagagacgggagggcgaagaagttacagggagtatgatcagagctatcttggagatcatagttgggggtgtagcctctacgagccaggatatgcatacctatgcagcctgtacgttcctggccgcttccatgaaagagggcaaacagggcattcagaggaaccaggaatcggtgcaactcggggctatagaggcctgtgtgatgtggttactggagaatgagttcattcagtccacagaggccagtgacggtactgaaggcaaagtgtaccaccccacccatctggggtcagctaccctctcgtcttcgctgtcacccgctgataccctcgatatctttgctgacttgcagagggccatgaaaggtttcgtgctcgagaatgatctacatatcctttatctggtgactcctatgttcgaggattggactaccattgattggtatcggttcttttgcctgtgggagaagctgcctactagtatgaagagggtggctgaactcgttggagtggaggaagggtttctggcccgatgcgtgaagggtaaagtcgtggccagaaccgaacgccagcacagacagatggctattcataaacggttctttactagcctcgtcctgcttgacctcatttcagaagtgcccttaagagagatcaatcagaagtacggttgcaataggggtcagatccaaagccttcagcaaagcgcagctgtatacgcgggaatgatcaccgtgttttctaaccgactcggctggcataatatggaattgctgttgagccagttccaaaagcgcttgacctttggcatccagagagagctgtgcgatctggtgcgcgtatccctcttgaatgctcagcgggctagggtgctgtatgccagcggattccacaccgtagcggatctggcgagagccaatattgtggaggtcgaggtgattctgaagaacgcggtgcctttcaagtcagccagaaaagctgtagatgaagaggaggaagccgttgaggagaggcgcaatatgcgtacgatctgggtaacaggaaggaaggggctcaccgaacgggaagccgcagctcttatcgtggaagaggccaggatgatcttgcagcaggatctcgtggagatgggcgttcagtggaatccttgtgccttgctacacagctctacctgcagtctgacacactctgagtcagaggtgaaagaacacacctttattagccagacgaagtcatcatataagaaactaacctcaaagaataagtccaatacaattttctccgacagttacatcaaacattcacccaatattgtgcaagatctaaataaaagccgcgaacacactagcagcttcaattgtaacttccagaatggtaatcaggagcaccagacgtgttcaatttttagggccagaaagcgtgcgtcgttagacatcaataaggagaagccaggagccagtcagaacgagggaaagacgtctgacaagaaagtggtgcaaaccttctcacagaagaccaagaaagctcccttaaactttaacagcgagaagatgtcccgatcgttccgctcatggaagaggaggaaacatctgaaacgatccagggacagtagccccctgaaggactccggcgcttgcaggatccacctgcagggccaaacgctgtccaatccctctctctgtgaggacccctttacacttgacgagaaaaagaccgaatttcggaacagtggaccctttgcaaagaacgtgagcctcagcggcaaggaaaaggataacaaaaccagctttccgcttcagattaagcagaactgcagttggaacatcaccctaacgaatgacaattttgtagaacatatcgttacgggaagccagagcaagaacgtaacctgccaggccacgtcggtggtgtctgagaagggcagaggggtggctgtggaggcagagaaaattaatgaggtgttgatccagaacggcagtaagaaccagaacgtgtatatgaaacaccacgacatccaccccattaatcaatacctcagaaaacagtctcacgagcaaaccagtaccattacaaagcaaaaaaatattatcgagcgtcagatgccctgcgaagctgtttcatcctacatcaaccgagacagcaatgttacaatcaattgtgaaaggatcaagctcaatactgaggaaaataagccctcccacttccaggccctgggagatgacattagcagaaccgtgatcccatccgaagttctcccttcggctggagctttctccaagtctgagggacagcacgaaaattttctgaatattagccgtctccaggagaaaaccggcacatacacaacgaataagacaaaaaacaaccacgtcagtgacctgggcttggtgttgtgtgactttgaagacagcttctatctggatacacaaagcgaaaagattattcagcaaatggccacagagaatgcaaaactgggggcaaaggacactaatttggccgcaggaatcatgcagaagagtcttgtgcagcagaatagtatgaatagctttcagaaagaatgccatataccattccccgcagagcaacacccactgggagccaccaaaatcgatcatctggatcttaaaaccgttggcactatgaagcagagctctgacagtcacggcgtggacattctaactcccgaatcccctatattccatagcccgatattactagaagaaaacggcctgttcttgaagaaaaacgaggtctccgtcactgattcccagctgaactccttcctgcagggatatcaaacccaggagacagtcaaacccgttatattgctcattccacagaaaagaactcctactggggtagagggtgagtgtctacctgtgcccgagacgtctcttaacatgagcgactccctgctttttgattctttttccgacgactatcttgttaaggaacagctcccggatatgcaaatgaaagaacccctgccttccgaagttacgtccaaccatttctctgatagcttatgtctgcaggaagacctcatcaagaagtcaaatgtaaacgaaaaccaagatactcaccagcagctgacgtgcagcaatgacgagagtatcattttttccgaaatggactccgtgcagatggttgaggctcttgacaacgtggatatcttcccagtgcaggaaaaaaatcacactgtggtttctcctcgcgctctggagcttagcgatccagtgttagacgaacatcaccaaggagaccaggatggcggtgaccaagacgaacgggcagagaaatcaaaacttactggcaccagacagaaccattcatttatttggagcggagctagtttcgacctgtctcccggattacagcgcattctggacaaagtcagtagccctctggaaaacgagaagctgaagtctatgaccattaatttttccagcctgaaccgtaagaatacggagctcaacgaagaacaagaagtcatctccaacctggaaaccaaacaggtgcagggaatatcgttcagctccaacaacgaggtaaaatccaaaattgagatgctcgagaataacgccaaccacgacgaaacaagctccctgctgcctagaaaggaatcaaacatcgtggacgataatggactaatcccacccaccccaatacccacttctgcaagtaaactgacattccccggaattctggagacacccgtgaacccatggaagacaaacaacgttctgcagccaggggagagctacttatttgggtccccttcagatattaaaaaccatgaccttagccccggttcgcgtaacggattcaaggacaatagccctatctcagacacaagtttttcactccagctttcccaggacgggctgcaactgacccctgcgtcatcatcaagtgagagtcttagcattatcgacgtggcctcagatcagaacttgtttcaaaccttcatcaaagagtggcggtgtaaaaaacgcttcagcatcagccttgcctgcgaaaaaattaggtcattaacaagttcaaagacagctacaatcggtagtagattcaagcaggctagctctcctcaagaaattcctattcgcgacgatggcttcccaataaagggctgtgacgacacactggtcgtcggactagccgtgtgttggggtggtagagatgcgtactacttctcgctgcaaaaggagcagaaacatagtgaaatcagcgcctcattagtgcccccatctttggaccctagtctaactctcaaagatcggatgtggtacttacaatcatgtttaagaaaggaaagcgataaggagtgtagtgtggtcatttacgattttattcagagctacaaaatccttctgctgtcttgtgggatatccctggagcagtcttacgaagatcctaaggtggcttgttggctgctcgatcccgattcccaggaaccaaccctgcactccattgtgaccagcttcttgccccacgagctgcctctgctggaaggaatggagactagccagggtatccagagcttgggactgaacgcgggatccgagcacagtggtagatatcgggctagcgtggagagcattctgatattcaactccatgaatcagctgaacagtctcctgcaaaaggaaaatctgcaggacgtgtttagaaaagtggagatgccctcacagtattgcctggctcttcttgagctgaacggcattggtttctccactgctgaatgcgagagtcagaaacacattatgcaagctaagctcgatgcgattgaaacacaagcctaccagcttgctggccacagctttagtttcactagctcggatgacatcgctgaggttctatttttggagttgaagctgcctccgaatcgagagatgaaaaaccaggggagtaagaagaccttgggctcaacaagaagaggtatcgataacggcagaaagctaaggctcggaagacagttttccactagtaaggatgtcctaaacaaactgaaagccctgcaccccttgcccggtctgattctggaatggcgaagaatcacaaatgctattaccaaagttgtattccctctacagcgagaaaagtgcctgaatccctttctgggcatggaacgcatttacccagtctctcagagtcacactgctaccggcagaatcacctttaccgagccaaatattcagaacgtaccacgcgatttcgaaatcaagatgcctaccttggtcggagagtctcccccatcacaagcagtggggaaaggcctccttccaatgggcagaggcaagtacaagaaggggttttccgttaaccccaggtgccaagcccaaatggaagagagagccgctgacagaggaatgccattttccatctcaatgaggcacgccttcgtaccattcccgggtgggtctatcctggctgctgattatagtcagttggagttaagaatcttggctcacctgtcgcacgatcggaggctcatacaagtattgaacacaggagccgacgtgttcagatccatagcagctgaatggaaaatgatcgagcccgagagcgtcggagacgatctgcggcagcaggcaaaacagatttgttatggaatcatctatgggatgggggctaagagcctgggcgagcaaatggggatcaaggaaaacgatgcagcctgctacatagatagtttcaagagtaggtatacgggcatcaatcagttcatgactgagactgtgaaaaactgtaaacgggatgggttcgtgcagacaatattaggcagacgcagatacctcccagggatcaaggacaacaatccctaccgtaaagcacatgccgagcggcaggcaatcaatacaatcgtgcagggctccgcggcagatattgtgaagatagctacagtaaatatccaaaaacagctggagactttccactcaacttttaagagccacggtcaccgtgagggaatgctgcagtcggatcagacagggcttagtcgtaagcgtaaactgcagggcatgttttgcccaatccgtggcggtttctttatcctgcagctgcacgatgaacttctctacgaggttgcggaagaagatgtggtgcaggtagctcagatcgtgaagaatgagatggagtctgccgtgaaactgagtgtcaaacttaaggtcaaagtgaagatcggtgctagctggggggaactgaaagactttgacgtgtaa

SEQ ID NO: 235455 - DNA, 8180 bp, Artificial Sequence
  Description of Artificial Sequence: Synthetic coding sequence
atgaacgggcaccgttttacatttcggacacgtagcctgctccctctgcagaagggacaacaccgatgtatcacaaagcttttggctcataatgatccatggggaatctttagggcacctagttccagaagatcttatagtgtttctggagtatgccagccagcgataccaaatagtagcctccatatccctcataatgcttgttggctaaaatggaagctttgttccgaaatagctcttccctaccatcacattctgggggagagacgaaagttgtgttccatcaggcggtttgaattcgaggactggcgagaagatgttagatcctgctgccaggctcgtgttctcccccgagggaggaccttgggtctgtggctggccctgatcggccgagaagaatttgctatgaacttgttgcgtagaagcggcaagcggaggaggtccgagtctggcagcgatagcttcagcgggtccggcggagactcctcggcctcgccccagtttctttccggcagcgttctttccccacccccaggcctcggtagatgtctcaaggcagcagccgctggggaatgcaagcccacagtcccagactacgaaagggataaacttctcttagctaattgggggctgcccaaagcggtgttggaaaagtaccattctttcggagtgaagaagatgttcgagtggcaggccgagtgtctactgctggggcaagtgctggagggaaagaacctcgtgtactctgccccaacaagcgccggtaaaacactggtagctgaattgctcatcctgaagcgcgtgctggaaatgcgaaaaaaggccctctttattttaccattcgtatccgtagccaaggagaagaagtactatctgcagtccctgttccaggaggtcgggatcaaggtggacggctacatgggttcgacttccccatcccggcatttctcttctctagatatcgccgtttgtaccatcgaacgcgctaacggcctgatcaaccggctgatcgaagagaacaagatggatctgttgggcatggtggttgtggacgagcttcacatgctgggcgattctcaccggggatacttgctcgaactcctcctgaccaaaatctgttacatcacaagaaaatccgcatcttgtcaagcagacctcgccagtagtctctctaatgctgtacagattgtcggcatgagcgctaccctgcctaacctcgagctggtcgcgtcctggcttaacgccgagttatatcacaccgactttcgccctgtaccactgctcgaaagtgtaaaagtgggcaatagtatctacgactcatccatgaagctggttagggagttcgagccgatgctgcaggtcaagggtgacgaggaccacgttgtttccttgtgttatgagaccatctgcgataatcactcagtattgcttttctgcccttccaagaaatggtgtgaaaagttagccgacattattgccagagaattttataatctgcatcatcaggcagaaggcgagggcctggtgaaaccttctgaatgccctcctgtcattcttgagcagaaggagcttctggaagttatggatcagctgagacgacttcctagcggactggatagcgtgctccaaaaaacagtcccttggggggtggccttccaccacgccggattgacctttgaggagcgggatatcattgagggcgctttcaggcagggactgatacgcgtactggcggctacttcaaccctaagtagtggggtgaatcttcccgcaagacgcgttatcatccgaacgcccattttcggcggacggccactcgacattctgacatacaaacagatggtaggcagggccggacgaaagggagtcgacaccgtggaatcaattctgatctgtaaaaattcagaaaaatccaaaggtatagccctgctccagggatcgctgaagcctgttcggagttgcttgcagcggagggaaggagaggaggtgaccggcagcatgatcagggccattctggaaatcatcgtcggtggcgtggcatccacatcccaggacatgcacacttacgctgcttgcacgtttcttgccgcttcaatgaaggaaggcaaacagggtatacagaggaaccaggagtccgtccagctgggggctatcgaagcttgtgtgatgtggttgctggagaatgaatttattcagtccactgaggccagcgatggaactgagggcaaggtgtaccacccaactcacttggggtcagccactctatcaagctctctttctcccgctgacaccttggatatctttgccgatctgcagcgtgcgatgaaaggcttcgttttggaaaacgacctgcacatcctgtaccttgtcacacccatgtttgaagactggaccactatcgattggtatcgcttcttctgcctgtgggaaaaacttcccaccagcatgaaaagagtagcagagctcgtcggggtggaggagggattcctcgccaggtgtgtgaagggaaaggttgtggctcgtaccgaacgacagcaccggcagatggctatccacaagcggttctttacgtctctggtcctgctggatctgattagcgaggtgccattgagggagatcaaccagaagtatgggtgtaatcggggtcaaatccaatcactgcagcaatctgcagcagtatacgctggcatgatcacagtcttctccaataggttagggtggcacaacatggagcttctcctatctcagttccagaagcgtctgacctttggtatccagagagagctatgcgacctggtgagggtgtctctcctgaatgcgcaacgcgctagggtgctgtacgctagtggctttcacacagtggccgatctggcccgtgccaacatcgtcgaggttgaagtgatcctcaaaaacgccgtgcctttcaagagcgcccgaaaggcagttgatgaagaagaagaggcggtagaggagagacgcaatatgcgcactatctgggtgaccggccgaaagggactgacagaacgggaggccgcagccctgatagtggaggaggcgcgaatgatcctgcagcaggatctggtggagatgggggttcagtggaacccatgcgcattgctgcacagtagtacatgtagccttacccactctgaatcagaggttaaagaacacacctttatttcacaaactaagtcatcctacaagaaactgacttccaaaaacaagtcaaatacaatttttagcgattcttacatcaagcactctcccaacatagtgcaagacctgaataagagccgcgagcacacatcgagttttaattgcaatttccagaatggtaaccaggaacaccagacttgctctatctttagggccagaaagagggcctctctggatatcaacaaagagaaacctggcgcaagtcagaacgaggggaagactagcgataaaaaagttgttcagactttcagccagaagacgaaaaaggcacccctgaatttcaacagcgagaagatgtcaagaagcttccgctcgtggaaacgtagaaagcatctgaagagatcccgcgactccagccccctcaaagactccggtgcctgtcggatccacctgcaggggcagacgctttctaatccctcgctgtgtgaagatccgtttacactcgacgagaagaaaacagagttcaggaatagcgggcctttcgccaagaacgtctccctgtccggaaaggaaaaggacaacaagacgtcttttccgctgcagatcaagcagaactgttcctggaatatcaccttgaccaatgacaacttcgttgagcacatcgtcaccggatcccagtcaaagaatgtcacttgtcaagcgacatccgtggtgtcagagaaaggacgaggcgtagccgttgaggcagagaaaattaacgaagtcttaattcagaacggctcaaagaatcagaacgtgtatatgaagcatcacgatattcacccaataaatcagtacttacgaaagcagtcccatgagcaaacaagcactatcacaaagcagaaaaatattatcgagaggcagatgccttgtgaggctgtgtcctcatacattaatcgcgattccaacgtcacaatcaactgtgagcgcattaaacttaacacggaggaaaacaagccctctcacttccaggcactcggggatgatatctccagaacagtgattccgtctgaagtgcttcccagcgccggagcctttagtaaatcagagggccaacacgagaactttctaaatatcagtagactccaggagaagacaggtacttatactacaaacaaaactaagaataatcatgtctctgatcttggtcttgtcctctgtgatttcgaggactccttctaccttgacacccaatctgaaaaaatcatacaacaaatggctaccgagaacgccaagctcggcgcaaaggatacgaacctggcagccggtatcatgcagaagtccttggtccagcagaacagtatgaacagttttcagaaggaatgtcatatcccgtttcctgcagagcagcatcctttaggggctaccaagattgaccacctggacctcaaaacagttgggactatgaagcagtcttctgacagtcatggcgtcgatatcttgactcctgagtcgcctatcttccattctcccatcctcctggaggagaacgggctttttctcaagaaaaacgaagtaagcgtaactgactcccagctgaactccttcctgcagggctaccagactcaggaaacagttaagccggttatactcctcatcccccaaaagagaacccctactggcgtggaaggcgaatgcctgcccgtgcctgagacctcccttaatatgagtgacagcctgctattcgacagcttttccgacgactatctggtcaaggagcagctgcctgatatgcaaatgaaagaacctcttccatccgaagtgaccagcaatcatttttccgactcactgtgccttcaggaagacctcatcaagaaaagcaacgtgaatgaaaaccaggatacacatcagcaacttacatgcagtaacgatgaatctatcatcttcagcgaaatggatagtgttcaaatggtcgaggctctggataacgtcgacatatttcctgtgcaggaaaaaaaccacaccgtcgtctccccccgtgctctggaacttagtgaccccgtgctcgatgagcaccaccagggcgaccaggacgggggagaccaggacgaaagagccgagaagtcaaagctgacagggacacggcaaaaccatagctttatctggtcaggagcgtccttcgatctctcacccggacttcagcgcattcttgataaagtatcaagtcccctggagaatgaaaaattgaagagcatgaccatcaacttttcttctcttaatcgaaaaaacaccgagctgaacgaagagcaggaggtcattagtaatttggaaaccaagcaggtgcaaggcatttcattttcaagcaataatgaagtgaaatccaaaatcgagatgttagagaacaatgcaaaccatgatgagacatcctcgctgcttcctcgaaaagagtccaatatcgtagacgacaacggactaatcccacccactcctattccgacatctgccagcaagctcacattcccaggaatcctggaaacgcctgtgaacccatggaagactaataacgtgctgcagcctggcgagtcctatctgttcgggtctccgagtgacatcaaaaaccacgatctctcacctggatcacggaatggatttaaggacaactctcccatctcagatacatcttttagcctccagctgagccaggacgggctgcagttgaccccagcgtcatcatcctcagagagcttgtcgattatagacgtggcctccgaccagaatctgtttcagactttcatcaaggaatggcggtgcaagaagcggttctctatatcccttgcttgtgagaagatacgttcattgacatccagcaaaactgctactatcggctccaggttcaagcaagcgtcgtctcctcaggaaattcccattagggacgacggatttcccattaagggatgtgacgacaccctcgtcgtagggcttgctgtttgctggggcggacgggatgcatactatttttccctacaaaaggaacaaaagcattccgagatttctgcctcgttggtgcccccttctttagacccgagcctaaccctaaaggatcggatgtggtaccttcagtcctgcctgcgcaaagagtccgacaaagagtgtagtgtggtgatttatgatttcatccagagctataagatcctgctgctgtcttgcggcattagcctggagcaatcttacgaagaccctaaggttgcctgttggctgttggaccccgattcacaggaaccaaccctgcactcaatcgtaacctccttcctgccacacgaacttcctctgctggagggtatggagacctcacagggcattcagagcctggggctgaatgcaggcagcgagcattcaggacgatacagagcctctgtggagtctatcctgatctttaactctatgaaccagctgaattccctgctccaaaaggaaaatttacaggacgtatttcgcaaagtggaaatgccaagccagtactgcctcgcgttgcttgagctgaatggtattggtttcagcaccgcagagtgtgagagccagaaacacattatgcaggctaagttggacgccattgagacccaggcctaccagttggccggacactccttctcattcacttcttctgatgacatagcagaggtcttgtttcttgagctgaaattacccccaaaccgggaaatgaagaaccaagggtctaaaaaaacccttggctccactagacggggaattgataatggtagaaaattacggctggggcgacagttctccaccagtaaagacgtgctgaacaagcttaaggctctgcatccattgccaggactgatcctggagtggaggcgcataaccaacgccatcacaaaagtggttttccctctgcagcgagaaaagtgtctcaacccttttctggggatggagaggatttaccctgtctcacagtcgcacaccgctacaggcagaattactttcaccgaacctaatattcagaacgtccctcgtgacttcgaaatcaaaatgccgactctggtcggcgagtctccacctagtcaagccgtggggaaaggtctgctacccatgggcagagggaagtacaagaaggggttctccgtgaatccaaggtgtcaggctcagatggaagagcgagccgcagatcgcggaatgcctttctctatctcaatgcggcacgccttcgtgcctttcccagggggatctattctggccgcagactactcgcagctggagctgcgcatcctcgcccacctatcccacgacagaaggcttatccaggtactgaataccggcgctgacgtgttccgcagcattgccgctgaatggaaaatgatcgagcccgagtctgtcggcgatgacctgcggcagcaggcgaagcaaatctgttacggaataatttatggcatgggcgctaagtctctgggcgagcagatgggaataaaagagaatgacgcagcctgttacatcgacagtttcaagtctagatacactggcatcaaccaatttatgaccgaaaccgtcaaaaactgcaagcgggacggatttgtgcagacaatcttgggcaggagacgttatttgcccggaatcaaggacaataatccatatcgcaaggcgcatgccgaaagacaagccatcaataccatcgttcagggttccgccgcagacatagtgaaaattgcaaccgtgaatatccaaaagcagctggaaacattccacagcacgttcaagagccacggtcacagagaaggaatgctccaatctgaccagactggcctgagccgtaagcgtaaactgcaaggcatgttctgccctatacgtgggggattcttcattcttcagttgcacgacgagctcctctacgaggtcgcggaggaggacgtagtgcaagtggctcagatcgtcaagaacgaaatggaaagcgccgtcaaactgtcggtcaaactgaaagtgaaggtaaaaatcggcgcatcatggggggagctgaaggatttcgatgtgta

SEQ ID NO: 235456 - DNA, 6641 bp, Artificial Sequence
  Description of Artificial Sequence: Synthetic coding sequence
atgccaacttccaatagtcagaaggagctgctagaggtgatggatcagctgagacgcctgccaagtggcctggatagtgtgttacaaaagacagtaccatggggcgtggcattccaccacgcaggattaactttcgaagaaagggacatcatcgaaggcgcatttcgccagggcttaatacgggtgctcgcagctactagcactttgtcaagcggcgtcaatctgcccgctagaagggtcattattagaaccccgatcttcggagggcgaccactggacattctgacttataaacaaatggtaggtagggccggtagaaagggtgtcgataccgtgggcgagtcaatcctgatatgcaaaaacagcgagaaaagcaagggcatcgctctactgcagggaagtttgaaacccgtaaggagttgcttacagcgtcgagagggcgaggaggtgaccggcagtatgattagagcgatcctcgagattatcgtgggcggagtggctagcacttcacaggacatgcacacatacgccgcatgcacttttttagcagcctctatgaaagaaggaaagcagggaatccaacgcaaccaggagtctgtgcagcttggtgccatagaagcatgcgtcatgtggctgctggagaacgagtttatacaatcaacagaggctagcgatggcactgaggggaaggtgtaccaccccacacatctgggcagcgcaaccctcagctcttccctcagccccgctgacacgctcgacatcttcgcggacctgcagcgtgccatgaaagggtttgtgctggagaacgaccttcacattctttacctagtgacgccaatgtttgaggactggactaccatagattggtatcgcttcttttgtctgtgggagaagctgccgacaagtatgaaacgcgtcgccgaactggttggggtcgaagaagggttcctggcacgctgtgtgaagggtaaagtggtcgctcgaaccgagcggcagcatcgacaaatggcaatacacaagcgctttttcacaagtctggtgctgctggatctgattagcgaagtgccgttacgggagatcaaccagaagtacgggtgtaacagaggccagatccaatctttgcagcagtccgcggcagtgtacgccggtatgatcaccgttttctccaacaggctgggctggcacaatatggaactcctgctgagccagttccagaagcggctcacttttggaattcagagagagttatgcgacctggtgcgggtctcattattgaatgctcagcgggcacgtgtcttatacgcatccggattccatacggttgctgatctggcccgtgcaaacattgtcgaagtggaagtgatcttgaaaaacgccgtgcccttcaagtcagcacgcaaagcagtagacgaggaagaggaggctgttgaagagcgcagaaatatgcgtaccatttgggtaacagggagaaagggcctcaccgagagggaggctgcagccttgatcgtcgaagaagcaaggatgatcctgcagcaggatctggtagaaatgggagtacaatggaatccctgtgctctcctccacagtagcacatgttctctgacccactccgagagcgaagtgaaagaacacactttcatttcccagacaaagagcagctataagaaacttacgagcaagaataagtctaacactatattctcggactcctatatcaagcatagcccgaacatcgtgcaggatctaaacaagagtcgggaacataccagcagctttaactgcaactttcaaaacggcaaccaagaacatcagacgtgcagcatctttagagcccgaaagagggctagccttgacatcaacaaggagaagcctggcgctagccagaacgagggtaagacgtccgataaaaaagtggtccagacattcagtcaaaaaacaaagaaagctcctttgaactttaatagcgagaagatgtcaaggagttttcggtcttggaaaagacggaagcatctcaaaaggtctcgcgactcttctcccctcaaagatagcggagcgtgccgcattcatctgcagggccagaccctgtccaatcccagcctctgtgaagatcctttcacactggacgaaaaaaaaacagaatttcgcaatagcgggccatttgctaagaatgtgagcttgtccggcaaggagaaggacaataaaactagttttcctctgcagataaaacagaattgtagctggaatataacgttgaccaacgacaatttcgttgagcatattgtgacgggctcgcaatccaagaatgtgacatgccaggcaaccagtgtcgtgtcagagaagggacgaggagtcgcagttgaggccgagaagatcaatgaggtgctgatccagaatggttcaaagaatcagaacgtgtatatgaagcatcacgatatacatcccattaatcaatacctgcgcaagcagtctcatgagcagacttccaccatcacaaaacaaaagaacataatcgaacgtcaaatgccctgtgaggcggtctcttcatacattaatcgggattccaatgtgaccatcaactgtgagcggattaagttgaatacggaagaaaacaagccctcacatttccaagcgctgggcgacgatatctctagaactgtgatcccttctgaggtacttccttccgccggagctttctctaaaagtgaaggccagcatgaaaactttctgaacattagtagactacaggaaaagacgggtacttatacaaccaataagacgaagaataaccatgtcagtgacctcggcctagtcctgtgcgacttcgaagattcgttctacctggacactcaatctgaaaagatcattcagcagatggcaacagagaatgctaaactgggagctaaagacaccaacctggccgctggtattatgcagaagagcctcgtgcagcagaattcaatgaattcgtttcaaaaagagtgtcacattcctttcccagcggagcagcacccattgggggctacgaagatcgaccacctcgacttgaaaacagtgggcacaatgaagcagtcttctgactcacacggtgtggatattttgacacccgaaagcccaatttttcattctcctatattgctggaagaaaacggcctcttcctcaaaaaaaacgaagtgagcgtaacagactcacagctgaacagctttctgcagggctaccagacacaggaaaccgttaagcctgtgattctgttgatcccccagaaacggactcccactggcgtagagggggaatgtcttccagtaccggaaaccagtctgaatatgagtgactctctgctcttcgacagcttctctgatgattacctcgttaaggagcagctgcccgatatgcaaatgaaagagcctctaccctctgaagttacttccaaccatttcagtgattccctgtgcttacaggaagatttgatcaaaaaatccaatgtgaacgaaaatcaggacacccaccagcagctaacctgcagtaatgatgaatcgatcatatttagtgaaatggattcagtgcagatggtagaagccctggataatgtggatatatttcccgtccaggaaaagaaccatacagtcgtttccccgagagcactcgagctctccgatcccgtcctcgatgagcaccaccaaggggaccaggacgggggagaccaggacgaaagggcagaaaagtcgaagctgaccggtaccaggcagaaccactccttcatatggtcaggggcttcttttgatctgtcccccggtcttcagcgaatcctggacaaagtgagttcccccttggagaatgaaaagctgaaaagtatgaccattaacttttcatcactcaatcgaaagaatactgaacttaacgaggagcaggaagtgatcagcaacttggagactaaacaggtacaggggatcagtttcagttcaaacaacgaggtaaaatcaaaaattgagatgctggaaaacaacgccaatcacgatgaaacaagctctctgttgcccagaaaggagagtaatatcgtcgacgataatgggcttataccacctaccccaattcccacctctgcctccaaactcacattccccggtattctggaaaccccggtgaacccctggaagaccaacaacgtcttgcagccgggtgagagttacctgttcgggagcccgtccgatatcaagaaccacgatctgtctcctggtagcaggaatggctttaaggacaactcaccgatctcagatacaagcttctccctgcagctgagccaggatggactgcagctgactcccgcttcctcttcttctgaaagcctttcgattatagacgtggccagtgaccaaaacttatttcagacattcattaaagaatggcgatgcaaaaagcgcttctctatttccctggcctgtgagaaaatcagatccctgacgtcaagcaaaacagccactatcggcagccggttcaagcaggcctcttcacctcaagagatcccaatcagggatgacgggttcccaatcaagggctgtgacgacactctagtggttgggcttgcggtgtgttgggggggacgggatgcctattactttagcctgcagaaggagcagaaacattctgaaatttccgcatctctcgtccccccttccctcgaccctagcttgaccctgaaagacaggatgtggtatttgcaaagttgtctcagaaaggagagcgacaaggagtgctccgttgtgatctacgatttcatccagagctacaagatattactgctatcttgcggtatttcattggagcagtcttacgaagaccctaaggtcgcatgttggctcttggatccagacagccaagagcccactctgcactcaattgtaacaagttttctaccacacgaactccctctgttggagggcatggaaaccagtcaagggattcaatctctgggactaaacgccggatctgagcactccggacgctaccgggcatctgttgagtccatcttgattttcaactccatgaaccaactgaacagcctgcttcaaaaagagaatctgcaagacgtgtttcgcaaggtggaaatgccttcgcagtattgtctggcactactcgagctgaacggtataggattttccacagctgaatgcgagagccagaaacatatcatgcaagctaagcttgatgctatagagactcaagcctaccagcttgcgggacacagcttctcattcacgagctccgacgatatcgcagaagtcctgttcctggagttaaagctgcctccaaacagagagatgaagaaccagggaagcaagaaaaccttaggttcgacaaggagagggattgataacgggaggaagctaaggctcggaagacagttttccacctctaaggatgtccttaacaaactcaaagctctgcatccccttccaggactgatactggagtggaggaggataactaacgctataacaaaggtggtgtttccgcttcaaagggaaaagtgccttaatcctttcctcggcatggaaagaatttatccagtgtctcagtcccacacagcaactggaagaattacgtttacagagcccaacatccagaatgtcccaagagatttcgagataaagatgcctaccctcgtaggtgaaagtccccctagtcaggccgtggggaagggactgctgcccatggggcgtggcaagtacaaaaagggatttagcgtcaaccccagatgccaggctcagatggaagaacgggcagccgacaggggcatgccgttttctattagtatgagacatgcttttgtgccgttcccagggggatccatactagccgctgattatagtcaacttgaacttagaatcctggcacacctcagtcacgacagacgccttatccaggtgctcaatacaggggcagacgtgtttcgcagtatcgccgcagaatggaagatgattgaacccgagagcgtcggggatgatctgcgccagcaggcaaagcagatttgttatggaatcatttacggcatgggggcaaaatcgttgggtgagcagatgggtattaaggagaacgacgccgcatgctatatcgactcattcaaatctaggtacactgggatcaatcaattcatgaccgagactgtgaagaactgcaaacgggacggcttcgtccagaccattttgggtcgaagacgctatctccccggtataaaagacaataatccataccgcaaagctcatgccgagcggcaagccattaacaccatagttcaaggatccgccgcagatattgtcaagatagcgaccgtgaacatccagaaacaactcgagacctttcatagcacctttaaatctcatggccaccgcgagggaatgctgcagtctgatcaaacaggactctcacgaaagcggaagcttcagggcatgttttgccctattcgcggtggcttctttatactccagctgcacgacgagctgttgtatgaggtggccgaagaggacgttgttcaggtggcccagattgtgaagaacgaaatggaatccgccgtgaaactcagtgtcaagctgaaggtgaaggttaaaattggggcatcttggggcgagcttaaggacttcgatgtgta

SEQ ID NO: 235457 - DNA, 240 bp, Artificial Sequence
  Description of Artificial Sequence: Synthetic coding sequence
atgggcaggaagagactgattacggactcgtaccccgtggtcaaacgtcgggagggtccagccggtcacagcaagggggagctcgccccagagttaggggaagagcctcagcccagagatgaagaggaagccgaactcgaactgctgcggcagttcgacctggcttggcagtacggcccatgtactgtcagtggaattagcattccatatgaagcccctcggaagacctcctgcccctag

SEQ ID NO: 235458 - DNA, 324 bp, Artificial Sequence
  Description of Artificial Sequence: Synthetic coding sequence
atgggcaggaaacggctcataactgacagttacccagttgttaagagacgggaggggccagctggacactcaaaaggagagctggcacccgaattaggagaggagccacagcccagagacgaggaagaagccgagctcgaactgttgcgtcagtttgacctagcttggcaatatggaccttgcacaggcattactcggcttcaaaggtggtgccgcgctaaacaaatggggcttgagccccctcctgaagtctggcaggttctgaaaacacatcctggcgatccgcgatttcaatgtagcctgtggcacttgtatccgttatag

SEQ ID NO: 235459 - DNA, 105 bp, Artificial Sequence
  Description of Artificial Sequence: Synthetic coding sequence
atggggcgaaaacgactgataaccgattcttacccggttgtgaagcgaagagaagggcctgccggacactccaaaggagagctggcacctgagttgggtctgtag

SEQ ID NO: 235460 - DNA, 1266 bp, Artificial Sequence
  Description of Artificial Sequence: Synthetic coding sequence
atggcggatatctctttggatgaacttattcggaaaagaggagcagcagcaaagggacgcttaaacgctaggccaggtgtggggggagtacgttctagggtggggattcagcagggtctcctgtcccagtctacccggacggccacattccagcagcggtttgacgccagacaaaaaatcggcctctccgatgctcgactgaagctcggagtcaaggacgcccgtgaaaagctcctgcagaaggacgcgaggttcagaatcaaggggaaagtgcaggacgctagagagatgttgaattcacgaaagcagcagacaacagtgccccaaaagcccagacaggtggctgacgcccgagagaaaatatctcttaagcgctcaagccctgcagcattcatcaatcctccaatcggcacagtgaccccggcactcaaactcacgaaaacaatccaggttccacagcagaaggccatggccccactgcacccacacccagccggaatgcgcattaacgtggtgaataatcaccaggcaaaacagaacttgtatgatctcgatgaggatgacgatggaatcgcatctgtgcccactaaacagatgaagttcgcagctagcggcggttttctacaccacatggctgggttgtcttcctctaaactttcaatgagcaaagcactgcccctgactaaggtggtgcagaacgatgcatatacagcccctgcactgccatccagcattagaacaaaagctcttaccaatatgtcccggactctcgtcaataaagaggaacccccaaaggaactgcccgcagctgagcccgtgctatcccctctagagggcactaagatgactgtcaataacttgcaccctcgcgtcactgaagaggatatcgtcgaactgttttgcgtgtgcggtgcactgaagcgggctagactggtgcaccccggagtggcagaggtggtgttcgtgaagaaagacgacgcaatcaccgcttataagaagtataacaacagatgtctggacggtcagcctatgaagtgcaacttacacatgaacggtaatgttatcacttctgatcagcccattctgcttcgcctgagcgactccccttccatgaagaaggagtctgaactgcccaggcgcgttaattccgccagcagcagcaaccccccagccgaggtggatccagataccatcttgaaagcactgtttaaatcaagcggcgcttccgtgacaacccagcctactgaattcaaaattaagctttag

SEQ ID NO: 235461 - DNA, 558 bp, Artificial Sequence
  Description of Artificial Sequence: Synthetic coding sequence
atggcagacatctctctggatgagctgattagaaagcgtggagctgctgccaaaggcaggctcaacgctcggccaggcgtggggggagtgcgttcccgcgtcggcatccagcagggtttactgtcacagagtaccaggaccgccacattccaacagcgcttcgatgcgagacagaagatcggactcagcgacgcaagattaaaactgggtgtcaaagatgctcgtgaaaaactgctgcagaaggacgcgaggtttcgtatcaagggaaaggtccaggacgctcgagaaatgctgaacagccgcaagcagcagaccacagtcccacaaaagccaagacaggttgctgacgccagggaaaaaatctctttaaagcgctcgtcccctgctgctttcatcaatcctccgatcggtactgtgactcctgcgctcaaacttaccaagacaattcaagttggtctccgagccgttcccttgctgtgcctagttagtggtggtgcctgggtgggctcccgcagtcaggcttcttgtccacttcccagcgggtctcgccctcattag

SEQ ID NO: 235462 - DNA, 1179 bp, Artificial Sequence
  Description of Artificial Sequence: Synthetic coding sequence
atggctgacatcagcctggacgagctcatcagaaaacgcggagctgctgctaaaggcagacttaacgcgaggccaggagtaggcggagtcaggagccgtgtgggcatccagcaagggctgcttagccaatccactcgcacggccacctttcagcaaagatttgatgcgaggcagaagattggactctctgacgcacgcttgaagctcggagttaaggatgcccgagaaaagctgctgcaaaaggacgcccgttttagaataaaaggcaaggtacaggacgctagggagatgctcaacagtaggaaacagcagacgaccgtgccacagaaaccacgccaggtcgctgacgctagagaaaaaatcagcctgaaaaggtctagcccagctgctttcatcaatccacctattggcactgtgactcccgcactgaagctcaccaagacaattcagaatctctatgatctcgacgaggatgatgacggaatcgctagtgttccaacaaagcaaatgaaatttgccgcatccggaggatttcttcaccacatggccggactgagttcttcaaaactgtcaatgtccaaagcacttccactgacaaaggtggttcagaacgatgcatatacagccccagcattgccgtcctccattcgcactaaggcgctaacaaatatgagccgtaccctggtgaacaaagaagaaccccctaaagagctgccggctgccgagcccgtgctgagcccactggagggcacaaaaatgaccgttaataatctacaccccagagtgacggaggaggacatcgtagagctattctgcgtgtgcggggctctgaaacgggcaagactggttcaccccggtgtggctgaggtagtctttgtgaagaaggatgacgctataacagcttacaaaaaatacaacaaccgatgtttggatggtcagcctatgaagtgcaacttgcacatgaacggaaacgtgattacctcggatcagccaatcttgctgcgattaagcgattctccatccatgaagaaggaaagcgagctcccaagacgggttaactctgcatccagcagtaaccctccagcggaggtcgatcctgataccattctcaaagctctcttcaagtcgtccggggcatctgtaactacacaaccaacagaatttaagattaaactgtag

SEQ ID NO: 235463 - DNA, 690 bp, Artificial Sequence
  Description of Artificial Sequence: Synthetic coding sequence
atggctgacatctctctcgacgaacttattaggaagcgcggagctgccgcaaaaggacgacttaatgcaagacctggggtgggcggagtgagaagcagggtcgggatccagcagggacttctgagtcagagcactcggacagcgactttccagcagcgctttgacgctcgccagaaaatcggcctgtcagatgctcgacttaaattaggcgtgaaggatgctcgagaaaaactgctgcagaaagatgcacgatttagaattaagggcaaggtccaggatgccagagagatgttaaattctaggaagcagcagactacagtcccacagaagcctcggcaggtcgcagatgccagggaaaaaatatccttgaagagatcaagccccgctgcattcataaaccccccaatcggaacagtgacaccagcccttaagttaactaagacgatccagaacctttacgatctggatgaagatgatgatgggatagctagcgtgcccacaaagcagatgaagttcgctgcctccggaggatttctccatcatatggctgggctgtcgagcagcaagttatcaatgagcaaggccttgcctcttacaaaggtagtccaaaatgacgcttacacagcccctgcactgcccagctcaattaggacaaaagccctgcccgtgcttacttcacccggtacttag

SEQ ID NO: 235464 - DNA, 561 bp, Artificial Sequence
  Description of Artificial Sequence: Synthetic coding sequence
atggcccctctgcatccccacccggcaggcatgagaattaatgtcgtcaacaatcaccaggccaagcagaatctgtatgacttagacgaagacgatgacggtatcgcttccgttcctacgaaacagatgaaatttgcagccagtggtgggtttttgcaccacatggctgggctgagctcatccaagctgagtatgtccaaggccctgccacttacaaaggtagtgcagaacgacgcttataccgccccagcactccccagctcaatccggaccaaggcacttaccaatatgtccagaacgttagtcaataaagaggaaccccctaaagagcttcctgcagccgaaccagttctctcacccctcgaaggtaccaaaatgacagttaacaatttgcatccgagagtgacagaggaggatatcgttgagctgttctgtgtttgtggggcacttaagcgagcgaggctggtacatccaggcgtggccgaagtggtatttgtgaaaaaagacgatgcaatcacagcctacaagaagtataataataggtgcctcgacgggggttag

SEQ ID NO: 235465 - DNA, 555 bp, Artificial Sequence
  Description of Artificial Sequence: Synthetic coding sequence
atggcagacattagtctggatgagctcatacggaaacggggtgcagccgcaaaagggcgactcaatgctaggcctggagtgggcggtgtgcggtctagggtcgggattcagcagggactactcagccagtcaacacgcactgccacgtttcagcagcgatttgacgctagacagaagatagggctttccgacgctcggctgaagttgggtgtgaaggacgccagggagaaactgctccagaaagatgcacggttccggatcaaggggaaggttcaggacgcaagagagatgctcaacagtagaaaacagcagaccaccgttcctcaaaaaccaagacaggttgcggacgctcgagaaaagatctccttaaaacgcagcagcccggctgcatttatcaacccacccatcgggaccgtgacccccgctttaaaattgacgaagactatccaggtaccaagcttcccctgtccgagaccttccttaagcccaaagtggttcagaatgatgcacacacagctcttactgtcattgcctctgtttgaacagaagccctag

SEQ ID NO: 235466 - DNA, 354 bp, Artificial Sequence
  Description of Artificial Sequence: Synthetic coding sequence
atggccgctgctgctgccgctggatccggcactcccagagaagaggaaggcccagccggagaggcagctgccagccagccacaggctccaacttctgttcccggtgcacggttaagcaggctcccgttagctagggtcaaagctctggtgaaagccgatcctgacgtgactctagctggccaagaggcaatcttcattttggccagagcagccgaactctttgtggagaccattgctaaagacgcttactgctgcgcccaacaaggtaaacgcaaaaccttgcagagaagagacttggacaacgctatcgaggcagtggacgaatttgcgttcttagaagggacgctggattag

SEQ ID NO: 235467 - DNA, 1029 bp, Artificial Sequence
  Description of Artificial Sequence: Synthetic coding sequence
atggcggcatcacaggcagtggaagagatgcggtcgagagttgtgctcggagagttcggcgtacggaacgtgcatactacagactttcctggtaactacagcggctacgatgacgcatgggatcaggaccgcttcgagaaaaattttcgcgtcgatgtcgtacatatggacgagaactccttggaattcgacatggttggtattgacgctgccattgccaatgcctttcgacggatccttttggccgaggtccctactatggctgtcgagaaggttttagtttataacaacacatctatcgtgcaagatgagatcttggcacaccgcctcggacttatccccatccatgccgacccacgactatttgagtatagaaaccagggagacgaagaaggaaccgagatcgacactcttcagttcaggctgcaagttcggtgtacaagaaacccacatgctgccaaagactcgtctgacccgaatgaactttatgtcaaccacaaggtgtatacccggcacatgacatggattcctctcggcaatcaggctgatctgtttcccgagggaacaatcaggccagtccatgatgatatccttatcgctcaacttcggccaggccaggaaatcgacttactgatgcactgcgtaaaaggcatcggcaaggaccacgccaaattctcccctgtggccacagctagctatcgcctactgcccgacatcactctgctggagccagtcgaaggggaggcagcagaggagctctccagatgcttttctccaggcgtgattgaggttcaggaggttcagggcaagaaagtcgcccgagtcgctaaccctcgcctggataccttttccagagaaatattccgcaatgagaagctgaagaaggtggttcgcttagcacgtgtccgggaccactatatctgcaagaaggatctacttgcagcagttgcccacacatgtaacccctctaccctcgggggtcagggtgagtggatcactgggagccgggagcgggaccatcccggttag

SEQ ID NO: 235468 - DNA, 633 bp, Artificial Sequence
  Description of Artificial Sequence: Synthetic coding sequence
atggccgtggaaaaggtcctggtctataataacacttcaatcgtccaggacgaaattctggcccatagactgggcctgataccaatccacgcggatcccaggttgttcgagtacagaaatcagggggacgaggagggaactgagatagacaccctccagttccgactgcaggtaaggtgcacccgtaatccccacgctgcaaaagattctagcgaccccaacgagttgtacgttaaccataaggtgtatacacgccatatgacttggattcccctcggcaatcaggctgacctgttcccagaaggaactattcgccctgtgcacgatgatatactgattgcccagctgcgcccaggccaagaaatagacctgctgatgcactgcgtgaaagggattggtaagaaagttgctagagtggccaatccgaggcttgacactttctctagagagatttttagaaatgaaaaactgaaaaaagtagttaggctcgccagagtgagggaccactacatcttctcagtcgagagcaccggagtgctccctcctgatgtattagtatcagaagccataaaggtcctgatgggcaagtgtcgacggtttctggacgagcttgatgccgtccaaatggactag

SEQ ID NO: 235469 - DNA, 1041 bp, Artificial Sequence
  Description of Artificial Sequence: Synthetic coding sequence
atggcggcttcacaagcggttgaggaaatgcgatccagagtcgttctgggcgaattcggtgtaaggaatgtgcatacaacagacttccctggtaattactctggatatgacgatgcctgggatcaggaccgttttgagaaaaactttcgagtggatgttgtgcacatggacgagaatagcctggagtttgatatggttggcatagatgccgctattgcaaacgcattcagaagaatcctgctcgcagaagtgcccaccatggctgtcgagaaagtgctggtgtacaataatacaagtatagttcaggatgagatattggcccaccggctcggtctcattcccatacacgctgaccccaggctttttgaatatcggaaccagggcgacgaagaaggtactgaaattgatacactacagttcagactgcaagtgcggtgcactcgcaatccacatgctgcaaaggatagctctgaccctaatgagctgtatgtgaaccataaagtgtatacacgtcacatgacatggattcccctcggcaaccaggccgacctctttccagaaggcaccatccgcccagtgcacgacgacatcctgatagcccagttgcgccctggccaggagattgacctactgatgcattgtgtcaaaggaattggcaaggatcatgccaagttctctccagtagcaaccgcgtcgtaccgcctcctcccagacataacactcttagagccagtcgagggcgaagccgcagaagaactgtcccggtgtttctcccccggtgtgatagaggtgcaggaagtgcaaggtaagaaagttgcccgagttgccaaccctagacttgatacgttttctagagagattttcagaaacgagaagctgaagaaggttgtccgcctggcgcgtgttagggatcattatattttctcagttgaatctactggagtgctgcctccagatgttcttgttagtgaggccatcaaggtgctaatgggaaaatgtcgccgattcctggatgagctcgacgctgtgcagatggactag

SEQ ID NO: 235470 - DNA, 369 bp, Artificial Sequence
  Description of Artificial Sequence: Synthetic coding sequence
atggaggaggaccaggaactcgagagaaaggcaattgaagagcttctcaaagaagctaagcgaggtaaaacaagagccgagaccatgggcccaatgggctggatgaagtgcccacttgcctctacaaacaaaagattccttatcaacacaatcaaaaacaccctgccttcccataaggaacaggaccacgagcagaaggagggggataaagagcctgccaagagccaggcccagaaggaagaaaaccctaaaaagcatcggtctcatccttataagcactctttccgagcgaggggctccgcatcttactccccgcctcgcaaaaggagctcacaggataagtacgaaaaaagatccaaccgcagatag

SEQ ID NO: 235471 - DNA, 402 bp, Artificial Sequence
  Description of Artificial Sequence: Synthetic coding sequence
atggaagaggaccaagaactggagaggaaaattagcgggttgaagacaagtatggcagagggcgagagaaagacggcactggagatggttcaagccgctggtacagatcgacactgtgtcaccttcgtgctgcacgaagaagatcatacactgggaaacagcctgcggtacatgattatgaagaatcccgaagtggagttttgcgggtataccaccacccaccctagtgaatccaagattaatctgagaatccagacacggggaactctgcccgcagtggaaccatttcaacgcggactgaacgagctgatgaatgtctgtcagcatgtcttggacaagtttgaggctagcatcaaagactacaaagatcaaaaggctagtcggaatgagtctaccttttag

SEQ ID NO: 235472 - DNA, 402 bp, Artificial Sequence
  Description of Artificial Sequence: Synthetic coding sequence
atggaagaggaccaggagctggaaagaaagattagcggcctgaagacatccatggcagaaggcgagcgcaagaccgcccttgagatggtgcaggcggctgggacagaccgtcactgcgttaccttcgtgctgcacgaggaagatcataccttagggaattcactccgatatatgatcatgaagaaccctgaggtagagttttgcgggtatacgacgactcacccttccgaatccaaaattaacctgagaatccaaacaagggggactctgcccgctgtggaaccatttcaaaggggtttgaatgagttaatgaacgtttgtcaacacgtgcttgacaagttcgaggcctccataaaggactataaagaccagaaggcatcaaggaacgagagtactttttag

SEQ ID NO: 235473 - DNA, 5912 bp, Artificial Sequence
  Description of Artificial Sequence: Synthetic coding sequence
atgcatggcggaggtccaccaagcggcgactccgcttgccccctccggaccattaagcgggtgcagttcggtgtactttccccagacgagttaaagagaatgagtgtgaccgaaggaggaataaagtaccctgaaactaccgaaggcggtagaccaaagctgggaggacttatggatccaagacagggtgtgatagagagaacagggagatgccagacttgtgctgggaacatgactgagtgtcctggccactttgggcacattgaactcgccaagcccgtcttccacgttgggtttcttgtgaagaccatgaaggttctccgatgcgtctgtttcttttgctctaagttgttagtcgattcgaataatcccaaaatcaaagacattctggctaagtccaagggacagcccaaaaaacgcctcacgcacgtttatgatctgtgtaaaggcaaaaacatctgtgaaggcggagaagaaatggacaacaagttcggggtagagcagccggagggggacgaagacctgactaaagagaagggtcacggagggtgcgggaggtatcaacctcgaattaggaggagcgggctggaactttatgccgaatggaagcacgtcaacgaagattcgcaggaaaaaaaaatcctgctgtcgcctgagcgtgtgcacgaaatcttcaagagaatatcagatgaagagtgtttcgtgctcggtatggagcccagatacgccagaccagaatggatgatagttacagtcctcccagttcccccactgagtgtgaggcctgcagtggtcatgcagggatctgcgcgtaatcaagacgatctgacacacaagctggccgacatcgtgaagatcaacaaccagttgagaagaaacgagcagaacggtgcagccgcacatgtgattgcagaagacgtgaagctgttacaatttcatgttgcaacaatggtggacaatgagctgccaggtctgccacgtgcgatgcagaaatccggccgaccacttaaatcactcaagcagcgccttaagggcaaggagggcagggtcaggggaaacctcatgggcaagcgcgtggacttttccgcaagaaccgttattacaccggatccaaacctatctatagaccaagtgggcgtccctcgatcaattgctgccaacatgacgttcgcagaaattgtaacaccattcaacatcgaccggctccaggaactagtgcgacggggaaacagtcagtacccaggggcaaaatatattattcgcgacaatggtgaccggattgatctccggtttcatcccaagccttcagatctccacctgcagaccggatacaaggtggaaagacacatgtgtgatggcgatatagtcatttttaatcgccaacccactcttcacaagatgagtatgatgggccatcgcgtgagaatcctcccatggtctacttttcgcttgaatttgagcgttaccacaccttataatgccgacttcgatggcgacgaaatgaatctgcacttaccccagtccctggagacaagagccgaaatccaggaactggcaatggtgcccaggatgatcgtgactcctcagagcaatagacccgtaatggggatcgtgcaggacacattgacagccgtcaggaagtttaccaagcgggacgtgtttctggagcggggagaggtgatgaatttactgatgttcctttctacctgggacggcaaagtcccccagcctgccatcttgaaaccaaggccattgtggacaggtaaacagattttttccctgatcattccgggacacataaactgtatccgcacacactccacccacccagacgatgaggacagcggcccttacaaacatatcagccccggtgacactaaagtggttgtagagaacggggagctaattatgggtatattgtgcaagaagagcctgggcacctccgcaggatccctggttcacatttcatacctggaaatgggacatgacataaccaggttgttttacagcaacatccagaccgtgataaataactggcttttgatcgagggccacacaattggcatcggtgacagcatcgcagactccaaaacttatcaggacatccagaacaccataaagaaggcaaagcaggatgttattgaggtgatcgagaaagcacataacaatgaactggagcctacacccggaaatacactgaggcagactttcgagaatcaggtgaaccgtatcttaaacgatgcacgagataaaactggtagtagcgcacagaagtcgctgagtgagtacaataactttaaaagtatggtggtcagcggagcaaaaggctcaaaaatcaacatatcgcaggtcatcgcagtggtcgggcagcagaacgtagaaggaaagcgtatccccttcggatttaagcaccggaccctcccacatttcatcaaggatgattacggcccagagtcacggggtttcgtggaaaattcttacctcgctgggttgacccccaccgaatttttctttcatgcaatggggggaagggaaggacttattgacaccgccgttaagacagcagagaccgggtacattcagaggagactgatcaagtcaatggagtcggttatggtcaaatatgatgccacggtacgcaactcaattaatcaggttgtccagctgaggtatggagaggacgggttagcaggggagtcagtagaattccagaatcttgccacccttaaaccatccaacaaggcattcgaaaaaaagttcaggtttgactatactaacgaaagggcgttacgcaggacacttcaggaagacttagtgaaggacgtactttccaacgctcacattcaaaatgagctggagagagaattcgagagaatgcgggaagaccgcgaagtgctaagggtgatcttcccgacaggcgactcgaaagtggtcctcccctgcaatcttttgcgaatgatctggaacgctcagaagatttttcacatcaaccccagactcccaagcgacttacacccaataaaggtggtggagggggtgaaagagttgtccaaaaaactggtaatcgttaatggggacgatcctctgtctagacaggcccaggaaaatgctaccctgctgttcaacatccacctgcggtccaccctgtgtagtcgcagaatggctgaggagtttcgactgtctggggaggcttttgattggctactgggggagatcgaaagcaaatttaaccaagccatcgcacaccctggcgagatggtgggtgccctggcagctcagtctctgggagagcccgctacccagatgacccttaatacattccattatgcaggtgtctccgcgaaaaatgtaaccctgggcgtaccgcgactgaaggaactaatcaacatttctaaaaaaccaaagaccccttcactgacagtcttcctgttagggcagagcgccagagatgctgagagggccaaggatatactgtgcagacttgagcatacaaccctgaggaaggtaacggctaacaccgctatttactacgaccctaatccacagtcaacagtggtggcggaagatcaggaatgggtcaacgtgtactacgagatgcctgactttgacgtcgctcgaatatccccttggctgctcagggtggaactagacaggaaacacatgaccgataggaaattaactatggaacaaattgccgaaaaaatcaacgccggttttggtgacgacttaaactgtatctttaacgacgacaatgctgagaagctcgtgttgcggatccgcataatgaatagtgacgagaacaaaatgcaggaggaagaggaggtcgttgacaagatggacgacgacgtttttctcaggtgtatagaaagcaacatgctcactgatatgacactccaaggtatcgagcagatcagtaaagtctacatgcatctgccgcagactgataataagaaaaagattattatcaccgaagatggggaattcaaagccctgcaggagtggatactcgaaaccgacggtgtcagcctgatgcgagtgctgagcgagaaagatgtcgatccagttagaaccacctcaaatgatatagtggaaattttcactgtgctggggatcgaagccgtccggaaggctctggagcgtgagctttatcacgtcatcagctttgacggcagttacgtcaactaccgtcacctggccttgctctgtgacacgatgacatgccgtgggcacctaatggcgataactagacacggggtgaaccggcaggatactggtccactcatgaagtgtagctttgaagaaaccgtggatgtgcttatggaagccgcagcccatggtgaaagtgatcccatgaagggtgtttcagagaacatcatgctcggtcagttggcccctgctggcactggctgctttgacctgctattggacgccgagaaatgcaagtacggcatggaaatacccacgaatattcctgggctgggggctgccggacccaccggtatgttcttcgggtccgcaccttcccctatgggcggaatctcgccagcaatgacgccttggaatcaaggtgctaccccggcttatggcgcttggtccccttcagtcggctcagggatgacaccaggcgcagctgggttctctccaagcgccgcatcagatgcctccggcttcagcccaggttactctcccgcatggagtccaacccccggatctcccggatcgccaggccctagctccccttatattccatctccgggaggagctatgtcgccaagttacagtccgacgagccctgcttacgaacctaggtctcctggcggttataccccccagtctcccagctacagccctactagcccctcatactcacccacatcacccagctattcacccaccagtcctaactattctcccacctccccctcctattcgcccacaagcccgtcctacagtcccacgagcccaagttactcgccaaccagtcctagctattcgcccacctcaccgagctatagcccaacatccccgagttacagccctacctctccaagttatagccccacttctcctagctacagtcccacttcccctagctactcacccactagccctagctattcacctacctcgccttcgtacagtcctactagtccgagctattcgccaacatcacctagctacagcccgacgagcccttcttacagcccaacctccccctcatactcacccacctcgccaaactacagcccaacttcgcctaattataccccaacctccccctcttatagcccgacttcaccttcatattcgccaacatcaccaaattacactcccacctcaccaaactattctcctacctcgccatcatattcaccaacgtcaccatcctacagccccacctcaccatcatactcgccctctagcccccgatacacgccacagtcaccaacctacaccccctcctccccctcatactcgccttcaagcccaagctactcgcccgcatcaccaaagtacacgcctacgtcaccttcctattccccaagttctcccgagtacacaccaaccagccccaaatacagtcctacctcaccaaaatacagcccaacctccccgaaatacagccctacctcccctacatattcacctaccactcccaagtattcgccaacttcccctacgtattctcccactagccccgtatacaccccaactagccccaagtactcgcctaccagcccaacctactccccaacaagccctaaatatagccccacctcaccgacatacagtcctacctcaccgaagggtagcacctatagcccgacctctcccggttattcccctacttcccccacatacagcctgacctcacctgcaatctcacctgacgactccgacgaggagaatta

SEQ ID NO: 235474 - DNA, 1626 bp, Artificial Sequence
  Description of Artificial Sequence: Synthetic coding sequence
atgcctggacgatgccaatcagacgccgcaatgcgggttaacggacccgctagtagagcaccggctggctggacttccggatccttgcacacaggcccacgggctgggagaccaagagcccaagccaggggagtccggggacggggacttcttttgaggcctcgccctgccaaggaattgcccctcccccgaaaaggtggtgcctgggcccctgcagggaatcctggcccactccatcctctgggcgttgcagtgggcatggccggttccggcagactggtgcttcgcccatggattagagagttgatattaggatctgagaccccaagctcccccagggccggtcagctcttggaagacgccgaagccgctgtcgctggccctagccatgcgccagacacctcggacgtgggcgctacgttactcgtatccgatggtacgcacagcgtcagatgcctcgtgacacgcgaggccttagacacgtccgactgggaggaaaaagagtttgggtttcggggaacagaaggcagactcctcctgcttcaggactgtggagtgcacgtacaggtggctgaaggaggcgctcctgcagagttttatctgcaggtggacagattttccctcctgcccactgaacagccacgcctcagggtaccagggtgtaatcaggatttggacgtgcagaagaaactgtacgattgtctggaggagcacctttctgagtcgacttctagcaatgcgggactctcattgtcgcagctgcttgacgagatgagagaagatcaggagcaccagggggctctggtgtgcctggctgagagctgtctcactctcgaaggaccgtgcaccgcgcctcccgtgacacactgggccgctagcaggtgcaaggccactggagaagccgtgtataccgttccttcctcaatgctctgtatatccgagaatgatcaactgattctgtcctctctcgggccttgccagaggactcagggccctgagttaccgcctccggatcccgcactgcaggacctgtctctgacattgattgcctcgcctccctcttcaccgtcctcctctggaactcctgccctgccagggcacatgagctccgaagagagcggaacttctatctcgctcctccctgccctcagccttgcggctccagaccctggacagcggagctccagccagccgagtccagcgatatgttctgcacctgcgaccctgacccccaggagcccccatgcaagccgcacccccagttctccacttcagagttgtaccccaagtttgtctcccaggtctcacgtgcccagcccgcatcaggctctagtgacaaggccacagaagcccagtttggagtttaaggagtttgttgggctgccttgtaagaacaggccaccctttcccaggaccggggctacaaggggcgcacaggagccttgtagtgtatgggagccacccaaacggcaccgagacggcagtgccttccagtacgaatatgaacctccctgcacctcattgtgtgctagagttcaggcggtgaggctaccacctcaactgatggcttgggctctgcacttccttatggatgcgcagcccggaagtgagcctacgcccatgtag

SEQ ID NO: 235475 - DNA, 2040 bp, Artificial Sequence
  Description of Artificial Sequence: Synthetic coding sequence
atggacagagtcacacgctaccctatcctgggaatcccgcaggcacatcggggaactgggctggtgctagacggagacacaagttatacataccacctggtgtgtatgggccctgaggcctcaggatgggggcaggatgagcctcagacatggccaaccgaccacagggcacagcagggcgtgcagcggcagggggtcagctactctgttcacgcctacacagggcagccatctccaagggggttgcacagcgaaaatagggaggatgagggatggcaggtctaccggctgggcgctagggacgcccaccagggcaggccgacctgggctcttaggccagaggatggcgaggacaaggaaatgaagacttacaggctggatgccggagacgccgaccccaggcgactctgcgatcttgaacgggaaaggtgggccgttattcaagggcaggccgttcgaaagtcttccaccgtggctaccctccagggtacgcccgatcacggcgaccctaggactcccggaccccctcgcagcacaccgttagaggagaatgtcgtagaccgggagcagatcgatttcctggctgctcggcagcaatttctctcattggagcaagccaacaagggggcaccccacagttctcctgccagagggacccctgctggcaccactccaggagcttctcaggcgcctaaagcgttcaataagccacatctggcgaatgggcatgtggtgccgattaaaccacaggttaaaggcgttgtcagggaggaaaacaaagtaagagctgttcctacatgggcttctgttcaagttgtggatgaccctggatcactggcatccgttgagtcaccagggacaccaaaggagacccctattgaaagggagatcaggctggctcaagagcgggaagctgacctgcgcgaacagaggggcctcaggcaggcaaccgatcatcaggaactcgtggaaattccgacgagacctctcctcaccaaattgagtctgattaccgccccacggagagagagggggcgaccttcactgtatgtgcagagagacatcgtgcaggagacgcaaagagaggaggaccatcgcagagaaggactgcacgtaggtagggcctctacgcccgactgggtgtctgaggggcctcagcctggcctgaggcgggctcttagctcagacagcatcctgagtcccgctcccgatgctcgcgcagcagacccagcgccagaagttcgcaaggtgaaccgcataccacccgacgcttaccaaccttacctgtctccaggaaccccacagctggagtttagcgcctttggtgcctttggcaaaccttcctcactgtctacagcagaggctaaggctgcgacctcacctaaggccacaatgtcaccacggcatctctctgaaagctcaggtaagcccctgtctactaagcaggaagcctctaaacccccacgcggttgccctcaggccaatagaggagtagtaagatgggaatactttagactgcgtcctctgagattccgcgctccggacgaaccacagcaagcccaggtcccacacgtgtggggatgggaggtggccggagcgcctgctctgaggctgcaaaaatcgcagagcagcgacctcctggaacgtgaacgggagtccgtcctgaggcgggagcaggaagtagcggaggagcgcagaaacgctctgtttccggaggtattctctcccacacccgatgagaatagcgaccagaacagcagaagctctagtcaggcatctggtataactggaagttatagcgtcagcgaaagtccattcttttcaccaattcacctccactctaatgtggcttggactgtggaagatcctgtggactctgctcccccaggacaacgcaagaaggaacagtggtatgcgggtatcaatccctccgatggcattaactcggaagtgttagaggcgattcgcgtgactagacataaaaacgctatggctgagagatgggagtcacgaatctatgcttctgaggaagatgattag

SEQ ID NO: 235476 - DNA, 381 bp, Artificial Sequence
  Description of Artificial Sequence: Synthetic coding sequence
atgagcgacaatgaggacaacttcgatggggacgattttgacgacgttgaagaggacgagggcctggacgatcttgaaaatgcagaggaagagggccaagaaaacgtagagatcctgcccagcggagagaggccacaggctaatcagaaaagaatcaccactccctacatgacgaaatacgagcgcgctcgggtgctggggactagagcactgcaaattgctatgtgtgcccctgttatggtagaactcgagggtgagactgaccctctgctgatagcaatgaaagagctgaaactgctctggggacttgaatacaccgtgctgaggcccagttatgctctagcccattctctcggcagcttttcaataagctcccggtag

SEQ ID NO: 235477 - DNA, 477 bp, Artificial Sequence
  Description of Artificial Sequence: Synthetic coding sequence
atgagtgacaatgaggacaactttgacggagatgacttcgacgacgtcgaagaagacgagggactggacgatctcgagaacgccgaggaggagggccaggagaatgttgagattcttccttccggagaacgccctcaagccaatcagaagaggataacaacaccttatatgacgaagtacgagagagctagagtattgggcactcgcgctctccagattgctatgtgcgccccagtgatggtcgaactggagggggagaccgaccccctgctaattgctatgaaagagctcaatgctagaagcgcctcagagcctcccggagaggagccaccctggatggacaggggaaccagggacgaacacctgccatcatgcccaggatgtcctgcagtggcctccaacactaggtgttgccccccagccgcatgcctgccaggtatttcactgtcaaggcggcgacggcttcgggaagagtag

SEQ ID NO: 235478 - DNA, 384 bp, Artificial Sequence
  Description of Artificial Sequence: Synthetic coding sequence
atgtccgacaatgaggacaattttgacggggatgattttgacgatgttgaagaagacgagggattagacgacctggaaaatgccgaggaggaagggcaggagaatgtggagatcctgccatctggagagagaccccaggcaaaccagaaaaggatcaccacgccttatatgactaagtatgagcgcgcaagggtactggggacaagggctctccaaatagcaatgtgcgcgcctgtcatggtggaactggagggagagacagatccattgcttatcgcaatgaaagagctgaaggcacgaaagatcccaattattattagacgctacttaccagatggatcctatgaggactggggtgtggacgagctcattatcactgattag

SEQ ID NO: 235479 - DNA, 519 bp, Artificial Sequence
  Description of Artificial Sequence: Synthetic coding sequence
atgttctatcacattagcttggagcacgagatccttctccaccccagatacttcggtccaaatctgctgaataccgttaaacagaagctctttactgaggtggaagggacgtgcactgggaagtatggttttgtgatcgcagttacaaccatcgacaacataggagccggtgttatacagcccggaaggggcttcgtgctatatccagtgaaatataaagcaatagtttttcggccattcaagggggaggtggtagacgccgtcgtgactcaggtaaacaaggtaggcctgtttacagaaattggccctatgagctgtttcatcagtcggcactctataccttcagagatggaattcgaccctaacagtaatcctccatgttataaaactatggacgaagacatcgtgatccagcaggacgatgagatcagactgaaaatagtcgggacgcgggttgacaaaaatgacatcttcgccattggtagcctgatggatgactacctggggttggtgtcatag

SEQ ID NO: 235480 - DNA, 453 bp, Artificial Sequence
  Description of Artificial Sequence: Synthetic coding sequence
atggcagggatcttgtttgaagacatctttgacgtgaaggatattgaccctgaaggaaaaaaattcgatagagttagtcgattgcattgtgagtcagagtcttttaagatggacctgatcctggatgtcaatatccagatttaccctgtcgacttaggcgataaattcagactggtcattgcatctactttgtatgaggacggtaccctcgacgacggcgaatataacccaacggacgatcggcctagtcgcgcagaccagttcgagtacgttatgtatggcaaagtctacagaattgagggcgacgaaacatccaccgaggctgccactcgactgtctgcatacgtaagctatggtgggctgctcatgagactgcagggagatgcaaacaacctccacggattcgaagtggacagcagagtgtatctcctcatgaagaagctggccttctag

SEQ ID NO: 235481 - DNA, 39 bp, Artificial Sequence
  Description of Artificial Sequence: Synthetic coding sequence
atggccggaattctgttcgaagacatcttcgatgtctag

SEQ ID NO: 235482 - DNA, 450 bp, Artificial Sequence
  Description of Artificial Sequence: Synthetic coding sequence
atggctggaatccttttcgaggacatttttgacgttaaggacattgatcccgaaggaaaaaagttcgaccgcgtttcacgcctccactgtgagagcgagtctttcaagatggatctgattctagatgttaatattcagatctaccctgtggacttgggggacaaattccgcttagtgatcgcctctacactgtacgaagatggaacccttgatgacggtgagtacaatcccactgatgatagaccatcacgggcagatcaatttgagtacgtcatgtacggcaaagtttacaggattgaaggagatgaaacttctacagaagcagctacaaggttgtcagcctacgtcagttatggaggcctgcttatgagacttcaaggggacgccaacaatttacatggatttgaagttgacagcagagtgtaccttctaatgaaaaaactcgcttag

SEQ ID NO: 235483 - DNA, 453 bp, Artificial Sequence
  Description of Artificial Sequence: Synthetic coding sequence
atggcgggtatcctgttcgaagacatcttcgacgtgaaggacatagatccggaaggtaaaaagttcgatagggtgtcccgcctgcattgcgagagcgaaagctttaagatggatctcattctcgatgttaatatacagatctaccctgtggatctaggagataagttcaggctcgtgatcgcatctaccctgtacgaagacggaaccctcgatgatggcgaatacaacccaactgacgatcgcccaagccgtgccgatcaattcgagtacgttatgtatggtaaagtatatcggatcgagggggacgaaacttcaacggaagccgcaaccaggctcagtgcctacgtgagctatggagggcttctgatgcgtctgcagggggacgccaacaacctccatggctttgaagtcgacagccgcgtttatcttttaatgaagaagcttgccttctag

SEQ ID NO: 235484 - DNA, 1491 bp, Artificial Sequence
  Description of Artificial Sequence: Synthetic coding sequence
atggaggaacaaagggaggccctccgaaagataattaaaacactggcggttaagaatgaggagatccagagtttcatttatagccttaaacagatgctgctgaatgttgaagccaacagcgctaaggtgcaggaggatctcgaggccgaatttcaatctctgtttagccttttggaagaattaaaagaggggatgctgatgaaaatcaaacaggacagagccagcaggacctacgaactgcagaaccagttggctgcctgtactagagccctggaaagctcggaagaactcctagagaccgctaatcagacgcttcaagctatggatagcgaggacttcccacaggccgctaaacaaatcaaggatggagtgacaatggctcccgcattcaggcttagcttaaaagccaaagtgtctgataacatgtctcacctcatggtggatttcgcccaggagcggcaaatgctgcaggctttgaagttcctaccagttcctagcgctcccgtgatcgatctcgctgaatcgctagtggctgataattgcgtcacccttgtctggcgtatgcctgacgaggactctaagatcgaccactacgtcctagaatatcgccgtactaacttcgagggcccaccccgactcaaagaggaccagccatggatggtaattgaaggcatacggcaaacagagtacacgctcacaggcctgaagtttgatatgaaatatatgaacttccgagtcaaggcctgcaataaggcggtcgctggagaatttagcgagcctgtgaccctggagacccctgcctttatgttccggctagacgcatccacatcacaccagaatctgcgagtcgatgacctgtccgtggaatgggatgccatgggaggaaaagtacaggacatcaaggcgcgtgaaaaggacggaaaaggaagaactgcaagcccaatcaattcccctgccagaggaaccccatcacctaaaaggatgccctctgggagagggggaagggataggtttaccgccgagtcgtatacagtcctaggtgatactctaattgacgggggagaacattactgggaggtccggtatgaaccggactctaaagccttcggagtgggagtcgcctaccgtagtctcggtcggttcgaacagttgggcaagacggccgctagttggtgcctgcacgtgaataactggcttcaggtgtcattcacagccaagcacgcaaacaaggttaaagtgctcgatgctcctgtccccgactgtctcggggtacactgcgactttcatcaagggctcctgtccttctacaacgctcgcacaaagcaagtgcttcacacatttaagacccgcttcacgcaaccattgctgccagccttcactgtgtggtgcggcagcttccaggtgacaaccggactacaggtgccctcagccgtgcgatgcttgcaaaagcgcggtagcgcaacatcctctagcaacacatccctgacatag

SEQ ID NO: 235485 - DNA, 354 bp, Artificial Sequence
  Description of Artificial Sequence: Synthetic coding sequence
atgaacgctccaccagccttcgaatcgtttctgctttttgagggggaaaagaagatcaccatcaacaaagataccaaggtccctaatgcatgcttgtttaccatcaataaggaagatcacaccctggggaatatcatcaaatcacagctcctcaaggatccccaggtgctgtttgccggatataaagtgccacacccattggaacataagattatcatccgggttcagactactccagattattccccacaggaggcttttactaatgcaatcaccgatctgattagtgaactatctctcttggaagaaagatttcgggtggcaattaaggacaagcaggaagggatcgaatag

SEQ ID NO: 235486 - DNA, 384 bp, Artificial Sequence
  Description of Artificial Sequence: Synthetic coding sequence
atgaacgcccctcctgcctttgagtcatttctgctcttcgaaggcgagaagaagatcactatcaataaggacactaaggtgcccaatgcatgtctgtttacaattaataaggaggatcacaccctgggtaatataataaagagccagttgctgaaggaccctcaggtactgttcgctggctataaggtaccgcacccgttagagcataaaatcatcattcgggtgcaaactacccccgattattccccccaggaagcttttactaatgccattacagacctgatttcagaactgtctctactggaggagagatttcgagtccgggcaggccctggcggtgctgatggcgtggcaataaaagacaagcaggaagggatcgaatag

SEQ ID NO: 235487 - DNA, 351 bp, Artificial Sequence
  Description of Artificial Sequence: Synthetic coding sequence
atgaatgcccctcccgcatttgaaagctttctactattcgagggtgaaaagatcactatcaataaggacacaaaggtcccgaaggcatgcctgtttaccatcaataaagaggaccacaccttagggaacataatcaaaagtcgcgcttgtttcccttttgctttttgccgggactgccagtttcctgaggcatcgcccgcaaccctccctgtccagcctgcagagctgtgccctcgtgcccaccagttgtgcgcccctgcccttaagcgccaccttggcggtgaggcccacccagtacatctgcacgccggtgctgcgagccgacccgttcagcagccgcagcacctgtag

SEQ ID NO: 235488 - DNA, 348 bp, Artificial Sequence
  Description of Artificial Sequence: Synthetic coding sequence
atgaacgcccctcccgcatttgagagttttctcctcttcgaaggggagaagataactattaataaggatacaaaggtacccaaagcctgtctgttcacaattaataaggaggaccacacactcggaaacatcatcaagagtcaactgttgaaagacccgcaggtgttgtttgccggatacaaagtgccccacccactggagcacaaaattataatccgggttcagacaactcccgattattctccccaggaggctttcactaacgcaattacagacctgatctcagaactctcactgctggaggagagatttcgtacgtgcctgttgccactgagactgttgccatag

SEQ ID NO: 235489 - DNA, 177 bp, Artificial Sequence
  Description of Artificial Sequence: Synthetic coding sequence
atggacactcaaaaagacgttcagccacctaagcaacagccaatgatttatatatgtggcgagtgtcatactgagaacgaaattaagagtcgcgacccaatcagatgcagggaatgtggatatcgcattatgtacaaaaagaggactaagcgattggtggtttttgacgcacgatag

SEQ ID NO: 235490 - DNA, 204 bp, Artificial Sequence
  Description of Artificial Sequence: Synthetic coding sequence
atgattattcccgttcgttgcttcacatgtggtaaaatcgtaggaaataagtgggaggcctacctaggtttgcttcaggccgaatacactgagggcgacgccttggacgccctgggcttgaaaagatattgttgccgtcgaatgctgctggcgcacgttgaccttatagagaagcttctgaattatgcaccattagaaaaatag

SEQ ID NO: 235491 - DNA, 204 bp, Artificial Sequence
  Description of Artificial Sequence: Synthetic coding sequence
atgattatccctgttcggtgtttcacctgcggaaagatagtaggcaataagtgggaggcttatctcggcctgctccaagcagaatacactgagggcgacgccctggacgccctcgggctcaaacgttattgttgtcgtcggatgctcctagcacatgtggatctcatcgagaaactgctgaattatgcgcctctggagaagtag

SEQ ID NO: 235492 - DNA, 4173 bp, Artificial Sequence
  Description of Artificial Sequence: Synthetic coding sequence
atggttaaggagcagttccgtgagacggatgtggccaaaaaaatttcacatatatgtttcggcatgaaaagtcccgaggaaatgcgtcagcaagctcacatccaagttgtatctaaaaatctgtattcccaagacaaccaacacgcaccactgctctatggtgtccttgaccaccggatgggtacgtcggagaaagatcgcccatgtgaaacctgtggtaaaaatctggcagactgtcttgggcactatggatatatcgacttagagttgccttgtttccatgtggggtatttccgggctgttattggcatcctgcagatgatttgtaagacctgctgtcacattatgctgtcacaggaagaaaagaagcagttcctcgactacctcaaaaggccgggactcacctacctgcaaaagaggggcctgaaaaagaagatcagcgataagtgtcgtaaaaagaacatctgtcatcattgcggagctttcaacggaaccgtcaaaaagtgtggcttgctgaagatcatccacgaaaagtacaaaactaataaaaaggtggtcgaccctattgtgtctaacttcctgcagtcatttgaaacggcaattgagcacaacaaggaggtcgagcctctgctggggagggcacaggagaacctgaatcccctcgtggtactgaacctttttaagaggattccggcagaagatgtgccactgcttcttatgaatcctgaagcgggaaagcccagcgatttaatccttacacgcctcctcgtgcccccactgtgcatccgcccatctgtcgttagtgatcttaaaagcggcacaaatgaagatgacttaacaatgaaattgacagagattattttcctaaacgatgtgatcaagaaacaccgtatttcgggcgctaagactcagatgatcatggaagattgggacttcctccagctgcagtgtgccctatatatcaactcagagctgagtggaataccattaaatatggcccctaagaagtggactcgcggtttcgtccaacgcttgaagggcaagcaaggccgtttccgcggtaatctgtctggtaaaagggtcgacttttccggcagaacagtaattagccctgaccccaacttacggattgatgaggtggccgttccagttcacgtggccaagatcctgactttccccgagaaggttaataaagccaatataaattttctgaggaagctggttcaaaacgggcctgaagtgcatccgggagcaaactttattcagcaacgacacacacaaatgaaaagattcttgaagtatgggaatcgggagaaaatggcccaggagttaaagtatggagatatagtcgagagacatctgattgacggcgatgtggtgttattcaaccggcagccttcactccacaagcttagcatcatggcacacctggctagagtgaagccacaccggacattccgattcaacgaatgtgtctgcacgccttataacgccgatttcgatggggacgagatgaatctgcacctgccacaaacggaggaagcgaaagcagaggccctagtcctcatgggaacaaaggccaatctcgtgacacccaggaacggcgaacctttaatcgcggcaatccaggacttcctcaccggcgcatacctgctcactttaaaggacacattttttgaccgggctaaggcatgccagattatcgccagcatactcgttggcaaggacgagaagatcaaagttcgcttgcccccaccgaccattcttaagccagtcacgctgtggaccggtaaacagatattcagcgtgattctgagaccaagcgacgataatcctgtaagggctaacttgcgtacaaaggggaagcaatactgtggcaagggggaagacctgtgcgcgaacgatagctacgtgacaattcaaaactctgagctgatgtcaggctcaatggacaaaggaacgctgggatccgggtcgaagaataacattttttacatcctccttagagactggggccagaacgaggccgcagacgccatgtcacgcctggcaaggctggcaccagtttacctgtcaaatagaggattttcaattggcattggcgatgtaaccccaggtcagggtttgctcaaggcgaagtacgaactcctcaatgccggatacaagaaatgcgacgagtatattgaagcgcttaacaccggaaaactccaacagcaacccggttgcaccgccgaggagacgctggaggccttgatcctgaaggagcttagcgtgattagggatcacgctggatccgcctgtctcagagagctggacaagagcaatagccccctgacgatggctctgtgtggcagtaaaggctctttcatcaatatctcacagatgatcgcatgcgtgggccagcaagccatctcaggctccagggtcccagatgggtttgagaacaggagcctcccacattttgagaagcattcaaagctccccgcagctaaggggtttgtcgctaactcattctactccggtctcaccccgacggagtttttcttccacacgatggccggtcgcgaaggcctggttgataccgccgtaaaaactgcggagacaggctatatgcagcggcgactggttaaaagccttgaggatctgtgtagccagtacgaccttactgtgcgatcgtctacaggagatattatccagtttatttacggtggcgacggtctcgacccagctgcaatggagggtaaagatgaacctcttgagtttaaacgagttctggataatatcaaagcagtttttccatgcccatccgagccagccctatcaaagaatgaactgatcttgaccaccgaatctattatgaaaaagtccgagttcctctgctgccaggactccttcctgcaggagattaagaaattcataaagggtgtgagcgaaaagataaaaaagaccagggataaatatggtattaacgacaacgggacaaccgaacctagggtgctataccagctggacaggatcactccgacacaggtggagaagtttcttgagacttgccgcgataagtacatgcgtgcacagatggagcccggatctgcggtgggggctctttgtgctcagagtatcggcgagcccggaacccagatgacattaaagacattccatttcgccggagtggctagcatgaatatcacccttggagtacctcggattaaggaaatcattaatgcctccaaagccattagcacacctatcatcacggcccagctcgacaaggacgacgacgccgactatgctagactggtcaaggggaggattgagaaaactcttctgggcgagatctctgagtatatcgaggaggttttccttccggatgactgctttattctcgtgaagctctcgttggagcggatacgcctcctaaggctggaagttaatgccgagacagtccgctatagtatctgtacttcaaaactccgagtgaagcccggagacgtggcggtacatggagaggcggtggtgtgtgttactccaagagaaaacagcaaatctagcatgtactacgttttgcagtttctgaaggaggatctgcctaaagtggttgtgcagggaatccctgaggttagcagagccgtgatccatattgacgagcagtcaggaaaggagaaatacaagttgctggtcgagggcgacaatttgcgcgctgtgatggcaacacacggggtgaaagggacccgaacaacctccaataacacctacgaagtcgaaaagactcttggcattgaggccgcaagaacaacgattatcaacgagatacagtatactatggttaatcacggcatgtcaatcgaccgaaggcacgttatgttgctgtccgacttgatgacctataagggtgaagtgctaggcataaccagattcggacttgccaagatgaaggaaagtgttcttatgcttgcctccttcgaaaagaccgccgaccacctcttcgacgccgcatacttcggtcagaaggattctgtttgcggtgtttcagaatgcattataatggggatcccgatgaacatcgggactggcctcttcaagctcctgcataaagctgacagagaccccaatccccctaaacgcccactgatatttgatactaatgagttccatatccctttggttacctag

SEQ ID NO: 235493 - DNA, 489 bp, Artificial Sequence
  Description of Artificial Sequence: Synthetic coding sequence
atgtactacgtgctgcagttcctgaaggaggacctcccaaaagtggtagtgcaaggcatcccggaagtttcccgcgcagtgattcacattgatgaacaaagtggtaaagagaagtataagttgctggtggagggcgacaacttgcgcgctgtcatggctacacatggggtgaaggggacccgaaccacctctaataacacttatgaggtggaaaagaccctgggtatcgaagcggctagaacgactatcatcaatgagatccagtacacaatggtaaatcatggaatgtccattgacagacgccacgtgatgttgctttcagatctgatgacctataagggggaagttctgggcataactaggtttggcctggcaaaaatgaaagaatctgtattgatgttagcctcttttgagaaaacggccgaccacctgttcgacgctgcatactttggacagaaggacagcgtttgcgcctggccacagccgtag

SEQ ID NO: 235494 - DNA, 4110 bp, Artificial Sequence
  Description of Artificial Sequence: Synthetic coding sequence
atggtgaaagagcagtttagagagaccgacgtagcaaaaaagatttcccacatctgttttggcatgaagagccccgaggagatgcgccagcaggcacacatccaggtcgtatctaagaacctttactcacaggataaccaacacgcccctcttctgtacggggtattggaccacagaatgggcactagcgagaaagaccgcccttgcgagacctgtggaaagaatttggccgattgcctgggacactatggctacatcgatctcgagctgccctgttttcacgtcggttattttagggctgtgatcggcattttgcagatgatctgtaagacctgttgccacattatgttgagtcaggaagaaaagaaacagttcttagattacctgaagcggccaggactcacatatcttcaaaagagaggactaaaaaagaaaatctccgataaatgccgaaagaaaaatatctgccaccactgtggggcatttaacgggaccgtgaagaagtgcggcctgcttaagataattcacgaaaagtataagaccaacaaaaaagtcgtagatccgattgtgagtaactttctccagagctttgagacagctattgaacacaacaaggaggtggagcctctccttggcagggctcaagagaacttaaatccattggtcgtgttaaacctgttcaaaaggatcccggcagaagacgtgcccttgctgctaatgaacccggaagccggaaagccctcagacctgatcctgacccgtctgctggtacctcccctgtgtatccgcccttctgttgttagcgatctgaaatcgggcaccaacgaggacgacctaaccatgaaactcaccgaaatcatcttccttaatgacgtcataaaaaaacatcgaatttcaggagctaagacccaaatgattatggaagactgggactttctgcaacttcagtgtgctctgtatatcaattccgagctgtctggcataccgctcaatatggctccaaaaaaatggacacgcggtttcgtccagagactcaaaggcaaacagggcagattcaggggaaatctgagcggaaagagagtggacttcagcggtcggacggtaatcagccctgacccgaatctgagaatagacgaagtggccgtgccagtgcacgttgccaaaatcctcacatttcctgagaaggtgaataaggcaaacatcaactttctacgaaaactagtgcagaacgggccagaagtccatccaggtgcgaactttattcagcagcggcacacacagatgaaaaggtttctgaagtacggtaatagggagaagatggctcaagagctgaagtacggtgatatagttgagcgtcatcttatagacggcgacgtagtgctcttcaatagacaaccaagcctccacaaactgagcattatggcccacctagctcgagtcaagcctcacaggacctttcgctttaacgaatgcgtatgcactccctacaatgctgatttcgacggcgacgaaatgaatctgcacctacctcaaactgaggaggccaaggccgaggcactagtgttaatgggcaccaaggctaacctggtgactccccgtaatggagagccactaattgccgcaatccaggattttctgactggggcatacttgctcacccttaaagacacatttttcgatagagctaaagcatgtcagatcattgcaagcatactggtggggaaggatgaaaaaatcaaggtgcggctaccccctcccaccattctgaagcctgtgactttatggactggcaaacagatctttagtgttatcttgcggccatctgacgataatcccgtccgcgctaaccttagaaccaaggggaaacagtactgtgggaagggggaggacctgtgtgcgaacgactcatatgtgaccattcagaactccgagctgatgtccggctcaatggataaagggacgctcggctccggttcgaagaataacattttttatatcctgttgcgcgactggggccaaaacgaggccgctgacgccatgtcccgactcgcacggttagcgccagtgtacctgtcaaatcgcggttttagcataggcataggcgacgttactccgggacagggccttctcaaggccaagtacgaactcctcaatgccggatataaaaaatgtgacgagtacatcgaggccctgaacactggaaagctgcagcagcagcccggatgcacagcggaagaaacgctggaagctctcatcctaaaagaattatctgtgattagggaccacgccggttccgcatgcctgcgggagctggacaagtcaaactcgccattgactatggccctgtgtggcagcaagggctcttttatcaatatcagtcagatgattgcttgtgtagggcagcaagccatatcaggctcaagagttccagacggctttgagaatcgctcactgccacatttcgaaaaacactcgaaactgccagcggctaaaggatttgtcgccaacagcttctactcgggtctgactcccacagagtttttttttcataccatggctgggagggaaggtctggtggacactgctgttaagacagccgagacgggctacatgcagcgtcgcctggtgaaaagcctggaggatctttgttcccagtacgacttgaccgttcggagcagtaccggtgacattattcagttcatttacggaggagacggtctggatcctgctgctatggagggtaaggacgagccacttgaatttaaacgtgttctcgataatatcaaggccgtctttccatgtccatcagagccggcactgtcaaagaacgagctcatcctgactacagaaagtataatgaagaagagtgagtttctgtgttgccaagattcctttctgcaggagattaagaaatttattaagggggtgtcggaaaagatcaaaaagacaagagacaagtacggcatcaacgacaacggtaccactgaaccgagggttttatatcagctggatcggattacccccacacaggtggagaagttcctcgaaacctgccgcgataagtatatgcgagcccagatggaacccggatctgccgtcggtgctctttgcgctcagagaaacataaccctgggcgtcccgaggattaaggagatcatcaacgcttctaaggcaatctcaacgcccattattacagcccagctcgacaaagatgacgatgccgactatgcacgcctggtcaaaggccgaatcgaaaagactctgttgggagagatatcggaatacattgaggaggtgttccttcctgacgactgtttcattctggtgaagctttcccttgaaaggatacggctgctgaggctggaggtcaacgcagaaactgtgaggtatagcatttgtaccagtaagctcagagtcaaacctggcgatgtggcggtacacggcgaggccgtggtttgtgtaaccccaagagaaaattccaagagctcaatgtattacgtgctacaatttcttaaagaagacttgcccaaggttgtagtgcaggggatccctgaagtaagccgtgcagtcattcatatagacgagcagagtgggaaggagaagtacaagctcttagtagaaggtgataacctgcgagccgtgatggcaacacatggcgttaagggcacccggacaacctccaacaacacttacgaggtggagaagactctgggtatagaggcagctagaaccacaattatcaatgagatccaatacacgatggtgaaccatggaatgtctatcgatcgaaggcatgtgatgctcttgtcagacctgatgacctataagggcgaagttctaggaattacccgctttggtcttgcaaagatgaaggaaagcgtgttgatgctggccagttttgagaagactgcggatcatctgttcgatgctgcatactttggacaaaaagactcagtgtgtggggtttcagaatgcatcataatgggcatacccatgaatatcggcaccggcctgttcaagttacttcacaaagctgaccgggatcccaacccccctaagcgaccccttatcttcgacactaatgagtttcacatccccctagtgacatag

SEQ ID NO: 235495 - DNA, 753 bp, Artificial Sequence
  Description of Artificial Sequence: Synthetic coding sequence
atgaaggccaccataatccttctgctgcttgcgcaggtatcttgggctggcccattccaacagcgcggtttatttgactttatgctggaagacgaggcctctgggatcggccctgaggtccccgacgacagggactttgagccatccctaggaccagtctgccctttcaggtgccaatgccacctcagagtggtgcaatgtagcgacttagaactggggacaaaccctctaaaaagttctggaattgagaatggcgcatttcaggggatgaagaagttgtcgtatattaggatagctgacaccaatattacctcaatcccccagggcctgccaccttctctgactgaactccatctggacgggaataaaatcagccgtgtagatgccgcaagcttgaaggggctgaacaacctggctaaactgggactttcctttaatagtattagtgcggtggacaatggcagcctcgcaaacacgccccatctgcgggagcttcatctcgacaacaataagctgacccgggtgcctgggggactggcagagcacaagtacatacaggtcgtgtacttgcacaacaacaatatatccgtagtggggtcctccgatttttgtccacccggacataacactaaaaaagcctcctacagcggtgtttctttattctctaaccctgtgcagtactgggagattcaacctagtaccttccggtgcgtgtacgtccggtccgcaatccagttggggaattataagtag

SEQ ID NO: 235496 - DNA, 3228 bp, Artificial Sequence
  Description of Artificial Sequence: Synthetic coding sequence
atgaaagctaatgaaaaagtcacttctgatgccgatcccatgtggtacctgaaatacctgaatatttacgtcggactgccagatgtggaagaatcttttaatgttacgaggcccgtatcgccacacgaatgtcggttaagagacatgacttatagtgcacctatcaccgtcgacatcgagtacacacggggaagccaaaggatcatccgcaatgcactccctattggccgaatgccaatcatgcttaggtcctccaattgtgtactgacaggaaaaacaccagctgagtttgcaaagctcaatgagtgccctctggaccctggcggatactttatagtcaagggtgtcgagaaggtcatcctgatccaggagcagctgtccaaaaataggatcatcgtcgaagctgacagaaaaggcgctgtgggggcatccgtgacatcctccacccacgagaagaaaagcaggaccaatatggccgtcaagcaggggagattttacctgcggcataacacactgtccgaagatattcctattgtgatcatattcaaagccatgggtgtcgaaagcgaccaggagatcgttcagatgataggtacagaggaacatgttatggcggctttcggcccatcacttgaagagtgtcagaaagcacagatctttacccagatgcaggccctaaagtacattggcaacaaggtgaggcggcagagaatgtggggcggtggaccaaagaagaccaagattgaggaggctcgggagctgttggcttccaccattttaacacatgtccctgtgaaggaatttaacttcagggctaagtgcatctacactgccgttatggttcggcgagtgattcttgcgcagggagacaacaaggttgatgacagggactactacggaaacaaaaggcttgaattagctggtcagttgctgtctcttttgttcgaagacctgttcaaaaaatttaactccgaaatgaaaaaaatcgctgaccaggtgattccgaagcaaagggctgcccaatttgatgtagtgaagcatatgagacaggatcaaattactaatggtatggtgaatgccatctcaaccggaaattggagcctgaagagattcaagatggatagacagggcgtgacacaggtcctgtctcggctgtcatacatttcagcgcttgggatgatgaccagaatttccagccagtttgaaaaaacgcgaaaagtgagtggtcctcgaagcctacaaccgtctcagtggggcatgttgtgcccctccgacacccccgagggcgaggcgtgtgggctagtcaagaacctggccctgatgacgcacataacgactgatatggaagatggcccaatcgtcaagctggcttccaacctcggggtggaagacgtgaacctgctctgtggtgaggagttatcgtacccaaatgtttttctcgttttcctcaatggtaacatcttgggtgtcattcgtgatcacaaaaagctggttaacaccttccgtctcatgcggcgtgcgggttacatcaacgagtttgtaagcatatcaacgaatcttacagaccgatgcgtgtatatcagcagcgacggcggaaggctgtgtcggccatacattatagtgaagaaacaaaagcccgctgttacaaataaacatatggaagaactcgcccagggataccggaattttgaagactttctacacgaaagtctagtagagtacttggacgtgaatgaggagaacgactgtaatatagctctctacgaacacactatcaacaaggatacaacgcatctggagatcgaacccttcacgctactgggcgtgtgcgccggtctaatcccatacccccatcacaatcagtcccccagaaacacataccaatgcgccatggggaaacaggccatggggacaatcggatacaatcagcggaaccgtattgatacattgatgtatctcctagcgtacccacagaagccaatggtgaagacaaagacgatcgaactgatcgagtttgaaaagttgcccgcaggtcagaacgctacggtcgctgtaatgtcatactctgggtatgacattgaagatgcactggtgctgaacaaggccagtctcgatcggggttttggaagatgccttgtgtacaaaaacgccaagtgcaccctgaaaaggtacactaaccaaacgttcgataaggttatggggcctatgctggacgcagctacacgtaagccgatctggcgacatgaaatcctcgatgcagacggcatttgtagccctggtgagaaggtagaaaacaagcaggttctagtgaataagtcaatgccaacggtgacccagattcctcttgaaggcagcaacgtcccacagcagccccagtacaaggacgtgccaattacttataagggggctactgactcctacatcgagaaggtgatgatttcctccaacgccgaggacgcttttctgatcaagatgctcctcagacaaaccagacggccagaaattggggataagttttcaagcagacacgggcaaaagggcgtgtgcggcttgattgttccacaagaggacatgcctttctgcgactccggaatttgtcccgatattattatgaacccacacggattcccttctcgaatgaccgtgggaaagcttatagagttactagctgggaaagccggagtccttgacggaagattccattacggaacagccttcggtggatctaaggtgaaggacgtgtgcgaggatcttgttcggcatgggtacaattacctgggaaaagattacgtgacaagcggtattaccggagagccccttgaggcttacatctatttcggacctgtgtactaccagaaactgaaacacatggtactggacaagatgcatgcacgggcacggggtccgagggccgtccttacccgccaacccactgaggggaggtcgagggacgggggattgcggctaggcgaaatggaaagagattgtcttataggttacggggctagtatgctgctcctcgagcgcctcatgatctcctctgacgcatttgaagtcgacgtctgcggacaatgtgggctgctggggtacagcgggtggtgccattactgtaaatccagttgccacgtaagcagcctgcgcattccctatgcgtgtaaactcttgttccaggaattgcaatctatgaacattatcccccgtctaaagctcagcaaatataatgagtag

SEQ ID NO: 235497 - DNA, 633 bp, Artificial Sequence
  Description of Artificial Sequence: Synthetic coding sequence
atggacgacgaagaggagacctacagactgtggaagatcaggaagaccataatgcagttatgccacgatcggggttatctggtgacgcaggacgaactcgatcaaacattggaggaattcaaagcgcagtcgggtgataagccgagcgaaggaagacctaggcggaccgaccttacggtgcttgtggcccataatgacgacccgactgatcagatgttcgtattttttcccgaagagccgaaggtggggattaagacaattaaggtttactgccagaggatgcaagaggagaatatcacgcgagctttaatagtggtccaacaaggtatgacaccgtcagcaaagcagtcactggtggacatggcacctaaatacattcttgaacaatttctccagcaggagctgctcatcaatatcaccgaacacgaactcgtcccagagcacgtagtgatgacaaaggaggaggtgactgaactgctggccaggtacaagcttcgcgagaaccaactccccaggatacaggcaggtgaccccgtagccaggtatttcgggattaaacgtggccaggttgtgaagataatccgaccctccgagaccgccggaaggtatattacctaccggctcgtccagtag

SEQ ID NO: 235498 - DNA, 1173 bp, Artificial Sequence
  Description of Artificial Sequence: Synthetic coding sequence
atggaggacccaacactttacattgtcgagcggcctcttccaggctatcccgatgcggaggcccctgagccctcctcagcaggcgctcaagccgctgaggagccttccggcgcaggatccgaagagcttattaagagtgatcaggtcaacggcgtgctagtactttctctgctggataaaattattggcgcagtggaccagattcaactcacacaggcacagcttgaagagagacaagcagagatggagggagccgttcagagtatccagggcgaattgagtaagttaggcaaggctcatgccactaccagcaataccgtatccaaactcctcgagaaggtgagaaaggttagtgtgaatgtaaagaccgtcagaggctctttggagagacaggctggccagatcaagaagctggaggtcaatgaagcagaactcctgcggagaagaaactttaaagtcatgatatatcaggatgaggtaaagttaccagcaaaacttagcattagcaaatctctcaaagagtccgaggcactcccagagaaggagggcgaggagctcggagagggagaaagaccggaagaagatgccgctgccttggagctgtcttcagacgaggccgttgaagtagaggaagttatagaggaaagtagggctgaaagaatcaagagatcgggccttcgaagagtggacgactttaagaaggccttcagcaaagagaaaatggaaaagacgaaagtaagaaccagggaaaatctcgaaaaaactcgactgaagactaaagagaatctcgaaaagacgaggcacacactggagaagcgcatgaacaagttaggaacaagattagtccctgctgaaaggagagagaaattgaaaacatctcgagacaagctgcggaagagttttacccctgaccatgtggtttatgcccgttccaaaaccgccgtgtataaagtgcccccattcactttccatgttaagaagattagggaggggcaagtggaagtgctcaaggccaccgagatggtggaggtgggggctgacgatgatgaaggtggcgctgaaagaggagaagcaggcgatctgaggagaggatcttcccctgatgtgcacgctttgttggaaatcaccgaagaatcggacgccgtcctggttgataagagtgatagtgattag

SEQ ID NO: 235499 - DNA, 1038 bp, Artificial Sequence
  Description of Artificial Sequence: Synthetic coding sequence
atggaagaccctactttatacattgtggagagacctttaccaggctaccccgacgccgtggaccagatccagttgacccaagcccagcttgaggagagacaggctgaaatggagggcgctgtgcagtcaatacagggtgagctttcaaagctaggtaaagcccatgccacaacaagcaacacagtctctaagttactggaaaaagtaagaaaggtctcggttaatgtcaagaccgttaggggcagcctggagcgtcaggccggtcagatcaaaaagttagaggtgaatgaagccgagttgctcaggaggcgcaattttaaagtgatgatttaccaggacgaggtcaagcttccagccaaactgagcattagcaagagtctaaaggaatccgaagctttgcccgaaaaagagggagaagaattgggcgagggggagaggcccgaggaagatgccgcagcgctcgaactttctagcgatgaagcagtggaggtggaggaggtaattgaagagtcacgtgctgagagaatcaagagaagcgggctgcgccgtgtggacgactttaagaaggcgtttagcaaggagaagatggagaagactaaagtaaggacccgggaaaacctagaaaagactcgcctcaaaacaaaggagaacctggagaagacgagacataccctggagaaaaggatgaataaactgggaactcggctggttccggctgaacgaagagagaagcttaagactagccgcgataagcttcgcaagtcattcaccccggaccacgttgtgtatgcccgatcgaaaaccgcagtctataaggtgccgccatttacatttcatgtcaagaagatcagagaaggtcaggtcgaggtattgaaggctacagagatggttgaagtgggcgcagacgacgatgagggcggagccgagcgaggagaggctggggatctgagacggggttcttctcccgatgtgcacgccctgctggaaattaccgaagaaagcgacgctgtactcgtagacaaaagtgactcagattag

SEQ ID NO: 235500 - DNA, 2295 bp, Artificial Sequence
  Description of Artificial Sequence: Synthetic coding sequence
atgctgctttttgtgctaacgtgccttctggccgtgtttcccgctatctccaccaaaagcccgatttttggtccagaagaggtcaacagcgtcgagggcaacagcgtctctattacatgctactatccacctaccagcgtgaaccgacacactaggaagtactggtgtcgccagggagccagggggggttgtattaccctcatctcctccgagggctatgtgagttccaagtacgcaggcagagcgaacctgactaacttccctgaaaatgggacttttgtggtgaacattgcacagttgtctcaagatgacagcgggagatataagtgcggtctgggtatcaacagtagggggcttagctttgatgtctccctcgaggtgtcgcaaggcccaggacttctaaatgatacaaaggtgtatacagttgacctaggcaggacggttactataaactgtccctttaaaaccgagaatgcacagaagcggaaaagcctgtacaagcagatcgggctctaccctgtgcttgtaattgatagctcgggatacgtgaacccaaattatacagggagaatccgcctggacattcaaggtactggccagttactcttcagtgtggtcattaaccaactacgcctgagtgacgccggacagtacctgtgtcaggccggtgatgactccaattccaataagaagaatgccgacctgcaggtgctcaaaccggaacctgagcttgtgtacgaggacctgagaggaagtgtgacgttccattgtgccctcgggcctgaggtcgctaatgtggccaagttcttgtgtagacagagtagcggcgaaaactgcgacgttgtggtgaatacgctcggaaagagagcccctgcatttgagggaagaattctgctgaaccctcaggacaaagacggctctttctctgtggtgatcactggcttacgaaaagaggatgccggaagatatttgtgcggagcccatagtgacggacagcttcaggaaggctcccctatccaggcttggcagctcttcgtgaatgaagaaagcaccatcccccgaagccctactgtcgttaagggagtggcgggaggctccgtggcggtcctgtgcccgtacaatcgtaaggaaagcaagtcgatcaagtactggtgcctttgggagggggcacagaacggcagatgcccactgttagtggattctgaaggatgggtcaaggcacaatatgaaggtcgccttagcctgctggaagagcctggaaacggtacattcacggtgattttgaaccagctgacttctcgggacgccggtttttactggtgcctaactaacggcgataccctctggcgaaccacagtggagatcaaaattatagagggtgagccgaacctgaaggtgcctggtaatgtaactgcagtgcttggagagactcttaaggtgccttgccattttccatgcaaattcagttcctacgaaaaatactggtgcaagtggaataataccggttgtcaggcactgcccagccaggacgagggcccttccaaagcatttgtaaattgtgatgaaaactctcgcctcgtgagtctcacactcaatttagttactagagccgatgagggctggtactggtgtggtgtgaagcaggggcacttttacggtgagacggccgctgtgtatgtggcagtagaggaacggaaagccgcaggttcccgggacgtctcgctggcgaaggctgatgccgctccagatgaaaaagtcctcgactcagggttcagagaaattgaaaataaggcgatacaggatcccaggctcttcgcagaagaaaaggctgttgcggatacgcgggatcaggcagacggtagcagggcctccgttgacagtggctccagtgaagagcaggggggaagctctcgtgctctcgtgtcaacactggtgccactaggactggtcttggccgttggagctgtggctgtgggcgtggctagagccaggcatagaaaaaacgtggatagagtgagtattaggagttacaggacagatattagcatgtccgactttgagaactccagggaatttggtgccaacgacaatatgggggctagctcaataacacaggaaacctccctggggggtaaggaagagtttgtagccacaaccgaatccacgactgagaccaaggagcctaagaaggccaagagaagcagcaaggaagaagccgaaatggcttacaaagactttttgctacaatcctccaccgtagccgctgaggcccaggacggccctcaggaagcctag

SEQ ID NO: 235501 - DNA, 1596 bp, Artificial Sequence
  Description of Artificial Sequence: Synthetic coding sequence
atggacggcatagtccctgatatagcggttgggactaaaagagggtcggacgaattgttctctacatgtgtcaccaatggcccattcattatgtcctcaaatagcgcaagcgccgctaacggcaatgattctaagaagtttaagggcgactctcgttccgctggcgtcccatctcgagtgatccacattagaaaattgcccatcgatgtgactgaaggagaagttataagtttgggcctgccttttggtaaagtgactaacctgttaatgctcaagggtaagaaccaagccttcatagaaatgaataccgaagaggccgcaaataccatggttaattattatacatcagtgacacctgtacttagggggcagcccatttacattcagttctctaatcacaaagagctgaagaccgattcatctccaaaccaggcgagagctcaggccgcactgcaggccgtcaactccgtccagtccggaaatcttgccctagcagctagtgctgccgctgtagacgccggaatggctatggcaggccagtccccagtcctccgaatcatagtcgagaatctcttttaccccgtaaccctggatgtcttgcaccagatcttttctaagttcggcactgtgctcaaaattataacatttaccaagaataatcagttccaggccttgctccagtacgcggatcccgtatccgctcaacacgctaagctttcgctggacggccagaacatctacaacgcctgctgcacactgcggattgatttttcaaaactgacgtcactcaacgtgaagtacaataacgacaaatcacgcgattatactcgacctgacctcccgtcaggagactctcagccgtcattggaccagactatggccgcagccttcggactgtccgtaccaaacgtacacggcgcattagccccacttgccatcccttccgccgcagctgcagccgctgctgccggtcggatcgcgatccccggattagccggagccggaaatagcgtgttactcgtcagcaaccttaaccccgaacgcgttactccccagagtctgttcattctttttggcgtgtatggcgatgtgcagagggtcaagatcctctttaacaagaaagagaacgccctggtccagatggctgatgggaaccaggcccagttggccatgtcccaccttaacggccataaactccacggcaaacctattaggatcaccctgagtaaacaccaaaacgttcagctgccgcgagaaggacaggaagatcaagggctaacaaaggattatggaaactctcctctgcataggttcaaaaagcctggcagcaagaatttccagaatatatttcctccaagcgccaccctgcacctttcgaacatcccgccttctgtttccgaagaggatctgaaggtcctattttcatctaacgggggagttgtaaaggggtttaagttcttccagaaggataggaagatggccctgattcagatgggctctgtggaagaagccgtgcaggctctcatcgatctccataatcacgacctgggggagaaccaccacttgcgcgtgtcatttagcaaaagcacaatttag

SEQ ID NO: 235502 - DNA, 594 bp, Artificial Sequence
  Description of Artificial Sequence: Synthetic coding sequence
atggatggaattgttccagacattgcggtagggacaaaacgggtcacgccccagtctctgttcatcttgtttggagtgtacggagacgtgcagcgcgtaaagatcctctttaataagaaggaaaatgcgttggtgcagatggcagacggaaatcaggcacagttggccatgtcacacctcaacgggcacaagctacatgggaagcccattagaattaccttgtctaagcaccagaatgttcagctgcccagggaaggccaagaagaccagggtctcaccaaagactacggcaacagtcccctacacagattcaagaaacccggttctaagaattttcagaacattttccccccaagcgccaccttgcacttgagtaacatacccccttcggtttcagaggaggacctgaaggtgctgttttcatcaaacggaggagtagtcaaaggcttcaaattctttcagaaggacagaaaaatggcgctaatccagatgggatccgttgaagaggcagtgcaagcacttatagatttacacaaccacgacttaggcgaaaaccatcacctgcgggtgagtttctccaagtcaacaatctag

SEQ ID NO: 235503 - DNA, 1674 bp, Artificial Sequence
  Description of Artificial Sequence: Synthetic coding sequence
atggacggcatcgtacccgacatagccgtcggaacgaaaagagggagcgatgagctgttttctacatgcgtgaccaatgggcctttcatcatgagctcgaacagcgcctcagctgcaaatggtaatgactctaagaaatttaagggcgactcccgctctgctggggtccccagtcgggtgatccacattaggaagctacccattgatgtaaccgaaggggaggtgatcagtttaggcctgcctttcggcaaagtcacaaacttgctgatgctcaagggaaagaatcaagccttcatcgagatgaatactgaagaggccgctaacacgatggtaaattactacacttcggtcaccccagtcctccgaggacagcctatctacatccagttctccaaccataaggagctgaaaaccgactcttctcccaatcaggccagggcgcaggccgctctccaagccgttaacagcgtgcagagtggcaatctggccctcgctgcaagcgcggctgctgtggacgctggaatggcgatggctggccagtcacctgtgctaagaataatcgtagagaacctattttaccccgtgacacttgacgttctgcatcagatatttagtaaatttgggacggtgctgaagataattacatttacaaagaacaatcaattccaggcccttctgcaatatgccgacccagtgtcagcccagcatgcaaagctctcccttgacgggcagaacatttataacgcttgctgcacgttgcgcatagactttagcaagcttacaagcttgaacgtgaaatataataatgacaaatccagggattatacacgaccagatctgccttctggagattcccagcccagtctggaccaaaccatggccgcagcttttggcgctcctgggattatatcagcgagtccttacgctggggcaggatttccgcctacgttcgccataccccaggcggcaggattatccgttccgaacgtacacggggctctggcgccactggctatcccatctgcagccgctgccgctgcagctgcgggacgaattgctattcccggtctcgcgggagctgggaactccgtgttgctggtctccaatctcaatcccgagcgtgttaccccccaaagtctcttcatcttgtttggcgtatatggggacgtccagagggtgaagatcctcttcaacaagaaggagaacgctcttgtccagatggctgacgggaatcaggcccaattagctatgtcgcatctgaatggccataagctgcatggcaagcccattcgaatcacattgtccaagcatcagaacgtgcaactgcccagggaagggcaggaggatcagggattaaccaaggactatggcaactccccgttacaccgcttcaaaaagccagggtcaaagaattttcaaaacatttttcctcccagtgcaacactgcacctgtccaatattccaccttctgtgtcagaggaagacttaaaagtgctgttttcaagtaatgggggagtggtgaaaggttttaagtttttccaaaaagacagaaaaatggctctgattcaaatgggctcagtcgaggaagccgtgcaggccctgattgacttacacaatcacgatcttggggagaatcaccatctccgggtttcgttctcaaagagcacaatctag

SEQ ID NO: 235504 - DNA, 1653 bp, Artificial Sequence
  Description of Artificial Sequence: Synthetic coding sequence
atggatggaatagtacccgatatcgccgtcggtacaaaaagagggagtgacgaactcttctctacctgtgttaccaacggccctttcatcatgtcgtcaaattcggccagcgcggcaaacggcaatgactcgaagaagtttaaaggcgatagccgatcagcaggcgtgcctagtcgggtgatccacattaggaagttgcctattgatgtgacagaaggtgaagtcataagtctcggactaccattcgggaaggttacaaacctcctcatgctgaaaggaaagaaccaagctttcatcgagatgaacaccgaggaggccgctaacaccatggttaactattatacatccgtcactcccgtgctccgcggtcagcccatttatatccagttttctaatcataaggagctgaagaccgacagctccccaaaccaggcccgagctcaggccgcattacaggccgttaactctgtccagtctggcaacctggctctcgcggcaagtgccgctgccgtggacgccggtatggcaatggccggacagtcccccgttttaaggattatcgtggagaatctgttctatcctgttactctagacgtgctccatcagatctttagcaagttcgggaccgtgttgaagattatcacttttacaaaaaacaaccagtttcaggctctgctgcagtatgccgaccccgtctctgcccagcacgccaaactgagcttggacgggcagaacatttataatgcatgttgcaccctccgaatcgacttctcaaagctgacaagtttaaatgtaaaatacaacaacgacaagtcccgtgactacactaggcctgacttaccgtccggtgatagtcagcccagccttgatcaaacaatggcagccgctttcgctagcccatacgccggtgcgggattccccccaacttttgctattcctcaggctgccggtttgagtgtacctaatgtacacggtgctttagcacctttggcgataccctcagctgccgctgccgctgccgcagccggaagaatagccatccctggtctggccggtgccggaaactcggttctcctcgtgtctaatctgaaccccgagcgcgtaacccctcagtccctttttattctgttcggcgtgtacggcgacgtacagcgagtaaaaatcttgttcaacaagaaggagaacgcccttgtgcagatggctgacggcaaccaggctcagcttgctatgtctcacttgaatggccacaaattgcacggcaagcccattagaattacactgtcaaaacatcaaaacgtccagctcccgagggagggccaggaagaccagggcctaaccaaagattatggtaacagtcctcttcaccgatttaaaaaacctggctctaaaaatttccagaatattttccctccaagtgccacactccatctcagcaatattcccccatcagtctccgaagaggacctgaaggtgctgttctcgagtaacggaggtgtggtgaagggattcaagttctttcaaaaggacagaaaaatggcattaattcagatgggttccgtggaggaagcagtgcaggctctcattgacctgcataatcacgatcttggcgagaaccaccacctcagggtctcctttagcaagagcacgatttag

SEQ ID NO: 235505 - DNA, 1599 bp, Artificial Sequence
  Description of Artificial Sequence: Synthetic coding sequence
atggacgggattgttacagaagttgcggtaggcgtgaagagagggagcgacgaactcctgtcagggagcgtgctttccagccctaacagcaatatgtcttccatggtggttaccgccaatgggaatgatagtaaaaagttcaaaggcgaggacaagatggatggtgccccaagccgggtactccacatcagaaagctgccgggtgaggtgactgaaacagaggtgatcgcactgggtctgcccttcgggaaagtcaccaacatcctgatgttaaaaggcaagaaccaggcgtttcttgaactggccaccgaggaggcagccattactatggtgaactattattccgcagtcaccccacacctgcggaatcagcccatctatatccaatactcgaatcacaaagagctcaaaaccgataatacactgaaccagcgggcacaggcggttctgcaagctgttaccgcagtccagactgctaacacgccgctctcaggcacaaccgtctccgaatcagctgtgaccccagcccagtctcccgtgcttcgaattataatcgacaatatgtactatcccgtgacactggacgtgctacatcagattttttcgaaatttggggcagtactgaagattatcaccttcactaagaacaatcagttccaggccctcctgcagtatggagacccagtcaacgctcagcaggctaagctggctctcgatgggcaaaacatctacaacgcttgctgcacgttgagaatagacttttccaaactggttaatctgaacgtaaagtacaacaatgacaaaagccgagactatacgcgcccagatcttccgagcggcgacgggcaacccgctctggatccagccatcgctgcagccttcgctaaggagacctccctgctggccgtgccgggagctttaagtcctttggccatcccaaacgccgcagccgctgctgccgcagcggcagcagggcgtgtgggcatgcctggggtttcagccggaggtaataccgtcctgctggtgtctaacttgaacgaagaaatggtcacgccacagagtctgttcacactttttggggtctatggtgatgttcagcgcgtcaagatcctctacaacaagaaggacagcgcgctgattcagatggccgacggaaaccagagccagctggcaatgaatcacctcaatggacagaaaatgtatggtaaaataatccgcgtgaccttaagcaagcatcagaccgtgcagctgcctcgggaaggactcgatgaccaggggctaacaaaggacttcggtaacagccctctccatcggttcaagaaacccggatccaagaattttcaaaatatctttccaccaagcgctaccctgcatcttagcaacatacctccaagcgtagccgaagaggacctgcgcacattgtttgccaatacaggcggtaccgttaaagcgttcaaatttttccagagggaccataaaatggcactcctgcagatggccacagtggaggaggccatacaagctctgatcgatttgcacaactataacctgggagagaatcaccacctgagggtttctttctctaagtcaacgatttag

SEQ ID NO: 235506 - DNA, 1614 bp, Artificial Sequence
  Description of Artificial Sequence: Synthetic coding sequence
atggacggcatcgtaactgaagtcgctgtcggggtgaaacgaggatccgatgagctgttgtctgggagtgtgctgtcgtcaccaaactcaaatatgagtagcatggttgtgaccgccaacgggaatgattccaaaaaattcaaaggggaagataagatggacggagctcccagtagagtactgcacatccgcaaattaccaggagaggtgacagaaacagaagtgattgcattgggcctgccgttcggcaaagtgaccaacatcctgatgctgaaaggtaagaaccaggccttcttagaactagctaccgaggaggctgccataacgatggttaactactattccgcagtgactccccacctgagaaaccagcccatttatattcaatatagcaaccacaaagaactcaagaccgataatactttgaaccaaagggcgcaggccgtgcttcaggcggtgacagctgtgcagaccgcaaatacaccgctgagcggcaccacagtgagtgaatctgccgttacgccagcccaatctccggtgttgagaattattatcgacaacatgtattatcccgtcacactcgatgtcctgcatcaaatatttagtaaattcggtgctgtactaaaaattataacctttacaaaaaacaatcagttccaggccctgctgcaatatggggacccggtaaacgcccagcaggctaagttagcgctggacggccagaacatctataacgcctgctgtactctcaggattgatttttcaaagctggtcaacttgaacgtcaaatacaacaatgataagagccgtgattataccaggcctgatctgccatcaggtgacggtcaacccgcactcgatccggcaatagccgctgcgttcgcaaaagagacatcactacttggcttgcccgtagcagccgtacctggcgcactcagcccactggctattcccaatgccgcagccgcagccgcagccgctgcagctggtagagtgggaatgcccggagtgagcgcgggaggaaacaccgttttgctggtgtccaatctcaatgaggaaatggtcaccccccagagtctattcactctgtttggagtatatggagacgtgcagagggttaagatcctctacaataagaaggattctgccctgatccagatggcagatggaaatcagagccagcttgccatgaatcacctaaatggacagaagatgtatggtaaaatcattcgggtgaccttgtctaaacatcaaacagtacaactgccccgtgagggtttagacgaccagggcctgaccaaggacttcggaaatagccccttgcacagattcaagaagcctggatccaagaacttccaaaacatcttccccccttctgccactctacatttaagcaatatcccacctagtgtggcggaagaggatctcagaaccctgtttgccaatacaggtgggacagtgaaggcatttaaatttttccagcgcgaccacaaaatggcattgctgcagatggccactgttgaagaggccatccaggccctgatagatctgcacaattataatttgggagagaaccaccacctgagagtcagcttttccaaaagcactatctag

SEQ ID NO: 235507 - DNA, 1611 bp, Artificial Sequence
  Description of Artificial Sequence: Synthetic coding sequence
atggatggaattgtgactgaagttgccgtgggtgtaaagaggggttctgacgagctcctgtcggggtccgtgctgagctcacctaattctaatatgtcttcgatggttgtcaccgcaaacgggaacgactcgaaaaaattcaagggcgaagacaaaatggacggagcaccatccagagttcttcatatcaggaagttacctggcgaagtgactgagactgaagtgatcgctctggggctgccattcggcaaagtcaccaacatcttaatgctgaaaggaaaaaaccaggcgttcttggagctcgctaccgaagaagcggctatcaccatggtaaattactacagcgctgtcacaccgcatttaagaaatcagccgatctacattcaatatagtaaccataaagagcttaaaaccgacaatactctgaatcagagagctcaggccgtgctacaagcagtgaccgctgttcagactgcaaatacacccttaagtggcacgactgtcagtgagtctgctgtcacccctgcccagtcacccgttctgcggattatcatagacaacatgtactatcctgtcacgctcgatgttttgcaccagatatttagcaaatttggagccgtcctgaaaattataacttttacaaaaaacaatcagttccaggccctactgcagtacggagacccagtaaacgcgcagcaggccaaattggctctggacggccagaatatttataacgcatgctgtacattaaggattgacttctctaaactcgtcaatctgaatgtgaaatacaataatgataaatctcgagattacacccggcctgatttgccgtctggcgacgggcaacctgcgctggaccccgctatagctgccgcattcgccaaagaaacatccctcctaggtctgccagtcgcagctgttcccggtgcccttagccccctcgcgattccgaacgcagccgctgccgcagccgctgctgctgccggtcgggtgggaatgcccggtgtgagcgctggtgggaataccgtactgttggtctccaacctcaatgaggagatggtgactccccaaagtctctttactctattcggagtgtacggcgacgtgcaaagggtcaaaattttatataataagaaagattctgccctgatccagatggcggatgggaaccagtcccagctagctatgaaccacctgaacggtcagaaaatgtatggcaagatcatccgggttacactgagtaaacaccagacagtccaattgccccgtgaggggctagacgaccagggcctgactaaggactttggcaactccccattgcatcgattcaaaaagcctggcagtaagaatttccaaaatattttccctccgagtgccactttgcatctgtccaacatccccccttccgtggctgaagaagatttacgcaccctgtttgccaacaccggcggtaccgtgaaggcttttaaatttttccaggaccacaagatggccctcctgcagatggctactgtggaggaggccatccaggctctcatagacctccataactataacctgggtgagaaccatcatctccgagtgtccttcagcaagtcaactatttag

SEQ ID NO: 235508 - DNA, 1056 bp, Artificial Sequence
  Description of Artificial Sequence: Synthetic coding sequence
gggatgaagaggggttctgatgaactcttaagtgggtctgttcttagcagtcccaattcgaatatgtcctccatggtggtcactgctaacggaaacgatagcaaaaagtttaaaggggaagacaaaatggatggggctccttcgcgggtgctgcatattcgcaaactgcctggagaggtaactgaaactgaagtgatcgcactggggctcccgtttgggaaggtaacaaacatcctgatgctaaagggaaagaatcaggctttcctcgagttggcgaccgaagaagcagccatcacaatggttaactactactccgccgtcaccccacatctacgtaaccagcctatctacatccagtattcaaatcacaaggaactgaagacagacaacacactgaaccagcgcgcacaggccgtgctccaagccgtgactgccgtgcagacagccaatacgcctctttctgggactacagtgtcagagtccgcagtgacgcccgctcagagcccagtgctccgcatcatcatagataacatgtattatcccgtgaccctcgacgttctgcaccagatattttctaaattcggcgcagtgcttaagattataactttcaccaaaaataatcagttccaggcccttctgcagtacggggacccagtgaatgctcagcaggccaaattggctctagacgggcagaatatttacaacgcatgctgcacattgcggatagacttttcgaagctcgtgaacctgaatgtgaaatacaacaacgacaagtcgcgcgattacactagaccagacctcccctccggtgatggacaacctgccctggatcccgctatagcagcagcttttgcaaaagaaactagtctgctcggtctcccagtggcagctgtgcccggagcacttagtccactggccattcccaatgctgccgcagcagccgcagccgctgccgctggacgcgtcggaatgcccggtgtctcagccggaggcaatacagtgctgcttgtgtcaaatctgaatgaggaggtgtttatggagatgtgcagcgtgtag

SEQ ID NO: 235509 - DNA, 1647 bp, Artificial Sequence
  Description of Artificial Sequence: Synthetic coding sequence
atgtggtctaatctcactttcagcttcttcggcttacgcaccaaagcgaaaaagtacgtcacagtgaataaccgcggatctgacgagctgctgagtggatccgttctgagctcccccaattcaaatatgtcttcgatggtcgttaccgcaaacggtaatgattcaaaaaaattcaagggggaggacaaaatggatggagccccttctagagtgctacacataaggaagcttcccggtgaagttaccgaaaccgaggtaattgccctcggcctgccattcgggaaggtaactaacattctcatgctgaagggcaagaaccaggcattcttggaactggcgaccgaggaggccgcaatcacaatggtcaattactatagcgccgtcactccgcacctgcggaatcagccaatctacatccagtattcaaaccataaggaacttaaaacagacaatacattgaatcagcgcgctcaggcggtgctgcaggcagtaaccgccgtgcagaccgcaaataccccactttccggcaccactgttagtgagtcagcggttaccccggctcagagtcccgtcctgcgaattattatagacaacatgtactaccccgtgaccttggatgtgctacatcagattttctctaagttcggcgctgttcttaaaatcataacgttcaccaagaataaccagttccaggcactgttgcagtacggcgaccccgtaaacgcccagcaggcaaaactggctttagatgggcaaaacatctacaatgcctgttgcactcttagaatcgacttttctaagcttgtgaacctgaatgtgaaatataataatgataagagccgggactatactagacctgacttgccttcaggcgacggtcaacccgctctggatccggcaatcgccgctgcttttgccaaggagacctcccttctgggcttacctgtggctgccgtgccgggtgcattaagccccctggccatccccaacgcagcagctgctgcagctgcagcagccgcaggccgagtcgggatgcccggtgtcagtgctgggggaaacacagttctgctcgtgtcgaacctaaatgaagagatggtgacgcctcagtctcttttcaccctattcggagtttatggggatgtacagcgcgtgaagattctgtataataaaaaagactcggcgttgatccagatggcagacggtaatcagagccaactggctatgaatcacctcaatggtcaaaaaatgtatggcaagatcatcagagtcaccctttctaagcaccagactgtccagctcccccgagaagggttagatgaccaggggctgacaaaagacttcggtaatagccctcttcatagatttaagaagcccggttcaaagaactttcagaatatctttccaccttcagccacactccatctgagtaacatcccaccctctgttgccgaggaggacctgcgcaccctctttgcaaacaccggcggaactgtgaaggctttcaagtttttccagcgggatcacaaaatggccctgctgcagatggcgacagtggaagaggccatccaggctctgatagatctccacaattataatttgggggagaatcatcacctccgagtgtcttttagtaaatcgacaatctag

SEQ ID NO: 235510 - DNA, 1596 bp, Artificial Sequence
  Description of Artificial Sequence: Synthetic coding sequence
atggatggcattgttactgaggtcgctgtgggagtcaaacgcggatcagacgaactactttccggctccgtgttgtcatcgcccaactccaacatgagctctatggtcgtgaccgcaaacggaaatgattccaaaaaattcaaaggagaagacaagatggacggtgcaccaagccgtgtgctgcatatacggaagcttccaggcgaagtgactgaaacggaagtgatcgccctgggtctaccgtttggaaaggtcacaaatatcctgatgctcaaggggaagaaccaagctttcctggagcttgccactgaagaagccgcaatcacaatggtgaattactatagcgcggtgacgcctcacctgagaaaccagcccatttacatccaatatagcaatcataaagaactcaaaacagacaacaccctgaaccagagagctcaagccgtgctgcaggccgtgaccgccgtccagacggcaaacacccctctcagcggaacgaccgtttccgagagtgcggtgacccccgctcaatcaccagtgttgcggatcatcatcgacaatatgtactatcccgttaccctcgacgtcctccatcagattttctccaagttcggcgcagtgctgaagataataactttcaccaagaataatcagtttcaggcacttctgcagtatggcgacccggtaaatgctcaacaggcgaaactggccctagacggccagaacatttacaacgcctgttgcaccctgagaattgacttctctaagctggtcaacctgaatgtcaagtacaataacgataagtcacgcgactacacaagaccagacctgccctccggtgatggccagccggctctggatccggctattgctgcagctttcgcgaaggaaacatctctcttggccgtgcccggagctctctcccccctggctattccgaatgctgccgctgcggctgcagcagccgctgcaggcagagtcggcatgcccggtgtgagcgccggtgggaatacagtgctcttggtgagcaacctgaatgaagagatggtaaccccacagagcctctttacattgttcggcgtgtacggggacgtacagcgagtaaaaatactgtacaacaagaaggacagtgccctgattcagatggccgacgggaatcagagccagctggctatgaatcaccttaacggccaaaagatgtacggcaagattattagggtgactctgtccaagcaccagacggtgcagcttccaagggaaggattggacgatcagggcttaacaaaagacttcgggaactcccccctccacagattcaaaaagcctggttctaaaaacttccagaacatctttccaccttctgctaccctccatttatccaacatccccccatctgttgctgaagaagatctgaggaccctgtttgcgaacactggagggaccgtaaaggcctttaagttttttcaggaccacaagatggcactcctccagatggccactgttgaggaagcaatccaggcactgatcgatctccacaactacaatctcggagagaaccaccatttgagggtgagcttttccaagtcaactatctag

SEQ ID NO: 235511 - DNA, 978 bp, Artificial Sequence
  Description of Artificial Sequence: Synthetic coding sequence
atgtcttctatggtagtgactgctaatggcaacgacagtaaaaaatttaagggcgaagacaaaatggatggtgctccttcccgtgtccttcatattaggaagttgccgggagaggtaactgaaacggaggtcattgccctcggcctgccctttgggaaggttaccaatatattaatgcttaagggaaagaatcaggccttccttgaactggccaccgaggaggctgcaatcactatggttaattattatagtgccgtgacaccgcacttaagaaaccagccaatttacatacaatattcaaatcataaagagttgaagaccgataacacccttaatcagagagcccaggctgtactacaagcagttacagccgtgcagactgcaaacacacctctgagtggaacaactgtctcggagtccgccgtgactcctgcccagtcccctgttctccggatcatcatagataatatgtactatcctgtgactctggacgttctgcatcaaattttctctaaatttggggctgtgctcaaaattatcaccttcacaaagaacaaccagttccaagccctcctgcagtacggagaccctgttaacgcccagcaagccaagctagctctcgatggccagaacatatacaacgcttgttgcactctgagaatcgacttcagcaaattagtcaatctaaatgttaagtacaataatgataaatcccgcgattatactcgccctgatctgccgtccggggacgggcagcccgctttggatccagccattgccgcagcttttgccaaggagacatccttactggcagttcctggcgctttaagcccactggccatccctaacgcagctgcggcagcagcagcagctgctgcagggcgagttggaatgcccggtgtctccgcgggtggcaatacagtattactggtttccaacctgaacgaagaagtttttatggaaatgtgtagtgtctag

SEQ ID NO: 235512 - DNA, 615 bp, Artificial Sequence
  Description of Artificial Sequence: Synthetic coding sequence
atgccaggcgtgagcgctgggggaaatactgtgctgttggtgtcaaacctgaatgaggagatggttacacctcagtccctgttcacgctcttcggggtttacggtgacgtacagagagtgaaaattctgtacaacaagaaagattctgcgctgatacagatggccgacgggaatcagtcccagctggccatgaaccacctgaatggacagaaaatgtatggtaagattatcagggtaactctgtcgaaacaccagaccgtgcagctaccccgagaggggctggacgaccagggcctcactaaggactttgggaattcaccactccacaggttcaaaaagccaggaagcaagaattttcagaacatttttcccccaagtgccaccttgcacctcagtaatatcccacctagtgtcgccgaggaggacttgcgtactttgtttgcgaatactggcggtacggtcaaagcgttcaagtttttccagcgcgaccacaaaatggccctgctgcagatggcaaccgtcgaggaagccatacaagcgctaatagatctgcataattataatctgggcgaaaatcaccatttgagggtctctttcagcaagagcacaatctag

SEQ ID NO: 235513 - DNA, 348 bp, Artificial Sequence
  Description of Artificial Sequence: Synthetic coding sequence
atggtgtgcagtccggtcacacttaggatcgctccgccagatcgcaggttctctcgtagtgcgatccctgaacagattatttccagcacgctgagttcaccatctagcaacgcgcctgacccgtgcgccaaagaaaccgtgctctccgcactcaaagaaaaaaagaagaaacgaaccgtggaggaggaagaccagatatttctggatggccaagaaaataagcggagctgcctcgtggacggtctcacagacgcgtcctccgcctttaaagtgccacgcccaggtcctgacacgttgcaatttactgtggacgtattccactttgccaacgacagtcggaatatgtag

SEQ ID NO: 235514 - DNA, 564 bp, Artificial Sequence
  Description of Artificial Sequence: Synthetic coding sequence
atggtgtgcagccccgtcaccctcaggattgcaccacccgatcgacggttctcccgaagtgccatccctgagcaaataataagctcaacactctcgagcccttccagtaacgcccctgacccatgcgcaaaagagactgtgctgagcgccctcaaggaaaagaaaaaaaagcgcaccgtggaagaggaggatcagatattcctcgatggacaagaaaataaaagatcgtgcttggtggatggacttacggacgcctcctctgcatttaaagtgccgagaccaggaccagatactttgcagtttactgtagacgtgtttcattttgctaacgatagcagaaacatgatctatatcacttgccatctgaaggttaccctggcagagcaggaccctgacgagttgaataaggcgtgctcattctctaagccctccaactcttggtttcccgtagaggggcttgctgacatctgtcagtgctgtaacaaaggtgattgcggtactcctagccactcccgcagacagcccagggtcgtcagccagtggtctacaagcgcatcattgtag

SEQ ID NO: 235515 - DNA, 1095 bp, Artificial Sequence
  Description of Artificial Sequence: Synthetic coding sequence
atgtccgcgaatagttcaagagttggacagttactgctgcaggggtctgcatgtatcaggtggaagcaagatgtggagggggctgtgtaccatttggctaactgcctgcttcttctggggtttatgggcggttcaggagtctatggatgcttctaccttttcggcttcttgagtgctggttacctttgttgtgtgctatggggttggttttccgcctgtggtctggacatcgttctctggagtttcttgctggctgtggtttgcttgctacagttagcccacttggtctataggttacgcgaggacacactccccgaggagtttgatctcctctataagaccctgtgtcttcccctccaggtccctctgcaaacttataaggaaattgtccattgctgcgaggagcaagtccttactctggcaacagaacagacatacgctgtcgaaggtgagacccctatcaacagactgagtctgctcctgtccggtagggtgagagtgtctcaagatgggcagtttctgcattatatctttccctaccagttcatggactcccctgaatgggagtccctgcagccttccgaggaaggcgtgtttcaggtgacgcttactgccgaaacaagctgttcctatatcagctggcctcgaaagagtcttcatttgctgctgaccaaggaacgctatatctcctgcctattcagcgcgctgctcggctatgacatcagcgaaaagctgtatactctcaatgataaactgttcgctaagtttggactccgctttgatatccgacttccatctttataccatgtgcttgggcctactgctgccgacgccggacccgagagtgaaaaaggtgacgaggaagtctgcgaaccagctgtgtcccccccacaggctactcccacatcccttcagcagactccaccttgttctaccccaccggctaccactaacttcccagcgcctcccacccgcgcacgtctgtctcgtccagatagtggcatactagcctctcggattccgcttcagtcatacagtcaggtgatctctagagggcaagccccactggccccaacacacactccagagctgtag

SEQ ID NO: 235516 - DNA, 1083 bp, Artificial Sequence
  Description of Artificial Sequence: Synthetic coding sequence
atgagcgccaattcatcaagagtcggacagctgctgttacagggcagcgcctgcatccgctggaagcaagacgtggaaggggcagtgtaccacctagctaattgtttattgctgctaggcttcatgggaggcagtggcgtgtacggttgcttctatttgtttggcttccttagcgccggttatttatgctgtgtgctctggggatggttcagtgcctgcggcctcgatattgtactgtggagctttctgctggcagttgtctgtctgcttcagcttgcccacctggtgtaccggctgagggaggacacgctgcctgaagaatttgacctgttatataaaacgctctgcctccccctgcaagtgcccctgcagacatataaggaaatcgtgcactgctgcgaggagcaggtgctgacgctagcgaccgagcaaacatacgctgtagaaggcgaaactccaataaacagactcagtctcctcctgagtggtcgggttagagtgtcccaggacgggcagtttttgcattacattttcccttaccagtttatggattcccctgaatgggagtctctccagcctagcgaagaaggcgtcttccaggtgacacttactgctgagacatcttgttcctacattagctggccaagaaaatccctacacctgttgctgactaaagaacgttacatctcttgtttgttttctgctctccttggttacgacatctcagaaaagctgtacaccttgaacgataaactgttcgcaaagttcggattgaggtttgatatcagattacccagtctctaccacgtcctggggcctacagcggctgacgctggtcccgagtccgagaagggcgatgaggaggtgtgcgagccagcagtatcgccccctcaggccaccccgactagtctgcagcagacccccccttgttcaaccccacctgccaccactaacttcccggctcccccaactagagcacggctttctaggcctgattccggcattctggaaatagacgacttcccttcatattttcatcaattcggctttagcgggaaagtcgctgcaggccgtataccctag

SEQ ID NO: 235517 - DNA, 1083 bp, Artificial Sequence
  Description of Artificial Sequence: Synthetic coding sequence
atgagcgcaaacagctcacgagtcggccaactgctcctccagggttccgcttgtattaggtggaaacaggacgtggaaggtgctgtttaccatcttgcgaactgccttcttctgcttggttttatgggcggatccggcgtgtacggatgcttctacttattcggattcttgtctgctgggtacctgtgttgtgtcctgtggggatggttcagtgcttgcggcctagacattgtcctgtggagcttcctactcgcagtggtgtgtcttctacagttagcccatttggtctaccggctgagagaggatacgctgccagaggagtttgatctcctgtacaagaccctgtgtctgcctctccaggtgcccctacagacttacaaagaaatcgtgcactgctgcgaagagcaggttttaactctagctaccgagcaaacatacgctgttgaaggtgagacaccgatcaaccggctcagcttgctactgagtgggagggtccgcgtaagtcaggatggacagttcctgcattatattttcccttaccaatttatggactcaccggagtgggaaagtctgcagcctagcgaggagggcgtgtttcaggtcacattgacggcagagacctcttgctcctacatctcatggccaaggaaatccttacacctgctgctgacaaaggagcggtacatctcatgtctgttctctgccctgctggggtacgacatctccgaaaagctgtacacattaaacgataaactgtttgccaagtttggcttgcgtttcgacattagattgccaagcctctaccatgtccttggccctaccgcagctgatgcgggacccgagtccgaaaagggcgacgaggaagtctgtgagcccgctgtttcacctccccaggcaacccctacctcactgcagcagactccaccctgtagtactccacctgctacaaccaattttcccgctccccctactcgcgcacgactgagccgcccagatagcgggatactagagatcgacgattttcccagctacttccatcagtttggttttagcgggaaggtcgcagcgggacgaattccttag

SEQ ID NO: 235518 - DNA, 876 bp, Artificial Sequence
  Description of Artificial Sequence: Synthetic coding sequence
atggaaagaaatagctcactttggaaaaatctcatagacgaacatcctgtgtgcactacgtggaaacaagaggccgaaggggcaatctatcacctggctagcatcctattcgtggtgggattcatggggggtagtggtttctttgggctgctttacgtgttctcgctcctgggcctgggctttctttgttccgccgtttgggcttgggttgatgtgtgtgccgctgatatctttagctggaattttgtgctgttcgttatctgctttatgcagtttgtgcatattgcttaccaagtgcgatctattacattcgcaagagaatttcaggtgctgtatagcagcctgtttcagcctcttgggatctccctccctgttttccgcaccatcgccctgtcatcagaggtcgtaactctcgaaaaagaacattgctatgcaatgcaggggaagacgtctattgacaagcttagtctgctcgtttccggaagaatccgtgtaacggtggacggagagttccttcactatatctttccgctccagtttctcgacagccccgaatgggactcccttaggcctacagaggaggggatctttcaggtcacactcacggccgagaccgactgtcgatatgtcagttggagaaggaaaaagttgtacctgctgttcgctcagcatcgctatatctctcggctgttctccgtgctgattgggtcagacatcgcagataaactgtatgctttgaacgatagagtgtacataggcaaacggtatcattatgatatcaggctgccaaacttttaccaaatgtctactccagaaatacgcaggagccctctgactcagcatttccagaattccaggaggtactgcgataaatag

SEQ ID NO: 235519 - DNA, 306 bp, Artificial Sequence
  Description of Artificial Sequence: Synthetic coding sequence
atgctttttctttgcttcgacaggatcagggtaactgtagatggtgaattcctccattacatattccctttgcagtttctggatagcccagaatgggactcccttcgccctaccgaagagggaatatttcaggtcacacttacggccgagactgactgccgctacgtgagttggagacgaaagaaactctaccttttgttcgcacaacacaggtacatatcaagactgttcagtgttttgattggcagcgatatcgcggataaattgtatgctctcaatgatcgggtgtacattggcaagcgttag

SEQ ID NO: 235520 - DNA, 1386 bp, Artificial Sequence
  Description of Artificial Sequence: Synthetic coding sequence
atggccaccttttctaggcaagaattcttccagcagctgcttcagggttgtctgttacccactgcacagcagggcctggaccaaatttggctgctcttagctatatgtcttgcctgccggctcttgtggcgactgggcctgccatcatatctgaagcacgcttctaccgtggcaggcggttttttcagcctgtatcatttcttccagttgcacatggtctgggtggtcctgctgtctttactctgctatctggtgctctttctgtgccgacatagttctcacaggggggtctttctgtctgtgactatcctgatttatctgctgatgggcgaaatgcacatggtggatacggtgacatggcacaagatgaggggagctcaaatgatcgtggctatgaaagccgtttccctggggttcgatcttgaccgcggtgaagtgggaacagtgccatctcccgttgagtttatgggatatctgtacttcgtcgggacaattgtattcgggccttggatatctttccatagttatctacaagcagtccagggcaggcctctgtcctgtcggtggcttcagaaagtggctcgctctctcgcactcgccttattatgtctcgtgctgagtacttgtgtcggtccataccttttcccgtatttcatccctttgaacggggatcgcctgctcaggaacaaaaaacgaaaggcaaggggcactatggtgcgctggttgcgcgcttatgaatctgccgtgtcattccatttctccaattattttgtgggatttcttagcgaagccaccgccacactggcaggtgccggatttaccgaggagaaggatcacctggagtgggatcttacggtttctaagcccctgaacgtcgagttaccgagatctatggtcgaggtagtaacctcctggaacttaccgatgagttattggctgaataactatgtgttcaaaaatgcactcagactggggacattttcagctgtgttggtcacgtatgctgcttctgccctcctgcatggcttttcctttcatctagcagctgtccttctttctttagccttcattacctacgtcgagcatgtgctccgaaaacggcttgcaaggatcctctctgcgtgtgtgttgagcaagaggtgccctcccgactgttcccaccagcacagactgggtctgggcgtgcgggcactcaacctcctgtttggcgcactggcaatcttccacttagcctaccttggcagcctatttgacgtggatgtagacgacactacagaggaacaggggtatggcatggcctacaccgttcacaaatggtccgaactttcctgggcctctcactgggtgacgtttggctgctggatcttttacaggctgataggctag

SEQ ID NO: 235521 - DNA, 1368 bp, Artificial Sequence
  Description of Artificial Sequence: Synthetic coding sequence
atggctaccttctcccggcaggaattcttccagcagttgctgcaaggttgccttctcccaaccgctcagcagggattagaccagatctggttgttgctggccatttgtctagcgtgtcggttactatggcgtctcggattgcccagctacttgaaacacgcatccactgtcgctggtgggttttttagtctctaccacttctttcaactgcacatggtctgggttgtcttactcagtctcctttgttacctggtgttatttctttgtagacattctagtcatcgtggtgtctttctctctgtaaccatccttatatacctgcttatgggcgagatgcacatggtggacactgtgacctggcacaagatgcgcggtgcacagatgatcgtcgccatgaaggccgtctccctgggcttcgacttggatagaggcgaggtggggacggtgccatcccccgtggaatttatgggttatctgtactttgtaggcacaatcgtttttgggccttggattagcttccattcgtatttgcaagcagtgcaaggacgcccattgtcctgtcgttggctccagaaagtggctcggagcttagctctcgccctgctgtgcctggttttgtccacctgtgtaggaccatatctgtttccgtattttatccccctcaatggcgataggctccttaggaagggcaccatggtcaggtggctcagggcatacgaatcagccgtatcctttcatttcagcaactactttgtggggttcttgtcagaggccaccgcgacacttgccggagcaggatttactgaggaaaaagaccatcttgagtgggacctgacagttagcaagcctttgaacgtggagcttcctcgatcaatggttgaggtcgtgacgtcatggaacctccccatgtcatactggctgaacaactacgtgttcaaaaacgccttacgactggggaccttcagcgccgtgctcgtgacttatgccgcaagcgcgctgttgcacgggttctcattccatttggcggcagtgctcctgagcctcgcatttataacatatgtagagcacgtactccggaaacgcttggccaggatcctctctgcttgtgtcctgagcaagcggtgtcctcctgattgctcccatcagcaccggctgggcctgggcgtcagggcattaaatcttttgttcggggctctcgcgatcttccatcttgcttacctgggttcattattcgacgtggatgtggacgacaccactgaagagcaggggtatgggatggcttataccgtgcacaaatggagtgaactctcctgggcaagccactgggtaaccttcggctgctggatcttctaccggctgattggatag

SEQ ID NO: 235522 - DNA, 1371 bp, Artificial Sequence
  Description of Artificial Sequence: Synthetic coding sequence
atggccaccttttcacgccaggagttttttcagcagcttttacagggatgcctgctccccactgctcaacaggggttggaccagatctggctcctacttgcgatctgccttgcctgccggcttctgtggaggctgggactgccttcttatctgaagcatgcctcaacagtggccggtgggtttttctctctctatcattttttccagctgcatatggtctgggtggtcctcctatctctcctttgttatttagtgctgttcctgtgccggcattctagccacagaggggtgttcctgagcgtgactatccttatctacctgcttatgggcgagatgcatatggtcgataccgttacatggcacaaaatgaggggagcccaaatgattgtggctatgaaagctgtctcactggggttcgatctcgaccgcggagaagtcggaaccgtgcctagtccggtcgagttcatgggctacctgtactttgttgggaccatcgtcttcgggccatggatttctttccactcttacctacaggctgtccagggccgacccctaagttgcaggtggttgcaaaaagtagctaggagcttggcacttgcactcctgtgcctggtgctgagcacttgcgtgggcccatacctcttcccatacttcatcccactgaacggcgaccgtcttttgcgcaataaaaaacgtaaggcacgatggctgagggcctatgagtccgcggtcagctttcactttagtaattattttgtgggctttttaagcgaagccacggcaactctggctggtgctggcttcacagaggagaaggatcacctcgagtgggatctcacggtgtccaaacccttgaacgtagaactgcctaggtccatggtggaggtggtcaccagctggaatttgcccatgagctattggctcaacaactacgtcttcaagaatgccctgaggctgggtactttcagtgccgtgttggtcacttacgccgcaagtgctctcttgcacgggttctcattccacctggcagccgtcctgctgtccctcgcatttatcacgtacgttgagcatgttctacgcaagaggttagcaagaatcttgtctgcttgtgtgctctctaaacgatgtcctccggattgctctcaccagcacagattgggactgggggtacgagctctgaatttattatttggtgccctcgccatcttccatctggcatatctagggtctctattcgacgtagatgtggacgacaccacagaggagcaagggtacggaatggcttataccgtccataaatggtcagagctgagttgggcttcccactgggtcacgttcggttgttggattttttacagacttataggatag

SEQ ID NO: 235523 - DNA, 1368 bp, Artificial Sequence
  Description of Artificial Sequence: Synthetic coding sequence
atggctacctttagtcggcaggaattttttcagcagctcctgcaaggttgtctgctgcctacggcccagcaaggcctcgaccaaatttggctcctacttgccatctgtttagcttgcagactcctgtggcggcttggtttacctagttacttgaagcacgcgagcacggttgctggtggcttcttcagcctttaccacttcttccagcttcacatggtgtgggtcgtgttattgtctctcttgtgctacctggtgctgttcttatgcagacattcgtcccatcgcggtgtgtttctctctgtcacaatcttaatttacctgttgatgggggagatgcacatggtggatactgtgacatggcacaaaatgcgaggagctcagatgatagtggccatgaaagctgtgagcctcggctttgatctggacaggggggaggtgggtaccgtgcctagccctgtggagtttatgggttatctctacttcgtaggcacaatcgtattcggcccttggatctcattccattcctacctgcaagccgtgcagggtcgccctctgtcctgtagatggctgcagaaggtggcaaggagtttagcccttgcgctcctctgcctcgtcctgtccacatgcgtcgggccatacttgttcccctacttcatccccctcaacggggacaggttacttcggaaaggtactatggtccgttggctacgcgcttatgagtccgccgtgtcttttcacttctccaattacttcgtcggattcctatcagaggctacagctacactagccggagccggattcactgaggaaaaagaccatctagagtgggaccttacagtctcaaagccattaaacgtcgaacttcctcgctcgatggttgaggttgtcacgtcttggaatctgcccatgagttattggctgaataattacgtgtttaaaaacgcactccggctgggaactttttctgccgtgctcgtcacttacgcagcttccgccctactccatgggtttagctttcatttagcagctgtacttctttcgcttgcgtttataacttacgtagagcacgtgctcaggaaacgactggctagaattctgtctgcttgcgtgctgagcaagagatgcccacctgactgctcccatcagcaccgtctgggcctgggggtacgggcactgaatctgctgttcggcgctctggctatcttccacctcgcttacttaggcagtctattcgacgtggatgtggacgacactactgaggaacagggctatggtatggcctacacagtgcacaaatggtcagaattgtcatgggcctctcactgggtaacatttggttgttggatattctaccgcttaatagggtag

SEQ ID NO: 235524 - DNA, 1353 bp, Artificial Sequence
  Description of Artificial Sequence: Synthetic coding sequence
atggcaacatttagtcgtcaggagtttttccaacaacttttgcaaggatgcctgctccccaccgcgcagcagggcctagatcagatttggctcctcctggcgatctgcctcgcttgtagattattatggaggcttggccttcccagctaccttaagcacgcttctacagtcgctggaggtttctttagcctgtatcactttttccagttacacatggtgtgggttgtgctactgtctcttctctgttaccttgtgttgttcttgtgcagacactcatcccatcgaggagtttttttaagcgtgacgatcctgatttatctgctaatgggagagatgcacatggttgatacagtgacatggcacaaaatgaggggggcacagatgatcgtggccatgaaggccgtttctttaggatttgacctggaccggggagaagtgggcaccgtcccatcccccgtggaatttatgggatatctctacttcgtgggaacgatcgtgttcggaccctggatcagctttcatagttatctgcaggcagtgcaaggcaggccccttagctgccgatggctccagaaagtagcaagaagcttggctctggcactgctctgcctagtcttgagtacctgcgtaggaccttatctgttcccctactttatccctctgaacggggaccgcctgctgagaaaatggcttcgagcctatgaaagtgccgtcagtttccatttctctaattacttcgtggggttcctgtcagaagccactgcaaccctggctggtgccggattcacggaggagaaggaccatctcgagtgggacctgacagtgagcaagcccctcaacgtggagctgccccgatccatggtagaggtggttacctcctggaacctgcctatgagctactggctgaacaattatgtcttcaagaatgcactgcgtctgggcacgttctctgcggtgctcgtgacttatgcagctagcgccctgctgcatgggttctctttccatctagccgcagtgcttctctcactcgcgttcatcacatatgtggaacatgtgctaagaaagaggttagctagaattctgtcagcatgtgtgctctctaaaagatgcccccctgactgctctcaccaacaccgcctcggcctgggggtcagggctctgaatctgttgttcggagcactcgcaatctttcacctcgcctatttggggtccctatttgacgttgatgtggacgacacgacagaagagcagggatatggcatggcgtacacagttcataaatggtctgagttgagctgggccagtcactgggtgacctttgggtgctggatcttttataggctgatcgggtag

SEQ ID NO: 235525 - DNA, 1140 bp, Artificial Sequence
  Description of Artificial Sequence: Synthetic coding sequence
atggtctgggtggttctgctttccctcctgtgttatttagtgctcttcttgtgccggcattcctcccatagaggggttttccttagcgtcacgatattgatttacctgctgatgggtgaaatgcacatggttgatactgttacgtggcataaaatgaggggggcacagatgattgtagcaatgaaggcggtgtctttggggttcgatctggatcgaggtgaggtcggcacggttccctcacccgtggagttcatgggctacctctactttgtgggaaccattgtctttggaccctggatcagctttcattcatacctgcaagctgtgcagggacggccactgtcatgccggtggttgcagaaggtcgcccgatctttagcactcgccctactgtgtcttgtgctgtccacctgcgtgggcccttacctgtttccctatttcattcctctgaacggagaccggctgctccgcaaatggctgcgggcatacgaatccgccgtgagtttccatttttccaactactttgtgggctttttgtctgaggcaacggcaacacttgccggtgcaggtttcactgaggaaaaggatcacctcgaatgggacttaaccgtttccaaacctctcaatgtagagctcccacgatcgatggtcgaagtggtaacgtcatggaacctgccaatgagctattggcttaataactacgtgttcaagaatgcactgagattgggaacattctctgcagtcctcgtaacttacgctgcctccgccctcttacatggattttcgttccatctggctgccgtattactgagccttgctttcattacttatgttgaacatgtcctgcgcaaacgcctagcacggatcctgtcagcctgcgtgctgtcgaagaggtgtcccccagactgtagccaccagcatcggctcggtttaggcgtgagggcactaaaccttttattcggagccctcgcaatattccacctcgcctacctgggctccctttttgacgttgatgtggacgataccacggaggagcagggttacggcatggcatatacagtccacaaatggagcgagttatcatgggccagccattgggtgaccttcgggtgttggatcttctacaggttaataggttag

SEQ ID NO: 235526 - DNA, 294 bp, Artificial Sequence
  Description of Artificial Sequence: Synthetic coding sequence
atggctacgttttccagacaagaattttttcagcagctgctgcagggttgtctgctcccaacagcccagcaaggactggatcagatctggctcttgttagctatttgtcttgcttgcaggctcctttggcgccttggactcccaagctacctaaagcacgcgagcacggtagccggtggtttcttttcactctaccatttcttccagctgcatatggtttgggtagtgttgctgagcctcttatgctatttggtactgttcctatgcagacacagctctcatcgcggagtgtag

SEQ ID NO: 235527 - DNA, 1386 bp, Artificial Sequence
  Description of Artificial Sequence: Synthetic coding sequence
atggctaccttttcccggcaggagttttttcagcagttgttgcaggggtgcctgctcccgacggcccagcagggtctagaccagatttggctgcttctggccatttgcctagcgtgccgactgttgtggcggctgggtctcccctcttatctgaaacacgcctcaactgtggccggagggttcttctcactctaccactttttccaattgcatatggtatgggtcgtgctgctgtccctgttgtgctatctggtgctctttctatgcagacactcctcacaccggggtgtctttctgagcgtcactatcctcatatatttgttgatgggtgagatgcacatggtggacacagtgacttggcataaaatgcgaggtgctcaaatgatcgtagccatgaaggccgttagcctcggatttgacctggaccggggtgaggtaggaacggtgccctcacctgtggaattcatgggctatctatactttgttggcactattgtgtttggtccatggatttcttttcacagctatctgcaggctgtgcaggggaggccactgtcatgccgttggctgcaaaaagtggccagaagccttgctttagcgctcctttgcctggtcctctcgacctgcgtgggcccttacttgttcccttactttatccccctgaatggcgaccgtttgctccgcaacaagaaacgtaaagccagaggcaccatggtgcgctggctgcgggcatatgaatccgccgtgagttttcattttagcaactattttgtggggtttctcagcgaggctactgcaactctcgctggagccggatttaccgaagagaaagaccatctagaatgggaccttactgtatccaaaccgctcaatgtggaattacccaggagcatggtggaggtggtaacatcctggaatctgccaatgagctattggttgaacaactatgtttttaagaatgccctgcggctcggtacattttcagcagtcctagtcacatacgccgctagtgctttactgcatgggttttcattccaccttgccgcagtgttactgtctcttgcatttataacatacgtcgagcacgtgctccgcaagcgcctagcccgaatactgtctgcatgcgtactgagtaaacggtgtccaccagattgtagtcaccagcatcgtctaggcttgggggtgcgtgctctcaaccttctcttcggggcacttgcaattttccatctcgcatatctcgggagtctcttcgacgtggatgtggatgacacgacggaggagcaagggtacggcatggcgtacaccgtgcacaagtggagcgagctctcctgggcctctcattgggtcactttcggctgttggatcttctaccgtttaatcggatag

SEQ ID NO: 235528 - DNA, 2769 bp, Artificial Sequence
  Description of Artificial Sequence: Synthetic coding sequence
atgttcctccatagcgtgaacctatggaacctggccttctatgtctttatggtgttcttggccactctggggttatgggatgtgttttttgggttcgaagaaaacaagtgctctatgtcttacatgttcgaatatcccgaataccagaagatcgaactgcctaaaaagctcgccaagagatacccagcgtacgaactctacctgtacggcgagggcagttacgccgaagaacacaaaattctcccactgactgggattcccgttctgtttctgcccggtaacgccggtagctacaagcaagtgcggagtattggtagcatcgctctcagaaaagcggaggacatcgacttcaagtatcactttgactttttttcagtgaattttaatgaagaactcgtggctctgtacggagggtcactacagaaacagacaaagttcgtgcatgagtgtatcaagactatactgaaactatataagggccaagaattcgccccaaaatctgtggccataattggccactctatggggggattggtagccagggcactgctgaccctgaagaacttcaagcatgacctgattaacttactaattacccaggccacccctcacgtcgcccctgtcatgccattagacagattcatcactgacttctatacgacagtaaataactattggatcctgaacgccaggcatataaacttgacgaccctgtccgtcgccggaggctttagggattatcaggtgcgcagtgggctcaccttcctcccaaaacttagccaccatacaagtgcgctgagtgtcgtgtcaagtgccgtgcctaaaacctgggtgtctactgaccacctctccatcgtctggtgtaagcagctgcagcttaccaccgtgagagcattcttcgatttgattgacgccgacaccaaacagattacacaaaactccaaaaaaaagctctctgtgctctatcaccattttataagacacccttcaaagcattttgaggaaaaccccgctattatcagcgatcttaccggcacctctatgtgggtcttggtcaaggtgtctaagtggacttacgtagcctacaatgaaagcgaaaaaatttatttcacttttcccctggaaaatcataggaagatttacacgcacgtgtactgtcaatccacgatgctagacactaactcctggatatttgcatgcatcaattccacatccatgtgcctgcagggagtggatctctcctggaaggcggagttgctgcccactattaaatacctgactctgagactccaggattaccccagtctctcacacttggtagtctatgtgcccagcgtgaggggatctaagttcgtggtggactgcgagtttttcaaaaaggagaagagatacatccagctgccggtcacacacttgttctcattcggattatcatctaggaaggtcgtgctgaataccaatgggctgtactataatctagagctgctgaactttggccagatctatcaggcattcaagattaatgtggtatccaaatgctccgcggtgaaggaagagatcacttctatttatagactccacataccctggagctacgaggactctctcacaatcgctcaggctccttcctctaccgaaatcagtttgaaattacacatcgcccagcctgagaataacacacatgtcgcactcttcaagatgtacacgtcttcagactgtcggtacgaggtgacagtgaagacttccttctcccagatccttggtcaggtcgtccgctttcacggcggagctctgccggcttatgtcgtctctaacatcctcctggcataccggggtcagctatactcgctcttctctaccggctgttgcctagagtatgccacaatgttggacaaggaggctaagccgtataaagtggatcctttcgtcataattataaaattcttactaggatataagtggtttaaggaactgtgggacgtgctgctcctgccggagcttgacgcagtgattctgacctgccagtctatgtgttttcccttgatctcattgatcttgttcctgttcgggacttgcactgcatactggagcggactgctgtcgagtgcatccgtcagactcctatcctctctttggctggcattgaaaaggccgtccgaattacctaaggacatcaagatgatctccccagacttaccattccttacaatcgtccttatcatagtgagctggaccacttgtggggcactggccatcctcctctcctacctgtattatgtgtttaaagttgtgcatctgcaagcttcgttgacaaccttcaagaactctcaaccagtcaatccgaagcacagccgcagatctgagaagaaaagcaatcaccacaaagattcttcaatccaccatctgcggctgagtgccaacgacgcagaggattccctacggatgcatagcacggtcatcaacttgctgacctggattgtcctcctttcaatgcctagcttaatttactggctaaaaaacctgcgatactacttcaaactgaaccctgatccctgcaagccactagccttcatactcatacccacgatggccattctcgggaatacgtataccgtgtctattaagagtagtaagttactgaaaaccacaagccagtttcccctccccctcgccgtgggtgtcatagccttcggttctgcccatttgtacaggcttccatgcttcgtatttattccactcctgctccacgcactgtgcaatttcatgtag

SEQ ID NO: 235529 - DNA, 915 bp, Artificial Sequence
  Description of Artificial Sequence: Synthetic coding sequence
atggaggtcctggagagcaaaaaaattgagctccctaaaaaactggccaaaaggtatcccgcttacgagctctatctttatggcgagggttcctacgccgaggaacacaaaatcctgccactcaccggtatccccgtcttgttcctcccaggcaacgcaggttcttacaaacaggtgcgcagcattggctcaatcgcccttaggaaggctgaagacatcgactttaaataccactttgactttttctcagtcaatttcaacgaggaactggtggcactgtatgggggttcactccagaaacagacgaagttcgtgcacgagtgcatcaaaaccattctgaaactgtacaaaggtcaggagttcgccccaaagtccgtagccatcattggccactctatgggaggccttgtggctagggcgcttctgacgctgaaaaacttcaagcacgatctgatcaatttactgattacccaagctacaccccacgtggctccagtgatgcccctcgaccgctttatcacagatttctacactacagtgaacaactattggattctcaatgccagacacattaacctgacgacgttatccgttgctggaggattccgggattaccaggtccgttccgggctgaccttccttcctaagctctcacatcacacaagtgccttgtcagtggtgagctctgctgttccaaagacgtgggtgtcgacagaccacctgtcgatcgtctggtgcaagcagctgcagcttacaacagtgagggctttcttcgacttaattgacgctgatacgaaacagataacacagaattcaaagaagaagcttagtgttctgtaccaccattttatcaggcaccccagtaaacattttgaagagaatccagccatcatctctgatctgacagggatctag

SEQ ID NO: 235530 - DNA, 1779 bp, Artificial Sequence
  Description of Artificial Sequence: Synthetic coding sequence
atgttcctgcatagcgtcaacctgtggaatttagcattctacgttttcatggtgttccttgctaccctggggctgtgggatgtgtttttcggcttcgaggagaataaatgctctatgtcatatatgttcgaatatcctgaataccagaaaatcgagctgcccaaaaagctggcgaaaagataccccgcttatgaactttacctttatggcgagggctcttatgctgaggagcataagatcctcccgctgacgggcattccagtcttgttcttaccgggtaacgccggaagctacaagcaggtacggtccatcggaagcatcgccctgcggaaggcggaggatatcgatttcaagtatcatttcgactttttttccgtgaacttcaacgaggaattggtggcactgtacggcggatctctgcaaaagcagaccaaatttgtacatgaatgcatcaaaactattctgaaactctacaaaggccaagaattcgcaccaaagtcagtggcaattatcggccactcaatggggggactggtggctagggccttgctgacacttaagaactttaagcacgacttaatcaatttgctgattacacaggccactccacacgtggcacctgtgatgccactggatcggttcatcactgacttttacactacggtaaacaactattggatactgaacgcacgacacatcaacctgaccaccctctctgtggcgggaggattccgagactaccaggtgcgttccggcctgaccttccttcccaaactgtcccatcacacttcggccttatccgtggtttcatctgcagtcccaaaaacgtgggtttcaactgatcatctttccattgtgtggtgcaaacaactgcagctgacaaccgtcagggcatttttcgacctgatcgacgcagatacaaagcaaatcacccagaattcaaagaagaagttgtcagtgctgtatcaccatttcatccgccatcccagtaaacattttgaggagaacccagcaattatctccgacctgactggaacaagcatgtgggtgctggtcaaagtgagtaagtggacctacgtcgcgtacaacgagtctgaaaaaatttacttcactttcccactggagaaccacaggaagatctatacccatgtgtattgccagtctaccatgctcgacacgaactcatggatctttgcatgcatcaactctacttcaatgtgtctgcaaggggtggatctatcttggaaggcagagctgctccccacaatcaagtacttgacactccgtctgcaggactatccatccctgtcccacctagttgtgtacgttccatccgtccggggtagtaagttcgtcgtggattgtgagtttttcaagaaggaaaaaagatacattcaacttcctgtgactcatctctttagcttcggtctgtcctcacgcaaggtggtcctaaataccaatggcctgtactataatctggagctgctgaattttggccagatctaccaagcctttaagataaatgtggtgtcgaagtgtagcgccgttaaggaggagatcacatctatttacaggcttcacatcccatggagttacgaggacagcctcacgatcgcccaggccccatcttctaccgagataagcctgaagctgcacattgcccagcctgagaacaacacacatgtcgccctgttcaagatgtacacctccagcgattgcaggtacgaggtcactgtcaagacttcttttagtcaaatcttaggccaagtggtagcttag

SEQ ID NO: 235531 - DNA, 1293 bp, Artificial Sequence
  Description of Artificial Sequence: Synthetic coding sequence
atgtttcttcactctgtgaatctgtggaacctggccttctacgtattcatggtctttctcgctaccctgggcttgtgggacgtgttctttggctttgaggagaacaagtgctcaatgagctacatgtttgaataccctgaataccagtctagcgcagtgccgaagacatgggtctcaactgaccatctatctattgtgtggtgtaagcagctgcagttgaccacagtgcgcgctttcttcgacctgattgacgccgacactaagcagatcacgcagaacagtaagaagaagcttagcgtactatatcaccattttattcgccatcccagcaaacacttcgaagaaaatcctgcaattatctcggatctcaccggcaccagtatgtgggtgctcgtaaaggtgtctaagtggacctacgtggcctacaacgaatctgagaagatctatttcacatttcctttagagaaccacaggaaaatttacactcatgtgtattgtcagtctacaatgctggataccaatagctggatttttgcatgtattaacagcacttccatgtgcttacagggggtggacctctcttggaaggcagagctactccctacaattaaatacctcaccctcaggctacaggactacccatctctgtcgcatcttgttgtgtacgttccgagcgttagaggatcaaagttcgtcgtagattgcgagttctttaagaaagagaagcgttacatccagctcccggtcacacatctttttagctttgggttaagcagccggaaagtggtgcttaatacgaacggcctgtactacaatctagagcttcttaattttggacagatttaccaggcttttaagattaacgtagttagcaaatgctcagccgttaaggaggaaatcacctctatataccgattgcatatcccttggtcttatgaggatagtctgaccattgcacaggcaccttcatccacggaaatcagcctcaagctgcacatcgctcagcctgagaacaacacacatgtggctctgtttaaaatgtacacctcaagtgactgccggtacgaagtgacggtgaagacttcgttttcccagatattggggcaggtggtgagattccatggaggcgctcttcctgcttacgtagtctccaacattctactcgcatacagaggacagctgtacagcctgttttctacagggtgttgtctggaatacgccaccatgcttgacaaagaggcaaagccttacaaggtcgatccctttgtcatcattattaaatttttactgtag

SEQ ID NO: 235532 - DNA, 774 bp, Artificial Sequence
  Description of Artificial Sequence: Synthetic coding sequence
atgtcgcgccctctgattactagatctccggcatcccctctaaataatcaaggcattccaacaccagcccagctgacgaaatccaatgccccagttcatatcgatgttggtggacacatgtacacttcatcactggcaacactgacgaaataccccgaatcccgtattgggcgtctgttcgacgggacagaaccaattgtcctggatagcttgaagcaacattacttcatcgaccgcgacggtcagatgtttcgctacatcttaaactttctcaggactagcaagctactcattccggacgacttcaaggactatacccttctgtacgaggaggcaaaatattttcagctgcaacccatgctcctggaaatggagcgatggaaacaggatagagaaacagggcgattcagccggccttgcgagtgcctggtcgttcgggtcgctcctgatcttggggagcgaattactctgagcggggacaaaagtttgatcgaagaagtatttcccgagataggggatgtgatgtgcaactcagtcaacgctggctggaatcacgacagtacccacgtgattcggtttcccctgaacggctactgtcaccttaattctgttcaggtacttgagcgcctgcaacagcggggttttgagatcgtcggatcttgcggtggaggcgtcgattcctctcaattttccgaatacgttctgcgcagagaactgagaaggactccaagagtgccttctgtgattcgcatcaagcaggaaccactggattag

SEQ ID NO: 235533 - DNA, 774 bp, Artificial Sequence
  Description of Artificial Sequence: Synthetic coding sequence
atgtccaggccactgatcactcggtcaccggcatcccctttgaataatcagggaattcccacccctgcacagctgactaagtccaatgccccagtgcatatagacgtgggaggccacatgtacacatcctccctggccactttaacaaagtatcccgaatcccgaatcggaaggttgttcgacggcactgaacccattgtgctggattctctgaaacagcactactttatcgatcgcgatggccagatgttccgctacattctcaacttcctgagaacaagcaagctgcttattcccgatgatttcaaagactacaccctgctttacgaggaggctaagtacttccagctgcagcctatgctcttggagatggagagatggaagcaggacagagaaaccgggcgattcagcagaccgtgtgagtgtctggtggtaagagtggctcccgacctgggcgagcgcattaccttgtctggcgacaaatccctgatcgaggaggtttttccggaaatcggggacgttatgtgtaactccgtcaatgctgggtggaatcatgattcgactcacgtgatcagattccctctcaatggctactgccatctcaatagtgtccaggttcttgagagattacagcagaggggtttcgaaatcgttggctcctgtgggggaggtgtagattcctctcagttttcagagtacgtgttaagaagagaacttaggcggacacctagggtaccttccgttattcgtataaaacaagaaccactggattag

SEQ ID NO: 235534 - DNA, 2598 bp, Artificial Sequence
  Description of Artificial Sequence: Synthetic coding sequence
atggcacgcatgccagggtcgggggactgcaatacctcagcgggtggatctgccagcgcagctgccgcagcggcagaaaacaatggcgagcgtggggagggtgaaagaggtgctggcggtcgcggtagacgacatagccgccctcactactgttccgccggtgaggaagaagaggaggaagaggaagaagatgaaattcaggaggtccagatcacaggggacgaagaagaggaagaggacgggggagggggattggaggaggatgaagaagaagaggaagaggaggagatgggactagactgggatgaacccttggagccagaggactccgccggagaggaactggaaccggagcccgtccacatgattaacatggaccagagcgccgcactggagccagaagctcccccacggctactcgccccacgtgcccgtggaggccctcctggggatgggagtgagttggaccctgacgtgctccagcgcccagaacgagcgagactctctgagaacacaaggctggcgaccagatatgcggtgcgaatatttagagagtatctgtctgaaaaagcccagtcacccgacttcgaaaccatggacaagggagcattgtgccgggtgctgcggtctttttatgctgaagccagatctaagagcgggcagctctacagtaagagttcattgatctctatccggtcctcactgaatcgatatctgaacgaacctccttactgcagaacacttgatctgaccaaggaccccgaactccggagtgccaacctcactttggccgctgtcattcgaaaactggaagagcagggtgccggacccgttgtgcagaaacaggctattacacgcgctgatctgcgcaagttgtacacatcgtcagtgttttccactaacacaccattcgggctactcaacaaggtctggttcgaaacctgtatgtatttttgcacccgcggaagagaaaatcagcgcgagctcgaagaggacagcttcggactcgcaatggacgaagacgggcgaaagttcgtgtatttcaaatcactaggaccctaccataagagtagaagctcctcctggtccaagaagagagccgaatcatccgatgaggagaacctgccccgtatgtacgagaccggtacggagttctgcccatatgcctcctttgtgaagtacctgtcaaaacgtaacccgctgtgcaaggcattctttcagcgaccacgggatcactgttctgagggggacgttacctggtacgagaacaaggcaatcggaaagaacctcttagggacccgcatgcagatgttgtcaaaggctgccaaactgagtaaaacctacactaaccactgtatcggtgcagtctccattgccaccctgaattcaatcgcagggataggcaccaagttgggatctcccgcaccgcaggggtgttatgcagaagcccttaatggtgccgcacgacaccacagtcatcaccccccaacccaccctagccatcaccaccggccacaaccaccctctcttggcaatacctatattttgccaaaggacagtcaagtaggtcctgatgttaaaagtgaagccgcaccgaagagggctctgtatgaatctgttttcggctccggggagatctgtgggcctacctctccaaagaggttgtgtatccgcccatcggaacccgtggacgctgtggtggtggtgagcgttaagcatgaccctttgccactgctgcccgaagctaacgggcaccgttccaccaacagcccaactatcgtgagtcccgctatagtgagcccaacccaggattccagacctaacatgtcccgccctctgatcacacggagcccagcatctcccttgaacaaccaaggtattcccaccccagcgcagctgaccaaaagcaacgctccagtacatatcgatgtgggcggtcatatgtatactagcagtctggccaccctcaccaaataccccgaatcaagaatcggacgcttgttcgatgggacagagccaatcgttctggacagcctcaaacaacattactttattgatcgggatgggcagatgttccgctacatcctgaactttctgagaacttccaaactcctgatccctgatgactttaaggattatactctgttatatgaagaggccaagtattttcaactgcagcccatgctgcttgagatggaaagatggaagcaggacagagaaacaggacgttttagccggccttgcgaatgcctggttgtacgggttgctccggaccttggggaaagaatcaccctctccggagataagtctctaatcgaggaggtattccccgagatcggagacgtgatgtgcaattcagtgaatgccggttggaaccacgactccacccacgtcattcgcttccctttaaacggatattgccacctcaattctgttcaagtactggagagattgcagcagaggggtttcgagatcgttggttcctgtggtggtggcgtcgattccagtcagttctccgagtatgttctgcgccgtgagctgagacgtacaccccgagtgccttctgtgatccggattaaacaagaaccactcgattag

SEQ ID NO: 235535 - DNA, 774 bp, Artificial Sequence
  Description of Artificial Sequence: Synthetic coding sequence
atgtctcggcctctgatcaccagaagccccgcatcaccgttgaataaccaaggcatacccactcccgcacagctgacaaaatccaatgcacctgttcatatagatgtgggaggacacatgtacacatccagccttgccactttgaccaagtatcccgaaagccgcatcggaagactattcgatggaacagagcccatcgtgcttgatagtttaaagcaacactactttatagatagagatgggcagatgttcagatatatcctaaactttctgcggacctctaaattactcatccctgatgacttcaaagattataccttactctatgaggaggcaaagtacttccaacttcaacctatgttgcttgaaatggagcgatggaaacaggatagagagacaggacgtttttcaaggccctgtgagtgcctggtcgttcgggtagcccctgacctgggagagcggatcactttatctggagataagtcactgatcgaggaggtgttccccgagataggggacgtcatgtgtaattctgtaaacgccggttggaaccacgattcaacccatgtcatcagattcccattgaatggctattgccacctaaactccgttcaggtcctggagcggctgcaacagaggggcttcgagattgtcgggagctgtggagggggagtggactccagtcagtttagtgaatatgtcctgcggcgagaactcagaagaacaccacgcgtgccttcagtgataaggataaagcaggaacccctggactag

SEQ ID NO: 235536 - DNA, 1044 bp, Artificial Sequence
  Description of Artificial Sequence: Synthetic coding sequence
atgcgcgttgtggtcatcggtgccggtgtaatcggccttagcactgccctctgtatccacgagcggtatcattccgtgttgcagccactcgacatcaaagtttacgcagaccgattcacccctctgactactactgacgttgccgcaggactgtggcaaccgtacctgagtgaccctaataaccctcaggaggcagattggtcccagcagaccttcgattacctgctcagtcacgtgcactcacctaatgcggagaacttgggcctgttcctaatatctgggtacaatttgttccacgaggccatcccggatcccagctggaaggataccgtgctcgggtttaggaaactgacccccagggagttagacatgttccccgactatggatatggctggttccacacttctctgatactggaaggaaaaaattacttgcagtggttgacagagaggctgactgaacggggagtgaaattttttcagagaaaagtggaaagctttgaggaggtagccagggagggcgcagatgtgatcgtgaactgcactggtgtgtgggccggagcactgcaacgcgatcctctccttcaacctggtcgtggccagattatgaaggtggatgcaccctggatgaagcactttatcctaacgcatgatcctgaaagaggcatttacaattctccttatatcatcccaggtacgcagacggtcacgctaggcggaatctttcaattgggaaattggtctgagctgaacaatatacaagaccacaatacaatctgggagggctgctgtagattggaacctactctcaagaatgctcggataattggcgagaggacaggcttccggccagttcgacctcaaattaggctagagcgggagcagttaagaaccggtcctagcaacactgaagttatccataattacggtcacggcggatacggattgactattcactgggggtgtgctctggaagctgctaaactattcggcaggatcctggaagaaaagaaactaagcaggatgccccctagccatctgtag

SEQ ID NO: 235537 - DNA, 399 bp, Artificial Sequence
  Description of Artificial Sequence: Synthetic coding sequence
atgcttaaaaacatcgagctgtttgataaactgtctctccgcttcaacggccgagttctgttcataaaggacgtgataggggatgagatctgctgttggagcttttatggacagggaaggaaaattgcagaagtttgctgcacgtcaattgtctacgcaacggagaagaagcagacgaaagtagaattccctgaggctagaatctatgaggaaaccctgaacatcctcttgtacgaggcccaagatggcagagggcctgataatgcccttctggaagccacaggcggtgccgctggacgttcccaccaccttgacgaagacgaagaaagggaaaggatcgagcgggtgcgacggatccacattaaacggccagacgaccgcgctcatctccaccagtag

SEQ ID NO: 235538 - DNA, 840 bp, Artificial Sequence
  Description of Artificial Sequence: Synthetic coding sequence
tgaagatactgtagatctcccttctggagcggctacgggaatttttactccctccagaaatctgggttcttacctaccctgggaacagtacaacccttcaactactgtaagtcaggatggattctgatagaccggtgtgggaagcacttcggcacaatcttaaactatctaagagacggggctgtgccgttgcctgaatcccggagggaaattgaagagctgctggcagaagctaagtactatttggttcaaggacttgtcgaggaatgtcaggcagcactgcaaaacaaggatacctacgagcccttctgcaaggttccggtgatcacttccagcaaagaagagcagaaattaatcgcaaccagcaataagcccgcagtgaagcttctgtacaatcgatccaataacaaatacagctacacctccaatagtgatgacaatatgctgaagaatatcgaactgttcgacaaactgtctttaagattcaatggtcgggtactcttcatcaaagacgtgatcggtgatgaaatttgttgttggtccttctatggccagggcaggaagatcgccgaagtatgctgtacaagtatagtgtacgcaactgaaaaaaaacagacgaaggtggaattcccggaggctagaatctacgaagagaccttgaacattctgctctacgaagcccaagatggccgagggccagataacgcactgctggaggcaaccggtggcgcagccggaaggagccatcatctcgatgaagatgaggagcgggagagaatcgagcgagtaaggcggatccacatcaagagacccgacgatcgagcccatcttcatcagtag

SEQ ID NO: 235539 - DNA, 864 bp, Artificial Sequence
  Description of Artificial Sequence: Synthetic coding sequence
atgtcaggagagagcgttgtctcttctgcggttcctgctgccgcaacaaggaccacatcgttcaaaggtaccagcccaagcagcaaatacgtgaagctgaacgtgggtggggcactgtattacaccaccatgcaaacccttactaaacaggacactatgctcaaggcgatgttcagtggcagaatggaagtgcttactgactcggaagggtggattttaatagatcgctgcggcaaacattttggaactatcctcaattatttaagggatggggcagtgccattgccagagtctcgaagggaaattgaagagctactggccgaagccaagtattacctggtgcaggggctcgtcgaggagtgccaggccgcactgcagaacaaagatacgtacgagccattttgcaaggtcccggtcatcacctcttctaaagaggagcagaagttgatcgctacctccaacaaacccgctgtgaaactcctttataaccggtcgaacaacaagtactcgtacaccagggttctgtttatcaaagatgtaatcggcgacgaaatctgttgttggtctttctacgggcagggacggaagattgcggaggtgtgctgtacaagtatagtatatgctacagagaagaagcagacaaaggtggagttccctgaagccaggatttacgaggagactttaaatattctcctttatgaagcccaggacggcagaggacccgacaacgctctgctggaggcaactgggggagctgctgggaggtcccatcacctggacgaggacgaggaacgggagcggatagagagggttcgtcgtatccacataaaaaggccagacgatagagctcacctgcaccaatag

SEQ ID NO: 235540 - DNA, 468 bp, Artificial Sequence
  Description of Artificial Sequence: Synthetic coding sequence
atgatggccgtattcacaagcctgtggagcccttaccagatgctcttttgcagcaattctgatgataatatgcttaagaatatcgaactgtttgacaagctctccttgaggttcaacgggagggttctttttatcaaagatgtgattggagatgaaatttgttgttggtctttctacggacagggcaggaaaattgccgaagtctgttgcaccagcatcgtctacgccacagaaaagaagcagacaaaggtggagttccccgaggctagaatttacgaagaaacacttaatatcttgctttatgaggcccaagatggccgagggcctgacaatgctttgctcgaggcgactggcggtgcagctggcaggtcccaccacctcgacgaagatgaagagagggagaggattgaacgagtgcgtagaattcacatcaagagaccagatgaccgagcccacttgcaccagtag

SEQ ID NO: 235541 - DNA, 990 bp, Artificial Sequence
  Description of Artificial Sequence: Synthetic coding sequence
atgtctgccgaggcatcagggccagcagctgctgcagccccttccctggaggctcccaagcctagtggtctggagcctggacctgccgcatatggtctgaagccattaacaccgaacagtaagtatgtgaagctcaacgttggaggcagtttacattacactacactcaggactctaaccggacaggacacaatgctgaaggcaatgtttagcggtcgcgttgaggtcctgactgacgcaggaggctgggtcctgatcgaccggagcggccgacactttggtacaatccttaactatcttcgggacggcagtgtgcctctgcccgaaagcactagagaactgggtgagttgctgggcgaggcccgttactatttagtccagggactgattgaagattgccagttggctctccaacagaagcgcgagaccttgtcaccactgtgtctgattcccatggttacaagtccaagggaggagcagcaactgttagcatccacctccaaacctgtagttaagctgctacataatcgctctaacaacaagtattcttacactagcacttccgacgacaacctactaaaaaacatcgagctttttgataagttagcgttgagatttcatgggagactactgtttctaaaggatgtgctcggtgacgagatctgttgttggtccttttacggccaagggaggaagatcgccgaggtgtgctgtacctctatcgtctatgcgactgagaagaagcaaacaaaggtagagttccccgaagcgcgtatctttgaagaaactcttaatatccttatatatgagacacctagaggccctgacccagcccttcttgaagcaacaggaggagcagcgggagctggtggagccggtcgtggggaagatgaggagaatcgagagcacagggtgcgcaggattcacgttagacggcacatcacacacgacgagcggcctcacggacagcagatcgtcttcaaggactag

SEQ ID NO: 235542 - DNA, 990 bp, Artificial Sequence
  Description of Artificial Sequence: Synthetic coding sequence
atgagcgccgaggcttccggacccgctgccgctgctgcaccaagcctggaggcacccaaaccatccggccttgaacccggaccagctgcttacgggctgaagcccttgacaccgaattccaaatacgttaagttgaacgtggggggatctcttcattacaccacactgagaaccttgaccggccaggataccatgttgaaagccatgttctcgggacgtgtcgaagtgctcacagatgcgggagggtgggtactcatcgatcggagcggccgacacttcggcactattctgaattatctccgtgatggtagcgtgccgctgcctgagagcactcgcgagctgggcgaactactgggtgaggccagatattatctggtacaggggctgatcgaagactgccagctggcactccagcagaagcgggaaacattaagtccactgtgtttgattccaatggttactagccctcgggaagaacaacagttacttgccagcacaagcaaaccagtggtcaagctcttacataatcgctctaacaataagtactcctataccagtacatcagatgacaatctgttgaagaatatcgagctcttcgataagttggcattgaggttccatgggcgactgctctttttgaaagatgtcctgggagacgaaatttgctgctggtctttttacggccaggggaggaaaatcgctgaagtgtgctgcacatcaatcgtgtacgcaaccgagaaaaagcaaacaaaggttgagttccctgaggccaggatcttcgaagagaccttgaacatcctgatctacgaaacacccagaggtcctgatcccgcactactggaagcaaccggcggagctgctggcgcagggggtgccggaagaggtgaggatgaggagaatcgggagcaccgcgtccgcagaatacatgtccgtcgccacattacgcacgacgagcgcccacacggacagcagatagtgtttaaggactag

SEQ ID NO: 235543 - DNA, 1287 bp, Artificial Sequence
  Description of Artificial Sequence: Synthetic coding sequence
atggcactcagtggaaactgcagccgatactacccccgagagcaagggagcgcggtcccaaacagctttccagaggtcgtagaattgaacgtggggggtcaggtctacttcacccggcactcaacacttatttctattccgcactccttgctctggaagatgtttagccccaagcgagacaccgccaatgatttggccaaagatagcaaaggtagattcttcatagatcgagatggttttcttttcagatatatcttggactacctgcgcgacaggcaagtggtgctccccgaccatttcccagagaaaggaaggctgaagcgagaagctgaatacttccaactgccagacctggtcaaactgcttacacccgacgaaataaagcaaagtcccgatgagttctgccattcagatttcgaggatgccagccagggaagtgatacgagaatttgtccgccaagttctctgttacctgctgaccgcaagtggggctttatcactgttggctacagaggtagttgcacactgggaagggaaggacaggctgacgccaagttcagacgggtgcctcggatcctagtctgtggacggatttctctggctaaagaagtattcggcgaaacacttaatgagtccagagatcctgatcgggcacccgagaggtacacaagtaggttttacctaaaattcaaacaccttgagagagctttcgatatgctctctgagtgtgggtttcacatggtggcgtgcaactctagtgtgaccgccagttttataaatcagtacactgacgataagatctggagttcttatacagagtacgtgttctatagagagcccagccgctggtcacctagccattgtgactgctgctgcaaaaatggcaagggggataaagagggagaaagcggaaccagctgtaatgatctatcaaccagttcttgcgactcccaatcagaggcaagttccccccaggagaccgtcatttgtggaccagtcacgaggcagacaaatatccagacattggaccgaccaatcaagaaaggcccagtgcaattgatacaacagtcagaaatgagacgcaagtccgacttgctgaggaccttgaccagcggttcccgggagtctaacatgtcatcaaagaagaaagccgtcaaggaaaagctctctattgaggaggagttggaaaagtgcattcaggactttctaaagattaaaatcccagacagatttcccgagaggaaacacccttggcagagtgagctcctgagaaaatatcacctctag

SEQ ID NO: 235544 - DNA, 1287 bp, Artificial Sequence
  Description of Artificial Sequence: Synthetic coding sequence
atggccctctccggaaactgcagccgttactaccccagggagcagggttcagctgttcccaacagcttccccgaggtcgtggaattgaatgtaggcggacaggtttacttcacacgtcacagtactttgatatcaattcctcacagtcttctctggaaaatgttttcccctaaacgggacacggcaaatgacttagctaaggattctaaaggcaggtttttcattgacagagacgggtttctgttccgttatatcttggattaccttagggaccgacaggtggtcctccctgaccactttcctgagaaggggaggctaaaaagagaagccgagtactttcagctcccagatctggtgaagctgcttactcccgacgaaatcaaacagtccccagacgagttttgtcactccgacttcgaagatgcatcgcaggggagcgacacccggatttgcccgcctagtagcttgctgcctgccgatcgaaagtggggatttatcaccgtggggtacaggggctcatgcaccctgggaagagagggccaagccgatgcgaaatttcgtagggtgccccgaatcctggtgtgcgggaggatttccctcgccaaagaagtgtttggagaaacacttaatgagagccgagaccctgaccgagcccctgaaaggtacacatcccgcttttatttaaagttcaagcacctcgagcgagccttcgacatgctttctgagtgcgggtttcacatggttgcgtgtaacagctccgtgaccgcttcgttcattaaccagtatacagacgacaaaatttggtctagttatactgaatatgtgttctaccgcgaacccagtcgatggtccccttctcactgtgattgttgctgtaagaacgggaaaggagataaggaaggcgaatctggcacttcttgcaacgatctatcaacttcctcttgtgactcacagtctgaagcgtcctctccccaagaaacagtgatttgcggccctgtaactcgccagactaatatccagactctcgatcgccctattaagaaaggacctgtccaactcatccagcagagtgaaatgagaaggaagagtgatctgttgcgaactttaacaagcggctcccgagagagcaatatgagctcaaaaaaaaaggctgtcaaggaaaaattgtccatcgaggaggaactggaaaagtgcattcaagatttcctgaaaattaagatccccgaccgctttcccgaacggaagcatccctggcagtctgaacttttgcgcaagtatcacttgtag

SEQ ID NO: 235545 - DNA, 792 bp, Artificial Sequence
  Description of Artificial Sequence: Synthetic coding sequence
atggccgagttgcagttggaccccgctatggcaggtctcggaggtggaggcggatcaggtgtgggcgatggaggcggtcccgtcagaggcccaccaagtcctagacccgcagggccaactcccaggggccatggtaggcccgcagctgccgttgcccagccactggagccaggcccaggcccacccgagcgggctggtggcggaggtgccgctagatgggtcagactgaatgtgggcggtacatactttgtcaccacaaggcagaccctgggcagagagccgaaatctttcctgtgtcgactatgctgtcaggaagatccagagctggactccgataaggatgagaccggcgcttacttgatcgatagagatccgacttactttgggccaatcctgaattatctcagacacggaaaactaatcataacaaaggaactggccgaggagggagtgctggaggaagccgagttttacaacatcgcgtccctcgtgcgcctggtgaaagaacgaatccgggacaacgagaatcgtaccagccagggacccgtgaagcatgtttatagagtgctgcagtgtcaggaagaagagctgacccagatggtgtctaccatgtccgatggatggaagttcgagcagcttatcagcatagggtcttcttataattacggcaatgaagaccaggcagagtttctgtgcgttgttagccgggagttgaacaatagtactaacggcatcgtgatcgaaccctctgaaaaggctaagattctgcaagagaggggctcgagaatgtag

SEQ ID NO: 235546 - DNA, 738 bp, Artificial Sequence
  Description of Artificial Sequence: Synthetic coding sequence
tcactaccaaggaacggtccagccagattaagggctgggagctccgggggaggtggcggaccacggtggcgcaactgctcttggaccagacgatggcggggttgggagggcgctcccggtcctggaccacctgaacgcgctgggggaggaggggcagccaggtgggttcggcttaacgtgggcggtacttactttgtcaccacaagacagacccttggcagagagcctaaaagcttcctgtgtcgactgtgttgccaggaagaccctgagctcgacagcgataaggacgagacaggtgcctacctgatagaccgtgatcctacttactttgggcctattctgaattaccttcggcatggcaaactcataatcactaaggaacttgccgaagagggcgtgttagaagaagccgaattttacaatatcgcttctcttgtgcggctcgtaaaggagcgcatccgggataatgagaaccgtactagccagggacctgtgaagcatgtgtacagagtactgcagtgtcaggaggaagaacttactcagatggtttccaccatgagcgacggctggaaattcgaacagctgatatctatcggtagctcttacaactacggaaatgaagaccaggccgagtttctgtgcgtggtgagtagagaactgaacaactctactaacggtatcgtgatcgagccctccgagaaggcgaagattctgcaagagcgcggatcccgaatgtag

SEQ ID NO: 235547 - DNA, 2448 bp, Artificial Sequence
  Description of Artificial Sequence: Synthetic coding sequence
atggccggtggacattgcggctcatttcctgccgctgccgctgggtccggagagatcgtccagctgaacgtggggggaaccagattttccacctccagacagaccttaatgtggattccggacagctttttcagtagcctgttgtccggcaggatttctactttgagagatgaaaccggtgctatttttattgatcgggatcccgcagcatttgctcccattcttaatttcttgcggaccaaggagctggatctgcgtggagtctccatcaacgtgcttcgccacgaagccgaattttatgggatcacaccactcgtgcggaggctgcttctgtgcgaagaattggagcgctcctcatgtgggagcgtgctttttcatggctatctcccccctccagggatccctagccggaaaatcaataatacagtgagatcagccgattcacgaaacgggcttaactccacagagggggaagccagaggaaacgggacccagcctgttttgagcggcactggggaagaaacagtgagattagggtttcctgtggatcccagaaaggtgttaattgttgcaggtcatcataactggatcgtggctgcgtacgctcatttcgccgtttgttatagaattaaagagagttcaggttggcaacaagtgtttacctctccttatttagactggacaattgaaagggtcgcccttaacgctaaggtggttggcggtccccacggtgataaggacaagatggtagccgtcgcttctgagtctagcatcatattgtggtccgtccaagacggcggatctggctccgagataggtgtgttctcactcggggttcctgtggacgctctgttcttcattgggaaccagctggtcgccacctcccatacagggaaagtgggggtctggaatgctgtgacacaacattggcaggtccaagatgtcgtgcccataacgtcgtatgatacagccggttcatttctgttgctgggttgcaataatgggtcaatctattacattgatatgcaaaaattcccactacggatgaaggacaacgatttattggtgacagaactgtatcacgatccatccaatgacgccatcacggccttgtcggtgtatcttactccgaagacttctgtaagcggaaactggatcgaaatagcctatggcacctcatctggggcagtgcgggttatcgttcagcaccctgaaaccgtgggcagcgggccacagttattccagacttttactgtccaccgcagtcctgtgactaaaattatgttgagcgagaagcacctggtgagcgtgtgtgctgataacaatcacgtgcgtacctggaccgtaacacggttccggggaatgatcagcacacagcctggaagcacccctctcgcctcatttaagatcttgtccctcgaggagactgagagccacgggagctactcctctggaaacgacatcggaccattcggagaacgcgacgaccaacaagtgttcatacagaaggtcgtgcctattacaaataaactgttcgttaggctgtcctctactggaaagcggatctgtgaaatccaggctgtagactgtaccacaataagcagtttcaccgtcagggaatgcgaagggtcttcgcggatgggaagccgccctaggcgctacctgttcacgggccacaccaatggtagcattcagatgtgggacctgaccacagcgatggatatggtcaataaaagcgaagacaaagatgtgggcggtcccacggaggaggagttgctcaagttgctggatcagtgcgacttaagtacctcccgatgtgcaactcccaacatatcccccgctaccagcgtggttcagcactcccacctgagggaaagcaattctagccttcagttgcaacaccatgacactactcatgaagccgctacctacggctctatgaggccatacagggaatctcccctgttggcacgcgcaagacgtaccgaatcattccactcgtacagagatttccaaacaatcaatctgaacagaaacgtggagagggctgtgcccgagaacggtaacctgggaccaattcaggccgaagtcaagggagccacgggcgagtgtaacatatcagaacgcaagtcccctggtgttgagatcaagagcttgcgcgaactggactcagggcttgaagtacataagatcgctgaaggcttcagcgaatcaaaaaagaggagtagcgaagacgaaaatgagaacaagatagaattccgaaagaaggggggattcgaagggggtggtttcttaggtcgaaagaaagtgccctacctggcttcttcaccgtcaactagtgacggtggaactgactccccagggacggcgagtccatcccctacaaagacaacaccatcaccaagacacaagaagagtgatagcagcggacaggagtattctctgtag

SEQ ID NO: 235548 - DNA, 723 bp, Artificial Sequence
  Description of Artificial Sequence: Synthetic coding sequence
atggccggagggcactgtggaagttttcctgccgcagctgccggatccggagagatcgtacagttgaatgttggcggaaccaggttcagcacaagcaggcaaactcttatgtggatcccagattctttcttcagcagccttttgagtggcagaatttccactctcagagatgaaaccggggcaattttcattgaccgggaccctgccgcattcgccccaattctgaactttctgaggaccaaagagctagatctacggggagtgagtattaatgtgctgagacacgaagccgaattctacggcatcacgcccctggtgcgccgactgctgctgtgtgaggaactcgaaaggagctcttgcgggagcgtgctcttccacggatatctgccacctcccggaattccatctagaaagattaataacacagtgcgatccgctgattcacgcaacggtttgaacagcactgagggtgaggcgaggggtaatggcacacagccagtgctgagcggcacgggggaggaaacagttcgcctggggtttcctgtggatcctaggaaggtgctcatagtggcaggtcatcacaattggattgtggctgcgtatgcccacttcgctgtctgctatcgggtcttctggctgggcaccgtgggtcacgcatgtaaccccagtaccctaggcggaagggatggatggtctagccgtagcgcgagaccgacgtggtag

SEQ ID NO: 235549 - DNA, 567 bp, Artificial Sequence
  Description of Artificial Sequence: Synthetic coding sequence
atgaaggacaacgatctgttggtgactgagctataccatgatccttccaacgatgctattaccgctctcagcgtgtatctcactccaaagacctctgtttcaggtaattggatcgaaatcgcttatggcactagttccggtgccgtcagagtgatcgtccagcatcccgagactgtcgggtcaggaccacaactcttccagacgttcacagtccataggtctccagttaccaagatcatgctttccgagaaacatctcgttagtgtgtgcgccgataataaccacgtgcgaacttggacagtaacacgatttcgcggaatgatcagcacacagcctggaagcacgcccttggccagctttaagattctttctctcgaggagactgagtctcatggcagttatagcagcgggaacgacattggacccttcggggagcgcgacgaccagcaggtgtttatccagaaagtagtgcctatcactaataagctattcgtgcgattgtctagcaccggcaaatctctgtgtggcgtttcccttgtctctcggtcttcccaggagcccacgtag

SEQ ID NO: 235550 - DNA, 642 bp, Artificial Sequence
  Description of Artificial Sequence: Synthetic coding sequence
taattctctacaagccgtcaaacgttaatgtggataccagactcctttttttcatcactgttgagcggcagaatctccaccctgcgtgacgaaacgggtgcgattttcattgatcgcgaccccgcagcctttgcacccatcttaaacttcttgaggaccaaagagttggacctgcggggagtttccattaacgtccttagacacgaggccgagttttatgggattaccccactggtgcgacgccttctactgtgtgaggaactggagcggtccagctgtggctccgtcctgtttcacggctatttgccccctccagggatccccagccgcaagataaacaatactgtgagatcggccgactctcggaatggactgaacagtacagagggtgaagcgaggggcaatggcactcaacccgtgctctcaggaactggcgaggaaactgttcggttaggattccctgttgacccaagaaaggttctgatcgtggccggacaccacaattggatagtggcagcttatgctcactttgctgtctgctatagagtgttctggcttggaacagtcggccacgcctgtaatcccagcaccctaggtggaagagatggttggtcctcacggagcgccaggccaacatggtag

SEQ ID NO: 235551 - DNA, 507 bp, Artificial Sequence
  Description of Artificial Sequence: Synthetic coding sequence
taggcactgtcggtgtatctgacccctaagactagcgtgtccgggaattggatcgagatagcttatggcacctcttccggtgccgtgagagtgattgttcagcacccagagactgtcggtagcggtccacagctcttccaaacattcacagtccaccgcagccccgtaaccaagatcatgctgtccgagaaacacctcgttagcgtttgcgccgataacaatcatgtacggacatggaccgtgacaagattcaggggtatgatctcaacccagccaggttctactcccctcgcttctttcaaaattctaagcctggaggagaccgagagccatggaagctactccagtggcaatgatattggaccatttggagagcgggacgaccagcaggtcttcatccagaaggtggtgcctatcactaataaactgttcgtgcggctgtcatctaccggtaagagtctgtgcggggtgagtctggtgagcagaagctcacaggaacccacctag

SEQ ID NO: 235552 - DNA, 870 bp, Artificial Sequence
  Description of Artificial Sequence: Synthetic coding sequence
atggtggtggtgaccggccgagaacccgatagccgacggcaagatggcgcaatgagtagtagcgacgccgaggacgattttctagagccagcgacaccgactgctacacaggcgggacacgctctccctctccttccgcaggagttccccgaggtggtgcctctgaatataggcggagcacactttacaacccgccttagtactctccgctgttatgaagatactatgctggcagcgatgttttcaggtcgccattacattccaactgattcagaagggaggtacttcatagatagagacggaactcactttggagatgtcctgaatttcctccgtagcggcgatctccccccacgcgagcgcgttcgcgctgtctataaagaggcacagtattatgctattgggccactcctggaacaacttgaaaacatgcaaccattaaaaggagaaaaggtccggcaggcattcctgggtctgatgccatactataaggatcatcttgagcgcatagtggagatcgcacgactgagagccgtacagcgcaaagcaaggttcgccaaactaaaagtgtgtgtgtttaaggaggaaatgcccataaccccctacgaatgcccactgcttaacagcctgcggttcgagcggtcggaatctgatggtcagctattcgagcatcactgcgaggtagacgtaagtttcggaccttgggaggcggttgcggacgtttatgatctgcttcactgcctggtgaccgacctatcagcacagggactgactgtcgatcaccagtgcatcggggtgtgcgacaagcatttggtaaaccattactactgtaaacggccaatatacgaattcaaaattacttggtggtag

SEQ ID NO: 235553 - DNA, 1728 bp, Artificial Sequence
  Description of Artificial Sequence: Synthetic coding sequence
gtcagcaggaaaaagatgagcctcaaatcagaacggagaggaatccatgttgaccagagtgacctgctttgcaagaaggggtgcggctactatggtaaccccgcttggcagggattctgctccaagtgttggcgggaggagtatcacaaggcgagacagaaacagatccaagaagattgggagctggcagaaagagtcctactgtgttacccgggatggtctgccatggtccagttccagctgaccgctacatcggcctcgtgggcacaggtaatcctgctgctgcagccacccaatgtgctcggccttcaagccctgcagcgagaggaggaagaggccttcgcttcctcccaatccagtcaaggggctcagtcactgaccttctctaagtttgaggaaaagaaaaccaacgagaaaacgagaaaggtcacaactgtaaagaagttttttagtgcctcctcacgagtgggcagcaaaaaggagatccaggaggcaaaagctccctctccatcgattaaccggcaaactagcatcgagaccgatcgcgtgtccaaggagtttatcgaattcctgaagacattccacaagacaggccaggagatctataagcagactaaactgttcctagagggtatgcactacaagagagatctttccatagaagaacagtctgaatgcgcacaggatttctaccacaacgtcgctgagcgcatgcaaacaagaggtaaggaaagacgattccatcacgtcgggcaggcaggtcttgaactcctcaccagtggcgatcctcccgcaagcgccagccagtctgcaggaaacacaggcgttgagcccccacatcccgcagttccgcctgaacgggtggagaaaataatggatcagatcgaaaagtatataatgacacggttatacaagtacgtcttttgcccggagaccacagatgatgaaaagaaggacctggctatacagaaaaggatccgagcgctccgctgggtcactccgcagatgctgtgtgtaccggtgaacgaagacatccctgaggttagtgacatggtcgtgaaagcaatcacagatatcatcgaaatggacagtaagcgagtcccaagagataagctggcgtgtataactaaatgctctaagcacatattcaatgccattaagattactaagaatgaaccagctagcgcagacgattttttacctactttgatttacatcgtgctgaaggggaacccgcctaggcttcaaagtaacatccaatacatcacgcgcttttgtaatccaagtaggctgatgaccggggaggatggttactattttacaaacctgtgctgcgctgtggccttcatcgagaaactggacgctcagtctttgaacctgtcacaagaggacttcgaccgctatatgagcgggcaaacctcacccaggaagcaggaggcagaatcctggagtcccgacgcatgccttggcgtgaagcaaatgtacaagaacctggatctgctgagtcagctgaatgaacgacaggagcggattatgaacgaagctaaaaagctggagaaagacttaatcgactggactgacggcattgccagggaggtgcaagatattgtagagaagtacccactggaaatcaaacctccgaatcagcccctcgccgctatcgacagtgaaaacgtggaaaatgataaactgccaccacccctgcagccccaggtgtatgcgggttag

SEQ ID NO: 235554 - DNA, 1596 bp, Artificial Sequence
  Description of Artificial Sequence: Synthetic coding sequence
atgtcactgaaaagtgagaggcgaggaatacatgtagatcagagtgatctactctgcaagaagggttgtggatactacggcaatccagcttggcaagggttctgttcgaaatgctggcgcgaagagtaccataaagctcgacagaaacagatccaggaagactgggagctggctgaaagggtactcctgtgttacccgggatggagtgctatggtacagttccaactaacggccacgtctgcgagttgggcacaagttatccttctgctacagcccccaaacgtactgggcctgcaggccctccagcgtgaggaggaagaggctttcgcaagctcccaatccagtcagggcgctcagagcctgacgtttagtaagttcgaagaaaagaagaccaacgagaagacaaggaaagttacaaccgtgaaaaaatttttcagcgcctcatcccgagtcgggagcaagaaggaaatccaagaggctaaagcgcctagcccttcgattaaccgccagacttctattgagaccgacagggttagtaaggagttcattgagtttctgaaaacatttcataagacgggacaggagatctacaagcagaccaaattgttcctggagggcatgcactacaagagggatctatcaatcgaagaacagagtgagtgtgcccaagacttctaccataatgtagccgaaaggatgcagacacggggaaaagtccctccagaaagggttgaaaaaatcatggaccaaatcgaaaagtacattatgacaaggctttacaaatatgtgttctgccccgaaactacagacgatgagaaaaaagatcttgccattcagaaaagaattcgcgctttaaggtgggttactccccaaatgctttgcgtccccgtcaatgaggacattcctgaggtgtccgacatggtggtgaaggctatcactgacattatagagatggactcgaaaagggttccccgagacaagctggcctgcattactaagtgctcgaaacatatctttaatgcaatcaagatcaccaagaatgagcccgcttcagctgatgacttcctaccaaccctgatctacatcgtgctgaagggcaatccccctagactgcagtccaatatccagtacatcacgcggttctgtaatccctctcggttgatgaccggggaggatggttattatttcacaaatttatgttgcgctgtcgcatttatagagaaactcgatgcgcagagccttaacctgtcccaagaggacttcgacagatatatgtcaggccaaacatcccctcgaaagcaagaggccgaaagttggtctccagacgcatgtttaggcgtgaaacaaatgtacaaaaacctggatctcttgtcccagttgaacgaacggcaagagcgcatcatgaatgaggcaaaaaagctggagaaagatctcattgattggaccgacggaattgccagagaagtgcaggatatcgtggagaagtacccactggaaataaaaccccctaaccaacctctggccgctatcgattccgagaacgtggagaatgacaaactgcccccaccactccagccacaggtttacgctgggtag

SEQ ID NO: 235555 - DNA, 1476 bp, Artificial Sequence
  Description of Artificial Sequence: Synthetic coding sequence
atgagtttaaagtctgagcgccgaggaattcacgtggatcagagcgatctcctgtgtaaaaagggctgcggatactatggtaatccagcatggcaaggcttttgtagcaagtgctggagagaggagtatcataaggccaggcagaagcaaattcaggaggactgggagcttgcggaacgacttcagagagaagaagaggaagccttcgccagctctcaatcttcccaaggagctcagtcattgaccttcagcaaattcgaggaaaaaaagactaatgaaaagacgagaaaggtgaccaccgtgaagaaatttttttccgcatcttcaagggtaggcagtaagaaagaaatacaggaagccaaagcgccatccccttcaatcaaccggcagactagcatcgagaccgacagagtatccaaggagtttattgagtttcttaagactttccataaaacaggacaggagatatacaagcagactaagctgttcctggagggcatgcactataagagagacctctccatcgaagagcagagtgaatgcgcccaggatttctaccataacgtggccgaaagaatgcaaacccgcggtaaggtaccacccgagcgcgtggaaaagattatggatcagattgagaaatacatcatgacacggctctacaagtatgtcttttgccctgagacaacagacgacgagaagaaagacctggccatacagaaacggattcgagcactgaggtgggtcacaccccagatgctctgtgtgcctgtgaatgaagacattcctgaggtatctgacatggtggtaaaagccataaccgacattatcgagatggacagcaagcgggtgcccagggataagttggcttgcattacaaagtgctcgaaacatatctttaacgccattaaaatcaccaagaacgaaccagcttctgctgacgatttccttcctactctgatttacatcgtcctgaagggaaatccacccaggctccaatccaatatccagtatattaccaggttttgtaacccaagccgcttgatgacaggggaggacggctattattttaccaatctgtgctgtgccgtggcatttatcgagaaactggacgcccaatccctgaatttgagtcaggaagatttcgatcgctatatgagcggacaaacaagtccccgaaaacaggaggctgagagctggagccccgacgcctgtcttggggtcaaacagatgtacaaaaacttagatctcctgtcacagctaaacgagaggcaggagaggattatgaatgaagctaaaaagctcgagaaagatctcatcgactggaccgacggtatcgctagggaagtccaggacatcgtcgagaagtatccgcttgaaatcaaaccacccaatcagcctctggcagccatcgactccgagaatgtcgaaaacgataaattgcctccgccacttcagccacaggtatacgccggatag

SEQ ID NO: 235556 - DNA, 1476 bp, Artificial Sequence
  Description of Artificial Sequence: Synthetic coding sequence
atgagtctgaagtctgaaagaagaggaatccacgttgaccagtctgacctgttatgtaaaaagggctgtggctattatggcaatcctgcctggcagggcttttgctccaaatgttggagagaggagtatcacaaagcacgccaaaagcagatccaggaggactgggaattggccgagaggttgcagagagaagaggaggaagctttcgcctcctcccagagtagccagggagcccagagcttaacttttagcaaattcgaggagaaaaaaaccaatgagaagacacgaaaggttacaaccgtcaagaagtttttcagtgcctctagcagggtcggctctaagaaggagattcaggaggctaaggcgccttctccttcaattaacaggcaaacctcaatcgagaccgatagagtttccaaagaatttatcgaatttctaaaaacctttcataagaccgggcaagagatttacaagcaaacaaaactttttctggaaggtatgcactataagcgagatctgagtatcgaggagcaatccgagtgcgctcaggatttttaccataatgtggctgaacggatgcaaacacggggtaaggtcccgcctgaaagagtggaaaaaattatggaccaaattgagaagtatatcatgactaggctgtacaagtatgtcttctgccctgagacaacagacgacgagaaaaaggacctggctatccagaaacggatacgggctctgaggtgggtaaccccacagatgttatgtgttcccgttaacgaggacatccctgaagtctccgacatggtagtaaaagcgatcacagacatcatagagatggatagcaaaagggtcccacgtgacaagctggcttgtatcacaaaatgttcaaaacacatcttcaatgccattaagataactaagaacgaacccgcatcagccgatgattttctgcctactctgatatacattgttctgaaaggtaacccgccacgcctccaatctaatatccaatatattacccggttctgcaacccctccaggttaatgactggagaagatggatattattttaccaacctgtgctgcgctgtagcttttatcgagaagctggatgctcagtcgcttaacttgagccaagaagactttgacagatatatgagtggacaaacctccccacggaaacaggaagcagagtcatggtcccccgatgcctgtctgggagtcaagcagatgtataaaaatctggacctgctgagccagctcaatgagcggcaggagcgcataatgaacgaggctaagaagctagagaaggacctgattgattggactgacggaatcgccagggaggtccaggatatcgtggagaaatatcccctcgagatcaaacctccaaaccagcctctcgcagccatagactcagagaacgtggaaaatgataagttacctccccctctgcaacctcaggtatatgcaggatag

SEQ ID NO: 235557 - DNA, 1224 bp, Artificial Sequence
  Description of Artificial Sequence: Synthetic coding sequence
atgagcttgaagagtgaacgacgaggaatccacgtggatcagtctgatctgctgtgtaagaaaggctgtggttactacggcaatcctgcgtggcagggcttttgcagcaagtgttggcgcgaagagtaccataaagcccgacagaaacagatacaagaggactgggagctggcagaaaggctgcagcgtgaagaagaggaagcttttgcatcaagccagtcctcccagggagcgcagagtctcacttttagtaagtttgaggagaagaaaacgaacgagaagacacgcaaggtgactactgttaaaaagttcttcagtgcctccagtagagtggggagtaaaaagcccccagaaagagttgaaaagataatggatcagatcgagaaatacattatgacacgactctacaaatatgtgttctgtcccgagaccaccgatgatgaaaagaaagacctggcaatacaaaaacgcatcagagcacttcggtgggtgaccccacaaatgctctgtgtcccggtcaatgaggacattccggaggtctcagacatggtggtcaaggccatcaccgacatcatcgaaatggactcgaagcgcgttccccgtgacaagttagcctgcatcacaaaatgctccaagcacattttcaatgccattaagatcacaaagaacgaacctgcttccgccgatgacttcctcccgacactgatttacatcgttctgaaggggaaccctccaaggttgcagagcaatattcaatatattacaagattctgtaatccttcccggttaatgacgggggaagatggctattatttcaccaacctgtgctgtgccgttgcattcatcgagaagttggacgcacaatcccttaacctaagccaggaggacttcgatcggtatatgtctggtcaaacttctcctcggaagcaagaggccgaaagctggtccccagacgcttgtcttggtgttaagcagatgtacaagaatttagacctcttgtctcaactgaatgagaggcaggagagaatcatgaacgaggcaaagaagttggaaaaagatctgatcgattggaccgatggaatagctcgtgaagtgcaagatatagtggagaagtaccccttggagataaaacctcctaatcaacccttggccgctatagactctgaaaatgtagagaatgacaaactgccaccgccacttcaacctcaggtgtatgcgggatag

SEQ ID NO: 235558 - DNA, 867 bp, Artificial Sequence
  Description of Artificial Sequence: Synthetic coding sequence
atggtggtcgtgacgggcagggagcctgattctcggagacaggatggtgcaatgagcagttccgatgcagaagatgacttcctggagcctgcaactccaaccgcgacacaggcgggtcacgcactcccactgctgccacaggagtttcctgaagtggtgcctctgaatatcgggggagcccatttcacaaccagattgagtacactcagatgttacgaagacactatgctcgcagctatgttctcaggcaggcattacatccccacggattcggaagggagatactttatagatagagacgggacccactttggcgatgtgctcaacttcctgaggtctggtgacctcccaccccgagaaagggtcagggctgtatacaaggaggctcagtactatgccattggccctctgctggaacaactggaaaacatgcagcctctcaaaggagagaaggtcagacaggcatttctggggctaatgccctattataaggatcacctggagcggattgtggagatcgccagactgagggcagtgcagcggaaggctagatttgctaagctgaaggtgtgtgtgtttaaagaggagatgcctatcaccccctatgagtgccccctgctgaacagcctccgcttcgagagaagcgaaagcgatgggcaactgtttgaacaccactgcgaggtagacgtgagtttcgggccatgggaagctgtggccgacgtgtatgatttgctccattgcctggtgactgatctttctgcacaaggtctcactgtggatcatcagtgcataggcgtgtgtgacaagcacctagtcaaccattactattgcaaacgtccgatttatgagtttaaaatcacctggtag

SEQ ID NO: 235559 - DNA, 663 bp, Artificial Sequence
  Description of Artificial Sequence: Synthetic coding sequence
atgaagggatacgggcacacggtgccgctgtctgacggagggaaagcgttctgcatcatttacagcgtgatcggcattccatttacgctactttttctgacagcagtggtgcagcggattaccgtgcacgtcacccgcaggcccgtgctttatttccacatccggtgggggttcagcaagcaggtcgtcgccattgtacatgccgttttactaggttttgttacagtgagctgcttttttttcatacccgctgccgttttctctgttctggaggatgactggaattttttggagtctttctatttctgcttcatcagtctgtccacaataggccttggagattacgtgcctggggaaggctacaaccaaaaattcagggaactctacaagattggaataacgtgctatctgctacttggtctgatcgctatgcttgtggttctcgagaccttctgtgagctccacgagctcaaaaaattccgcaagatgttttatgttaagaaggacaaagacgaggaccaggtgcatattatagaacacgaccagttgagctttagttccataaccgaccaggcggctgggatgaaagaggatcagaagcagaatgaaccttttgtggccacccaatcctctgcatgcgtcgacggcccagccaatcattag

SEQ ID NO: 235560 - DNA, 1011 bp, Artificial Sequence
  Description of Artificial Sequence: Synthetic coding sequence
atgctacagagcttggccggttcatcctgcgtgagattggtggaacgacatcggtctgcctggtgcttcggctttcttgtgctaggctacttactctacctggttttcggggcagtagtgtttagctctgtagaactgccatacgaggacctcctccgccaggagctccgcaagctgaaaagacggtttcttgaggaacacgaatgtctcagcgagcagcagttggagcagtttctgggtcgcgtgttggaagcttctaactacggagttagcgttctcagcaacgccagtggaaactggaactgggatttcacatccgctctattcttcgcctcaactgttctttccaccactggttacggccacaccgtgcccctcagtgatgggggaaaagctttttgcattatctattccgttataggaatccccttcacgctgctattcctgactgctgttgtgcagagaatcaccgtccatgttacgcgaagaccagtcttatacttccacattcgatggggttttagtaaacaggtggtggctatcgtccatgcggttcttctcggttttgtgactgtctcgtgttttttctttattcccgcagccgtttttagcgtcttggaggatgattggaacttcctggaatccttttacttctgcttcattagcctctcaaccatcggtctgggcgactacgtccctggggaaggatacaaccagaagtttcgtgagctgtacaaaattggaataacctgctacctccttctgggactcatagcgatgctggtcgtcctggaaacgttctgtgaactgcatgagctcaagaagtttcgtaaaatgttctatgtaaaaaaggacaaagatgaggaccaggtccatatcatcgaacatgaccagctcagcttctctagcattacagaccaagcggctgggatgaaggaggaccaaaaacagaacgagccgtttgttgcaacccagtcatccgcttgcgtggacggccctgccaatcactag

SEQ ID NO: 235561 - DNA, 729 bp, Artificial Sequence
  Description of Artificial Sequence: Synthetic coding sequence
gttctccgggtcctcagcccagacctcgtccgcagactcctaaatctggcagtccgcgcatttcaggtcccgaaaggcgagtcccttaatttcccagagagtactccaggatatggtcataccgtccccctttcggatggaggaaaggctttttgtattatctactcggtgattggaattccttttacattgttgttcctgacagccgtggttcagcggattacggttcatgtaacccgccgacccgtcctctattttcatataagatggggtttctctaaacaagtggtggccattgttcacgctgtgctcttgggctttgtaacggtgagttgttttttttttattccagctgccgtgttctcagtactggaggacgactggaatttcttagaaagtttctacttttgtttcatttccctgagtaccattgggctgggggattacgtccccggtgagggctataaccagaaatttagagaactttacaaaatcggaatcacttgctacctgcttcttggtctcatcgctatgctcgtcgtcttggaaactttctgcgagctacacgaactcaagaaatttagaaaaatgttttacgtaaaaaaggataaggatgaagatcaggtccatatcatcgaacacgatcagcttagtttttcctccattacagatcaggctgcaggcatgaaggaggatcagaagcagaatgagccattcgtggcgacttag

SEQ ID NO: 235562 - DNA, 1632 bp, Artificial Sequence
  Description of Artificial Sequence: Synthetic coding sequence
atggaagacggtttcaagggcgaccgaactgaaggctgcagaagcgactctgtggcagttcctgctgcagcccctgtgtgccaaccaaagagtgcaacaaatgggcagcctcccgcacctgctcccacaccgacacctcggctcagtatttcctcacgagccactgtggttgcccgaatggagggtacatcccagggcggattgcaaacagtgatgaaatggaagaccgtggtggcaatttttgttgtggtggtcgtatacctggtcacaggaggtctggtgttccgggcactggagcagccattcgaaagtagtcagaaaaatacaattgcactcgagaaagcagaatttctgcgggatcatgtctgcgtttcacctcaagagcttgagaccctgattcagcatgctctggatgcagacaacgcaggcgtctctcctatcggcaatagcagcaacaacagttcacactgggacctgggctccgcctttttctttgctggcaccgtcattacaacaatcggttacggcaacatcgcccctagcactgaagggggtaagattttttgcatactgtatgcaatcttcggcattccgctattcgggttcttattagccggtatcggggatcaacttggaacgatctttggaaagtctatcgcccgagtcgaaaaggtcttccgcaagaaacaggtctcacagacgaagattcgagtcatatccacaatcctgtttatcctggcgggttgtatcgtctttgttacaatcccggctgtaattttcaaatacatcgaggggtggacggcactggaatccatctacttcgtggtggtaactctgacgactgtgggattcggggactttgttgcaggtggcaacgctggaatcaattatagggaatggtataagcctctggtatggttctggatcctggtgggtttagcttattttgcagccgtcttgagcatgatcggcgattggttgcgcgtgttatccaagaaaaccaaagaagaggtcggagagatcaaagcgcatgccgcagaatggaaagcaaatgttacagccgagttccgggagacccggcgtaggctttctgtggaaattcacgataagttacagcgagcagcaacaatccgcagcatggagaggcggaggctggggctcgatcaaagggcccacagtcttgatatgctaagccccgagaaaagatccgtgtttgctgccttggatacaggcaggttcaaggcctccagtcaggagagcattaataacaggcctaataacctcagacttaaagggcctgaacagcttaataagcatggacagggagccagcgaggataatattatcaataagtttgggtcaacgtcaaggctcaccaaacgaaagaacaaggatttaaaaaagacactgcctgaggacgtgcagaagatctataagacgttccgcaattattctttagacgaggagaagaaagaggaagagacagagaaaatgtgtaactctgacaattcctccactgctatgctgactgactgcattcagcaacatgctgaattggaaaatggcatgatcccaacggataccaaagacagggaacccgaaaataattctctactcgaagaccggaactag

SEQ ID NO: 235563 - DNA, 1632 bp, Artificial Sequence
  Description of Artificial Sequence: Synthetic coding sequence
atgaaattccccattgagacaccacgcaaacaggtcaactgggacccaaaagtggccgtgcccgctgcagcgcctgtatgtcagcccaaatcggcaactaacggacagccacccgcacccgctccaacaccgactcctagactatccatttcctccagggctactgttgtggccagaatggagggtacgtcacagggaggcctgcaaactgtcatgaagtggaagacagtcgtggctatcttcgtcgtggtggtggtatatttggtcacagggggtctggtgttccgcgctctcgaacagccgtttgagtcctctcagaagaatacaattgcattagagaaggcggagttccttcgcgaccatgtgtgtgtctctcctcaggagctggagaccctgatccagcacgcactggacgccgataatgccggagtgtctcccattggaaactcttcaaacaacagttctcattgggacctcgggtctgcctttttttttgccggtaccgttatcacaacaatcggttacggcaacatcgctccctcaactgagggcggaaaaatcttctgtatcctctatgcaattttcgggataccgctgtttggttttctgctcgccggaataggtgaccagctaggcactattttcggaaagtctatcgccagggtggagaaggtttttaggaagaaacaagttagccagactaaaattagagtcatttccactatccttttcatactggctggatgcatcgtatttgtgactatacctgccgtcatattcaagtacattgaggggtggaccgccctggagagcatatattttgttgtcgttacgttgaccacagtcgggttcggcgactttgtggcaggcggaaatgccggaatcaactaccgcgaatggtacaaacccctggtgtggttctggatcctagtcgggttggcctactttgccgcagtgttatccatgataggagactggctaagagtgttgtctaaaaaaaccaaggaagaggtgggcgagataaaggcacatgctgctgagtggaaagctaatgtgactgctgagtttagagagacacgcagacggctcagtgtcgaaatacacgacaaattgcagcgggctgccacaattcgctccatggagaggcgaaggctgggcctggaccaaagggcacactctctggatatgctgagccccgagaaacgcagcgtcttcgccgcactcgatactggcagattcaaggcttcatcccaagagtctatcaacaataggccaaataatctgcgtttgaaaggtcctgaacaactcaacaagcacggccagggggcttcggaggacaacattatcaacaaatttggtagcacgagcaggctgacgaagaggaaaaataaggatctcaagaagactctgcctgaggatgtgcaaaagatctacaaaacgttccgtaactattcccttgacgaggaaaagaaagaagaagagaccgaaaagatgtgcaattccgataacagctcaacagccatgctgaccgattgcattcagcagcatgccgagttggagaacggcatgatccccaccgataccaaggatagggaacccgaaaataacagcctactggaggaccgcaactag

SEQ ID NO: 235564 - DNA, 1617 bp, Artificial Sequence
  Description of Artificial Sequence: Synthetic coding sequence
atgttctttctgtataccgacttctttctttccttagttgccgtccctgctgctgccccagtttgtcagcctaagtccgctacaaatggtcaaccacccgcacctgccccaacccctacaccgaggctttccattagttcacgggctacagtcgtcgctagaatggagggaacaagtcagggaggcctccagactgtgatgaaatggaaaactgttgtcgctatattcgttgtcgtggtggtttatttagtaaccggtggtctcgtctttcgggctttggagcagccgtttgagtcaagtcaaaagaataccatcgcccttgaaaaagcagagtttctgcgagaccacgtgtgcgtgtctccgcaggagctcgagacattgatccagcacgcgttggatgccgataatgccggagtatctccaataggtaattctagcaataattcttcccattgggaccttggatccgcctttttcttcgccggaactgtgattacaactattggctatgggaacatcgcgccttctaccgagggtggcaagatcttctgtattctctacgccatcttcggcattccgttgtttggctttctcttggctggcatcggcgatcaactgggcactatctttggaaaaagtattgcacgtgtggagaaggtatttaggaaaaaacaggtgtcccagactaagataagagtgatctcaaccatcctgtttattctggctggctgtatcgtctttgtgaccattccagcagtgattttcaagtatattgagggatggacagcacttgagtccatttactttgtggtggtcaccctcaccacagtcggcttcggcgatttcgtagccggaggaaatgccggaataaattacagagagtggtataaaccactggtatggttctggatcctagtggggctcgcttatttcgccgctgtgctgtcaatgatcggtgactggttacgggtactgtcaaaaaagacgaaggaggaggtgggcgagatcaaagcccacgctgctgagtggaaggctaacgtaaccgccgagttcagggagactaggaggcgcctgtcagtagagatacatgacaaactgcagcgcgctgccactatcagaagtatggaaaggagacggctcggcctcgatcagagggctcatagcttggacatgttgtccccagaaaagcgcagcgtgttcgcagccttagatacgggacgtttcaaggcttctagtcaggaaagtatcaacaacagacccaataacttgcgcttaaaaggcccagagcagctcaacaaacatggccagggagcaagcgaggacaatatcatcaataagttcgggagtacgagcaggctgaccaagagaaaaaataaggatctgaagaagaccctgcctgaggatgtccagaagatttataaaacctttcggaactattcccttgacgaagagaaaaaggaggaagaaaccgagaaaatgtgtaattccgataattcctccaccgcgatgctgaccgactgtatccagcagcacgctgaactggaaaatggtatgatccccaccgacacaaaggaccgcgaaccggaaaacaatagtctattggaggaccggaactag

SEQ ID NO: 235565 - DNA, 1293 bp, Artificial Sequence
  Description of Artificial Sequence: Synthetic coding sequence
atgagtagccgctcaccacgccctcccccacgccgttctaggcgccgacttccaaggccgagctgctgttgctgctgctgtcgacgctcccatctgaacgaagataccgggcgttttgtcctgttggctgccctgataggactatacctggtcgcaggggctaccgttttcagcgctttggagtcccccggagaggctgaagcacgcgctcgctggggggcaacgttgaggaatttttccgcagcacatggagtcgccgaaccagagctgcgagcctttctacgtcactatgaggccgcacttgctgccggtgttcgggctgatgccttacggccacgctgggatttcccgggagctttttacttcgtgggaaccgtggtcagcactatcggctttggcatgactaccccagccacagtaggcggaaaagctttcctgatcgcctacggtctgtttggttgcgctggaacaatcctgtttttcaatctgtttctagaacggataatttcactgctagctttcattatgagggcctgtcgtgagcggcagcttcggaggagtgggctgcttcctgctaccttccgtcgagggagcgctctcagtgaggcagatagtctcgccggttggaagccgtctgtttaccacgtgctgttgatcctgggtctttttgccgtcttgctgtcatgttgcgcgtctgcaatgtatacctctgtcgagggttgggactatgtggattcgctgtatttctgctttgtcactttttcaacaatcggcttcggagacctggtatcatcccaacacgctgcctacagaaaccagggtctttaccgcctgggaaattttctgttcatcttgctaggcgtttgctgtatttacagtctatttaacgtgatctccatattgattaagcaggtactcaactggatgctgcgtaagctgagctgccggtgttgcgccagatgctgtccggcacctggggctccactcgcgaggaggaacgccattacacctggtagtcgactccggagacgcttagccgcactgggagcagacccagccgctcgggattccgacgccgagggcagacgactcagcggcgaactgataagcatgagagacctcaccgctagtaataaggtgtcacttgccttgctccagaaacagctgtccgaaacagcaaatggctatccgcgatctgtctgcgtgaacactagacagaacggattctccggcggtgtgggcgctctgggcatcatgaataaccgactggccgagaccagcgcaagtagatag

SEQ ID NO: 235566 - DNA, 1227 bp, Artificial Sequence
  Description of Artificial Sequence: Synthetic coding sequence
atggctgggagggggttcagctggggtcccggacacctgaacgaggacaatgccaggtttctgttgttagcggcactgatagtgctttatttgctggggggagctgcagtgttttcggcactggaactcgcccatgagaggcaagccaaacaacgatgggaagaaaggcttgctaatttctcacgtggccacaatttgagccgagatgagctcagaggatttctgcgacactatgaagaggccaccagggccggtatacgcgtcgacaacgttcggcctaggtgggacttcaccggcgcattctattttgtcgggaccgttgtctctaccattgggttcggcatgaccactcccgctaccgttggcggtaagatcttcctaatattctacgggctggtgggttgctcctcgaccattttgttctttaatctgtttctggaaagactgataacgatcattgcttacattatgaagtcctgccatcagcgccagcttcgcagacgtggggctctcccccaggaatccctcaaggacgcaggtcaatgcgaagttgattctctcgcagggtggaagccctctgtgtattacgtaatgctgatcctatgtaccgcctctatcttaatcagttgttgcgccagtgctatgtacactcctatcgaaggctggagctacttcgacagtctgtacttctgcttcgtggccttcagtacaatagggtttggggatcttgtttcgtctcagaacgcccactatgagtcgcaggggttatacagatttgcaaatttcgtattcatcctgatgggcgtctgttgcatctatagcttattcaacgtgatctccattttaatcaagcaatccctgaattggattctccgcaagatggactcagggtgttgccctcagtgccagaggggcttgttgcgctccagaaggaatgttgtcatgccaggatccgtgcggaaccgttgtaatatttcgattgagactgatggagtagccgagagcgacacagatggccgaaggctttcaggcgagatgattagcatgaaggatctgctggccgctaacaaggctagccttgcaatccttcagaagcaactctcagagatggccaacggctgtcctcatcagacctccacactggctcgggataacgaattttctgggggagtgggcgcatttgcaattatgaacaacaggctcgcggagacctctggcgatagatag

SEQ ID NO: 235567 - DNA, 993 bp, Artificial Sequence
  Description of Artificial Sequence: Synthetic coding sequence
atgcgacggccttctgtgcgggctgctggtcttgtactgtgtactctgtgctaccttctggtgggtgcagcagtgttcgacgcactggagtccgaagcagaaagtggcaggcagcggctgctggtgcagaagcggggagccctcaggcgaaagttcggcttttccgcggaagattatcgcgagctagagaggttagcactccaggcggagccccacagggccggtagacagtggaagttccctggctctttctacttcgccattaccgtaatcactaccatcgagtacgggcatgctgccccaggcacagattcgggcaaagtcttttgcatgttttacgctctactggggattcctctcaccctagtcaccttccagagtctgggggagcgtttaaacgccgtggtcagaaggctgctgcttgcggcaaagtgttgcctcggcctgaggtggacctgcgtgtcgaccgagaacctggtagtggcagggcttttagcatgcgcagccacgctcgctctgggagccgtagccttctcgcattttgaaggatggacttttttccacgcttattactactgtttcattaccctgactacgattggctttggagattttgtggcactacagtcaggggaggccttgcagcgtaaacttccttacgttgcgttctcttttctgtatatcctcctgggtctgactgtgataggtgcattcctcaacctggtcgtgttacgtttcctagtggcaagcgccgattggcctgagagggctgcccgaacacccagtcccagaccgccaggagccccagaaagccggggattatggttaccccgacgtccagctagatccgtcgggagtgccagcgttttttgtcatgtgcataaacttgagagatgcgctcgcgataatcttgggtttagtccccctagctcccccggagtagtcagaggagggcaagcccctcggcttggcgctagatggaagagtatctag

SEQ ID NO: 235568 - DNA, 789 bp, Artificial Sequence
  Description of Artificial Sequence: Synthetic coding sequence
atgccatccgctggactgtgcagttgctggggcggtagagttctgccacttctgcttgcatatgtatgctatctgctgctgggtgctacgatattccagctcttagaacgacaagccgaggctcagtctagggatcagtttcagctggaaaaactcaggttcctcgagaactatacctgcttggatcaatgggcgatggagcagtttgtccaggtgatcatggaggcgtgggtgaaaggggtcaaccccaaaggtaactctaccaatccgtctaactgggatttcggctcctccttttttttcgctggtacagtagtgaccaccatcggctatggtaacttggcgccatcaacggaggccggacaggtgttttgtgtattttacgccctcctgggaattccactcaacgtaatttttctgaaccacctgggaacggggctaagagcccatcttgctgcaatagaacggtgggaagacagacccagaaggtcacaggtgttgcaggtgttgggcctagccctgtttctcactctgggtaccctcgtcatcttgatattcccccctatggttttttcccacgtggagggctggagcttctccgagggattctacttcgcttttatcactctcagcactattggttttggcgattatgtcgtgggactcaggcaagggtgtggggcaaaagccgcacctggaaggaggcctcggagagggagcactgctgcccgtggagtgcaggtgacgcctcaggattttcccatcagcaagaaggggctcggcagttag

SEQ ID NO: 235569 - DNA, 930 bp, Artificial Sequence
  Description of Artificial Sequence: Synthetic coding sequence
atgccaagtgctggactgtgcagctgctggggcggacgcgtgctgcccctcctcctcgcatatgtgtgttacctgctgctcggtgccactattttccaactgctggaacgtcaggccgaagcccagagtagggatcagttccagctggagaaactgcgctttctggagaactatacctgtctagatcaatgggctatggaacaatttgttcaagtcatcatggaagcatgggtaaagggtgtgaaccccaaggggaacagtacgaatccctccaattgggactttggttcctcattcttttttgctggaaccgtggtgactactatcgggtatggaaacctggccccaagtaccgaggctggccaggttttttgtgtgttctacgctctcctgggaattccgctcaacgtcattttcctgaatcaccttggtactgggttgagagctcatctggcagcaattgaaagatgggaagataggccgaggagatcccaggtccttcaggtgctcgggctggccctgtttcttaccctgggaacacttgtcatactgatcttcccgccaatggtgttcagtcatgtagaggggtggtccttcagcgagggtttttacttcgcttttatcactctctcaaccattggttttggtgattacgtggtcggtacagaccccagcaagcactatatttccgtgtaccggtcgttagctgctatatggatcttgttgggcctggcctggctggccctgatcctgcccctaggccctcttttactccaccgatgctgtcaactctggttgctctccttgaggcaaggctgcggggcaaaggccgctccaggaaggagacccagacgcggttcaacagctgcacgcggagttcaagtcactccacaggattttcctatttcaaagaaagggctggggagctag

SEQ ID NO: 235570 - DNA, 969 bp, Artificial Sequence
  Description of Artificial Sequence: Synthetic coding sequence
atgccatccgccggactttgcagctgctgggggggaagagtcctgcccctcctgctcgcctatgtctgttacctactcctgggagcaaccatttttcagctcctggagcggcaggctgaggcccaaagcagggatcaattccagttggagaaacttcgctttctagaaaactacacttgccttgatcaatgggctatggagcagtttgtgcaggtgattatggaggcctgggtgaagggagttaaccctaaaggcaactctaccaatccaagtaattgggatttcgggtctagcttcttttttgccggaactgtggtgacaacaattggctatggcaacctggccccttccactgaggccggtcaggtgttctgcgtcttttacgccctccttggcataccactcaacgtgatcttcctcaatcaccttggcaccggtttgcgcgcacacctcgcggctatcgaacggtgggaagaccgtcccaggagatcccaggtactgcaggtattgggattagctctgtttctgactctggggacgctggtgatcctcatcttccccccaatggtgttcagccacgtggagggatggagcttctcagaaggcttttactttgcctttattactctctcaactatcgggttcggagattatgtggtaggccacccgcttaatttcattacacctagcggcctgctgcccagccaggagcccttccaaaccccacacggcaagcccgagtcccagcagatccctgggagttttcagaaggtgtctagcatgaatgtctggcccctgagtggaatgcattctccaggcctggctttccctcttcccgattgcaatatccctgaccaggaacggttcaggcctcttcacccgggagcatggaagttttggcctcttccactgccaagcagtaatagtaaatgggccccaatgtggcttggaagttcagcgcaggtctag

SEQ ID NO: 235571 - DNA, 885 bp, Artificial Sequence
  Description of Artificial Sequence: Synthetic coding sequence
atgccttcagccggattgtgcagctgctggggaggccgtgtccttccattactcttggcctacgtgtgctacctgctactgggggcaacaatctttcagttgctggagcgtcaggccgaagcccagagcagagaccaatttcaattggaaaaattgaggtttctggagaactatacctgcctggaccagtgggccatggaacagttcgtgcaggtgatcatggaggcctgggtgaagggagtgaatccgaaagggaatagcaccaacccgtcaaactgggacttcggaagctccttcttctttgctggcacagtggtgaccactatcggatacggcaacctggcgcctagcacggaggccggtcaggtgttctgcgttttttacgccctcttggggatcccactcaacgtaattttcctgaatcatttgggtactggccttagagctcatctcgccgctattgaacgctgggaagatcgacccaggcgaagtcaggttctccaagtgttggggctggccctctttctcaccttgggtacactcgtcatcctgatcttcccccctatggtgttctcgcacgtcgaggggtggtcgttttcggaagggttttatttcgcctttattacactgtcaacaatcgggtttggggactatgtagttggaaccgacccgagcaaacattacatttcagtttatcggtctttggccgcaatctggatcctgcttggcctagcctggttggcactgattctgcccctcggccctttgttattacatcgatgctgccagctttggctcctgagccgaggcctcggcgttaaggacggggcagctagtgaccccagtggactcccgcgtccccagaagataccgatttctgcgtag

SEQ ID NO: 235572 - DNA, 594 bp, Artificial Sequence
  Description of Artificial Sequence: Synthetic coding sequence
atggaacagttcgtgcaggtgattatggaagcgtgggtgaagggggtgaatcccaagggcaatagtactaatccctcaaactgggacttcggctccagcttcttttttgccggtaccgttgtgaccaccatcggttatgggaacctggccccttcaacagaggcgggacaggtattctgcgtcttttacgcccttttggggatccccctgaacgtgattttcctaaaccatctaggtacagggctgagagcccatctggccgctattgagaggtgggaagacaggccacgcaggtctcaggtgctgcaggtgcttggtctggcactgtttcttaccctggggacgctagtgatattgatttttcctccaatggtcttctcgcacgttgagggatggtccttttctgagggtttctactttgccttcatcacattgtccactatcggattcggagattatgtcgtgggattaagacagggttgcggagcaaaagccgcaccgggaagaagaccaaggagaggtagcacagcggcacggggagtgcaagtgactcctcaggacttcccaatctccaagaagggattgggatcctag

SEQ ID NO: 235573 - DNA, 999 bp, Artificial Sequence
  Description of Artificial Sequence: Synthetic coding sequence
atgtaccggcctagggctagagcagctcccgagggccgagtgcggggttgtgccgtgccatcaacagtcctcttgctgctggcctatttggcgtacctggcccttggaaccggggttttttggacgttagaaggaagggcggctcaagacagctcacggtcttttcaacgggacaaatgggaactcctacagaattttacttgtctagatcggcctgccctggattccctcatccgcgatgttgtgcaagcttacaaaaacggagcctcactgttgtctaacaccacatctatggggaggtgggaactggtgggaagcttctttttttctgtgagtacaatcaccaccatcgggtatggtaatcttagccctaatactatggctgcacgcctgttttgcatattctttgccctggtggggattcctttaaatttggtggtgcttaatcgtctgggacatctaatgcagcagggcgtgaaccactgggcctcgaggctcgggggaacttggcaagacccagacaaagccaggtggctcgcagggagcggtgccctgttgagcggcctccttttgtttctgctgctgcccccactattgtttagccatatggagggttggtcctatactgaagggttttatttcgcctttatcactctgtctacggtaggcttcggggattacgttattggcatgaatccgagccagcgctaccctctctggtacaagaatatggtcagcctgtggatcctgttcggcatggcctggttggccttgatcatcaagttgattctgtcccagctggagacacccggtagagtgtgcagttgctgccatcatagctccaaggaggatttcaagtctcagagctggagacaggggcctgaccgagaaccagaatcccactcacctcagcagggctgttatcctgaggggccaatgggcataatccagcacctggagccatctgcccatgccgcaggttgcggtaaggattcttag

SEQ ID NO: 235574 - DNA, 816 bp, Artificial Sequence
  Description of Artificial Sequence: Synthetic coding sequence
atgtacaggcccagagccagggccgcacctgagggcagagtgcgaggctgtgcggtaccgagcaccgtgctgctgctgctggcatacttagcatacttagcgctgggtaccggcgtgttttggaccttggaaggcagggcggctcaggattcatctaggagcttccagagagacaaatgggaacttctccagaatttcacatgtctcgaccgccctgcactggattctctcatcagggatgtggtgcaggcctacaagaatggtgcaagtctattgtccaacactacctccatgggccgttgggaactcgtgggatccttctttttcagtgtttccaccatcactactatagggtatgggaacctgtcacccaatactatggccgctcgccttttctgcatctttttcgcactggtggggatccccttgaacttggttgtgctcaatcgcctgggacacttgatgcagcagggcgtcaatcactgggcatccaggctaggcggtacatggcaagacccggataaggcgaggtggctcgcgggaagcggagcattgctgagcggcctgctgctgtttttgttactgcctccccttctgtttagtcatatggaagggtggagctacaccgaggggttttacttcgctttcatcacgctttccacggtcggtttcggcgattacgttatcgcctcatgtctgatcagtgacacacgcaagccgaatagggattggcagaccctagagagaactagtaagtccagtgggggtctgctgaagtacaggttcctagccggacatggcggatcccacttgtag

SEQ ID NO: 235575 - DNA, 1155 bp, Artificial Sequence
  Description of Artificial Sequence: Synthetic coding sequence
atggaagtgagtggccatccacaggctcggaggtgctgcccggaggctcttgggaagttgttcccagggctatgcttcctctgtttccttgtaacttacgccctcgtgggggctgtcgtgttttctgcaatagaagacggccaggtcctcgtcgccgctgacgatggcgaatttgaaaagttcctggaagagctttgtagaatcctgaactgttcagaaacagtcgtggaggacagaaagcaggaccttcagggccacttgcaaaaagtgaagcctcagtggttcaatcgcaccacccactggtcctttctttcaagcctgtttttttgttgtaccgtcttcagcactgtgggatacgggtacatctatccagttactcggttaggcaaatacctttgcatgttgtacgccctatttggaattcccctgatgttcctggtgctgaccgacactggagacatcctcgccactatactctccacaagctataataggtttaggaaattcccatttttcaccagacccttactgtccaagtggtgccccaagtctctgttcaagaaaaagcctgaccctaaacctgcagatgaagcagtgccccaaatcattatttccgccgaggagcttccgggtccaaaattaggaacttgcccatcacgaccgtcttgctctatggaactgtttgagcgctcccacgcattagaaaagcaaaacacactccagttgccaccgcaggccatggaacgctccaactcctgcccagagcttgtactgggcagactatcatatagcataatcagcaacctggatgaggtgggacagcaggtggagcgtcttgacatcccgcttcccatcatcgccttgatcgtgtttgcatatatctcatgcgccgctgccatcctgcctttttgggaaacccagcttgacttcgagaacgcattctacttctgtttcgtgactcttacaacaatcgggttcggagacacagtccttgagcaccctaacttttttctgttcttctcaatctatattatagtgggaatggagattgtatttattgcctttaaactagtgcaaaataggctcatcgacatctacaaaaatgtgatgctgttcttcgcaaaaggtaagttttaccatctggtgaagaagtag

SEQ ID NO: 235576 - DNA, 459 bp, Artificial Sequence
  Description of Artificial Sequence: Synthetic coding sequence
atgatgaacccgcgtgccaaacgggacttttacttagctgcacccgacctgctggatccgaagtctgctgcccagaactcaaaacctcgcttgtcattctctacgaaacctaccgtcctagcatcccgtgtagaatcagataccacaattaatgtcatgaaatggaagacagtgagtaccatatttcttgtagttgtgctgtacctgattataggcgctacagtcttcaaggcccttgagcagcctcacgaaatcagtcagcggacaaccattgtcatccagaagcagaccttcatcagtcaacattcctgcgtgaatagcaccgagttggacgaactcattcaagatctcgagacgtctcatcatgctcagaaggctgccaaatactctgtgtcttccatgccgtattgggagttccctagcctggtattcagttggctcgagctagaaattagctag

SEQ ID NO: 235577 - DNA, 1236 bp, Artificial Sequence
  Description of Artificial Sequence: Synthetic coding sequence
atggccgcacccgacctgctcgaccctaaaagcgctgctcagaacagcaaacctaggctgtctttttcgaccaagcctacggtgttggcaagcagggtagagagtgacactacaattaacgttatgaaatggaagacagtgtccacaatatttttggtggtagtgctgtacctgataattggagctacagtttttaaagctttggagcagccacacgagatcagtcagcgcaccaccatcgtgatacagaagcaaacgttcatatcccagcactcttgcgttaacagcacagaattggatgaactcattcagcaaatagtggccgcaataaatgctggcattattccactcggaaacaccagtaaccagatttctcattgggatctggggagtagctttttcttcgccggaactgttatcaccaccattgggttcggaaatatcagtcctagaaccgaaggagggaaaatcttttgcataatttatgccttactcgggatccctctttttggatttctgctggcaggtgtgggcgatcagctgggaacaatcttcggaaagggcatcgccaaggttgaggatacttttatcaaatggaatgtcagtcagacaaaaatacggatcatcagcaccattatttttatccttttcggatgtgtcctgttcgtggccctgcccgctattatcttcaagcacattgaggggtggtcggcgctggatgccatctacttcgtggtaatcaccctcaccactattggcttcggcgattacgtagccggtggcagcgacattgagtatctggatttttacaaaccagtggtatggttctggattttagtcgggctcgcctattttgctgccgtgctgtctatgatcggagactggttgagagtcatttctaagaagactaaagaggaagtaggcgaattcagagcccacgcggctgagtggaccgccaatgtcaccgctgagtttaaggagactaggaggcggctgagtgtggagatttacgacaaatttcagcgggctaccagcatcaaacgcaagctgtctgccgaactcgcaggcaatcataaccaggagcttaccccctgcagacgtaccctgagtgtgaatcatctaacaagcgagagagacgttctgccaccactcttgaagaccgaaagcatctacttgaacggactgactcctcattgtgcaggcgaggaaatagccgtaatcgaaaatatcaagtag

SEQ ID NO: 235578 - DNA, 1269 bp, Artificial Sequence
  Description of Artificial Sequence: Synthetic coding sequence
atgatgaatccgagagcaaagcgagatttttatctggcagctcctgatctcttggatcccaaaagcgcagctcagaatagcaaacccagactgtccttttctacaaagcccacagtgttagcctccagggtggaaagtgacacaactatcaacgtgatgaaatggaaaaccgtgtctacaatttttttagtcgtggtgttgtacctgattattggagccacagtgttcaaggccctggagcagccgcacgagatttcccagagaactaccattgtgatccaaaagcagaccttcattagccagcactcttgcgtaaattcgaccgagcttgacgagctgattcagcaaattgtggcagctatcaatgctggaatcatacccttgggtaacacttcaaaccaaatcagtcattgggacttgggtagctcttttttcttcgcaggcaccgtgataaccacaattgggttcgggaatatctccccacgcactgaaggaggcaagatcttttgtatcatttacgcccttctcggtatcccactgtttggtttccttctggccggtgtcggtgaccagctagggaccatctttgggaagggtattgccaaagtggaggatacattcatcaagtggaatgtatcccaaacaaaaattcgaatcatcagcacgataatcttcattctcttcggatgcgtgctctttgtggctctgcctgctataattttcaagcatatcgagggatggtccgcccttgatgctatatattttgtggtcatcacactgaccaccatcggattcggcgactatgtagcagggggaagcgatatagaatacctggatttctacaaaccagtggtgtggttctggatcctggtcggactggcttattttgcggctgttctgagtatgattggcgattggctcagagtgatctctaaaaagacaaaagaagaagttggcgagttcagggcccatgccgcagaatggacagcgaatgttacagctgaattcaaagagacaagaaggcgtctctccgtggaaatctatgacaaatttcagagggctacgtcgatcaagcgaaagttgtccgctgaactggctggcaatcataaccaggagttaacgccatgcagaagaactctgtctgtcaatcacctcacttctgagagggacgtgttgcccccattactcaagacggagtccatttatctgaacggattaactccccactgtgctggcgaagagatcgctgtgatcgagaacattaagtag

SEQ ID NO: 235579 - DNA, 1281 bp, Artificial Sequence
  Description of Artificial Sequence: Synthetic coding sequence
atgctgccatcggcctctcgcgaacgacctggctatcgggcaggagtcgcggcaccagaccttctcgaccctaagtctgccgctcaaaacagcaagcctagattaagcttttctactaaacctacagtgctcgctagccgcgtcgaaagtgacactaccatcaacgttatgaagtggaaaacggtgtcaacaattttcctggtggtggtgctgtatttgatcattggtgcgacagtattcaaggccctggagcagccacacgagatttcgcagcgaactaccatcgtgatccagaaacagacttttatttctcaacactcttgcgtgaacagcaccgagctcgatgagctcatacagcaaatcgtggccgcaattaacgccggaatcatccctcttggaaacaccagtaatcaaatctcccactgggacctgggcagttccttcttctttgccggaactgtgattaccacgatagggtttggaaatatctcacccagaacggagggtggcaaaatattttgcataatttatgcactgctcggtatcccattgttcggttttctgctggcaggggtaggagatcagctcggtactattttcgggaaaggcatcgctaaagtcgaagacacattcataaaatggaatgtcagtcagaccaagatccggatcattagcactattatatttatcctgttcgggtgcgttctgttcgtggcacttccagcaatcatcttcaagcacatagaaggttggtccgccctcgatgccatatacttcgttgtgatcaccttgaccacaataggttttggcgactacgtagcgggtgggtccgatatcgagtacctcgatttttataaaccagttgtgtggttctggattcttgttgggttggcctactttgcagccgtgctgtccatgataggtgactggctaagagtaatttcgaaaaagactaaggaggaggttggggaattcagagctcacgccgcagaatggactgccaatgtcacagccgagttcaaggaaacaagacggagattgtctgtcgagatatacgataagttccagcgcgcaacctcaatcaaacggaaactgtcagccgagctcgccggaaatcataaccaggaattgacaccctgccggaggacactctccgtgaaccacctcacctcagaacgtgatgtactgccccctctattgaaaacggaatcaatctatctgaatgggttgactccacattgtgccggtgaagagatcgccgtcatcgaaaatattaagtag

SEQ ID NO: 235580 - DNA, 687 bp, Artificial Sequence
  Description of Artificial Sequence: Synthetic coding sequence
atgatgaatccacgtgctaagcgcgatttctacctggcagcacccgatttgttggatcctaaaagcgcggctcagaattcaaaaccacggttgagcttcagcacgaaacccacagtcctggcaagcagagtcgagtctgacaccaccatcaacgtcatgaaatggaagacagtgtcgacaatctttctggtcgtcgtactgtacttaattatcggggctactgtgtttaaggcccttgaacagccacacgaaatcagtcagagaaccaccatagttatccaaaaacaaactttcatctcacaacactcatgtgtcaactcaaccgagctggacgagctgattcagcagattgtcgcagctatcaacgctggaatcatccccctcggtaatacatctaatcagatttcccattgggacctgggcagttcattctttttcgcagggacagtgattacgacgattggtttcggcaacatctcccccaggaccgaaggaggcaaaattttctgtattatctatgcactcctaggaattccccttttcggattcctcctggcaggggtcggggatcaactggggacaatatttggaaaagggatagctaaggtggaagatactttcatcgtagaccccattctgaacatttggacaagcatcagtctgagttgtggttcaggatccctgtag

SEQ ID NO: 235581 - DNA, 471 bp, Artificial Sequence
  Description of Artificial Sequence: Synthetic coding sequence
atgctgccctccgcaagcagagagaggcccggatatcgtgccggtgtcgcagccccagatctcttggaccccaagtccgcggctcaaaactcaaaacccagactgtcattcagtactaagccaactgtcctcgcttcccgggtggagtcagatactaccatcaacgtaatgaaatggaaaacagtttcaactattttccttgtggtcgtgctgtacctcattatcggcgctaccgtcttcaaggcactggagcagcctcatgaaattagccagcgaacaactattgtcatacagaaacaaacatttatcagtcagcatagttgtgtgaattccactgaactcgacgagctcatccaggacctcgaaacaagccatcatgcccagaaagctgctaaatacagcgtgagctccatgccttattgggagttcccgagtttagtcttcagctggctggaactggaaatctcctag

SEQ ID NO: 235582 - DNA, 459 bp, Artificial Sequence
  Description of Artificial Sequence: Synthetic coding sequence
atgatgaaccccagagctaaacgggatttttacctcgctgcccctgaccttctggacccgaagtcagcagctcagaactctaagccaaggctctcattctcgaccaagccaactgtgcttgccagcagagtggaatcagacaccaccattaatgtaatgaagtggaagacagtgagcactatattcctggtggtcgtattgtacctgatcataggcgctactgtgttcaaggcgctggaacagccacacgaaatatctcagagaaccactattgtcattcagaagcagaccttcatttctcaacactcttgcgtcaattctacagaactggatgagcttatccaagaccttgaaacatcacaccatgctcagaaggccgcaaagtattctgtctcgtctatgccctactgggaattcccttccctagtgttttcgtggttggaattggagatttcgtag

SEQ ID NO: 235583 - DNA, 1185 bp, Artificial Sequence
  Description of Artificial Sequence: Synthetic coding sequence
atgaagagacagaacgttcgaaccttggccctaatcgtgtgcacgtttacttatctgctcgtcggggctgctgtttttgacgctctcgagagtgagccagaactcatcgagcggcagcggctagagctccgacaacaggagctgagagcacgatacaacctatctcagggcggatatgaagagctggaaagggtcgtgctgcggctgaagccgcataaagccggtgtccagtggcggtttgcaggctcattttattttgctatcacggtgatcaccaccattgggtacgggcatgcggctccctcgaccgacgggggaaaagttttttgtatgttctacgctctgctgggaatccctctcaccctggtcatgtttcagtccctgggggagcggattaataccctagtgcggtaccttctacacagagccaaaaaggggctcggcatgagacgcgctgacgtgagcatggctaatatggtgcttatcggtttcttctcttgtatctcaacattatgtatcggcgcagcagccttcagtcactatgaacattggaccttcttccaggcttattattattgcttcattacactgactacaatcgggtttggagactacgttgcacttcagaaggaccaggctctgcagacacagccgcagtatgtcgccttttccttcgtgtatattctgaccggtctaacagtgataggggcatttctcaaccttgtggtgctgcgatttatgaccatgaatgctgaggacgaaaagagggacgctgaacacagggcactgctcactcgtaacgggcaggcaggcggtggaggaggcggtgggagcgctcacaccactgatacagcttcgtccaccgccgctgctggtggtggtggatttcgcaacgtgtatgctgaagttcttcactttcagtccatgtgcagctgcctttggtataagagtagggaaaaactgcagtattccatccctatgatcattcctcgagatttatctaccagcgacacttgcgtggaacagagccattctagtcccggaggcggaggaaggtactctgacactccaagtaggagatgtctttgctctggggctccacgatcagcgatatcctctgtctccacgggtctgcattcactttccactttccggggactgatgaaaaggcggtcctcggtttag

SEQ ID NO: 235584 - DNA, 816 bp, Artificial Sequence
  Description of Artificial Sequence: Synthetic coding sequence
atgtttcagagcctgggcgagcgtatcaacactctggtgaggtacctgctccaccgggcaaaaaagggactgggtatgcgtcgcgcagatgtttctatggctaatatggtgctgattgggtttttctcatgtatttccacactgtgcataggtgcagctgccttttctcactacgaacactggaccttttttcaggcctactactattgtttcataacattaacaacaatagggttcggcgactatgttgcactgcagaaggatcaggcgctacagactcagccgcaatacgtggcgttctcttttgtgtacatcctgaccggtctgacagtcatcggcgcattcctcaacctcgtggttctgagattcatgacaatgaacgctgaggatgagaagagggacgccgagcacagggccctcttgaccagaaacgggcaggccggtggtgggggagggggaggcagtgctcatactacagacacagcctcttccaccgcggcagctgggggaggcggattccggaacgtttacgcagaagtgctccattttcagagcatgtgcagttgtctgtggtataaaagcagggaaaaactccaatacagtataccaatgataatcccacgcgatctttcaacgagtgacacatgcgtggagcagtctcatagctcccccggaggcggtggaaggtatagcgataccccatctcggaggtgcctttgttcgggggcacccagatctgcaatctcgtcggtaagtactggacttcactccctctcaaccttccggggtttgatgaagcgtcgttctagtgtgtag

SEQ ID NO: 235585 - DNA, 1182 bp, Artificial Sequence
  Description of Artificial Sequence: Synthetic coding sequence
atgcggagcacaacacttctagctctcctcgccctggtcttgttgtatctggtctctggggctctcgtgttccgagccctggaacagccccatgaacagcaggcacaaagagaactcggggaagtacgggaaaaattcctgagggcccacccctgtgtgtcagaccaggagctgggacttttaatcaaagaagtcgccgatgccctcggaggcggagctgatccagagacaaatagtacttccaattcttcccactccgcatgggacttggggtctgcgtttttctttagtggtaccatcatcaccaccatcggctacggcaatgtcgccctgaggacagatgccggacgcctgttctgtatcttttacgctctggttggcattcccctgtttggtatactactggccggagtcggcgatcgtcttggctcatcattacggcacgggattgggcatatcgaagccattttcttaaaatggcacgtgcctcccgaattggtgagagtcttgtcggccatgttattccttctgattgggtgcctactgttcgtcctcactcctacattcgtcttctgctatatggaggactggagcaaactggaagctatctacttcgtcattgttactttgaccacagtgggttttggtgactacgttgctggcgcagaccctcgacaggacagtccagcataccagcctttggtgtggttctggatcctccttggcctggcttactttgcctctgtgttgaccactataggaaactggctgagggtggtgtcacgcaggaccagggctgagatggggggactgacagctcaggcggctagttggactgggacagtcaccgccagggtgacccagagagcgggaccggctgctcctcccccagaaaaggaacagccgcttcttcccccacccccttgccccgctcagcctctggggaggccacggtcgcccagcccacctgagaaagctcagcccccttccccccctaccgcttccgcgttggattacccctccgagaatctggcctttatcgatgaatcttctgacacacagagcgagaggggttgtccattgcctcgggcaccccgtggtcgcaggcggccaaaccctcctcgaaaacctgtaaggccaagaggtccgggacgaccccgagacaaaggtgtgccagtgtag

SEQ ID NO: 235586 - DNA, 1182 bp, Artificial Sequence
  Description of Artificial Sequence: Synthetic coding sequence
atgaggagcaccacactgttagcactgctggcactcgtgctgctatatctggtttctggggctctggtcttccgcgctctagagcagccccatgagcaacaggcacagcgtgaactgggagaagtgcgcgagaaatttttacgggcacacccatgcgtctccgaccaagagctgggactcctgattaaagaggttgcagacgccctgggcggaggggcagatccagagacaaattccacttccaatagctcacacagcgcctgggatctgggttccgcgttcttcttttccggcacaattattactactattgggtacggcaatgtggcattgagaaccgacgcaggcagacttttctgtatcttttatgcgctcgttgggatcccgctctttggtatcctactcgccggagtgggcgaccggcttggtagctcattaaggcatgggattggacacatagaagctatttttttaaagtggcacgtcccccctgaactggttcgggttttatccgccatgctgttcctactcatcggatgcctgctgtttgtcctgacccccacatttgtgttctgctatatggaggactggagcaagcttgaagctatttactttgttattgtcaccctgaccacagtgggtttcggcgactatgtggccggagccgatccgcgtcaggatagccctgcctaccagcctctcgtctggttttggatactactggggctagcctattttgcatctgtgctcaccaccattggcaattggttacgagtggtatctaggcggacccgcgcagagatgggtggcttaactgcccaagcagcctcttggaccgggactgtaaccgcgagggtaactcagagggccggacctgccgcacccccacctgagaaagaacagcccctgttaccccctcctccatgcccagcccagccgcttggaaggcccaggagcccttccccacctgaaaaggcccagcctccaagtccccctaccgcatctgcgctggactaccctagtgagaatcttgcttttattgatgagtcttccgatacacagagtgagaggggttgtccgcttcccagggcgcctcgtggccgaagacgtcccaatccccctcggaaacctgttcgccctcgtggcccaggacgtccgcgtgacaaaggagtgcctgtctag

SEQ ID NO: 235587 - DNA, 1182 bp, Artificial Sequence
  Description of Artificial Sequence: Synthetic coding sequence
atgcggtccaccacgctgttagcccttctggcactcgtgcttctgtatctcgtgtcgggggctctggtgtttagggctctggagcaaccccacgaacagcaggcgcagcgcgagctgggcgaagtacgagagaagttcctgcgcgcacacccttgcgtcagtgaccaggaactgggccttctgatcaaggaggtggctgacgctctgggtggcggtgctgacccagaaactaactctacttccaacagcagtcactcagcttgggatctgggcagtgctttctttttcagcggaacaattattactacaattggttatgggaacgtggccctacgcactgacgccggaaggttattttgcattttctacgcccttgttgggatcccactttttggaattctcctcgccggtgtcggcgaccggctgggttcatccctgcgtcacggaattggtcacatagaggcaatcttcctaaagtggcacgtcccccctgagctggtaagagttctcagtgctatgctgttcttgcttattggctgcctgctgtttgtcctgacacctacgtttgttttttgttacatggaggattggtccaagctggaggcaatctattttgtgattgtcactttaactacagtgggttttggggactacgtggcaggtgcggaccctcgccaggatagccctgcctatcaacctctagtgtggttctggatcttgctcggcctcgcctatttcgccagcgttctgacaacaatcggcaactggctccgcgtggtctctcgtagaacccgggctgaaatggggggattgacagcccaggctgcatcctggacaggcaccgtaacggctcgtgtcacacagagagcgggaccggctgcccctccccctgaaaaagagcagccactgttacctcccccaccttgccccgctcagcctctgggtcgccctcgaagccccagtccacccgaaaaagctcaacccccttctcctcctacggcttccgccctggactatcctagcgagaacctcgcgtttattgatgagtcttccgacacccagagcgaacgagggtgtcctctcccaagggcacccagaggccgacgtcgacccaacccaccaagaaagcccgtacgacctagaggcccaggacgccctcgcgacaaaggggtgcccgtctag

SEQ ID NO: 235588 - DNA, 1257 bp, Artificial Sequence
  Description of Artificial Sequence: Synthetic coding sequence
acaaccgctccccaggagccgcctgcccgacccctccaggccggatccggggcagggcctgcacctggtcgggcaatgagatctacaaccctgcttgccctccttgctcttgttctgctgtacctggtatcaggcgcattggtgtttagagccctggagcagcctcacgaacagcaggcacagcgggaacttggggaagtcagggagaaattcctcagggcccatccctgtgtgtcggatcaggaattgggcttgctcattaaagaggtggccgatgcccttggcggaggcgctgatcccgagacaaactccacctccaatagctcccactccgcctgggatctggggagcgcctttttcttctcaggcactatcatcaccaccatcggctatggcaatgtggctcttagaaccgatgctggcaggctgttttgcattttttatgctttggtgggtatcccactcttcggtattctcctggctggcgtgggcgaccgccttggtagcagcctgaggcatggaattggccacatcgaggccatctttctgaagtggcacgtgcctcctgaactggttcgagttctgagcgctatgctgttccttcttatcggttgcttgctcttcgttctgacccctacattcgtgttttgctacatggaagactggtctaaattagaagctatctatttcgtgattgtgaccttaacgactgtcggcttcggggattatgtcgccggtgccgatccccgtcaggattctcccgcatatcaacctctcgtatggttttggattcttcttggcctcgcctacttcgcttccgttctgactactatcggaaactggctaagagtggtgtcaagacgaacccgcgcagaaatgggaggcttaaccgctcaagccgctagctggaccggaacagttacggcacgggtcactcagcgggctggccctgcagcgcctccacctgagaaggagcagccactgttacctccccctccatgccctgctcagcccctaggtcgccctagaagcccatccccgcctgagaaggcccaacctccctccccacccacagcatcagcactggattatccatctgagaaccttgctttcatcgacgagtcgtccgatacacaatctgaacgcggttgccctttgcccagagccccacgaggcagacgcaggcccaatcccccacgaaaaccagtgagacccaggggccctggcagacctcgggataaaggcgtccctgtctag

SEQ ID NO: 235589 - DNA, 1368 bp, Artificial Sequence
  Description of Artificial Sequence: Synthetic coding sequence
gtccatgctagcgtgcataccagggtgagagggctgtgggtgccctggagaggccgtcatgcccatggcggtagagggtgtcgcggagtatgtggggaatgtaggtgggtcaccacagcgccacaggaaccccctgccagacccctgcaggctggatccggagctggccctgccccaggcagagccatgagaagcaccacactgctggctctcctggcactcgtactcctgtacttagtcagcggcgctctagtctttcgtgctctggagcagccccatgagcagcaggcacagcgcgaactcggcgaggtccgagagaagtttctgagggcgcacccgtgcgtgtccgatcaggagttaggcctgttaattaaagaggtggctgatgccctgggtggaggagctgatccggaaactaattctacttccaattccagtcattccgcttgggacctggggtccgcattcttcttcagtggcactattattacgaccatcggatatggaaacgtagcactcaggacagacgcgggtcgcctgttctgcatattttatgccttagtgggaatccctctctttggcattctgctggccggtgtaggcgacagactgggttcctctctcagacatggaataggacacattgaagccatcttcttgaaatggcatgtacctccagagttggtcagggtgctgtctgccatgctgttcctgctgattggatgcctcctcttcgtactgaccccaacttttgtgttctgctacatggaagactggtccaagcttgaagcaatatactttgttatcgtgacattgactaccgtcggatttggagactatgttgcaggcgctgaccctaggcaagacagccctgcgtaccagcctctcgtttggttctggatcctgctgggtcttgcatatttcgcttctgttttgactaccattggaaattggctgagagttgtgagcaggcggactcgagcggagatggggggtttaacggcccaggctgcatcatggacaggcactgtgacagccagggtgacgcagagggccggtcccgcagcaccacctccagagaaggaacagcccctcctcccgcctcctccttgtccagcccagccgctggggaggccccgtagtccctcacccccagaaaaggctcagccacccagtccccctacagccagtgcattggattacccttctgaaaacctggccttcattgatgagtcttccgacacccagtccgagcgagggtgccctctgccacgtgctcccagagggaggaggcggcctaatccccctaggaagccagtccgccctcgcggacccggaaggccaagggataaaggcgttcctgtgtag

SEQ ID NO: 235590 - DNA, 1500 bp, Artificial Sequence
  Description of Artificial Sequence: Synthetic coding sequence
atggtcgatagaggacctctgcttaccagcgcaattatcttttacctcgctatcggtgctgcaatcttcgaggtgttggaggagccacactggaaagaagctaagaaaaattactacacccaaaagcttcaccttctcaaggagttcccctgccttggacaggagggcctggataagatcctggaggttgtctcagatgcagcgggacagggtgtagctattaccggtaaccagacattcaataactggaactggcctaatgccatgatcttcgctgccactgttatcactacaatcggctacggtaatgtagcgccaaaaacgccggctggtcgactgttctgtgttttctatggcctgttcggcgtccctttatgcctcacctggatcagtgctctgggcaagtttttcggcggtagagccaagcgcttgggccaatttctcacaaagaggggcgtgtcgctgaggaaggcccagatcacatgtaccgtcatctttatagtttggggcgtgctggtacatcttgtaattccccctttcgtcttcatggtaaccgagggatggaactatatcgagggcctgtactactccttcattacaatttcaaccatcggtttcggagacttcgtcgccggagttaatccctccgccaattatcacgccctctatagatacttcgttgagttatggatctatctggggctggcatggttatctctgttcgtgaactggaaggtgtccatgtttgtcgaggtccacaaagctatcaagaaacggaggcggagacgcaaggaatcttttgaatccagcccccactcgaggaaggcactgcaggttaaaggctcaactgcaagtaaagatgtgaatattttctccttcctgtccaagaaagaagagacgtataatgatttgatcaagcagatagggaaaaaggcgatgaaaacgtccggtggtggcgaaactggtcccggaccgggactggggcctcagggaggagggcttccggcactgcccccaagtctggtcccgcttgtggtgtacagcaaaaacagggttccaaccctggaggaagtgtctcagactctccggagcaaggggcacgtcagtagatcccccgatgaggaggcggtggcgagagcccctgaagacagtagtcccgctccggaggtcttcatgaatcagctggatcggattagcgaagagtgtgagccctgggatgctcaagactaccatccacttatcttccaggatgctagcatcacttttgtcaatacagaagcaggcctgagcgatgaggaaactagtaagtcgtcactagaagataatttagccggagaggagtccccacagcaaggcgctgaggccaaagctcctctgaacatgggcgagttcccatcgagcagtgaaagtacatttacctccaccgagtccgagctgtccgtgccatacgaacagctgatgaacgaatacaacaaagcgaattcaccaaagggcacctag

SEQ ID NO: 235591 - DNA, 942 bp, Artificial Sequence
  Description of Artificial Sequence: Synthetic coding sequence
atgcgcagaggggctctgctcgcgggtgctttggctgcatatgccgcttacctggtgctgggggcactgctggtggctcgactggaggggccacacgaggctagattgagggccgaacttgaaaccctgcgagctcaactgttgcagcggagcccttgcgtggcagcacccgcactcgacgcattcgttgagagggtactggccgcaggtcggctaggtcgcgtggtgcttgctaatgctagtggaagcgccaacgcgtcagacccagcctgggatttcgcctctgccctgtttttcgcaagtacactgattacaacggtgggatacggatacaccactcccttgactgatgcagggaaagctttcagtattgcctttgctttgctgggggtgccaacaaccatgttactgctcaccgctagcgcccagagactcagcctactgttaacccacgtccccctgtcatggttaagcatgagatggggatgggacccccgtcgagcggcttgctggcatcttgtggcactcctgggagtggtggtcacagtttgtttcctggttccagctgtaatatttgcccatctagaagaagcctggagttttctagacgctttctacttttgtttcatctcgctgagtactattggattgggggattatgtgccgggtgaagcgcctggtcagccgtaccgggctttatacaaggttttggttactgtctatttattcctcggtcttgtcgccatggtgctggtactgcagaccttccggcacgtgtccgacctgcacggcttgactgaactgatacttctgccccctccctgcccagctagtttcaacgcagatgaagacgacagggtagatatcctgggtccccagccagagtcgcatcaacagctcagtgcgtcctcccatactgactatgccagcatcccaaggtag

SEQ ID NO: 235592 - DNA, 924 bp, Artificial Sequence
  Description of Artificial Sequence: Synthetic coding sequence
atgggaggactccgtccctggtctcgctatggcctgctggtggtcgcacatctactcgcattgggccttggggcagtcgtgtttcaggctcttgagggacctccagcatgccggctgcaggcggaactccgtgcagaactggccgcatttcaggccgagcaccgtgcctgcctgccgccaggcgcattagaggagctgctgggcacagcactggccactcaggcccacggcgtgtccactcttggcaactcttccgaaggtagaacttgggatttgccttctgcactgcttttcgctgcatccattctaacaacgacgggatacgggcatatggccccactgagtcccggtgggaaggcattttgtatggtctatgccgcactgggtttgcccgcatcactcgcgctggtggctactctcagacattgtttgctcccggtgcttagtaggcctcgggcttgggtagcggtgcactggcagctttcaccagccagggctgccctgttgcaagccgtggcgctggggttgctagtagcaagtagttttgtgctgctcccagccttggttttgtggggcctccagggggactgttccctgttgggtgctgtctacttctgcttctcttcccttagtactattggtctcgaggacctcttaccgggtcgcggtcgctcactccatcccgtcatttaccatttggggcaattggcactgttaggttacctcctgctcggactgctggcgatgctactggcagtggagaccttctctgaattgccccaggttagagcaatgggcaagttctttagaccttcagggccagtcaccgccgaggaccagggaggtattctaggccaggacgagctcgctttatcaaccttacccccagccgctcccgcttccggccaggctcccgcttgttag

SEQ ID NO: 235593 - DNA, 759 bp, Artificial Sequence
  Description of Artificial Sequence: Synthetic coding sequence
atggggggtctgcgcccttggagcaggtatggacttcttgtcgtggcgcatctgctcgcccttggcctgggcgctgtggtcttccaagctcttgagggacctccagcttgccggcttcaggcagagctccgcgcagagctggccgcttttcaggcagagcaccgagcatgcctgccccctggcgctctggaggaattgcttggtacagcactggctacacaggcccacggcgtgtctacgctcggcaattccagtgaaggtcgaacctgggacctcccgagcgctttgttgtttgcagccagcatcttgacaactacaggatatgggcatatggctccactctcccctggcggaaaggcattttgcatggtttacgcggcactcggactacctgcctcactggccctcgttgctacactgaggcattgcctcctccctgtcctttcccggcctcgggcatgggtggctgtccactggcaattgtcacctgctcgggctgccctgttgcaggctgtggctttgggcttgctcgtggctagctcattcgtgctgctgcctgcactggtgctttggggccttcagggagactgctctctgctcggagccgtttatttttgttttagctctttatctaccattggacttgaagacctccttccagggcgtgggcgaagtctgcatcctgtaatctaccatctggggcagctcgccctcctaggcggtggtacttcccttcagggcaccgcctgggagggttag

SEQ ID NO: 235594 - DNA, 774 bp, Artificial Sequence
  Description of Artificial Sequence: Synthetic coding sequence
atgggtggtctgaggccttggagtcgatatggcctgcttgtcgtggcacatctgctcgccttagggcttggtgccgttgtgttccaggccctggaaggccctcccgcatgtagactgcaggccgagcttcgggctgagctggccgcttttcaagctgagcatcgcgcttgtttgccccctggcgcactggaagagcttctaggaaccgctttagccactcaggcccatggcgtgagtaccttgggcaattcgtctgagggcaggacttgggatcttcctagcgccctgctgttcgccgcatcgatcctgacaaccactggatacggccatatggctccgctctcacccggaggaaaagcattttgtatggtttacgctgctttaggtttgccagcctccctggccctagttgctacactcaggcactgcctgttgcctgtcctctccagaccacgagcttgggttgccgtgcattggcagctcagtccggctagagccgctctgctccaggccgtggctctcggcctgctggtggcctccagcttcgtcctgctaccggctctggtcctgtggggacttcagggggattgctcacttctcggagcagtttacttttgctttagctcactatcgaccatcggacttgaagatctcctgccaggccgaggcagaagtcttcatcccgtcatttaccatctgggtcaactagcattgttgggcaaaagcagccacctcaccgcatgcggcggtcgcggaaagagatcactcgactag

SEQ ID NO: 235595 - DNA, 759 bp, Artificial Sequence
  Description of Artificial Sequence: Synthetic coding sequence
atgggagggctgcggccatggtcacggtatggcctcttggtggttgcccaccttctagccctaggattaggtgcggtggtattccaagccctggaaggccctccggcttgtaggctgcaagctgaacttagagccgaactggccgcatttcaggctgaacatcgagcctgcctgcctcccggagccctggaagagctactcggaaccgccctggccacccaagcgcatggtgtgagcactctcgggaacagctcggagggaagaacatgggatctgccctctgctcttctcttcgcggcatcgatattaacgacgacaggctatggtcatatggcccctctctctccaggcggtaaggccttctgcatggtgtacgcggcactgggtctgcccgcttcactagccctggtggctactttaaggcattgtttgctgcctgttctcagccgccctcgggcatgggtggctgtacactggcagttatcccccgcaagagccgctctgcttcaggcagtggctctgggactgctggtggctagctcattcgtgttattgcccgctctggtgctttggggtctccaaggggactgctctctgctgggggctgtttacttttgcttcagctcgctgtctaccatcgggctcgaagatctcttacccggtaggggccgtagtcttcatcctgtcatttatcacctgggtcaactcgctctcctgggaggcggtacctcactccagggaactgcttgggaagggtag

SEQ ID NO: 235596 - DNA, 87 bp, Artificial Sequence
  Description of Artificial Sequence: Synthetic coding sequence
tgactgcatcccgtgatttaccatctgggccaattagcgctgctgggaggcggaacctctttgcaggggacagcctgggaagggtag

SEQ ID NO: 235597 - DNA, 1125 bp, Artificial Sequence
  Description of Artificial Sequence: Synthetic coding sequence
atgaagaggcagaatgttcggacactttccttgattgtatgcacttttacctacctgcttgtgggggcagctgtgtttgacgcgttagagtcagaccatgaaatgagggaggaggaaaagctaaaggctgaggagattaggattaaagggaaatataacatcagtagcgaggattacagacagctcgagcttgttattttgcagtctgagcctcatcgggcaggtgtgcagtggaagtttgcgggaagtttctactttgccattaccgttatcacaaccattggatacggacatgctgcccctgggacagacgcaggcaaggccttttgtatgttctacgccgtgctcggcatcccactcaccttagtcatgtttcagtcactcggagagagaatgaacacgttcgtgcgatatttactgaagaggatcaagaagtgctgtgggatgaggaatacggatgtgagcatggagaacatggttactgtgggattcttcagctgtatgggaactctgtgcatcggggctgccgcattctcccagtgcgaagaatggtcttttttccacgcctattactattgctttataacattgaccacaattggctttggcgattatgtcgctttgcagactaagggggctttgcagaaaaaacccctctatgtggcgttctccttcatgtatattctcgttggcttaacggtgatcggagcttttttgaatctagttgtgctgagatttctcacgatgaacagcgaagacgagagaagggatgctgaggaaagagcaagtttggcgggtaatcgaaacagcatggtcatccatatcccagaggagcccaggccatcccggcctagatacaaagctgatgtgcctgatctccaaagtgtgtgcagctgcacatgctatcgaagccaggactatggtgggcgttccgtggcgcctcagaacagcttctccgcgaagttggctccgcactattttcactcaatcagttacaagatcgaagaaatttctccgagcacactgaaaaactcactctttcccagccccatcagctcgatctccccaggactgcacagtttcactgatcatcaaagactaatgaaacgcaggaaatccgtgtag

SEQ ID NO: 235598 - DNA, 1125 bp, Artificial Sequence
  Description of Artificial Sequence: Synthetic coding sequence
atgaaaagacagaacgtgcgcaccctttcacttatagtatgcacgtttacctatctgctcgtcggggctgccgtatttgacgctttagagtccgaccatgagatgcgggaagaggagaaactcaaggccgaagagattaggataaagggcaagtataacatctccagtgaggactatcgccagctggagctggtcatcctccaatctgaacctcatcgagctggcgtacaatggaagttcgcaggttctttctactttgctatcacagtgatcacgaccattgggtacgggcatgctgcaccaggtacagacgcaggcaaggccttctgcatgttctatgcggtgctcgggattcccctaacactagtgatgttccagtcacttggcgaacggatgaatacttttgttaggtacctgctgaaaagaatcaagaagtgctgtggcatgagaaatacagatgtgagcatggaaaacatggtgaccgtggggtttttttcatgcatggggaccctgtgcatcggtgcagcggcttttagccaatgcgaagagtggtcatttttccacgcctattactattgtttcatcactctgaccaccatcggcttcggggactatgtcgcccttcaaaccaaaggagccttgcaaaagaaacccctgtacgtggcattctccttcatgtatatactggtgggacttaccgtgataggcgcttttctcaatttggtggtgctgcgcttcctgacgatgaatagtgaggatgaaagacgggatgcagaagagagggcctctctggcaggaaatcgcaacagcatggttattcacattcctgaggagcctaggccgagccggccacggtataaggcggatgttcctgacctgcagtcggtttgtagttgcacttgttatagaagccaggactatggaggtagatctgtggctccccagaattccttttccgctaaacttgccccacattattttcattctatttcctacaaaatcgaagaaattagcccctcgaccctcaagaattcactgttcccttcccctatcagctcaattagccccggactgcacagtttcaccgatcatcaaagactgatgaagagacgtaagagtgtctag

SEQ ID NO: 235599 - DNA, 1125 bp, Artificial Sequence
  Description of Artificial Sequence: Synthetic coding sequence
atgaagcggcagaacgtaagaaccctgtcgctgatcgtttgtacttttacgtatctactggtaggtgcagctgtgttcgacgctctcgaatctgatcacgaaatgagggaggaggagaagttaaaagctgaggagatcagaatcaagggcaagtacaatatcagttccgaggactaccgccagctcgagcttgtgatcttgcagagcgaacctcaccgcgctggcgtgcagtggaaattcgccggaagtttttattttgccattacagtgattactactataggatacggccacgctgccccaggcactgacgctggcaaagcgttttgcatgttttacgcagttctgggcatccccctgaccctggtcatgttccagtctctcggtgaacggatgaacactttcgtgagatacctcctcaaacgcatcaaaaagtgctgcggcatgaggaatacagacgtgagcatggaaaatatggttactgttggttttttcagctgcatggggacactgtgtatcggcgcagccgctttctcccagtgcgaggagtggtccttttttcatgcttattactattgtttcattactctgactactataggctttggagactatgtcgcccttcagaccaaaggtgcactccagaagaagccactgtacgttgctttctcttttatgtatatcctggtgggtttaacagttattggtgcattcctcaacctggttgtgctgcgatttctgaccatgaactctgaagacgaaaggcgggacgcggaagaaagggctagcctcgccggaaaccgcaattccatggttatccacatccccgaagaacccagaccctcacggccacgctataaagctgatgtgcctgacctgcaatcagtatgtagttgtacttgttaccgatctcaggattacggaggcagatctgtcgcccctcagaattccttcagcgctaaactcgcaccacactactttcacagcatctcctataaaattgaagagatctccccgtcgactctgaagaactctctcttccctagccccatctccagtatctctcctgggctgcacagctttacagaccatcagcgactgatgaagaggcgaaaatccgtgtag

SEQ ID NO: 235600 - DNA, 3693 bp, Artificial Sequence
  Description of Artificial Sequence: Synthetic coding sequence
atggcacgcgcaaaactgccaagatctccctccgagggaaaagctggtcctggaggcgctcccgcaggcgctgccgcaccagaagaaccacatggcctgtctcccctgttgccagctcgcggtggtggctctgtggggtctgacgtgggccagcggctgccagtcgaagacttttccctggatagttcacttagccaggtgcaggtcgaattttatgtgaatgaaaatacttttaaggagagactgaagcttttctttattaagaaccagaggtcttcccttcggatacgactgtttaacttttcactgaagttactcacatgccttttatacatagttcgggtcctgttggatgatccagccctgggtatcggctgctggggttgtccaaaacaaaattattcctttaacgacagcagctctgaaatcaattgggcacccatcctgtgggtggaaagaaaaatgaccctctgggcaatccaggtgatagtggcaatcatctcctttctagagaccatgctgctgatatatttaagctacaaaggcaatatttgggaacagatctttcgtgtttcgtttgtactagagatgataaatacccttccttttattatcacaattttctggcctccactgaggaacttattcattcccgttttcctgaattgctggctcgcaaaacatgccctggaaaacatgattaacgattttcacagagccatactgcgcacgcaatcagccatgttcaaccaggtgctcatcttattctgcacacttctgtgccttgtcttcactggaacgtgtggcatacagcacctagagcgtgctggcgagaatctgtccttactcacttccttttatttctgcatagtcactttctccacagtcgggtatggagatgtgacgcccaaaatatggcctagtcaattgctcgtggtgattatgatctgtgtggcactggtagtgctgcccctgcaattcgaagaattagtctacctgtggatggagcggcagaagtctggcggaaactactctagacacagagcgcagaccgaaaaacacgtggtactgtgtgtttcttctttgaagatcgatttgctgatggacttcttgaatgagttttacgcacatccacggctccaggattactatgttgtgatactgtgcccaaccgaaatggatgtccaagtgagaagggttctccagattcccctctggagccaaagggtgatctacctacaagggtctgctcttaaggaccaggacctaatgcgagccaaaatggacaatggcgaagcatgtttcatcttaagttctcgcaatgaggtggaccggactgcggctgatcaccaaaccatcctaagagcctgggctgtcaaggattttgcaccgaactgtccgctgtatgtccagatactcaaaccagagaacaagtttcatgtgaagtttgctgatcacgtagtctgtgaagaggaatgtaagtatgccatgctggcactcaactgcatctgccccgctacaagtacgctgatcacattactagtccatacttcgagagggcaagaaggccaagaatccccggagcaatggcagcgaatgtatgggagatgctccggaaacgaggtgtatcacattaggatgggagatagtaagttcttcagagagtatgaaggcaagtcatttacttacgctgcgttccacgctcacaaaaagtatggtgtgtgccttatcggcttaaaaagggaggacaataagtctatcctgctgaatccaggcccacgccatatactggccgcttccgatacttgcttctatatcaatatcacaaaggaggaaaactccgcatttattttcaaacaggaggagaaacggaagaaacgagccttctctgggcaggggttgcatgagggaccagccagattgcctgtacattccatcatagcgtccatgggcaccgtcgcgatggacctgcaaggaaccgaacatagacctacccagtctggtggcggtggtggagggtccaaattggcactgcccacggagaatggcagtggatccaggcggccttcgattgcgcctgtactggaacttgctgattcaagtgccttattgccctgcgacttactaagtgaccagtccgaagacgaagtaaccccaagtgacgacgagggactgagtgtcgttgaatacgttaagggttacccgccaaacagcccatacatcggcagctcccctacgctctgccatctgctccccgtgaaggctcccttctgctgtttacggctcgacaaagggtgcaaacacaattcttacgaggacgcaaaagcatacggcttcaagaataagctaatcattgtgagtgcagagactgcaggcaacgggttgtacaacttcatcgtgccgttgagagcttattatcgctccagaaaggagctgaaccccatcgtgctcctgcttgacaacaaaccggaccatcattttcttgaagcgatctgttgttttccaatggtctactatatggaggggtcagtggataatttagatagcctgcttcaatgtggcatcatctatgctgataacctcgttgtagtcgataaggaatccactatgtcggctgaagaggactacatggctgatgccaaaaccattgtgaatgtgcagacaatgttccgcttgttcccaagtctgagtataaccaccgagcttactcatccgtcaaacatgcgttttatgcaatttcgggctaaggattcttactcgctggcattgtctaaactggagaagcgggaacgcgagaacggctctaacctcgcattcatgtttagacttcctttcgccgctggacgtgtcttcagcatctccatgctggacaccctcctgtaccagagtttcgtgaaggactacatgatcactatcacccggctgctgctggggctggataccacgccaggctctggatatttgtgcgcaatgaagatcactgaaggtgatctgtggatccggacatatgggagactgtttcagaagctgtgtagttcaagcgccgaaatccccatcgggatttatcggaccgagtcccatgtatttagtacttccgaaagtcagatcagcgtcaacgtcgaagactgcgaggacacaagggaagttaaaggcccttggggcagccgagccggaaccggtggatcaagtcagggacgccataccggagggggagacccagcagagcaccctctcttgcgccgaaagagcttacagtgggctagacggctctcccggaaggcacccaagcaggccggtagagcggcagccgcagaatggattagccaacagcgattgagtctttacaggcgttcagaacgccaggaactttccgagttggtgaagaatagaatgaaacacttggggttacctacaacagggtacgaagatgtggctaacctgacagcatcagatgtaatgaaccgggtgaacctgggctacctgcaggatgagatgaacgaccaccagaatacattgagttacgtgctgattaatccccctcccgacacaaggctggagcctagtgatatcgtgtatctgattcgtagcgatccactggcgcatgttgcctcttcttctcagtcccggaagagcagttgtagtcacaagttgagctcctgcaacccagagacccgagatgagacacaactatag

SEQ ID NO: 235601 - DNA, 3771 bp, Artificial Sequence
  Description of Artificial Sequence: Synthetic coding sequence
atgcccctgcctgatggcgcaagaacccccggaggagtgtgtcgggaagcacggggtggcggttataccaacagaacgtttgaattcgatgatggacagtgcgcgccaagacggccatgtgctggggacggagccctcctagacaccgccggattcaagatgagtgacttagacagcgaagtgctacctcttcctcctcggtaccggtttcgtgacctattactgggcgaccccagtttccagaatgatgacagggtgcaagtcgagttttacgttaacgagaataccttcaaggagcgccttaaactgttcttcattaaaaatcagaggtcctctctgagaattaggctgttcaacttcagcctgaaactgctgacatgtctgctatacatagtgcgagtgttgcttgacgacccagcgctggggataggctgttggggatgcccaaaacagaactactcctttaatgactccagttcagagattaactgggccccaattctatgggtggagagaaagatgaccctatgggcaattcaggtgatcgtcgcaatcatcagctttctggaaaccatgttactcatctacctctcctataagggcaatatatgggaacagattttccgcgtgtcattcgtacttgagatgatcaacacgttacccttcattatcacaattttttggccacccctgagaaacctgtttattccagtcttcttaaactgttggctcgcaaagcacgccctggagaacatgattaatgattttcatcgggctattttacgcacgcaatccgctatgttcaatcaggtactgattctgttttgcactcttctctgtcttgtctttactggaacatgcgggattcagcaccttgaaagagccggtgaaaatttatctctgttaacctccttctacttctgcatcgtgaccttttctacagtggggtacggggacgtgactcccaagatttggccctcccagctcttggtggtgatcatgatttgcgtcgctctggtggtgctccctctgcagtttgaagagctcgtgtatttatggatggagcgacagaagtctggaggcaactactcccgacaccgagcacaaacagaaaagcacgtggtcctgtgtgtgagcagcttgaaaatcgatcttttgatggattttctgaatgagttctacgcccatccacgtctgcaggattactatgtggtcattttatgccccacagagatggatgttcaggttagaagagtgctccagatccccctgtggagccagcgcgtcatatacctgcagggtagcgcccttaaagaccaggatcttatgagggcaaagatggacaacggagaggcatgcttcattctgtcttcaagaaacgaagtggatcggaccgcagcggaccatcagaccatccttagagcctgggcagtgaaggactttgcccctaactgccccctgtacgtgcagatcttaaagcccgagaacaaattccacgtgaaattcgcagatcacgtcgtgtgtgaggaagaatgcaagtatgctatgctggcccttaactgtatctgccccgctactagcacactcataaccctccttgtgcatactagcagaggtcaagaggggcaggaaagtcctgagcagtggcagcggatgtacggtaggtgctccggaaacgaagtgtatcatattcgcatgggtgacagtaagttcttccgagaatacgagggaaagagctttacttatgctgctttccatgctcacaaaaagtacggtgtgtgtctgattgggctcaagcgcgaggacaataaaagtatcctgttgaatccaggccctcggcacatcctggcggcatctgatacctgtttctacatcaacataactaaagaagaaaacagcgcattcatcttcaaacaggaggagaagcggaagaaacgagccttttctgggcagggcctgcatgagggcccagcaaggctgccagtgcattcaatcattgccagcatgggcactgtagctatggaccttcaggggaccgaacaccgtccaacacagagcggcggaggcggaggcggttctaagctcgccttgccgaccgagaacggttcaggctccaggagaccttccattgcgcctgtcctcgagcttgccgactcctctgccttgcttccttgcgaccttctgagcgaccagtcagaggacgaggtgacccccagtgatgacgagggattgtctgtcgtagaatacgtgaagggataccccccaaactctccgtacattggctcctcccccaccctttgccatcttctgccagtgaaagccccattttgttgtctgagacttgacaagggctgcaagcataactcttacgaagatgctaaggcttatgggttcaaaaataagttgattatagtgtcagcagagactgctggaaatgggctgtataactttattgtcccactccgggcttactaccggtctaggaaagaactgaacccgattgtgttactgctggacaacaaacctgaccatcatttcctggaggccatatgttgttttccaatggtttattatatggagggaagcgtcgacaatttagactccctgctgcagtgtggtataatctatgcggataacttggttgtggttgataaagagtctaccatgtcagccgaggaggactacatggccgatgctaaaaccattgtcaatgtacaaacaatgtttcgtctttttccctctctcagtatcaccaccgagcttacccacccctcaaatatgcgctttatgcaattccgagctaaggattcgtacagtctggccttgagcaaacttgagaaacgagagagggaaaatggcagtaacttagcctttatgttcagactcccatttgccgctggcagagtattcagtattagtatgcttgacacacttctataccagtcctttgtgaaggattatatgatcacgataactcggcttctcctgggattggacactactcctggatccggctatctgtgtgcgatgaagatcacagagggagacctgtggatccgcacatatgggagacttttccagaagctgtgttcttccagcgctgaaatcccgatcggaatttatcgcacggaatcccatgtctttagcacctctgagccgcacgacttgagagctcagtctcagatttcggtcaacgttgaggattgtgaagatactcgcgaggtaaagggcccttggggctcgcgggcaggcacgggtgggagttcccagggaaggcatacaggcggaggtgacccagcagagcatccccttctgagacggaagagcttgcagtgggcacggagactttctcggaaagctccaaaacaagccggacgggcagccgcagctgagtggatctctcagcagcgcctgagtctgtataggcgatccgaacgtcaggaacttagcgaactggtgaagaacaggatgaaacatttggggctgccgacaacaggctatgaggatgtggcaaacctgaccgcctccgatgttatgaaccgcgtcaatcttgggtacctgcaggacgaaatgaacgaccaccagaataccttaagttacgttctgatcaatccccctcctgacacgaggctggagccctccgatatcgtgtatctgattagatcagaccccctcgcgcatgtggcttcttcgtcccagtctaggaagagctcctgctcgcacaagcttagctcatgtaaccccgaaacccgagacgagacgcagctttag

SEQ ID NO: 235602 - DNA, 3708 bp, Artificial Sequence
  Description of Artificial Sequence: Synthetic coding sequence
atgcctctgcccgacggcgcaaggactccgggtggggtgtgcagggaggctcgaggcggaggctacactaatagaacattcgagtttgacgatgggcagtgtgccccacgaagaccttgcgcaggagacggggctcttttggacacagcaggattcaaaatgtcagatttggattctgaggtgctgcctctccccccaagataccgcttccgcgacttgctgctgggggacccaagcttccagaatgacgacagggtgcaggttgaattttacgtcaacgaaaataccttcaaagaacgccttaaactcttcttcattaagaatcagaggtcctccttacgtatccggctgttcaacttttcgttgaaactgctaacctgtctcctgtatatcgtccgggtgctgctggacgaccctgcccttggcatagggtgctggggatgcccaaagcagaattacagctttaatgattccagcagtgaaatcaactgggcacctattctgtgggtagagagaaagatgacgctgtgggcaatacaggtgattgtagcaattattagtttcctggaaactatgctgctgatttacctttcttataaaggtaacatctgggagcaaatattcagagtgtcttttgtgttggagatgattaatacactgccctttatcatcacgatcttctggccgccactgcggaacctgttcattcccgtgttccttaattgttggctggcgaaacatgccctggagaatatgatcaatgactttcaccgtgcaatactgagaacccaatctgctatgtttaaccaggtactcatcctgttttgcacactgctctgccttgtattcacgggcacgtgcgggatccagcacttggagagagccggagaaaacctatcactgctgaccagcttttatttttgtatcgtgacattctccaccgtgggctacggtgatgtcactccgaaaatatggcccagccagctgctagtggttatcatgatctgcgttgccttggttgtcttacctctccagttcgaagaactggtgtacctgtggatggaacgacagaaatccgggggaaactattctcggcatcgggctcagacagagaagcacgtggtgctctgcgtctcttcactgaaaatcgatctgctgatggatttcctgaacgaattctatgcacatccgaggctacaggactactacgtcgtcattttgtgccctacagaaatggacgtgcaggtaagaagagtcttgcagatcccactatggagtcagagggtcatctaccttcaaggatccgccctaaaagaccaggacttaatgcgggctaaaatggataacggggaagcctgcttcatcctttctagcaggaacgaagttgatcgtaccgcagccgaccaccagactatcttacgtgcatgggctgtgaaggactttgctcctaattgtccactctatgtgcaaatcctgaaacctgaaaacaagttccacgtaaaattcgccgatcacgtcgtttgcgaagaagagtgtaagtatgccatgttagctctcaattgcatttgcccagccacttccacgttaatcacactgttggtacacaccagtcgaggccaagagggtcaagagagtcccgaacagtggcagaggatgtatggacggtgcagcggaaatgaggtctaccatatccgtatgggagacagcaagttctttagggaatatgagggcaagagcttcacttacgccgcttttcacgcccataaaaagtacggagtttgtctgattgggttgaagagggaggataataagagcatattgttaaaccctggacctaggcacatcctagctgcttctgatacttgcttctatataaatatcactaaggaggagaattctgccttcatattcaaacaggaggagaagcgaaaaaaaagagccttcagtgggcagggcctccacgaggggcctgcaaggctgcctgttcattccattatcgccagcatgggaacagttgctatggatctgcagggaactgaacacagacccacacaaagcggtgggggaggtggtggaagcaagttagcgcttcctacagaaaacggctcaggtagtcgtagaccctcaatcgctcctgtgctcgaactggccgactcttccgcgctgttgccctgcgatctactcagcgaccagtcagaggatgaagtgacaccgagcgacgatgaaggacttagtgtagtggagtacgtcaagggatacccccctaattccccgtatatagggtcttcacctaccctgtgccatctcttgccagtgaaggctcccttctgttgcctcaggcttgataagggttgtaagcataattcttacgaagacgcgaaggcttacgggtttaaaaacaagctcattatcgtgagcgctgagacggctggcaatggtctatacaatttcattgttcccctcagggcctattatagatctagaaaggagttgaacccgatagtcttactacttgataacaagcccgaccatcacttcctcgaagcaatatgctgtttccccatggtttactacatggaggggagcgtggacaatctggattcactactccagtgcggcatcatttacgctgacaacctagtggtggttgataaggagtcaaccatgagcgccgaggaagattacatggccgatgcgaaaactattgtgaatgtgcagaccatgttcagactctttccgagcttgtccatcactacagagttaacccacccctctaatatgcgattcatgcagtttagggccaaggactcctatagcctcgcactgagtaagcttgagaagagagaacgcgaaaatggctccaatctagcatttatgttcaggctccctttcgccgcagggagggtcttctctatctcaatgcttgacacactcctgtaccagtccttcgtaaaggactatatgataactattacccgcttgctgctggggctggatactacccctggatccggctacctgtgtgcgatgaagatcactgagggcgacctgtggatccgaacctatggtagactgtttcagaaactatgctcatcctctgcagaaattcccatcggcatttacagaactgagtcccacgtctttagtacatctgagccgcacgatctgagagcccagtcgcagatttccgtaaatgtcgaggattgcgaggacactcgcgaggtcaaaggcccttgggggagtagggcaggtaccggcggatctagccagggtagacacaccggcggaggggatcctgctgaacatcctctgctgagaaggaagagcctgcagtgggcgcgacgcctaagcaggaaggcccctaagcaggctggtcgcgctgccgctgctgagtggattagccagcagcgtttaagtctgtatcgaagaagcgaaaggcaggaactgtccgaactagtgaagaaccggatgaagcacttggggcttccaaccacggggtacgatgaaatgaacgatcatcagaacacactgagttacgttctcatcaacccacctccagatacgcggctagagccatcagacattgtgtatctaatccgtagtgaccctcttgctcacgtggcttctagcagtcagtcccggaaatcgtcctgctctcacaaactctcttcttgcaaccccgagacccgcgatgagacccagctgtag

SEQ ID NO: 235603 - DNA, 3408 bp, Artificial Sequence
  Description of Artificial Sequence: Synthetic coding sequence
atggttgacttggagtccgaggtgccgcctttacctccaaggtacagattccgagatctcctccttggcgatcaggggtggcagaacgatgatagggtccaggtcgagttctatatgaatgagaatacctttaaggagaggctcaagcttttttttataaagaatcagcgttcttccttgcgcattagactcttcaatttcagtctgaaactgctgagttgcctcctgtatattatccgagttcttctcgaaaacccatctcagggaaatgaatggtcccacatcttttgggtgaaccgcagtctacctctgtggggactgcaggtgagcgtggccctgatctctctcttcgaaaccattttactgggttatctttcgtataaaggcaacatctgggagcagatattacgcataccattcattttggagatcatcaatgccgtacctttcattatttctattttctggcctagtctcagaaacctgtttgtgcccgtcttcctgaattgctggctggcgaagcacgcgctggaaaatatgattaacgacttgcatcgtgcaatccaacggacccagtctgctatgttcaaccaggtgctgatacttatcagcacccttttatgcctcattttcacctgcatctgcggaatacagcacctggaaaggatcggcaagaagctgaacctgtttgatagcctttacttttgtatcgtgacattcagcacagtcgggttcggggatgtgactcctgaaacttggtccagtaagctcttcgtggtagcgatgatttgtgtagccttagtggtgttaccaatccaattcgaacagctggcatacctgtggatggagcggcagaagtccgggggaaattactccaggcacagggctcaaaccgagaaacacgtggttctatgtgtgtcatccttgaagatcgacctgctgatggatttcctgaacgagttctatgctcaccctcggctgcaggattactacgtcgtgatcctgtgcccaacagaaatggatgtccaggtacggagagttctccagatcccaatgtggtcccaaagagtgatttatctgcaagggtctgcactgaaggatcaggatttgctaagggctaagatggacgacgcagaggcgtgtttcatcctgtcttctcggtgtgaggtggatcgcacttcgagcgaccatcaaaccatattgcgtgcctgggccgtgaaagattttgcccctaattgccctttgtacgtccagatcctgaagccagagaataagttccatattaagtttgccgaccatgtggtatgtgaggaggaattcaagtacgctatgctggctttgaattgcatttgccccgcaacctctactttgataaccctcttggtgcacacctctagaggacaagagggccagcaatcccctgagcagtggcagaagatgtatgggcgatgtagtggcaacgaggtgtaccacatcgtgctagaggagtctactttcttcgccgaatacgaaggaaagtcatttacatacgcctcttttcacgcccacaaaaaatttggcgtgtgtctcatcggggtgagaagggaagacaataaaaacatcttgttaaatccgggaccgcgatatattatgaacagcaccgatatttgtttctacattaacattacaaaggaggagaactcagccttcaaaaatcaagaccagcagagaaagagcaatgtgtcgcggtccttctaccacggcccttcccgcctgccagttcactccataatagcctctatgggcacagtggcaattgacctccaggacacctcttgtcgttccgctagcggcccaacactgtcacttccgacggagggttctaaggaaatacgaagaccaagcatagcaccagtgcttgaagtggcagacacctcaagcatccagacctgcgatcttctgtctgatcagtccgaggatgaaacgactcccgatgaagaaatgtcatcgaatctggagtacgccaaaggttaccctccctacagcccctacattggtagcagtccaacattctgccatctgctccacgaaaaggtgccattttgttgcctgcggctggacaaatcctgccagcacaactattacgaggatgccaaggcatatggattcaagaacaaattgatcatcgtggctgccgagactgcgggtaacggattatacaacttcatcgttccgttgcgcgcatattatcggccaaagaaagaactgaaccccatcgtcttgctgttagacaacccccctgatatgcatttcctggacgccatatgttggtttcctatggtctattacatggtcgggagcatcgacaacctggatgatctcttacgctgcggagtgaccttcgcagcgaacatggtggttgtagataaggagtccactatgtcagcagaagaagactatatggccgacgcaaagacaattgtgaacgtccaaacactgtttcgtttattttccagtttaagcatcataactgagcttacgcaccccgcaaatatgaggttcatgcagttccgagccaaagactgttattcactggccctctcaaaactggaaaaaaaggagagagagcgcggtagcaacctggcctttatgtttagacttccgttcgctgctggacgggtctttagcatatcaatgctggacacactcctgtaccagtcctttgtcaaggattacatgatttccattactaggctcttgcttggtttggacaccactccaggcagcggatttctctgctctatgaaaattacagcggacgatctgtggatccgtacctacgctagattgtaccagaaactttgtagctccaccggagatgtcccaataggaatctataggactgagagccagaagctgaccacttcggaatctcagatctctattagtgtcgaggagtgggaggacactaaggactccaaagaacagggtcatcaccggagcaatcatcggaactcgacatcatctgaccagtctgaccaccctctgctccgaaggaagagcatgcagtgggcgagacgtctgtcccgcaagggacccaagcattccggtaaaaccgctgaaaagattactcaacagcgtctcaatctttaccggcgtagcgagagacaagaactggcagagctagtcaagaatcgcatgaaacatctggggctgtctacagtgggctacgacgaaatgaacgatcaccagtccaccctttcctacattctgatcaatcccagtcctgatacacgtatcgagcttaatgatgtggtctatctgataagaccagatcccctcgcatacttacctaactctgagccttctaggcggaacagtatttgtaatgtgacggggcaggattcccgcgaggaaactcagctctag

SEQ ID NO: 235604 - DNA, 3210 bp, Artificial Sequence
  Description of Artificial Sequence: Synthetic coding sequence
atggtggacctcgaatcggaagtgccaccactcccaccccgatatcggtttagagatctcctgctgggggatcagggctggcagaatgatgatagggtgcaagttgaattttatatgaacgagaataccttcaaagagaggctcaaactatttttcataaagaatcagcgctcctccctacgtatacgtctctttaacttttctctgaaactcttgtcctgcctcttgtacataatccgggtcctcctcgagaacccatcgcagggtaatgagtggtctcacattttttgggtgaacagatccctgccactctgggggcttcaggtttcagttgccttgatttccctgtttgagaccatcctgcttggatacctgagttacaagggcaacatttgggaacagattttgcgcatcccattcattctggagatcatcaacgccgtgccttttatcatcagcatcttttggccatcattacgtaatctgttcgtcccagtctttctgaactgttggctagccaaacacgctttggaaaatatgattaatgacttacatcgagccattcagaggactcaatctgccatgtttaatcaggttttgatcctcatatctactctgctctgcctgatcttcacctgcatttgcggtattcagcatctcgagaggatcggcaagaaactgaacctgtttgattcattgtacttttgcatcgtgaccttcagtacggtgggattcggcgatgtgactcccgaaacttggtcctccaaactattcgtagttgccatgatttgcgttgcactggtggtactgcctattcagtttgaacaattagcttatctgtggatggagcgccagaaatcaggtggaaactattcacgccatcgggcacagactgaaaaacacgtggtgctttgcgtgagcagcctcaaaatcgatctcctgatggacttcctgaacgagttttacgctcatccgcgactgcaggattactatgtagtcattctttgccctaccgagatggacgtgcaagtgagacgggtactgcagattccaatgtggagtcagcgcgtgatctatttgcaggggagtgcacttaaggaccaagatctgttgcgtgcaaaaatggatgatgccgaggcttgttttatcctgtcttctagatgcgaagtcgatcggacctccagcgaccatcagacgatcctaagagcctgggccgtgaaggacttcgctcccaactgtcctctttatgtccagatcctcaagccagagaacaaattccacattaaatttgcagatcacgtagtctgcgaagaggagtttaagtatgccatgctggcgctgaactgcatttgtccggctacaagcaccttaattaccttgctcgtccatacgtcaaggggccaatttggcgtgtgtctgattggtgtgagaagggaagacaacaagaacattttgctgaaccctggaccgaggtatatcatgaactcaaccgatatttgtttctacataaacattacaaaggaggaaaattctgcttttaaaaatcaagaccagcagcggaagtcaaacgtttctcgaagtttctatcacggaccaagcaggctgcctgtgcattccattattgccagcatgggaactgtagcaatcgatctccaagacacatcctgcaggtcggcctcgggcccaaccctgagtctccctaccgaaggatctaaggaaattcgccgacctagcattgctcccgtactagaggttgctgacacttcctcaattcaaacttgtgaccttctgtccgaccagagcgaggacgaaacaacccccgatgaggagatgtcatcaaacctagaatatgccaaggggtatccaccctactccccatacataggctcttctcccactttttgccacctgttgcacgaaaaagtgcccttctgctgtttgcggctggacaagtcttgccagcataattactacgaggacgccaaagcctatggctttaaaaataagctcattatcgtagcggcagaaacagcgggaaacgggttgtataacttcatcgtgccactgagggcctattaccggccaaagaaagagctgaaccctatcgtgctactccttgacaacccacttgatgatctgctacgctgcggcgtaaccttcgctgccaatatggtggtggtggataaggagtccactatgagtgccgaagaagattacatggccgacgcaaagactattgtgaacgtacaaaccctcttccgcctcttcagtagtctctcaatcattactgagctcacgcacccagccaacatgcgatttatgcaatttagggccaaggattgctattctctggcgctgtctaaactcgagaagaaagaacgcgaaagaggaagcaatctggcatttatgtttcggttaccattcgccgcagggcgagtattttccatttctatgctggacaccctcctctaccagtctttcgtgaaagactatatgatcagcataacccgcctccttctggggctggatacgaccccagggtcgggtttcctttgctccatgaaaatcaccgcggacgatttatggatacggacttacgccagactctatcaaaaactgtgtagttccactggcgatgttcccatcggaatctatcggactgagagccagaaactgacaacttctgaagagacatacattttaattttcctgtcacaaattagcatcagcgtcgaggagtgggaggacacaaaggacagtaaggaacagggtcatcatagatcaaaccacagaaattccacctcctccgaccaaagtgaccaccctctgctccgcaggaagagcatgcagtgggcacgcagacttagccgcaaaggtcccaagcatagcggaaaaaccgcagaaaaaatcacacagcagcgtctgaatttgtatcggaggtccgaaagacaggaactggccgagcttgtgaaaaaccgcatgaagcatttgggcttgagcacagtcggttacgacgaaatgaacgatcaccagtcgactctatcttatatcctgataaatccctctccagatacccgcatcgagctgaacgatgtcgtttacttaatacgaccagaccccctcgcatatttaccgaattcggagcctagccggcgaaacagcatttgtaatgtgacaggacaggactcacgcgaagagacccagctgtag

SEQ ID NO: 235605 - DNA, 3336 bp, Artificial Sequence
  Description of Artificial Sequence: Synthetic coding sequence
atggttgacttggagtctgaagttcctcccctgccaccgaggtaccgtttccgcgatttgctgctgggggaccagggttggcagaacgatgacagagttcaggtggagttctatatgaatgaaaatacatttaaggagcgcctaaaattgtttttcatcaaaaaccagaggtccagcttgcgcattaggctattcaatttctcattgaagttactgtcctgcctgctatatatcatccgtgtgctactcgaaaaccctagtcagggcaatgaatggtcccacattttctgggtgaatcgaagtctgccgttgtgggggctgcaggtgagtgtggccctaatctccctgtttgaaacaattctgttggggtatctgtcttataaaggtaatatctgggagcaaattctgaggatcccattcattctggaaatcatcaacgcagtgccattcatcatatccattttctggcccagcctaaggaacctgttcgtgcccgtgtttctcaattgctggctagcgaaacatgcgctcgagaatatgatcaacgatttgcaccgggctattcagagaacccaaagtgctatgttcaatcaggttttgattctgatttccaccttactgtgcctgatcttcacttgcatctgcggcatccagcatttagagcgaataggcaagaagttaaatcttttcgattccctgtatttctgtatcgttaccttctctactgtaggctttggggacgtgacccccgaaacctggagcagtaagctgttcgtggtcgctatgatctgcgttgccttggttgtcttaccaatacagttcgaacagctagcatacctctggatggaacgccagaaaagcgggggaaattacagccggcaccgggcacagaccgagaaacacgtagtgctgtgcgttagtagcttgaagatcgacttgctgatggactttctgaacgaattctatgcgcacccaagactgcaggactactacgtagttatcctgtgtcccaccgagatggacgtccaggttagacgggtgctgcagatccctatgtggtctcagagggtcatatatctgcaggggtccgccctgaaagaccaggacctgttacgcgctaagatggatgatgccgaagcctgtttcatcctatcttcgaggtgtgaggtagaccggacatcgtccgaccatcagacgatcctgagagcctgggccgtgaaagactttgcaccgaattgcccactgtacgtccaaatccttaaaccggagaataagttccatattaagttcgctgatcacgtagtgtgtgaggaggagttcaaatacgcgatgctggcactgaattgcatttgccctgctacctcgacccttatcacacttctcgtgcacaccagcagagggcaggagggccagcagagtcctgaacaatggcagaagatgtacggcagatgttcgggcaatgaggtgtatcacatagtccttgaggaaagcaccttcttcgccgaatacgaggggaaaagcttcacctatgccagctttcatgcccacaagaagtttggcgtgtgtttgatcggggtgcggcgagaggacaataagaacattcttctgaaccccggaccgaggtacataatgaatagcacggacatttgcttctacattaacatcaccaaggaggagaattcggcttttaaaaatcaggatcagcaacgcaagtccaatgtgtctaggtccttttatcacggcccaagtagactcccagtccacagcataatcgcttccatgggcacagtcgccattgacctccaggatacatcgtgccgctcagcctctggcccaaccctatcgctcccaactgagggatccaaagagatcaggcgacctagtatcgcccctgtcctggaagttgcagatacctcctctattcagacctgcgatctcctttcagaccagtctgaagacgaaactacgccggatgaagagatgagctctaatctggagtacgctaaaggctacccaccatatagtccctatataggctcatcccctaccttttgtcatctgctgcatgagaaggtgccgttctgctgtctgagactcgataaatcctgtcaacataactactatgaggacgcaaaagcatatggattcaagaacaaactgataatcgtggcagcagagaccgccggtaatggcttgtataatttcattgttccactccgtgcttactataggcccaaaaaagaactgaatccgatcgtcctgttgttggacaaccccctggacgacctcttacggtgtggcgtcacatttgcagctaacatggtggtcgtggataaagagtcaaccatgagtgcggaggaggactatatggcggatgcaaagacgatagtaaatgtccagaccctgtttcggctgttttcttctctttcaatcatcacagaactcactcatccagccaacatgagatttatgcagtttcgcgctaaagattgttactccctggcgcttagcaagctggaaaaaaaagagagagaaagggggtccaatctggcttttatgttccggctgccattcgctgctggacgcgtcttctccatttcaatgttagatacgctgctgtaccagagcttcgttaaagactatatgatcagcataactaggctcctcctgggcctggacaccacgccaggcagcggctttctgtgcagcatgaaaatcacggccgacgacctgtggattcggacatacgcgaggttatatcagaagctatgttcctccaccggcgatgtgccgatcggtatttatcggaccgagtcccagaaactgacaacttccgagtctcagataagcatatctgttgaagagtgggaggataccaaggacagtaaggaacagggccatcatcgtagcaaccaccggaactctaccagttcggatcaaagtgaccacccacttctaagacggaaatccatgcaatgggctagacgactgtcccggaagggtcccaagcacagcgggaagaccgcagaaaagatcactcagcagcggctgaatctgtaccgtagatcagagcgccaggagctggcagagctggtcaaaaacaggatgaaacatctgggcctgtccaccgtaggctacgacgagatgaacgatcatcagtctactttgagctacatcctgattaatccaagcccggacaccagaatcgaattgaatgacgtggtctacctcatcaggccagaccctctcgcttatctccccaattctgaaccctccagacgaaatagcatctgcaacgttaccggtcaggattccagagaggagacgcaattgtag

SEQ ID NO: 235606 - DNA, 1113 bp, Artificial Sequence
  Description of Artificial Sequence: Synthetic coding sequence
atgccgtacctgcacctggatcaccagacaatacttcgggcatgggctgtgaaggatttcgcacctaactgccctctgtacgtgcagatccttaagcccgaaaataaattccacattaagtttgctgatcacgtggtatgcgaggaagagtttaagtatgccatgctggcgcttaactgtatatgtccggcaacaagtacgttaattaccctcctggttcacacttccagagggcaggaaggtcaacagagtcccgagcagtggcagaaaatgtacggacgttgtagcggcaacgaggtatatcatatcgtcctggaagagagcacattttttgccgagtatgagggtaaatctttcacgtacgcttcattccatgcccacaaaaaattcggagtgtgcctgatcggcgtacgcagggaggacaataaaaatattctgctcaaccctggaccgcgatatatcatgaactctacagacatctgcttctatattaacatcacaaaagaagagaacagtgcattcaaaaaccaggaccagcagcgaaagtccaacgtcagtcggtccttttaccacggtccctcccgcctcccggtccacagcatcattgcttcaatgggcaccgtcgccattgacctccaggacactagctgtcgatcggcaagcggacccacgctcagcctgcccaccgagggaagcaaggagatccggaggccgagcattgcccctgtcctcgaggtggccgatacttcaagcatacagacatgcgacctcttaagcgaccagagcgaggatgagaccacccctgacgaagagatgtcctccaacctggaatacgcgaaagggtatccaccatatagcccttacatcgggtccagccctacattttgccacctgctccacgagaaagttcccttttgctgtctccgactcgacaaatcatgccaacacaactattacgaagacgctaaggcttatgggtttaagaataaactgatcattgtcgcagctgagaccgctggcaatggtctttacaacttcatcgtccccctgagagcctactaccgccctaaaaaggagttgaatcccattgtcctgctcctggataacccatag

SEQ ID NO: 235607 - DNA, 1572 bp, Artificial Sequence
  Description of Artificial Sequence: Synthetic coding sequence
attataaatgacctccaccgagcaatccaacggactcagagcgctatgttcaatcaggttctgatattgatttcgaccttactttgcctgatatttacgtgcatctgcggcatccagcaccttgagcggataggaaagaaactgaacctcttcgactccctatatttttgcatcgtgacattcagcaccgtgggattcggcgatgttacccccgagacatggagctcaaagctctttgtggtggcaatgatatgtgtggcactggtcgtgcttccaatccagtttgaacagctcgcatacctgtggatggagcgccagaaaagtgggggaaactacagtagacatagggcccaaacagagaaacacgtcgtgctgtgtgtgtcttctttgaagattgatctgctcatggatttcttgaatgaattttacgcccatcctcggttgcaggactattacgtggtgattctgtgtccaacagaaatggatgtccaggttaggcgcgtgcttcagatccctatgtggtcccagagggttatctacctgcaaggctccgccctcaaggaccaggatctactgcgcgctaaaatggacgacgccgaggcctgttttatcttgtcgtcaagatgtgaggtagacaggacaagctccgaccaccagaccattctcagggcctgggcagtgaaggatttcgccccaaactgccccctatatgttcagatcctcaaacccgaaaataagtttcacatcaaatttgcagatcacgtggtgtgcgaagaagaattcaagtatgccatgctggcactgaactgtatatgccctgccacttcgaccctaattaccctgctggtccacacctcacgaggccaggaaggccaacagtcgcctgagcagtggcagaaaatgtatggaaggtgttccggaaatgaggtgtaccacatcgtgctcgaagagagtacattcttcgcagagtacgagggcaagagtttcacatacgctagtttccatgcacataaaaaattcggagtgtgcctcattggggtcagacgggaagataataagaacatattactgaaccccggaccccgatacataatgaactctaccgatatctgcttttacatcaacattacaaaagaggaaaactctgccttcaaaaaccaagaccagcagagaaagtccaatgtgtccaggtctttttaccatggcccaagcaggttgccagtgcactccatcattgctagtatgggcactgtcgcaatcgacttgcaagacaccagttgtagatcagccagcggccctaccctgtccctcccgacagagggctccaaagaaatcaggagacctagcatcgctcccgttctcgaagtcgccgacacgtcatccatccagacctgtgatctgctctccgatcagagtgaggatgaaactactcccgacgaagaaatgtcgagtaatttggagtacgcaaagggctaccccccatactctccgtatatcgggtcgtcgccaaccttctgtcacctgcttcacgagaaggtgcccttttgttgcctgcgtctggacaagttttag

SEQ ID NO: 235608 - DNA, 1503 bp, Artificial Sequence
  Description of Artificial Sequence: Synthetic coding sequence
atgcccagttcaggcagggccctactagacagcccgctcgacagtggatccctgaccagtctggatagcagcgtattctgcagcgagggcgagggagaacccctagcactaggcgattgtttcaccgtaaacgtgggcggaagccgattcgtcttaagtcagcaggctctgagctgcttcccgcacacccgcctaggcaaacttgccgtggtggtcgcatcatacaggagacccggagcgctggctgccgtgccgagccccttagagctgtgtgacgacgcaaacccagtcgataatgagtacttctttgacagatctagccaggcctttcgctatgtgcttcactattaccgcaccggcagattgcacgttatggagcagctctgcgctttgtctttcctgcaagagattcagtactgggggattgacgagctgtcaatcgacagttgctgtcgggacaggtactttaggcggaaggaactctcagaaaccttggatttcaagaaagataccgaagatcaggagagccaacatgaatcggagcaggacttctcacaagggccttgcccaacagttcgacagaaactgtggaatattctggaaaaacctggatcatctacagcggcaagaatattcggcgtaatttctatcatcttcgtggtcgtaagcattatcaatatggcactgatgtcagctgagctctcttggctagacctgcagctgttagaaattctcgaatacgtttgtatcagttggttcacgggcgagttcgtgctaagatttctgtgtgtacgcgacaggtgtcgtttccttcgtaaagtgcctaacatcatcgatctgctcgctatcctaccattctacataactctgctggtggagagtttgtctggatcccagacaacacaggaactggagaacgtaggccgaatcgtacaggtgttacgcctccttcgggcactgagaatgctaaagctgggacggcacagtactgggctgcgcagtctgggtatgaccattacgcagtgttatgaggaggtagggctcctactcctgttcttgtccgtgggaatcagcatattctccacagtcgagtactttgctgagcagtccatacccgacacaacgtttacgtctgtgccttgtgcttggtggtgggctaccactagcatgacaacagtgggttacggcgatatccgtccagataccacaactgggaagattgtggcgtttatgtgtattttatcagggatcttggtgctggccctgccaattgcaattatcaacgatcgcttttcagcatgctacttcacactgaaactcaaggaagccgcagtcaggcagcgcgaggcgctgaagaagctcacgaagaacatagccaccgactcgtatatcagcgtgaatctgagggatgtatacgctcggagcatcatggagatgctccggctgaagggccgagaaagagcaagtactcggtcttccggcggagacgatttctggttctag

SEQ ID NO: 235609 - DNA, 1503 bp, Artificial Sequence
  Description of Artificial Sequence: Synthetic coding sequence
atgcccagcagcggcagggcactgcttgactcacctctcgactcaggctctctcacaagcctggacagctccgtgttctgtagcgaaggggagggcgaaccgctcgcccttggcgattgctttacagtgaacgtggggggatctcgattcgtcctctcccaacaggctttatcgtgctttcctcacacacgcttgggaaaactggctgtagttgttgcctcatataggcggccaggcgcacttgctgccgtgccgtctccgctcgaactttgtgacgacgccaaccctgtggataacgagtacttttttgatcgcagcagtcaggctttccgatatgttctccattattatcggaccgggaggcttcatgtgatggagcaactgtgtgctttaagtttcctgcaggagatccagtattggggtattgacgaactgagtattgattcttgttgccgggatcggtatttcagacggaaagagctaagcgagacattagactttaagaaggacacagaggaccaggaatctcagcatgagagtgagcaggacttctcacagggcccatgccccactgtacgtcaaaagctgtggaatatactggaaaagccagggtcctctaccgctgctcggatcttcggggtcataagcattatcttcgtagtagtaagcataatcaatatggctctcatgagtgcagagctgagctggctagatctgcagctgttggagatcctcgaatacgtgtgtatctcatggttcacaggcgagttcgtgttgcgatttctttgcgttagggaccggtgccgcttcctgaggaaggtccccaacatcattgatctgctagccatcctccctttctacatcactctgttggttgaatcactctccggaagccagacaacccaggagctggagaacgtggggcgaatcgtgcaggtgctccggctcctgcgcgcactacgtatgttgaaactcggtaggcactcaaccggtctgaggagtttgggcatgactataacacaatgctacgaggaagtgggactccttctgctgttcctgagcgtcggtatttccatcttctcgacggtggaatacttcgccgagcagtccattcctgatacaacctttaccagcgtaccatgtgcctggtggtgggctactacctcaatgacaaccgtggggtacggcgatatccgtccagacactacaacaggaaaaatcgtggccttcatgtgcatcctgagtggtatcctagttttggcacttccgattgccattatcaacgaccgtttttccgcctgctacttcacattaaagctgaaggaggcggcagtgcgccagagagaagcacttaagaaactgacaaagaacattgccaccgactcctatatctctgtgaacctcagagacgtctatgcgcgtagtattatggaaatgctgagactcaagggcagggaaagggccagcaccagatccagcggcggtgatgatttctggttttag

SEQ ID NO: 235610 - DNA, 1131 bp, Artificial Sequence
  Description of Artificial Sequence: Synthetic coding sequence
atggaacagctgtgcgcactatccttcctccaggaaatacagtactggggcattgacgaactctctattgattcctgctgccgggaccgatactttcgcagaaaggagttaagcgaaactttggatttcaagaaggacactgaggaccaggaaagccagcatgaaagcgaacaagacttcagccagggcccttgtccaacggtgcggcaaaagttgtggaacattcttgagaaacctgggtcctctacggcggctcgcatttttggagtgatatctattatattcgtcgtggtctccattattaacatggctctcatgagcgccgagctgtcatggctggatctgcagctgctggagattctggagtacgtatgtattagttggtttaccggcgagttcgtcctgaggtttttgtgtgtccgcgatcggtgcagatttttaagaaaggtcccaaacatcatcgacttactggcgatcctgccgttttatattactctcctagttgaatccctgagcggatctcagaccacacaggagttggagaacgtcggaaggattgtccaggtgctgagacttctacgggctctgcgtatgttaaagctcggcaggcatagcacgggcctcaggagtctcggaatgactatcacccaatgttatgaagaggtgggactgctactgctgttcttatccgttgggatatctatcttttccaccgtggagtacttcgctgagcaaagcattcctgacactacattcacgtccgtaccctgtgcttggtggtgggctacgacatctatgaccaccgttggctacggagatatccgacccgatactaccaccggaaaaattgtggcctttatgtgtatcctgagtgggatcttagtcctggctctccccattgcaatcatcaacgatcgcttctccgcgtgctatttcacccttaaactaaaggaagccgctgtgagacagagggaggctttgaagaagctgaccaaaaatattgctactgattcttacatttcagtgaacctgagggatgtatacgctagatcaattatggagatgcttagattaaagggccgagaaagggcttcaacgagatcttcaggcggagacgatttctggttttag

SEQ ID NO: 235611 - DNA, 1638 bp, Artificial Sequence
  Description of Artificial Sequence: Synthetic coding sequence
atgctaaaacagagcgaacgtaggcgatcttggtcctaccgcccttggaatactactgagaacgagggatctcaacacaggaggtctatatgcagtctcggggctcgctctggatcccaagctagtatccacggctggacggaaggtaattataactattacatagaagaggacgaggacggggaagaagaggaccagtggaaagatgatttggccgaggaggaccagcaggcaggagaagtgacgaccgctaaaccagagggtcccagcgaccctcctgcattactatctactctgaatgtgaatgtgggaggacacagctaccagctggactattgcgagctggctggcttccctaagacaaggctgggcagactcgcaacatccacatcaaggtcccgccagctctctctgtgtgatgattatgaagaacagaccgatgagtacttcttcgacagagaccctgccgtattccaactcgtgtataacttctacctgtccggtgtgctgctggtgctggatgggctgtgtcctaggaggtttctcgaagaattaggctactggggagtgaggcttaagtacacacctcgctgttgtcggatctgtttcgaagaacgccgagatgagctctcggaacggctgaaaatccagcatgaactccgggcacaagcccaggtcgaggaagctgaggaactgtttcgggatatgcgattttacggccctcagcgcagacggttatggaatctgatggagaaacccttctcttcggtcgcagccaaggctattggcgtggcctcaagcacctttgttctggtcagcgtggttgccctggcactgaacactgtagaggaaatgcagcagcatagtggccaaggcgagggaggaccggatcttagacctattctggaacacgttgagatgctgtgcatgggatttttcaccttggagtacctgttgagattggcttccacacccgatttgaggcggttcgctcggtctgcattaaatctggtagacctggtagctattctcccattgtacctgcaactgctcctcgagtgcttcaccggtgaaggacaccagagaggacaaacggtgggctcagtggggaaggtaggccaagtcctgcgagtgatgaggttaatgcggatctttagaatcttgaagctggccaggcacagtactggactgagggctttcggttttacactgagacagtgctatcagcaggttggttgcttactgctatttatcgcgatggggatcttcactttttctgccgctgtatattcagttgaacacgacgtgccatctacgaattttactacgattccccactcttggtggtgggctgccgttagtatcagcacagtcgggtacggagatatgtatcctgaaacccatctcggcaggttctttgcctttctgtgcatcgccttcggcattatattaaatggtatgcccatcagcatattgtataacaagttcagcgactattattccaaactgaaagcctatgaatatacaaccataagaagagaacggggtgaggttaacttcatgcagagagcccgaaagaaaattgctgagtgcctactgggtagcaacccacaactgacgccacgacaagagaactag

SEQ ID NO: 235612 - DNA, 963 bp, Artificial Sequence
  Description of Artificial Sequence: Synthetic coding sequence
atgttgaaacagagcgagcggagaaggtcttggagctatcggccatggaacaccactgagaacgaagggtcacagcataggaggtctatctgcagtctcggcgcacggtccgggtcgcaggcatcgatacacggctggaccgaaggcaattacaattactacattgaagaagacgaagacggggaggaggaggaccaatggaaagatgatctagcggaagaagaccagcaggccggagaggtgacaaccgcaaagcccgaaggcccttcagatccacccgctttgctgagcacactgaatgtgaatgtgggtggccactcttatcagctggactactgcgagttagctgggtttcccaagactcgccttgggagacttgcaacgtcaacatcccggagtaggcagttgtctctctgtgatgattatgaagagcagaccgatgagtatttctttgatagagacccagcagtgtttcagcttgtgtacaatttttatctgtcaggcgtacttctggttctggacggattgtgcccacgcagatttttagaggagctcggctactggggcgtccgactaaagtatacccctagatgctgccggatttgtttcgaggagcgacgcgacgaactgagcgaacgtctgaagattcagcacctgcgtgccagacttaggggcggagccggtgcccagcatcggggtggtgatgccgcagcgcttggcgcaggacgcggacggccacggccagcggctcacccaggggcaaggggggatgccgtccacggcctgttgcatgccagggtccccgcagctcccagcctgcacgccaggcccgaggctctgcgcgctcagagaccccagccaggaggacctggcggacaccccgcagccctgcccagcgcggcagctcgtgtgctgcacggacgcggtccccctacaaggccggacgggggacagcggggatag

SEQ ID NO: 235613 - DNA, 1740 bp, Artificial Sequence
  Description of Artificial Sequence: Synthetic coding sequence
atgtcttcttgccggtacaatggaggggtcatgaggcctctgtctaacctttctgcctctaggaggaacctccacgagatggattccgaagcacagcccctgcagcccccagcatcagtcggcggtggcggaggggcttctagcccatcagcagctgctgccgctgcagccgctgtgtccagttccgcccctgaaatcgttgtttctaagcctgaacacaacaacagcaataacctggccctctatggaaccggaggaggtggctccacaggaggcggaggaggtggagggggttcaggtcatggaagcagtagcggcactaagagcagtaagaaaaagaatcagaacattggatataaacttggccaccgtagagcattgtttgagaagcgtaaacggctaagtgactacgccctaatatttggaatgtttggtattgtggttatggtgatcgaaactgaactgagttggggggcatatgacaaagccagcctgtactccctggctctgaagtgcctgatcagtttgagcactattatcctgcttggacttatcatcgtttaccatgccagagaaattcagctgttcatggtggacaacggcgctgatgactggcgcattgccatgacgtacgagcgcattttctttatctgtctggagatactggtgtgtgctattcaccccattccaggcaactacaccttcacttggacagccaggctggcctttagttacgccccttcaaccacaaccgctgatgttgacataattttgtccatacccatgtttcttcgactgtacctgatagccagagttatgctgctgcattccaagctttttactgatgcctcctctaggtcaattggggcattaaataaaattaactttaacacccgcttcgtgatgaaaactctcatgactatatgcccgggtaccgtactcttggtattttctatatcactctggatcatcgctgcctggaccgttagggcctgcgagaggtaccacgatcaacaggatgtgacatcaaacttccttggggcaatgtggctgatcagtatcacgttcttatctattggatacggcgacatggtgccaaatacgtattgcggcaagggtgtatgcttgctaacaggaattatgggcgcaggatgtacggcactagtggtggctgtggttgctcgtaaacttgagttgacaaaagcagagaagcacgtccacaactttatgatggacactcagcttaccaaacgtgtgaaaaacgccgcagccaatgtccttcgagaaacctggctgatctataagaacacaaagttggtgaaaaagatcgaccatgcgaaagtcagaaagcaccagcggaagttcctgcaggcaattcaccaactgagaagcgttaaaatggaacaacgtaagctcaacgatcaagccaacaccctggttgacctcgcgaaaactcagaatatcatgtacgatatgatttctgacctgaatgagcgatccgaagactttgaaaagcgtattgtaaccctagaaacaaagctcgaaacattgatcggctctattcacgctctcccaggtctgataagccaaaccatccgtcagcagcagagagacttcattgaagcacagatggaatcatatgataaacatgtgacttataatgctgagcgctccaggtccagtagcaggcggaggcgaagctctagcactgcgccacccacatcgtccgaaagtagctag

SEQ ID NO: 235614 - DNA, 696 bp, Artificial Sequence
  Description of Artificial Sequence: Synthetic coding sequence
atgtggctcatatctatcacttttctatcaattggctacggtgatatggttcctaatacttattgcggcaagggagtgtgcctactaactggtataatgggggcaggctgtaccgcactggttgtcgcggtcgttgcgagaaagttggagcttaccaaagcagaaaaacatgtccacaatttcatgatggatacacagctgacaaaaagagtcaagaatgccgctgccaatgtgctgagagagacttggcttatctataaaaacactaaattggttaagaagattgaccacgcaaaggtccggaaacaccagcggaagttcctccaggccattcaccagctgaggagcgtgaagatggagcagcggaaactcaatgatcaagctaacacgctggtggatctggccaaaactcagaacatcatgtacgatatgatctccgacctcaatgagcgctcagaggactttgagaagagaatagtaaccctggagaccaagcttgagactttgataggatcaattcatgcacttcctggccttatatcccaaaccattaggcagcagcagcgggatttcatagaggctcaaatggaaagttatgacaaacatgtgacatacaacgccgaacgctcgcggagtagtagtcgaaggcgccgttcaagcagcaccgcccctcccacctccagcgagagcagctag

SEQ ID NO: 235615 - DNA, 1326 bp, Artificial Sequence
  Description of Artificial Sequence: Synthetic coding sequence
atgagctcatgccgctacaatggcggtgtcatgagaccattgtcgaatctttcagctagcaggcggaacctacacgagatggactctgaggcacaacctctacagccccctgcaagcgtcggcggaggcggaggtgcatcgagcccctcagcagccgcagcagccgcagccgctgtgtctagctctgccccagaaatcgtggtctcgaagcctgagcacaataatagtaataatctcgctctctatggtaccgggggaggcggtagcacgggagggggaggaggaggaggagggagtggccatggcagcagttccggaaccaaaagctctaagaaaaaaaaccagaacattggctacaagctggggcacaggcgcgctctgttcgagaaaagaaaacggctgtcagactatgccctcattttcggaatgttcggcatagttgtgatggtgatcgagaccgagctgtcctggggagcgtatgataaagcctctctctattccttggctctgaagtgtttaatcagcctgagtacaataattcttcttggactgattatagtctaccacgccagagaaattcagctcttcatggtggacaatggggcagacgactggcgcatcgccatgacatacgagcgtatcttctttatctgtttggagattctggtctgcgccattcaccctattcctggaaattatacctttacctggacggcccgtttggcattcagctatgctccgtccaccacaactgccgatgtcgacatcatactgtcaatcccgatgttcctgcgactgtacctgattgctcgcgtcatgctcctgcacagtaagctgttcaccgatgcgtcctcacgatcgatcggcgcattgaataaaatcaatttcaacactcggtttgtcatgaaaaccctgatgacgatctgccccggaacagtacttctcgtgttttcaatttctctctggataatcgctgcttggaccgtaagggcttgcgaacgataccatgatcagcaggacgtcacatcaaactttcttggcgcaatgtggttaattagtataacctttctaagtattgggtatggggatatggttcctaacacatattgcggcaagggagtgtgcctgcttacaggtatcatgggagccggttgtacagctctagtagtggcagtcgtcgcacgcaagctcgagctgaccaaggccgaaaaacatgtccataatttcatgatggatacccagctgaccaaacgggtgtcttactatccttatatattcaaagaaaacattatcgtcatcttctccgtgctcggaaatatggcttag

SEQ ID NO: 235616 - DNA, 2196 bp, Artificial Sequence
  Description of Artificial Sequence: Synthetic coding sequence
atggacacaagtggccactttcacgactctggtgtcggcgacttggatgaggatcctaaatgcccctgccccagcagcggcgatgaacagcagcagcaacaacagcagcagcaacaacagcaaccgccacccccagccccacccgctgccccacagcaacctctcgggcctagcctccagccacagcctccccagctgcaacaacagcagcagcagcagcaacagcaacagcagcagcaaccacctcacccgctgtcacagttagcgcagcttcagtcccagcctgtgcatccaggtctactgcactcgtcccctaccgcattccgcgcaccgccttctagcaatagtacagcaattctccacccctcgtcacgacaggggtctcagcttaatctgaacgaccacctgctggggcattctccatcttctacagcgacttccggtcctggaggaggcagtagacatagacaggccagtcctttagtgcaccgccgtgattctaatccgttcaccgagatcgctatgagctcttgcaagtattctggcggagtgatgaaacctctatctaggctgtctgcatctagacgaaatctgatcgaagcggaaacggagggacagcctctgcaactgttcagcccttcaaacccacccgaaattgtgatcagcagcagggaagataaccatgcccaccagactctgctgcatcaccctaatgcaacccacaaccatcaacacgcaggcacgactgcctctagcacaacttttccgaaggcaaacaaaaggaaaaatcaaaatatcggctataaactagggcaccgcagggccctgtttgagaaaagaaaaaggttgtctgactacgctctgatctttgggatgttcgggatcgtggtgatggtgatagagaccgagctgagctggggtctatattctaaggattcaatgttcagtctggcccttaaatgcctcatctctctgagcacaataattctgttaggtctcattatcgcctaccatacacgggaagtccagctctttgtgatagataatggagcagacgactggagaatcgccatgacttacgaaagaatcctctacatttccttggagatgctggtctgtgccatccacccgattcccggagagtataagttcttttggaccgcgcgactcgcattctcttataccccctcaagggcagaagccgatgtggatatcatattgtcaatccccatgtttctgaggctctaccttatagctagagtaatgctgcttcactctaaacttttcactgatgcatctagtagatccattggggctctaaataagatcaactttaacaccaggttcgttatgaaaaccttaatgaccatatgtcctggtactgtcctgctggtcttcagcatttccttatggatcatcgccgcttggactgtccgtgtatgcgagcggtatcatgaccagcaggatgtcacttccaattttttgggggctatgtggctcatctcaatcacatttctgagtatcggctatggcgacatggtgccacacacatactgtggaaagggggtttgcctgctgacgggcatcatgggcgctggctgcactgccttggtggtagcagtcgtggcaagaaagctggagcttacaaaggctgaaaaacatgtccacaattttatgatggatacccagctgactaaaaggatcaaaaatgctgcagctaacgtcttgagagaaacctggctgatctataaacacacaaagcttttgaagaaaattgatcacgccaaagtgcgcaaacaccaacgtaagttcctgcaggccattcatcagctgcgttccgtcaaaatggaacagagaaaactgtcagatcaggctaacactctggtagacctgtcaaaaatgcaaaacgtgatgtatgatctgataaccgagctgaacgaccggtctgaggaccttgagaagcagatcggatcacttgagagcaagctggagcatcttactgccagctttaatagcctcccattgctcatcgctgacacactgagacaacagcaacagcagctcctgtcagcaatcattgaagcaaggggcgtttcagtggcggtgggcactacacacacacccatctctgattctcctatcggagtgtcctctacttcatttcccactccatacaccagctcctcttcttgttag

SEQ ID NO: 235617 - DNA, 1257 bp, Artificial Sequence
  Description of Artificial Sequence: Synthetic coding sequence
atgttctccctggccttgaaatgtctcatcagtcttagtaccattatactactggggcttatcattgcttaccacactcgggaggtgcagctgttcgtcatagataacggagccgacgactggcggatcgccatgacatatgagagaatcctatacatcagtctcgaaatgcttgtgtgtgctattcatccaatccctggggagtacaaattcttctggacagctagacttgcattttcctatactccttcaagagccgaggctgatgttgacatcatcctttcaatcccaatgtttcttagactgtacctgatcgctcgcgttatgctacttcattctaagcttttcacagatgcatcttcgcggtcaataggggcacttaataagatcaactttaatacaagatttgttatgaagacactgatgaccatctgccccggaactgtgctgctggtgttctccattagcctgtggattatcgccgcatggacagtacgggtatgtgagaggtaccatgatcagcaggacgttacaagcaatttcttaggcgctatgtggctaataagcataacctttctttctattgggtacggcgacatggtgcctcatacctactgcggtaaaggggtctgtctgctcactgggatcatgggtgcaggttgcaccgcactagtcgtggctgtggtggcgaggaagcttgaactgactaaagcggaaaaacacgtgcataattttatgatggatacccagcttaccaaaagaatcaaaaatgccgctgcaaatgtgctgcgcgaaacctggctcatctataagcacacaaagctgctgaaaaagatagatcatgctaaagtgcgcaagcaccagcgtaaatttttacaagcaattcatcagctaaggagcgttaagatggagcagaggaagctgagtgatcaagcaaacacactggtcgacctgtctaaaatgcagaacgtgatgtatgacctgatcacagagctgaatgatcgctcagaggacctcgagaagcagatagggtcgctcgagtctaagttggagcatctgaccgcctcttttaactccctgccactcctcattgctgacaccctccgtcagcaacagcagcagttgctttctgccattatcgaggccagaggcgttagcgtggccgtgggcaccacccacacccccattagtgattccccgatcggggtctctagcacctcttttcctaccccttatacatcttcttctagctgttag

SEQ ID NO: 235618 - DNA, 1281 bp, Artificial Sequence
  Description of Artificial Sequence: Synthetic coding sequence
atggagaggccaattaaggacagtatgttttcgctggctctgaaatgtttgatcagcttatccacaatcatcttgttgggtcttatcatcgcatatcacacacgggaggtgcaattatttgttatcgataacggcgctgacgattggagaattgctatgacgtacgagagaatcctttacatctcactggagatgctagtttgcgctattcaccctatccctggcgaatataagttcttttggacggcccgactggctttctcctacacaccgagcagagccgaggctgatgttgacatcatactctccattcctatgttcttgaggctgtacttgattgccagggtcatgttgctacattcgaagcttttcacagatgcatcgtcccgatccatcggagccctcaataagatcaactttaatactcggtttgtaatgaaaacgttgatgacgatttgtcccggaaccgtgctcttggttttcagtataagcctgtggattatagctgcatggaccgttcgcgtctgcgaacggtatcatgatcagcaggatgtcacctccaacttcctcggcgctatgtggctgatttccattacctttctctctatcggctacggtgatatggtgccacacacctactgcggaaagggcgtctgcctgctcacaggtatcatgggggcaggctgcaccgctctcgtggttgccgtcgtggccaggaagctcgaactgaccaaggctgaaaagcacgtgcataactttatgatggacactcagctcacgaagcgaatcaagaacgccgcagccaatgtgcttcgggagacttggttaatctacaagcataccaagcttctgaagaaaatcgaccacgccaaggtccgcaagcaccagaggaagtttcttcaggccatccaccagctccgatctgtcaaaatggagcagcggaagctgtcagaccaagccaataccctggtagatctgagtaagatgcagaatgtgatgtacgatctcataaccgagctaaacgacagatctgaagatctggagaagcagattgggagtctcgaatcaaagttagagcacctgacagcatctttcaacagtctaccactcttgatcgctgatactctgcggcaacagcagcagcagctgctgagtgcgatcatcgaagccaggggcgtgagcgtcgctgtggggaccacccacactcccatttctgattcacccatcggggtgagtagcacatcgtttccaaccccctatacgagtagttcatcttgttag

SEQ ID NO: 235619 - DNA, 684 bp, Artificial Sequence
  Description of Artificial Sequence: Synthetic coding sequence
ccacacacattgctcgaggaccatctgcttcgtgagttctttcatccactgttttttcttcaggcccctctcctgctttctctgccagctcaatacaacgcatttctgtctggatcagtatggaccccagggagtcctagagaacccaaacaagcaaaagaacggaccggggcaaaaatcctggtgggcgaaatcggctgcttagctttcttcgaggatatcttcggcgctagagtcgctctcgggtggggtcttgtgctgcaaggcatccagcctgggcctaaaatggacacctctggacatttccacgactctggagtcggcgacctcgacgaggatcctaaatgcccctgcccatcaagtggggatgagcaacagcagcagcagcaacagcagcagcagcagcaaccgcctccccctgctccgcctgccgctccccagcaaccattgggcccatccttgcagcctcagccaccacaactgcagcagcaacagcagcagcagcagcagcagcaacagcagcagccacctcatccactgtcccagctcgcgcaattgcagtctcagcctgtgcaccccggactgctgcattcatccccaacagctttccgacccccttttgtacagctccaccgccaccctcctccctttctgcaggccagacagccagcacaaagccagtag

SEQ ID NO: 235620 - DNA, 1284 bp, Artificial Sequence
  Description of Artificial Sequence: Synthetic coding sequence
atgggcggagatctggtcctcggcttgggggctcttaggcgcagaaagagactattggaacaggagaagtccttagctggatgggccttggtgctggcaggaaccgggatcggcctcatggtgctgcatgccgagatgctctggttcggtggctgctcttgggctttgtacctcttcctggtgaagtgcaccattagcatctccacctttcttttattatgtcttatcgtggccttccacgctaaggaagtgcagctgttcatgactgataacggcctccgagattggagagtggcactgacaggtaggcaggcagctcaaatcgttctggagctggtagtttgtggactgcacccagcgcctgtgagagggcctccatgcgtccaggacttgggggctccactgacctcgccgcagccctggccaggcttcctcggacaaggtgaggcccttctttcgctcgccatgctcctcaggctttacctcgtgcctcgtgcagtactgttgcgctccggagtgctattgaacgcgagttataggtctatcggagcactgaaccaggtcaggttcagacattggttcgtcgctaaactatacatgaatacacaccctggacggctcctgttgggtctgactctgggcctgtggctgactaccgcatgggtgctcagcgtggccgagcgccaagccgtcaatgccactgggcatctgtccgatacactgtggttaattcccatcacatttcttacaataggttatggcgacgtcgtccctggaactatgtggggtaagattgtctgtctgtgcaccggcgtgatgggtgtctgctgcaccgcccttctcgtagcagtcgtcgcccgtaagctagagttcaataaggctgaaaaacatgtccacaactttatgatggatattcagtacaccaaagaaatgaaggagtcggccgcacgggtcctgcaggaagcatggatgttttataagcataccaggaggaaagagagccatgccgctagacgccatcagaggaagctcctggctgctatcaacgcatttcgccaagtgcgcctgaaacatagaaaactgagagaacaagtaaatagcatggtagacatttcaaagatgcacatgatcctgtacgatctgcagcagaacttgtctagtagccatagggcgcttgagaagcagattgacacactggctggaaagctggatgctctcactgagctgttaagtactgcactgggacctaggcagctccctgagccatcccagcaaagcaaatag

SEQ ID NO: 235621 - DNA, 888 bp, Artificial Sequence
  Description of Artificial Sequence: Synthetic coding sequence
atgcacgatcagcacttccatctgcttacccccctgccacatagggggctgtcatgccagaggggaccagctgtgcacgataggcagagggccgcaggactggcgagaggcgctgaccgtgccgctgggaatgccagctataggtccataggggctctgaaccaggtgaggttccggcactggttcgtggcgaaattgtacatgaacactcaccctggacgtctgcttttagggctgaccctcggactttggctaacgaccgcttgggtgttgtctgttgccgaacggcaggccgtgaatgccactgggcacttgtcagacacgttatggctgatacctattacattcctcaccattgggtacggcgatgtggtgccaggtaccatgtggggaaaaattgtctgcctttgtacaggagttatgggcgtttgttgcacagccctactggttgccgtcgtggcaagaaagctagagtttaataaggccgaaaaacatgtacataattttatgatggacatccagtacactaaggaaatgaaggagtctgctgcccgagtgctgcaggaggcctggatgttttacaagcacacaaggcgcaaagaaagccatgccgctcgcagacaccaacgtaagctcctggcggctattaatgcctttcgccaagtgagactgaagcacaggaaactgagggagcaggtgaatagcatggtggacattagcaaaatgcacatgatactgtacgatctgcaacagaatctgtcttccagtcacagagcccttgagaaacagatagacacgttagcagggaaactcgatgccctgacggaattgctcagtacagccctcgggccacggcagcttccagaaccgtcccaacaaagcaagtag

SEQ ID NO: 235622 - DNA, 1119 bp, Artificial Sequence
  Description of Artificial Sequence: Synthetic coding sequence
atgtttaagcatcttaggaaatgggtcgtgactcgcttttttgggcactccagacagcgcgctaggctggtttcaaaggacggcagatgtaacatagaattcggcaatgtggaggcgcaatccaggtttatcttctttgtggatatatggacaacggtcctggatctgaagtggcgatataaaatgaccattttcattactgcattcctcggtagctggtttttcttcgggctactatggtatgccgttgcatatatccacaaggacctgccagagttccacccatccgccaaccacaccccttgtgttgagaacatcaacggattgactagcgcatttctctttagccttgagactcaagtcaccattggttacggatttcgctgtgttacagagcagtgtgctacagccatcttcctactcatcttccagtccattctgggggtgataatcaacagtttcatgtgcggtgccattctggcgaaaattagccgtcctaaaaagcgtgccaagaccattaccttctcgaagaatgccgtgatttcaaaaagaggtggtaagctgtgccttctcatccgcgttgcaaatctgagaaagtctctgctgattgggagccatatttatggcaagctgctgaagactacggtcaccccagagggggaaactataattctggatcagatcaatatcaactttgtggtagacgccggaaatgagaacctgttctttatatcaccactgacaatttatcacgtaattgatcataatagcccattcttccacatggctgcggagaccctgctccagcaggattttgaattggtcgtgttcttggatggaacggtagagtccacttctgctacatgtcaggtgcgcacgtcgtacgttccagaggaagtactgtgggggtatagatttgccccaatcgtctcaaaaacaaaggaaggcaaatacagggtggattttcataatttctccaaaacagtcgaggtggagactccacactgcgccatgtgcttatataacgaaaaagacgtgagagccaggatgaagcgcggttatgataaccccaacttcatcctcagtgaagtgaacgaaaccgacgacacaaagatgtag

SEQ ID NO: 235623 - DNA, 1119 bp, Artificial Sequence
  Description of Artificial Sequence: Synthetic coding sequence
atgttcaagcaccttaggaagtgggtggtgacacgcttttttgggcactctcgccagagggcacgactggtgtccaaggacggcaggtgcaacatagaatttggaaatgttgaggcgcagagccggttcattttttttgtcgacatttggactacagtcctagatctgaagtggcgctacaagatgaccatcttcatcaccgctttcttagggagttggtttttttttggcctgctgtggtatgccgtggcctacatccacaaagatctgccagaatttcacccatcagctaaccatactccctgcgttgagaatatcaatggcctgaccagtgcattcttattctccctcgagacccaggtaaccattggttacggcttcaggtgcgtgacagagcaatgtgcgacagctattttcttactgattttccagtcaatcctaggggtgatcatcaactcttttatgtgcggcgcaatattggcaaagattagtcgtcctaaaaagagagcaaaaactatcaccttcagcaagaacgccgttatttccaaacggggtggaaaactgtgtcttctgattagagtagccaacctgcgcaagagcctgctgattggtagtcacatttacggcaagttgctcaagaccaccgtcacacctgaaggagagaccattatcctggaccagatcaacattaatttcgtggtagacgccggaaatgaaaatctcttcttcatctctccgctgacaatatatcacgtgatagatcacaattcccctttttttcacatggccgctgagacccttctgcagcaggacttcgaactagtggtgtttctggacggaacagtagagtcaacctcggcaacctgccaagtgcgcacaagttatgttcccgaagaggtcctgtggggataccgttttgcaccaattgtgagtaagactaaagaggggaagtaccgggtagatttccacaatttctctaagacggtcgaggtcgaaacaccccactgtgctatgtgtctgtataatgagaaggacgtccgagccagaatgaagaggggatacgataaccccaactttattctgagtgaagtgaacgagaccgacgataccaaaatgtag

SEQ ID NO: 235624 - DNA, 912 bp, Artificial Sequence
  Description of Artificial Sequence: Synthetic coding sequence
atggcttggtggttaattgcctttgcgcatggggatctggcgccatctgagggcaccgccgaaccttgtgtgacttctatccacagcttttctagtgctttcctttttagcattgaggtgcaggttactattggctttggcggtcggatggttacagaggaatgtcccctggccatcctgattctgatcgttcagaacattgtcgggcttatgatcaatgccattatgctggggtgcatcttcatgaagacagcacaagctcaccgtcgggcagagacacttatattctcgaagcatgctgtaattgccctgagacacgggagattgtgctttatgctgcgggtgggagacctacggaagtctatgattatctctgccactattcatatgcaggtggttcgaaagacaacctcccccgagggcgaggtggtccccctgcaccaggtcgacatccctatggaaaatggagtcggcggtaatagcattttcctggtggcccctctcatcatctatcacgtaatagacgccaatagccctctctacgatcttgctccatctgatttgcaccaccaccaagaccttgaaatcatagtgattcttgagggtgtggtggaaaccaccgggatcactacacaggctaggacctcctacctcgctgacgaaattctgtgggggcagcgctttgtgccgattgtcgccgaggaagatggtcggtattccgtcgattatagcaagtttggcaacacggtaaaggtccccacccctttgtgtaccgcgcgtcagctggatgaagatcactccttactggaggccctaaccctggcctcagcaaggggaccactccgtaagcgcagtgttcctatggcaaaagccaaaccaaaattttcgataagccccgactccctgtcctag

SEQ ID NO: 235625 - DNA, 1302 bp, Artificial Sequence
  Description of Artificial Sequence: Synthetic coding sequence
atgactgccgcttccagagccaacccctattcgatcgtgtccagtgaggaagatgggttgcacctggtgacgatgtccggtgccaatggctttggcaatggcaaggtccacactaggcgccgatgcagaaaccggttcgtgaaaaaaaacggccaatgcaatatagaattcgccaacatggacgagaaaagccaaaggtacttagctgacatgtttactacctgtgttgacatccgctggcgctatatgttactcatcttttcccttgctttcttggccagttggctgcttttcggcattatattttgggttatcgccgtggctcacggcgatcttgagccagccgaaggcaggggcaggacaccttgcgtgatgcaagttcatggctttatggctgcctttttgttcagcattgaaacacaaaccaccattggctatggcctgaggtgtgtgaccgaagaatgtcccgtggctgttttcatggtagtagcgcagtccatagttggctgcatcatcgacagctttatgattggggcaatcatggccaaaatggccaggcccaagaagagagcccaaacactcctgttctctcataacgccgtggtggccctccgtgacggcaagctatgtttaatgtggcgggtgggtaatttacggaagagtcatatcgtggaggcacacgttcgggctcagctgatcaaaccgagggtgacggaggagggcgagtacattccactagaccaaatcgacattgatgttgggtttgataagggtctggataggatctttctggtatctcctatcaccattctacacgagatcgacgaggcaagtcccctctttgggatctcccgccaagatctggaaaccgacgactttgagatagtcgtgatccttgaaggaatggtggaggcgaccgccatgactacccaggcaaggtcaagctacttagctaacgaaatcctatggggacatcgattcgagcccgtcttgttcgaagagaaaaaccaatataagatagattattcccactttcataaaacttatgaggtgccatcaacccccagatgctccgcaaaggatttggtagaaaataagtttctgcttcctagtgctaattccttctgctacgagaatgaactcgcatttctgtcccgagatgaggaagatgaggccgatggagaccaggatggtcgaagcagggatggcttgagcccccaagctcgccacgattttgacaggcttcaggccggagggggagtgctcgagcaaagaccctatcggcgagagtccgaaatttag

SEQ ID NO: 235626 - DNA, 1257 bp, Artificial Sequence
  Description of Artificial Sequence: Synthetic coding sequence
atgtcatattatggctcaagttatcacattataaacgctgacgccaaatacccaggttatcctccagagcacataatcgccgagaaacggcgtgcacggaggcggttgctgcataaagacggcagctgcaatgtctacttcaagcacatatttggcgagtgggggagctacgtggtcgacatcttcactaccttagtggacactaaatggcgccatatgtttgtgattttctccctctcatacatcctcagctggttaattttcggaagcgtcttttggctgatcgcattccatcacggagacctcctcaatgatcccgacatcactccttgcgtagacaacgtccacagttttaccggagcctttctgttcagcctggagacccagaccactatcggatacggttatcgatgtgtgactgaggaatgctccgttgctgtgctcatggtaattctgcaatctatactgtcatgcatcataaacaccttcatcatcggggctgctctggccaaaatggcaaccgcaaggaagagggcacagacaattcggttttcatattttgcactcattgggatgagagacggcaaactttgcctgatgtggaggatcggggactttagacccaatcacgttgtggaaggaaccgttcgagcgcaactgctgcgatacactgaagactcggagggcagaatgactatggcctttaaagacttaaagctggttaacgaccagattatattagtgacccccgtaaccatcgtacatgagatcgatcatgagagccccttgtatgctttggatcggaaagccgtggccaaggacaatttcgagatcctggtcaccttcatctacacaggagatagcacagggactagccatcagagcagatccagctacgttcctagagagattctttggggccatcgattcaacgacgttctcgaagtgaagaggaagtattacaaggtcaactgtctccagttcgagggctcggttgaggtctacgctcccttttgttctgctaagcagctcgattggaaggaccagcagctgcatatcgaaaaagctccaccagttcgggaaagttgtacctccgacacaaaagccagaaggcgatcattctccgccgtggccatcgtgagcagttgcgagaatccggaagaaaccaccacctccgcgacccacgaatatcgcgagacaccttatcagaaagccctcctgaccctgaacaggatctccgtcgaatctcagatgtag

SEQ ID NO: 235627 - DNA, 1119 bp, Artificial Sequence
  Description of Artificial Sequence: Synthetic coding sequence
atgtttaaacacctccgaaaatgggtcgtaactcgtttttttggacatagcaggcagcgcgcacggctggtgagcaaagacggtcgatgcaacatcgagttcggaaacgtggaggctcagtcaaggtttatcttcttcgtcgatatatggaccaccgtgcttgatctcaagtggaggtacaaaatgaccatctttatcacagcgtttctgggctcctggttcttcttcggactgctgtggtacgctgtagcgtatatccacaaggatctcccagagttccaccccagcgctaaccacaccccttgcgttgagaacattaatggattaacttccgccttcctcttctccctggaaacgcaagttacgattggatatggttttcgctgtgtcaccgagcagtgtgccacagctatctttttattgattttccagtctatcctgggagtgattattaactctttcatgtgtggggctatccttgctaagatatcccgtccgaaaaaacgtgctaagaccataaccttctcgaaaaatgccgtgatttctaaacgaggaggtaaattatgccttttgatcagagtggccaacctgcgaaagagcctgctgataggaagtcatatctacgggaaactgctgaagaccacagtcacccctgagggtgaaactattattttggatcagatcaatattaattttgtggttgatgcaggtaatgagaacttgtttttcatttctcctcttactatataccacgtgattgatcataacagtccattctttcacatggctgctgagactctgctacaacaggacttcgagctggtcgtgttcttagacgggaccgtcgaatcaacctcggctacttgccaggtccgaaccagttatgtgcccgaggaagtcctatggggctaccggttcgctcctattgtaagcaagactaaggaaggcaagtaccgggtggatttccataatttcagtaaaactgtggaggtggagacaccccactgtgccatgtgtttgtacaacgaaaaggacgtgcgtgccagaatgaagcgaggatatgacaacccaaattttatcctgtccgaggtgaacgaaaccgacgacacaaagatgtag

SEQ ID NO: 235628 - DNA, 1176 bp, Artificial Sequence
  Description of Artificial Sequence: Synthetic coding sequence
atgaatgcctcttcccgcaacgtgttcgataccctgattagggtgctcaccgagtcaatgtttaagcatctccgcaaatgggtggttaccagattcttcggacattccaggcagcgggcaagacttgtctcgaaggacggtcggtgtaatatcgagtttgggaacgtggaagcccagagccggtttattttcttcgtggatatctggaccacggtcctggaccttaaatggcgatataagatgacaatttttatcaccgcctttcttggctcctggttcttctttggcctcctgtggtacgccgtcgcatatattcacaaagatctccctgaatttcacccaagcgctaatcacactccctgcgtcgagaatatcaatggtctcacgtctgcctttcttttctctctcgagactcaggttaccattggttatggctttcggtgtgttacagaacaatgtgccaccgcgatcttcttattaatctttcaatctattctcggagtgatcattaactcctttatgtgcggcgctatactggcgaagatctccaggcctaagaagcgcgcaaaaacaattaccttcagcaaaaacgccgtgatctcgaaacgcggaggtaaactctgcctgttaatccgcgtcgccaacttgaggaagtcccttctgatcggatctcacatctatggaaagttactgaaaaccaccgtgacaccggagggggagaccattatactggaccagatcaatattaactttgtagtcgacgccggaaatgagaacttattctttatttcccccctgacgatataccacgtgatagatcacaactcacctttcttccacatggcggctgagacgctgcttcagcaggatttcgagttggtggtttttctagatggtactgtcgagtctacatccgctacctgtcaggtgcgaacttcatatgtgcctgaggaggtgctgtggggttataggtttgccccaatcgtctcaaagaccaaggagggcaaatatagggttgactttcataacttcagtaagacggtggaagtcgagactccgcactgtgctatgtgcctgtataacgaaaaggacgtgcgggctagaatgaaacggggttacgataatcccaattttatcctcagtgaggtcaacgaaactgacgatactaaaatgtag

SEQ ID NO: 235629 - DNA, 1119 bp, Artificial Sequence
  Description of Artificial Sequence: Synthetic coding sequence
atgttcaaacaccttcgtaaatgggtagtgacacggttctttggtcactcaagacagcgcgctcgtttggtttcaaaagacgggcgatgcaatattgagtttggcaacgtcgaggcccagagccggttcatttttttcgtcgacatttggactactgtcctcgatctcaagtggagatacaagatgaccattttcataactgctttcctgggcagttggttctttttcggtctgctctggtatgctgtcgcctacatccacaaagatttgcccgaattccatccatcagctaaccacaccccatgtgtcgagaatatcaatggcctcactagcgcattcctcttctccctggaaacacaagtaactattggttacggatttaggtgtgtcaccgaacaatgcgccacagccatatttctcctgatatttcaaagcatcctgggtgtgatcattaattcctttatgtgtggagcaatcctagccaaaatttctagacccaagaaaagggctaaaacaattacatttagcaagaatgccgtcatcagcaaaaggggcggaaagctatgcctccttattagggtggcgaacctgcggaagagcctgctaataggatcccatatttacgggaagctgctcaagacaactgttactccagagggtgagaccatcattctcgatcagattaatattaattttgtagtggatgccggaaatgagaatctgttcttcatctcccccctgaccatatatcacgtcatcgaccacaacagtccttttttccatatggccgctgaaactctgctccagcaagatttcgagctggtggtgttcctggatggaacggtggagagcacgtccgccacctgccaggtgagaacaagctatgtgccagaagaggtattgtgggggtatcgtttcgccccaattgtgtccaagacaaaagagggaaaataccgggtcgacttccacaacttttccaagacagtggaggtggaaactccccattgcgcaatgtgcctctataacgagaaggatgtgcgggcaagaatgaagcgaggatatgacaatcccaattttatcctctctgaggtgaatgaaaccgatgacacgaagatgtag

SEQ ID NO: 235630 - DNA, 1140 bp, Artificial Sequence
  Description of Artificial Sequence: Synthetic coding sequence
atgacaagcgtcgcaaaagtatattattcccaaactacacaaacagagagccgtcctcttatgggacccggaatcagacgcagacgagtgctcaccaaagatggcaggagcaacgtgcggatggaacacatcgcagataagcgctttctgtaccttaaggatctgtggaccacttttattgatatgcagtggagatacaaattgctgttattcagtgctacattcgcaggcacctggttcctgtttggtgtggtgtggtatctcgtggcagtggcccacggggatcttctggagctggaccctcccgcaaaccatacaccttgtgtggtgcaggtgcacactctgacaggagctttcttgttcagcctggagagtcagactactatcggatatggctttcggtatatatccgaggagtgccctctggccattgttctcctgatcgctcagttggtgctgaccaccattctggaaattttcatcactgggactttcttggccaagatcgcccgaccaaaaaagagggccgagaccattcggttctctcaacatgctgttgtcgcttctcacaacggaaagccctgtctgatgatcagggtggccaacatgcgaaagtcactgctgatcggatgtcaggtgactggaaagctcttgcagacacatcagaccaaggaaggagagaacattcggctcaatcaggtgaacgtcactttccaggtcgatacagccagtgatagcccttttctgatcctgccactgactttctaccacgtcgtcgacgagacatcaccacttaaggatctacctctgagatcaggagaaggcgattttgagttggtcttgatactgtctggcaccgtggaatccacatccgcaacttgccaagtgcggacctcgtatctgcccgaagagatcctatggggctacgagttcacacccgcaattagcttgagcgcttccggcaaatatatagccgactttagtctcttcgaccaggtcgttaaggttgcctccccaagcggattgcgggactcgaccgtgcggtacggagatcccgaaaagttgaaactggaggagtctttaagggagcaggcagaaaaggagggaagcgccctgagcgtgaggatcagcaacgtatag

SEQ ID NO: 235631 - DNA, 1173 bp, Artificial Sequence
  Description of Artificial Sequence: Synthetic coding sequence
atgctctccaggaagggcattattccagaggagtacgttctgacgcgcctagcggaggatccagcaaagccacggtatcgtgccaggcagcgaagagctagatttgtctcaaagaagggaaattgtaatgtagcccacaaaaacatccgggagcagggaaggttcttgcaggacgtgtttactaccctggtggatctgaaatggcctcacacactgctcatctttacaatgagtttcctctgcagctggttgttgtttgctatggcatggtggctcatcgcttttgcccacggagatcttgccccttcggagggtaccgccgaaccctgtgtgacgtctattcacagcttttctagcgcatttctgttttctatagaggtacaagtgaccattggatttggtggacggatggtgaccgaagagtgccccctggcgattctcatcctgatcgtgcagaatattgttgggttgatgatcaacgccattatgctagggtgcatttttatgaaaacggcacaagcacacagacgagccgagaccttgattttctctaagcatgccgtgattgctcttcgccatgggaggctctgttttatgttacgggtgggcgatctccgcaagtccatgatcatcagtgcaaccattcatatgcaggtcgtgagaaagactacaagcccggagggggaggtggtgcccctgcaccaagtggacatacctatggaaaatggcgtgggcggaaacagcatctttttggtggctcctctgattatctatcatgtgattgacgccaatagccccctctatgatctggcgccatcggatttacaccatcatcaggaccttgagattatcgtaatccttgaaggcgtcgtcgagacaaccggaataaccacccaggccaggacatcctacttggccgatgaaattctctggggacagagatttgtccctatcgtggctgaagaagatggcagatacagcgttgactacagcaagttcggaaatacagtgaaggtccctactcccttgtgcacagcaaggcaattagatgaggatcactccttgttagaagccttaaccctggcgtccgcacgcggaccattgcgaaaacggtctgtgccaatggctaaggccaaaccaaaattctccatcagcccggacagcctctcttag

SEQ ID NO: 235632 - DNA, 1302 bp, Artificial Sequence
  Description of Artificial Sequence: Synthetic coding sequence
atgacagccgcttcacgggcaaacccgtattctatcgtgtcctctgaagaagacggcctgcatctcgtgaccatgagtggggctaacggatttgggaatgggaaagttcacacacgacggaggtgtaggaaccggttcgtgaagaagaatgggcagtgtaacattgaattcgccaacatggacgaaaagagtcaacggtatttggcagatatgtttactacctgcgtcgatattcggtggcgctacatgcttctgatcttctctctcgcatttctggcgtcctggctgttgttcggcattatcttctgggtgatcgccgtcgcccacggtgatctggagccggctgagggtaggggacgtacaccgtgtgtgatgcaagtccacggctttatggccgcatttcttttctccatcgagacgcagaccactatcggctatgggctcagatgtgtgactgaggagtgccccgtcgcggttttcatggttgtggcacagtccatcgtgggatgtatcatagactctttcatgataggagcaataatggccaagatggcaagacccaagaaaagggctcagaccctgctcttcagtcacaatgccgttgtggccttgcgcgacggtaagttgtgtctgatgtggagagtgggaaacttaaggaagtcccatatcgttgaggcccacgtccgagcacagctcatcaaaccgcgagttacagaagaaggggaatatataccactcgatcaaatagacatcgacgtgggtttcgacaaagggctggatagaattttccttgtgagcccaattacgattctccatgagattgacgaagccagtcctttattcgggatatcaaggcaagatctggaaaccgacgatttcgaaatcgtagtgattttagaaggtatggtggaggctaccgctatgaccacccaggccaggtcgtcctacctggctaatgagattctctgggggcaccgtttcgaaccagtgttattcgaagaaaagaaccagtacaaaattgactatagccattttcacaaaacctatgaggtgccaagcacaccacgctgtagtgctaaggatctcgtggaaaacaagttcttgcttccttctgctaattctttttgttacgaaaatgaattagccttcttgagccgggacgaggaagacgaagccgacggcgaccaggatggcagatccagagatgggctgtccccacaagcaagacatgactttgatcgcttacaggccggaggtggagtgctagagcagcggccttacagacgtgaatcagaaatatag

SEQ ID NO: 235633 - DNA, 819 bp, Artificial Sequence
  Description of Artificial Sequence: Synthetic coding sequence
atggtcctgcttactgctgttctactgctgcttgccgcttacgcagggcctgcccagtcgctcggctctttcgtacactgcgaaccctgtgatgagaaggcccttagtatgtgtccacccagccccctgggctgcgagctagtgaaagagcctggttgcgggtgctgtatgacatgtgctctcgccgaaggtcagtcctgtggcgtttacactgagagatgtgcccaggggctccgatgtctcccaagacaggatgaggagaagccactacatgccctcctgcacggcagaggagtgtgcctgaatgagaagtcgtaccgggagcaagtcaaaatcgagagggactcccgggagcacgaagaacctacaacgtctgaaatggctgaggagacatattctcccaagatttttagacccaaacataccagaatctccgaacttaaggctgaggccgtgaaaaaagataggagaaaaaagttaacgcagagcaagttcgtgggcggagccgaaaatactgcccatcccaggatcatcagcgccccagaaatgcgacaggagtctgagcagggtccttgtcgcagacatatggaggcaagtttgcaggaactcaaggctagccccaggatggtgcccagggccgtgtacctgcctaattgcgacagaaaaggcttctacaaacgtaagcagtgtaaacccagtcgcggtcgcaaacgaggtatttgctggtgtgtggacaagtatggaatgaagctgccaggtatggagtatgtagacggggacttccaatgtcatacattcgattctagtaacgtggagtag

SEQ ID NO: 235634 - DNA, 285 bp, Artificial Sequence
  Description of Artificial Sequence: Synthetic coding sequence
atggatagcagtaactgcaaagttattgcgcctctactctcgcagagatatcgacgtatggtgacgaaagatggccactccacccttcagatggatggcgcacagcggggtcttgcctacttgcgcgacgcatgggggatccttatggatatgaggtggcggtggatgatgttggtattttctgccagctttgtggtccattggctcgtgttcgcggtgctgtggtgtttctgtggggaagattgccctgccaagaaaagttcttttttcaacagtctgtactag

SEQ ID NO: 235635 - DNA, 1083 bp, Artificial Sequence
  Description of Artificial Sequence: Synthetic coding sequence
atggacagctccaattgcaaagtgatcgccccactgctgtcccagcgctatcgccgaatggttacaaaagacgggcatagtactttacaaatggacggggcacagaggggcttggcttaccttcgcgacgcttggggcattctgatggatatgcggtggagatggatgatgctagttttctcagctagttttgtcgtgcactggttagtgtttgctgttctttggtacgtcctggctgagatgaacggagatctcgaattggatcatgacgccccacccgaaaatcacaccatttgcgtcaagtacatcacctcctttaccgccgcattctcttttagtcttgagacccaactcacaatcggctacgggaccatgtttccctctggagactgtccgtcagccatagccctgctcgctatccagatgctgctgggtctgatgctcgaggcatttatcacaggagcctttgttgcaaaaattgcacgcccaaagaatcgcgcattttctattagatttaccgatactgccgtcgtagctcacatggacgggaaacccaacctgatcttccaagtggccaataccagaccttctccattgacctctgtgagggtgtcggcagtgctctatcaggagcgggaaaatggaaagctgtaccaaacaagcgtggacttccacctggacggcatctcctccgatgaatgcccctttttcatatttccactcacatactaccacagcatcactccctcctcaccactggctacccttcttcagcacgagaaccctagccacttcgagcttgtcgtgtttttatcggcaatgcaggaggggactggagagatctgccagcggcgaacgtcttatctcccctctgaaattatgctgcatcactgttttgcctctctgctcacccgcggatctaaaggcgagtaccagatcaagatggagaattttgataagaccgtacccgaattccctactcctctcgttagcaagtcaccaaatagaacagacctcgatatccatatcaacggtcagtcaatcgacaactttcagatatcagagactggactcactgaatag

SEQ ID NO: 235636 - DNA, 1128 bp, Artificial Sequence
  Description of Artificial Sequence: Synthetic coding sequence
atggacgccatccacattgggatgagctccacgccactagtaaagcatacggccggagctggacttaaggcgaaccggccacgcgtgatgtcaaaaagcggccatagcaatgttaggattgacaaggttgacggaatttaccttttgtatctgcaggacttgtggactactgttattgacatgaaatggcggtataagctgactctgttcgctgcgaccttcgttatgacctggtttctcttcggagtgatctactacgctatcgccttcatccacggcgacctggaaccgggtgagcccatatctaaccataccccttgcataatgaaagtcgactcactaacaggagctttcctgttcagtcttgagtcacagacgacaatcggctacggcgtacgctcaatcacggaggagtgtccccacgccatcttcttgctggttgcacagctggtgatcacgacgctcatcgaaatatttatcactggtacctttctcgcaaagatcgctcgccctaagaaacgcgcagagacaataaagttttcgcactgcgccgtcattacaaagcagaatggcaagctctgtcttgtgatacaggtggcgaatatgagaaaatctctgttgattcagtgccagctgagtggaaagctgttgcaaacccatgtgaccaaggaaggagagaggatactgctgaatcaggccactgtcaagttccatgtggacagtagtagtgaaagcccattcctgatcctgcccatgacattctatcacgtcctggatgagacgagccccctgcgcgacttaaccccccagaacctgaaggaaaaggaattcgagctagtggtactcctgaacgccacagttgagagcacttctgctgtgtgccaatcaagaacaagctacatcccagaggaaatttactggggtttcgagttcgtgccagtagtaagcctgtcaaagaatggaaaatacgtggccgattttagtcagttcgagcagatacgaaaaagccctgattgcaccttctactgtgcggactctgagaagcaacaactcgaagaaaagtatcgacaggaggatcaaagggagagggaactgaggacacttctcctgcagcagtcgaatgtctag

SEQ ID NO: 235637 - DNA, 186 bp, Artificial Sequence
  Description of Artificial Sequence: Synthetic coding sequence
atggacgccatccacatcggcatgagctccacaccattggtgaagcacaccgctggtgctgggctgaaagccaacaggccaagagtgatgtctaaaagcggtcattccaatgtgcgcatagacaaggtggacggcatctacttgctgtaccttcaagacttgtggacgactgtcatcgacatgtag

SEQ ID NO: 235638 - DNA, 471 bp, Artificial Sequence
  Description of Artificial Sequence: Synthetic coding sequence
atggacgctatccacattggcatgtccagcactcccctggtcaagcatacggcaggcgctggccttaaggctaacagaccaagagtgatgtccaagtcaggacactctaacgtcaggatagacaaggtcgacggcatctatttgctgtaccttcaggatctctggaccacagtaatcgacatgaaatggaggtataaactaaccctcttcgcagcaacattcgtaatgacctggttcctgtttggggtgatttactatgccatagcatttattcacggtgacttagaaccaggtgagcccatctccaatcataccccatgtatcatgaaagttgacagcttaactggcgcattcttatttagtctggagtcacagacaaccatcggttatggcgttcggtccattaccgaggaatgcccccacgccatcttcctgcttgttgcccaactcgttatcacgactctgatttag

SEQ ID NO: 235639 - DNA, 471 bp, Artificial Sequence
  Description of Artificial Sequence: Synthetic coding sequence
atggacgcaatccacatcgggatgagttctaccccgctagtaaagcatactgcaggtgctggactgaaggcaaatcggcctagggtcatgtcaaagtcagggcatagcaacgtgcgcattgacaaagttgatggaatttatctgctctatctccaggatctgtggaccacagtgatagatatgaaatggagatacaaactgaccctcttcgctgcaacttttgtgatgacgtggtttctttttggtgtcatctattatgctattgcattcatccacggcgacttggaacctggtgagccgatttcaaatcatacaccgtgcattatgaaggtggattccctgaccggggcttttctgttcagcctcgaaagccaaacgactataggatatggggtgcgctccatcaccgaggagtgccctcatgctatcttcctgctggtagcccagttggtgattacaacattgatttag

SEQ ID NO: 235640 - DNA, 1128 bp, Artificial Sequence
  Description of Artificial Sequence: Synthetic coding sequence
atggacgccattcacattgggatgagctctacacccttggtgaaacacacagctggcgctggactgaaagcaaatcggcctcgggtcatgtccaaatctgggcattcaaacgtccggattgacaaggtggacggtatctatctcctgtacctccaggatctctggactacagtcattgatatgaaatggagatataagttgactctgtttgccgcaacctttgtgatgacctggtttctgtttggtgtgatttactacgctatcgccttcatacatggcgacttggagccgggagagccgatcagcaatcatacgccatgtatcatgaaagtggactccctgactggggcttttctcttttccctcgaatcacaaacaactattggatatggagtgagatctataacagaggagtgcccccacgctattttcctattggtcgctcagctggtgatcactaccctgattgagatattcattacagggaccttcctggcaaaaattgcccgacctaagaaaagagccgaaacaatcaaattctctcactgtgcagtgatcactaagcaaaacggaaaactttgtctggtgatccaggtcgctaatatgcggaaaagcctgctgatacagtgccagctgtccggaaagctgttgcagactcacgtgacgaaggaaggtgaacgcattctattgaaccaggccaccgtgaaatttcacgtggactctagcagtgaaagcccctttctgattctccccatgaccttctatcacgttctggacgaaacatctcctctgagggacctcacaccccagaacctaaaggaaaaggaatttgagttggtggtgctgctcaacgcaacagtcgagtcaactagcgccgtctgccagtctagaacgagctacattccagaggaaatttactggggcttcgagttcgttcctgttgtctctctgtcaaagaacggtaagtacgtggccgactttagtcaattcgaacaaatccgtaaatccccagactgcactttctattgcgcagatagcgagaagcaacagctggaagagaaatacagacaggaagaccaacgagaacgtgagctcaggaccctgttgttgcaacagagcaacgtctag

SEQ ID NO: 235641 - DNA, 1128 bp, Artificial Sequence
  Description of Artificial Sequence: Synthetic coding sequence
atggacgccatccatattgggatgagctcaaccccgttggttaagcatacggccggagccggtctgaaagccaaccggcctcgtgtcatgagtaaatccggacattcaaacgtcagaatcgacaaggtcgacgggatctacctactgtatctgcaagatctatggacaacggtgattgatatgaagtggaggtacaaacttacgctgttcgccgctacatttgtgatgacctggttcctttttggggtgatttattatgccattgcttttatacacggtgatcttgagccaggagagcctatcagcaaccatactccctgcatcatgaaagtggattctctgacgggcgcattcctgttctctcttgagtcccagactaccatcggctacggcgtgcggtctataaccgaagaatgcccgcacgcaatttttctacttgttgcccagcttgtgattaccacgctgattgagatctttatcactggcacatttctggccaagattgccagacctaagaaacgagccgagaccattaagttctctcactgtgccgtgattacaaaacagaatggcaagctgtgcctggtgattcaggttgccaatatgcggaaatctttgttaatccagtgccagctatcaggcaagctgctccagacccatgtcaccaaggagggtgagaggatactactgaaccaggctactgtgaaatttcacgtggactcatcctcggaatccccattccttatccttccaatgaccttctaccacgtgctggacgagacgagccccctgagggacctcaccccgcagaacctcaaagagaaggagtttgaattagtcgtgctcctgaacgccaccgtggagtccacttccgccgtgtgtcaatctaggacttcgtatattcctgaggagatctactggggtttcgaatttgtgccagtggtctccctgtcaaagaacggcaaatatgtcgctgacttttcccaattcgagcaaatccgaaagtcacccgattgtacattttactgtgcagacagtgagaaacaacagcttgaggaaaagtatcggcaggaagatcagagggagcgggagctccgtactttactgttgcagcagtctaatgtgtag

SEQ ID NO: 235642 - DNA, 1128 bp, Artificial Sequence
  Description of Artificial Sequence: Synthetic coding sequence
atggacgccattcacattggaatgtcctcgacacctcttgtcaaacataccgctggcgctggcctcaaggccaacagaccacgcgtaatgagcaagtccggtcattccaatgttcggatagataaggtggatgggatttacttgctgtatcttcaggacctctggactaccgtgatcgacatgaagtggcggtacaagctgactctttttgctgcaacttttgtgatgacatggttcctgtttggcgtcatttattacgccatcgccttcatccatggagatttggagcctggtgaacctatctctaaccacacaccctgtattatgaaggttgactccctaacaggtgctttcctatttagtctcgagagccagactaccatcggctacggcgtgcggtctatcaccgaggagtgcccccatgccatttttttgctagtggcacagctggtcattaccactctcattgaaatcttcataaccggaacgttccttgctaagatagccaggccaaagaagcgcgctgagaccatcaagttctctcactgcgccgtgatcacgaagcagaacggaaagctgtgtctcgtgatccaggtcgctaatatgaggaagtcattgctcatccagtgtcagctctcagggaaattactacagacccatgtgactaaggagggggagcggattctgctgaatcaggccacggtgaaatttcatgttgattcttctagcgaatcgcctttcttaattctcccaatgacattttatcatgttctcgatgaaacgtctccactaagggatttgacgcctcagaacctgaaagaaaaagagttcgagctagtcgtactccttaatgctaccgtcgaatccaccagcgctgtgtgccagtccaggacctcatacattcccgaagagatttactggggattcgagttcgttcccgtggtctcactgagcaagaatggtaagtacgtggctgactttagccagttcgaacagatacgcaagtcgccagactgcactttctattgtgccgattccgaaaaacaacagttggaggagaagtataggcaggaagatcagcgtgagagagaattacgcacccttctcctgcaacaatcaaacgtatag

SEQ ID NO: 235643 - DNA, 1128 bp, Artificial Sequence
  Description of Artificial Sequence: Synthetic coding sequence
atggatgctattcacatcggcatgagcagcacgcccctggtaaaacacacagcgggagcaggactgaaggccaacaggcctcgggtcatgagtaagtctggacacagcaacgtgcgaatcgacaaagtcgacggaatctaccttctgtacttgcaggacctatggactaccgtgattgacatgaagtggagatacaaactaaccctgtttgcagccacatttgtgatgacatggttcctttttggagttatctattacgcaatagcctttatccacggcgacttggaacccggtgaaccaatctctaaccacacgccgtgtatcatgaaggtcgatagcttgacaggcgctttcctattctccctcgaaagccagaccaccatcgggtatggcgtgcggtcgatcactgaggagtgcccgcacgcaatattcctgttggtggcccaactagtgatcaccaccctgattgagatcttcattacgggaacttttctggctaaaatagccaggcctaagaaacgggctgaaacaattaaattctcccattgtgcggtgatcacaaagcagaatggcaagctgtgcctggtgatccaggtcgcaaacatgagaaagtctttgctgattcaatgtcaactcagcggaaagctgctgcaaactcatgtgactaaggagggcgagaggatcctcctgaaccaggcgactgttaagttccacgttgattcatcttctgagagcccctttcttatccttcctatgacattttatcatgtgctggacgagaccagcccactccgagaccttaccccccagaatttgaaggaaaaagaatttgagctggttgttctccttaatgctacagttgaatctacatccgcagtatgtcagtctcgcacctcctatatacctgaagagatctactgggggttcgagtttgtgcccgtcgtatctctgagtaaaaacgggaagtatgttgccgatttcagccaattcgagcagatacggaagtccccagactgcacgttctactgtgccgactctgaaaagcagcagctcgaagaaaagtataggcaggaggaccagagagaaagggaattaaggaccctgctactgcaacagagcaacgtttag

SEQ ID NO: 235644 - DNA, 60 bp, Artificial Sequence
  Description of Artificial Sequence: Synthetic coding sequence
atggacgccattcacattggcatgtcatcaactcccctggtgaagcatactgccggttag

SEQ ID NO: 235645 - DNA, 420 bp, Artificial Sequence
  Description of Artificial Sequence: Synthetic coding sequence
atggacgccatccatatcgggatgtcgagcaccccactcgtgaagcataccgccggagccggactgaaagcaaatcgtccacgagtgatgtcaaaatcgggtcattctaacgtcagaatcgataaggtggacggaatatacctgctgtatttgcaagacttgtggaccaccgtcattgatatgaagtggcgttacaagctgactcttttcgccgcaacgttcgttatgacatggttcctgtttggagtcatatattatgcaatcgcgttcatccatggagatctggaaccaggcgaaccgatatccaaccataccccctgtatcatgaaggtcgatagcttaaccggcgctttcctgttctcgctggagtcacagacaacgatcgggtatggcgtgcgttccattacagaggagtgttag

SEQ ID NO: 235646 - DNA, 738 bp, Artificial Sequence
  Description of Artificial Sequence: Synthetic coding sequence
atggacgcgatccacatcgggatgagctctactcctctcgtgaaacacaccgccggtgctggattaaaggccaaccgaccaagagtgatgagcaagtccggccactctaatgttcgaatcgacaaggtggacggaatctatctcttgtatctgcaagatctctggacgactgtgatcgacatgaaatggcgctacaagctgacgttgtttgcagcaactttcgtaatgacttggttcctgtttggcgtgatctactacgccattgcctttattcatggagacctggaaccgggtgagcctatttcgaatcacaccccatgcattatgaaagtggactctctgaccggagcctttctgttttcgctggagtcgcagactactattgggtacggggttcggagtatcacagaagaatgtccacacgctatattcctcttggttgcgcagctggtgatcacaaccctgatagagatatttatcacgggtactttcttggcaaagatcgctcgcccaaaaaagagggctgagaccataaaattttcgcactgcgccgtcatcacaaaacagaatggcaagctttgcctggtgatccaggtagccaacatgcggaaatccttactgattcagtgccagctgagtggaaagcttctgcagactcacgttacgaaggaaggtgagcgtatccttctgaatcaggcgacagtgaagtttcacgtggatagctcaagtgagtcgtag

SEQ ID NO: 235647 - DNA, 120 bp, Artificial Sequence
  Description of Artificial Sequence: Synthetic coding sequence
atggatgcaattcacatcggtatgtcttctactccgctagtgaaacacaccgcaggcgcaggactgaaggccaaccggccaagagtgatgagcaaaagtgggcactccaatgtgaggtag

SEQ ID NO: 235648 - DNA, 147 bp, Artificial Sequence
  Description of Artificial Sequence: Synthetic coding sequence
atggatgcaattcacatcggaatgtccagcacccctttggttaagcatacagcaggcgcaggccttaaagccaatcggccacgggtgatgtcgaagtctggacactcaaatgtgagaatcgacaaggtggacggcatctacttgtag

SEQ ID NO: 235649 - DNA, 147 bp, Artificial Sequence
  Description of Artificial Sequence: Synthetic coding sequence
atggatgccattcacattggtatgagtagtactcccttggtcaagcacaccgctggcgctggcctcaaggcaaacaggcctcgggtcatgtctaaaagtggccactccaacgtgaggattgacaaagttgacgggatctacctttag

SEQ ID NO: 235650 - DNA, 147 bp, Artificial Sequence
  Description of Artificial Sequence: Synthetic coding sequence
atggacgcaattcacattggcatgtctagcacccctctcgtgaagcacacagcaggcgctggcctcaaggccaaccgtcctcgcgtaatgagtaaatccggccactccaatgttagaatagataaggtcgatggaatctatctgtag

SEQ ID NO: 235651 - DNA, 78 bp, Artificial Sequence
  Description of Artificial Sequence: Synthetic coding sequence
atggatgccatccatatcgggatgagctctacacctctggttaagcatacagctggcgctgggctaaaggctaactag

SEQ ID NO: 235652 - DNA, 147 bp, Artificial Sequence
  Description of Artificial Sequence: Synthetic coding sequence
atggacgctatccacatcggcatgtctagtactccactggttaaacataccgctggggctgggttaaaagcaaacaggcccagggtgatgagcaaaagcgggcactccaatgtaagaatcgacaaagtcgacgggatttatctgtag

SEQ ID NO: 235653 - DNA, 147 bp, Artificial Sequence
  Description of Artificial Sequence: Synthetic coding sequence
atggacgcaatacatatcggaatgtccagtactcctctggtgaaacatactgccggagcgggactgaaggcgaatcgacctagagttatgtctaagagcggtcattcaaatgtccgaatagataaagttgacggcatctacctgtag

SEQ ID NO: 235654 - DNA, 147 bp, Artificial Sequence
  Description of Artificial Sequence: Synthetic coding sequence
atggatgcaatacatatcggcatgagttccacacccctggtgaagcacacagcaggcgcaggcttgaaggcaaatagacccagggtgatgtctaagagtggtcactctaatgtgcgcatcgataaagttgacggaatatatttatag

SEQ ID NO: 235655 - DNA, 1257 bp, Artificial Sequence
  Description of Artificial Sequence: Synthetic coding sequence
atgtcatattatggaagcagttaccacatcatcaacgccgatgctaagtaccccggttatcctccagaacacataatcgcagagaagcggagagcgagaaggcgtctcctgcataaagatgggagttgtaatgtctatttcaagcacatcttcggggaatgggggtcttatgttgtcgacattttcactaccctggtggacactaaatggcggcatatgtttgtaattttcagtttatcgtacatcctgtcttggctgatttttggctcagtgttctggctgatcgccttccatcacggggatttattaaacgatcccgacattactccctgcgttgataacgtccactccttcacaggagcttttctgttttcactcgagacacagaccacaatcggctatggatacagatgcgtgacagaagagtgctctgttgccgtgctgatggtcatcctccagagtatcttatcgtgcattatcaatacattcatcattggtgcggctctagctaaaatggctactgccagaaaacgcgctcagacaatccggttctcgtatttcgctttgattggtatgagagacggaaagttgtgtctaatgtggcggatcggcgatttcagacctaaccacgttgtggagggaacagtgagggcgcaactgctaaggtataccgaggatagcgagggaagaatgaccatggcgttcaaggacctaaagttagtaaatgaccagattattctcgtaactcccgtgaccatcgtccacgagattgatcacgagtccccactgtatgcgttggacagaaaagccgtggcaaaagataacttcgagattctcgttacattcatttatacaggggactctactggcacgagtcaccagtctcgctcaagctacgttcccagggagatcctgtggggacatcgcttcaacgatgtgcttgaagtgaaaagaaaatactacaaagtgaactgtctgcagtttgaaggttcggtggaggtgtatgcccctttctgcagcgccaagcagttggattggaaggaccaacagcttcacatcgaaaaggcccctccagtgagggagtcctgcacctcagataccaaagctcgtaggcgatcctttagtgccgtggccatagtgtctagctgtgagaaccccgaagagaccaccacttccgccactcacgaatatagggagacaccctatcagaaagcactcctgactcttaacagaatctccgtggagagccagatgtag

SEQ ID NO: 235656 - DNA, 1257 bp, Artificial Sequence
  Description of Artificial Sequence: Synthetic coding sequence
atgtcctactacggttcgagttatcatatcatcaatgctgatgcgaagtatcccggatacccacctgagcacataatcgccgagaaaaggcgcgcaaggcggaggctactacacaaagacgggtcctgtaatgtgtactttaagcacatatttggggagtggggcagctacgtagttgacatctttacaacattggtggacaccaagtggcgtcacatgttcgtgatcttctctctaagttatatccttagttggctcatcttcgggagcgtcttttggctcatagcctttcatcacggcgatcttttaaatgaccccgacatcaccccctgtgtggacaacgtgcactccttcacaggcgcttttttattttctctagaaactcagaccactatcggatacggctacaggtgcgtcactgaagagtgtagtgtcgccgtgctaatggtgattcttcaaagtattctatcctgtatcatcaacactttcatcatcggggcagcattagcgaagatggcaactgcccgaaagcgcgcacaaaccatccgattttcctatttcgcactcataggaatgcgcgacggaaaactgtgtctcatgtggcggataggagactttcgaccaaaccatgtcgtcgagggtaccgtgcgggcacagctccttcggtatactgaggacagtgagggtcggatgactatggcatttaaggaccttaagttagtaaatgaccagatcatcttagtaacaccggtgacaatagttcacgaaatcgaccatgaatcccccctttatgcactggatcgaaaggccgtggccaaggataacttcgagatcctggtaacgttcatttatacaggagacagcaccgggacttctcaccagtctcgtagttcgtatgtcccacgggagatcctctggggccacagattcaatgacgtgttggaggtgaagagaaagtattacaaggttaactgtctgcagttcgaaggtagtgttgaggtatacgctcccttctgcagcgccaaacagctcgattggaaggaccagcagcttcatatcgagaaagcaccccctgttcgagagtcctgcaccagtgatactaaggctcgcagaaggtctttttccgctgttgctattgtgtcatcttgtgagaatccagaagaaaccacaacgtcggccacacatgagtaccgcgagacgccctaccaaaaggcactgttaactctcaacagaatcagcgttgagtctcagatgtag

SEQ ID NO: 235657 - DNA, 1257 bp, Artificial Sequence
  Description of Artificial Sequence: Synthetic coding sequence
atgagttactacggcagcagctatcacatcattaatgccgatgccaagtaccccggatatccccctgaacatatcattgctgaaaagcggagagccagacgcagactgctgcacaaggatggctcttgcaatgtgtacttcaagcacattttcggggaatgggggtcatacgtggtggacatctttacaacactggttgatacaaagtggagacacatgtttgtgatattcagcctgagttatatcctgagctggctgatcttcggctctgtgttttggcttatagcatttcatcacggagatctcctcaatgacccagacattacaccgtgcgtggacaacgtgcatagctttacaggagcatttctgttcagcctcgagacccagactaccataggctacgggtaccggtgcgtaaccgaggagtgttctgtggccgtactgatggtaatattacagagcatattatcttgtatcattaacactttcattattggggctgccctcgctaaaatggctactgctcgcaaaagagcacagacaattcgattctcttatttcgccctgatcggaatgagggatggcaagctctgcttaatgtggagaattggggattttaggcccaaccatgtcgtggaaggaactgtgcgggcacagttactgagatacaccgaggactcggagggcaggatgaccatggcttttaaggacctaaaactcgtcaatgatcagatcatcctggtgacaccagtgacgatcgtgcatgagatcgaccatgagtctcctctgtacgccctggatcggaaggctgtggccaaagataatttcgagatcctggtcacatttatctacacaggcgacagcacaggcacgtctcatcagagccggagttcctacgtcccgagggaaattttgtgggggcacaggttcaacgacgtccttgaagtcaagcgcaaatattacaaagtgaattgcctccagttcgaaggaagtgtagaggtttacgccccattttgttcagccaaacagctggattggaaagatcagcagttgcacattgaaaaagcacccccagtgcgtgagtcctgtaccagtgacaccaaagcacggaggcggtctttttcggcagtcgccattgtgtcttcctgtgagaatcctgaggagacaaccacttctgcaacgcatgaatatcgggaaacaccttatcagaaggctctcctaacactgaacaggatctccgtggagtcgcagatgtag

SEQ ID NO: 235658 - DNA, 1284 bp, Artificial Sequence
  Description of Artificial Sequence: Synthetic coding sequence
atgggctctgtgcggaccaatcgctatagcatcgtgtcgtccgaggaggacggcatgaaattagctaccatggcggttgccaacggtttcggcaacggaaaatctaaggtacacaccagacagcagtgccggagtagattcgtcaaaaaggatggccattgcaatgttcagtttattaacgtcggcgaaaaaggtcagaggtatctcgcggatatatttacaacctgtgttgatatccggtggagatggatgctcgttatattctgcctcgcgtttgtcctctcatggctctttttcgggtgcgtgttctggttaatcgccctactccatggcgatctggacgcatccaaggagggaaaggcctgtgtatctgaagtcaacagttttacagctgcattcttgtttagcatcgagacccagaccaccatagggtatggttttcgatgcgtaacagatgaatgtcccatcgccgtatttatggtggtgttccagtcaatcgtcggatgtatcatcgatgccttcataatcggcgctgtaatggccaagatggccaaacccaaaaagcgaaatgaaaccctcgtgtttagccacaatgctgtgatagcaatgcgggacgggaagctctgcctgatgtggcgcgtgggcaacctgcgtaagtcacatcttgtggaggctcacgtgcgagcccagttactgaagtcccggatcacttcagaaggggaatacatccctctcgaccagattgatataaacgtcggcttcgatagtggcattgatagaatctttctggtgtcgcctataacaatagtccacgagattgacgaagactctccactctacgacctcagcaaacaggacatagacaatgcagatttcgagatcgtggtaatacttgagggtatggtagaggctacagctatgacaacacagtgccggtcctcgtacttggctaatgagattttatgggggcatcggtacgaacccgtgctgttcgaggagaagcattattataaagtggattattcgcgattccacaagacctatgaagtgcctaacacccctttatgttctgccagagatctggcggagaaaaaatatattctctctaacgccaactctttctgttacgaaaatgaagttgctctcacttcaaaagaggaggatgattctgagaacggcgttcctgaatccactagtaccgacactccgccagacattgatctacacaatcaagccagtgtccctcttgagccacgcccattgaggagagaaagcgagatctag

SEQ ID NO: 235659 - DNA, 1284 bp, Artificial Sequence
  Description of Artificial Sequence: Synthetic coding sequence
atgggctccgtgcggactaatcgttatagcatcgtatcttcagaagaggacgggatgaagcttgccaccatggctgtcgccaacggctttggcaacggaaaaagcaaggtgcatacccggcagcagtgtagatctcggtttgtgaagaaagacgggcactgcaatgtccagtttatcaatgtcggggagaaagggcaaaggtacctggccgacatttttaccacctgcgtcgatattcgctggagatggatgctggtcatcttctgtttagcgtttgtcctgagttggttattctttgggtgtgttttttggctcatcgccctgctgcatggagacttggacgccagcaaggagggaaaggcttgcgtgtctgaagtcaacagttttacagccgcattccttttttcaatagagacccagacaaccattgggtacggattcaggtgtgttacagatgaatgcccaattgccgtctttatggttgtgtttcagtcaattgtgggttgcattatcgatgcttttatcatcggcgctgtcatggcaaagatggcaaagccaaagaagagaaatgaaaccctggtgttttcacacaacgccgttattgccatgcgcgatgggaaactgtgcctcatgtggcgcgtgggcaatcttcgcaaatcccatctagtagaggcccacgtcagagcccaacttcttaaatcacgcataactagcgaaggagagtatattccactggatcagatcgacatcaatgttggattcgacagcggcatcgacaggatttttttggtttcccccatcaccatcgtgcacgaaatcgatgaagactctccgttgtatgacctgtccaagcaagacatcgataacgcagactttgagattgttgtaatcctggaaggaatggtcgaagcaacagctatgacaacccagtgtcgcagttcctacctcgcaaatgagatactgtgggggcatagatacgagccagtcctgtttgaggagaagcattattacaaagttgattatagccggtttcataagacttacgaagttcctaatactcccttgtgttctgccagagatctggctgagaaaaagtatatactgagtaatgctaattccttctgctatgaaaacgaggttgccttaacttccaaagaagaggatgatagcgaaaatggcgttcctgaatccacgtccaccgatactccgccagatattgacttacacaatcaggcatcagtccctctggaaccaagacccctgagaagggaaagcgagatctag

SEQ ID NO: 235660 - DNA, 1506 bp, Artificial Sequence
  Description of Artificial Sequence: Synthetic coding sequence
atgagcgccctcagaaggaagtttggtgatgactaccaggtcgtcacgacgagtagcagtggtagcggactgcagccccaggggcctggtcaggaccctcagcagcaattggttccaaaaaagaagcggcagagatttgtcgataaaaatggccgttgcaacgtgcaacatggcaacctgggttccgagacatcaaggtacttgtcggatttgtttaccaccctcgtggacctgaagtggcgctggaacttatttatattcatcctcacctatacagtcgcctggctgtttatggcttcgatgtggtgggtgattgcctacacccgcggagatttgaataaggcacacgtggggaattataccccctgcgtagcaaatgtgtataacttcccatccgcctttctctttttcatcgagaccgaagctactatcggctatggctatagatatatcactgacaagtgccccgaaggaatcattcttttcttgtttcagtcaatcctgggctctattgtggacgccttcctcataggatgtatgttcattaagatgagtcagcccaaaaagcgtgcggagacccttatgttctccgaacatgccgtgatttccatgcgtgatggcaaactcactctgatgttccgggtgggcaacctacggaactcccacatggtgtctgcgcagatcaggtgcaaactgcttaaatcaagacaaacacctgaaggagagttcttgcctttggaccaacttgaactggacgtgggcttttctaccggcgcagaccagctctttctggtgagcccacttaccatttgccacgtcatcgatgccaaaagcccattctacgacttgtcgcagagaagcatgcagacagagcagttcgaaatagtggtcatccttgagggaattgtggaaacgactggtatgacctgccaggccagaacctcatatacagaggacgaggtgctctggggccaccgattttttcccgtcattagccttgaagaagggttcttcaaagtagactacagtcagttccacgccacattcgaagtacccactcccccatatagcgtcaaggagcaggaggagatgctgctgatgagcagccctctaattgccccagcaatcacaaatagcaaggagcggcacaattcagttgagtgcctcgacggactggacgacattactacaaaactccccagcaagttacaaaaaatcacaggcagagaggattttcctaagaagctgctgcggatgagtagtaccacatctgaaaaggcctattcgctgggtgacctgccgatgaagttgcagcgcatctcttctgtgcccggaaacagcgaagagaagctcgtgagtaaaactactaagatgctcagcgatcccatgtcgcagtcggtggccgatcttcctccaaagttacaaaagatggcagggggagctgcgaggatggaaggtaatctgccggctaaattaaggaagatgaattccgaccggtttacctag

SEQ ID NO: 235661 - DNA, 708 bp, Artificial Sequence
  Description of Artificial Sequence: Synthetic coding sequence
atgtccgcacttaggagaaaattcggagacgattatcaggttgtaaccacttcttcctccggatcaggactccagcctcaggggccaggacaggacccacagcagcagctagttcccaagaaaaagcggcagcgctttgtggacaagaatggccgttgtaacgtgcagcacgggaacctcgggtctgaaacctctagatatctgtccgacctctttactacactggttgatttgaagtggcggtggaacctatttatcttcatactgacttacaccgtggcttggcttttcatggcatctatgtggtgggtgatcgcttacacaagaggcgacctgaataaagctcatgtgggcaactacaccccctgtgttgcgaatgtctataattttccatccgcttttttgttttttattgagaccgaggcaaccatcggttatgggtaccggtatatcacggacaagtgtcctgagggcatcatactctttctgttccagtcgatactcggaagcatcgtggatgctttcctgattgggtgtatgttcataaagatgtctcaacccaagaagcgggctgagacactgatgttctccgagcacgctgtaatttcgatgagggatggtaagttgaccctgatgtttcgagtcggcaatctcagaaacagccatatggtttctgctcaaattagatgcaaacttctgaagggatag

SEQ ID NO: 235662 - DNA, 1338 bp, Artificial Sequence
  Description of Artificial Sequence: Synthetic coding sequence
atgcacgggcactctagaaacggacaagcgcacgtcccaagaaggaaaagaagaaatcgattcgtgaagaagaacggtcagtgcaacgtctacttcgccaacctttctaataagtctcagcgttacatggccgacatttttacaacatgcgttgatactagatggcgttatatgttaatgatttttagcgcagccttcttagtgagttggctgtttttcggattgttattctggtgcatagcgttctttcacggagatttggaggctagccctggcgttccagccgctggtgggcctgccgctgggggtggaggcgctgcccctgttgccccaaagccttgtataatgcatgtgaatggatttttaggggcattcctttttagtgtcgaaacccagacaaccatcgggtatggttttaggtgcgtgactgaagaatgtcctctggcagtgatcgccgttgtagtccagtctatcgtgggatgtgtgatagatagttttatgatcgggacaatcatggccaaaatggccagacctaagaaaagagcccaaacactgcttttcagtcatcacgctgtcatttcagtgcgcgatggcaagttatgcctgatgtggcgtgtcggaaacctcaggaagagccacatcgtggaggctcacgtgcgcgcacagctgattaaaccctacatgactcaggagggggagtacctgccactggatcagcgcgacttaaatgtgggatatgatatcggtcttgaccggattttcctggtttccccaatcattatcgttcatgaaatcgacgaagactccccactgtacggcatgggcaaggaggagctggaatctgaggacttcgaaatcgtggtcatccttgagggtatggtcgaagccacagcaatgaccactcaggcgagatccagctaccttgcttccgagatcctgtgggggcacaggtttgaacccgttgtattcgaggaaaagtcccactataaagtcgattattccaggttccataagacttacgaggtggcgggtactccttgttgctctgccagggaactgcaggaaagcaaaattaccgtactccccgctccccctccaccgccttctgctttttgttatgagaatgaactcgcgcttatgtcccaggaggaggaggagatggaggaggaggcggctgcagccgctgccgtggctgccggtctcgggctggaggctgggagcaaggaagaagctggaatcataagaatgcttgagtttgggtcgcaccttgatttggaacgcatgcaggcctcacttcccctcgataacatctcttaccgcagggaaagcgctatttag

SEQ ID NO: 235663 - DNA, 1260 bp, Artificial Sequence
  Description of Artificial Sequence: Synthetic coding sequence
atggcaggagatagccgaaacgccatgaatcaggatatggagataggggtgacaccttgggatccgaaaaagattcccaaacaagccagggattatgtgcccatcgctacagaccggacacgcttgctggccgaggggaaaaagcccaggcagaggtacatggaaaagagcgggaagtgtaacgtccatcacggcaatgtgcaggaaacttaccggtacctcagcgatctttttacgaccctggtggatctcaaatggcgctttaacctgctcgtctttacaatggtgtatactgtgacctggctatttttcggattcatttggtggttgattgcatatataagaggggatcttgaccacgtcggggatcaggaatggattccgtgcgtggagaatctgagcgggttcgtcagtgcctttcttttctcaatagaaaccgagacaacaataggatatggctttagagtcattacagaaaagtgcccagagggcattatcctgcttctcgtgcaggcgatcctaggtagcatagttaacgccttcatggtcgggtgcatgtttgtgaagatctcgcaacctaagaaacgtgctgagacccttatgttcagtaataacgcagtaataagtatgcgggatgagaagctttgtttaatgtttcgcgtaggagacctcaggaactcccacattgtggaagcctctatcagggctaagctgataaagtctcggcagacaaaagaaggcgagttcatccctctcaaccaaactgacataaacgtgggctttgacaccggagatgataggctcttcctcgttagtcccctgatcatctcacatgagattaatcagaagagcccattctgggagatgtcccaggcacagctccaccaggaggagtttgaggtcgtcgttattctcgaggggatggtggaagccaccggcatgacttgtcaggccagatcaagttatatggatactgaggttctgtggggccaccgattcaccccggtcttaaccctggagaaggggttctatgaggtggactataacacctttcacgatacatacgagactaacacaccttcatgctgcgcaaaggaattagccgaaatgaaacgcgagggtagattgctccagtatttaccatctcccccattgttagggggatgcgcagaagccggacttgatgcagaagcagagcaaaatgaggaggacgagcccaaagggctgggcggaagtcgcgaggcgagaggtagcgtatag

SEQ ID NO: 235664 - DNA, 1260 bp, Artificial Sequence
  Description of Artificial Sequence: Synthetic coding sequence
atggcaggagatagccgtaatgcaatgaaccaggatatggagatcggagtcacgccgtgggatccaaagaagatacctaagcaggcccgtgattacgtacctatagcaaccgatcgcactagattacttgcagaaggcaaaaagcctagacagaggtatatggagaaaagtgggaaatgtaatgtccaccacgggaatgttcaggagacctatagatatctgagtgatctcttcaccactctggtggacctgaagtggcggtttaacttgttggtctttacaatggtgtacaccgtcacatggctgttctttggcttcatttggtggctcattgcctatatccggggtgatctggaccacgtgggagatcaggaatggatcccctgcgtagagaaccttagtgggtttgtaagcgcatttctatttagcatcgagacagagacaaccatcggctatggatttagagtgattacagagaagtgtcccgaaggcatcattctgttgctggttcaggctattttgggatctattgtcaatgcatttatggtggggtgtatgtttgtcaaaatttcccagcccaagaagagggccgaaacgctgatgttcagcaacaatgccgtgatctcaatgcgagatgagaagctctgcctgatgttcagggtgggggacctcagaaactcccacattgtggaagcttctattcgagccaaactgattaagtcccggcaaaccaaggagggagaatttatacccctgaatcagaccgatatcaatgtggggttcgatacaggggacgaccggctgttcttagtaagccccctaataatctctcatgagatcaatcagaagagcccattctgggagatgtctcaggcccagctgcatcaggaggagtttgaggtagttgtgatactcgagggcatggtggaagctacgggcatgacatgccaggccaggagctcttacatggacaccgaggtactctggggacaccgctttacccctgtgttgacattggagaaaggcttctacgaggtggattataataccttccatgatacctatgagactaataccccaagttgctgtgctaaagaactggccgagatgaagagagagggaagactccttcagtaccttccttctcctcccttactcggaggatgtgccgaggccggtctggacgccgaggctgagcaaaatgaggaggatgaaccaaagggactgggtgggtcccgcgaagcacgcggttccgtctag

SEQ ID NO: 235665 - DNA, 1260 bp, Artificial Sequence
  Description of Artificial Sequence: Synthetic coding sequence
atggctggcgatagtcggaacgccatgaatcaagacatggaaattggggtgaccccttgggatcccaaaaaaatcccaaaacaggccagagactacgtgccaattgctaccgacaggactcgtttactcgccgaaggtaagaagcctcggcagaggtacatggagaagagcggaaaatgcaatgtccaccacggcaacgttcaggagacctaccgatacctgtctgacctgtttactaccttggtggatctcaaatggaggttcaatcttctggtgtttaccatggtatacacggtgacttggctattctttgggtttatatggtggctcatcgcttacattcgtggcgatttagaccatgtgggtgatcaggagtggataccttgcgtggagaacctgagcggattcgtgtccgcattcctgttttccattgagaccgaaactactattgggtatgggtttagggtgataaccgaaaagtgcccagaaggaattatcctgcttcttgtgcaagcaattctgggatccattgtgaacgctttcatggtgggctgtatgttcgtcaagattagtcagcctaaaaagcgcgctgagaccctgatgtttagtaacaatgctgtgatctctatgcgggatgagaagctgtgcttgatgttccgcgttggcgatttacgcaactcccacattgtcgaagcaagcatccgcgctaagttaattaagtcccgccaaactaaggagggagagttcatcccactgaaccaaactgacattaacgtggggttcgatacaggtgacgacaggctgtttctcgtctcacccctcatcatctcccacgagatcaaccagaagagcccattttgggagatgagccaggcacagctgcaccaagaggaattcgaggtggttgtgatactcgaaggaatggtggaggccacgggtatgacatgtcaggcccgttcctcttatatggacacagaggtcctatgggggcaccgattcacgccagtcctgacactcgaaaagggattttatgaggtcgattataacacattccacgacacctatgaaactaacaccccctcatgttgcgctaaagaattggctgaaatgaaacgggaaggcaggcttctgcagtatctccccagcccccctctgctgggaggttgcgctgaagccggattggatgccgaagccgagcagaatgaggaggatgaacccaaaggccttggcggatcacgcgaagcccgtgggtcagtttag

SEQ ID NO: 235666 - DNA, 1272 bp, Artificial Sequence
  Description of Artificial Sequence: Synthetic coding sequence
atggccaagctgaccgagagcatgacaaacgtattagagggtgacagcatggatcaggatgtcgaatctcctgtggccattcatcagccgaaacttccaaagcaggccagggacgacttgcctcggcatatcagcagagacaggactaagcgaaaaattcaaaggtacgttagaaaagacggtaagtgtaacgtccatcacggaaacgtgagagagacatatagatatttgaccgacattttcaccaccctcgtagaccttaagtggaggttcaatcttcttatcttcgtaatggtgtataccgtgacatggctgttttttggaatgatctggtggctcattgcctatatcaggggggacatggatcatattgaggatccctcttggacaccatgcgttacgaatctgaacggctttgttagcgcatttctgtttagtattgagacagaaacaaccatcgggtatggataccgagttattaccgacaagtgccctgaagggattattctactgctgatacaatctgtcctgggcagtatcgtgaatgcgtttatggtgggatgtatgttcgtgaagatcagccaacccaaaaagcgagctgaaacacttgttttcagcacccacgctgtgatttctatgagagacgggaagctctgcctcatgtttcgggttggcgaccttagaaattctcacattgttgaagcctctatccgggcaaagctaattaaaagcaagcagaccagtgaaggagagtttattcctctcaatcagactgatatcaatgtgggatattatactggtgatgaccggctttttctggtttctcctttgattattagccacgagataaaccagcagtcaccattttgggagatctctaaagcccagctacccaaggaggaactggagatcgtcgtgatattggaaggtatggtggaggctacagggatgacatgccaggcacggagttcttacattacttccgaaatcttatgggggtataggttcacaccagtccttactcttgaggatggattctacgaggttgattacaactcgtttcatgagacctacgagacctcgactccctcgctgtcggcaaaagagctcgccgagttggctagccgtgctgaactgcccctgagttggtcagtgtcttctaagctcaaccaacacgccgaactcgaaactgaggaggaagagaaaaatttggaggagcaaactgagagaaacggcgacgtagcaaatcttgagaacgaatctaaggtatag

SEQ ID NO: 235667 - DNA, 1272 bp, Artificial Sequence
  Description of Artificial Sequence: Synthetic coding sequence
atggctaagctcacagaatcaatgaccaacgtgctggagggagattcaatggaccaagacgtggagagtccagtcgcgatccatcagcctaagttaccaaaacaggccagagacgatcttccaaggcatatctcccgagaccggaccaagcgcaagattcagaggtatgtgcgaaaagatggtaaatgtaacgtgcaccacgggaatgtaagggagacgtatcgatatctaacggacatctttacaactcttgttgacctgaaatggagatttaatctgttaattttcgtgatggtatacaccgtgacatggctgttttttggcatgatttggtggctgatcgcttatattaggggagatatggatcacatcgaggacccatcgtggacaccttgcgtgactaacctaaatgggttcgtctcagcctttctgttctcgattgaaaccgagacaaccataggctatggttacagagtgattaccgataagtgccctgaagggatcattttactactgatccagagcgttttgggctctatcgtcaatgctttcatggtggggtgcatgtttgtgaaaattagtcagccaaaaaagcgggctgagactttggtgttttctacgcatgccgtcatttcaatgagagacggtaagctatgcttgatgtttcgtgtcggggacctgcgcaattctcatattgtggaagcctccattagagcaaagctcatcaaatctaagcagacttcagaaggggagttcattccgctgaaccaaaccgacatcaacgtaggttactatactggagacgatagactctttttggtatcgcctttgattatatcccacgaaatcaatcagcagagtcctttctgggaaattagcaaagcgcagctgcccaaggaggagctggagatcgtggtgatactggagggaatggtagaagctacgggcatgacatgccaagctaggagctcatatattacttccgaaatcctgtggggctatagattcacccccgtgttgacgttggaggatggcttctatgaggtggactataatagcttccacgagacctacgaaaccagcactccatctctctctgctaaagagctggccgagttggcctcccgggctgagctgccccttagttggtcagtgtccagcaaactgaaccagcacgctgagctggagaccgaggaagaagagaaaaacctggaagagcagaccgagaggaatggggacgtggcaaacctcgagaacgagtcaaaggtctag

SEQ ID NO: 235668 - DNA, 1275 bp, Artificial Sequence
  Description of Artificial Sequence: Synthetic coding sequence
atgctggcccgaaagtcaatcatcccagaggaatatgtgctagctcgcattgctgccgagaacctgcggaaacctcgcatcagggatagactcccgaaagccagatttatcgctaaatccggggcttgcaatctggctcacaaaaacattcgtgaacagggacgcttcttgcaggacatttttaccaccctcgtggatctcaagtggcgccataccctagtcatctttacaatgtcgttcttatgctcatggctgctatttgccatcatgtggtggctcgtggctttcgcacacggcgatatctatgcatacatggaaaagagcgggatggaaaagtcaggattagagagtaccgtttgtgttacaaatgtgcgcagtttcacttccgcgtttttatttagtatcgaggtacaagtcacgattgggttcggtggcaggatgatgaccgaagaatgtccattggccatcaccgtcctaattctgcagaatattgtcggactgataatcaacgcagtgatgctgggatgcatcttcatgaagactgcccaggctcatcgcagagccgagactctgatcttcagcaggcacgccgtgatcgctgtccggaacggtaagttgtgcttcatgttccgcgtgggcgacctgcgcaaaagtatgataatatccgcatcggtgaggatccaggttgtaaagaagaccactacccctgagggggaagtcgtgcctattcaccagctggatattcctgtcgacaatccgatcgaaagcaacaacatattcctcgtcgcgcctctgatcatctgtcatgtgatcgacaagcggtctccactgtacgacatctccgctaccgacctcgctaatcaggatttagaggtgattgtaattctggagggagtggtggagacaactggcataactacgcaggcccgaacctcttatattgccgaggaaattcagtgggggcacagattcgttagcatagtgaccgaggaagagggcgtctattcagtagattatagtaagtttggaaacaccgtgaaagtagcggctccaaggtgttcagccagggaactggacgagaaaccgtcaatcctgatacagaccctacagaaatcggaactgtcccaccaaaattctcttcgcaagaggaacagtatgcgcaggaataactcaatgcggcgaaataacagcattcggcgtaataactcaagcctgatggtgcctaaagttcagttcatgacaccagaagggaatcaaaacacatccgagagctag

SEQ ID NO: 235669 - DNA, 345 bp, Artificial Sequence
  Description of Artificial Sequence: Synthetic coding sequence
atgctggcccgtaaatccatcatacccgaggaatacgtgctggcacgcattgcagcagaaaacctccgaaagccaagaattcgagacaggttgcctaaggccagattcatcgcaaaatcaggggcttgtaatctagcccacaagaatattcgcgagcagggccgattccttcaggatatattcaccaccctggtggatctgaagtggcgccacaccctggtgattttcacaatgtcctttttatgttcttggttgctcttcgcgatcatgtggtggctggtggcattcgcccatggcgacatttacgcgtatatggaaaagtcggggatggagaaaagtggctag

SEQ ID NO: 235670 - DNA, 1275 bp, Artificial Sequence
  Description of Artificial Sequence: Synthetic coding sequence
atgctggctagaaaatctatcattcctgaggagtatgtgctcgcccgtatcgcggcagaaaacctgcgtaagccgagaattagggacaggttgccaaaagcgagatttattgccaagtcaggggcatgcaatctcgcgcacaagaatatccgcgaacagggacggtttttgcaagacatattcaccaccctggtagatttaaaatggcggcatacccttgttatattcacaatgagttttctgtgctcttggctgctcttcgccatcatgtggtggctagtcgcctttgcccacggagatatctatgcttacatggaaaagtcaggtatggagaagtcaggcctggagtccacggtttgcgtgacaaacgtaaggagctttacatccgctttcctcttctcaatcgaggtgcaggtgactatcgggttcggcggtagaatgatgaccgaagagtgccctctggctataactgttcttattctgcagaacatcgttggcctaattatcaatgctgttatgctcggttgcatctttatgaagacagcccaagctcatcgaagggcagaaactctgattttctcacggcatgccgtgatcgcagtcaggaatggaaaactttgctttatgtttagagtgggcgacttaaggaagagcatgatcatttcggcttcagtccggattcaggtggtgaagaagaccacaacaccggagggggaagttgttcccattcaccagctagatatccctgttgataatcccatcgagtctaacaatatctttctagttgctcccctgattatatgccacgtgattgacaagaggtctccactttacgatatctctgcgacagacctcgccaatcaagatctggaagttattgttatcctcgagggtgtggttgaaaccacggggattacaactcaggctcgcacctcctacatcgctgaagaaatccaatgggggcatcgcttcgtgtccattgtgaccgaagaggaaggcgtgtacagcgtggactattccaagtttggaaacactgtgaaagtggctgctcccaggtgtagcgcacgtgagctggatgaaaagcccagtattctcatccagaccctgcagaaaagtgagctgtcacaccagaactctctgcgcaaaagaaatagcatgcgaagaaacaactccatgaggagaaacaattccatccgaagaaataacagctcactcatggtgccaaaggtgcagttcatgacacccgagggcaatcaaaatacttccgagagctag

SEQ ID NO: 235671 - DNA, 774 bp, Artificial Sequence
  Description of Artificial Sequence: Synthetic coding sequence
atgacagcatttccagcctctggaaagaaaagagagactgactactcagacggggaccctctggatgtacacaagcggttacccagcagtgctggggaagaccgggctgtcatgttgggctttgcaatgatgggcttttcagtcctgatgtttttcttactcgggaccactattctgaaaccatttatgctttccattcagagagaggagagcacatgcaccgccatccacacggacattatggacgactggctggattgtgcattcacatgtggcgtgcattgtcacggacagggtaagtacccatgcctccaggtcttcgttaatttgagccatcccggtcaaaaggcacttctccattataacgaggaggcggtgcaaattaacccaaagtgtttttacaccccaaagtgtcatcaggaccggaacgacttgctcaattccgccctggatattaaagaattttttgatcacaaaaacgggactccatttagctgtttctactcaccagcatctcagtccgaagatgtgatcctgattaaaaagtacgaccaaatggccatattccattgcttgttctggccctcgttgactctcttaggcggagccctgatagtgggtatggtacgcctgacccagcacctgtcactgctttgtgaaaagtatagcactgtagtgcgcgacgaagtggggggaaaagtcccgtacatagagcagcaccagttcaagctctgtattatgcgccgtagtaagggaagagccgagaagtcttag

SEQ ID NO: 235672 - DNA, 522 bp, Artificial Sequence
  Description of Artificial Sequence: Synthetic coding sequence
atgcaaccgttctccatccccgtgcagattacgcttcagggatcccgccgacgccaggggagaacagcgtttccggcttctggtaagaaacgggagactgattactctgacggtgatcccctcgacgtccacaagagattgcctagtagcgcaggggaagacagagcggtgatgctcggtttcgccatgatggggttctccgtccttatgttcttcttgctggggactacaatcctcaagccctttatgctctctatccagcgggaggagagcacctgcacagccattcataccgatatcatggacgattggctggactgcgccttcacatgtggtgtccactgccatggtcagggcaagtatccatgtttacaggtgttcgtgaacttaagtcaccccggacagaaggccctccttcactataacgaggaagctgtgcaaatcaacccgaagcgggatgttaccgactgtagagtcaaagagaagcagaccctgactgtctctgacgaacacaaacagtag

SEQ ID NO: 235673 - DNA, 840 bp, Artificial Sequence
  Description of Artificial Sequence: Synthetic coding sequence
atggatttctcacccagctcagaattagggtttcatttcgttgcttttattctgttgacgaggcatcgcactgcctttccagctagcgggaagaaaagagagaccgactattcagacggagatcctctggacgtccataagagattgccttcatccgctggggaagatagggctgttatgctgggcttcgctatgatgggcttttctgtgctgatgttctttttgctgggtacgacaattctgaaacccttcatgttgtctatccaacgcgaggaatcaacatgtactgctattcacactgatatcatggacgactggctcgattgcgcgtttacatgcggagtccactgccacggccagggaaagtatccatgcctacaggttttcgtgaatctcagtcatcctgggcagaaggcgctgctgcactacaacgaagaagccgttcagatcaaccccaaatgcttttacacccctaaatgccatcaggaccgcaacgatctgttgaacagcgcgttggacattaaggagttcttcgatcataagaacggaacccccttctcttgcttctactcaccagcatcccagagcgaggacgtgattctgataaaaaaatacgaccagatggctatttttcactgtctgttttggccctccctgactttgctgggcggtgccctcattgttggcatggtacgccttacccagcacctgtcactcctgtgcgaaaagtattccaccgtggtgcgggatgaagtgggcggtaaggtgccttacattgaacagcatcaatttaagctgtgcattatgaggaggtctaaaggcagagcagaaaagtcatag

SEQ ID NO: 235674 - DNA, 834 bp, Artificial Sequence
  Description of Artificial Sequence: Synthetic coding sequence
atgcagcccttctctatccctgttcagatcaccctccaggggagccgtcgtagacaggggcgtaccgcgttcccagcgagtggcaaaaaacgcgagaccgattattctgacggcgacccactggacgtccataaacgactgccatcgtcagccggagaggatagagctgtgatgttagggttcgccatgatgggcttcagcgtgctgatgttctttctgctgggaaccaccattctgaaaccgttcatgctttctatccagcgcgaggaaagcacctgcacagccattcataccgacatcatggacgactggctggactgcgcgttcacctgtggggttcactgtcacggccaggggaaatacccttgcttgcaagttttcgtcaacctctcccaccccggacaaaaagccctgctccattataacgaggaagctgtgcagataaatcctaagtgcttttatacccccaagtgccaccaggatcgcaatgacctactcaactcggcccttgatattaaagagttcttcgatcataagaacgggactccattttcgtgcttctacagccccgcaagccagtccgaggatgtaatactcatcaaaaaatatgatcaaatggctatattccattgtctcttctggccttccctgacccttctgggcggagcactgatcgtcggaatggtgcgcctgactcagcatttatccctgttatgcgagaagtactccacggtggtgagggatgaggttgggggaaaggtgccttatatagagcagcaccagttcaaactgtgcatcatgcgcagaagcaagggacgagcagagaaatcatag

SEQ ID NO: 235675 - DNA, 828 bp, Artificial Sequence
  Description of Artificial Sequence: Synthetic coding sequence
atgttcccactcctatatgagcttactgccgtcagtccctcgccattccctcagcgcaccgcatttcccgcttccggcaaaaagagagagactgactactctgatggtgaccccctggacgtccacaagcgcttaccctcttccgctggcgaggatcgggcagtaatgctcgggttcgctatgatgggattctccgtcctaatgtttttcctccttggaaccactatactgaagccattcatgctctccatccagcgcgaagagtccacctgtacagccatccatactgatatcatggacgattggttggactgcgcttttacttgcggcgtacactgccatgggcaagggaagtacccttgcctgcaggtgttcgtgaacctttcacaccccggtcagaaagccttgctgcactacaacgaggaggctgtgcaaatcaatcccaagtgtttctatactcccaaatgtcatcaggacagaaacgaccttctgaacagcgcgcttgatatcaaagagttctttgatcacaagaacgggactccattctcctgcttctacagcccagcctcccaatccgaggatgtgatcttgatcaaaaagtatgatcaaatggccattttccactgcctgttctggccctcgcttacactcctcggtggggcactgattgttggaatggtccggctgactcagcacttgtctcttctttgtgaaaaatatagcactgtggttagagatgaggtgggaggcaaggtcccctacatcgagcaacatcagttcaaattatgcattatgaggagatcaaaggggagggcggagaagagctag

SEQ ID NO: 235676 - DNA, 774 bp, Artificial Sequence
  Description of Artificial Sequence: Synthetic coding sequence
atgactgcttttcctgcctctggcaagaagcgagagactgactacagcgacggcgatcctctggatgttcacaagagacttccttcctccgcaggagaggatcgggcagtcatgctggggttcgccatgatgggattctcggtgcttatgttcttcctgctggggaccacaatcctgaaaccctttatgttgagtattcagcgcgaggaatcaacctgcaccgccatccacactgatataatggacgactggctggactgcgcctttacgtgtggcgttcattgtcacggtcaggggaagtacccctgtttgcaggtttttgtgaatctatcacacccaggccagaaggcccttctccattataatgaggaggccgtgcagattaatcctaagtgtttctatacccctaagtgtcatcaagatcgcaacgatctactgaattcagcattggacattaaagagttcttcgatcataagaacgggacgcctttctcctgcttctacagtcctgcaagtcagagcgaggacgtgatactcattaagaaatatgatcagatggcaatcttccactgcctgttttggcccagtcttacattgctgggcggagccctcatcgtagggatggttcgattgacacagcatctttctctcttgtgcgaaaagtacagtaccgttgtgagagatgaagtcggcggaaaagttccctacattgaacaacaccaattcaaactgtgtatcatgcgcaggtcaaagggacgcgctgaaaagtcttag

SEQ ID NO: 235677 - DNA, 3537 bp, Artificial Sequence
  Description of Artificial Sequence: Synthetic coding sequence
atggcgaatggaggcggtggaggaggcggaagcagcggcggagggggaggtggcggaggtagctcccttaggatgagcagcaacattcatgccaatcacctgtctttggatgcttcctcctcttcttcttcttccagctcctcatcttcgtccagctcaagctccagctcctcttcaagcgtgcacgaacccaagatggatgccctgattattccagtgactatggaggtgccctgtgactcccggggacagcgcatgtggtgggctttcctggccagtagcatggtcaccttcttcggtgggctcttcatcatccttttgtggcgtaccctgaagtatctgtggacggtctgctgccactgcgggggaaagactaaagaggcgcagaagatcaacaacggtagtagtcaggcagacggaaccctcaaaccagtggacgaaaaagaggaggcagtggccgcagaagtaggatggatgacgagcgtgaaagactgggctggggtgatgatttcggcccagaccttgaccggacgcgtgctggttgtactggtatttgcactctccattggagcattagtaatctattttatagattcaagtaaccctattgagtcatgtcagaatttctacaaggacttcaccctccagattgatatggccttcaatgtcttctttctgctatacttcggcctgcgtttcatcgccgctaatgataagctttggttttggctcgaggtaaacagcgtcgttgactttttcacagtgcctcctgttttcgtttcagtatatcttaatagatcatggctcgggttgaggttcctgagggccctgaggctgattcagtttagtgaaattctccaattcctgaacatactcaaaacatctaactctatcaagctcgtcaatctactcagcatatttatctctacctggctgaccgcggcaggctttatacatctcgtcgagaattccggagatccctgggaaaacttccaaaacaaccaggccctgacatattgggaatgtgtatacttgctcatggttacaatgtcgactgtgggctacggagatgtgtacgcaaagacaacactgggcaggctattcatggtctttttcattttgggcggactggctatgtttgcgagctatgtgcccgaaataattgaactcatcggaaaccggaagaaatacggtggctcgtattcagcagtgtccggcaggaaacacatcgtggtgtgcggacacattaccctcgaaagcgtctccaattttctcaaagacttccttcacaaagacagagacgatgttaatgtggagatcgtgtttctgcataatataagtccaaatcttgaactggaggccctgttcaaaaggcactttactcaggtcgaattctatcagggatccgtgctaaatcctcatgatcttgccagagtcaagatcgaatcagccgacgcctgcctaattctggcgaacaagtactgtgcagaccccgacgctgaagacgcgtccaatatcatgcgggtcattagtataaagaactatcaccccaagatacggatcatcacccagatgctccaataccacaataaggcgcatctgctcaatatcccgtcttggaattggaaagagggcgatgatgctatatgcctggcagagctgaagcttggctttatcgcccagagctgcctggcccaagggttaagcaccatgttggccaaccttttttcaatgcggtcgttcataaagattgaagaggatacatggcagaagtattacttagagggagtctccaatgagatgtatacagagtacctcagctcagcctttgtgggcttgagctttcccaccgtgtgcgagctatgtttcgttaagttaaagctgttaatgatagcgatagagtacaagtccgctaacagagaaagtagaattttgatcaaccccggaaatcatctgaagatccaagagggaaccctgggattttttatagcatctgatgctaaggaggtaaaacgtgctttcttctattgcaaagcatgtcacgacgacattacagatccgaaacgcatcaaaaagtgcgggtgcaagcgtctggaagatgagcagcctagtacgctgagccctaagaaaaaacagcgcaatggtgggatgcgcaactctcccaatactagcccgaagctgatgcgccacgatcccctccttatccctgggaatgaccaaattgacaacatggactccaatgtcaaaaaatacgattccaccggtatgttccactggtgcgcccctaaggaaatcgaaaaggtaatcctaactagaagcgaagctgctatgacagtgctgtcgggtcatgttgttgtgtgcattttcggcgacgtaagttctgctctaatcggtctgaggaatctcgttatgccactacgggcttctaattttcattatcacgaactgaagcacatcgtgttcgtcgggtcaatcgagtatcttaagcgcgagtgggagacgttacacaacttccctaaggtgtccattctcccagggacacccctctcccgcgctgatctaagggcggtgaatattaacctgtgcgacatgtgcgtcatcctgtctgctaatcagaataacatcgacgacacctctctccaagataaagaatgcatactcgcctcattaaacatcaagtccatgcagttcgatgacagcataggggttctacaggccaattcccagggcttcactcccccaggcatggataggtcttctcccgacaattctcccgtacatgggatgctcaggcagccgagtattaccacgggggtgaatataccaatcatcacagagttggttaacgacactaatgtgcagtttttggaccaagacgatgatgatgacccggatactgagctgtacctaactcagccattcgcgtgcggaactgcatttgctgtgtccgtgctcgatagcctgatgagcgccacatacttcaacgataacatcctgactttgatcaggaccctagttaccggtggcgcaactcctgagctagaagcactgatcgcagaagagaatgcccttagaggaggatatagtactccccagactctggcgaatcgcgataggtgccgcgtagcacagctggctctcttggatggaccttttgcagacctgggggatggcggatgttacggtgacctgttttgtaaggctcttaagacctacaacatgctgtgcttcggaatctacaggcttagggacgcccacctctcgactccttcccagtgcactaaaagatatgtcataacaaaccctccatatgagtttgagctggttcctaccgaccttatcttttgcctaatgcaatttgaccacaacgctgggcagagccgcgcaagtctgtctcattcttcacactcttcgcagagcagttctaaaaagagctcctctgttcattcaattccttcaaccgccaaccgtcagaaccggcctaagtctcgagaatcacgggataagcaaaaatatgtgcaggaagagcgtctgtag

SEQ ID NO: 235678 - DNA, 3633 bp, Artificial Sequence
  Description of Artificial Sequence: Synthetic coding sequence
tccaatatccatgccaaccatctgtcattagatgcaagctctagttcaagctctagttccagctccagctcttcctcttcctcatcctcctcctcgtcaagtgtgcacgaacctaaaatggatgcccttatcatcccggtgacaatggaggtcccttgcgattctaggggtcaacgaatgtggtgggctttcctcgcatctagtatggtgactttcttcggcggtctattcataatcctactgtggcgaactttgaagtacctgtggactgtgtgctgccattgtggcggaaaaacaaaggaggcacagaaaattaacaatgggagtagccaagccgacgggacgctcaaaccggtggatgagaaggaggaggccgtggccgcagaagttggatggatgacctccgtcaaggattgggctggcgtgatgattagcgcccagactctgactggacgggtactggtggtgctcgtgttcgctctctccatcggagcgctggtaatctactttatagacagttctaatccaattgagagttgccagaatttttataaggacttcaccctccaaatagacatggcgtttaacgttttttttctgttgtactttgggttacggttcatcgccgcaaacgacaagctgtggttttggctggaagtgaattctgtagtcgatttctttaccgtgcctcccgtgttcgtgagtgtctatctgaaccgctcctggctgggtctgagatttcttagggcccttcgccttattcaatttagtgagatcctgcagttcctgaatattctgaaaacgtctaacagcattaagttggtgaacctgctgagtatcttcataagcacctggctgacagccgctggctttatccacttagttgaaaactcaggtgacccctgggagaatttccagaacaatcaagctctgacctattgggaatgtgtgtacctgttaatggtcacgatgtcaactgtgggatacggcgatgtgtatgccaaaacaacgcttggacggctcttcatggttttctttattttaggaggcctggccatgtttgcttcatacgtgccagaaatcatcgaactcattgggaatagaaagaaatacggcggatcatattccgcagtaagtggccgtaagcacatcgtagtgtgcggccacattaccctggagagcgtgtcgaacttcttgaaggacttcttgcacaaggacagagatgatgtgaatgtggaaatagtcttcctccacaacatctctcctaacctggagttagaagccctctttaagagacatttcacgcaggtggagttctaccagggttcggtgctgaaccctcacgacctcgccagggtcaagatcgaatctgccgacgcctgcttaatcctcgctaataagtactgcgctgaccccgacgctgaggacgcatctaacatcatgcgggttatcagtattaaaaactaccatccgaagattaggataatcactcagatgctgcaatatcacaataaagcacatctgctcaatatcccatcgtggaattggaaggaaggcgatgacgccatatgtttggcagagctcaaactcggcttcatcgctcagagttgcttagctcagggacttagcacgatgctcgccaatcttttttccatgagaagcttcatcaagatcgaagaggacacctggcaaaagtactacttggaaggagtcagcaatgagatgtacacagaatatctctcttcagctttcgtaggcctcagctttcccactgtgtgcgaactatgctttgttaagctgaaattactcatgatcgcaatcgaatacaagtcagccaacagggagtcccggatcttgatcaaccccggaaaccatttgaaaatccaggaaggcaccctcggattctttattgcaagtgatgctaaagaagtgaagcgagcctttttctactgtaaggcttgccacgacgatattaccgatccaaagcgcataaagaagtgtggctgcaagagaccaaagatgtccatctacaaaaggatgcgtcgcgcatgttgcttcgactgtggcaggtcggaacgggattgtagttgcatgagcggtagggtcagaggcaatgtcgacacactggaaagagcattccctctctcgtctgtaagcgtaaacgactgctccacaagtttccgtgcctttgaggatgagcaaccttctacactcagtccaaaaaaaaagcagagaaacggtggtatgcgcaacagtcccaatacctctcctaaacttatgcgacacgatccactgttaatcccgggtaatgatcagatcgacaacatggactctaatgtgaagaagtacgactcaactggcatgtttcattggtgtgccccaaaggagatcgagaaggtgatcttaacaagatctgaagctgccatgacggtgctttctggacacgtggtggtctgtattttcggcgacgtgtcctccgcccttatcggactgcggaatctagtcatgcccctgcgggcttcaaatttccattaccacgagctaaagcacatcgtgtttgttggaagcatcgagtacctgaaacgcgaatgggaaacgctgcacaacttccctaaggtctcaatcttgcccggaacaccgctctctcgagctgatctgagggctgtcaatatcaacctgtgtgacatgtgcgtaatcttaagtgccaaccagaacaatatagacgacacctcgcttcaggacaaagaatgtatcttagcctcgctgaatattaagtctatgcagttcgacgactctatcggcgtgctacaagccaacagtcagggattcaccccccctggcatggaccgtagctctccggataactctcccgttcatggcatgcttaggcaaccgtccattacaacgggtgtgaacatccccatcatcacagaactagtgaacgacacaaatgtgcagttcctcgaccaggacgatgacgacgatcctgataccgaactgtacctcactcagccgttcgcatgtggcacagctttcgccgtctccgtcctagattccctgatgtccgccacttactttaacgataatattctcactctgattcggaccctggtgaccggcggtgccacccccgagctggaagcactgatcgccgaggaaaacgctctgcgcggaggatattccacaccccagacccttgctaaccgggatcggtgccgggtggctcagttagccttactcgatggaccattcgccgatctgggagacggcggatgctacggggacctgttttgcaaagccctgaaaacgtataacatgttgtgtttcggcatttatagactgagggacgcccatttgtccacccctagccagtgtaccaaacgctatgtgatcaccaatcccccttacgagttcgagcttgtgcctacagacctcatcttctgtctgatgcagtttgaccataacgctggacagtcccgcgctagtctgtcccatagtagccactctagccaatcatcctccaaaaaatccagctctgtacattccataccgtccactgccaaccggcagaataggccaaagtcccgcgagtcccgcgataagcagaagtacgttcaggaggaaagactgtag

SEQ ID NO: 235679 - DNA, 3720 bp, Artificial Sequence
  Description of Artificial Sequence: Synthetic coding sequence
atggccaacggaggcggagggggtgggggttcctctgggggtggaggcggaggagggggttcatctctgcggatgtcctcgaacatccacgccaatcacctctctctggacgcttcatcctccagctcgtcttccagtagttcctccagcagcagttcaagtagcagctcctcctcaagcgtccacgaaccaaaaatggacgcgcttatcataccagttacaatggaggtgccgtgtgacagtcgtggacagcgaatgtggtgggcgtttctagctagctcgatggttacttttttcgggggtctcttcattattctactctggaggacactgaagtatttatggaccgtgtgctgccactgcggcggaaaaactaaggaggcacagaagattaataacggcagcagccaggccgatggtacgcttaagcccgtggacgaaaaggaggaagcggttgccgcagaggtgggatggatgacttctgtgaaggactgggcaggcgtgatgatcagcgcccaaacactcaccggcagagtactagtggtactggtattcgctctgtccataggcgcactcgtgatttatttcatcgacagttcaaaccccatcgaaagttgccagaatttttataaagacttcactctgcagatcgacatggcctttaatgtcttttttctcctttactttggcttaagattcatcgccgctaacgacaaactctggttctggcttgaggtgaactcagtcgtggacttcttcacggtgcctcctgtcttcgtgagtgtgtatctcaataggagctggcttggcctcagattcctgagggctctgaggctaatccagttctcagagatccttcaattcctgaatatcttgaaaacctctaatagcataaagctcgtcaacttgctgagcatttttatctccacctggcttacggcagcaggcttcattcacttggtcgagaattctggtgacccctgggagaacttccaaaacaatcaggccctaacttattgggagtgcgtataccttctgatggtcactatgagcaccgtcggctatggcgacgtatatgccaaaacgactctgggccgactattcatggtcttcttcattttgggcggacttgcaatgttcgcatcctacgttcctgagattatagagctgatcggcaaccgcaaaaagtatggaggatcatacagcgccgtgagtggaaggaaacatattgtggtgtgtggacatattacactcgaaagtgtgtccaacttcctgaaggacttcttgcacaaggatcgcgatgatgtgaatgtggaaatcgtctttctgcacaacatctcgccgaatttagaactcgaggctctcttcaaacgccatttcactcaagtggaattttatcagggatctgtgctcaacccgcatgatttggctcgcgtaaagatcgagagcgctgacgcatgtctgatcctagcgaacaaatattgcgccgacccggatgccgaagatgcctcaaacataatgcgtgttatatcaatcaaaaactaccatccaaagatccgcattataacacagatgttgcagtaccacaacaaggctcaccttctaaacatcccttcatggaactggaaagagggcgatgatgcaatttgtttggcagagctcaagttaggatttattgcacaatcgtgtctggcgcaaggactgtcaaccatgcttgccaatctcttttcaatgcggtcctttatcaagatagaggaggacacatggcaaaaatactacttagaaggagtgagcaatgagatgtataccgaatacctctcttccgctttcgtcggattaagcttccctacggtttgcgagctgtgcttcgtaaagctgaaactactgatgatcgccattgaatacaaaagcgccaatcgggagagtaggatcctgatcaatcctggaaaccacctgaagatacaggaaggcacccttgggttctttattgccagtgatgccaaggaagtcaagagggcttttttctattgtaaagcctgccatgatgatattacagacccgaaacgtatcaagaagtgcggatgcaagagacggtgggaagagcactgctctctctggcgtctggaaagcaagggcaatgtgcgcaggctgaactattgccgtggccagcaaaccttcagcgtcaaagttaaggttgcagctagaagcaggtatagcaaggatccctttgagttcaagaaagaaacacccaatagccgccttgtgaccgagcccgtcgaggacgaacagccctctactctcagtccaaagaagaagcagcggaatgggggtatgagaaattccccgaatacctcacccaagctgatgaggcacgacccacttctgattcccggtaacgatcagatcgacaacatggattccaatgtgaaaaagtacgacagcactggcatgtttcattggtgtgcaccaaaggaaattgagaaggtgatcttgacccggtccgaggccgcaatgacagtgctctccggtcacgtggtggtttgcatatttggggacgtaagctctgccctgatcggccttaggaacttggtcatgcctctcagggccagtaatttccactaccacgaattaaagcacatagtattcgttggcagcattgaatacctcaaaagagaatgggagaccttgcacaattttcctaaggtcagtattctccccggaactcctctcagccgcgcagatctgagagcggttaacattaacctttgcgacatgtgcgtgattctctcggctaatcagaacaatatcgacgacacatcgttgcaggacaaagaatgcattctcgccagcttaaatatcaagtcgatgcagttcgacgactccataggagtgctccaggccaattcccaaggattcacaccaccaggtatggacaggagttccccagacaactccccagtgcacggaatgttgcgccagccctcgattaccacaggggtgaacataccaatcatcacggagctggtcaacgacaccaatgtgcaatttctagatcaggatgatgatgacgacccagacaccgagctctatctgacccagccgttcgcctgtggaactgcttttgcggtgagcgtgcttgactctctcatgtctgccacgtattttaatgacaatattctcactctcattcgtactcttgtgactggcggagcgacacccgaactggaagcccttattgccgaagaaaacgctctgcgcggtggatattctaccccacagactctggcaaatcgcgatcgttgtagggtcgctcaacttgccctgctggatgggcctttcgccgacctgggagacggaggatgttatggggacctgttctgtaaggcccttaagacttataatatgctgtgctttggcatctatcgcctgcgggatgctcacttgagtactccaagccagtgtacgaaaagatatgtgatcacgaacccaccatacgagtttgaattggtccccaccgatcttattttttgtctgatgcagttcgaccacaatgcaggacagtccagggcttccctgagccattcctcccattcctctcagtcttcttcaaaaaaaagcagctccgtgcactcgatcccctcaaccgccaacaggcagaacaggccaaagagcagggagagccgcgataaacagaagtacgtccaggaggaacgactgtag

SEQ ID NO: 235680 - DNA, 3549 bp, Artificial Sequence
  Description of Artificial Sequence: Synthetic coding sequence
tgaagcagtagttcaagctcctcatcttcctccgtacacgaacctaaaatggatgccttaattatccccgtcactatggaagtcccctgcgattccagaggccagcgtatgtggtgggccttcctggcgagctcaatggtgacgttcttcggaggactgtttatcatcctcctctggcggacacttaaatacctctggactgtgtgttgtcactgcggagggaaaactaaggaagcccaaaagattaataacggcagcagccaggccgatggcacattaaagccggtggacgagaaggaggaagctgtggcagcagaggtcggctggatgacttccgtgaaagattgggccggagtaatgataagtgcccagacactgactggtagagttctcgtggtcctggtgttcgccctttccattggcgctctagtcatctactttattgactcctccaacccaatcgaatcttgtcagaacttttataaggacttcaccctgcagattgacatggcgttcaacgttttttttctgctgtatttcgggctgcggtttatcgctgccaacgacaagctctggttctggcttgaggtcaactcagtcgtagacttctttacagtgcctcctgtcttcgtgtcagtctacctgaatcgaagctggctgggcttgagatttttgagggccttgaggttaatccaattcagcgaaattctccagttcctaaacatcctgaagacaagtaattcaatcaagctagttaatctgctgagcatttttatctcgacctggctgaccgctgctggatttattcacctcgtggagaacagcggagatccatgggaaaatttccagaataatcaggccttgacttattgggagtgcgtctaccttctcatggtgacaatgtctacagtggggtacggggatgtgtacgctaagactacactgggtagactgtttatggtgtttttcattctgggaggtcttgctatgttcgcctcatatgtcccggaaattatcgaactgatcggaaaccgaaaaaaatacgggggtagctattcagcagtgtcaggcaggaaacatatcgttgtctgcgggcacataactctcgaaagcgtgtccaacttcctgaaggacttccttcacaaagatagggacgacgtcaacgtggaaattgtgtttctgcacaacatctcaccaaacctggaacttgaagctttatttaagcgtcattttactcaagttgagttttatcaggggtccgtacttaaccctcatgatctcgcacgagtaaagattgagtccgccgatgcctgcctaatcctagccaacaaatattgtgctgatccggatgcggaagatgcatccaacatcatgcgggtcatttctatcaagaattaccacccaaagattaggatcatcacgcagatgcttcagtaccacaacaaggcacatcttctgaatataccctcatggaactggaaggagggagatgacgccatttgtctggccgagctgaagttggggttcattgcccaatcctgcctggcccagggactgtctacgatgttggccaatttgtttagcatgaggtctttcataaagatcgaagaagatacctggcagaaatactacttggaaggcgtgtccaacgaaatgtacacggagtacctctctagcgctttcgtcggactcagctttccgaccgtatgtgaactctgttttgtcaaactgaagctattgatgattgcgattgagtacaaaagtgccaatagagaatcccgcatcttaattaatccaggcaaccacctgaagattcaggaagggacccttggattctttatcgcctcagatgctaaagaagtgaaaagggccttcttttactgtaaagcctgtcacgacgatataacagaccccaagcgcattaaaaagtgtggctgcaaaaggttggaagatgagcagccatccacactctctccgaaaaagaaacaacgcaacggaggtatgcggaattctcccaatacctcgccaaaattgatgcgtcacgacccactgctgatcccaggaaatgaccagattgacaatatggactctaatgtaaagaaatacgactctactgggatgtttcattggtgcgcacccaaggaaatcgaaaaggtcatcctcacacggtctgaggctgcaatgactgtgctatctggccacgttgtggtttgtatcttcggggatgtctccagcgctttgatcggccttcgcaacctggtcatgcctttaagggcctctaatttccattaccatgaacttaagcacattgtttttgttggcagcattgagtaccttaaaagggagtgggagacactacacaactttcccaaagtcagcatactgcccggaacacctctctccagggcagacctgcgcgctgtgaatattaacctctgcgacatgtgcgttattttgagcgccaaccaaaacaatatcgacgatacgagcctccaggacaaagagtgcatactggcaagcctcaatattaagtctatgcagttcgacgactccattggcgtcttgcaggctaacagccaggggtttacaccaccaggcatggacagatccagccccgacaatagtccagtgcatggcatgctgagacagcctagcattactacaggggtaaatattccaattatcaccgaactggtgaacgataccaatgtgcaatttctggaccaagatgatgacgatgatccagacactgagctgtaccttacccaaccattcgcatgcggcacggccttcgctgtgtccgtacttgattccctgatgtccgctacctactttaacgacaacattctaaccttaatcagaaccctggtaactggtggtgccaccccagagcttgaggctctgattgccgaagaaaacgccttacggggagggtactctacacctcagaccctggccaacagggatcgctgtagagtcgcccagctcgcgctccttgatggcccttttgccgatctgggggacggcggttgttatggtgacctgttttgcaaagcattgaagacatataatatgttgtgctttggcatatatcggctacgagatgcacatttaagcacgcccagtcaatgcacgaagcggtacgtaattacaaatccaccctacgagtttgaattggttccaaccgatttaattttttgtctcatgcagtttgaccataatgccggacagtcgagggcatccctgtcccacagtagtcactctagccaaagttcatcaaagaaaagctcttcggtgcattccattccatcaaccgccaacaggcagaaccgccctaagagtcgggaatctcgcgataaacagaatgccacgagaatgaacagaatggggcaggcggagaagaaatggtttacagacgagcctgataatgcctaccccaggaatattcagatcaagccaatgagcactcacatggccaatcaaatcaatcaatataagtccacatcttccctgatcccgcctattagggaggtggaggatgaatgctag

SEQ ID NO: 235681 - DNA, 3504 bp, Artificial Sequence
  Description of Artificial Sequence: Synthetic coding sequence
cccaagatggacgctctgatcattcctgtgaccatggaggtcccctgtgactccagaggccaacgtatgtggtgggccttcttggccagcagtatggttacattctttgggggactgtttattatccttctatggagaaccctgaagtacctctggaccgtgtgttgtcactgcggcggtaagaccaaggaggctcaaaaaatcaacaatggctcctctcaggccgacgggactctgaagcctgtggacgagaaagaagaggccgtggccgcagaggttggctggatgacctccgtgaaagattgggccggagttatgatttcagcacagaccctcacaggacgcgttctggtggtcctggtgttcgcactgtctataggggctcttgtgatctactttatcgattcgtccaacccaattgagtcctgccaaaatttctacaaggacttcaccttacagattgatatggcattcaatgtgttcttcttgctctactttggtctccgcttcatagctgccaacgataaattatggttttggttagaggtcaattctgtggtggacttcttcacagtaccacccgtgttcgtcagcgtatacctcaacaggagttggctggggttgcggttcctgcgggctctcagacttattcaattttctgagatcctccagtttttaaatatactaaagacaagcaacagcatcaaactggtgaatctcctgagcatctttattagtacctggctcaccgccgcaggatttatccacctcgtcgagaattctggcgatccgtgggaaaacttccagaataaccaggcgctgacctattgggagtgtgtgtacctgctgatggtgaccatgagcacagtgggatatggtgacgtgtacgcaaagactacactggggagactcttcatggtgttcttcatcctgggtgggctggccatgttcgccagctacgtgcctgaaataatcgagctgatcggaaacaggaaaaaatacgggggaagctatagcgccgtcagcggcagaaaacatattgttgtgtgtggacacatcaccctggaatccgtcagtaatttcctgaaggatttcctgcacaaagaccgcgatgacgtgaacgtcgagattgtctttttgcataatataagccccaatttggaacttgaggctctctttaaacgccatttcacacaggtggagttttaccaaggctccgtactgaacccccacgaccttgctcgtgtcaagatagaatctgctgatgcatgcctcattctggccaataagtactgcgccgatccagacgcggaggacgcatctaatatcatgcgagtgatctctattaaaaactaccaccctaaaattcggatcataacacagatgctgcagtaccacaacaaagctcatctgcttaacatccccagctggaattggaaagaaggcgacgacgctatttgtttggcagagttgaagttgggcttcattgcccagtcttgtctggctcaaggtctctcgactatgctggcaaacttgttttctatgcgttccttcattaagatcgaagaagacacctggcagaagtattacctggagggggtcagcaatgagatgtataccgaatacctctccagtgcctttgtcggtctgagcttccccaccgtgtgcgaactctgctttgtgaaacttaaattattaatgatagcaatcgagtataagagtgccaaccgtgaatcccgaattctcattaatcccggaaaccatctgaagatccaagagggaacactgggtttcttcatagcatctgatgccaaggaagtgaaacgtgcatttttctattgcaaggcctgccatgatgatattaccgatccaaagcgcattaaaaaatgtggctgcaagcggctagaagacgaacaacctagtacactcagtccgaagaagaagcagcggaatgggggaatgcgcaactcccccaacacatccccgaagctaatgcgacatgaccctcttcttatacccggaaatgaccagattgacaacatggattcaaatgttaagaaatacgacagtacaggaatgtttcactggtgtgcaccaaaagaaattgagaaagtgatactgaccaggtccgaagcagccatgaccgtgctaagcgggcacgtagtggtctgcatctttggggacgtgtcatccgccttaatcggactgcggaatctcgtaatgcctctgcgcgcttcaaattttcattatcatgagctcaagcatatcgtgttcgtgggctcaatcgagtatcttaaaagggagtgggagacactccacaacttccccaaagtgtctatccttcccggtacaccactttcccgcgctgatcttcgggcagtgaacattaatctttgcgatatgtgcgttattctgtccgcaaaccaaaataatattgacgatacaagcctgcaagataaagagtgcattctggctagtctcaacatcaaaagcatgcagtttgacgacagtattggggtgctgcaagcaaactcgcaggggttcacgccgccaggcatggaccggagtagtcccgataatagcccagtgcacggaatgcttcgccagccaagcataaccaccggggtgaatatacctattatcaccgaactggtcaatgacaccaacgtgcagtttcttgaccaggatgatgatgatgatccagacacagagctatatcttacacagcctttcgcctgcggcacagcgtttgccgtttcggtattagatagcctaatgtctgccacatacttcaacgacaacatcctgaccctgatccgcaccttggtcactggcggtgctactcctgagctggaggctctgattgccgaggaaaatgctttgcgtggtgggtacagtacaccccaaacactggccaaccgagataggtgccgcgttgcacagctggctttgctggacggaccattcgctgatcttggtgatggaggttgctacggggatctcttttgcaaagcactgaaaacatataatatgctgtgctttggtatatatagattacgtgacgcgcacttatcaactccttcacagtgtactaaacggtatgtgatcacaaaccctccttatgagtttgaactggtgcctactgacctcatattttgcctgatgcaatttgaccacaacgccggacagtccagagctagccttagtcactccagtcacagtagccaaagctcgagcaaaaaatcatctagcgtccattccattccaagcacagccaatcgccagaaccgacctaaatcgcgtgagtccagagacaaacagaatgccacccgcatgaataggatgggtcaggagaaaaagtggttcactgatgaacctgacaatgcctaccctcgtaacattcagatcaagcctatgtcaacccatatggctaatcagatcaaccagtacaagtccacctcctctctcattccacccattcgggaagtagaagacgaatgttag

SEQ ID NO: 235682 - DNA, 3504 bp, Artificial Sequence
  Description of Artificial Sequence: Synthetic coding sequence
taagggggtgggggaggagggggaggctcctcgctacgcatgagttctaatatacatgctaaccacttaagcctggacgcctctagtagctcatcctcatcctcttcctcttcatcctcatcgagttcttcatcttcctccagctcggtccacgagccaaagatggatgcattgattatcccagttactatggaagttccttgtgactcacgcggacagcgaatgtggtgggcatttctcgcgtcaagcatggtgacattcttcggcggactgttcatcatcttgctctggcggactctaaagtatctctggacagtctgctgccactgcggtggcaaaaccaaagaagctcagaaaatcaataatgggagctctcaggccgacggaactttgaagccggtggacgaaaaggaagaggccgtggccgctgaggtcggctggatgacgagtgtgaaagattgggccggagtaatgattagtgctcaaaccttgactggacgcgtactggtcgtcttggttttcgcgctctcgatcggcgcacttgtgatatattttatcgattcctccaatcctatcgagtcttgtcagaacttctacaaggatttcaccctgcagattgacatggccttcaatgtgttttttctgctgtatttcggcctacgatttatcgccgctaatgacaagctgtggttctggctggaagtgaatagtgtggtggactttttcacagtgccccctgtgtttgtgtcagtatacctgaaccggtcctggctgggactgagattcctgcgagccctaaggctcatacagttctccgagatcctgcaatttcttaatatcctcaagaccagtaactccataaagctggtgaacctgctatccatttttatcagcacatggttaacagccgcaggtttcatccatctagtggagaattccggagacccttgggaaaattttcagaataaccaggcacttacatactgggagtgcgtctatctactcatggtgacgatgtcaaccgtgggatacggtgatgtttacgccaaaaccaccctcggtagattgttcatggtgttctttatcctggggggattagctatgtttgcatcgtatgtcccagaaatcattgagttgatcggcaatagaaagaagtatggagggtcttacagtgccgtcagtggcaggaagcacattgtcgtctgcggacacattacactcgagagtgtgagcaacttcttaaaggactttcttcacaaggaccgggacgatgtaaacgtggagatcgtctttctccacaacatctcaccaaacttagaactagaggcattatttaaacgccactttacccaagtcgagttctaccagggctcggtgctgaatcctcacgacctggctcgcgtgaagattgaatccgccgatgcttgcctgattctggccaataagtactgcgccgatccagacgctgaagacgcaagcaatatcatgcgtgtaatctcaattaaaaattatcatcctaagatccgcattattactcagatgctgcagtatcataacaaagcacatctgctcaacattccatcatggaactggaaagagggcgatgacgccatatgtctcgccgagttgaagctaggcttcatcgctcagagttgtctggcacaaggactgagcacaatgctggccaacctcttcagtatgaggtcctttattaagatagaggaagatacttggcagaagtactacctggaaggcgtgagcaatgagatgtatactgagtacctgtcttcagccttcgttgggttgtcctttccaaccgtttgcgagctgtgttttgtgaagctgaagctgctgatgatcgccatcgaatacaagtccgccaaccgcgaaagcagaattctgatcaaccctggcaaccatctaaagattcaggaagggactctgggcttttttatcgccagcgacgctaaagaggtcaaacgggcattcttctattgtaaggcgtgtcacgatgacataaccgaccccaagagaataaaaaagtgcggctgcaagagactcgaagatgagcaaccaagcaccctgtcgccgaaaaagaaacagaggaacgggggaatgcgcaactcacctaacacatcccccaaacttatgagacatgatccgctgctcattccgggtaacgaccaaatcgacaacatggactcaaacgtaaaaaagtacgactccaccgggatgttccactggtgtgcgcctaaggagatcgagaaagtgattctcacccgatcagaagcagcaatgaccgttttatccgggcacgtggttgtctgtatctttggtgatgtctcgtccgcactcatcgggctccggaacctggtcatgccactacgggctagtaattttcattaccacgagcttaaacacatcgtcttcgtgggctcgattgagtacttgaagagggagtgggagactttacacaacttccccaaagtgagtattctccccggaacacccctcagtcgcgctgacttacgggcagtcaacattaatctctgcgacatgtgtgtgattctctctgccaaccagaacaatattgacgatacaagcctccaggataaagagtgtatactggcgtctttgaatattaaatccatgcagttcgacgacagcatcggagtgttacaggcgaacagccaaggattcacccccccaggcatggaccgctcatccccggataacagccctgtccatgggatgctgagacagccctccattacaactggagtaaatattccaatcattacggagttggtgaatgataccaacgtccaattccttgatcaggatgatgatgatgacccggataccgagctgtatcttactcagcccttcgcttgcggaactgccttcgccgtttctgtgctggatagtctgatgtcggccacctactttaacgataatattctgactcttattcgtactcttgtcacaggaggtgcgacccccgagttagaagctctgattgctgaggagaatgcactgcggggaggctactcaacccctcagacactggcgaacagggaccgctgtcgggtagctcaactcgccctgctggatggcccatttgccgatctgggagacggcggatgctatggcgatcttttttgtaaagcactcaaaacctataacatgctgtgtttcggcatttatcgcctgcgcgacgcacacctgtcgacccccagtcagtgcacaaaacggtacgtcatcacaaatccgccatacgagttcgagctggtgcctacagatctcatcttctgcctcatgcagttcgatcacaatgctggccaaagtagggcttccctaagtcacagctcccattcctcccagtccagctccaagaagtcatcatctgttcactcaatcccgtccactgcaaaccgccaaaaccgaccaaaatcccgcgaaagcagggataaacagaaccggaaggagatggtttaccgatag

SEQ ID NO: 235683 - DNA, 3516 bp, Artificial Sequence
  Description of Artificial Sequence: Synthetic coding sequence
atggatgccttgattatccctgtgaccatggaagtcccttgcgacagcagaggccagcgcatgtggtgggcgttcttggcttctagcatggtgactttttttggagggttatttataattctgttgtggcgaactcttaagtacctgtggacagtgtgctgtcattgtggcggtaaaacgaaagaggcgcaaaagatcaacaatgggagcagccaagctgatggcaccctgaagcctgtggatgaaaaagaggaagcggtagctgccgaagtgggttggatgacctccgtcaaagactgggccggagtgatgattagtgcccagacactaaccgggagagtgcttgtggtcctggtctttgccctgagtatcggcgcactggtcatatattttatcgatagctccaatccaattgagagttgccagaatttctataaggatttcacactgcagatcgacatggccttcaacgtttttttcctgctatattttggcctgcgcttcatcgctgctaatgataagttgtggttctggctcgaggtgaactctgtggtggactttttcactgtaccaccagttttcgtttccgtgtacttgaatcgcagttggcttggcctgcgtttcctgcgggcactaaggcttatccagttttccgaaattctgcagttcctgaatatcttgaagacaagcaactcaatcaagcttgttaatcttctgagcatctttatctccacctggttaaccgctgcaggcttcatccatctggtggagaactcgggagatccgtgggaaaacttccagaataatcaagctttgacttattgggagtgtgtttatctgctcatggtgactatgagtacagtggggtatggagacgtttacgcaaaaaccaccctgggccgtcttttcatggtctttttcatccttggcggtctggcaatgttcgcaagctacgtgcctgagattatcgagttgattggcaatagaaaaaagtatgggggaagctatagcgccgtgagcggcaggaagcacatcgtggtgtgtggacacataactctcgagtcagtgagtaatttcctgaaagattttcttcataaagatagggatgatgtcaatgtggaaattgtgttcctgcataacattagtcccaacttggagctcgaagcactctttaaacgccattttacccaggtcgaattttaccaggggtcagttttaaatccacatgatttggcccgagtcaaaattgagagtgctgacgcatgccttattctggcgaataagtactgcgctgatccagatgcagaggatgcatcaaatatcatgagggtgatctctattaaaaattaccatcctaaaatacggattatcacccagatgctgcagtaccacaacaaggcccacctgcttaatatcccctcatggaattggaaggagggagacgacgctatatgtttggccgagctcaagctggggttcatcgcccagagttgtctggcacagggcctgtcaacgatgctcgccaatttattctctatgaggagctttatcaagatcgaagaagacacctggcagaagtattatctggaaggggtgtcgaacgaaatgtacacagagtacctgtccagcgcattcgtgggactgtcttttcccactgtgtgcgaactgtgttttgtgaaactcaagctcttgatgattgctatcgagtataaaagcgctaatcgggaatcgcgaatcctcatcaatccaggcaatcaccttaagatccaggagggtacccttggcttcttcattgcctccgacgctaaagaagttaaacgagctttcttttattgtaaagcctgccacgacgatattaccgatccaaagaggattaagaaatgcgggtgtaagcggccaaagatgtctatttataagaggatgagacgagcgtgttgtttcgactgtgggaggtcagaacgtgattgttcttgcatgagcgggagggtgcggggtaacgtcgataccctcgaaagagctttccctctgtcaagcgtctcagtaaacgactgctcgacctcattccgggcattcgaggatgagcaacctagcaccctgtcgcctaaaaagaaacagaggaatgggggaatgcgtaactcaccgaacacttccccgaagctgatgcgtcacgatcccctactaatccctgggaatgaccagatcgacaatatggacagcaacgtgaagaagtacgattctacgggaatgtttcattggtgcgcccctaaagaaatcgagaaggttatactgacgcgctcagaggccgctatgacagtgctgagtggccatgttgtggtctgcatttttggcgacgtatcatctgctcttatagggcttcggaacctggtgatgcctctgagagccagcaacttccattatcacgagcttaaacatatcgtgtttgtaggctccatcgagtacttgaaacgggagtgggagactcttcacaattttcccaaggtctcaatactgccaggaactcctctgagtcgcgcagatctgagagccgttaacatcaacctctgcgacatgtgtgtgatcctatcagctaaccaaaataacatcgatgatacatcgctgcaggacaaagagtgtatcctggcttctttaaatataaaatctatgcagtttgatgattctattggtgtgcttcaggccaactcgcaaggattcaccccccctggcatggaccggtcctcgcccgataattctcctgtccatggcatgctgagacaaccatccatcacaaccggagttaacattccaatcatcaccgagctcgttaacgacaccaacgtgcagttcctagatcaggacgatgacgacgatcccgacaccgagctatacttgacacagccattcgcttgcggcactgccttcgcagtgtctgtcttagactctctgatgagcgcaacatactttaatgataatatactcaccctgattcgaactctggtaacagggggagccacccctgaattggaggctctcatcgctgaagaaaacgccctgcggggaggttactccactcctcaaaccctggcaaaccgggaccggtgtcgggtggcccagctggctctgctcgatggcccatttgccgacctcggagacggaggctgttacggggacctgttctgcaaagccctgaaaacttataatatgctttgttttggtatatataggttgcgcgatgcgcatctctctacaccctctcagtgtaccaagcggtatgtgattactaaccctccatatgagtttgagcttgtccctaccgacctcatattttgtttgatgcagttcgatcataatgcaggacagtctagagcgagcctgtctcactcgagccacagctctcagtcttcaagtaaaaaatcgagctccgttcactcgatacccagtaccgcaaaccgacagaatcgcccaaagtcaagagagagcagggataagcagaatcgcaaggagatggtgtaccgatag

SEQ ID NO: 235684 - DNA, 3534 bp, Artificial Sequence
  Description of Artificial Sequence: Synthetic coding sequence
atggcaaacggaggaggaggaggaggagggtcctctgggggtggcggtggtgggggaggctctagcttaagaatgtcctcaaacatccacgccaaccacttgtcactggatgcttcctcaagcagttccagctcttcatcatcatcatccagctcaagctcatcatcctcctcaagcagcgtacatgaacctaagatggatgccctgattattcctgtgaccatggaggtcccctgcgacagtcgtggacagcgtatgtggtgggcctttcttgctagctctatggtcacgtttttcgggggactctttatcatcctgttgtggaggacactgaaatatctgtggaccgtgtgctgccactgcggcggtaagaccaaggaagcccagaaaatcaataatggctcatcccaggcagacggcacactgaaacccgtggatgagaaggaggaggccgtggccgctgaagtcgggtggatgacctcagtgaaggactgggccggagtcatgatttccgcgcagacactgacagggcgagtcctggtcgtgcttgtttttgcgctgtccatcggtgctctggtgatctacttcatcgactcctctaatcccattgagagctgtcagaacttctacaaagacttcacacttcagatcgacatggcttttaatgtgttctttctgttatacttcggattgagatttatagccgctaatgataaactctggttctggctcgaggtgaattccgtcgtggacttctttacagtgccaccagtgttcgtgtctgtgtacctcaaccgtagctggctcggtctgaggttcctgcgtgctttgcgactgattcagttctctgaaatacttcaatttctcaacatccttaaaacgtcaaacagcatcaagctcgttaacctgctttcaatcttcatctctacttggcttactgccgctggcttcatacacctcgtggaaaattccggtgacccttgggagaactttcagaataatcaagccctgacatactgggaatgcgtgtatctgctgatggttaccatgagcacagtgggttacggagacgtatatgccaagaccacactggggagactgtttatggtatttttcatcctgggtgggcttgccatgttcgcatcgtacgttccagagattatcgagctgattggtaatagaaagaagtatggtggcagctactcagctgtctccggtagaaaacacatcgtagtttgcggccacatcacactagagtctgtgtccaactttctgaaggactttctacacaaggatcgcgatgatgtgaatgtcgaaatcgtattcctccacaacatttcaccaaatctcgagcttgaagcgttgttcaaacggcactttacacaagtggagttttatcaaggtagcgtcttgaacccacacgacctcgcgagggtaaagattgaaagcgccgatgcatgtttgattttggccaacaaatattgtgctgacccagacgccgaagatgccagtaatataatgagggtcatctccatcaagaattatcatcccaagatccgcattatcacacagatgctgcaataccacaacaaagctcatctccttaacatccctagctggaattggaaggagggggatgacgcaatatgcctcgccgaactcaagctcggattcatcgcccaaagctgtctcgcccagggactttcaacaatgcttgccaacctcttttcaatgcgtagcttcattaaaatcgaagaggacacttggcagaagtactatttggagggggtgagcaacgagatgtatactgaatatctgtcgtctgcctttgtgggcctatcctttcccactgtctgcgaactctgtttcgtgaagctcaagcttttaatgatagcaatcgagtacaaaagcgccaatagggagagccgaattctgattaaccccggaaatcatctgaagatccaggaagggacacttggttttttcatcgcaagcgatgccaaagaagttaagagggcttttttctactgcaaggcttgtcacgacgatatcaccgatccaaagagaattaagaaatgcgggtgcaagcgcctggaagacgagcagcccagcacgctgagccccaaaaagaaacaacggaacggtgggatgcgtaattctcctaacacatctccaaagttaatgcgccatgatcctctgctgattccgggaaatgatcaaatagataatatggatagtaatgtgaaaaaatacgactctacaggcatgttccattggtgcgcccctaaagagatagaaaaggtgattctcacccggagcgaggccgcaatgaccgtgttgtctggacacgttgtggtttgtatcttcggggacgtctcttcagccttgatcggacttagaaaccttgttatgcctctgagagctagcaacttccattaccacgagttgaaacatatcgtcttcgtgggcagtattgagtatctcaagcgtgaatgggaaaccctgcataattttccgaaagtgagtatcctcccgggtacacccctgagcagggccgaccttcgggctgtcaatatcaatttgtgcgatatgtgtgtgatcctgagcgccaaccagaataatatcgacgatacctctctccaggataaggaatgtatcctggctagtctgaatattaaaagcatgcagtttgatgatagtataggtgtcctccaagctaatagccaagggttcaccccccctggaatggatcgcagttctcccgacaactcccctgtgcacggcatgttgcggcagccatctataacaactggggtgaatattcctattattactgagcttgtgaacgacaccaatgtacagtttcttgaccaggatgacgatgacgatcccgacactgaattgtacttgactcagcctttcgcctgtggcaccgccttcgccgtgtctgtgctggatagcctcatgagcgcaacttatttcaatgataacattctgaccttgatcagaacgctggtgaccggcggtgcaacaccggagctggaagcgttgattgcagaagagaatgcactgaggggtgggtacagcacccctcaaacacttgctaacagggatagatgcagagtcgctcaactggcactcctcgatggtcccttcgcagacctgggcgacggtgggtgctacggtgaccttttctgtaaggctctcaagacctataacatgctatgcttcggcatctatcggctcagggacgcacatttaagcactccttcgcaatgcactaaaagatatgttattactaacccaccatacgagttcgagctggtgcccacagacctcatcttctgtctgatgcaattcgatcacaacgccggacagtccagagcatctctgtcacattcctcccactcaagccagagctcaagtaagaaatccagcagtgtccactcaatccctagcactgcaaatagacagaaccgcccaaagtcccgtgagagccgggataagcagaagaaggagatggtgtaccggtag

SEQ ID NO: 235685 - DNA, 3618 bp, Artificial Sequence
  Description of Artificial Sequence: Synthetic coding sequence
atggctaacggcggtggtggcggtggaggatccagtgggggaggaggaggtggaggcggaagttcactgagaatgtcatccaatattcacgcaaaccatctgtctttagatgcctcatcatcaagctcctcctcctcaagctctagcagtagttcaagctccagctcatcatcttcttccgtccacgaacctaaaatggatgccctgattattcccgtgactatggaagtaccatgcgatagccgaggacagcgaatgtggtgggctttcctcgccagctcaatggttactttttttggtggactgtttatcatcttgctgtggcgcactctcaagtatctatggaccgtctgctgccactgcggcggaaagacaaaggaggcccaaaaaatcaacaatggctcaagccaggctgatggcaccctgaaacccgtggacgaaaaggaggaagctgtggcagccgaagtgggctggatgacttctgtgaaagactgggccggagtgatgatctcggcacagacgttaacaggtcgcgtcctcgtggtgctggtgtttgcactctccattggagcgctcgttatttatttcatcgactcaagcaatcccatcgaatcgtgccagaacttttacaaagattttactttgcagatcgatatggccttcaatgtcttctttttgctctatttcggccttcgattcattgccgctaacgataaactctggttttggctggaagtgaactcagttgttgacttcttcactgttcctcccgtcttcgtgtcggtctatttgaataggtcatggctgggcctgagattcctgagggctctgagactgattcagttttcagaaatactccagttcctgaacatcctgaaaactagtaacagtattaagctcgtcaatctgttgtccatcttcatctcaacctggctgaccgctgcgggttttatccatctggtggagaatagtggcgacccgtgggaaaattttcagaacaaccaagctcttacctactgggagtgtgtgtatttgttgatggtgactatgtcgactgtcggctacggtgatgtatacgcaaaaaccaccctggggcgtctgtttatggtctttttcatcctgggcggactcgccatgttcgcctcctacgtgcctgaaatcatagagttgatcggcaaccgtaagaaatacggtggctcatactccgccgtcagcgggcgtaaacacatagtggtgtgcggccatatcactctggaaagcgtaagtaatttcctcaaggattttctgcacaaggacagagacgacgtgaatgttgagatagtctttcttcacaacatctctccaaacctggaactcgaggcccttttcaagcggcactttacgcaagtggaattctaccagggttccgtgttaaacccacacgatcttgcccgagttaagatcgagagcgccgacgcttgcctgatcttagccaacaaatattgtgcggacccagacgcagaggacgcctccaacatcatgcgtgtgatctccattaaaaattaccatccaaagatccgaattataacacagatgctgcaatatcataacaaggctcatctgttgaacatcccttcttggaactggaaggaaggtgacgatgccatctgcctggctgagctaaaactcggcttcatcgcgcagtcttgcttagcccagggtttgagtactatgcttgccaatctcttttctatgaggtcattcataaagatcgaggaggacacatggcagaagtactaccttgaaggcgtgagcaatgagatgtatacagagtatctatcatctgcgttcgtgggactctcgtttcccacagtgtgcgagctctgtttcgtcaaattaaagctccttatgattgccatcgaatacaaaagcgccaaccgcgaatcccggatcttaattaatccaggcaatcatcttaagattcaggagggaacattgggtttctttatcgctagcgatgctaaagaggtcaagcgagctttcttctattgcaaggcctgtcacgatgatataacagaccccaaacggatcaagaagtgcggatgtaaaaggctggaggatgagcagccatccacactgtctccaaagaaaaagcagcgtaacggaggaatgcggaatagccccaatacttcccccaagctgatgcggcatgatcctctgctaatacctggcaatgatcagatcgataacatggactccaacgtgaaaaaatatgatagtactggcatgtttcattggtgcgcaccaaaagagatcgagaaggtcatccttactcggtccgaggccgcaatgaccgtactgtccgggcacgtagtggtgtgtatcttcggagacgtgagctcagcacttatcggactgagaaacctggtgatgcctctccgtgcgtctaacttccattaccacgaactcaaacatattgtcttcgtcggctcaattgaatatctgaagagggagtgggaaacacttcataactttccaaaagtgagtattttgccaggcaccccactctctcgggctgacttaagagctgtaaatataaatctgtgtgatatgtgtgtaatattatcggctaatcagaacaacatagacgatacatctctgcaagataaggagtgtatcctggcttccttgaacatcaaatctatgcagttcgatgattcaatcggcgtgctacaagctaattcccaaggcttcaccccaccgggtatggataggagtagtcctgacaattcgccagttcacggtatgctgcgccagcctagcatcacaactggagtgaacattccaattataaccgaactggctaaacctggaaaactgcccttagttagcgtgaatcaggagaagaatagcggaactcacattttgatgatcaccgagctcgtaaacgatacaaacgttcagtttttagaccaggacgatgacgatgaccctgacactgagttgtacctgacccagccgttcgcttgcggcactgcttttgccgttagcgtgctggactccttgatgagcgcaacctatttcaatgacaacattctgacactcattaggacgctggtgacagggggagcaaccccagagctggaagccctgatcgccgaggaaaacgccttaagaggaggctactctacaccgcaaaccttagctaaccgcgatcgttgtcgcgtggcccagctggccctcctggacgggccttttgccgacctgggggacggcggttgctacggagacctgttttgcaaggccttaaagacttataacatgctgtgcttcgggatctaccgtctcagagacgcacatctctccacgccgtcccagtgtactaagaggtacgtgatcaccaaccccccttacgagttcgagctcgtgccaacggacctgattttttgcctgatgcagttcgaccacaatgccggacagagtcgggctagtctgagtcactcttctcattcttcacagtcctcttccaagaagagctctagtgtccacagcatcccaagtactgctaatcgacaaaataggccgaaaagtcgagagagtcgggacaagcagaaccgaaaagagatggtgtataggtag

SEQ ID NO: 235686 - DNA, 3678 bp, Artificial Sequence
  Description of Artificial Sequence: Synthetic coding sequence
ccaaaaatggacgctctgatcattcctgtgacaatggaggtaccgtgcgattctagagggcaacgcatgtggtgggcctttctcgcaagcagtatggtaacgttctttggtggtctgttcataatcctcttgtggcggacactgaagtatctttggactgtatgctgtcattgcggcggtaagacaaaggaagctcaaaagataaacaatggctccagtcaagccgacggaaccctgaaaccggtcgacgaaaaagaagaggccgtggctgccgaggtgggatggatgacatctgtgaaagactgggccggagtaatgatctctgcccagactctcacgggaagggtactggtggtcctggtgtttgcactgtcaataggggctttggttatatatttcatcgattcctccaatccaatagagtcctgccagaatttctataaagatttcactctccagatcgatatggccttcaacgttttctttttgctgtatttcggcctgcggttcattgctgcaaatgataagctgtggttttggctggaagttaattctgtagtagacttcttcactgtgccccctgtctttgtgtctgtttatctgaacagatcctggttgggactgcggtttctgagggccttgaggctgattcaattctctgagatcttacaatttctgaatatcttaaaaactagcaactccattaaactcgtaaatctactgtccatctttatctccacatggctgaccgccgcaggatttatccatcttgtggagaatagtggagacccctgggagaattttcagaataatcaagccctcacctattgggaatgcgtctatctcttaatggtgacgatgtccactgtcggatacggcgacgtgtacgccaaaaccactttgggcagactttttatggtgttttttattctggggggattggccatgttcgctagctacgttccggagataattgagctcattggaaaccgcaagaagtatggaggttcttacagcgcagtctccggacgtaagcacatcgtggtgtgcggacatattacgctagagtccgtgagcaactttctgaaagattttctacataaggatcgcgatgatgtaaacgttgaaatcgtgttccttcacaatatcagccctaatctagagctggaggctttattcaaacgccattttacacaagttgagttttatcaaggcagtgtgctcaatccccatgacctggccagagtcaaaatcgaaagcgcggatgcttgcctgatcctcgctaataagtactgcgccgatcccgacgctgaggatgcctccaatataatgagagtgatttcaatcaagaactaccaccctaaaatacgcatcattactcagatgctgcagtatcataataaagcccacctactgaatatcccaagctggaactggaaagagggagatgatgctatctgcctcgctgaacttaagctaggctttatcgctcagagttgtctggcgcagggtttgtccacaatgctggccaaccttttttctatgagaagctttattaagattgaagaagatacctggcaaaaatactatctcgagggtgtgtccaatgagatgtacactgagtacctctcgagtgccttcgtcggtcttagcttccccacggtttgcgagctgtgcttcgtaaagctgaaactgctcatgatcgctattgaatacaagtctgctaaccgcgagtcaagaatcctcatcaatccgggaaatcacctgaaaatccaggaagggaccctcggtttttttattgcgagtgatgccaaagaagttaagcgggctttcttctactgcaaagcctgtcacgacgacatcactgaccccaagaggatcaagaaatgtggttgcaaacgcccaaagatgagcatatacaaaaggatgagacgcgcttgttgtttcgattgtggacgatcagagagggactgtagctgtatgtccgggcgagtgagagggaacgtcgataccctagagcgcgcattccccctcagctccgtgagtgtgaacgactgttcaacctcttttcgtgcatttgaggatgagcagcctagcacactatctcccaaaaaaaagcagcggaacggaggcatgagaaactctcctaatacctctcctaagcttatgagacatgatcccttactcattcctggtaacgatcaaattgataacatggattcaaacgtgaaaaaatatgactccacaggcatgttccactggtgcgccccaaaggaaatagagaaagtgatcctgacaaggagcgaggctgccatgactgtcctttctggccacgtcgtcgtctgtatttttggagacgtgtcctcggccctcattggcctgcgcaatttggttatgccactgcgcgcatctaatttccactaccatgagctcaagcacatcgtattcgtgggctccattgagtacctaaagagggagtgggagacgctacacaactttcctaaggtttccatcctgcccggtacccctctcagtagagccgacctgcgggcagtcaacatcaatctgtgtgatatgtgtgtcatcctgtctgcgaatcagaataacatcgatgacacctccctacaggataaagaatgcatcctagcctctctgaatatcaagtccatgcaattcgacgactccataggcgtcctccaagccaattcacaaggatttaccccacctgggatggatcggtcatctcccgacaattcgccagtccacggcatgctgagacagccttcaatcactaccggagtcaatattcctattatcacagaactcgtgaacgacactaatgtccaatttctggaccaagatgatgatgatgatcctgacaccgagttgtatctcacccaaccattcgcctgtggcactgcatttgcggtgtccgtactggactcactaatgtctgccacatatttcaacgataacatcctgactctcatccgaacgctggtgacaggaggcgctaccccagagttggaggcactgatcgcagaagaaaatgcgctgcgaggaggctatagcaccccacagaccctggctaacagggacaggtgtcgggtggctcaactggccctgttggatgggccttttgctgacctgggagatggaggttgttatggcgatttgttctgcaaagcactgaaaacttataacatgctgtgcttcggaatctaccggcttcgtgatgcacatctatccacaccgtctcagtgcaccaaaaggtacgtgatcacaaatcccccttatgagtttgaactggtgcctactgacctcatcttctgcctgatgcagtttgaccacaatgccggacagtctagggcatcgctttcacattctagccactctagccagagttcgtctaaaaaaagttcaagtgtgcacagcatcccgagtacagcgaaccgacagaatcggcctaaatcccgtgagtctcgggataaacagaatgccactcggatgaatagaatgggacaggaaaagaaatggttcaccgatgagccggacaacgcgtacccccgtaatatccagatcaagcccatgtccactcacatggctaaccagatcaaccaatataagtccacgtcttctctcatccctcccatccgtgaagttgaagacgagtgttag

SEQ ID NO: 235687 - DNA, 3660 bp, Artificial Sequence
  Description of Artificial Sequence: Synthetic coding sequence
atggccaacgggggtggagggggaggcggatcgtcgggcggtggagggggtggcggtgggagcagtctgaggatgtcctcgaacatccacgcaaatcatctcagtctagacgctagttcatcctcaagttcatcttcttcctcctcgtcgtcttcatcatcttcaagttctagctccagcgtgcacgagcctaaaatggatgcgctcattattcctgttacgatggaagttccgtgtgactctcgtggccagcgcatgtggtgggcctttctagctagcagtatggtgaccttttttggtggattgttcatcatcctgctgtggcgcaccttaaaatatctttggaccgtctgctgtcattgcggaggcaaaacaaaggaagcccaaaagattaataacggttcatcccaggctgatggtacactcaagccagttgacgagaaagaagaagcagtggccgcagaggttgggtggatgacttctgtgaaagactgggccggagtgatgataagcgcccagaccttgactggaagagttctggtggtattggttttcgccctcagtatcggagctcttgtgatctacttcattgactcatccaacccaatagaatcatgtcagaatttttacaaagactttacactacaaattgacatggcctttaacgtgttctttctgctctactttgggctacggttcatcgccgctaatgataagctatggttctggcttgaagtgaacagcgtcgttgacttcttcacagtccctcccgtattcgtcagtgtgtacctgaacaggtcatggcttggcctgcggtttctgagagctctaagattaatccagttctccgaaattctccagtttctgaatatccttaaaacaagtaatagcattaagctcgtaaacctactgtctattttcatctccacctggctcaccgctgccggattcattcacctggttgagaacagtggcgacccatgggaaaatttccagaacaatcaggctttaacttattgggaatgcgtgtatctactcatggtaactatgtccactgttggctatggcgatgtctacgcaaaaacaacattaggtcgattattcatggtcttctttatcttgggtgggctggctatgtttgcctcttacgtccctgaaattatagagctgatcggtaaccggaagaagtacggaggtagctattccgccgtgagcgggcgtaaacacatcgtcgtgtgcggacacataactctggagagcgtatccaatttcctgaaagatttcctgcataaagacagggacgacgtaaacgtcgagattgtttttctccacaatatatctccaaacttagaacttgaagccctatttaagcgtcatttcacgcaagtagaattctaccagggttctgttttgaatcctcatgacctcgctagagtaaagatcgagtctgccgacgcatgcctgatcctcgccaacaagtattgcgccgacccggatgccgaggacgcctccaacattatgcgagtaatcagtatcaaaaattaccatcccaagattagaatcatcacacagatgctgcagtatcacaataaagcccacctgttgaacatcccatcctggaactggaaggagggggacgacgccatctgccttgccgagctcaagctgggttttatagcacagtcctgtctggcacagggtttgtccaccatgctggctaacctcttctccatgcggtcattcatcaagattgaagaggatacgtggcagaagtattacttggagggagtctcaaatgaaatgtacactgagtacctttcgtcggctttcgtgggcctctcattccccacagtgtgtgaactttgctttgtcaagctcaagctgctgatgatcgcgattgagtacaaaagtgctaatcgagagtctaggattctgatcaacccaggaaaccacctgaaaatccaggaaggaacactgggtttttttatcgcttcagatgcgaaggaggtgaagagggcctttttttactgtaaagcatgccacgatgatataaccgatccaaagaggatcaagaaatgtggctgcaagcggttggaagacgagcagccgagcacactaagtcccaagaaaaaacagcggaacggcggaatgcgtaactctcctaacacctcccccaagctcatgcgacatgatccgctcctgatccctggcaacgatcaaatcgacaacatggatagtaatgtcaagaagtacgacagtacagggatgttccactggtgtgctccaaaagaaattgagaaagtgattctggttaccggatggatgccttatcttggaccccgagtcctgatgacttgcttggatataggcgtagtctgtatgcccaccgatatacagtccactagtccggctagcattaagaagtttaaagaaaccaggtctgaagccgctatgactgtgttatcaggtcacgtcgtggtttgcatatttggtgatgtctcctctgctctgatcgggctgcgcaatctggtgatgcctctccgggctagcaattttcactaccacgaactaaaacacattgtcttcgttggctcaatcgaatacctgaaacgtgaatgggaaactctgcacaacttcccaaaagtctcaatactcccgggaactccactgtctcgtgctgatctacgagccgtgaacatcaacttgtgcgatatgtgcgtcattctcagcgccaatcaaaataacatagatgacacatcgcttcaagacaaggagtgtattctggcctccctgaatattaagtccatgcagtttgacgattctatcggggtgttacaagccaattcgcagggttttacccccccaggcatggacaggtcaagccctgataattctcccgtgcatgggatgcttcgccagccctctatcaccacaggggtgaacatccctatcattactgaactcgttaatgataccaatgttcagttcttggatcaagatgacgacgacgaccccgatacagagttgtatctgactcagccattcgcctgtggcacagccttcgccgtctctgtgctcgactcattgatgtctgccacctatttcaatgacaatattctgaccctcatccggacccttgtgacaggtggtgcgacgcccgagctcgaagcccttattgcggaggaaaatgcgctgcgcggagggtatagcaccccccaaaccctcgcaaatcgcgaccgttgccgagttgcacaactcgccttattagacggccctttcgcggacctcggagatgggggttgctatggggatttattctgtaaggcgctgaagacatacaacatgctctgcttcggaatttaccggctccgtgatgcccatttatctacaccatctcagtgcacaaagagatatgtgattactaaccccccatatgagttcgagctcgtgcctacagacctgatattctgcttgatgcagttcgaccataacgctggacagtcccgtgcatccctgtcacacagtagtcatagtagtcagagctctagcaaaaaatccagttccgtccactccattccgtcgactgcgaatagacagaatcggccaaagtctagggagagtagagacaaacagaaatacgtgcaggaggaacggctctag

SEQ ID NO: 235688 - DNA, 3723 bp, Artificial Sequence
  Description of Artificial Sequence: Synthetic coding sequence
atggccaacgggggtggaggaggcggtggatctagtggcggaggagggggtggaggcggttcgtctctgcgaatgtcaagtaatattcatgccaaccacctctctctggacgcgagttcaagctcatcttcatctagctctagcagctcgtctagcagctcaagttccagcagctcgagcgtgcatgagccaaagatggatgcgcttattatccctgtgaccatggaagtgccttgtgactcgagaggacagagaatgtggtgggcgtttcttgccagcagtatggtgaccttcttcggaggactgtttatcatcctcttatggcgcacattgaaatatctttggactgtctgttgtcattgcggcggaaaaaccaaggaagcacagaaaattaacaatggatcgtctcaggcagacggcaccctcaagcccgtggatgagaaggaagaggccgtcgccgcagaggtgggatggatgacttcagtcaaggattgggccggtgtcatgatcagcgcacagacactgacaggcagggtcctggttgtcttagtatttgccctgtcaattggagcccttgttatctattttatagattctagcaatccgatagagtcgtgtcaaaatttttataaggattttacactgcagattgacatggcttttaacgttttttttctgttatatttcgggctccgattcattgctgccaatgacaagctctggttttggctggaagtcaactctgttgtcgacttttttactgtcccgccagttttcgtatccgtatatttgaatcgatcttggcttggcttgagatttctgagagcgcttcgactgattcagttttctgagattctgcaattcctgaacattctcaagacctctaactctatcaagttggtaaatctcctaagcatttttataagcacatggttgacagccgcaggcttcattcatttggtggaaaactccggcgatccttgggagaactttcagaacaaccaggcacttacctattgggagtgtgtctacctgctcatggtgaccatgtctaccgtagggtacggcgatgtctatgcgaagaccacacttggcagactgtttatggtcttctttattttgggtggactagccatgtttgcctcgtatgttccagaaataatcgagttaatcggcaaccgcaagaaatatggcggaagttactctgctgtctcaggaaggaagcacatcgtggtctgtggtcacatcacactggagtctgtgagcaatttcttaaaagattttcttcataaggaccgagacgacgttaacgttgagatagtctttctgcataacatatccccgaatctcgaactggaagccctgttcaagagacactttacccaggtggagttctatcagggctccgtgctaaaccctcacgacttagcacgcgtcaaaattgaatctgccgatgcctgtctgattttagccaacaagtattgcgctgatccagacgcggaggacgctagcaacattatgagggttatcagcattaaaaattatcatcctaagatccggatcattacgcagatgttacagtaccacaataaggctcacctgctgaatattccaagttggaactggaaagaaggggacgacgctatttgtctggcggaactgaaactgggctttatcgcgcagtcgtgcctggctcagggtctgtcgacaatgctggctaatttgtttagcatgaggagttttattaaaatagaggaagacacctggcaaaagtactatctcgaaggagtgtcaaacgagatgtacacagaatacctgagtagcgcttttgtgggactcagtttcccaactgtgtgtgagctttgctttgtgaagctcaaattgctgatgatcgcaatcgaatataaatctgcgaacagggaatcacgcggaaggctgtccattcttatcaaccccggaaaccaccttaaaatccaggaggggacactgggtttctttatcgctagcgacgcaaaggaagtgaaaagggcctttttttattgcaaagcttgccatgacgatataactgatccgaaaaggatcaagaaatgtggatgcaagagaccgaagatgtccatctataaacggatgagaagggcttgctgtttcgactgcgggagatcagagcgtgattgtagctgcatgtccggcagggtaagaggcaatgtggacacattagagagggcctttcccttaagttccgtgtccgttaatgattgcagcacctcctttagggcgttcgaggatgaacagccatcgacattgtcccctaagaagaaacagagaaacggagggatgcgaaatagtcctaacaccagtcccaagctcatgaggcacgaccctctgctgattccagggaacgaccagattgacaatatggactcaaatgttaagaaatacgactcaaccgggatgttccattggtgcgccccaaaggagatcgagaaagtgattttgacaaggtctgaagctgcgatgactgttttaagcggccatgtggtagtgtgtatcttcggtgacgttagtagcgccctcattggattgcggaacttggtaatgcctctgagagcctctaatttccattatcatgaactcaaacatattgtgttcgttgggtctattgagtatttgaagagggagtgggagacattgcacaattttcccaaggtgtcgatactgccgggaaccccactgagccgggctgatttgcgggcagtgaatataaacttatgcgacatgtgcgtgatcctctctgcgaaccaaaataatatagatgacacttccctgcaggataaggaatgcattctcgcctctctcaacatcaaatcaatgcaattcgatgactcaattggggtcctccaagccaacagtcaaggcttcacccctccaggtatggaccgctcaagcccagataattctccagtgcatggtatgctgcggcaacctagcatcactacgggcgtcaacattcctattattactgaattagtgaacgatacaaatgttcagttcttggatcaagacgatgatgatgatccagatacagagctgtacctaacccagcccttcgcctgcgggaccgcctttgctgtttcagtgctggattcgctgatgtctgctacatattttaacgacaatatcctgaccctgatacgcactctggttaccggcggtgccaccccggagctcgaggccctcatcgctgaagagaacgcgctgcggggtggatattctacccctcagaccttagccaacagggatagatgtcgcgtggcccagcttgctttacttgatggaccgttcgccgacttgggtgacggaggctgctatggagatttattctgcaaggctctgaaaacatataatatgttgtgttttggcatttatcggctgcgcgacgcccacttgtcaaccccttcccagtgcacaaaaaggtacgttattaccaacccaccatatgaatttgagcttgtgcccaccgatttaattttttgtctcatgcaattcgaccacaacgccggacagtccagagctagcctgtcccattctagtcatagcagccagtcctctagcaagaagagcagctcagtccattctatcccgtcaactgctaatcgtcagaacaggcccaagagtcgcgagtcccgggacaaacaaaaatacgttcaggaggaaaggctgtag

SEQ ID NO: 235689 - DNA, 2970 bp, Artificial Sequence
  Description of Artificial Sequence: Synthetic coding sequence
atggccttcaatgtgttcttcctcctttatttcgggcttcgtttcattgcggcaaacgacaagctttggttttggttggaagtgaattcagtcgtagacttttttactgtccccccagtgttcgtttcagtctacctgaaccggagctggctgggtctgcgctttctgagagcactacgccttatacaattttccgagatccttcaattcctcaacattttgaaaactagcaacagcatcaaactcgtgaaccttctgtctattttcatctctacatggctgactgctgccggtttcatccacctcgttgaaaattcgggagacccatgggagaactttcaaaacaatcaggcattgacatactgggagtgcgtgtatcttctgatggtgacgatgagcaccgtcgggtatggagacgtttatgcgaagactaccctcgggaggctgttcatggtgttctttattctgggcggtctggcaatgttcgctagttacgtgccggagatcattgagctgatcggcaaccgaaaaaaatatggcggtagctattctgccgtctcgggccgaaaacacattgttgtgtgcggccacattactctagagtctgtcagcaatttcctcaaggactttctgcacaaagacagagatgacgtgaacgtggaaatagtgttccttcacaatataagccccaatctagaactcgaagccttgttcaaaaggcacttcacccaggtcgaattttaccaaggtagcgttttaaatccccacgatttggctagggtgaaaattgagtcagcggacgcctgcctgattctagctaacaaatattgcgccgatccggacgcagaagatgcaagcaacattatgcgggtgataagtattaagaactatcatccgaaaatccgcatcatcactcagatgctccaataccacaataaagcccatcttctgaatatcccttcgtggaactggaaggagggcgatgatgctatttgcctggcagagttgaagttggggtttatcgcccagagttgtcttgcacagggcctctcaaccatgctagctaacctcttttctatgcggtcctttattaaaatagaggaagatacttggcaaaagtactaccttgaaggagtcagtaacgaaatgtataccgagtatttgagcagcgccttcgtcgggttatcttttcctacggtgtgtgaactatgtttcgttaagttgaagctgttgatgatcgccatcgaatacaagagtgctaaccgcgagtcacgcattctgattaatccaggcaatcacctaaaaatccaggagggcaccctggggttcttcatagcttcagacgcaaaagaagtgaagagggcattcttctactgtaaagcgtgtcatgatgatatcaccgaccctaagagaatcaagaagtgtggatgcaagagactgaaagtggctgctcgatccagatattccaaagacccattcgaattcaaaaaagagacacctaatagtagactggttacggagccggtcgaggatgagcagccatccaccctgtcccccaagaagaaacagagaaacggcggtatgcgaaactctcctaacacatctcccaaattgatgcggcacgatcccttactgattcccggaaacgatcagatcgataacatggattcaaacgtgaaaaagtacgacagtaccggcatgtttcactggtgcgccccaaaagagatcgaaaaggttatactgaccagaagcgaggctgctatgaccgtgctgagtggtcacgttgtggtctgtatcttcggtgacgtgtcgagcgcactaatcggcctgaggaatttggtcatgccgctgagagcctctaatttccattatcacgagctcaaacacatagtcttcgtcggcagcatcgagtatctgaaacgggaatgggagactttacataatttcccaaaagtttcaattctccctggtactccattaagcagggccgacctgcgtgctgtgaatatcaacctgtgcgatatgtgtgtgatcctgagtgccaatcagaacaacattgatgacaccagcctccaggataaggagtgtatcttggcgagcctcaatattaaatcaatgcagttcgacgactctattggagtgctgcaggctaacagtcaaggcttcacaccccctgggatggaccggtcgagtcctgacaatagccctgtgcacggaatgcttagacagccctcaatcacaaccggcgtgaatattcctatcatcacagagctggtcaacgacacgaatgtgcagttcctggaccaggacgatgacgacgaccccgacacagagctctatctgactcagccattcgcctgcggcaccgccttcgctgtctccgtgctagatagcttgatgtccgccacttacttcaatgataatatcctgaccctcatcaggacccttgtgaccggtggggctacgccggaactggaggccttgatcgctgaggaaaatgccctgcgcggaggatattccaccccccagaccctggcaaaccgcgatcgctgtagagtggcacagttggcgctgctggacggcccatttgcggatctgggggatggcggatgctacggcgatcttttttgtaaggcgttgaaaacttataatatgttgtgttttggtatttaccgcctgcgtgacgcgcatctgagcacaccctcccagtgcactaaaaggtatgtgattaccaatcctccttacgaattcgaactggtcccaaccgatctcattttctgtctcatgcagttcgaccataatgctggccaatcccgagccagtctgagtcactcttcacactcgagtcagtcttcaagcaagaaatcctcttccgtacattcaatcccttccaccgctaataggcaaaatcggcctaagtcaagggaaagtagagataaacagaaatacgttcaagaggaaagactgtag

SEQ ID NO: 235690 - DNA, 543 bp, Artificial Sequence
  Description of Artificial Sequence: Synthetic coding sequence
tgaaaaatcagaatcatcactcagatgcttcagtatcacaataaggcgcacctcttgaacattcccagctggaattggaaagaaggagacgacgccatatgcctggctgagctgaagcttggcttcattgcgcagtcttgcctggctcaaggtctcagtaccatgttagccaatctcttcagcatgcgaagcttcataaagatcgaggaagatacatggcagaagtattatcttgagggagtgagtaatgaaatgtacaccgagtatttgagctccgctttcgttggcctgtctttccccacggtgtgcgagctgtgtttcgtcaagctcaaactgctcatgatcgcgatcgagtacaaatcagcaaatcgggagtctcgcatcttaataaatcccggtaatcatctgaaaatccaggagggcacccttggttttttcatcgcttcagacgcaaaagaggtaaaacgccctcctcagctgtgccttccactggcggcacagaagagatgctttcagtccgacaagctcgatatctttatctag

SEQ ID NO: 235691 - DNA, 2661 bp, Artificial Sequence
  Description of Artificial Sequence: Synthetic coding sequence
tgaaactctggagacccatgggagaactttcagaacaaccaggccctcacttactgggaatgcgtttatctgctgatggtgactatgtctaccgtaggatacggtgacgtttacgccaaaacaactttaggtaggctttttatggtgttctttatcctgggagggttagcaatgtttgcttcgtatgtacccgaaatcatcgagctgatcggcaacaggaagaagtacggtgggtcctatagcgcagtctctgggaggaagcacattgtagtttgcgggcacattaccctcgagagtgtttccaattttttgaaggattttctgcacaaggaccgcgatgacgtgaatgtggaaattgtattcctgcataacatcagccccaacctagagttggaagccctgtttaaaagacatttcacccaggtggagttctaccaaggctccgtcttgaacccacatgacctggctagagtcaaaatcgagtccgccgacgcttgtttgatcctggccaataaatattgcgccgaccccgatgccgaagacgcctctaatattatgagggtaatttctatcaaaaattatcacccaaagatccgtatcatcactcagatgctgcaataccataataaagcgcacctgctcaacattccgagctggaattggaaggagggagacgatgcaatctgtttggctgaattgaaactcgggtttattgctcaaagttgtctggcccagggcctgagtaccatgcttgctaacctgtttagcatgcgatccttcataaagatcgaagaagacacatggcaaaagtattatcttgaaggcgtctcaaatgagatgtacactgagtacctttcaagtgccttcgtcggcctctccttccccactgtctgtgaactgtgtttcgttaaactgaagctcctgatgatcgcgattgagtacaaatctgcgaacagggaaagcagaatcctcattaacccgggtaatcacttaaagatccaggaggggacgttagggttctttattgcttctgacgctaaagaagtcaagagggcctttttttattgtaaagcatgccacgatgatatcacagaccctaaacgcataaagaaatgcggctgtaagagactcaaggtcgccgcaaggagtagatattcaaaggatccatttgagtttaaaaaagagacaccaaacagccgcctggtgactgagcccgtagaggacgagcagccatctaccctgagtcctaaaaagaagcagcggaatgggggtatgaggaactcaccaaacacgtctcctaagcttatgcgccacgaccccctactgattccagggaatgatcagatcgataacatggattcaaatgtcaagaagtatgacagtacaggcatgtttcattggtgcgcgcctaaggaaatcgaaaaggtcatactgacaaggtctgaggctgcgatgacggtcctgtccggtcatgtggtggtgtgcatcttcggggatgtgtcctcagcattgatcggactgcgaaacctggttatgcccctgagagcctccaatttccactatcatgagctgaagcacatagtgtttgtaggtagcatagaatacctcaagagagagtgggagactctgcataacttcccaaaggtcagcatcctgcccggaacccctctcagtagggctgatctgagggcagtgaacatcaacctctgcgacatgtgcgtcatcctttcggcgaatcagaacaatatcgacgatacatccctgcaggacaaagaatgtatcctggctagcctaaatataaagagtatgcaatttgatgattcaattggagtccttcaggctaatagtcaaggatttacacctcccggtatggataggagctctccagacaactcaccagtgcacggaatgttaaggcagccatccataacgaccggagtcaacattcccattatcactgagctcgtgaatgacacaaacgtccagttccttgaccaggatgatgatgacgatccggacactgagctgtacctcacgcagccatttgcctgcgggacagccttcgcagttagtgtgctggacagcttgatgtccgcgacctatttcaatgataacatcctcactctgatccgaaccttggtcacagggggagcaacacctgagcttgaggcccttattgctgaagaaaacgctctgagaggtggctactccacaccccagaccttagccaaccgtgatagatgccgggtggcccagttggcgttactcgatgggcctttcgcagatctgggcgatggaggttgctatggggacctgttttgtaaggctctgaagacctataacatgctctgcttcggtatataccggctgagagatgcgcatttgtcgacccccagccagtgtaccaagaggtacgtcataacgaaccctccgtatgaatttgagctcgttccgacagatcttatcttctgcctgatgcaatttgaccacaacgccggtcaatcacgagcctctttgagccattcgtctcattcaagccagtcaagttctaaaaagtcgagctcagtgcatagtattcccagcacggctaaccggcaaaacagaccaaaatcacgtgaatctagggataagcagaagtatgtgcaggaagagcgcctttag

SEQ ID NO: 235692 - DNA, 795 bp, Artificial Sequence
  Description of Artificial Sequence: Synthetic coding sequence
tgagtcatatccattaagaattatcatccaaaaattagaatcattacccagatgctccagtaccataataaagctcacctgctgaacatcccatcttggaactggaaggagggtgatgatgcaatctgcttggcagaattgaaactggggttcattgcccagagttgtctcgctcaagggctgtcaacaatgctggccaaccttttctcaatgcgcagcttcattaagatcgaagaagacacatggcagaaatattatcttgagggcgtaagtaacgaaatgtacaccgagtatctctcgagcgcatttgtgggacttagtttccccactgtgtgtgaactgtgcttcgtcaaactgaagctcctcatgatagcaattgaatacaaaagcgcgaacagggaatcccggatcctaataaatcccggaaaccacttaaagatacaggaaggcactttaggcttcttcattgctagtgatgcaaaggaggttaaacgtgcatttttttactgcaaagcatgccatgacgatatcactgacccaaaacgcatcaagaagtgtggctgcaagagacttgctggatctcaggacactcatcctgatagcttttaccatcaggcggtgaatgctagctcctacctgcacggtgggggacaaatgtggccagtttcgtcttccagcagcatcctgctccactatctgcgccgtcagatgcctggccctgcacgcctgcccctggagttgtcatgccagggatctgctctgagtcctaaccctgacctctactgtatgaagtag

SEQ ID NO: 235693 - DNA, 3630 bp, Artificial Sequence
  Description of Artificial Sequence: Synthetic coding sequence
tctaatatccatgcaaaccacttgagcttggatgccagctcttcaagttcttcttcctccagctcatcttccagctcctctagcagctccagtagctcaagcgttcatgaacctaagatggatgctctgattatccctgttactatggaagtcccatgcgactcgcgtggtcagcggatgtggtgggcctttctggcctcatctatggtgacgtttttcggcggactgtttatcatactcctgtggaggacactcaagtatttatggaccgtgtgttgccactgcggcggaaaaaccaaggaggcccagaaaatcaacaacggaagtagccaggccgatggcaccctgaaaccagttgatgaaaaagaggaggccgttgcagccgaagttgggtggatgacctcggtcaaggactgggccggagtcatgatttctgctcagactctgactggcagagttctcgtcgttttggtgttcgctttaagcattggagcattggttatttacttcattgacagctcaaaccctatagagtcctgtcagaatttttacaaagactttaccttgcagatcgacatggcatttaacgtgttcttcctgttgtacttcgggttaagatttattgctgccaacgacaagctttggttttggctggaagtcaatagtgtggtggattttttcaccgtccccccagtgtttgtgagcgtgtacctcaacaggagctggttaggactccggtttctgcgggcattacgcctcatacagttcagtgaaatactgcaattcctgaacatcttaaagacatcgaattccatcaagctggtgaatctcctgtccatcttcatctctacatggctaacggccgctggcttcattcacctcgtggagaattcgggagacccctgggagaatttccagaacaaccaagcgctgacttattgggaatgtgtatatttactcatggtgacgatgtcaactgtcggctatggagacgtgtacgctaaaactacactgggcagattatttatggtgttctttatcttgggcggattagcgatgttcgcatcttatgtccctgagattattgagctgatcgggaacaggaaaaaatatggaggtagctattccgcagtgtcaggcagaaaacacatcgtggtgtgtgggcacatcacactcgagtcagtgagcaacttcctgaaggacttccttcacaaggatagggacgacgtcaacgtagaaatcgtgttccttcacaacatctctcctaatttagaattagaagcactgttcaagcggcactttacacaagtggagttctaccaggggagtgtgctgaatcctcatgatctcgccagggtcaaaatcgagtccgcagacgcttgcctcattcttgccaataaatactgcgctgacccagatgccgaagacgccagcaatataatgcgtgtgatctcaataaagaattatcaccctaaaatacgtattattacacagatgcttcagtatcataacaaagcacatctcctcaatatcccttcatggaattggaaggagggcgatgacgcaatctgtctggctgagctcaagctgggattcatagcacagagctgtctggcccagggccttagcacaatgctcgccaatctcttttccatgagaagtttcatcaaaattgaggaggacacctggcaaaagtactacctggagggcgttagcaatgagatgtataccgagtaccttagctctgcattcgtcggtctgtcttttcctaccgtttgtgaactgtgttttgtcaaattaaagcttcttatgatcgccatcgaatacaaatctgcaaatcgagagagccgaatattaattaatcctggtaaccatcttaagatccaggaagggaccttgggattttttatcgcctccgacgccaaggaggtgaaaagggccttcttctactgtaaagcttgccacgacgatattactgatccgaagcgtatcaagaaatgcggctgcaaaagacccaagatgtcaatctacaaaagaatgagacgggcatgttgctttgactgcggcagatcagagagggattgctcatgtatgtccggcagagtcagagggaatgtggatacactggaacgcgcttttccactgtctagtgtgtccgtgaatgactgctctacaagtttccgagccttcgaagacgaacagccttctacattgtcccccaaaaaaaagcagcgtaacgggggtatgcgcaattcccccaacacaagccccaagctgatgcggcacgatcccctgttgataccaggcaatgatcagatcgataacatggatagcaacgtgaagaaatatgattccacaggcatgttccactggtgcgccccaaaggaaattgagaaagtgatactaacccgaagcgaagcggcaatgaccgtgctttcaggacacgtggttgtatgtatctttggggacgtctcgagcgctctaatcgggcttcggaatctggtgatgccgcttcgtgcctctaatttccactaccatgaactaaaacacatcgtgttcgtggggtctattgagtacctgaaacgggagtgggaaactttgcacaactttcccaaggtctccattttgcccggaacaccattgtcgcgcgcagatctgcgagcagtcaatatcaacctgtgtgacatgtgcgtgatactgagtgcaaatcaaaacaatatcgatgatacatcactccaagacaaggaatgtatcttggcctcactgaatatcaagagcatgcaatttgatgattctatcggcgttctccaggcaaattctcagggcttcacacccccaggcatggataggagttcaccagacaatagtcccgtgcacggcatgctccggcagccaagcattacaacaggagttaacattccgatcattaccgagttagttaacgacaccaacgtacagttcttagatcaggacgacgacgatgaccccgatacggaactttacttgactcagcctttcgcttgtggaaccgcctttgcagtgagcgtactggatagtctgatgtctgccacttatttcaacgacaacatccttaccctgatcaggacattggtaaccggcggtgccaccccagagctggaagcgcttattgcagaagaaaacgcactccggggaggatactccaccccccaaactctcgccaatcgtgaccgatgtcgggtggcccagctggctctgttggatggtccctttgccgatcttggagatggcggatgctacggcgacctattctgtaaggcactgaagacctataatatgctgtgcttcggaatctatagactgcgcgacgctcatctgtcaaccccctctcagtgcacaaagcggtacgtgataactaacccaccgtacgaattcgagttagtgccgacagatttaatcttctgtctgatgcagtttgaccacaatgctggacaatcccgggcttcactctcccatagtagtcacagctcccaaagctcctctaaaaagagcagtagtgttcactctatccctagcactgcaaatagacagaataggccaaagtctagagagtcccgtgacaagcagaaaaaagaaatggtttatcggtag

SEQ ID NO: 235694 - DNA, 576 bp, Artificial Sequence
  Description of Artificial Sequence: Synthetic coding sequence
atggtgaagaagctggtcatggcgcagaaacgcggagaaacacgagcattgtgtcttggagtgacaatggtagtgtgcgctgttataacctattatatattagtcactacagtgcttcccctgtatcagaagtctgtgtggacgcaggagtcaaagtgccacttaatcgaaactaatattcgcgaccaggaggaactgaagggcaaaaaggtgcctcagtacccgtgcctttgggtgaacgtgagcgctgctggcagatgggctgtgctgtaccatacagaggatactcgcgatcagaaccagcagtgttcttatatacctggtagcgtggataattaccagacagcgagggccgacgttgaaaaagtaagagcaaagttccaggaacaacaagtcttctactgtttctccgccccaagaggaaatgagacctccgttttgttccagagattatacgggccacaggccctcctatttagccttttctggcccactttcttgctgaccggcggtctgctaataatcgccatggtgaagtctaaccaatatctaagcattttagcagcacagaaatag

SEQ ID NO: 235695 - DNA, 393 bp, Artificial Sequence
  Description of Artificial Sequence: Synthetic coding sequence
atggtgaaaaagctcgtgatggcccaaaagcgtggcgagactcgggctctgtgtttgggcgtcactatggtcgtgtgcgccgtcataacctactatatcttggtaaccaccgtgctgccattgtatcagaagtccgtctggacccaagagagtaaatgtcatctcatagagactaacatacgcgaccaggaagagctgaaagggaaaaaggtcccacagtacccatgcctgtgggtgaatgtttcagccgcaggccgatgggcagtgctttatcataccgaggatactagagatcagaaccagcaagtcttaaactggagagacggcgacaccagcttatatccctgtcaagtgtgcgagcctgtgccaaactgcccttgcccccgtggatag

SEQ ID NO: 235696 - DNA, 633 bp, Artificial Sequence
  Description of Artificial Sequence: Synthetic coding sequence
atggctaagttgcgggtggcttatgagtacactgaggccgaagacaagtcaattcggctgggtttgttcctgatcatttcaggggtagtgtctctgttcattttcggcttttgttggctctcccctgccctacaagacctgcaggctaccgaggcaaactgtacagtgctctcagttcagcagattggcgaagtgttcgaatgcacttttacctgcggtgccgattgccggggaacttcccagtacccttgcgttcaggtgtacgtcaataatagcgaatctaatagcagagcgctgctccactccgatgaacaccaacttctcaccaatcctaaatgtagctatatccctccctgcaagcgcgaaaatcagaagaacctagagtctgtgatgaattggcagcagtattggaaggacgagatcggatctcagcccttcacctgttactttaaccaacaccaaagacccgatgacgtcctgttacatcggacccacgacgaaattgtgcttctgcattgcttcttatggcccctggtaacctttgtcgtgggtgttttgatagtcgtcttaactatctgtgcaaagagtctggccgttaaggctgaagccatgaagaagagaaagttttcttag

SEQ ID NO: 235697 - DNA, 2259 bp, Artificial Sequence
  Description of Artificial Sequence: Synthetic coding sequence
atgaaacctgccgaacacgccaccatgtttttaatcgtcctaggctgcctgatactggcagtccttactacatttaaagagtacgagaccgtatctggcgattggctgctgcttctcgagaccttcgccatattcattttcggcgcagaatttgcccttaggatatgggccgctgggtgctgctgcaggtataaggggtggagaggcaggctcaagtttgcccgaaagccgctctgtatgctggatatctttgtcctcatcgcctccgtccctgtggtcgccgttggaaatcagggaaacgtcttggccacgagcctgcgatccctgagattcctgcagatactccggatgttgaggatggaccggagagggggaacctggaagcttctcggcagcgctatctgcgcccacagcaaggaacttatcactgcctggtatataggatttctgacattaatccttagcagttttttagtgtatcttgtggagaaggatgtgcccgaagtggacgcgcaaggcgaagaaatgaaagaagaattcgagacctacgccgatgctttgtggtggggactgataacactcgccaccataggatacggagacaaaacccccaagacatgggaggggaggcttatcgctgctacattcagtctgattggcgtcagcttttttgcactgccagcaggcattctggggagtggtcttgcgctgaaggtccaggaacaacatcggcagaaacacttcgagaagaggcgcaagccggcagccgagctgatccaggcagcctggaggtactacgccacaaaccctaaccgaatagacctggtggccacgtggaggttctacgagtctgtcgtgagtttcccattttttaggaaggagcagttggaggcagccagttctcagaagctgggcctgttggaccgggtccggctgagcaacccacgcggttcaaataccaaaggcaagctgtttaccccgttaaacgtggacgctatagaagaatcccctagtaaggagcctaagccggtaggacttaataataaagagagattcagaaccgcgtttcgtatgaaagcttacgcattttggcaaagttcagaggatgccggaacaggcgatcccatggcggaagatcgcggatatggcaacgatttccctatcgaggatatgatcccaactctcaaagccgcaattcgggctgtgagaatattacaattccgactttacaaaaagaagttcaaggagacactccggccttacgatgtgaaggacgtgattgagcagtacagtgccggacatctcgatatgttgagcaggatcaagtatctgcaaaccaggattgatatgattttcacacctggccctccaagtacccccaaacataaaaaaagccagaaaggctccgcattcacattccccagccaacaatcaccacggaatgagccctacgtcgccagaccatctacatcagaaatagaggaccagagtatgatgggcaagttcgtcaaagtggagcgccaggtacaggacatggggaaaaagctcgacttcctggtggacatgcacatgcagcacatggaaagactccaggtgcaggtcactgaatactacccaaccaaggggacctctagtcctgctgaagctgagaagaaggaagacaacagatattctgatctgaaaactattatctgcaactactctgaaactgggccaccggaaccaccctattcatttcatcaggtcaccattgacaaggtatccccttacggcttctttgctcatgatcccgtcaatctacctcggggagggccaagttccggcaaggtacaggctacgccaccatctagcgccaccacttatgtcgaacggcctactgtcttgcctattctgaccctgctggactcccgggtgtcttgtcactcacaggctgatcttcagggcccatattcagatcggatttcacccaggcagaggaggtctatcactcgcgactctgatactcctctgagtttgatgtctgtgaaccacgaagaactggagagatctccctcaggcttttcaatcagccaagatagggatgactatgtcttcgggccaaacgggggttcctcttggatgcgagaaaagaggtacctggcagagggtgagactgacaccgacacagacccatttacaccctctggaagtatgcccctgagctcaacaggagacggaattagcgactccgtgtggacacctagcaacaaaccaatatag

SEQ ID NO: 235698 - DNA, 1434 bp, Artificial Sequence
  Description of Artificial Sequence: Synthetic coding sequence
atgaccggccaaagtttatgggacgtgagcgaagccaacgtggaggacggcgaaatcaggattaatgtgggagggtttaagcgaagactgcgctctcatacacttctgagatttcccgaaaccagactaggccgtctgctgctgtgtcactctcgcgaagccatacttgaactatgtgatgactacgatgatgtgcagcgggagttttatttcgatcgtaaccctgagttattcccctacgtgttacacttttaccacacgggcaaactgcacgtcatggcagagttatgcgtcttttccttttcccaagaaatcgagtactggggaataaacgaattctttatcgattcttgctgttcctattcgtaccatggacgaaaagtggagcccgagcaggagaagtgggacgaacagagtgatcaggagagcaccacctccagctttgatgagatcctggccttctacaacgacgcatctaagtttgatggtcagccactgggaaattttaggaggcagttgtggctggccctggataaccctggctactcagtgttgtcccgggtattctctatcttatctatcttagttgtgatgggctctatcataaccatgtgcctcaattccctgccagacttccagatccctgatagtcaaggaaacccgggagaggaccccaggtttgagatagtggagcatttcggaatcgcgtggttcacttttgagttagttgcacggttcgccgttgccccagattttttgaagtttttcaagaacgcgctcaatctgatcgacctgatgagcattgttccattttatattaccctcgtcgttaacctggtggttgaatctactcccaccctagccaacttagggcgtgttgcccaggtgctgagacttatgcggatctttaggatcctgaagctcgcaagacacagtactgggctgagaagcctgggagcaacactcaaatacagctacaaagaggtgggtctcttactcctctacctcagtgtcggtatttcgatcttctcagtcgtagcctacaccatcgaaaaggaggagaatgagggactggccactattcctgcgtgctggtggtgggctaccgtgagcatgacaactgtgggatatggtgatgtagtgccaggtaccaccgccggtaagctcactgcatcggcatgcatcctggccggaatccttgtcgtcgtgctgcctattactctgattttcaacaagtttagccatttttacaggcgccaaaagcaactggagtcggccatgcgttcttgcgacttcggcgacgggatgaaagaggtccctagcgttaacttgcgagattactatgcacacaaagttaagtcgctcatggcctcattaactaacatgagtagatcttcgccaagcgaactatctctcaacgactccctcaggtag

SEQ ID NO: 235699 - DNA, 1434 bp, Artificial Sequence
  Description of Artificial Sequence: Synthetic coding sequence
atgactggccagtccctctgggacgtgagtgaggcaaatgttgaggacggcgaaatccggatcaacgtggggggtttcaagcggcgactccgctctcatacactgctgaggtttcccgagactagactaggacgattgctcttgtgtcactctagagaggctattctcgagctgtgtgatgattacgatgatgttcagcgtgagttctatttcgaccgcaaccccgagctgtttccatacgtgcttcacttttaccatactggcaagttgcatgtaatggccgagctctgcgttttcagcttttcgcaggaaattgaatactggggaataaacgagttctttatcgattcttgctgctcctatagctatcatgggcgaaaggtggaacctgagcaagagaagtgggatgaacagagtgatcaggaatcaacaacttcctcattcgacgagattctcgcattttataacgatgcctccaaattcgacggtcagcccctgggcaattttcggagacaactctggttagctcttgacaatcccggatatagcgtgctcagccgcgtgttcagcatcctgagcattctcgtcgtcatggggtccatcatcacaatgtgtttaaattcccttccagattttcagataccggactctcaggggaacccaggcgaagaccctcgctttgagatcgtggagcacttcgggatagcctggtttaccttcgaattggtggcaaggtttgctgttgcgccagattttcttaaatttttcaaaaatgcactcaacctcatagacttaatgtccattgtcccgttctatattacactagtcgtgaatctggtggtggagagcacgcccactctggcgaacctcggtcgcgttgcacaggtgcttcgcttaatgaggatattcagaatcctgaagctggccaggcatagcactggcctgcgatctctcggggctactctgaagtacagctacaaggaagtgggtcttctacttttgtaccttagtgtgggaatcagtatcttcagcgtagtcgcctacaccatcgagaaagaggagaatgagggactcgccactatacccgcatgttggtggtgggctactgtgagtatgacgaccgtagggtacggagatgtggtgcccggtacaactgctggcaaacttactgcctctgcatgcattctggcagggattctggtcgtggtcctgcctataaccctgatctttaacaagtttagccacttctatcgaaggcaaaagcaactggaatctgcaatgcggtcttgcgactttggggacggcatgaaggaagtgcctagtgtgaacctgcgggattactacgcccacaaggtgaaaagcctaatggccagtctcactaacatgagccgctccagtccttctgagcttagcctaaatgactccctgcgatag

SEQ ID NO: 235700 - DNA, 1476 bp, Artificial Sequence
  Description of Artificial Sequence: Synthetic coding sequence
atggtgttcggcgagttcttccataggccaggccaggatgaggaactggttaacttgaacgtaggcggttttaaacagtctgtggaccaatccacactgctccggttccctcatacacgcttagggaaattgctcacctgccactcggaggaggccatcctggaactgtgtgacgactattcagtggcagataaggagtactattttgatcggaaccctagcctctttagatatgtgcttaatttctattatacaggaaagttgcacgtgatggaggaactgtgtgttttttccttttgtcaggaaattgagtactgggggatcaatgagctcttcatcgactcctgctgttctaaccgatatcaggagcgaaaagaggagaaccacgagaaagactgggaccagaagagccatgacgtgtctaccgacagctctttcgaggagagctctctttttgaaaaggagctggagaaatttgacacgctccgtttcggacagctgagaaagaaaatttggattcgcatggaaaacccggcttattgcctgtctgcaaagctgatcgcaattagttcccttagcgtggtgctggcaagtatcgtagccatgtgtgttcattctatgtcggaattccaaaatgaggatggagaagtggacgacccggtcttagaaggagtcgagatagcctgcattgcatggtttaccggtgagttggctgtccgcctcgctgcagctccatgtcagaagaaattttggaaaaatcccctcaacatcatagactttgtgagtataatccccttttacgccacactcgcagttgatacaaaggaggaggaaagtgaagatattgaaaatatgggtaaagtggttcagatcttgcgactgatgagaatattccgaatcttgaagctggcccgtcactccgttggccttaggtccctgggggcaacactgcgccactcatatcatgaggtagggttgctcctactgtttcttagcgtcggcatttccatctttagcgttctgatttactccgtggaaaaagacgatcacactagttccctcaccagtattcctatttgttggtggtgggcaacaataagcatgactacggtcggatacggtgacacccaccctgtcactctcgctgggaagctgatagccagtacttgtatcatttgcggcattctggtagttgctctccctataaccattattttcaataagttctctaagtattaccagaagcaaaaagatatcgacgtagaccagtgctctgaagacgcgccagagaagtgccacgaactgccctactttaatatacgggatatctatgcccaaagaatgcataccttcatcacttccttatcttctgttgggatcgtcgtgtccgatccggattctactgacgcatctagtatcgaggataatgaggatatttgtaacaccaccagcctcgagaactgtacagccaagtag

SEQ ID NO: 235701 - DNA, 1476 bp, Artificial Sequence
  Description of Artificial Sequence: Synthetic coding sequence
atggtgtttggcgaatttttccatagacccggtcaagatgaagaacttgtaaacctgaacgtggggggtttcaaacagagtgttgatcagtccacgctgcttcgttttcctcatacacgcctaggcaagcttctgacctgccactccgaggaggcgatcctggagctgtgtgacgactactcagtcgctgacaaggaatattatttcgataggaatccctcactatttaggtatgtcctgaatttttactataccggaaagttgcatgttatggaagagctgtgtgtcttcagcttctgccaggagatcgaatactgggggatcaatgagcttttcatcgattcctgttgctccaacaggtaccaggaacgcaaagaagaaaaccatgagaaggattgggatcagaagtcacacgacgtgtcaactgactcaagtttcgaggaatcttctcttttcgagaaggagctggagaaatttgacactctgcgcttcggtcaattgaggaagaagatctggatcagaatggaaaacccagcatactgtctatcagctaaactgattgccatcagctccttgtcagtggtgctcgcttcaatcgtcgcaatgtgtgtgcactcaatgagtgagttccagaatgaggacggagaagtcgatgatcccgtgctcgagggcgtggagattgcttgtatcgcctggttcacaggtgaattagcggtgaggctggccgctgcaccatgccagaaaaagttttggaagaacccacttaacatcatcgactttgtgtcaataattcccttttacgccacgctcgccgttgacacaaaagaggaagagtctgaggacatcgaaaacatgggcaaggtggtccagatccttcggctcatgcgcatcttccggatcctgaagttagccaggcacagcgtcgggctgcgatccctcggcgcaactttacggcactcctaccatgaggttgggctgctgctcctctttctatctgtgggcatctccattttctccgttcttatttattctgtagagaaggacgaccatacatccagtctcacctctatccccatctgttggtggtgggccacaatcagcatgacaaccgtgggatacggcgacacccaccccgtcactctcgccggaaagctaattgcaagcacatgtataatttgcgggatcctggttgtggcgctgcccattaccattatttttaacaaattttcgaaatattatcagaagcagaaagatattgacgtcgaccagtgttccgaagacgcaccagaaaaatgccacgaacttccatatttcaacatcagggacatttatgcccagcgcatgcacacgttcataacttctctgtcttcagttggcatagtggtgtctgatcccgattccaccgatgcatcaagtatcgaagacaacgaggatatctgcaacaccaccagcttagagaattgcaccgccaagtag

SEQ ID NO: 235702 - DNA, 225 bp, Artificial Sequence
  Description of Artificial Sequence: Synthetic coding sequence
atggttttcggagagttttttcacaggcctggccaggatgaggagcttgtgaatctaaacgtgggtggattcaaacaatctgtagaccagtcaaccttactgcgattcccacacacccgactcggaaagctcttaacatgtcatagcgaggaagcaatcctagagctgtgcgatgattacagtgtcgccgacaaagaatactacttcgaccgcaatcccagttag

SEQ ID NO: 235703 - DNA, 390 bp, Artificial Sequence
  Description of Artificial Sequence: Synthetic coding sequence
atgatcctgagcaacactaccgccgtgacaccttttctgaccaaattgtggcaggagaccgtgcagcagggagggaacatgtctggccttgcgaggaggtcaccacgatcctcagatggaaagcttgaagccctatacgttcttatggttctgggattctttgggttctttacgctggggattatgctgagctacatccgcagtaaaaagctggagcactcaaacgaccccttcaacgtttatattgagtctgacgcctggcaagaaaaagacaaggcttacgtgcaggctagagtgctcgagagctaccggtcttgctacgtcgtggagaaccatctcgcaattgaacaacctaacacgcacctgccagaaaccaagccgtctccctag

SEQ ID NO: 235704 - DNA, 390 bp, Artificial Sequence
  Description of Artificial Sequence: Synthetic coding sequence
atgattctgtctaacaccactgcagtgacaccttttctgactaagctgtggcaagagactgtgcaacaaggtggtaatatgagcggtttggcgaggaggagtcctcggagcagtgacggtaagttagaagcattatacgttcttatggtgcttggcttttttggcttttttactttggggatcatgctttcatacattagatctaaaaagttggagcactcaaatgatccattcaacgtgtacattgaatccgatgcgtggcaggaaaaagataaggcctatgtccaggccagggtcctggaatcataccgaagttgctacgtagtagagaaccacctggccattgagcagccgaatacacacctgccagaaaccaaaccttcaccttag

SEQ ID NO: 235705 - DNA, 390 bp, Artificial Sequence
  Description of Artificial Sequence: Synthetic coding sequence
atgatcttatccaacaccactgcagtcacaccctttctgactaagctgtggcaagagacagtccagcaaggcggaaacatgagcggactcgccagacggagccctcgttcttcggatgggaagctggaggccctgtatgttctaatggtgctcggcttctttgggtttttcaccctcggaatcatgcttagctacatccgcagcaagaaacttgagcattctaatgacccctttaacgtttacatcgagtctgacgcatggcaagaaaaagataaggcctatgttcaggcgagagtcctggagtcctatcgtagctgttacgttgttgaaaatcatctggctatagagcaaccaaacactcatctcccagagaccaaacccagtccctag

SEQ ID NO: 235706 - DNA, 390 bp, Artificial Sequence
  Description of Artificial Sequence: Synthetic coding sequence
atgatcttgtcgaataccaccgccgtcacccctttcctgactaaattatggcaggaaactgtgcaacaggggggtaatatgagtggcctggccaggcggagccccagatctagtgatgggaaactggaggccctctacgtacttatggtgctgggattctttggattcttcaccctagggattatgttatcttacatccgctctaagaaattggaacatagcaatgacccctttaatgtgtacattgagagtgacgcttggcaggaaaaggacaaggcgtatgttcaggcccgagtgctcgagagctataggtcatgttatgtggttgaaaaccatctggccattgagcagcctaacacgcatctaccagagaccaaaccctctccatag

SEQ ID NO: 235707 - DNA, 390 bp, Artificial Sequence
  Description of Artificial Sequence: Synthetic coding sequence
atgattctcagtaacacaaccgcggtgaccccttttctcaccaagttgtggcaggagaccgtacaacagggcggtaacatgagtgggttggccagacgctccccaagatcgagcgacggaaaactggaggccctgtacgtgctcatggtgctcggttttttcggcttcttcactcttggcatcatgttaagctatatccgctccaagaaactggagcacagtaacgatccttttaacgtatatatagaaagtgatgcttggcaggagaaagacaaggcttatgtgcaggcaagagtgttggagagttaccgctcctgttacgtggtcgagaaccatctggcgatagaacagccaaacacccacttgcctgaaactaagccatcgccttag

SEQ ID NO: 235708 - DNA, 390 bp, Artificial Sequence
  Description of Artificial Sequence: Synthetic coding sequence
atgattctctccaatacgacagcagttacgccctttctcacaaagctctggcaagagacggtgcaacagggtggaaatatgagcgggctcgccagacgcagtccaaggtcatcagatggcaaactggaagcgctgtacgtgctgatggtactcggtttcttcggctttttcactttagggatcatgctgtcgtacatccgttccaagaaactggagcacagtaacgacccattcaacgtgtacattgagagtgacgcttggcaggaaaaagacaaagcctacgtgcaggcaagggttttggaaagttaccgttcttgctatgtggtggagaatcacctggcgatagagcagcccaacacccaccttcccgaaactaaaccaagcccttag

SEQ ID NO: 235709 - DNA, 372 bp, Artificial Sequence
  Description of Artificial Sequence: Synthetic coding sequence
atgtccacactgtccaacttcacgcagaccctggaggacgtgttccggaggatcttcatcacttatatggataactggagacagaacaccaccgccgaacaggaagctctgcaggcgaaggtggatgcagagaatttttactacgtaatcttgtacctaatggttatgatcggcatgttttcatttatcatagtggcaatcctagtgagtacggtaaagtcgaaacgtagagagcatagcaatgacccctatcatcaatacattgtggaagactggcaagagaagtacaaatcccagatattgaatttggaagaaagcaaggccacgattcacgagaacataggcgctgcaggatttaagatgtcaccctag

SEQ ID NO: 235710 - DNA, 312 bp, Artificial Sequence
  Description of Artificial Sequence: Synthetic coding sequence
atggagacaacgaacggcacagaaacctggtatgagagccttcacgccgtactaaaagctttgaacgccacattgcatagtaatcttctctgtcggccaggcccagggctggggcctgacaaccaaacagaagaacgccgtgcaagcctccctggcagggacgacaactcatacatgtacatactgttcgttatgttcctctttgccgtgacggttgggtccctgatcctaggctatacgagatcacgcaaggtggataaacggtcagatccctaccatgtgtacatcaaaaatcgtgtcagtatgatctag

SEQ ID NO: 235711 - DNA, 312 bp, Artificial Sequence
  Description of Artificial Sequence: Synthetic coding sequence
atggaaacgactaatggtacagagacttggtatgagtccctccacgcagtgctgaaggccctgaacgctacgttacattctaacctgctatgccgacctggtcctggcctggggcctgacaatcagaccgaagaaagacgggcatcgctgcctggacgggacgataactcatatatgtatattctgttcgttatgtttctcttcgccgtcactgtgggcagtctgatcctgggctacacaagatcccggaaagtcgataaacggagcgacccttaccatgtgtacatcaaaaacagggtcagtatgatctag

SEQ ID NO: 235712 - DNA, 39 bp, Artificial Sequence
  Description of Artificial Sequence: Synthetic coding sequence
atggagaccaccaacgggaccgaaacatggtatgagtag

SEQ ID NO: 235713 - DNA, 153 bp, Artificial Sequence
  Description of Artificial Sequence: Synthetic coding sequence
atggaaaccacaaacggcacagaaacttggtatgagagcctgcatgccgttttgaaggcgctgaacgccactctgcatagtaaccttctgtgcagaccaggacccggactaggaccagataaccagactgaggagagacgagctagtctctag

SEQ ID NO: 235714 - DNA, 162 bp, Artificial Sequence
  Description of Artificial Sequence: Synthetic coding sequence
atggaaactaccaatgggacagagacctggtacgagagtctgcacgcggtcctcaaagccctgaacgctactcttcacagcaacctactgtgtcgtcctgggcctgggctcgggcctgacaatcaaaccgaagagcgacgcgctagtctacctgggagatag

SEQ ID NO: 235715 - DNA, 300 bp, Artificial Sequence
  Description of Artificial Sequence: Synthetic coding sequence
atggagaccaccaacggcaccgaaacgtggtatgagagtcttcacgccgtacttaaagccctgaacgcaactctgcattccaatctactttgtagaccagggcctgggttaggcccagataatcagacagaggagagacgggcatctctgcccggacgagatgacaacagctatatgtacatcctgttcgtgatgtttctctttgccgttaccgtgggctctctcatactcggttacacccgaagccggaaagtcgacaagaggagtgacccataccatgtctacatcaaaaatcgctag

SEQ ID NO: 235716 - DNA, 513 bp, Artificial Sequence
  Description of Artificial Sequence: Synthetic coding sequence
atgctcaagatggaaccgttaaactccacccatcccggaacagcggctagcagttctcctttggaaagccgggctgcgggaggtggctcagggaatggaaatgaatacttctacatcctcgtggtgatgtccttttatggtattttcctgataggcatcatgctcggatacatgaagtccaagcggagggaaaaaaagtcaagtctgctcctcctgtacaaagacgaagaacgcctttggggagaggcaatgaaacccttaccagtcgtgtccggattgcggtcagtccaggtacccctcatgctgaacatgctgcaggaatccgtggccccagccctgtcctgcaccctatgtagcatggagggcgattctgtcagcagcgaatcgtcctcacccgatgtacatctgacaatccaagaagagggcgctgacgacgaactggaggagacctcagagactccactgaatgagagctccgaagggagttcggagaatatccatcagaatagctag

SEQ ID NO: 235717 - DNA, 2031 bp, Artificial Sequence
  Description of Artificial Sequence: Synthetic coding sequence
atggcggcagcctcttctccaccaagagcagagcggaaacgctggggatggggcaggctgccaggtgccagacggggtagcgccggtctcgccaagaagtgccccttttctcttgagttggcggaggggggacctgctggtggagcactttatgcacccatagccccaggagccccagggccagcaccacccgcatctcccgctgctccggcagccccacccgtggccagcgatttggggccacgcccacctgtctccctggatcctagagtgtcaatctattcgaccaggcggcctgtccttgcacgcacacatgtgcaggggagggtctacaacttcttagaaaggccgaccggatggaaatgttttgtatatcactttgccgtcttcttaatagttcttgtctgtttgattttttccgtgttgtccacaatagagcaatatgcagcactagccaccggcactctgttttggatggaaatcgtgctggtagtgttctttggcacagaatacgttgtgcgactgtggagtgccggttgccggtctaaatatgtcggtttgtggggacggttgcgattcgctcggaagcctatctccataatagatctgatcgtggtagtcgcaagcatggtggtgttatgcgtaggtagcaaaggccaggtgtttgctaccagtgcgattcgcggaatccggttcctacagattctaaggatgctccatgtcgacaggcaggggggtacttggcgtctgctcgggtctgtggtttttatccacagacaggagttgattacaactctgtatatcggtttcctgggcttgatatttagctcatattttgtatacctagctgaaaaggatgccgtcaacgaaagcggcagggtcgaatttgggtcatacgcagacgccttgtggtggggtgtagtgacggtgactaccattggctatggcgacaaggttcctcagacatgggtgggaaaaaccatcgcctcgtgcttcagcgtcttcgctattagctttttcgccctgcctgctggtatcctcgggagcggctttgctctgaaagtgcagcagaaacagagacagaagcacttcaatcgtcaaattcccgctgccgcttccttaattcaaacagcctggaggtgttatgctgcagaaaatcctgactcaagcacttggaagatatatatcagaaaagctcctcgaagccacacactattgtctccaagcccgaaaccaaagaagtcggtggtggttaaaaagaagaaattcaaactcgacaaagataacggggtaactcccggagagaagatgctcactgtaccccatatcacatgcgatcctccagaggagagacgactggatcattttagcgtcgacggctatgacagttcagtaagaaagagtcctaccctgttagaggtctcaatgcctcattttatgcgaacgaattccttcgccgaggatctcgacttggagggggaaaccctcctcacccccatcacacacatatcgcagctccgcgagcaccatcgtgctacgataaaggtcataaggcgtatgcagtattttgtagcgaagaaaaagttccagcaggcgaggaagccctacgatgtgcgcgatgtgatagaacaatactcccaaggacacctcaacctaatggttagaatcaaggaactgcagcgcaggttggaccagtccattggcaagcccagcctcttcattagtgtgtctgagaaatctaaagatcgcggatcgaatactataggagcacggttgaacagagtggaagataaggtgactcagctagatcagcggctggccctaatcacagatatgctgcatcagctcctgagcctccacggcggaagcactccaggctccggcggaccacctcgcgaaggaggcgctcacatcactcagccatgcggaagtggcggatcagttgatccggaactcttcctgccaagcaacaccctgccgacatacgagcaattgactgtccccaggaggggaccggacgaaggctcttag

SEQ ID NO: 235718 - DNA, 1650 bp, Artificial Sequence
  Description of Artificial Sequence: Synthetic coding sequence
atggattttctaatcgtcctggtttgcctgatatttagtgtgctttccactatcgagcagtatgctgcacttgcaaccggcaccttgttttggatggagatcgtgttagtcgtgttcttcggaacagagtacgtggtccgtctgtggtctgcgggatgccgctctaagtatgtgggcctttggggaagacttaggttcgcacgcaagcctatcagtattattgatttaatcgtggttgtggcttcaatggtggtgctgtgtgtgggtagtaaagggcaagtattcgcaaccagtgcgatccgtggaatccggttcctgcagatcctccggatgctgcacgtggatcggcaaggcggaacgtggcggctgctgggctctgttgtcttcattcatcgacaggaattaattactactctatacattggtttcttgggacttatattcagctcgtattttgtgtacctggccgagaaagacgctgttaatgaatccgggagagtggagttcggctcctacgccgatgccctctggtggggcgtggtcacagtcacgaccattggttacggtgacaaggtgccccagacgtgggttggtaagactattgcgagctgtttcagcgtgtttgctattagcttctttgccttacctgcaggaattttagggagcgggtttgcccttaaggttcagcagaagcagcgccaaaagcatttcaatcgacagatccccgctgccgcaagcctgatccagaccgcctggcggtgttacgccgcagagaaccccgattcctccacttggaagatatatatccgaaaggcccctcggagtcacacgttgctgagtcctagcccaaagccaaagaaatcagtggtggttaaaaaaaaaaagtttaaacttgacaaagacaatggagtgacacccggagaaaagatgctgaccgtgccacatattacctgtgatcctcctgaagagaggcgtctggatcacttttccgtggacggttatgattcctcggtgagaaagtcgcccacgctcttggaggtctcaatgcctcactttatgcggactaacagctttgccgaggatctcgacctggagggggagactctgctcacccctattacgcacattagtcagcttagggaacaccatagagctacaatcaaagtgatacgtcgtatgcagtacttcgtggccaaaaagaagttccagcaggccaggaaaccttacgatgtgcgcgacgtaattgagcagtactctcagggacatttgaaccttatggtgcggatcaaggaacttcaacggcgtctggaccagagcatcggcaaaccctcactgtttatcagcgtgtcagagaaatcaaaggaccggggatccaatacaattggagcgaggttgaaccgcgttgaagacaaggtgacccagctcgatcagagactcgcattaatcactgacatgctccatcagctgctgagcttgcacggcggttcaaccccagggtcgggcggaccacccagggagggtggagcccacataactcagccctgtggttcaggcggatctgtggacccggagttgtttctccctagcaacacgctgccaacctacgaacaattaaccgttccacggagaggcccagatgaggggagctag

SEQ ID NO: 235719 - DNA, 1182 bp, Artificial Sequence
  Description of Artificial Sequence: Synthetic coding sequence
atggtacaaaagtcccgtaacggcggagtttaccccggaccatcaggggaaaaaaagctgaaagtggggtttgtgggtctcgatcccggagccccagattctacccgtgacggtgcgctgctgatcgccggttccgaagccccaaaaaggggttcaatcttgagcaagccacgggcagggggagctggtgccggtaaaccccctaaacgcaacgccttctatcggaagctgcaaaatttcctgtataacgtactcgaaaggcctcggggttgggcctttatctaccatgcatatgtgtttctgctcgttttcagctgtctggtacttagtgtgtttagcaccattaaggaatacgaaaagagctctgagggagctctatacatccttgagatcgtgaccattgtggtttttggagtggaatacttcgtgcgaatctgggccgcaggctgttgttgccggtaccggggttggcgcggacgccttaagttcgccagaaagccattttgtgttatcgacattatggtgttgattgcaagtatcgccgtcctcgctgccggatcgcaaggcaacgtctttgcgacgtctgctttgcgcagtctgcgtttcctccagatcctgcgtatgatccgcatggacaggcgcggtggcacatggaagttgttaggatccgtcgtgtatgcccactccaaggagctagtcactgcatggtacattggatttctgtgtctgatcctggcttctttcctcgtgtatctggccgagaagggggaaaatgaccacttcgacacttatgccgacgccctctggtggggactgattacactaacgaccatagggtatggcgataagtacccccagacgtggaacgggaggctgctggccgctacttttactctcatcggggtaagcttcttcgctctgcccgctggaattctcggcagcggattcgctctcaaggtgcaagagcagcacaggcagaagcacttcgagaagcggcgaaaccctgccgcaggtctgattcagagtgcttggagattctacgcaacgaacctttcaagaaccgacctacacagcacgtggcaatactatgaaagaaccgttacagttcccatgtacagatacaggaggagggcccctgccaccaaacaactgtttcacttcctctttagcatttgctcctag

SEQ ID NO: 235720 - DNA, 2607 bp, Artificial Sequence
  Description of Artificial Sequence: Synthetic coding sequence
atggtccaaaaatcacggaacgggggagtttatccaggcccttccggggagaagaaactgaaggtaggattcgtgggcctcgatccaggggcaccagatagcaccagagacggcgctttgttgattgcgggttccgaggcccctaaacgaggcagcatcctgtccaagccaagggctggcggtgcaggagccggtaaaccgccaaaacggaatgccttttacaggaagcttcaaaactttctgtacaacgtgctcgagcgaccaagagggtgggcctttatctatcatgcttacgtctttctcctggtgtttagctgtcttgtgctcagtgttttctcaacgatcaaagagtacgagaaaagtagtgagggcgcactgtacatcctcgagattgtcacaatcgtggtgttcggtgtcgagtattttgtgcgaatctgggccgcagggtgttgctgtagataccggggatggcgtggccgtttgaagttcgccagaaagcccttctgcgttatcgacatcatggttctaatcgccagtatcgcggtgcttgccgcaggttctcaggggaatgtatttgcaacatcagcattaagaagcctccggtttcttcagatactaaggatgatcaggatggatagacgcggagggacgtggaagcttctgggtagcgtggtctacgctcactctaaagagttggtgacagcctggtacatcgggtttttgtgcctaattctggcctcatttctcgtgtacctggcagaaaagggcgaaaacgaccacttcgatacctatgcggatgctttgtggtgggggctcatcacactgaccaccatcgggtatggcgataaatatcctcagacctggaatggtcgcctgctagccgctactttcacactcattggcgtctcgttctttgccttgccagctggcattttgggctccggctttgccctcaaggtgcaggaacaacatagacaaaaacatttcgagaaaagacgtaaccctgcagcaggcctaattcagtccgcctggcggttttacgcgacaaacctctcccggactgacctgcacagtacctggcagtactacgaacgaactgtgacagtacccatgtacaggttaatcccgccacttaaccagttggagcttcttaggaacctgaagagcaagagcgggctggcgtttagaaaggatcctcccccagagcctagcccaagtccgcgtggcgtggccgctaaaggaaagggctctccacaggcccagaccgtaaggagatctccatcagccgatcaatccctagaggactcccctagcaaggttcccaagtcatggagttttggcgaccggtctagggccaggcaggcatttcggataaagggcgctgcgagtaggcagaattcggaggaagccagcttgcccggagaggacatcgtggacgacaaatcttgtccgtgtgagttcgtgactgaggatctgaccccagggctgaaggtatctattcgcgcagtatgcgtcatgcggttcctggtgtccaagaggaaatttaaagagtctctacgcccatacgacgtgatggatgtgattgagcagtattctgcaggccacctggacatgctgtctagaattaaatccctgcagagcaggatcgatatgatcgttggaccacctcccccttccacccctcgccataagaagtacccaacaaagggtccgactgcaccccctcgagagagtccccagtattccccccgagtggaccaaattgttggtagaggtccagccatcacagacaaagaccgaaccaagggtccagctgaagccgaactgcctgaggacccgagcatgatgggacgtctaggtaaggtggagaagcaagtgctaagtatggagaagaaactagacttcctggtgaatatatacatgcagcggatgggcatcccgccaaccgagacagaggcctactttggagctaaagagcctgaaccggctcccccttaccacagccctgaagattcccgagagcatgtcgaccgacatgggtgcattgtaaagattgtgaggagtagttccagcactggacagaagaacttttccgcccctcctgccgcacctcctgtacaatgccccccttcaactagctggcagcctcagagccatccacggcaaggccatgggacctcacccgtcggcgatcatggctcactggtgcggatcccacctccacctgctcacgaaagaagtctgagcgcctacgggggaggcaatcgtgcttcaatggagttcctcagacaggaagacactccaggttgtcgaccccctgagggcaatctccgagactctgacacatccatatcgataccatctgtagaccatgaggagctggagagaagcttctccggcttctctatcagccagtcgaaagaaaacctggacgccctcaatagttgttacgctgctgtggcaccatgcgccaaagtgcggccatacatcgcagagggtgagtcagacaccgattctgatctgtgcaccccctgcgggccaccgcctaggtcagccaccggggagggcccttttggcgatgtcgggtgggcgggacctagaaagtag

SEQ ID NO: 235721 - DNA, 2643 bp, Artificial Sequence
  Description of Artificial Sequence: Synthetic coding sequence
atggtccagaagtcccggaatggcggagtgtatcctgggccttcaggggaaaaaaagttgaaggttggtttcgtgggcttggaccctggtgcccctgatagtacacgcgacggagccctattgattgccggtagcgaggcccctaagcgtggtagtatcctttcaaagcctcgcgcagggggagccggagcaggtaaaccaccgaagcgtaacgccttctaccggaaacttcagaatttcctctataatgtgctcgagcgaccaaggggttgggcattcatctaccatgcatatgtgtttttgctagtgttttcctgcctcgtgctctcagtcttttccaccattaaagagtatgagaagagttctgagggggcattgtatatactggagatcgtgaccatcgtagttttcggagtggagtactttgtgcgcatctgggctgcaggttgctgttgtcgatacaggggctggaggggacgcttaaagtttgccaggaagcccttttgcgtcatcgatatcatggtgctgatcgcatccattgccgtcctcgctgccggaagccagggaaacgtgttcgcgacgtcagcgctgaggagcctgaggtttttacagatactgcggatgattaggatggatagaagggggggaacatggaaactgctggggtccgtcgtgtatgctcattcaaaagagttggtaacagcatggtatataggctttctctgcttgatcttggctagcttcttagtgtatcttgcagaaaagggggagaacgaccattttgatacatacgctgacgcattatggtggggccttattacgcttactactatcggttatggggacaagtatccgcaaacctggaatgggagactgctcgcagctacttttacactcattggggtgtcgtttttcgcccttcccgcaggtatactggggtctggcttcgccctaaaagttcaggaacagcaccgtcagaagcactttgaaaaaaggagaaaccccgcagccggactcatccagtcggcctggagattttacgcgacgaacttatccagaactgacctccacagtacctggcagtactatgagcgcactgtgacagtgcccatgtacagattaatcccaccattgaatcagttggaattacttcggaacctcaagagtaagagcgggctagcgtttcggaaagatccccctccggaaccgtcccctagccagaaagtttcactcaaagaccgcgtttttagcagtcccagaggcgtcgcggctaagggcaaagggagcccacaggcacagacagtgcggaggagcccaagtgctgaccaaagtctggaggactccccaagtaaggtgccgaagtcctggtcattcggtgatcgtagcagggcgaggcaggcttttagaattaagggcgcagcttctagacagaatagtgaggaggcctcactcccaggagaggacattgttgacgacaagagttgtccttgcgaattcgtgacagaggatctgaccccaggtttaaaagtctccatccgcgctgtctgtgtgatgcgtttcctggtgtctaagcgaaaattcaaagagagccttcgtccttatgacgtgatggacgtcatcgaacagtactcagccggtcacctggacatgttgagcagaatcaaatccctgcaaaccggaatcgatatgattgtcggccctccacctccctccacacctagacataagaagtacccaaccaagggtccgacagccccaccgagagagtctccccagtactcaccgcgagtggaccagatcgtcgggagaggccctgccataaccgacaaggataggaccaaagggccagctgaagccgaactgcccgaagatccatccatgatgggacggctgggcaaagtagaaaagcaggtgctgtctatggaaaagaagctggattttttggtcaacatttacatgcagcgcatgggtattcctccaactgaaaccgaagcgtatttcggggctaaagaaccggaacctgctccaccctaccatagccccgaagacagccgcgagcacgtggatcgacatggatgcattgttaagattgttagaagttcaagctcaacaggccagaaaaatttttcagcccctccagcagccccaccagtccagtgcccaccgagtacttcttggcagcctcaatctcacccgaggcaaggacatggaacttcgcccgttggcgatcacggatccctggtacgcatacctccccctcctgcccacgaacgcagcctatccgcttacgggggaggaaaccgcgcttccatggagttcttacgccaggaagacactccaggatgtaggccccctgaaggtaacttacgcgattcggatacatccatctctataccgagcgtagatcacgaggagcttgagcggtcttttagcggattctcaatctctcaaagcaaggagaatcttgatgcccttaattcttgctacgccgctgtcgctccatgtgccaaggtgcgcccttatatcgctgaaggggaaagcgataccgactctgatctgtgcacaccttgtggacctccccctcgctcggccacaggcgagggtcctttcggagatgtaggttgggctggcccacggaaatag

SEQ ID NO: 235722 - DNA, 2565 bp, Artificial Sequence
  Description of Artificial Sequence: Synthetic coding sequence
atggtacagaaatcaagaaatggtggggtttaccctgggccatcaggtgagaagaaactaaaagtgggatttgtaggcctggaccccggagcccctgattccacacgggatggcgctctcctcatcgccggtagcgaggcgcctaagagggggtccatcctgtccaaaccacgcgctgggggagctggcgctgggaaaccgcctaagagaaacgctttttatcggaaactccagaatttcctgtataatgtgttggagagaccgagggggtgggcattcatctaccatgcgtatgtgttcctcctggtgttctcctgcctcgtgcttagtgtgtttagtacaatcaaagagtatgagaagtcctcagaaggggcactctacatactcgaaattgtcacaatcgtggtcttcggtgtggaatacttcgtaagaatttgggcggcaggctgttgttgccgatatcgcggatggcgaggccgactgaagttcgccagaaagcccttttgtgtgattgatatcatggtactgattgctagcatcgccgttctcgcggcagggtcccagggtaatgtgtttgccacaagtgctctgagaagtctccgcttcctgcaaatcttgagaatgattcggatggatcgcagaggaggtacatggaaactactaggctccgtggtctacgcccattcaaaggagctggtcaccgcttggtatataggatttctgtgtctgattcttgcttcctttctagtataccttgcagaaaaaggtgagaacgaccacttcgacacatatgcggacgcactgtggtggggactgattactctgaccacaatcggttatggcgacaagtacccccagacttggaacgggaggctcctcgcagcaacatttaccctgataggggtgtcatttttcgcgttgccagccggtatcctgggtagcggattcgccttaaaggtgcaagagcagcatcgacagaaacacttcgagaaaagaaggaaccccgctgccggactgatccagagcgcttggcgtttttatgctacgaacctgtctcgaaccgatctgcactccacatggcagtactatgagcgcacagtgacagtgcccatgtattcttcgcagactcagacgtacggagcctcaagacttatacctcctcttaaccagctggagttactcagaaatctgaagtctaagagtggacttgccttccgcaaggatccacctcccgagccaagcccatcccagaaggtatccttgaaggaccgggtattttccagcccaaggggcgtcgcagctaagggcaaaggaagccctcaggcacagacggtgcggagatcacctagcgccgaccagtcattggaagactcaccctcgaaggtcccaaagtcctggtcattcggggatcgcagccgggcacgacaggcctttcgcattaagggcgcagcctcaagacagaacagcgaggaagccagtctccccggtgaagatatcgtggatgacaaatcgtgtccatgcgaattcgtaaccgaggatctcactccagggctgaaggtgtctatcagagctgtgtgcgtgatgaggtttctggtgtccaaacgcaagttcaaggagagcttgagaccctatgatgttatggacgtgatagagcagtattccgccggtcacttagacatgctcagcaggattaaatcactccagagcagagtggatcaaatagtcgggagagggccagccattacagacaaggatcgcaccaaagggcctgctgaggctgagctaccggaggacccttcaatgatgggaagactcgggaaggtggaaaaacaggttctttccatggagaaaaagcttgacttcctggtcaatatttacatgcagcggatgggcattccacctacagagactgaggcctattttggggctaaagagccagagccagccccaccctatcattccccagaggactccagggagcacgtggacagacatggttgtattgtgaaaattgtgcgttcgtcctcttctacggggcagaaaaatttttccgcccctcctgctgcgcctcctgtgcagtgcccgcctagcactagctggcaaccccagtcccatcctcgccagggtcacggcacatcccccgtgggagaccatggctctctcgttcgaattcctccaccccctgctcacgagagatccctgtctgcctacggtggcggtaatcgggcaagcatggagttccttcgacaggaggacaccccagggtgtcgccctccggagggtaacctaagagattcagatacgtccattagcataccaagtgttgatcacgaagagctggaaagaagctttagcgggttctcaatctctcagagtaaggaaaacctcgacgccctgaacagttgttacgccgcagtggctccgtgcgccaaagtgcgtccttacattgcagaaggcgagagcgacaccgacagtgatctgtgtactccttgtgggcctcctcctcggtccgctactggagaggggccatttggcgatgtggggtgggccggacccaggaaatag

SEQ ID NO: 235723 - DNA, 2619 bp, Artificial Sequence
  Description of Artificial Sequence: Synthetic coding sequence
atggttcaaaagagtcggaacggcggtgtgtacccgggaccatcaggcgaaaagaagctaaaggtaggctttgttgggctagatcccggagcgccagattctacaagagatggggctctgctgatcgctgggagcgaagccccaaagcgcggtagtattctgtcaaaaccacgagctgggggtgctggggctggaaagcctccgaaacgcaatgccttctatcgaaaattacagaatttcctgtacaacgtcctggaacggccacgaggatgggctttcatataccacgcatatgtgttcttgttagtcttctcttgcctcgtcttgtctgtcttctctacaattaaggaatatgaaaagtcctctgaaggggctctgtacatcctggaaattgtcactatcgttgtcttcggggtggaatattttgtacgtatttgggctgccggttgttgttgcagatatagaggatggagaggtcgcttgaaatttgctagaaagccattttgcgtgatcgacattatggtgctgatcgcctccattgctgtgttggccgctggttcccagggcaatgtgtttgcaacctcagctctgaggtccttgcgatttctccaaattttgcgaatgattaggatggaccgacgcggtggcacttggaagctactgggaagtgtcgtgtacgcccattcaaaagagctcgtcacagcatggtatatcgggttcctgtgtcttatcttagcctctttcctggtctaccttgccgagaagggggaaaatgatcacttcgatacatatgcggatgccctttggtggggactgatcacactcaccaccatagggtatggagacaagtatccacagacctggaacggccgactgctggccgcaaccttcacactgatcggagtctccttctttgctcttccagccggaatcttgggatcaggtttcgctttgaaagttcaggaacagcacagacaaaaacacttcgaaaagcgaaggaacccagccgctggccttatccagagcgcctggcgcttctatgccacaaacctatcacgcaccgacctgcattctacgtggcagtattatgaacgcactgtgacagtgccaatgtacagcagccagactcagacctacggcgcatcgcgcttgatcccccctttgaatcagctggagctgcttagaaacctgaagagcaaaagtggccttgcctttcggaaagaccctccaccagaaccttctcccagtaaaggttctccttgcagaggccctctttgtgggtgttgccctggcaggtcctctcagaaggtgagcctgaaggaccgcgtcttcagctcccctcggggagtggctgccaaaggcaaaggcagcccccaggctcagaccgtaaggcgctcaccatcggccgaccagtccctggaggattccccaagcaaggttcccaagagctggagcttcggagacagatcgagggcacggcaagcctttcgcattaagggcgcagctagtcggcagaattccgaagaggccagtctgcctggagaggacatagtggacgacaagtcctgtccctgcgaattcgttacagaggatctcacaccgggtctaaaagtgtccatccgcgctgtgtgcgtgatgagatttttggtgtcaaagagaaagtttaaggaatctctgaggccctacgacgtgatggacgtgattgaacagtactctgccggacatttggacatgctatctaggattaagtccctacagtccagggtggaccagatcgtcggacgaggtccagctataacagacaaagatagaactaaggggccagcagaggccgaattacctgaggatccatccatgatgggtaggttgggtaaagtggagaagcaagtcctgtcaatggagaaaaaactagacttcctggtgaatatttacatgcagaggatgggtatcccacccaccgagaccgaggcctactttggggcaaaagagcctgagcctgctcccccttatcattccccagaagacagcagagagcatgtagaccggcacggttgcatcgtgaaaatcgtgcgaagttcctccagcaccgggcaaaaaaatttctctgctcccccagcagcaccaccagtgcagtgtccaccaagcacaagctggcagccccaaagccaccctcgtcagggccacggtacgtcacctgtcggcgaccacggtagtctggtaagaatccctccgccacctgcacacgaaagatcactatctgcatatgggggaggaaaccgggctagcatggaattccttcgccaggaggacacacccggttgccggcctcctgagggaaatctgcgagatagcgatacatcaatctctatccccagtgtcgatcacgaggagcttgagcggagctttagcgggttctccattagccagtctaaagagaatcttgatgcgctgaattcatgttatgccgcagtggcgccttgcgctaaagtaagaccctatatcgccgagggcgagtccgatactgatagcgatctttgcactccatgtggacctcctcctagatcggccacaggcgaggggccatttggggatgtgggctgggcgggtccacggaagtag

SEQ ID NO: 235724 - DNA, 2619 bp, Artificial Sequence
  Description of Artificial Sequence: Synthetic coding sequence
atggtacaaaagtctagaaatggcggtgtgtaccccggaccctccggcgaaaagaaacttaaagtcggcttcgtaggcctcgaccccggtgcacccgacagtacccgcgacggagctctgctcattgctggcagcgaagcgccaaagcgaggctctatcctcagtaagcccagggcaggcggagcaggcgctggcaaaccaccaaagagaaatgcattttaccgcaagctgcaaaactttttgtacaacgtcctcgagcgcccacgaggctgggccttcatatatcatgcctatgtcttccttctcgtgttcagttgcttagtgctttccgtattctcaacgatcaaggagtacgagaagagcagcgagggggcactgtacatcctggaaatcgtgaccatcgtggtgtttggagttgaatacttcgtgaggatctgggccgcaggttgctgttgtcggtatcggggttggaggggacggctgaagtttgcccgaaagccattctgtgtgattgacattatggtgcttatcgcctctatcgctgtgttggcagctggttcccagggcaatgtctttgccaccagtgcactgcgcagtctccggtttttacagatcttacggatgataaggatggatagacgcggaggcacttggaaactgctggggagcgtggtctacgcgcacagtaaggagttagtgacagcctggtatattgggttcctgtgcctgatcctagcctcgttcttagtgtacctcgcagaaaagggtgagaatgaccactttgatacttatgcggacgccctatggtggggactgataacactaaccacgattgggtacggcgataaatatccacaaacctggaatgggaggcttctcgccgctacctttacgcttatcggtgtgagtttttttgccttgcctgccggtattttgggaagcggtttcgccttgaaggttcaggaacagcacaggcagaagcattttgaaaaaaggcgcaaccccgctgccggtttgatccaaagcgcgtggcggttctacgctacaaacctgtctcgcacggaccttcattccacatggcagtattacgagagaaccgtgacggtccccatgtatagtagccagacccagacatacggagctagcagacttattccccctctgaatcagttggaactactgcgcaaccttaaatctaaatctgggctcgcgtttcggaaagaccctcctcccgagccatcgccatctaagggttctccatgcagaggacctttgtgtggttgttgccccggacgttcgagtcagaaggtttctctcaaggacagagtatttagcagtcctcggggagtggctgccaagggcaagggatctccccaggcccaaactgtccgcaggtctcccagcgccgatcagtcactggaggatagcccttctaaagtacctaagagctggtctttcggagaccgatcacgtgcaagacaggcgttcaggattaaaggcgctgcgagcagacaaaattcagaggaagcctcactgcccggtgaagatatagtggacgacaagtcgtgtccgtgtgaattcgttaccgaggatctgacaccgggactcaaagtcagcatacgagccgtgtgcgtcatgcgcttcctcgtctccaaaagaaaattcaaggagtcgctgcgaccttacgacgtgatggacgtgatagagcaatattccgcgggacacttggatatgctgtctagaatcaaatcattgcaatctcaggtggaccaaatagtcggtagaggccctgcaattacggataaagataggacaaaagggccagccgaagccgagctgcccgaggaccccagtatgatgggcaggctcggcaaagtggaaaaacaggtcttatccatggagaaaaaactggatttcctggtgaacatctacatgcagcggatgggaatcccaccaaccgagaccgaggcctactttggtgccaaggagccagagcctgctcctccatatcattcgcctgaggacagtagggagcatgtggatcggcatggatgtatagttaaaattgtgcgaagttcctcgtcgacagggcagaaaaatttcagcgccccacccgctgctcccccagttcagtgccccccaagcactagctggcaaccacagtcccaccccagacagggccacgggacctcccccgtgggggaccacggatctctcgtccgcatcccccctccacctgcacacgagagaagcctgagcgcatacgggggagggaatcgcgcttccatggagttcctgcgccaggaagacacccccggttgccggccacccgagggcaacctgagggatagcgatacatcaattagcattccgtccgtcgaccacgaggagctggagcgttctttcagcgggttttcaatctcccagtccaaagaaaacctagacgcccttaactcctgctatgctgctgtagcaccctgtgccaaggtcagaccttatatcgccgaaggggagagcgacaccgacagtgacctctgcactccttgcggacctccaccacggagcgccaccggggagggacctttcggggacgtgggatgggccggtcccaggaaatag

SEQ ID NO: 235725 - DNA, 2535 bp, Artificial Sequence
  Description of Artificial Sequence: Synthetic coding sequence
atggtgcagaagtctcgcaatggcggagtgtatccagggccatctggggagaaaaagctaaaagtcggattcgttggactcgatccaggagcacccgattccacccgggatggggcactgctgattgccggatccgaagctcccaaacgtggcagcattctaagtaaacccagagcaggcggagctggagctggaaaaccccctaaacggaatgcgttctatcggaaattacagaatttcctgtataacgtgctggagaggcctcggggttgggcattcatctaccatgcttacgtctttcttctggtgttcagctgccttgtgctgtcagttttctctactataaaggagtatgaaaagagctccgagggagccctctacatcctggagattgtgacaattgtcgtgtttggtgtcgagtatttcgtccggatctgggccgctggttgttgctgccggtacagagggtggcggggtcggctaaagttcgccagaaaaccattttgcgtaatcgacatcatggtgcttatagcaagcattgctgtcctggctgcaggcagtcaggggaacgtgttcgccacttctgcgctgaggagtctgcgcttcctgcagatactgcgcatgattcgcatggatcgcaggggcggtacatggaaattactgggctcggtggtgtatgcccattcaaaggagctggtgactgcctggtatattggctttctctgccttatcctcgcttcctttttggtttatttagcagaaaaaggggagaatgatcatttcgatacctatgctgatgcgctgtggtggggactcataaccttaacaacaattggctacggcgacaaatacccccaaacctggaacgggaggctgcttgcagccacctttacattaatcggggtctcattcttcgccctcccagctgggatcctgggctcaggttttgcattgaaagtgcaagagcagcataggcagaaacactttgagaaaagaagaaacccggctgctggcctcatccagtcagcgtggcggttctacgcgaccaacctttcacgcaccgatctccatagcacatggcagtactatgagcgcactgttaccgtgccgatgtatcgccttatccccccacttaatcagctggagctcctgagaaacctgaagtcaaagagcgggttggcttttcgtaaggatccacctcccgagccctcccctagccagaaggttagtcttaaagatcgagttttttccagtccgcgtggagtggccgcaaagggaaaaggcagtcctcaggctcaaacggttaggaggtctcctagcgccgaccaaagcttggaggattcacccagcaaggtgcctaaaagctggtcattcggggatcgcagcagagcgaggcaagcattcagaattaagggagcagctagccgacagaactcggaagaggcctcactgccaggggaagacatagttgatgacaagtcatgcccgtgtgagtttgtgacggaagatctcacgcccggactaaaggtaagcataagagccgtatgcgtcatgcgattcctcgtttccaagaggaaattcaaggagtcactacgcccttatgacgttatggacgtaattgaacagtattccgctggccatttggacatgctaagtcggataaagagtttgcagtcacgggttgaccagattgtgggcagagggcctgctattactgacaaggacagaactaaaggaccggctgaggctgaacttccagaagacccttccatgatgggtcgactgggcaaggtggagaaacaagtgctctctatggagaaaaagctcgattttctcgtgaacatctatatgcaaagaatgggaattccaccaacagaaacagaggcctactttggcgcaaaggaacctgagccagccccaccttaccactcccccgaagattcccgtgagcacgttgatcgtcacggatgtatcgtgaagatcgtgcgaagtagttccagtactgggcaaaagaattttagtgcgccacccgctgcccctccggttcagtgcccccctagcaccagttggcaacctcagtcacatccacggcaggggcacggaacctctcccgttggggatcatgggtccctggtgcgaatccccccaccccctgctcacgagaggagcctgagtgcctatgggggtgggaatcgcgcaagcatggaatttctgcggcaagaggatacccccggatgcaggcccccagaggggaatctgcgtgattcagatacatctatcagtattccatctgtggaccacgaagagttggagcgctcattcagcggtttttcgatctctcaaagcaaggagaatctggacgccctcaactcatgctacgccgcagttgccccttgtgcaaaggtcagaccgtacattgctgagggcgaatctgatacagatagcgacctgtgcacgccttgtggtcctccccctaggtctgctaccggtgagggcccatttggagatgtggggtgggcaggaccaagaaagtag

SEQ ID NO: 235726 - DNA, 1311 bp, Artificial Sequence
  Description of Artificial Sequence: Synthetic coding sequence
atggtgcagaaaagccgaaacggaggcgtgtatcccggtccctcaggggaaaagaaactcaaagtaggctttgtgggcttagacccaggtgcacccgattctactcgcgatggtgctctgctgattgcgggttccgaagctcccaagcgtggatctattctgagtaaacctcgtgctggcggagctggggcaggcaagcccccaaaaagaaacgccttctatagaaaattgcagaactttttatacaacgtgctggaacgcccaagagggtgggccttcatttaccatgcctacgtcttcttattagtgtttagttgtcttgtgctgtcagtgtttagcaccatcaaggagtatgagaaaagttccgaaggggcactgtacatcctggagatagtgaccattgttgtgtttggagttgagtatttcgtcagaatatgggcagcaggatgctgttgccgctaccggggatggcggggaagattaaaatttgccaggaagcctttctgtgttattgacatcatggtattgattgcaagtatcgctgtgctggccgcagggtcccagggcaacgtgttcgccacttcggcgttaaggtcccttcggttcttgcaaatactgaggatgataagaatggatcgccgtggaggaacatggaaattgcttgggagcgtggtgtatgcccattcaaaggagctggtcacagcctggtacattggcttcctatgcttaatcctggcgtcattcctagtgtacctcgcggagaagggcgaaaatgaccatttcgacacatatgctgatgctctgtggtggggactgatcaccctcaccacaatcggttacggcgacaaataccctcagacatggaacggcaggttgttagcagccacctttacccttatcggcgtttccttcttcgccttaccggcagggatactcggaagtggattcgctttgaaggtccaggaacagcacaggcagaaacactttgagaaacgccgtaacccagccgctgggctaattcagtccgcttggcgcttttacgccacaaacctgtctagaacggatttgcatagtacatggcagtactatgagcggactgttacagtccctatgtataggcttatccctcctctcaatcaacttgaattattgcggaatctgaagtccaagtcaggtctggctttccggaaggacccgccaccagagcctagcccccgaagcgtaccccctgccgcaactctcgtgagtgctgtttgcaccgctgtttggtccctcagccacacatgcgcccagccagtaatggagatgtag

SEQ ID NO: 235727 - DNA, 1848 bp, Artificial Sequence
  Description of Artificial Sequence: Synthetic coding sequence
atggtgcagaagagtcgaaacgggggagtttatccgggacctagtggcgagaaaaagctgaaggtgggcttcgtcggactggatcctggggcacccgactcaactcgggacggagccctccttatcgccggaagcgaggctcccaagagaggctcaatcctgtccaaacctcgtgcagggggtgccggagcgggtaaacctcccaaacgcaacgctttctacaggaaacttcagaatttcctctacaatgtgcttgagaggccaaggggatgggcctttatctatcatgcttacgtcttcttgttggtttttagttgcctagtgttgagtgtgttctcaacgataaaagaatatgaaaaatcctctgagggtgcgttgtacattttggagatagtgactatcgtcgtgtttggtgtcgagtacttcgtgaggatctgggctgctggctgctgttgtcggtatcgtgggtggagggggcgactcaagtttgctaggaagcccttttgcgtcattgatatcatggtgctgattgcatccatcgccgtactggccgctggatcccaggggaatgtgtttgcgaccagtgcactgcggtctctacgcttccttcagatcctccgcatgattagaatggatcgacggggaggaacctggaaactgcttggctccgtggtttacgcccacagtaaagagctggtgacggcctggtacatcggcttcctctgcttaatcttagcaagcttcctggtgtatctggcagagaagggagagaacgatcatttcgatacctatgcagatgcgctatggtggggactcatcacgcttacaaccatcggctatggggataaatacccacaaacctggaacggtcggttactggccgcaacttttactctgatcggcgttagctttttcgcactaccagcagggatcctggggagcggttttgctcttaaagtccaggagcagcaccgccagaagcattttgagaagcgaagaaaccctgccgcaggcttgatccaatctgcatggcggttctacgcaacaaacttatcaaggacggatctccacagcacatggcagtactatgagaggaccgttaccgttccgatgtacagattaatccctccgttgaatcaacttgagttattgcggaatctgaagtcaaagagtggcctggcctttcgtaaggacccaccaccggagcctagcccatcgcaaaaggtgtccctgaaagatagggtcttctcttcccctaggggagtggctgcgaagggaaagggaagcccacaggcacagacggtgcggagaagccccagcgcagatcaaagcctggaggattcgccaagtaaagtgcccaaaagttggtccttcggcgaccgctcacgggcaaggcaggccttccgaattaagggtgcagcctccaggcaaaattcagaagaagcttccctcccaggcgaggacatcgtcgacgacaagtcctgtccctgcgagtttgtgacagaggatctgacacctggccttaaagtgagtattcgggcagtgtgtgtgatgagatttcttgtttccaagcgaaagtttaaagagtccctgcggccttatgatgtcatggacgtcatcgaacagtacagcgctgggcacctggacatgttatccaggatcaaaagtttgcaaagccgccaggagccccgtctcccagttcagcagggcacgcgcacagggtgggcctctggtacaaagcctaccgtagcacacggcggatccgcgggaggtgtgtgggctggtccgcctcctcacccacgcagacctttgtcagcttccgtggtctcaagtcaatctctcttctag

SEQ ID NO: 235728 - DNA, 2643 bp, Artificial Sequence
  Description of Artificial Sequence: Synthetic coding sequence
atggtccagaagagccggaatgggggagtgtaccccggacctagtggcgagaagaaactgaaagtgggctttgttggacttgacccgggtgccccagatagcacgagggacggagcactccttattgccggatctgaggctcctaaaagggggtcaatcctgtccaagcctcgagccggaggagccggtgccggaaagccaccaaagcgcaacgcattctatcgtaaactgcaaaatttcctgtacaacgtgctagagcgacctcgcggttgggcttttatctaccacgcctatgtattcctgctggtctttagctgcctcgtgcttagcgtcttttcgacaattaaagagtacgaaaagtcctcagagggagctttatacattctcgaaatcgtcactatagtggtcttcggtgttgagtattttgtcagaatctgggctgctggatgttgttgcagatacaggggttggcgcggacgtctgaaatttgcacgaaagcccttctgcgtaatcgatattatggtcctgattgcgtctatcgcggtgctggccgctggttcccaaggaaacgtgtttgcgaccagtgcactccgaagccttcgattcctccaaattttaagaatgatcaggatggaccgtcggggagggacgtggaagctccttggctccgtggtgtatgcacacagcaaggaactcgttaccgcatggtacatcgggttcctgtgcttgatcctcgccagcttcctggtgtatttagctgagaagggagagaatgatcacttcgatacctacgctgatgctctctggtggggcttgatcaccctcacaaccatcggatatggggataaatatccccaaacctggaatggacgactgttggccgctaccttcaccctcattggtgtctcgttcttcgccctccctgccggtatactaggatctgggtttgcccttaaggtacaggagcagcacaggcaaaagcacttcgagaagcgacggaatcccgcagctggtctaattcaaagtgcttggcggttctatgccacaaatctgtcacggactgacctacattcgacttggcaatactatgagaggactgttaccgtgccaatgtaccggctgatacccccactgaatcagctggagctgctccgaaacctgaagagcaaatctgggctagcattcagaaaagacccacccccagagccatctccttcccagaaggtgtctctcaaggaccgggtcttcagtagccctagaggtgtagctgccaagggcaagggctccccacaagctcaaacagtgcggagatccccaagcgctgaccaatcactcgaggatagcccctctaaagtcccaaagtcatggtctttcggggatagatcccgggctaggcaagccttccggatcaaaggagcagccagcaggcagaatagcgaagaagcttctctgcccggtgaagatattgtggacgataaatcctgcccctgcgaattcgtcacggaagatctgacgcccggactgaaagttagcatacgagctgtgtgcgtgatgagattcctggttagtaagagaaagtttaaagagagtctccgcccttacgacgtgatggacgtcatcgagcagtattccgccggtcatttggacatgctttcgcgcattaaaagtctccagtctcgtattgacatgatagtgggcccaccgcctccttctacccccaggcacaagaagtatccaacgaagggacccacggcgcctcctagggagtcgcctcagtattcccccagggtcgatcagatagtaggacgcggacctgccatcacggacaaggatcgaaccaaaggtcccgctgaggctgagctccccgaggacccttctatgatgggacgtcttggaaaggtagaaaaacaagtactatccatggaaaaaaaattggacttcctggtgaatatttatatgcaaaggatgggcatccctcccaccgaaaccgaagcatattttggtgctaaagagccagaacccgcacccccttaccattcccctgaggatagtcgagaacatgtggaccgacatggatgcatcgtcaagatcgttaggtcttcatctagcacggggcagaagaatttctctgcaccacctgctgccccaccggtccagtgcccaccctctacttcatggcagccacagagtcatcccagacagggtcacgggacctcaccagtgggtgatcacggatcactggttaggattccgcctccacctgcgcacgaaaggagcttatccgcttatggcggagggaatagagcttcaatggagtttttgaggcaggaagacactcccggatgcaggcccccagaggggaatcttcgagactcagacaccagcatttctattccttccgtggaccatgaggagcttgaacggagcttcagcggtttctctattagtcagagcaaggagaatctggatgccctgaacagttgctatgccgctgttgcaccttgtgccaaggtgcgcccttacatcgccgagggagaaagtgataccgactcagacctgtgcactccctgcggccctcctcccaggagcgccacgggtgaggggccatttggcgacgtcggctgggcaggcccaaggaagtag

SEQ ID NO: 235729 - DNA, 2529 bp, Artificial Sequence
  Description of Artificial Sequence: Synthetic coding sequence
atggtgcagaagtcccgaaacggtggtgtatatcccggtcctagcggggagaagaaactcaaggtgggattcgttggattggacccaggcgctcctgacagcactagggacggtgccctgctgattgccggatcagaagcgcctaagcgcggaagtatcctttccaaacctagagctggcggtgctggcgctggtaagcccccaaagcgaaacgccttttatagaaaactgcagaattttctgtataatgtccttgagagacctcgcggatgggccttcatttatcacgcttatgtgtttctgctggtgtttagttgtctggtgttatccgtgtttagtactataaaggagtacgagaagagttccgagggggctctctatattttggagatcgtcacgatcgtggtcttcggcgtcgagtactttgtcagaatctgggctgcaggatgctgttgtcgctatcgcggatggaggggtaggctcaaatttgctcgaaaacccttctgcgttatagacattatggtgctgatcgcttcaattgctgttctggccgcaggctcacaaggcaatgtatttgctaccagtgctttgaggtctctgaggttcctgcagatacttagaatgatccgcatggatcgccgaggcggaacatggaaactgcttggctcagtagtgtatgcgcatagcaaagaactggtcacggcttggtatatcgggttcctgtgcctgatcctcgcttccttcctggtgtacctggccgagaagggagagaacgatcattttgatacttacgctgatgccctgtggtggggcctgataacccttacgacaatcggttatggggacaagtacccccaaacatggaatgggaggctgctcgccgctaccttcactctaataggtgtgtcattttttgccctccccgctgggatcctcggcagcggtttcgccttaaaggtgcaggagcagcatcgccagaaacatttcgaaaagcggcgaaatcctgcagcgggactcattcagagcgcttggcgtttctatgccacaaatctgagcaggactgacctgcactccacctggcagtattacgaacgtactgtgactgtgccaatgtactcctcccagacacagacctatggggcttccagactgattccccctctgaatcagctggagcttcttcgaaacctgaaatcaaaatctggactggccttccgcaaggaccccccaccggaaccctccccgagcccgcgtggagtggctgccaaaggtaagggcagcccgcaggcgcagacagtcagacggagcccatcggctgatcagtcgctggaggacagcccgagcaaagtgccaaaatcttggagcttcggggatcgcagtcgcgcacggcaggctttcagaataaagggagccgcatcaaggcagaacagcgaagaggcctccctgcccggtgaagatatcgtagatgataagagctgtccctgtgaattcgtcacggaggatttgacccctggcctgaaggtgagcatcagggccgtttgcgtgatgcgatttctggtgtcaaagcggaaattcaaggagtccctccggccatacgatgtgatggacgtaatcgaacagtactcagctggtcatttggatatgttgagtcgcattaaatccttgcaatcgcgggtggatcagatcgtaggcaggggccctgctattaccgacaaggatagaactaagggcccagccgaagcagagcttccagaagacccttccatgatgggccgactgggtaaggtcgagaaacaggtattgtcgatggagaaaaagctggatttcttagttaacatctatatgcagcgcatgggaatccccccaactgagaccgaggcttatttcggcgcaaaagagcccgagccggctccaccatatcacagtcccgaagatagtagggagcatgtggaccgccacggctgcattgtgaagattgtgaggtctagttcttctaccggccagaaaaatttcagcgctcccccagcagctccacccgtgcagtgtcccccttctaccagttggcaaccgcagagtcaccctcgacaaggtcacggcacctctcccgtcggagaccatggatcccttgtgaggattccaccgccacctgcccacgagaggagcttgtctgcttacggcggaggcaatcgggcatctatggagtttcttcggcaggaggatactccaggctgccgcccacctgaggggaacctgagagactcggacacctccatctctatccccagtgtagatcatgaggagttagagcgaagcttcagcggcttctcaatcagccaaagcaaagagaacctggatgcacttaactcttgttacgcggcagtggccccatgtgcaaaggtgcgtccgtacatagcggaaggcgagtcagacactgacagcgatctctgcacaccctgtggtccccctcctaggtccgccaccggcgaagggcctttcggggacgtgggatgggcaggccctaggaaatag

SEQ ID NO: 235730 - DNA, 2526 bp, Artificial Sequence
  Description of Artificial Sequence: Synthetic coding sequence
atggtccagaagtctcgcaatggaggagtgtatccaggaccgtcaggtgagaagaaactcaaggtaggattcgtcggtctagatccaggcgcacctgatagcactagggatggggcacttctcatagcaggatcagaagcacccaaaaggggatctatactgtctaagcctcgggctggtggggctggggctggaaagccgcctaagcgtaacgctttctatcgtaaactgcagaattttctgtacaacgtcttagagcggcctagagggtgggcttttatttatcatgcctatgttttcctgctggtgttctcttgcttagtactgagcgtgttttccactatcaaagaatacgaaaagtcatcagagggtgctctgtacatactcgagattgtgaccatcgtggtattcggagttgaatatttcgtgcggatctgggctgctggctgctgttgtcgttatcggggatggcgcggaaggttaaagtttgcacggaagcccttctgcgtcatagatattatggtactgattgccagcattgccgttcttgccgctggtagccagggaaatgttttcgccacttcggccctgcgctccctccggttcctgcagatcctcaggatgattaggatggataggcggggtgggacctggaagttattaggctccgtggtgtacgcccattcgaaggagctggtgacggcgtggtatatcgggttcctctgtctgatcctggcctccttcctggtttatctggccgaaaagggcgagaacgatcacttcgatacatacgccgatgccctgtggtggggtttgatcactctgacgaccatcggctacggcgacaagtacccccaaacttggaatggacggctgttagccgctacttttactctgatcggcgtgagctttttcgcactcccagccggaatactggggagcgggttcgcactcaaggtacaagagcagcaccgacagaaacattttgaaaaaaggcggaaccccgctgccggtttgatccagtctgcctggcgcttctacgcaacaaatctgagcagaaccgatcttcattcaacatggcagtactacgagcgcaccgtgacggtgccaatgtactcctcacaaacccagacgtacggcgcttcaagactcataccacccctgaatcagctggaattgctgcgaaatctgaaatcaaagtcaggtctggcatttaggaaagacccgccaccagagccttcaccatcccctcgaggcgtggccgctaagggcaaaggcagccctcaggcacaaaccgtgcgtaggagcccctcagcagatcagtctttagaggattccccgtcaaaggtgcccaagagttggtccttcggtgaccgcagtcgcgctcgccaagcctttaggatcaagggtgccgcaagccgtcagaactcagaagcttcccttccaggcgaggatattgtagatgacaagagctgcccgtgcgagtttgtcactgaagatcttacgcccggactgaaggtgtcaattagagctgtgtgcgtgatgcggttccttgtgtcaaagcggaaattcaaggaatccctaagaccatatgacgtcatggacgtcattgagcaatatagcgccggacacctggacatgctctctcggatcaagagcctacaatctcgcgtcgatcagatcgtgggaagaggccctgctattacggacaaagataggaccaagggccctgccgaagccgagctgccagaggacccttcaatgatggggagactggggaaagttgaaaagcaggtgctatcgatggagaagaagctagattttctcgtgaatatctacatgcagaggatgggaatccctccgacggaaaccgaggcttacttcggtgccaaagagcctgagcctgcgccaccttaccacagtcccgaggatagtagagagcacgtggacaggcacggctgtattgtcaagatcgttcggtcatcctcctccacaggacaaaagaatttcagtgcaccgccagccgcaccgccagttcaatgtccccctagtacctcctggcagccgcagtctcatcctcgtcaggggcatggaaccagtcccgtcggggaccatggaagcctcgtgaggatccccccacctccagctcatgaacggtcactttcagcatacgggggaggcaatcgcgcatccatggagttcctgaggcaggaagacacaccgggttgccgcccaccagaagggaatctgcgagattcggatactagcatctctattcctagtgtcgatcacgaggagctcgaaaggtcatttagtggattctcaatctcgcagagcaaggagaatcttgacgcattaaattcctgctacgccgctgtagccccatgtgctaaggtaagaccctatattgccgagggtgagagcgacactgatagcgatctgtgtaccccttgcggaccccctccgaggtcggcaacaggcgaggggccatttggggacgtggggtgggctggcccaaggaagtag

SEQ ID NO: 235731 - DNA, 2619 bp, Artificial Sequence
  Description of Artificial Sequence: Synthetic coding sequence
atggggctgaaagccagacgggcagcaggcgcagcaggtggtggcggtgatggcggagggggtggtggaggggctgccaaccctgctgggggagacgccgctgcagccggtgacgaagagcggaaggtggggctggcccctggagatgttgaacaggtcacccttgccctaggtgcgggagctgataaagatgggacactgttgctggaggggggagggcgtgatgaggggcagaggcggactccacagggaattgggctcctggctaagacccccctgagcagacccgtgaagcgaaataatgcaaagtacagacgaattcagaccttgatttacgacgccctggagcgaccaagaggctgggctttactctaccacgcgttggttttcctgatcgtcctgggatgcctgatccttgcggtcctcacaacgttcaaggaatatgaaaccgtctcaggtgattggctgcttctgcttgaaaccttcgccatttttattttcggcgcagagttcgctctgagaatatgggctgctggctgttgttgtaggtataaaggatggcgaggcagattgaaatttgccaggaaaccactttgtatgcttgacattttcgtgctgatcgcctccgtcccggtcgtggcagtcgggaaccagggaaacgtgctggctaccagcttgaggtctctgcgctttctgcaaatccttcggatgttgaggatggatagacgcggtggcacttggaaacttctcggttcagctatatgcgcccattcaaaggagcttattactgcgtggtacattggatttctcaccctgattctgtcctcttttcttgtgtatcttgtcgagaaagatgtgcctgaagtggacgcccaaggagaggaaatgaaggaggagtttgagacttatgcagacgctttgtggtggggcctgattacactggcgactattggttacggggacaaaacgccaaaaacatgggaggggcgactcatcgccgcaacctttagcttaatcggggttagtttcttcgccttacccgctggtattttgggtagtggcctggcactgaaggtgcaagagcaacacagacaaaagcactttgaaaaacggagaaagcctgccgcagagcttattcaggctgcatggcgctattacgcgacaaatcctaaccgaattgatttagtggctacctggaggttttacgaaagtgtcgtgagcttcccctttttccggaaggagcagcttgaggctgcttcctcccagaagttgggccttctagaccgagtacgccttagtaaccccagaggctctaatacgaaaggaaaactgtttacacccctgaatgtagacgctatcgaggagtcaccctctaaggaaccaaaacccgtgggcttaaacaataaggaaagattccgcacagcattccgtatgaaagcatatgccttttggcagtcctcagaggacgcgggaaccggcgatccaatggccgaggacaggggctatggcaatgattttccaattgaggatatgatcccgacactgaaagcagctatcagggcggtgcgcattctccagtttagactttacaaaaaaaaattcaaagagactctcagaccctatgatgtaaaggatgtaattgaacagtattccgcaggacaccttgatatgctgagccgtattaaatacctgcagaccaggattgacatgatctttacaccgggtccaccctctacccccaagcacaaaaagagtcagaaaggtagcgccttcacatttccgagccagcagtccccaaggaatgagccatatgtagccaggcccagcacatcggaaattgaggaccagagcatgatgggaaagtttgttaaggtggagcgacaagtacaagatatgggtaaaaagctagactttctcgtggacatgcatatgcaacacatggaaagattgcaagtacaggtgactgagtactacccgacgaagggtactagctctcctgcggaagctgagaaaaaggaggataatcgatactctgacttgaagacaattatctgtaattactccgagactggaccgccagaacccccatactcctttcaccaggtgacaatagataaggtctcgccatacggatttttcgcccacgacccagtgaacctgccccgagggggtccaagtagcggaaaggtccaggcgactccgccatcttcagccacaacctatgttgaaagaccgaccgtgttgccaatccttaccttgcttgattctcgcgtttcttgtcattcacaggccgacctgcaaggtccttattcagacaggatcagcccaagacaacgccgatctatcaccagggattcagataccccattgtcactgatgtcggtcaaccatgaagaactggagcgaagcccctctggttttagtatttctcaagacagggatgactatgtctttggaccaaacgggggatcttcatggatgagggagaagcgatacctggctgagggcgagactgataccgacaccgatccttttacaccatcggggagtatgcccctatcgtctaccggcgacggaatttcagatagcgtgtggacaccctctaataagcctatatag

SEQ ID NO: 235732 - DNA, 2256 bp, Artificial Sequence
  Description of Artificial Sequence: Synthetic coding sequence
aagcctaagaagcatggacctatgtttttgatagtgttgggatgcctcatcctggccgtgctgactaccttcaaggagtacgaaaccgtttccggcgattggcttctgctgctggaaacatttgccatctttattttcggggcagagtttgccctgaggatctgggctgctggatgctgctgtagatataagggatggcgcggaagactgaaatttgcaagaaagcccctgtgtatgcttgacatttttgttctcatcgcgagcgtgcctgtcgtggccgtcgggaatcagggaaacgttctggcgacatccctgcgttctctgagatttttacagattcttaggatgctgcggatggatcgcagaggaggtacttggaagctattaggcagcgcgatctgtgctcatagtaaagagcttatcacagcctggtatatcgggtttctcactttgatcctgtcctccttcctcgtgtacctggtggaaaaagacgtccccgaggtggacgctcagggcgaggagatgaaagaggaattcgaaacctacgcggacgctctgtggtggggattgataacactggcgactatcggttacggcgataagacccccaaaacttgggaagggcgactgattgccgcaacatttagtctgattggggtctcattttttgcactgccggcaggaattttaggtagtggactcgctctcaaagttcaggagcagcaccggcagaaacactttgagaaacgtagaaagcccgcagcggagttaatccaggcagcttggcgctattacgccaccaaccccaatcgcattgacctcgtggccacctggcgattctacgagagcgtggtatcttttcctttttttcgtaaggagcaacttgaggctgcctcgagtcagaaactggggctcctcgacagggtacgtttatcaaatccaaggggttccaatactaaaggtaaactgtttacaccgttgaatgtggacgctattgaagaaagccccagcaaggagccaaagcccgtgggactgaataacaaagagcggttccggaccgcctttcgtatgaaggcatatgccttttggcagtcttcagaggatgccggtaccggcgatcctatggcagaggatagaggctatggaaatgatttcccgatcgaggatatgatccctaccctgaaggccgctattcgggctgtacggattctgcagtttcgtttgtacaaaaaaaagttcaaggagaccctgcgaccttacgacgtgaaggatgtaattgagcagtattctgcagggcacctggacatgctgtcacgcattaaatatctgcagactcggattgacatgatctttacccctgggccaccatcaactccgaagcataaaaaaagccagaaaggctctgcttttacttttcctagccagcagtcacctaggaacgaaccttacgttgccagaccctctacaagcgaaattgaggatcagtcaatgatgggaaaattcgtaaaggtcgaaaggcaggtccaggatatggggaaaaagcttgactttctggttgacatgcacatgcagcacatggaaagattgcaggtccaggtgaccgaatattatcctaccaaaggtacatcatctcccgcagaggccgagaagaaggaggataatcggtattccgacctcaagaccataatctgtaactactctgagaccggtcctccggagccaccatattcatttcaccaagtaacaatcgataaagttagcccttatggtttctttgcccatgaccccgtgaatctccctcgcggtgggccttcttccggaaaagtgcaagccactccaccttcaagcgccacgacatacgtcgagcgccctactgtgttgcctattctgacattgctcgactctcgggtgtcatgccactcgcaagccgaccttcaagggccatacagcgacaggataagtcccagacaacgcagaagcataactcgagacagcgatacccccctgagccttatgagcgtcaaccacgaggagctggaacggtccccaagtggcttcagtatcagtcaggaccgggatgactacgtttttggccctaacgggggatccagctggatgcgcgagaagagatatttagctgaaggagagaccgatacagataccgatccgtttacaccctcggggagtatgcccttaagctccaccggggatggaatctccgacagcgtttggacgccatcgaacaagcctatttag

SEQ ID NO: 235733 - DNA, 2550 bp, Artificial Sequence
  Description of Artificial Sequence: Synthetic coding sequence
agagcggctgccgaaaaggccaagcgcccagctggggctaggcaaatgggcctaaaagcaagaagggctgctgctggcgacgaggaaaggaaagtcggcttggcacccggtgacgtggaacaggttaccctggctctgggggctggcgctgataaagacggcactcttctgctggaaggaggaggcagagacgagggacagcgaaggacccctcagggtatcggactactcgccaaaacacccctgtctcgcccagtgaaacgcaataacgctaagtacaggaggattcagacgctgatctacgatgccctcgaaagaccgagggggtgggcgctgctgtaccatgcgctggtttttctcattgtgctgggatgtttgattctcgccgttttgacaacctttaaagaatacgaaacagtgtctggtgactggcttcttctcctagagaccttcgcgatattcatcttcggcgctgaatttgccctgaggatttgggccgctggatgttgctgtcgctataaaggatggagggggaggctaaagttcgccagaaaaccgctgtgtatgcttgatattttcgtgctcatcgcctctgtcccagtcgtggccgtcggcaatcagggcaacgtcctagccacatccctgaggtcactccggtttctccaaattcttcggatgcttcgcatggataggaggggagggacgtggaaactgctggggtccgccatctgcgcccactccaaagagttgattacggcatggtacatagggtttttgacactaatcctgagcagttttctcgtctatctcgttgagaaggacgtccctgaggtggatgctcagggagaagaaatgaaagaggaattcgagacctatgctgacgcgctttggtggggcctgattacactagccacaatcggctacggagataaaacccctaagacttgggaaggcagattgatagctgcgaccttctctctgattggcgtctcctttttcgctctcccggctgggatcctcggctcaggactggctttgaaagtccaggagcagcatcgacagaaacatttcgaaaagcgcagaaagccggcagcggagctgatccaggccgcatggcggtactatgctaccaaccccaaccggatagatctggtagctacgtggaggttctacgagtcggtggtgagttttcccttctttcggaaagagcaactggaagccgcatccagccaaaaactcggacttttagaccgggtccgtctttctaatcctcggggtagtaataccaaaggcaagctgttcacgccactgaacgtggatgccattgaggaatccccatctaaggagcccaagcccgtggggctaaataataaagagcgctttcggacagccttcaggatgaaggcctatgccttctggcagagttcagaggacgcaggtactggggacccaatggccgaggatcgtgggtacggcaatgactttccaattgaggacatgattccgactctcaaagccgctattagggctgtgcgcattttacagtttcggttgtataagaaaaagttcaaggagactctcagaccctatgatgttaaagatgtcattgagcaatactccgccggtcacttagacatgctttctagaataaagtatttgcagacccgcatagatatgattttcacgcccggtccccctagcactccaaagcataaaaagtcgcagaaaggcaacgagccatatgtggcgaggcccagcacctctgaaattgaagatcagagcatgatgggcaagtttgtgaaggtcgaacgtcaagtacaggatatgggaaagaagctggacttcttggtcgatatgcacatgcaacacatggagcgtctgcaggtgcaagtgacagaatattatccaaccaagggaactagtagccccgcagaggccgagaagaaagaggacaaccggtacagtgatctcaaaaccattatctgtaactattccgaaaccggtcctcctgaacctccatatagctttcaccaagtaaccattgacaaggtgagcccctatggcttcttcgcccatgatccggttaacctgcccagaggcggacctagcagcggcaaggtgcaggccaccccaccctcttcagccacaacatacgtagagcggccaacagtactgcctatcctcacgttgctggactcccgcgtaagttgccacagtcaggctgatctgcagggcccatattctgacaggatcagtccgaggcagcgcagaagtattaccagggacagcgataccccattaagcctgatgagtgtcaaccacgaggagctcgagcgaagccctagcggattttcgattagccaggacagagacgactacgtatttggtcctaacggcggttccagttggatgcgagagaagcgatacttggcagaaggcgagacagacacggatacggacccctttaccccttctggatccatgccactgagttctaccggcgatggcatcagcgactctgtttggaccccctccaataaacctatttag

SEQ ID NO: 235734 - DNA, 2088 bp, Artificial Sequence
  Description of Artificial Sequence: Synthetic coding sequence
atggccgaagctcccccaaggaggctcgggctaggccctccccctggcgacgccccacgcgctgagctggtcgccttgacggccgttcaaagcgaacagggagaagctggagggggaggctcacctaggcgtcttggacttctgggctctcctcttcctcccggagctcccctgcctgggccagggtccggtagcggctctgcctgcggtcagcggtcctctgcggctcataagcgataccgcaggcttcagaactgggtctacaacgtgctcgagaggcctcgcggatgggcgttcgtgtaccacgtctttattttcctgctggtgttctcgtgcttggtgctaagtgtgttatccactattcaagaacaccaggagttggccaatgagtgcctgctgatactcgagtttgttatgatcgtggtcttcggtcttgagtatatcgtacgcgtctggtccgctggatgctgttgcaggtaccgtgggtggcagggccgattcaggttcgccagaaaacctttttgtgtcatagacttcatcgtgttcgtcgcttctgtcgcagttattgctgccggtactcaaggtaatatcttcgccactagcgcgttgaggtctatgcggtttctgcagattctacgaatggtccgcatggaccgcagagggggaacttggaagctcctcggcagcgtggtgtacgcccatagtaaagagcttatcactgcttggtacattggcttccttgtgctgatcttcgcttccttccttgtgtatctggcagagaaggacgcaaactccgacttctctagctacgctgactccctgtggtggggcactattacactgaccactattgggtacggcgataagaccccgcatacgtggctgggccgagtcctcgccgcaggcttcgccctgctggggatttctttttttgcactgcctgctggcattcttggttctggcttcgccttgaaggttcaggaacagcaccgccagaaacactttgagaagaggcggatgccagctgccaatctgattcaggctgcctggaggttatattccacagacatgagcagggcctacctgacggctacttggtactactacgattcaatcctgccatcgttccgagaactggcattgctgttcgagcacgtgcagcgggctaggaacgggggactacgcccactcgaagtccgaagagcccctgtgccagacggtgctccaagccgataccctccggtcgcaacatgtcaccggcctggttcaacaagcttctgcccaggcgaatcctctcgtatggggatcaaggataggatccggatgggtagttctcagagaagaaccggaccatccaagcagcatctagccccaccaactatgcctacatcaccctccagtgagcaggtcggggaggcaacttcccctacaaaggtgcagaaaagttggtctttcaatgatcgcacccggttcagagcgagcctgagactgaagccacggacaagtgccgaggacgccccttcagaggaggtggcggaggagaaatcctaccaatgcgaactcactgtagacgacataatgcctgccgtgaagaccgtcattcgctctatccgaattctaaaatttctggtggccaaacggaagttcaaagaaaccctacgaccatacgatgtcaaggatgtaatagagcagtattccgcgggtcatctggacatgttggggcgaatcaaaagccttcagacacgtgtggatcagattgtggggcgaggcccaggcgacaggaaagcgagagaaaagggtgataaaggacccagtgatgccgaggttgttgatgaaatatctatgatgggacgcgtggttaaggtggagaaacaggtgcagtcgatagagcataagctcgatctgcttttaggattctactccagatgcctgcggagcgggacctcagcctccctgggcgctgtccaggtccccctgtttgatcctgacattacatctgactatcacagcccagtggatcacgaggatatctctgtctctgcccagacacttagtattagtcgctccgtttcaaccaacatggactag

SEQ ID NO: 235735 - DNA, 2856 bp, Artificial Sequence
  Description of Artificial Sequence: Synthetic coding sequence
atgcccagacaccatgccggtggtgaggaggggggagctgctgggctgtgggtgaagagcggcgctgcggctgcagctgcaggaggaggacgcctgggctccgggatgaaagatgtcgagagtgggaggggcagagtcctgctgaactccgccgctgctaggggtgacggtcttctgctactcggaacgcgggcagccactttgggcggtggcggtggtggacttcgggaatcacgacgcggtaagcaaggagctcggatgagcctgctgggaaaaccactctcctacacatcctctcagtcctgtagaagaaatgtgaaataccgccgtgtccagaactatttatacaatgtcctggaacgccctagaggctgggcgttcatctaccatgcttttgtgtttcttctcgtgtttggttgcttaatcctgtccgtgttctctactattcctgagcataccaaactggcgtcttcctgcctgctcatcctcgaattcgtcatgatcgtcgtgttcgggctcgagttcataatccggatttggtcagctggatgctgttgccgatatagggggtggcaaggaaggttaaggtttgctagaaaaccattctgcgtcattgacacaatcgttctcatcgcatctatcgcagtcgtgagcgctaaaacacaaggaaacatctttgctacttctgcactgcggagccttagatttctccagatactgaggatggtaagaatggatcgaagggggggaacctggaagctgctgggcagtgtggtatacgctcattccaaggagctgattacagcttggtatattggattcctcgtcctgatattctcatcctttttggtgtacctcgtagagaaggacgccaataaagagtttagcacctacgcagacgcgctttggtggggcactatcactctcacaactataggatacggcgacaagacccccctcacatggctcggcaggctgctctctgccggtttcgccctcctagggataagcttcttcgccctccccgcaggcatactcgggtctgggtttgccctcaaagtccaggaacagcaccgccagaagcatttcgaaaagcggaggaatcctgccgctaatttgatccagtgcgtgtggcggtcttacgcggctgacgagaaatcagtgtctattgccacttggaaaccacatttgaaggcactgcatacgtgttcaccaaccaagaaagagcagggagaggcctcttcgtctaagttttgctccaataagcaaaaattattccgtatgtacacctccagaaagcagtcacagaaactgtcctttaaagaaagagtacggatggcttcacctcgtggccagagtataaaatctcgacaggctagcgtgggagataggagatcacctagcacggacataaccgcagaaggatctcctacaaaagtgcagaagtcctggtcctttaatgatagaactagattcaggccctcactgcggctgaagtcatctcagcctaaacccgttattgatgccgacaccgctcttggcacggacgatgtctacgacgaaaagggctgccaatgtgatgtgagtgttgaggacctaacccctccacttaaaaccgtgatcagggctatccgtattatgaaatttcatgtagcaaagagaaaatttaaggaaacactgcgcccatatgatgtgaaggatgtaatcgagcaatatagcgccggtcacctcgacatgctgtgtcggattaaatcactgcagacccgcgtggatcagattttgggcaagggacagattacatccgataaaaagagccgagagaaaatcaccgccgagcatgaaacaacagatgatttaagcatgctggggcgtgtggtgaaagtggaaaagcaagtgcagagcatcgagagcaagctggactgtctcctggatatataccagcaggttctgcgcaaggggtctgcttcagcccttgccctggcaagcttccagattccacctttcgagtgcgaacagacttctgactaccagtcccccgtggattcgaaagatctgtcaggatctgcccagaactcgggctgcctgtcaaggtctacatccgcaaacatttctcggggactgcagtttatcctgaccccgaatgaattcagtgcccagacattttatgccctgagccctacaatgcactcccaggctacccaggtgccgattagtcagtccgacggctcagcagtcgctgcaaccaatacgattgccaaccaaatcaatactgctccaaaacccgcagctcccaccacgttacagatacccccaccactgccagcgattaagcacctgccacgacctgagacactccaccccaaccccgcaggcttgcaggagtcaatcagtgatgtcaccacctgtctcgtcgccagtaaagaaaacgtacaggtcgcgcagtctaatctgaccaaagaccgatcaatgcggaagtcattcgatatgggcggagaaaccttgctgtctgtgtgcccaatggttccgaaggacctaggaaaaagtctgtccgtgcagaacttgatacggtcaacggaagagctgaatatccaactgagtggcagcgagtccagcggctcaaggggcagccaggatttttatccaaagtggcgagaatccaagctatttattaccgacgaggaagtaggaccagaagagaccgagactgacactttcgatgctgcccctcagcccgcaagggaagccgcattcgcttccgattctttgaggaccggcaggtcacggagctcccagtcgatttgtaaggcaggagagagcaccgatgctctgtccctcccccacgttaagctcaagtag

SEQ ID NO: 235736 - DNA, 2799 bp, Artificial Sequence
  Description of Artificial Sequence: Synthetic coding sequence
atgcctcgtcaccatgcagggggtgaagaaggaggtgccgctggactgtgggtgaaatccggtgccgcagcggcagccgcaggcggtggccgtctaggatcagggatgaaggatgtagaaagcggtagaggacgtgttcttctaaattcagccgcagcccgaggtgacggcctccttttgctgggcacaagggctgctactctcggaggcggtggtggcggtctcagagagagtcgccgaggaaaacagggggctcgtatgtctctgctgggaaaacccctgagttatacctcctcacagtcctgccggagaaacgttaaatacaggcgggtacagaactatttgtacaacgtcctggagaggcccaggggctgggccttcatttaccacgccttcgtattccttcccgtcttcggatgtctaatcctctccgtcttcagcactatacccgagcacaccaaattggctagttcatgtctgctcatactggaatttgtcatgatcgtcgtatttggattagaatttattatcaggatctggtctgctggatgctgttgccggtataggggctggcagggcaggttgcgctttgcccgaaaaccattttgtgtgatagataccatagtgctcatagctagtattgcagtcgtgagtgccaagacccagggcaacatctttgcgacaagtgcactaaggtccctgcggtttctgcagattctccgcatggtgcgtatggaccgacgcggaggaacgtggaagcttctcggatctgtcgtgtacgcccattctaaggaactgatcacagcctggtatatagggttcctcgtcttgatctttagctctttcctggtgtatcttgtcgaaaaagatgctaataaagagttttccacatatgcagacgcactgtggtggggaaccattactctgacaactatcggttacggggacaagactccattaacctggcttggaaggctgctatccgcgggttttgccctgctcggcataagcttttttgctctacccgcaggaatcttaggtagtggctttgccctcaaagtgcaggagcagcaccggcagaaacacttcgagaagagacgaaatcccgctgccaaccttatccagtgcgtttggcgcagctacgcagcagatgagaaaagcgtctccatcgctacatggaagccacacctgaaagcgcttcatacttgtagccctactaagaaggaacaaggagaggcatctagctcacaaaagctcagctttaaggaacgggtcagaatggcctctccccgtggacagagtattaagtccaggcaggcttctgtgggcgacagacgatcaccgtcgaccgatatcaccgccgaggggtcaccaaccaaagttcagaagagttggtccttcaacgaccgaactcggttcagaccctcgctgaggctcaagtcctcccagcctaagcccgttatagatgcggataccgccttggggactgatgacgtctacgacgaaaaaggatgtcagtgcgatgtgtctgtagaagatctcaccccaccattaaaaacagttattcgagctattcggattatgaagtttcacgtggccaagagaaaattcaaggagacacttcgtccctacgacgtcaaagatgtcattgagcagtattccgccggacatcttgatatgttatgtagaatcaaatctctacagactcgcgtggatcagatcctgggcaaaggtcagattacctccgacaaaaagtctcgggagaagatcaccgccgagcatgagactacagatgatctgagcatgcttgggagagttgttaaggtagaaaaacaagtccaatcgattgagtctaaactcgactgtttgttggacatatatcagcaggtgcttcgcaaggggagcgcctccgctttagctctcgctagtttccagatccctccatttgagtgcgaacagaccagcgattaccaatcgcccgtagactcaaaggacctgagcggttctgctcagaacagtggctgcctgtcccggtcaacttccgctaatataagtaggggcttgcaatttatcctgacccctaacgaattcagcgctcagacgttttacgccctcagtccaactatgcacagccaggccacacaagttcccatcagccagagtgacggaagcgcagttgccgctacaaacaccattgccaatcaaataaacaccgcacccaagcctgccgcacccacgactctccagatccccccacctctacccgcaatcaaacatctgcctagacctgaaacactgcatcccaaccctgctggactccaggaatccatttccgatgttaccacatgtttagtggcttcaaaggagaatgtacaagttgcacagtcaaatttgactaaggaccgatccatgagaaaatcctttgatatgggcggtgaaacgctcctctcggtctgccctatggtgcctaaggacctgggcaagtctctttccgtgcaaaatttgatacgctcgacggaagagcttaatattcaactgtctggcagcgagagtagtggcagccgaggctcccaggacttttatccaaaatggagggagagcaagctgttcatcactgacgaggaagtggggcctgaggagaccgagactgacactttcgacgcagctccacaacccgcacgggaagccgcatttgccagcgactccttgcggacagggcgatccagatccagccagagcatttgcaaagctggtgagagcacagacgcattatcactcccccatgtaaagcttaaatag

SEQ ID NO: 235737 - DNA, 2802 bp, Artificial Sequence
  Description of Artificial Sequence: Synthetic coding sequence
atgcctcgacaccacgccggaggtgaggagggtggggctgctggcctctgggtaaaatcaggggctgctgcggcagctgctggagggggacgactgggcagcggcatgaaggacgttgagtctggcagaggcagggtgctcctgaactctgctgcagctaggggcgacggccttctgctgctaggcacaagagccgcaactctcggtgggggagggggagggctaagggagtcacgccgaggcaagcaaggcgcaagaatgtccctgctgggtaagccattaagctacacctcaagccagtcatgccggcgaaacgtcaagtaccgacgagttcagaactatttgtataacgtactggagagacccaggggctgggccttcatctatcacgcattcgtgttcctgttggttttcggatgcctgattctgagcgtgttcagtacaatccccgagcataccaaactggctagcagctgtctcctgattcttgagtttgtgatgattgtcgtgttcggactggagtttatcatccgcatctggtctgctggctgttgctgcaggtatcgagggtggcaagggagattgcgatttgcaaggaaacccttttgtgtgatcgatactatagtgctcatcgcatccatcgcagtagtgtccgctaaaactcagggaaatattttcgccacttctgcgctccgctccttgagattccttcagatactacgcatggtcaggatggacaggcggggtggtacgtggaagttattagggtccgtcgtgtatgcccactccaaagaactgataacggcctggtacatcgggttcctagtgctcatcttttctagcttcctcgtttatcttgtcgaaaaggatgcaaataaagaattttccacctatgcggacgctctgtggtggggcacgattactctgacgacgattgggtatggtgataagacccctttgacatggcttggccgactcctcagcgccggatttgccctgcttggcatcagcttcttcgctctgcccgcagggatactcggatcaggcttcgcactgaaggtgcaggagcaacatcgccaaaaacactttgaaaagaggcgcaatcccgctgccaaccttatacagtgtgtgtggcgaagctacgccgcagacgaaaaaagtgtgagcatcgctacctggaagcctcacctgaaggcccttcatacatgtagtcctactaaacaaaaccagcagggcgaatcccagtcttgtcaaaagctctccttcaaagagcgggtgagaatggcatcccctcgaggacaatccattaagtctcgacaggcctctgttggtgataggagatctccaagtacagacatcacagctgaggggtcacctacgaaagtccagaagtcttggtccttcaacgatagaaccagatttcgccctagcttgcgacttaagtcttcacagcctaagcccgttattgacgccgacacagcactcggcacagatgacgtctatgacgagaaaggctgccagtgcgacgtctccgttgaggacttaacccctcccctgaagaccgtgatacgcgcaattcggattatgaagttccatgtcgccaaaagaaaatttaaggagacactgcggccatacgacgtgaaagacgtgattgagcagtactcagcgggtcaccttgacatgctatgtcggatcaaatccctacagacacgggtcgaccagatcctaggcaaaggccagattacctcagataaaaagtcaagagaaaagatcacggccgagcatgaaacaactgacgacctgagcatgcttggcagggtcgtgaaggttgagaaacaagtacaaagcatcgaatcaaagcttgattgtttactggatatatatcagcaggtcctccggaagggatcagcctccgccttagcgctggcatctttccagattccccctttcgagtgcgagcagacatctgattatcagtctccagtggactcaaaagacctgtcaggttcagcgcagaactccgggtgtctgtccaggtctacatctgctaacatctccaggggtcttcagttcattttgacacccaacgagttttctgcacagaccttttatgccctttctcctaccatgcattcccaagccactcaagttcctatttcccagagcgatggctcagctgttgctgcgaccaacactatcgcgaatcagattaacactgcccctaagccagcggctcccactaccctccaaattccacctcccctgcctgcgataaaacatctgccccgaccagaaacattacacccgaacccagcgggtttacaagagagcatcagtgacgtgaccacctgcctggtcgcttctaaggagaatgtgcaagtggcgcaatctaacctgacgaaggatcgcagcatgcgcaagtcatttgacatggggggtgagacactcttgagcgtttgtcctatggtgccgaaggacctcgggaaaagtttgagtgtgcagaatctgattaggtccactgaggaattgaacatccagctttccgggtccgagtctagcgggagccgcggttcacaggacttctacccaaagtggagggagtccaagcttttcatcacagatgaggaagtgggccctgaagagaccgaaaccgacacctttgacgccgcacctcaacctgcaagggaggcagcatttgcttccgattctttgcgaacaggcagatctcgcagctcgcaaagcatttgcaaagctggcgaatccactgacgccctgagtcttccccacgtcaagctgaagtag

SEQ ID NO: 235738 - DNA, 1284 bp, Artificial Sequence
  Description of Artificial Sequence: Synthetic coding sequence
atgccccgacatcatgcaggtggggaagaggggggagcagcgggactttgggtgaaatcgggcgcagccgcagcagctgccggaggaggtcggctcggaagcggaatgaaagatgtggagtctggaagaggacgagtgctcctcaatagcgccgctgccagaggagacggccttctccttctgggcactagggctgctaccctggggggaggcggaggagggctccgcgagagtcgccgtggcaagcagggggcacggatgtcgttgcttgggaagcctttaagctacacatctagccagtcttgtcgcagaaacgtaaagtatcgcagggttcaaaactacctctataatgtattagaacgtccaagaggctgggcctttatctatcatgctttcgtctttctgctggtctttggctgcctcatcctcagtgtgttcagtacaatcccagaacatacgaagcttgcatcatcctgtctgttaattctcgagtttgtaatgatcgtcgtgttcggcctggaattcataatcagaatttggagcgccggttgttgttgtaggtaccggggttggcagggtcgactgaggttcgccaggaagcctttctgcgttattgacacaatcgtcctgatagctagcattgctgtcgtctctgcaaagactcaggggaatatttttgctacttctgccctgcgtagcctacggtttctgcaaatcttgagaatggttagaatggacaggcgtggcggtacttggaaacttctaggcagtgtggtctatgcacattctaaggaactgataaccgcctggtatattggattcttagtactgatcttttcatcctttttggtgtacctggtagaaaaggatgcaaacaaagagttcagtacctacgccgacgctctttggtggggcaccatcactttaacaacaattgggtatggagataaaacccctctgacttggcttggccgactcttatctgccggattcgctttgctcggaatttctttctttgccttaccagcgggaatattagggtcaggctttgccctgaaggtgcaggagcagcatagacagaagcacttcgagaagcgtcgcaacccagctgccaacctgatccagtgtgtgtggaggtcatacgccgcagatgagaagtccgttagcatcgcaacatggaaacctcacctgaaagcgctccacacctgttcacccaccaagaaggaacagggcgaggcttcctctagattcgtgatttctcttctgcttcatgtgtgcctgtag

SEQ ID NO: 235739 - DNA, 2799 bp, Artificial Sequence
  Description of Artificial Sequence: Synthetic coding sequence
atgcctcgccaccacgccggaggagaggaagggggagcggcaggtctgtgggttaagtcaggggcagcagccgcagctgcagggggaggaaggttgggctccggcatgaaagatgttgagagcggcaggggaagggtcctacttaatagcgccgctgctaggggcgatgggttgctcctcctaggcactcgcgctgcaaccttagggggaggtggaggtggactacgggagtcaaggaggggcaaacaaggagccagaatgagcctcctagggaaaccgctgtcatacacctctagtcagtcttgtcgtcggaacgtaaagtatcgcagagtgcaaaattacctgtacaacgtcctggaaaggccacgcggttgggctttcatctaccacgccttcgtgttcctgttagtgtttggctgtctaatcctgagtgtcttttccactattcccgagcatacaaagctagcttcaagctgccttcttattcttgagttcgtgatgatcgtggtcttcgggttggagtttattatccgaatttggagtgccggttgttgttgtcgatacagaggttggcaggggagacttcgcttcgcccgaaagcccttttgtgttattgacaccatcgtcttgatcgcgtccatcgctgtggtctcagcaaagactcagggaaacatttttgccacttctgcacttcggtctctccgatttctgcagatcctccgcatggtaaggatggatcggagagggggaacctggaagctactgggctccgtcgtgtacgcccatagcaaggagctcattacagcttggtatattggattcctcgtgttgatcttttcatcattcctggtgtatcttgtcgaaaaggacgctaacaaggagttttccacttacgctgacgctctgtggtggggtaccatcactctaacaaccattggatacggcgacaagacccccctgacttggcttgggaggctgcttagcgctggctttgctctgctgggaatcagcttttttgccctgcccgcaggtattctcggcagtgggttcgctctcaaagtgcaagagcagcaccggcagaagcactttgagaagcgaagaaatccagctgccaacctgattcagtgtgtctggcggagctacgcagcggatgagaagagtgtttctatcgcaacctggaagccccacctaaaggcgctgcacacttgctcacccacaaagaaagaacagggtgaagcttcttcctcccagaagcttagttttaaagagcgagtccgaatggccagcccacgcggacagagcattaagtctcgccaggcctccgtaggcgataggcgctcacccagcactgatattactgccgaaggctctccaactaaagtacaaaagtcctggagcttcaacgaccgcactaggtttcggccttctttgcgcctcaagagttcacagcccaagcccgtcatcgacgccgacacggcgcttggtacagatgatgtgtacgacgagaagggttgccagtgcgacgtgagcgtggaggatctgactccacccctgaagacagtgatccgagctatcagaataatgaagttccacgtcgctaagagaaaatttaaggaaacactccggccttacgacgtgaaggacgttatagaacagtatagcgccggacacctcgacatgttgtgccgtataaagagcctccagacacgggtggaccagatcctgggcaagggtcaaattacctccgacaaaaagagcagggagaagattaccgctgaacatgagactaccgacgatctttccatgctaggacgggttgttaaagtggagaaacaagtgcagtctatcgaatcgaagcttgactgtcttctcgacatttaccagcaggtcctccggaaaggctccgctagcgctctggcccttgcctctttccagattccaccgttcgagtgcgagcagacctcagactaccagtcaccagtcgactcaaaggacctatcaggctcagcccaaaactccggttgtctctctagaagtaccagcgctaatatcagccggggactgcagttcatccttactcctaatgaattctctgctcaaaccttctacgccctgagtccgacaatgcatagccaggcgacccaggtgcctatctcacagagtgacgggtcagccgttgcggcaaccaatactattgctaatcagattaacacagcccctaagcctgcagctcctaccactcttcaaattcctcctccattgcccgcaatcaagcacctgcctaggcccgaaaccctgcatccaaaccccgctggcctgcaggaatccatctccgacgtcacgacttgcctggtggcttccaaggagaacgtccaggtcgcccaatcgaatctgaccaaagacagatccatgagaaagtcatttgatatgggtggcgagacattgctgagcgtctgcccgatggttcccaaggacctgggcaaaagtctgagtgtgcagaacctgatccggagtaccgaggaactcaacatccagttatccggctcggagtccagcggttctcggggttctcaggatttttaccccaagtggagagaaagtaagctgtttattacagacgaagaagtgggcccagaagagaccgaaactgatactttcgacgccgcaccgcagccggcacgcgaggcagccttcgcctcagactcattaagaactggccgtagcaggtcaagccaatcaatctgcaaggcaggcgagtctactgacgccctttccttgccccacgtgaagcttaaatag

SEQ ID NO: 235740 - DNA, 2829 bp, Artificial Sequence
  Description of Artificial Sequence: Synthetic coding sequence
atgcccagacaccatgctgggggagaggagggaggggcagccggactctgggtaaaatcgggcgctgccgctgccgcagcgggagggggtcgactcggttctggtatgaaggatgtggagtctgggagaggcagagtcctgcttaattcggccgcagctagaggagacggcttactgcttttaggcacccgtgccgctaccctcgggggaggcggaggcggtttgagagagagtcgtagaggaaaacagggggctaggatgtccctgctgggtaagcccttgtcttatacttctagtcaaagctgtcggcgaaacgtgaaatatcggcgtgtgcaaaactacttgtataatgtgttggaacggcctcgaggctgggcttttatataccacgcatttgtattcctgcttgttttcgggtgtctgatcctgtccgttttctcaactatcccggaacacaccaagctggcctcgagctgtttactcatccttgagttcgtgatgatcgtggtatttgggctggaatttattattagaatatggtcagctggttgttgttgccggtatagaggatggcaaggtaggctccgatttgccaggaagcctttctgcgttattgatacaattgtgctcatagctagcattgccgtcgtgtcagcgaaaacccagggcaatatttttgctacctctgccctgcgatcattgagatttctgcagatcctgaggatggtgcgcatggaccggaggggcggaacgtggaagctgctgggaagcgtcgtgtacgctcactctaaagagctgatcacggcgtggtatatcggattccttgtgctcattttttcctccttcctcgtctatcttgtggagaaagacgctaataaggagttcagcacatacgctgacgcactgtggtggggaaccatcaccctgacaaccattggttacggcgacaaaaccccccttacatggctgggccgtctgctgagtgcagggtttgcccttctgggcatcagcttcttcgcactgcccgcaggaatcctcgggagcgggttcgcccttaaggtgcaggaacaacaccggcagaaacattttgaaaaacggagaaatcctgcagcaaatctgattcaatgcgtgtggcgtagctacgctgccgacgagaaaagcgtatccattgccacatggaaaccacaccttaaagcgcttcacacctgcagtcctactaacaaattttgttccaataagcagaaactgtttcgcatgtacacctcacggaagcaatcccagaaactcagcttcaaggagcgtgtaaggatggcgtccccccgtggccagtcaatcaaatcaaggcaagccagcgtgggcgatcggaggtcaccttctaccgacatcaccgctgagggcagtccaacaaaggtgcagaagagctggtcgtttaatgacaggactagatttagaccctctcttcgtctcaagtcgtctcaaccaaagcctgtgattgacgctgacacagcattgggaacagacgatgtgtatgacgagaagggctgccaatgtgacgtttctgtcgaagatctcacgccacccctgaagactgtgattcgggctatacgcatcatgaagttccacgttgctaagagaaaatttaaagaaaccctgagaccgtacgacgtcaaagatgtcatcgaacagtattccgccggacatttggacatgctctgtcggatcaaaagcctgcagaccagagtggaccagattctagggaaaggtcagatcaccagtgataaaaagtccagggagaagatcacggctgagcatgagaccactgacgacctgagcatgttaggcagggtggtgaaagtggagaagcaagtgcagtccattgagtctaaactggactgcctgcttgatatctaccaacaggtgctgaggaagggcagtgctagcgcgttggcgttggcatcctttcaaatccctccttttgagtgtgagcagacatctgattaccaatctccagtggacagtaaagatttgtccggatctgcccagaactctggttgtctgtccaggagcaccagtgcaaatatttcaaggggtcttcaatttattttaactcctaacgagttttccgcccagacattctacgcactttctcctaccatgcactcacaggcaacacaagtgcccatttctcagtcagacggaagtgctgtcgctgcaactaatactattgcgaatcagatcaacaccgcaccaaagcccgcagcccctactaccctccagatccctccaccgctccccgctatcaagcacctgcccagacctgagacacttcacccgaatcccgctggattgcaggagtctatctcagatgtgaccacttgcttagtcgcctctaaagaaaacgtgcaggtagcacagtcaaatttgaccaaagaccggagcatgcgcaaatcttttgatatgggaggtgagaccctcctctcagtgtgtcccatggtcccaaaagatctcggtaaatccctatctgtacaaaacctgatcagatctacagaggaactgaacatccaactcagcggctccgagtcatcaggctcaaggggttcccaggacttctaccctaagtggagggaatctaagttgtttataaccgacgaagaggtgggccctgaggaaaccgagaccgacacatttgacgcagccccacaaccagcacgcgaggctgcattcgcctctgatagtcttaggacaggaagaagtagatcctcacagtccatctgtaaagccggagagtccactgatgccctgtctttgccccatgtgaaattaaagtag

SEQ ID NO: 235741 - DNA, 2772 bp, Artificial Sequence
  Description of Artificial Sequence: Synthetic coding sequence
atgcccagacaccacgcaggcggtgaggaaggcggagctgccggactctgggtgaaaagtggagcggctgccgctgcggctggcggaggtaggctgggatccggaatgaaagatgtggaaagcgggaggggtagagtattacttaactctgctgccgctagaggggacgggctgctcctgctaggcacgcgcgcagccacgcttggagggggaggtggtggcttacgggaatccaggcggggtaaacagggggcaagaatgtcactgctcggaaaaccactttcctatacttcttcccagagttgtagacgcaacgtaaagtaccgcagggtccaaaactacctgtacaacgtactggagagaccacggggatgggcgttcatctatcacgctttcgtttttctgctggtctttggatgcctgatcttgagcgttttctctacaattcctgaacatactaaactggcatcttcttgcctgctgatcctcgaatttgttatgattgttgtgttcggcttggagtttatcattcgtatctggagcgccggatgctgctgtagatatcggggttggcagggaaggctgagatttgcaaggaagcctttctgcgtgatcgacacaattgtgcttatcgcaagtattgcggtggtctcagctaagacacaggggaatatttttgcaacaagtgctctgcggtccctgcgctttctccaaattttgcggatggtgcggatggaccgccgagggggaacttggaagctgttaggaagcgtggtatatgcccattccaaggagcttattacggcctggtatattggttttcttgtgctaatctttagctccttcttggtttacctggttgagaaagatgccaacaaggaattctcaacttacgccgacgccctgtggtggggaactataaccctgactacaatcggatatggagacaagacacctctgacttggctcggcaggctattgtcggctgggttcgctctgctgggaataagtttctttgccttgcccgctggaatcctgggctctggctttgccctcaaggtgcaggagcagcacaggcagaagcatttcgaaaaacggcgaaaccccgcagctaacctaattcaatgtgtgtggcggagctacgccgctgacgagaaatctgtgtccattgccacttggaagcctcatctcaaagcactccacacatgttcgccaacaaaccaaaagttatcattcaaggagagggtgcgcatggccagccccagaggccagagcataaaaagcaggcaggctagcgtgggggacaggcggagcccttccaccgatataactgcggaagggtctcctactaaggtgcagaaatcatggagtttcaacgatcggactagatttaggccatccctgcgtctgaaaagcagccagccaaagcccgtcattgatgcggacactgcactgggcactgatgacgtgtatgatgagaaggggtgccagtgtgatgtttccgtggaagatctgactccgcctctaaagacagtgattcgtgctattcgcattatgaagttccatgttgccaagagaaagttcaaagaaacccttagaccgtatgatgtaaaggacgtcattgagcagtactccgccggacacctcgatatgctatgcaggatcaagagcctccagaccagagtggaccagattcttggaaagggacagataacaagcgataaaaaatctagggaaaaaatcacagccgagcatgagactacagacgatctgtctatgctgggccgagtggtgaaagtcgaaaaacaggtgcagtccatcgagagcaaactggattgtttgctggatatctatcagcaggtgttaaggaagggcagcgcaagtgcccttgcgcttgccagttttcagatccccccatttgaatgcgagcagacctcggactatcaatcacccgtagactccaaggatctgagcgggtctgcacaaaattccgggtgcctctctaggagcactagtgctaacatctctagaggactgcagttcatcctgacccccaatgagttctccgcacagacattctatgcattatctcctaccatgcactcccaagccacgcaggttccgattagtcagtccgacggctccgccgtcgcagctacaaataccattgcaaaccagattaacacggctcccaagcctgccgcacccacaacattgcagatccccccacctctgcctgccatcaaacatttgccacgcccagagactcttcaccccaatcccgcaggcttacaggaatctatctcagacgtcaccacctgtctcgttgcctccaaagagaatgtgcaggtggctcagagcaacctgaccaaggatcggagtatgcgtaagtcatttgacatgggaggggaaacgttactctcagtctgccccatggtccccaaggatctcggcaagtccctttccgttcaaaaccttattagatctaccgaggagctgaatatccagcttagtgggtcagagagctctggatctaggggctcccaggacttttaccctaaatggcgcgaaagcaaactcttcatcaccgatgaagaagtggggccagaagagacggaaaccgatacttttgacgccgcaccgcagcccgctagagaagccgctttcgcctcagacagcctccgcaccggaaggtcccggtcatcgcaatcgatttgcaaggcaggcgaaagcactgatgcgttatcattgccccatgtcaagttgaagtag

SEQ ID NO: 235742 - DNA, 2469 bp, Artificial Sequence
  Description of Artificial Sequence: Synthetic coding sequence
atgccaagacaccacgcgggtggggaggaagggggagcagccggactttgggttaagtcaggagccgctgccgcagctgccggaggaggacggttaggctccggtatgaaggatgtcgagtcgggtcgcggtcgggttcttctgaacagcgcagctgcaaggggggacggactgcttttactgggtacccgcgcagccacgcttggtggtggaggaggaggactccgagagtctcgccgaggcaagcagggggcaaggatgtccctgctgggcaaacctctgtcctatacatcaagtcaaagctgtagacgaaacgttaagtatagacgggtgcagaattacctctacaacgtactcgaacgccctagggggtgggcttttatctaccatgcattcgtgtttctgttggtgtttggttgcttaattctgagcgtgttttccaccatccccgaacacaccaagctcgcatcaagctgcttactgattctcgaatttgtcatgatcgtcgtcttcggactagagttcatcattaggatatggagcgccggatgttgctgccggtaccgtggctggcaggggaggttgcgctttgctcgcaagccgttctgcgtgattgatacaatagtcttaatagcctcgatcgccgtcgtgagtgctaagactcaagggaatatcttcgccacatcagcactgagaagtttgcgctttctgcaaatcctgagaatggtgaggatggaccggagagggggaacctggaagctcctcggctcagtggtttacgctcattctaaggagctgatcaccgcctggtatatcggatttctcgttctgatctttagtagttttctggtctaccttgttgagaaggacgctaacaaggaattctcaacctatgctgacgctctgtggtggggtacaattaccttgaccaccattgggtacggggacaagacgcctctcacttggctcggcagattactctcagcgggatttgcgctgctcggtatatcatttttcgccctcccagctggcatcttaggttctggcttcgccctcaaggtgcaagagcagcatcggcagaaacacttcgaaaagcggaggaacccagcggcaaatctcatacaatgtgtgtggagatcttacgccgcagatgagaagagtgttagcattgctacttggaaaccccacctgaaggcccttcatacctgcagtccaacaaagaaggaacaaggcgaagcctcatctcgtattatgaagtttcacgtagctaagaggaagttcaaagagaccctgaggccatatgacgtgaaggacgtgatcgagcagtatagtgctggacacttggacatgctgtgcagaatcaaaagtctgcagactagggtggaccagatccttggcaagggccaaatcacatcagataagaagtcacgcgagaagatcacagcagagcatgagacaaccgacgacctgtccatgttaggtagggttgtgaaagttgagaagcaggttcagtcgattgaatccaaactcgactgtctgttagatatctatcagcaggtgctaagaaagggcagcgctagcgctcttgcccttgccagtttccaaatacccccattcgagtgcgagcagacatccgattaccagagtcctgtggactctaaggacctgagcggctccgcacagaactccggatgcctatccaggagtacatccgcaaatatttcacgaggtctgcaattcatacttactcctaatgaatttagtgcccagaccttctatgcgctctcgcctacaatgcacagccaggccacacaggttccaatctcacaatcagatgggagcgccgtcgccgcaactaatacaatagcaaatcagattaacactgctccgaaaccggctgccccaaccaccctccaaattcctccacccctgcccgctattaaacatcttcctcggcctgagactctccaccctaaccctgccggtctccaggagtctatttccgatgtaactacttgtctagtcgccagtaaggagaacgtccaagtcgctcagagtaaccttacaaaagatcgtagcatgaggaagagttttgatatgggaggagagacgctgctcagtgtttgtccaatggttccaaaagatctcggaaaatcgctgagcgtgcagaacttgattcgatccaccgaggagttgaacattcagctatctgggagcgaatcatcgggttctcgcggttcccaagacttctatcccaagtggcgggagtctaagctgtttattacggatgaagaggtgggtccagaggagaccgaaaccgatacttttgatgccgcacctcagcctgcaagagaggcggctttcgcgtcggattctcttaggacagggaggtcgagaagctcccagagtatatgcaaggctggcgagtcaacggatgccttgagcctccctcatgtgaaactgaaatag

SEQ ID NO: 235743 - DNA, 2856 bp, Artificial Sequence
  Description of Artificial Sequence: Synthetic coding sequence
atgcctagacaccacgccggaggcgaagaaggtggggctgccggattatgggtgaagagcggcgctgccgctgccgctgcgggtggtggcaggctggggtcagggatgaaggacgtggagtcaggcaggggcagggtccttttgaacagcgccgcagcgagaggcgatgggctgctcctgctgggtactcgcgctgctaccctcggaggcggaggcggaggtctcagagagtcaaggcggggaaagcagggtgcacgcatgtcactgttgggcaaacccttgtcatacacaagttcccaaagctgccgaaggaacgtgaagtaccgaagagttcaaaattacctgtacaatgtgctggagcgacccagaggctgggcattcatctatcacgccttcgtgttcttacctgtgtttggatgcctgatcctttcggtattttctaccataccagaacatacgaagctcgcaagctcatgtctgctgattctggagtttgttatgattgttgtctttggactagaattcatcatacgaatctggtccgccggatgctgttgccgctacagaggatggcaaggccgactgcggtttgccaggaaacctttctgcgtgatagacaccattgttctgattgcatccatcgcagtggtaagcgccaagacccaggggaatatattcgccacatctgcacttcggtccttgaggttcctgcaaattttgcggatggtgagaatggatcgtagggggggaacctggaaactgctgggcagtgtggtgtacgcccacagcaaggaactcatcacggcctggtatattggatttctggtgctgatcttctcttccttcctagtctatctggttgaaaaggatgccaacaaggagttttctacctatgccgacgccttgtggtgggggaccattaccctaacaactatcgggtatggagacaaaactcccctcacctggctgggccgtcttttgtccgctgggtttgccctgcttgggatatccttttttgcattgcctgcaggtatactcggatccggctttgctctgaaggttcaagaacagcatcggcagaaacatttcgaaaaaagacgaaatccagctgccaacctgattcagtgcgtgtggcgatcctatgccgcagacgaaaagagtgtgtctatcgctacatggaagccgcatctaaaggcgttgcatacatgttcacccacaaaaaaagagcagggtgaagcctcaagctcaaaattctgttcaaacaagcagaaattgtttagaatgtatacgtcaaggaagcaatcgcaaaaactgtccttcaaggagcgtgtacggatggctagcccccgaggtcagtcaatcaaatcacgccaggcatcagtcggtgatcgaaggagcccctccacggatattactgccgagggctcaccgacaaaagtgcagaagtcctggtcatttaatgatagaactcgtttccgcccatctctaaggctgaaatccagtcagcccaagccggttattgacgcagacaccgcactgggcaccgatgacgtttacgatgaaaaaggttgtcagtgcgatgtcagcgtggaggatttgacccccccactgaagacagtgattagagctatacgcattatgaagtttcacgtggcgaaacggaaattcaaggaaaccctgagaccgtacgatgtcaaagatgtgatagagcaatatagcgccggacacttggacatgctctgtaggataaaatcactgcaaacgagagttgaccagatcctggggaagggccagatcacctctgacaaaaagtcccgcgaaaagatcacggcggagcacgaaactacagatgacctgtccatgctgggtagggttgtaaaggtagagaaacaggtacagtcaattgaatctaaactggactgccttctagatatttatcagcaggttctcaggaaggggtccgcaagcgcacttgcactggcatcattccagatccctccctttgaatgcgaacaaacgagcgattaccaaagtcccgtggattctaaggacctctccgggagcgcacagaattcaggctgtctttccagatctacctctgctaatataagccggggtctgcaatttattctaacccccaacgaattcagcgcacagactttctatgctctctctcccaccatgcattcccaggccactcaggtacctatttcgcagtctgatggctccgccgtcgctgcgacaaacaccatagccaaccagatcaatacagcgccaaagcccgctgcgccaactacgctccaaattccaccccctttgccagccattaaacatttgcctagacccgaaacactccaccctaatccggcaggcctccaagaatctattagcgacgtgaccacatgccttgttgcaagtaaggaaaacgttcaggttgcccagtccaatctgacaaaggacaggagcatgcgtaagtcatttgatatgggaggcgagacactgctctcagtgtgcccgatggtccccaaggacctgggtaagtccttgagtgtgcagaacctgatccgctccacagaagaactgaacatacagttgtcaggaagtgaatcctcaggttcaagagggagccaagacttctacccaaaatggagggaatctaagctctttattacagacgaggaagtcggtcccgaagaaactgagacagatacctttgacgccgctccacaaccagccagggaagctgctttcgcgagcgatagcctcaggacggggaggagcagaagctctcagagcatttgtaaggcaggtgaaagcaccgatgccttgtcactcccacacgtgaagcttaagtag

SEQ ID NO: 235744 - DNA, 2577 bp, Artificial Sequence
  Description of Artificial Sequence: Synthetic coding sequence
atgcctgccggaatgacaaaacacggaagccgatctacatctagcctacccccagagccaatggagatagtccgctcgaaagcttgctctagaagagtccgactgaatgtaggcggacttgcccacgaagtattgtggcgcaccttggaccgtctgccacgcacacgactggggaagctgagggattgcaatacacacgattcgttgttggaagtctgtgatgactacagccttgacgacaatgaatacttttttgaccgccatccaggagccttcacctctatacttaacttctacaggactgggaggctgcacatgatggaagagatgtgcgccttatcatttagccaggagttagactactggggtatcgacgagatttatctggagtcttgttgtcaggccaggtatcaccagaagaaggaacagatgaacgaggaacttaagagggaggctgaaactctccgcgagagggaaggcgaagagttcgacaacacctgttgcgccgagaaacgaaagaagctgtgggacctgctagagaagccaaatagctctgtcgcggctaagatactggcaatcattagtatcatgtttattgtgctgtccacaatcgcactgtcactaaacaccctacctgaattgcagagtcttgatgagtttggccagtctacagataatccccagcttgctcacgtggaggcagtctgtattgcctggttcaccatggaatacttgttacggttcctctccagcccaaagaaatggaagtttttcaaaggacctctaaatgccatcgatcttcttgctattcttccttactatgtgacaatttttttgacggagagcaacaaatcggtactgcaattccagaatgtcagaagggtggtgcagatcttcaggatcatgaggatcctgagaatcttgaaactggctcggcattctaccgggcttcaatcattggggtttacacttagacgcagctacaacgaactgggcctcttaatcctcttcttagccatggggatcatgattttttcaagtctggtatttttcgcagaaaaggatgaggatgataccaaattcaagtccatccctgctagcttctggtgggcgactataacaatgacaacagttggatacggggacatttatcctaagacgttgttgggcaaaatagtcggcggactgtgctgcattgccggagttctcgtgatagcgctgcctatccctatcatcgtcaacaatttttctgagttttacaaagaacagaagcgccaagaaaaggcgatcaaaagaagggaggccttggaacgcgcaaagcgtaacggctctatcgtgtccatgaacatgaaagatgcctttgcaagatcgatcgagatgatggacatcgtggtagagaagaatggggagaatatgggcaagaaggacaaggttcaagacaatcacctgtctccaaacaagtggaagtggacaaagcggaccctgtccgaaacttcaagctcaaagtcgtttgagaccaaagagcagggctctcccgagaaggccaggtcatctagtagcccccaacacctcaatgtgcagcagctggaggacatgtataacaagatggccaaaacccagagccagcccatcttaaacactaaggaaagcgctgcccagtctaagccaaaggaggagctcgaaatggagtccataccatctccagtggcccctctgcctacaagaaccgaaggggtgatcgacatgcgctccatgtctagcatcgactctttcattagctgcgcaactgattttcctgaagcaaccagattctcacatagccccctcacaagtttgccgtccaaaaccggaggctccactgctcctgaagttgggtggcggggagcactcggggcatctggcggacgattcgtggaggctaacccaagcccagatgcaagccagcacagttccttcttcattgaatctcctaagtcctctatgaagactaacaaccctcttaaattgcgagctctgaaggttaatttcatggagggggatcccagtccactgctgcctgtactcgggatgtaccacgacccattgagaaaccgcggttcagctgccgcagctgtcgccggattagagtgcgcgacactgctggataaagccgtcctcagtcctgaatcaagcatttacactaccgcgtcggccaaaactccccctagatccccagaaaaacacactgctattgccttcaacttcgaggcaggcgtccatcagtatattgatgctgacactgatgacgaaggtcagctgctttattccgtcgattctagtccacctaagtcacttcctgggtcaacgtcaccaaaattctccaccgggacccgctctgagaagaaccatttcgagtcatccccgcttccaacctcacccaaatttctgcggcagaattgcatttatagtacagaggccttgacgggtaagggcccatcaggccaggagaaatgcaaactggaaaaccatatctcccccgatgtcagagtcctgcccggaggtggggcacacgggtctacaagagaccaaagtatctag

SEQ ID NO: 235745 - DNA, 2442 bp, Artificial Sequence
  Description of Artificial Sequence: Synthetic coding sequence
agggatggcggagagaagacggccgtcactaggcttggcaagctccgcgactgtaatacccacgacagtctgctggaggtctgtgacgactacagtctggatgacaatgagtattttttcgatcggcatcccggtgcttttacaagcatactgaacttctacagaaccgggagactgcacatgatggaagagatgtgcgctctgtcattttcacaggaactcgactactggggaattgacgagatttacttagaatcatgctgtcaggcaagataccaccagaagaaggagcagatgaacgaggaactgaagagggaggccgagactctcagggaacgcgaaggagaagagttcgataatacgtgctgcgcagaaaaacgaaaaaagctttgggatctgctggaaaagcctaactccagcgtggctgccaagatactcgccattatatcaatcatgtttatcgttctgagcactatcgcactgagcctgaacaccctgccagagctgcagtccctagacgagtttggccagtctactgataatccccagctggctcacgtagaggctgtttgtatcgcctggtttacaatggagtacctgctgagattcctgtctagcccaaagaagtggaagttttttaagggaccattgaacgcgattgatctgctggcaattcttccctactacgtgacaattttcctcacggagagtaacaagagtgtcctacagtttcagaacgtgcgcagagtggttcaaatcttccgaattatgcggattttacggattcttaaactggcacgacacagtaccggtctgcagtcactggggtttactctgcgaagatcatataacgaattggggctgctaattctcttcctcgccatgggcattatgattttctcttccctcgtatttttcgcggagaaagacgaggatgacactaagttcaaaagcattcctgcctcattctggtgggccactattacgatgactaccgtaggctacggggacatataccctaaaaccctgctgggaaagattgtgggcggattgtgttgtattgccggtgtactggttatcgctctcccaatacctattatcgtcaacaattttagcgagttctacaaagagcagaagcgtcaagagaaggccataaaaagaagagaagcactcgagcgcgctaagagaaacgggtccatcgtgtctatgaatatgaaggatgccttcgcccgtagcatcgaaatgatggatatcgtggtagagaagaatggtgagaacatggggaaaaaggacaaagttcaggataaccacctttcaccaaataagtggaagtggactaagcggacgctttcagagacctcttcaagcaagagctttgagaccaaggagcaggggtcacctgaaaaggccaggtcctctagctctcctcaacatttgaatgtccagcagctggaggatatgtataacaagatggctaagacacaatcacagccgatcctgaataccaaggagtctgcggctcagtctaagcccaaagaggagcttgagatggagtcaataccatctcccgttgccccactgccaaccaggactgagggagtgatcgatatgaggtccatgtcaagcatagactcattcattagctgcgccaccgatttcccagaggcaactagatttagccactctcccctgacatctcttccctccaaaaccggcggatccaccgctcccgaggtgggatggagaggcgcactgggtgccagcggaggccgtttcgtggaggcgaatcccagccctgatgcgtctcagcactcatcattctttattgaaagccctaaatcatccatgaagacaaataacccactaaagctgcgggcactgaaggtgaactttatggaaggtgacccctcccctcttctgcccgtgctgggtatgtatcatgacccgttgcgtaaccgcggaagcgcagccgctgcagtggctggcttagaatgtgctacactcctagacaaggcggtcctgtcccccgaatcttccatctacaccacagcctcagctaagaccccaccgagatccccagaaaaacatacggctattgctttcaacttcgaagcaggtgtgcatcagtatatcgacgcagacactgacgacgagggacagctgttgtacagcgtggattcctcccctccaaaatccctgcccggttccaccagtcccaaattctctacaggaacccgctccgaaaagaaccattttgaatctagtcctctccccacgagcccaaagttcctcaggcagaattgcatatatagcaccgaagcgttaactggaaagggaccttcaggccaagagaaatgtaagctggagaatcacattagtcccgacgtaagagttctccccggaggcggagctcacggtagcacccgcgaccagtctatctag

SEQ ID NO: 235746 - DNA, 2736 bp, Artificial Sequence
  Description of Artificial Sequence: Synthetic coding sequence
atggctgaaaaggcgcctcccggactgaatcgcaagaccagtcggtctaccctgtcactccctccagagccagttgatatcatccggtccaagacctgttcgagacgggttaagatcaatgtggggggactcaatcacgaagtactgtggcgaacacttgatcgacttccacgaactaggctgggcaagctccgtgactgcaatacccatgagtcgctgcttgaagtatgtgatgattacaacctcaacgaaaacgagtatttctttgataggcatccaggggcatttacctctatcttgaacttttatcgaacagggaagctccatatgatggaggagatgtgcgccctgagcttcgggcaggagttagattactggggcatcgatgaaatctatctggagtcttgctgtcaagccagataccaccagaagaaggagcagatgaatgaggagctccgacgcgaagcagagaccatgcgggaaagagagggcgaagagttcgataatacttgctgtcctgacaaaaggaaaaaattgtgggatttactggagaagccgaactcttccgtggccgcaaaaattctggccatcgtctccatcctcttcatagtgctctccactattgctctctctctcaacacccttcctgaactgcaggagactgatgagttcgggcaactgaatgacaatcggcagctggcgcatgtggaggccgtctgtattgcttggttcactatggaatacttgctccggtttctttcctctccgaataaatggaagttttttaagggacccttaaacgttattgatctcttggccatactgccttactatgttaccatttttctgacagagagtaacaagtctgtgctgcagtttcagaatgtgagacgggtcgtgcagatcttccgcatcatgcggattcttcggatcctgaagctggccaggcacagtaccgggctacagagtctgggatttaccctcaggagaagctacaacgagctggggctcctcatcctattcttagcaatgggtatcatgatcttctctagtctagtgttcttcgcagaaaaggacgaggatgccacaaagtttacgtccatcccggcttcgttttggtgggccaccattaccatgacgaccgttggttatggtgacatttatcccaagacactgctgggcaagattgtagggggtctatgttgtattgccggagtcctcgtcattgccctcccaatccccattatcgttaataacttcagcgaattttacaaggagcagaagcgccaggaaaaggctattaaacgaagagaggcgttggagagagccaaaaggaacggatccattgtgtctatgaatttgaaagacgcgtttgccaggagtatggaattgatcgacgtcgcagtcgagaaagctggtgaaagcgcaaatactaaagactccgccgacgacaatcacctaagtcccagccgatggaaatgggcgagaaaggcactgtcagagacgagcagcaacaagtcgttcgagaacaaataccaagaagtgtcccagaaggattcccatgaacagctaaacaataccagctcttccagtccacagcacttgtccgcgcagaagttagagatgctctacaacgagattacgaagactcagcctcattcgcaccccaatcctgactgtcaggagaagcctgaaaggccttctgcttatgaggaagaaatcgagatggaagaagtggtgtgtcctcaggagcagcttgctgtagcacagacagaggtgatcgtggatatgaagtcaactagcagcatagacagctttacatcctgtgcaacggacttcaccgaaacagaacggagcccactgccaccaccaagcgcatcccatctgcagatgaaattcccaactgacctcccgggaaccgaagagcaccagcgggcaagggggccaccattcctcaccctgagtagggaaaaaggacctgccgcaagagatggcactttggaatacgctcctgttgacattacagtcaacctggacgcatcaggatcccagtgtggcctgcactccccgttgcaatccgataatgctacagatagtcccaagagcagtcttaaggggtcgaatcctctcaagtcccgttcactcaaagtgaattttaaagagaatcggggtagtgctccgcagactcctccctccaccgcacgaccactgcctgtgaccaccgctgatttctctttgaccaccccacagcatatctcaacaattctgcttgaagagaccccttcccagggagacagacctctgctcggcacagaggtatccgctccttgccagggtccatccaaaggtcttagcccaaggtttcctaaacagaaattgtttcctttcagtagtcgggagaggcggtcattcaccgaaatcgatactggagacgacgaggactttctcgaattgcccggagccagggaggagaaacaagtagacagcagcccaaattgctttgcagataaaccatcagatggaagggatcctctcagggaggaaggttcagtcggcagttccagcccgcaggacaccggacataactgtcggcaggacatataccacgcagtttcagaagtcaaaaaagactcctctcaagaaggctgtaaaatggagaatcaccttttcgctcccgaaatccattccaatccaggagacaccggctattgcccgacaagagagacctctatgtag

SEQ ID NO: 235747 - DNA, 1206 bp, Artificial Sequence
  Description of Artificial Sequence: Synthetic coding sequence
atgcaggtcagtattgcatgtactgaacataatctgaagtcacgaaacggggaagaccgcctgctgtccaagcaatccagcacagcgcctaatgtggtcaacgctgccagagctaaattccgtacagttgcaatcattgccagatctcttggaacattcacaccacagcatcatatatcgctcaaagagagtacagcaaagcagacaggcatgaagtatcgaaacctgggtaagtccggtctccgcgtttcctgtctcgggctaggcacttgggttacctttggcggtcaaatttcggatgaagtggcggaacgtcttatgaccatcgcgtacgagagcggggtgaatctctttgatacagccgaagtttatgcagctgggaaggctgaggtgatcctcggcagcattatcaaaaaaaaggggtggcggaggtcgtctctcgtcataaccacaaaactgtactggggtggcaaagcagaaaccgaacgtggcctgtcaaggaagcacatcatcgaaggcctcaaaggttctttgcaaaggcttcagctagaatatgtggacgtggtttttgctaacagaccggactctaatacaccgatggaggaaatcgtgagggccatgactcatgtcatcaaccaaggcatggcgatgtattgggggacaagcagatggagcgctatggaaatcatggaggcctactccgtcgccagacaattcaacatgatccctccagtttgtgaacaggctgagtatcacctttttcagcgagaaaaagtcgaggtacagctcccagaactttatcacaagatcggggtgggcgctatgacatggagcccgttggcgtgtggcatcataagcggcaagtatggaaacggagtgccagaatctagtcgggcatcgctgaagtgctaccagtggctgaaggaaagaattgtgtccgaggaaggcaggaaacaacaaaacaagctcaaagacttgtcccctatcgccgagcgacttggttgcaccctgccacagcttgcagtagcctggtgcttgcgcaacgaaggggtaagctccgttttgcttggtagttctactccagagcaactgatcgagaatttgggggctatccaagtcctcccaaaaatgacctctcacgtggtcaatgagatcgacaacatccttcgtaacaaaccttactcaaaaaaagactatcggtcttag

SEQ ID NO: 235748 - DNA, 1173 bp, Artificial Sequence
  Description of Artificial Sequence: Synthetic coding sequence
atgctggctgccagaaccggagccgctgggagccagatttcagaagaaaatacaaaactcaggaggcaatctggcttttccgtggcaggcaaagataaatcaccaaagaaagcaagtgaaaatgcaaaggacagctccctgagtccaagcggggaatcccaattaagggcccgacagttggctttgttaagagaggttgaaatgaactggtacctgaaactgtgcgacctgagtagcgagcacacaaccgtctgtacaactgggatgcctcaccgcaacctggggaagtctggactgagggtgagctgtctcggtctcggaacttgggtgaccttcgggggacaaattagcgacgaagtcgccgagagactgatgacaatcgcatatgagtccggcgtgaatctgtttgatacagccgaggtttatgctgctggaaaagctgaggtcatactaggatccataattaagaaaaagggctggaggcggtctagcctggtgattacgaccaagctttactgggggggaaaggccgaaacagagcgcggactgagcagaaaacacattatcgaggagattgtccgtgcgatgacacacgtcattaaccagggcatggcaatgtattggggtacatccagatggtccgcgatggaaattatggaagcctacagcgttgctcgccagttcaacatgatacctcccgtctgcgaacaggcggaataccatttattccaaagggaaaaggtagaggtgcagttgccggagttgtatcataagatcggggttggggctatgacctggagccctttagcttgtggcatcatctctgggaagtatggaaatggagtgccggagtcgtcccgggcatctcttaagtgttaccagtggctaaaagaaagaatcgtcagcgaagagggcaggaagcagcagaacaagctgaaggatttgagtccgattgcagagagattgggctgcactctgcctcagctggcggtcgcttggtgcctcaggaacgagggggtaagttctgtgctgctgggctctagtactcccgaacagctcattgaaaatctgggcgcaatccaggttctgcctaagatgacaagccatgtcgtgaatgaaattgataacatcttacggaacaaaccatactcaaagaaagattaccgcagctag

SEQ ID NO: 235749 - DNA, 1227 bp, Artificial Sequence
  Description of Artificial Sequence: Synthetic coding sequence
atgcacttgtacaagccggcatgtgcagacatccctagccctaagctggggctgcctaaatccagtgagtctgctctgaaatgccggtggcacctcgccgtcaccaagactcagcctcaggccgcttgtaaaccagtccggcctagcggagcagccgagcaaaaatacgttgagaagtttttacgtgtacacggcattagccttcaggagaccactcgggctgagaccgggatggcctaccgaaatcttgggaaaagcggactgcgggtttcatgtctgggactggggacatgggttacattcgggggtcagatcagcgacgaggtggcagagcgcctgatgaccatcgcttatgagtccggggtgaacctcttcgacaccgccgaggtatatgccgcagggaaagccgaagtgattctcggatccattatcaaaaaaaagggatggcggagaagctccctggtcattaccacaaaattatactggggaggtaaggctgaaacagaaaggggcctgtcacggaaacacatcatagagggactaaagggaagccttcagcgcttacagcttgagtatgtggatgtagtctttgcaaaccgccctgatagtaatacaccaatggaggagatcgtaagggctatgacacacgtcataaatcagggcatggccatgtactgggggacgtccagatggtccgcaatggaaattatggaggcttattcagttgctcgccagtttaacatgatccccccagtgtgcgaacaagcagagtaccatctgtttcagagagagaaagttgaggtccagctccctgaactgtaccacaaaattggcgtcggcgctatgacatggagcccattggcttgcgggattatcagcggtaaatacgggaacggagtccccgaaagctctcgagcatccctgaagtgctaccagtggttgaaggagcggatcgtcagcgaggaaggaaggaagcagcagaacaagctgaaggatctctctccaatagccgagcgtctaggctgcaccctaccccagctcgccgtggcttggtgtctgagaaacgaaggcgtgagtagcgtgctgctgggctcctctacacctgagcagctgatcgagaaccttggcgcaatccaagtgttgcctaaaatgacaagccatgtggttaacgaaattgacaacatccttcgaaataagccttactctaagaaagactataggtcttag

SEQ ID NO: 235750 - DNA, 1260 bp, Artificial Sequence
  Description of Artificial Sequence: Synthetic coding sequence
atgcttgcagccaggacaggcgcagctgggagtcagatttcagaggaaaatacaaagcttcgcaggcagtccgggttctctgttgcaggaaaggacaagagcccgaaaaaggcttccgagaatgccaaagactcatccctgtcgccaagtggtgagtcgcaactgcgcgctcggcaactggcacttcttagggaagtggagatgaattggtaccttaagctttgtgatctgtcttcggagcacaccacggtgtgcacaacaggaatgccccacagaaatctggggaaaagcggactgcgggtttcgtgtctgggtttgggcacatgggtgacgttcggcggacagatttccgatgaagtagcagaaagacttatgacaatcgcttacgagagcggagtgaatcttttcgacactgcagaagtatacgcagccggaaaagcggaggtcatactgggctctattattaagaaaaaggggtggcgccgaagttctctcgtgatcactaccaagttgtattgggggggtaaggcagagacggaacgcggtctaagcagaaaacacatcattgaaggtcttaaggggtcattgcaaagactacagctcgaatacgtggacgtggtgttcgccaatcgaccagactccaatacacctatggaagaaatcgtccgcgctatgacacacgtcatcaaccaggggatggctatgtattgggggacctcacgatggagcgccatggaaattatggaggcttatagcgtggcacgccagtttaacatgatcccccctgtttgcgaacaggccgagtatcaccttttccagagagagaaagtagaagttcagcttccagaattgtaccataagatcggagtcggagctatgacttggagtccgttggcgtgtggtatcattagcggaaagtacggcaatggcgtgccagaatcaagccgagccagtttgaaatgctaccagtggctaaaggagagaatcgtcagcgaggaaggtagaaagcagcagaacaagcttaaagatctcagtcctattgccgaaagactcggctgcaccctccctcagttagcagttgcctggtgtctcagaaacgagggggtgtcttcagtcctcctgggctcttccacgcctgagcagcttattgagaatttgggagccatccaggtcctcccaaagatgacatcacatgtggtcaatgaaatagacaacatcctcaggaataaaccatatagtaagaaagattacagatcctag

SEQ ID NO: 235751 - DNA, 1104 bp, Artificial Sequence
  Description of Artificial Sequence: Synthetic coding sequence
atgtatcctgaatccacaacaggatcccccgcaaggctgtctcttcgacagacaggaagtcccggtatgatctacagtaccagatatggatctcccaaacgtcagctgcagttttacaggaatctgggcaagtcaggcttgagggtcagttgcttaggcctgggaacatgggttaccttcggcggacagattaccgatgaaatggccgaacagctcatgactctggcatatgataacgggatcaacctcttcgataccgctgaagtgtatgcagcgggaaaggccgaagtggtattggggaatatcattaaaaagaagggctggagacgcagctctcttgtgatcacgactaagatattttggggaggcaaagctgagactgaaagggggctaagcagaaaacacatcatcgaaggtttgaaggcatctctcgaacgcctacagctcgagtatgtagacgtagtgtttgctaaccgtccagaccccaatacgcctatggaagagaccgtgcgagccatgactcatgtcatcaaccagggaatggccatgtactggggtacaagtcggtggtcatctatggagataatggaagcctactcagtggcacgccagtttaacctaactcctcctatatgcgagcaggccgaataccacatgttccaacgggaaaaggtggaagtccagctcccagagctgtttcataagattggtgtgggcgctatgacatggagccctctggcttgtggaattgtgtctgggaagtatgatagtggaattcccccttattcccgggcttcactaaaggggtaccagtggctgaaggataagatcttatccgaagaaggcagaagacaacaggccaaactcaaagagttacaggctatcgcagagaggctcggttgtactctgccccagctggcaattgcctggtgcctgcgcaatgaaggcgtctcttcggtgctcttgggcgctagtaacgcagatcaactgatggagaacataggtgccattcaggtcctgcccaagttaagcagtagtatcatccacgagattgactcaattctcggcaacaagccctactccaagaaagattatcgatcgtag

SEQ ID NO: 235752 - DNA, 1104 bp, Artificial Sequence
  Description of Artificial Sequence: Synthetic coding sequence
atgtaccccgagagtactacaggaagccccgcacgtttgagtcttaggcaaaccggctcaccaggtatgatctattctacgagatatgggagcccaaaacgccagttacagttctacagaaaccttgggaaatcaggcctccgggttagctgtctcggcctgggtacgtgggttacatttggagggcagattaccgatgagatggccgaacagctaatgactttggcatacgacaatggtattaatctttttgatactgctgaggtttatgcagccggaaaagctgaggtggtcctgggcaatattatcaagaaaaaggggtggcgacggagctctctggtcatcacaaccaagatcttttgggggggaaaggcggaaaccgaaaggggcctgtcccgcaagcacatcatcgaaggtcttaaggccagccttgaaaggttgcagctcgagtatgtagatgttgtttttgcaaatagaccggatccaaatacacctatggaggaaaccgtgcgcgcaatgacacacgtgataaaccaggggatggctatgtattggggaacatccagatggtcttcaatggagattatggaggcctatagcgtcgctagacagttcaacctaacacccccaatttgcgagcaggcagagtaccatatgttccaacgcgaaaaggtggaagtgcaactgccggagctcttccataaaatcggggtgggagcaatgacctggtcgcctctggcatgcggaatcgtgtcgggaaaatatgattcaggcatccctccgtactctagagcatctctcaaaggataccagtggctaaaagacaagatattatctgaggagggcaggagacagcaggcgaagctcaaggagttgcaagccatcgccgagagactgggctgtaccttgccacagctggccattgcatggtgtcttaggaatgagggtgtatcctcagtgttacttggagcttccaacgcagatcagctgatggagaatattggagcgatccaggtgctgcccaaactcagctcttcaataattcatgagatcgactccatcctgggcaataagccctattcgaaaaaggactaccgatcctag

SEQ ID NO: 235753 - DNA, 1062 bp, Artificial Sequence
  Description of Artificial Sequence: Synthetic coding sequence
atgtacccggaaagcactacaggaagccctgccagactgtcactgaggcagaccggttctcctggcatgatctatcgcaacctaggaaaatcaggtctgcgtgtgtcttgccttggcctgggcacatgggtgacctttggcggtcagatcactgacgagatggctgagcagctgatgaccctggcctacgacaatggaatcaatctgtttgatactgccgaggtgtatgccgcaggcaaagccgaagtggtgttgggtaacattatcaagaaaaagggctggcgcagatcctccctggtgatcactacaaaaatcttttggggcggaaaggccgaaactgagcgcggtctgtctcgaaaacatataattgaaggattaaaggcctcactcgagcgactccagctcgagtacgtagacgtagtttttgctaatcggccagatcctaatacccccatggaggagactgtcagagcaatgactcatgtcattaatcaaggcatggccatgtactggggtacctctcggtggtcttccatggagataatggaggcttactccgtcgcccgacagttcaatttgactccgcctatctgcgaacaggccgaatatcacatgttccaaagggaaaaagtcgaagtccagttgcccgagctgtttcacaaaataggagtgggggcaatgacctggtcacctttagcctgcgggattgtgagtggtaaatacgactctggtatacctccatactctagggctagcctgaaaggataccagtggctgaaagacaagatccttagcgaagaaggcagacgacagcaggccaaactgaaagaactgcaggcaatcgcagagaggctgggttgtaccctgccccagctcgctatagcctggtgcctgcggaacgagggtgtatcaagcgttctgctcggcgcatctaatgcggatcaactaatggagaacataggcgcaattcaagttttgcccaagctctcatcctccatcatccatgaaattgacagtattctcggaaataagccatactcaaagaaggattaccggtcatag

SEQ ID NO: 235754 - DNA, 1248 bp, Artificial Sequence
  Description of Artificial Sequence: Synthetic coding sequence
atgctttccatgacatattctgagagcctgcgatctgtgagttcaagatgtcattctgagtgggcactgcacccagtgcgtcagacagatacactggaattgcagcggctgcgtgaggtgcgagctgctgcccaagccaggaatatggaaagctttctgcgcatgcatggtttatcgctggacgggtgcaccgctcagaggacagggatgaagtatagaaatctgggcaagtccggactccgagtgagctgtcttggcctgggtacatgggtcacattcgggggtcagatcactgacgagatggcggaacaacttatgacgctggcctatgataacggaattaacttgttcgatactgccgaggtttatgccgcaggcaaggccgaggtggttctgggaaacataatcaagaagaagggctggaggagaagctccttagtgatcactaccaagattttttgggggggaaaggcggagactgagcggggtctgtctcgcaaacacattattgagggactgaaggcatctctggaacgtttacagttagaatacgtggacgtcgtgtttgcaaaccgtccagaccccaatacaccaatggagggggaccctttcagcagcagcaaaagccggacattcatcatcgaagagacggtgcgcgctatgacccacgtgatcaatcagggcatggctatgtattgggggaccagccggtggtcatccatggagattatggaagcctattcagtggccaggcaatttaacttaaccccacccatttgcgagcaagctgagtatcatatgttccaaagggagaaagtggaggtacagctgcccgagctcttccacaagatcggagttggcgcaatgacgtggagcccgctcgcttgcggcatagtgagcggcaaatatgacagcggaattcccccatattctcgggcatctttgaaaggatatcagtggctgaaagacaaaatcctatctgaggaggggcgtcgccagcaggcaaagttaaaagagctccaggctattgccgaacggcttgggtgcactcttccgcagctggccatagcgtggtgcctcaggaatgaaggtgtaagctcagtgctgctgggggcttccaatgccgatcagctcatggagaatatcggggctattcaggtgctgcccaagctctcaagttccatcattcacgagatagattccatcttaggcaataagccctattctaagaaggattaccgcagttag

SEQ ID NO: 235755 - DNA, 522 bp, Artificial Sequence
  Description of Artificial Sequence: Synthetic coding sequence
atgtatccggagagtaccactggcagccccgctcgcttgtccctccggcagaccggatcaccaggtatgatttattctaccagatacgggtcaccaaagcgtcagctgcagttttatcgaaatctggggaaatccgggttacgtgttagctgtctcggcctgggcacctgggtgaccttcggcggacaaattactgacgagatggccgagcagctgatgacacttgcctatgacaatgggatcaacctgttcgacaccgcagaagtgtatgcagctgggaaggcggaggtcgtactgggtaacatcattaagaaaaagggctggtcccagcaaggagagagagccggacaagccagagttacccccccttgtagtcttggaaggcgggctagggatgcatctaagagcgcgggagctggctgtcatctccaggcacaggcttgcgtgccaagttccacccaggccctgcaaaccacacgcggtagggcacccctgaaaccccctccacccctggcaagttag

SEQ ID NO: 235756 - DNA, 1062 bp, Artificial Sequence
  Description of Artificial Sequence: Synthetic coding sequence
atgtatcctgaatctacaacggggtcacctgcaaggctctctctgagacaaactggctcccccggaatgatctacagaaatcttggaaaaagcggcttgagagtgtcctgtctcggcctggggacctgggtgaccttcggagggcagataacggacgagatggccgaacaacttatgacccttgcctacgataacggcattaacctgttcgacacagcagaggtctacgccgcaggaaaagccgaggtggttctgggcaacatcatcaaaaaaaagggatggaggcggtccagccttgtgataacgacaaagattttctggggtggaaaagccgaaacagagcgaggattgtctagaaagcacatcatcgagggcctgaaggcgagcctggaaaggctacagcttgaatatgtggacgtagtttttgctaatcgcccagatccaaatactcccatggaggagactgtccgcgctatgacccacgtaattaaccagggcatggccatgtattggggcacctcccgttggtctagcatggaaattatggaggcctactcagtagcccgacaatttaacctgacacctcccatatgcgagcaagccgagtatcacatgttccagcgtgagaaagtggaggtccagcttcccgagttgtttcacaaaatcggtgtgggagccatgacttggtctcccctggcatgtggcatagtctctggaaaatacgactcgggcattccaccatactcacgcgcttcgctcaaaggctaccagtggttgaaagataaaatcctcagtgaagaaggtaggagacagcaggccaagctcaaagagctgcaggccatcgccgaaagattgggatgtaccctgccacagctggcgattgcgtggtgcctgaggaatgaaggagtcagcagtgtcctgcttggcgcatctaatgctgaccagctcatggagaatattggtgcaatacaagttctgcccaaactctccagcagcatcattcatgagatcgactccattttgggaaataaaccttactctaaaaaagattaccgcagttag

SEQ ID NO: 235757 - DNA, 1104 bp, Artificial Sequence
  Description of Artificial Sequence: Synthetic coding sequence
atgtaccccgagtcaacgaccggcagtcctgccaggctgtctcttagacagacagggagccccggaatgatatatagtacaaggtatggaagtcccaaaagacagctgcagttctatcgtaacctgggcaagtccggtctgagagtttcctgcctgggattagggacgtgggttacctttggcggacagataaccgatgaaatggctgagcagctcatgacactggcatatgataacggtattaacctattcgataccgccgaagtgtatgccgcaggtaaagcagaagtcgttctgggcaatatcataaagaaaaaggggtggcggcgatcgtcacttgttataaccacgaagattttttggggtggcaaggcagagacggaaagaggattaagtcgtaaacacatcatcgaggggctgaaggctagtcttgagaggctgcagttggaatatgtggacgtcgtgttcgccaacaggcctgatcctaataccccgatggaggagacagttcgagcaatgacccatgttataaaccagggcatggctatgtattggggtacttctcgttggagttccatggagatcatggaggcttactcagtcgccaggcagtttaatttgacccctcccatttgtgaacaggctgaatatcacatgtttcagagggaaaaggtggaggtgcagctgccagagctcttccacaaaatcggagtgggcgcaatgacttggagcccgcttgcctgtgggatcgtctctggaaagtacgacagcggaatccccccttacagtcgtgctagcctaaagggctatcagtggttaaaggataaaatcctctcagaggaggggagaaggcagcaggccaaacttaaagagctgcaggccattgctgagcgactgggctgcacattgccacaactggctattgcttggtgcttgcgcaacgagggcgtgtcctctgtcttactgggcgcttctaatgctgatcagctcatggaaaacattggagccatccaggtccttcctaagctatcctcctcgatcatccatgaaatcgactcaatcttaggtaataagccctatagtaagaaagattaccggtcatag

SEQ ID NO: 235758 - DNA, 522 bp, Artificial Sequence
  Description of Artificial Sequence: Synthetic coding sequence
atgtaccccgagtctacaacaggctctcccgctaggctttctctaagacagacaggatctcccggaatgatatacagtactaggtatggctcacccaagaggcagctacaattctacaggaatttagggaagagcggcctgcgcgtgtcttgcctcggcctcggtacttgggttacctttggaggccagataaccgatgagatggccgagcagctgatgacgctggcttacgataatggcataaatcttttcgacaccgcggaggtctatgctgccggtaaggctgaagtagtcttggggaatatcatcaagaagaaaggttggaggcagcggggagagcgagctggccaggccagagtgacgcccccttgttctctggggaggcgcgctagagacgcctcaaaatcagcaggggctggatgccacctccaagcgcaagcctgcgtgccttcatccacacaagccctccagacaaccagaggacgtgccccactgaaacctccaccgcctcttgcgtcttag

SEQ ID NO: 235759 - DNA, 762 bp, Artificial Sequence
  Description of Artificial Sequence: Synthetic coding sequence
atgtatccggagagtaccactggctcaccggcacgcctgagtctgcggcagacagggtcccctggtatgatctacagcacgaggtacggcagcccgaaacggcagctgcagttctacagaaacttaggcaaaagcggccttcgggtctcctgcctgggattggggacatgggtaacgttcggaggtcaaatcaccgatgaaatggccgagcaactgatgacccttgcatatgacaacgggataaatctctttgacaccgcagaggtgtacgcggctggcaaggccgaggtggtgctgggaaatatcatcaagaaaaaaggctggcgtcgatcaagtctcgtgatcacaacgaagatattctggggcggaaaggctgagacagaaagaggcttgtcccgtaagcacataatagaaggtctgaaggcctctctcgagagactgcagctggaatatgtggacgtggtttttgccaaccgtcctgaccccaacactcccatggaggaaactgtgcgggctatgacacatgttattaatcagggcatggccatgtactgggggaccagccggtggagctccatggaaattatggaggcctatagcgtcgcccgacagtttaatctgaccccccctatatgtgaacaagcggaataccacatgtttcagagagaaaaagtcgaggtgcagctaccagagctgttccacaaaataggggtcggtgccatgacgtggtcacctctcgcatgcggtattgttagtgggtag

SEQ ID NO: 235760 - DNA, 765 bp, Artificial Sequence
  Description of Artificial Sequence: Synthetic coding sequence
atgtaccccgagtcgactacggggagcccagccagattgagcctcagacagactggcagcccaggtatgatttacagaaatctgggaaaatcaggcctccgcgtgagctgtctcggactgggaacatgggtcacctttgggggacaaatcactgacgagatggccgagcagcttatgacactagcttacgacaacgggatcaatctcttcgacaccgcggaagtttacgccgctggtaaggcagaggttgtgctggggaacataataaagaagaaggggtggagaaggtctagcctggtgataactactaaaattttctggggtggcaaagctgagactgaacggggtttgtcacgaaagcacatcatagaagggttaaaggcatcactggaaagattacagctggaatacgtcgatgtggtcttcgcgaatcgaccagacccaaatacacccatggaggaaacagtaagggctatgactcacgtgatcaaccaaggtatggccatgtattggggtacttcaagatggtctagcatggagatcatggaggcctattctgtcgccagacaatttaaccttacccctcctatttgcgaacaggcagagtatcacatgttccagcgtgaaaaggtcgaggtccaactccccgagctctttcataagatcggcgtgggcgctatgacatggtcgcctctagcatgcggaatcgtgtctgggaaatatgattccggaatccctccttacagcagagccagcttaaaatag

SEQ ID NO: 235761 - DNA, 288 bp, Artificial Sequence
  Description of Artificial Sequence: Synthetic coding sequence
atgtacccagaatctactactggaagccccgcacgtctgagtttgcggcaaacggggtcacccggaatgatttacaggaacctcggaaaatccgggttgagggtttcctgcctcggactgggcacctgggtgacattcggaggtcagattacggacgagatggccgaacagcttatgactttggcctacgacaatgggattaacctattcgataccgctgaggtctacgccgcaggcaaggctgaagtggtgttgggaaacataatcaagaagaaaggttggcggtag

SEQ ID NO: 235762 - DNA, 159 bp, Artificial Sequence
  Description of Artificial Sequence: Synthetic coding sequence
atgtacccagagtccactaccgggagccccgctcgactgtcacttcgccaaactggctctcccggtatgatctactcaacaaggtatgggtctcctaaaagacagcttcagttttacaggaatctaggcaaaagtgggctccgcgtgagttgcctgtag

SEQ ID NO: 235763 - DNA, 903 bp, Artificial Sequence
  Description of Artificial Sequence: Synthetic coding sequence
atggccgaacagcttatgacactcgcatacgataacgggattaatttgtttgacaccgctgaagtgtacgccgcaggtaaggccgaggtcgtactgggaaatatcatcaagaaaaaggggtggcgcagatcttctctggtgattacaacaaaaatcttctggggcggtaaggccgagactgagaggggcctgtctaggaagcatatcattgaaggactgaaagcctccctcgagcggcttcagctcgagtacgttgatgtggtgttcgccaatcgcccagacccaaataccccaatggaggagaccgtccgggctatgacacacgtcataaaccagggaatggccatgtattgggggacctcgaggtggagctcgatggagattatggaggcctatagcgtggcccgacaattcaacctcactccgccaatatgcgaacaggccgagtatcatatgtttcaacgagagaaggtggaagtgcagctgcccgaactattccacaaaataggggtaggggctatgacttggtccccacttgcttgtgggatagtcagcggtaaatatgacagtgggattccaccctactctagagcatcactgaagggctaccagtggctgaaagataagatcttgtctgaggagggtcggaggcagcaggctaagttgaaagagctccaagcgatcgcagaaaggttgggatgcacgctgccccaattggcaatagcctggtgtctacggaatgaaggcgtgtcttcagtccttcttggagcatctaatgcagatcagctcatggagaacatcggtgccatacaggtgctacctaagctctcatccagtatcatccacgaaatcgactctatcctgggcaataaaccttatagcaagaaagattataggagctag

SEQ ID NO: 235764 - DNA, 1215 bp, Artificial Sequence
  Description of Artificial Sequence: Synthetic coding sequence
atgcaggtctcaatcgcatgcactgaacagaaccttagatctaggtccagtgaggaccgcctttgcggccctagaccgggacctggagggggaaacggtggtccagcaggaggcggtcacggaaatccacccggaggaggcggttcaggcccaaaggccagagcagcactggttccacgccctcccgcaccggctggagctttgagggagagtacaggtcggggtactggcatgaagtatcgtaacctgggtaagtctggtttacgggtgtcttgcctggggctgggtacctgggtgacattcggaagtcagatttctgatgaaactgccgaggatgtgctcactgtagcatatgagcatggagttaacctgtttgatactgccgaagtgtatgccgcaggcaaggcagaaaggactttagggaatatcctcaaaagcaagggatggagacggagttcttacgtcataacaactaaaattttttggggtggccaggccgaaaccgagcgaggactgtctaggaagcacatcatcgagggattgcgaggttctctggagcgattgcagcttggctacgtggatattgtatttgccaatcgcagcgatcctaactgccctatggaagaaattgtgcgggctatgacatatgtcataaaccaaggtctcgcactgtactggggcacgtctaggtggggtgcagccgagattatggaagcctattctatggccagacagttcaacctcatcccacctgtttgcgaacaggctgaacatcacctgttccaaagagagaaggtggagatgcagttgcctgagctgtatcataagataggtgtgggctctgtcacctggtaccccttagcttgtgggctgatcacttctaagtatgacggcagggtgcctgatacctgccgagcaagtattaaaggctatcaatggctgaaagacaaagttcagtcagaggacggcaagaagcagcaggcaaaggtgatggacctgctgcctgttgcacaccagctgggatgtacagtggctcagcttgcaatcgcctggtgtctgagatctgaaggggtctcttccgtgctccttggcgttagtagtgcggagcagctcatcgaacatcttggagctctgcaggtcctgagtcagcttactcctcagaccgtgatggagattgatggcctcttggggaataaaccacactctaagaagtag

SEQ ID NO: 235765 - DNA, 2562 bp, Artificial Sequence
  Description of Artificial Sequence: Synthetic coding sequence
atgagcgagaaagtggactggcttcagtcccaaaatggagtctgtaaagtcgatgtctactcacccggagacaaccaggcccaggactggaagatggatacatccaccgaccctgtccgggtgctgagctggctccgacgcgatttagaaaaatctaccgccgagttccaagacgtgcggttcaaaccaggagaatctttcgggggagagacttctaactccggcgatccccataaaggtttttctgtggattactacaatactaccaccaaagggacacctgagcggttgcattttgagatgacacacaaggagatcccctgccaaggtccacgagcacaacttggcaatggaagttctgtcgacgaagtgtctttctatgccaatcggcttactaatttagtaatcgcaatggctcggaaggagatcaatgagaagatcgatggatcagagaacaagtgtgtgtaccaaagtctgtatatgggaaacgaaccaacgcctacaaagtccctctcaaaaattgcaagcgaactggtgaatgagacagtcagtgcatgttcccgcaacgcagctccggacaaagctcccggaagcggagaccgtgtgagcggcagctcccagtcgccaccaaatttgaagtataaaagtacactgaaaatcaaggagtccacaaaggaaaggcaagggcctgatgacaagccaccaagcaagaagtcatttttctacaaggaagtattcgaatcccgcaatggagactacgcccgtgaaggagggaggttcttcccaagggagcggaaacgctttcggggacaggaacgacccgacgatttcactgcaagcgtgagcgaaggaatcatgacatacgccaattctgtggtgtcggatatgatggtgagcattatgaagactctgaaaattcaggtgaaagataccaccatcgctactattctgttgaaaaaggtcctgctgaaacatgccaaggaagttgtcagtgacctgatcgacagctttctgcgcaacctgcactccgtaacaggcacactgatgacggacacccaattcgtgtcagctgtcaagagaacagttttcagccatggatcccagaaggctacagacattatggatgccatgctgcgaaagctctataacgttatgttcgctaaaaaggttccagaacacgtgcggaaggcccaggataaagccgaaagttatagtctgatctcaatgaagggaatgggcgacccaaagaacagaaatgttaattttgccatgaagtcagagactaagctgcgggagaagatgtacagtgagccaaagtccgaggaggagacatgtgctaaaacgctgggagaacacataatcaaagaaggtctcacgctgtggcacaagacccaacagaaggagtgcaaaagcttgggttttcagcacgccgcatttgaagcgcctaatacgcagcgtaaacccgcttcggacatttcttttgagtatccggaagatatcggaaatctgtccctccctccttacccccctgagaagcctgagaatttcatgtacgattccgactcttgggctgaggatctgatcgtaagtgctctgttgctgatccagtatcacctggctcaagggggacgaagggacgccagatcctttgttgaggccgctgggacgacaaacttcccagctaatgaacctcctgttgcgccagacgagagttgtctcaaatccgcccctattgtgggagaccaggaacaagccgaaaagaaggatctgcgctctgtattctttaacttcatcaggaatttgctgagtgagacaattttcaaacgcgatcagagccccgagccaaaggtgcccgagcaacccgtcaaagaagaccggaagctctgcgagaggccattggcctctagccctccgcgtctttatgaagacgatgaaacaccaggtgccttaagtggactgaccaagatggcagtatctcagatagatggccatatgtcaggccagatggtggagcacctcatgaactccgtaatgaagctctgcgtaatcatcgcgaagtcctgcgatgcttccctggccgagctaggcgacgacaaaagtggcgatgcaagcagactgactagcgcattccccgatagcctatatgagtgtctgcccgcaaagggaaccggatccgcagaagccgtcttgcagaatgcctatcaggccatacacaacgagatgcgaggaacatccggtcaaccgcctgagggctgtgctgctccaaccgtgatcgtatccaatcacaatctgacagataccgtccagaataagcaattacaggccgttctgcagtgggtcgctgcttccgagcttaacgtacccattctctatttcgcaggtgacgatgaaggaattcaggagaagttgctccagctgagcgccgcagccgtggacaaaggttgctctgttggggaggtgctccaatctgttctgcgttatgaaaaggagaggcagcttaatgaagccgtgggtaacgtcacccccttgcagctgctcgactggctgatggtcaacctgtag

SEQ ID NO: 235766 - DNA, 1488 bp, Artificial Sequence
  Description of Artificial Sequence: Synthetic coding sequence
atgacagtaatgtcgggagaaaacgtggacgaagcctctgccgctccgggtcatccccaggacggaagttatcctagacaggcagaccatgatgaccatgagtgctgtgaaagagtcgttattaacatcagtggtctacgattcgaaacacagcttaagaccctggcacagttccccaataccctcctggggaacccgaagaaaaggatgagatatttcgatccacttaggaacgagtatttttttgaccgcaacaggccttcttttgatgccatcctctactattatcagagcggaggtcgcctcagacgtcccgtaaatgtgcctcttgacatgttctctgaagagatcaaattctacgagctcggagaggaagccatggagaagtttcgagaagatgaggggtttattaaagaagaggaacggccactcccagagaaggaatatcaacggcaagtctggctgctgttcgagtatcccgagtcaagcggacccgctagggtgatagccatagtgtccgtgatggtaatcctgattagcatcgtcattttttgcttagagaccctgcccgagctcaaggacgataaagacttcacgggcacagtccatcgcatcgacaacacaaccgtgatttataatagtaacatcttcaccgaccctttttttatcgtggaaaccctgtgtattatatggttctccttcgagttggtggttcggtttttcgcttgcccgtcaaaaactgacttttttaaaaatattatgaactttatcgacatcgttgcaataatcccttactttatcacgttgggaaccgaaatcgccgagcaggaaggaaaccagaagggcgagcaggcaacaagcctcgccattttacgcgtgattagacttgtgagagtattccgcatttttaagctgtcccgtcattccaagggccttcagattttgggacagacattgaaggcatcaatgcgggaattgggacttctcatcttttttcttttcataggcgtaattcttttctcctcagctgtgtacttcgccgaggcagaggaggccgaatcacatttctccagtatccctgatgcattctggtgggctgtggtttcaatgacgacggttggatacggtgacatgtatcccgtgactattgggggaaagatcgttggtagcctgtgcgcaatcgctggcgtcctgacgatcgccctgccagtgcctgtgatcgtgtcaaacttcaactacttctatcaccgcgagacagagggcgaggagcaagcacagcttttacatgtttccagcccaaatttagcaagcgatagtgacctgtcacgcagaagttcttcaacaatgtctaagagcgagtatatggagatagaggaagacatgaataatagcattgcccactacaggcaagtcaatatcagaaccgcgaattgcaccacagcgaatcagaactgtgtgaataagtccaaacttctgacagatgtgtag

SEQ ID NO: 235767 - DNA, 1536 bp, Artificial Sequence
  Description of Artificial Sequence: Synthetic coding sequence
atggacgtgtgtgggtggaaggagatggaggtggcactggttaacttcgacaattccgatgaaatacaagaggagccaggctacgcaactgattttgatagcacaagtcccaaaggccgtccaggcggatcaagctttagcaatggaaaaatacttatatccgaatctaccaaccacgaaacggctttctcaaaactaccgggtgactacgctgatcctcccggtcctgagcccgtagtcctcaatgaagggaaccagcgggtgatcattaatatcgccggactacggtttgagacacagctgcgcacactttcccagttccccgaaactctgctgggcgatcgcgagaagcgaatgcagttttttgacagtatgaggaatgagtatttttttgaccgaaacagaccatcctttgacgggattttatactattatcaatcgggaggcaaaattaggaggcctgccaacgtacccatcgacatcttcgcggatgaaatctcgttttacgagctgggaagtgaggccatggatcagttccgcgaggatgaaggtttcataaaggaccccgagacactgcttcctacgaatgacatccacaggcagttctggctgctgttcgaataccctgaatcttcctcagcagctcgggctgtggctgtcgtctctgtactcgttgtagtgatctcaatcacaatattctgtctggagacactgccagaattccgtgaggatcgagaactgaaggtagtgcgggatccaaacctgaacatgtccaaaactgttttatctcagactatgttcactgaccccttttttatggtcgaatctacttgtatagtttggttcacattcgaactggttctcagattcgtggtgtgcccgtcgaagacggacttttttagaaacatcatgaatattattgacataattagcataataccatactttgcaactctgatcaccgagctagtgcaggaaacggaaccttctgctcaacaaaatatgtctctggctatcctccgcatcatccgtctcgtgcgtgtcttccgtatctttaaactgagtagacactccaaaggactgcaaatcctgggccagacactgaaagcatctatgcgggagcttggtctgctgatcttcttcctgttcattggagtgattctcttctcctctgctgtgtattttgccgaggtggacgaacctgagagccatttcagcagcatcccagatgggttctggtgggcggttgtgacgatgaccacagtgggatacggtgatatgtgccctacgacccctgggggtaagattgtcgggaccctctgcgctattgcaggagttctcactatagcgcttccggtgcccgtgattgtctctaacttcaactacttctaccacagagagaccgaaaatgaagagaaacagaacatccccggagagattgaaagaatattaaactccgtcggctcacggatgggatcgaccgattctctcaataagacgaacggaggatgctcaaccgaaaaatcacggaaatag

SEQ ID NO: 235768 - DNA, 1728 bp, Artificial Sequence
  Description of Artificial Sequence: Synthetic coding sequence
atggacgagcgcctcagtctgctgcgctccccccctcctccctcagccaggcaccgcgcacacccaccccaacgacccgcatcttcgggtggagctcacaccctggtgaatcacggttacgctgagcccgcagccggacgggaattaccgccagacatgacagtggttcctggggaccatttgctagagccagaggtggcagacggcggaggagctccccctcaggggggttgtggcggaggtgggtgcgaccgttacgagcccctgcccccttccctgcccgctgcgggagaacaagactgctgcggtgagcgcgtggtaatcaacatcagcggcctgaggttcgaaactcagttgaagacactttgccagttcccagagacacttctcggagatccaaaaagaagaatgcgttacttcgacccactgcgcaacgagtatttttttgatcgtaatcgaccttctttcgatgctatactgtactactaccaatccggaggacgaatcagacggccagtgaacgtcccaatcgacatattctccgaagaaattaggttttaccagttgggagaggaggctatggagaaatttcgggaggacgaggggttcctcagagaggaagaacgtcctctgccccgtcgagatttccagagacaggtgtggctcctcttcgagtaccctgaatccagtggacccgctagaggcatcgccattgtgtctgtgctcgtcattctgatttctattgtgatattttgtctggagacactgcccgagtttcgtgacgagaaagattatccagctagtacctctcaagattcatttgaggccgcaggtaatagcacttcgggtagccgggcaggggctagctcctttagcgatccttttttcgtcgttgaaacactgtgcatcatctggttcagctttgagctgctggtcaggttcttcgcctgcccttcgaaggccacctttagccgaaacattatgaatctcatcgatattgtggctatcatcccttactttatcacgttaggtacagagttggcagagagacaggggaacggccagcaggcaatgtctctcgccattttgagagtaatcagattggtgagagtgtttagaatatttaagttgtctcggcacagcaaaggattacagattctgggccagactctgaaagctagcatgagagagctcggccttttaatctttttcctgtttataggagttatcctgttctcaagtgccgtgtactttgctgaagccgacgacccaacaagcgggttttcttccattcccgacgccttctggtgggctgttgtcacgatgacaactgtcggttacggggacatgcaccctgttactatcggcggtaagattgtcggctctttgtgcgctattgctggggttcttacaatagctctacctgtgcccgtgatagtgagtaattttaactacttttatcaccgcgaaacggagggggaagagcaaagccagtacatgcacgtgggttcatgtcaacatctaagttcatcagccgaggagctgcgtaaggctcgctcaaatagcacccttagcaagagcgaatatatggtgatcgaagaaggaggcatgaatcattccgccttcccacagacaccatttaagaccggaaatagcactgccacttgcaccactaacaataatccaaacagttgcgttaacattaagaagattttcacggacgtgtag

SEQ ID NO: 235769 - DNA, 1962 bp, Artificial Sequence
  Description of Artificial Sequence: Synthetic coding sequence
atggaggttgccatggtgagtgcagagagctctggctgcaatagccatatgccatatggctacgcagcacaagcccgtgccagggagagggaacgactggcccattcacgagctgccgcagctgcagccgtggcagcagctacagccgcagtggagggatcaggaggatccggagggggttcccatcaccatcatcagtcaagaggcgcatgcacatcacatgacccacagagtagtagaggctcacgcagacgacggagacagaggagcgagaaaaagaaagcgcactaccgccagagttcgttccctcattgtagcgacctgatgccatcaggaagtgaagagaagatcctccgcgaattgagcgaagaagaagaggatgaggaggaggaggaggaagaggaggaagaaggtcgattctattatagcgaagatgaccacggtgatgaatgctcttatactgatctcctgcctcaggacgaaggcggaggcggatactcttctgtgagatattccgattgttgcgagagagtggttatcaacgttagtggactaaggttcgagacacagatgaaaacgcttgcacagttcccagagactctccttggtgatccagaaaagagaacccaatatttcgatccactgaggaatgagtatttcttcgatagaaatcgcccatccttcgacgccattttgtactattaccaatctggaggtcggctgaaaagacctgtaaacgtacccttcgatatttttaccgaagaggtcaagttctaccagttgggagaggaagcccttctcaagttccgagaggatgagggctttgttagggaagaagaagacagggccctaccagagaatgagtttaaaaagcagatatggctcttgttcgaatatcctgaatcttcctcacccgctagaggtatcgcaatcgtgtcagtgctggtcattctcatttctatagtgatcttctgtttggagactcttcccgagttcagagatgaccgggatctggtgatggctctcagtgcaggtgggcacggtggactgctcaacgatacctcggctccccacctggaaaatagcggacacactatcttcaacgatcctttctttatcgttgagacagtgtgtatcgtatggttcagctttgagtttgtcgtcagatgtttcgcatgtccttcccaagcactgttcttcaaaaacattatgaacatcattgacatcgtgtccatcctgccttatttcatcaccctgggcacggatctggcccagcaacaggggggaggaaatggccagcagcagcaggcgatgagcttcgctattctgaggattattaggttggtacgcgttttcagaattttcaaactgtctcggcatagcaaaggattacagattctcgggcataccttgcgtgccagtatgcgcgagctggggctgctcatcttttttttgtttataggagtcatcctgttcagcagcgcagtctatttcgccgaggctgatgaacctacaacgcacttccagagcatacccgacgccttttggtgggctgtcgtcaccatgaccactgtgggatacggcgatatgaaaccaatcacggtcgggggaaagatcgtaggcagcctgtgtgcgattgctggagtactgactatcgccttgcccgtgccagttattgtgagcaactttaactatttttatcatagggagaccgagaacgaagaacaaacgcaactcacccagaatgcggtctcctgtccgtatctgccttccaacctgttaaagaagtttagatcttctacttctagctctttgggcgacaaaagcgagtatctggagatggaggaaggtgttaaagagtctctgtgtgccaaagaggagaagtgtcaaggcaaaggggatgatagcgaaaccgacaagaacaactgttccaatgcaaaagcggtggaaacagatgtctag

SEQ ID NO: 235770 - DNA, 1842 bp, Artificial Sequence
  Description of Artificial Sequence: Synthetic coding sequence
atggaaatagcacttgtcccattggaaaacggaggagctatgaccgtgaggggcggtgacgaggctagggcaggctgtggacaagctactggcggagagcttcagtgtccaccaacagctggactctccgatgggccaaaagagcccgctccaaagggaaggggcgctcagcgcgatgcagattctggagtgaggccactcccgccactgccagatcctggggtccgaccattacctcccttgccagaagagttaccaaggcccagaaggcccccaccagaggatgaggaggaggagggggacccaggcctaggtaccgtcgaagatcaggccctgggtacggccagtttacatcatcaaagagtccatatcaacattagcggcttgagatttgagacccaactgggcacattggcccagtttcccaacacactcctgggagatcccgcaaagcggctaaggtatttcgatcctctgagaaacgagtactttttcgacaggaaccgcccttcatttgatgggatactgtactactaccaatcaggcggtagattgcgcaggccagtgaacgtgagcctggatgtgtttgcagatgagatccggttctatcagctgggggatgaggcgatggaacggtttcgagaggacgaaggcttcattaaagaagaggaaaaaccgttacctcgaaatgaattccagagacaggtatggttgattttcgagtacccagagagttccgggagtgccagagctatcgcgattgtctcagtgctggtaattctgatctcaatcataactttttgtttggagaccctgccagagttcagagacgaaagggagctccttcgccacccccctgcaccccatcagccccctgctccagctccaggcgctaacggcagcggtgtgatggcaccgcctagtgggccaacagttgccccactcctgcccagaactttggccgacccttttttcattgtcgaaactacctgcgtcatttggtttacctttgagctgctggtgaggtttttcgcctgcccatctaaggccggattctctaggaacatcatgaacattatcgatgttgtagctattttcccatattttatcaccctcggaacagagctggccgagcagcagcccggtggaggaggtggcggtcagaacgggcagcaggctatgtccctagcgatccttagggtaattagacttgtacgcgtttttcgcatttttaaactctccaggcattccaaaggtctgcagattctggggaagaccttgcaggcttcaatgagagaactgggcctcctgattttctttctctttatcggtgttatcctgttcagctcggccgtatatttcgctgaggccgacaaccaggggacacactttagcagtatcccggacgctttttggtgggcggttgtgaccatgacgaccgtgggttacggagatatgaggccaattacagttggaggcaaaatcgtaggatcattgtgcgccattgctggggtattgactattgcactgccagtccctgtcatcgtctccaactttaactacttttaccatcgcgagaccgaccacgaggaaccggcagttcttaaggaagaacaaggaacgcagtctcaaggtcctggccttgacaggggtgtacagcgcaaagtctctgggagtaggggaagcttctgtaaggcaggcggaactctggagaatgctgattcagccaggaggggatcatgcccattggaaaaatgtaatgtaaaagccaagtccaatgttgacctccgacggtctctttatgctctgtgtctggacacgagtagagagacggatctgtag

SEQ ID NO: 235771 - DNA, 1557 bp, Artificial Sequence
  Description of Artificial Sequence: Synthetic coding sequence
atggcagcctctatggctcgcagactctggccgctcttgacaagacgcggtttccgacccaggggaggctgtatcagcaacgacagtccccgtcggtccttcaccactgagaaaaggaaccgcaacctcctgtacgaatacgcgcgtgagggctacagcgccctgccacagctggatattgagcgtttttgcgcctgccctgaagaagcagcccacgctcttgaattaagaaaaggggagctgcgcagcgcagacctccccgcaatcatctcgacttggcaggagctgcgacagctgcaggagcaaatccggtccttggaggaggaaaaagctgcggtgactgaggctgtgcgggcattactggccaaccaggacagcggagaggtgcagcaggacccgaaataccagggattgcgcgctcgcggacgggagattcgcaaggaattagtccatctctatccaagagaggcccaactggaagaacagttctatctccaggccctgaagctcccaaatcagactcatcctgatgtccccgttggcgatgagagccaggcccgagttttgcatatggtcggtgataagcccgtcttttcattccagccacgagggcacttggaaataggagagaagctggatattatccgtcaaaagcgcctgagccatgtctctggacaccgcagttattacttgcgcggtgccggtgccctgctgcaacacgggctagtgaacttcacctttaacaagctgctcagaagaggatttacaccgatgactgtcccagacctgctgcggggagctgtgttcgagggctgtgggatgaccccgaacgctaatccttcacagatctacaacatcgatcccgcaagattcaaagatcttaacctagcaggaaccgcagaagtggggctcgcagggtactttatggatcacacggtggcctttagggaccttcccgttcgaatggtgtgctcaagcacctgttaccgtgcagagaccaataccggccaagagccccgaggactatatcgcgtccatcactttactaaggttgagatgttcggagttactggcccaggcctcgaacagagttcacagttgctcgaggaatttctgagcctgcaaatggagattttgacggagttgggactccacttcagagtgctagacatgcccacccaggagctgggcttgcccgcatataggaaattcgatatcgaggcctggatgcctgggagaggtaggttcggcgaagtgacttcagcatcaaattgcaccgatttccagtccagaaggctgcatatcatgttccagacggaggcaggagagctgcagtttgcccacaccgtgaacgccaccgcatgtgccgtgcccaggctgctcatagccctgctcgaaagtaaccagcaaaaggatgggtccgtgctggtccctcccgcactccaatcctatcttggaaccgaccggattacggctccgacgcacgtgccgctccagtacatcggcccaaatcaacccaggaagccaggcctgccaggacagccggcagtgtcctag

SEQ ID NO: 235772 - DNA, 1893 bp, Artificial Sequence
  Description of Artificial Sequence: Synthetic coding sequence
atggctgcaggagtcgccgcttggttaccctttgcaagggcggctgccatcgggtggatgcccgtggcctctggtcccatgccagcacccccacgacaggagagaaagagaacacaggatgcccttatcgtcctgaacgtcagtggaacacgtttccagacttggcaggacactcttgaacgctaccccgacactctcttggggtcaagtgagcgggactttttctatcaccccgaaacacaacaatatttctttgacagagaccccgacatattcagacatatcctgaacttctatcgaaccggaaaacttcattatcctcgccacgagtgtatcagtgcatacgatgaagagctggcctttttcggtctgatacctgagatcattggagactgttgctatgaggagtacaaggacagaaggcgggagaatgccgaacggttgcaagatgacgctgacaccgacaccgctggtgaatctgcgttacccaccatgaccgcccgtcagagggtctggagggcctttgagaacccacacacatctacgatggcgctcgtgttctactatgtcacaggtttttttatagcggtgagcgtgatcgccaacgtcgtggagaccgtgccctgcggctcctcccccggtcacatcaaagagcttccttgcggggagagatatgccgtagcctttttctgcctggataccgcttgcgtcatgatcttcaccgtcgaatacctgttacgtctagctgccgcaccttcccggtatcggttcgtgaggtccgtaatgagcataatagacgtcgtcgccatacttccttactacattggcctcgtaatgactgacaatgaggatgtgtccggggcttttgtgacactgagggtgtttcgggtatttcgcattttcaagttctctaggcatagccagggcctcaggatcttaggctataccctcaagagctgtgccagcgagttgggattccttttattcagcctgacaatggctatcattattttcgccaccgttatgttctacgccgaaaagggctcgtctgctagcaagtttacctcaattccagccgctttctggtataccattgtcactatgacaacactcggttatggcgacatggtgcccaagaccatcgccggaaaaatctttggctccatttgttccttgtccggggttctggttattgcactgccagtccctgtcattgtttccaatttctcacgtatataccaccaaaaccagagggctgataagcggcgtgcccaaaagaaggcgcgactggcccgaattcgtgcagccaagagcggctcagcgaacgcatatatgcagtctaagaggaacgggctcctttccaaccagctgcagtcaagtgaggacgaacaggctttcgtgagtaaaagtgggtcttcattcgagacccagcatcatcatctgctgcattgtctcgagaaaaccactaaccacgagtttgtggacgagcaggttttcgaggagagttgcatggaagtggcgacagttaatcgtccttcaagccactctccctctctctccagtcaacagggcgtcacaagtacttgctgcagccggcgacataaaaagacattcaggataccaaatgccaatgtgagcggaagccaccagggtagcatccaggagttatcaacaatccagatccggtgtgtagagaggaccccactgtccaacagtaggtcttctctaaacgcgaaaatggaggagtgcgtgaaactcaattgtgagcagccttatgtgactactgctatcatttctatccccacccctcccgtaactacccctgagggggatgacagacccgagtccccggagtactctggcggtaatattgtaagagtttcagctctctag

SEQ ID NO: 235773 - DNA, 1911 bp, Artificial Sequence
  Description of Artificial Sequence: Synthetic coding sequence
atggcagcaggggtcgctgcttggctcccgttcgcccgagccgcagcaatcggctggatgcctgttgcgaactgccctatgcccctggctcccgcagataaaaacaagagacaagacgagctcatcgtcctgaacgtgagcggcaggcgctttcagacttggaggacaaccctggagagatatcctgatactctgctcgggagtacagagaaagagttcttttttaatgaagataccaaggagtatttcttcgacagagaccccgaggtgttcaggtgcgtactaaacttttacaggacagggaaattacactacccaaggtacgagtgtatctccgcgtatgatgatgaactggccttttatgggattctaccagagatcattggggactgctgttacgaggagtataaagatcgcaagagagagaatgctgagcggctaatggatgacaacgacagcgagaacaaccaagagtcgatgccaagtctttcttttaggcagaccatgtggagagcatttgaaaatccccacacaagcactctggctttggttttttactacgtgaccggtttttttattgcagtgtctgtgatcacaaacgtcgttgaaacagtgccgtgtggaaccgtgcccggttcaaaagagcttccatgcggcgagaggtattctgtggcgttcttttgtctcgacacagcttgcgtgatgatctttacagtcgaatatctgctgaggctcttcgctgccccatcccggtatagattcatcaggtctgtgatgagcattatagatgtggtcgcgatcatgccttattacatcggactcgttatgaccaataacgaagacgtgtctggagcctttgtcacgctcagggtgttccgcgtttttcggatctttaagttttcccgccactcgcagggcctgaggatcctaggatacacgttaaaatcttgcgccagtgagctaggcttcctattgttcagtcttacgatggctatcattatctttgcaacagtgatgttctacgccgagaagggtagtagtgcatccaagttcacatccatccctgcctccttctggtatactatcgtgactatgacgaccctggggtacggggatatggtcccaaagacgatcgctggtaaaatctttggtagcatatgttcgctgtcaggagtccttgtgatcgcattgccagtgcctgtaatcgtctcaaacttttctcgaatttaccaccagaaccaacgggctgacaagcgcagggcacagaagaaagcccgactggcccgtattagggtcgctaaaaccggctctagcaacgcctatctgcatagcaaaaggaacggtctgttgaacgaggcgctggagctgacagggacacccgaagaggaacatatggggaaaaccaccagcctcattgaatcccagcaccaccatttgcttcattgcctggagaagaccactaaccacgagtttatcgacgaacaaatgtttgaacaaaactgcatggaaagttccatgcaaaattatccaagtacccggtccccttcactgtcttcccacccagggcttaccaccacttgctgcagccgtcggtcaaaaaaaacaacccacctgccaaacagtaatctgcctgctaccagactgagatccatgcaggagctttcaactatccacatccagggaagtgaacagccttcgctgaccacctcgcgcagcagtctgaacctgaaggccgacgacggactcagacctaattgtaaaacctctcagatcaccactgcaattatcagcataccaactccccctgcacttacccccgagggagagagtcgtcctccacccgcttcacccggaccaaacaccaacattccttctatagcatcgaacgtcgttaaggtctcagccctgtag

SEQ ID NO: 235774 - DNA, 1968 bp, Artificial Sequence
  Description of Artificial Sequence: Synthetic coding sequence
atggcggctggcgtggctgcctggctccccttcgccagagccgcagcgatagggtggatgcccgtggctaactgcccgatgcctctcgctccagcggacaagaacaaacggcaggacgaactcatagtgctgaatgtctcaggaagaagatttcagacctggcgcaccaccctggagagatatcccgatacattgctcggatcgacagagaaggagttcttttttaatgaggatactaaagaatacttcttcgaccgtgaccccgaagtattccgctgcgtgctgaacttctacaggacgggcaaacttcactatcccagatatgaatgcattagtgcctacgatgacgagctcgccttctacggaattttgccggagattataggagattgctgttacgaagaatataaagacaggaagcgagagaatgccgagcggctcatggacgataatgatagcgaaaacaaccaagagtcaatgccaagcctatccttccggcaaactatgtggcgcgcatttgaaaatccccacactagcacccttgctctcgtgttttattatgtcaccgggttctttatcgcagtgagcgtgatcaccaacgtggtggaaaccgtgccgtgcggcacggtccccggtagcaaggagctcccttgcggggaacgttacagcgtggctttcttttgtctggacaccgcctgtgtcatgatcttcactgttgagtaccttctacgcctgttcgccgctccctcccgctatcggtttatccggagcgttatgtctatcattgacgtcgtggctataatgccatattacatcggcctagtcatgaccaacaatgaagatgtaagcggggcattcgtgacactgagagtattccgcgtctttagaatttttaagttcagccggcacagtcagggcttgaggattcttggatacaccttgaaatcatgtgcttccgaattaggattcttgttgttttcactgactatggccattattatatttgctaccgtgatgttttacgctgagaaaggctcctccgcctcaaaatttactagcatccccgctagcttctggtacaccatcgtgactatgactacactgggctatggggacatggtgccaaaaactatagctggtaagatctttggttcgatctgcagcttatcgggggtcctcgtgatcgccctgccagtgccggtgatcgtgtctaacttcagccgtatttatcatcagaatcagcgggctgacaagcggcgagctcaaaaaaaggctcgattggctcgtattagggttgccaaaactggctcttctaatgcttatctgcatagcaaacgaaacgggctattgaacgaggcactggaattgacggggactcctgaggaagagcacatggggaaaactacttcactaatagagagccagcatcaccatttgctacactgcctagagaagacgactgggttgagttacctcgtggatgaccccttattgtctgtacgaactagcactatcaagaaccatgagtttattgatgaacaaatgttcgaacaaaattgtatggaaagttccatgcagaattacccttccacgaggagtccctctctttccagccacccaggactgacgaccacgtgctgcagtcggcgaagtaagaaaacaacacacctacctaatagcaacctgcccgcaactcgtctccgcagcatgcaggaactgtcaaccattcacatccagggatctgaacaacctagtctaacaacaagccgcagcagtcttaacctcaaggccgacgacggactgcgcccaaattgtaagacgagccagattactactgccataataagtattcccactcctcccgcactgaccccggaaggagagtccaggccaccaccagccagccccggacccaacaccaacatcccttctatcgcgtccaacgtggtcaaggtatcagccctctag

SEQ ID NO: 235775 - DNA, 1911 bp, Artificial Sequence
  Description of Artificial Sequence: Synthetic coding sequence
atggctgccggagtcgcagcctggcttccatttgcacgggctgctgctatcgggtggatgccagtcgccaactgtccgatgccgctagctccagcggataaaaataaacgacaggacgaactgatcgtgttaaacgtctctggccgtcggtttcagacgtggaggacgacactggagagatatcccgatactctgctcggcagcactgaaaaggaatttttcttcaatgaggataccaaggaatacttttttgaccgcgaccccgaagtattccgctgtgtcctcaacttttaccggactggaaagctgcattatccgagatatgaatgtatcagcgcctacgacgatgaactagctttctacggaatcctgcctgagataataggggactgttgctatgaggaatataaagatagaaagcgggaaaacgcagagcgactgatggacgataatgatagcgagaataaccaggagagtatgcctagcttgagttttagacagaccatgtggcgcgcttttgaaaacccccatacatcaacccttgcactggtgttttattacgtaactgggttcttcattgccgtcagcgttatcaccaacgtcgtggaaacagttccatgcggaactgtgcccggttcgaaggaattaccatgcggagagcgctattcagtcgcgtttttttgcttagatacagcgtgtgttatgatcttcactgtggaatatctcctccggcttttcgctgctccctctagataccgatttattcggtccgttatgtccattatcgacgtagtggcgatcatgccttactatatcggactggtgatgacaaataatgaagacgtgagcggcgcttttgtcacacttcgggtgttccgcgtgttccgcatcttcaagtttagtcgtcacagccaggggctgagaatcctgggctacaccttaaagagctgtgcaagtgagttgggatttctgctcttcagtttaacaatggctataatcatctttgctacagtgatgttttacgccgagaaaggcagctcggcaagtaagttcacgtcaatccccgcatcattctggtacacgatcgtaacaatgaccactctgggatacggtgacatggtccctaaaacaatcgcagggaagatcttcggcagcatctgtagcttatcaggtgttttggtcatcgcgctcccagtgcccgtgattgtgagtaactttagccgcatctatcaccagaaccagcgagctgacaagagacgcgctcagaaaaaagccaggctggctaggatcagagtcgcaaaaaccggcagttcaaacgcctatctccattcaaagcggaacgggctgctgaacgaggcactggaactgactggcactccagaagaggaacacatgggcaaaactacgtcccttatagagtctcaacaccaccaccttctgcactgtctagagaaaacaacaaaccacgagttcatcgatgagcaaatgttcgaacagaactgcatggagagttccatgcagaactatcccagcacgcggtcaccctctttgagctcccaccctggtctgacaaccacatgctgtagtcgacgatcaaagaaaacaacccatctcccgaactcaaaccttcctgcaactcgtttgcggagtatgcaggagctcagtaccattcacattcaaggctcagagcagcccagtctgaccacatcccggtcttctcttaatcttaaagctgacgatggactgcgaccaaattgcaagacctcccaaatcacaactgcaatcatatctatacctaccccaccagcgttaactcctgaaggtgagtcccgacctcccccagctagtccgggaccgaacacaaacatcccttcaatagccagtaatgtcgtgaaggtaagcgcactgtag

SEQ ID NO: 235776 - DNA, 1758 bp, Artificial Sequence
  Description of Artificial Sequence: Synthetic coding sequence
atgggacagggtgatgagagtgagaggatcgtcatcaatgtgggcggtacaaggcaccagacttacaggtccaccctcaggaccctgcccggtaccaggctcgcctggttggcggagcccgacgctcactctcacttcgactacgacccgcgtgccgacgaattcttcttcgatcgccaccctggcgtgttcgcacacatcctaaactactaccgcaccggcaagttacattgccccgctgacgtgtgtggacccttatatgaggaggaactggcattttggggcatcgatgaaaccgatgtcgagccttgctgttggatgacctaccgtcagcaccgggacgctgaggaggccctcgactcatttggcggagctccactagataatagcgcagatgacgccgatgctgatgggcctggcgatagcggagatggggaggacgaactggaaatgacaaagcgcctggcattgagcgacagcccggacggtcgcccaggtggattttggagacgctggcagccgaggatctgggcattattcgaagatccttacagttcccgctacgcgcgatacgtagcgtttgccagtctgttctttatactggttagtatcactacattctgtttggagacccatgagagatttaacccaattgtgaacaaaaccgaaatcgagaatgtcagaaatggtacgcaggtccgctactatagagaggccgaaaccgaggcctttctgacatatattgagggtgtatgcgtcgtgtggttcacctttgaattcttgatgcgggtaattttctgtccgaacaaagtggaatttattaaaaattccctcaacattattgacttcgtggccattttgcccttctacttggaagtgggcttatccggtctttcctcaaaagccgcaaaggacgtactcggctttttacgcgttgtccggtttgtgcgcatactgcggatcttcaagctaacccgccacttcgtgggcttaagggttctcggtcataccctacgggcttccaccaacgaatttctgttgctgattatatttctcgcacttggagtgctgatcttcgccacaatgatttactacgccgaacgcattggcgcacaacccaacgatcccagcgcaagtgagcatacacatttcaagaacatcccaattggcttctggtgggcggtagtcactatgaccacgctcggctatggtgatatgtacccgcagacgtggtccgggatgcttgtaggggctttatgcgccctggctggcgtcctcacgattgccatgcccgtgccagtcatcgtcaacaattttggcatgtactacagcttggccatggccaagcagaaactaccgaaaaagaagaagaagcacatccctcgacctcctcagctggggtctcctaattattgcaagagtgttgtaaatagtccccatcactcaactcagagtgatacctgcccgttagcccaagaggaaattttggagataaaccgcgctgattcaaagctgaatggcgaggtcgcaaaggctgccttggccaacgaggattgtcctcatatcgatcaggccctgactcccgacgaaggtttaccttttacaagatctggcacgagagaacggtacgggccatgtttcttactctccactggcgagtacgcatgtcctcccggtgggggtatgagaaaagacctttgcaaggaatctccagttatcgctaagtacatgcccacagaggccgtccgcgttacgtag

SEQ ID NO: 235777 - DNA, 1536 bp, Artificial Sequence
  Description of Artificial Sequence: Synthetic coding sequence
atgggtcagggtgatgaaagcgaacgcatcgtgattaacgtaggtggaacaaggcatcagacgtatcgctccaccctcagaacgcttccagggacacgcctggcttggcttgccgaaccggatgcccattcccactttgattatgatcccagggccgacgaattcttctttgatcgccatccaggggttttcgcccacatcttgaactattaccggaccgggaagctgcactgtcctgccgacgtctgtggcccattgtatgaggaagaactagctttctggggtattgacgagacggatgtggaaccctgttgctggatgacctataggcagcacagagatgccgaggaggctctcgatagttttgggggagcacccctggataactcggcagacgacgccgacgctgacgggcctggggattctggggacggagaagatgagctcgaaatgactaagaggctggcactttcagacagtcccgatggccgacccggtggtttctggaggaggtggcaaccccgaatctgggccttgttcgaagatccctacagtagtcgttacgccaggtacgtggctttcgcctcactgtttttcattctggtctccattaccaccttctgcctcgagacccatgagcgcttcaatcctatcgtgaataaaacagaaattgaaaatgtgcggaatggtacccaggtccgatattacagagaagccgagacagaagcattcctgacctacattgaaggggtttgtgtggtgtggttcacttttgagtttttgatgagggtaattttttgcccaaacaaggtggagttcatcaaaaactcgctgaatattattgacttcgtagctatcttgccattttatttggaggttggattgagcggcctctccagtaaagctgcaaaggacgtgttgggcttcctaagagtggtgaggttcgttagaatcctgcgcatattcaagctcacaaggcattttgtgggactaagagtgctgggacataccctgcgagcctcaactaatgaattcctgctcctgatcatcttcctggcactgggggttctgatttttgcaaccatgatatactatgctgagcgcataggagcgcagcccaatgacccatctgcctccgaacacacccactttaaaaatatcccaatcggcttctggtgggcggtggtgacaatgaccactttaggctatggagatatgtatccccagacttggtcaggcatgttggtgggggctctgtgcgcccttgcgggtgtattgactattgcgatgccggtgccagtgatcgtcaataattttggcatgtattactcactggccatggccaaacagaaactccccaaaaagaaaaagaagcacatcccaaggccaccccaactgggctcccctaactactgtaagagcgtcgtaaatagccctcatcatagcacgcagagtgacacctgtcccctcgctcaagaggagatcctcgagatcaatcgggctgggagaaagccactgcgaggcatgagcatctag

SEQ ID NO: 235778 - DNA, 1842 bp, Artificial Sequence
  Description of Artificial Sequence: Synthetic coding sequence
atgggaaagattgaaaacaacgaaagggttattctaaacgtgggtggcacacgacacgaaacatacagatctacactgaaaactcttccgggaactcgacttgctctactggcctcttccgagcctcccggtgattgcctcaccaccgccggagacaaactacaaccctctccccctccactttctccccctccgcgtgctccccctctctctcccggaccaggaggctgtttcgagggaggagccggtaattgttctagtcgcggagggagagcatctgaccatccgggtggcggacgggaattcttctttgaccggcatccgggtgttttcgcgtacgtacttaactactatcggactggtaagctacactgtccagctgatgtctgtggccctctgttcgaggaggaactggccttctggggcattgacgaaacagacgtcgaaccctgctgttggatgacctatcgccagcaccgcgatgcagaggaggctctcgacattttcgagactccggatcttatcggaggcgacccaggcgacgatgaggaccttgcagcaaaacggttggggatagaggacgcagcgggtcttggcggtcctgatggcaaatccggcaggtggcgcagactgcaaccaagaatgtgggccctcttcgaagatccctatagcagccgtgcggctcgctttatcgctttcgcctctctgttcttcatccttgtgtccatcacaaccttttgtctggagacgcatgaggcattcaacattgtgaagaataaaactgagcctgtgatcaatggcactagtgtcgttctgcaatatgagatcgagactgatcccgctctcacctacgtagaaggtgtgtgtgtggtgtggtttaccttcgaattcttggtccgcattgtgttctcacccaataagcttgagttcatcaagaatctcctcaacatcattgatttcgtcgcgatcctgcctttctacctggaagttggtttgtctggcctttctagtaaggcggcaaaagacgttctgggattcctccgggttgtgcgattcgtacgtattctgcggatattcaagcttacccggcattttgtaggactgagagtcctgggacacactcttcgagcgtctacgaatgagttcttgctgttaattattttccttgccctcggcgtcctgattttcgcaactatgatttactacgccgagcgagttggtgcccagcctaacgacccctccgcttctgaacatactcagtttaagaatattcctatcggattctggtgggctgtagtgacgatgacaacgcttgggtacggtgatatgtatccccagacttggtccggtatgctggttggggctctgtgtgctctcgcaggcgtgttgaccatcgcaatgccggtacctgtgatcgtgaataacttcggtatgtattattccctggctatggccaagcaaaaactccccagaaagcgcaaaaagcacattcctcccgcaccacaggcctccagcccaaccttttgtaaaaccgaactgaacatggcctgtaatagtacccagtctgatacctgtctcggaaaggacaaccgcctgttggaacacaataggtccgtgctgagtggagatgactcaaccggtagcgagcccccattatcacctcctgagcgcttaccgatccgcagatcatccacacgggataagaataggagaggtgaaacttgttttttgcttacgacgggcgactacacttgcgcatccgacggcggaattcggaaagacaactgcaaggaagtcgtgatcactggctacacccaggccgaggcacgcagcctaacttag

SEQ ID NO: 235779 - DNA, 1890 bp, Artificial Sequence
  Description of Artificial Sequence: Synthetic coding sequence
atggggaaaatagagaataacgaaagggtgattttgaacgtgggcggtacaaggcatgagacatataggtccacccttaaaacactacccggaactaggctcgcattgctggccagctcagaacccccaggcgactgccttactacagctggcgataaactgcaaccatcccctccacccctgtcgccccctcctcgtgcccctccactgagtccagggccaggcggatgcttcgagggcggagccggtaactgctctagtagagggggtcgcgcatctgaccacccgggaggtggtcgggagttttttttcgaccggcatcccggagtgttcgcctacgtgctgaactactataggacaggtaagctccattgcccagcagacgtctgtggtcccctctttgaggaggagctcgccttctggggtatcgacgaaaccgacgtcgagccatgctgctggatgacctaccgccaacaccgcgatgccgaggaagcccttgatatcttcgagactcctgacctcataggcggagacccaggcgatgatgaagacttggctgctaaaaggctgggtatcgaggatgctgcaggtctgggagggccagatgggaaaagtgggagatggagaaggctgcaacctcgtatgtgggccctttttgaggatccatactctagcagagctgctaggtttatcgccttcgcctctttattctttatcctcgtgtccatcacaaccttttgcctcgagacgcacgaagcttttaacatagtaaagaataagacagagccagtcatcaatggcaccagcgtggtgttgcagtacgagatcgaaactgatccagccttgacttatgtcgaaggtgtctgcgtggtgtggtttaccttcgagtttttagtgcgcatcgtctttagtcccaacaaactggaattcatcaagaacctgctgaacattatcgatttcgtggccatcctgccattctatttggaagttggcctgtccggcctcagctcaaaggcagctaaagacgtgctgggtttcctgagggtggttcgattcgtgaggatccttaggattttcaagctcaccagacattttgtcggattgcgagtcctggggcataccttgcgcgcttccacaaatgaattcctcctcttgattatcttcctggccttgggcgttctcatcttcgccaccatgatctactacgcagaacgtgtcggcgcacagcccaacgatccctcagcctcggaacatacccagttcaagaatatccctatcgggttctggtgggccgtggtaacaatgaccaccttaggatacggcgatatgtacccacagacctggagcggcatgctggtgggcgctttatgtgccctagccggagttctaacaatcgctatgcccgttccagtgattgtgaacaacttcggaatgtactactctctggccatggccaagcagaagctgcctagaaaacggaagaaacacattccgcctgcacctcaggcgagttctccaactttctgtaagacagagctcaatatggcctgtaactccacccaatccgatacgtgtctggggaaggacaaccgccttctggagcacaacagatctgtactaagcggcgatgacagcaccggttccgaaccccctctctctccacctgaaaggctgccaatcaggcggtcctctacaagagataagaacaggaggggtgaaacatgcttcctgctgaccacaggcgattatacatgtgcctccgacggaggcatccgaaaggtgttatataggatctaccacgggctgctaaccgccgagaaaggtacagtcgagttctcacataccaaggactacactggtaatcggctcctgcttctaaatgttccatag

SEQ ID NO: 235780 - DNA, 1677 bp, Artificial Sequence
  Description of Artificial Sequence: Synthetic coding sequence
atgggcaagattgagaataacgagcgtgtgattttgaatgtcggcggaacaaggcacgaaacctatagatcgaccctgaaaacgctccctggtacgcgactggcactgcttgctagctcggagccacctggagattgcctgactactgccggagacaagctgcagccttctccccctcctttatctccgccaccccgagcacccccactgagtccgggacctggtggttgcttcgaggggggagctgggaattgtagctcgagaggtggccgagcttccgatcaccctggagggggaagagagtttttctttgacaggcatcccggtgttttcgcctacgtgctcaattactacaggactggtaagctccactgccccgcagatgtttgcggaccactgtttgaggaggagcttgcattttgggggatcgatgagaccgacgtggaaccttgttgttggatgacataccgccagcatcgggacgcagaagaggcacttgatatcttcgagacaccggatcttattggaggagacccgggagacgacgaggatttagctgcaaaaagactcggcatcgaggatgccgctgggctcggtggaccagacgggaagagcggtcgctggcgccgtctccagccgagaatgtgggccctgtttgaggacccatactcctccagagccgcaagatttatagctttcgcaagcctcttttttatcttagtgagcatcacaaccttctgtcttgagacccatgaagcctttaacattgtgaaaaataagacagagcctgttatcaacggcacttcagtggtgttacagtatgagatcgagacggatccagccctgacttatgtcgaaggcgtctgtgtggtttggtttactttcgaattcctcgtcaggatcgtcttttcacctaataagctggaattcatcaagaacctcttgaacattatagatttcgttgccattttacctttctacttggaggtgggcctgtccgggttatcatccaaagcagctaaagacgtgttggggttcttaagagtcgtccgattcgtgaggatcttaagaatttttaaactgacccgccactttgtggggctccgggtactcggccatacactcagagcctccaccaacgagtttctgttacttattatctttctggccctgggggtccttatcttcgcgacaatgatatactacgctgagcgcgtcggagctcaacccaacgatccatcagcttctgagcacacccagttcaagaacatcccaattggcttctggtgggccgtagtgacaatgacaaccctcggatatggggacatgtatcctcagacatggagcggtatgcttgtcggtgccctatgtgctctggccggagtgctgacgatcgctatgcccgttcccgtgattgtcaacaatttcgggatgtactactctctggcaatggcaaagcagaagttgcctaggaaaaggaagaaacacattccaccagcccctcaggcgtcctctcctaccttttgcaagaccgagcttaacatggcctgtaatagcacacagagcgatacctgtcttggaaaagataacaggcttctggagcataaccggagcgataactgcaaggaagtggtcattaccggctacactcaggcagaggcgcgatccttaacatag

SEQ ID NO: 235781 - DNA, 1842 bp, Artificial Sequence
  Description of Artificial Sequence: Synthetic coding sequence
atggggaaaatcgaaaataatgagagggtgatcctcaacgtggggggaacaaggcatgaaacataccggtcaacgttgaaaaccctcccaggcactcggcttgccctcctggcatcaagtgagcccccaggcgattgcctgaccacggcaggggacaaattgcaacccagcccgccaccactgtcccctccccctagagctccccctctatcccccggtcccggaggttgctttgagggaggggcagggaattgtagcagccgagggggtagagcttccgaccatccaggcggaggcagggaattcttctttgacaggcaccccggtgtttttgcctatgtgctaaattactacaggacaggtaaactgcactgtcctgctgatgtctgtggcccactctttgaagaggaactggcgttttggggaatcgatgaaactgatgttgagccgtgttgttggatgacatatcgccaacatcgcgacgccgaagaggctctcgacattttcgagacaccagaccttatcgggggagatccaggcgatgatgaggacttggccgctaaacgacttggaatcgaggatgcagcaggactgggtggccctgacggtaaaagcggacgatggcgcagactacaacccaggatgtgggccctctttgaagacccctattcctctcgggcagctaggtttattgccttcgcttccttgttctttattctggtttctatcacaacgttctgcttggaaacccacgaggcctttaacatcgttaaaaataagaccgaacccgtgattaacggcacctccgtggttctccagtacgagattgaaacggatcccgctcttacttacgtggagggggtttgtgttgtgtggtttacctttgaattcctggtgcggatcgtgtttagccctaataagcttgaatttataaaaaatctgctgaacatcatagacttcgtggccattctgcccttttacctggaagtaggcttgagcggcctgagctccaaagcagctaaagacgtcctggggttcttgagagtggtgcgatttgtgcgcattttaaggatttttaagctcacacgccactttgtgggactgcgggtgctggggcatacattgcgagctagtacaaatgaattcctcttacttattattttcttagcactcggagtgcttatatttgcgaccatgatatattacgcggaacgggtaggcgctcaacccaacgatccttcggcttccgaacacactcagtttaaaaatattcctataggtttttggtgggccgtggtcaccatgactacacttggatacggagatatgtacccgcagacctggagcggaatgctggttggggcattgtgtgcattggctggagtcctcaccattgccatgcctgtccctgtgatcgtgaataacttcgggatgtattattctctggctatggccaaacagaagctgccccgaaagcggaaaaaacacataccacctgcaccacaagcttcatctcccacgttttgcaaaactgaattgaatatggcctgcaacagcacacagagcgacacctgccttggcaaagataatcggcttctggaacacaaccgttcagtgttgtctggcgatgactctacaggctctgagcccccactgtctcctcctgagagactgcccataagaagatcctctacccgagataaaaaccgcaggggcgaaacttgcttcttgttaacaaccggagattacacatgcgcctcggatggaggaattcgaaaggacaactgtaaggaggtggtcatcacgggatacactcaggctgaagccaggagtctcacttag

SEQ ID NO: 235782 - DNA, 1917 bp, Artificial Sequence
  Description of Artificial Sequence: Synthetic coding sequence
atgggtaagatcgaaaacaacgaacgggtgatcttgaacgtcggagggacccggcacgagacatatcgctcaacacttaaaaccctgcctggtacacgcctggctctgctcgcttcttccgaacctcctggggattgcttgaccacagctggcgacaagctgcagccgagcccacctcctttgtccccaccccctagggcacccccactgagtcccggacctggtgggtgcttcgaagggggtgccggtaattgctcttctcgagggggaagggccagcgatcatcctggcggaggcagagagttctttttcgacaggcatccgggagtgtttgcctacgtgttgaattattatagaacagggaagctgcattgtcctgcggatgtttgtggtcccttgtttgaagaggagctggctttttggggtatcgatgaaaccgatgttgagccctgttgctggatgacttaccggcaacatcgggatgctgaagaagctttagatatcttcgagactcccgacctaattgggggtgaccctggagatgacgaagaccttgctgccaagcggctgggcatcgaggatgccgcagggctcggtggacctgacgggaagtctggccgatggagacgcttgcagccgagaatgtgggccctcttcgaagatccatactcctctagggccgctcgctttatcgccttcgcctcgctgttcttcatcctcgtctcaattacaaccttctgcctggagacccacgaggcctttaacattgtgaagaacaagactgaacctgtgatcaatgggaccagcgttgtgctacagtacgaaattgaaacagaccctgctctgacgtacgtggagggggtctgcgtcgtctggttcaccttcgaattcctggtgcgcatagtcttctccccgaataagctggagtttatcaagaatttgttaaacatcattgacttcgtggctatcttaccattctacctcgaagttggcttatccgggctgagcagtaaggccgctaaagatgttctcgggtttttacgcgtagtcaggtttgtcagaatcctcagaatcttcaaattaaccaggcatttcgtgggactgagggtgctcggacacacgctccgagcctccacaaacgaattccttctgcttatcatcttcctcgcattaggcgttctaatctttgccaccatgatctattacgcggagagggttggcgctcagccaaacgacccctccgcgagcgaacacactcagttcaaaaacattcctattggcttttggtgggctgtagtaaccatgactaccttgggatacggtgatatgtacccccaaacctggagcggtatgctggtcggcgctctatgcgctctcgcaggcgttctcacaatcgccatgccagtccctgttattgtgaacaacttcgggatgtattattctctagccatggccaagcagaaactacccagaaaacgcaagaagcatattccccctgctccacaggcttcttcacccaccttctgcaagactgagcttaatatggcttgtaattccacacaaagcgacacctgtctcggaaaagataatagattgcttgagcataataggtccgtgctttctggtgacgattcaactggcagcgagccaccactgtcaccgcctgagcgcttgcccattcggaggagcagcaccagggacaaaaatcgacggggtgagacttgtttcctgctcaccaccggagactacacatgcgcttctgacgggggaatacggaaagggtacgaaaagtcccggtcactgaacaatattgctgggctggccggaaacgccctcaggctgagccctgtcacgtcaccatataactcgccttgcccactgagaaggtctcggtcccctataccgtccatcctctag

SEQ ID NO: 235783 - DNA, 1890 bp, Artificial Sequence
  Description of Artificial Sequence: Synthetic coding sequence
atgggcaagattgagaacaatgagcgcgtaattttgaatgttgggggaaccagacacgagacgtacaggtctactctcaaaacactccctggaacacgtctggcgctgctcgcttcaagcgaaccaccaggcgattgcctcacgaccgccggtgataagctgcaaccaagtcctcctccattgtcaccgccacctagggctccacctctgagtcccggtcctggcggatgcttcgagggcggagctggaaattgtagttcccgcggaggccgtgcttctgaccatcccggtggcggaagagagtttttcttcgaccggcaccctggggtcttcgcatatgtcctgaactattatagaacgggaaagttgcattgcccagctgacgtgtgtggcccactgtttgaggaggagttggcgttctggggcatagacgaaaccgatgtggagccatgctgttggatgacctaccggcagcatcgcgatgcggaagaggccctagacattttcgaaacaccagaccttattgggggtgacccaggtgatgacgaagatctggccgctaaaagattaggcattgaggacgctgccggtctgggcggacccgacgggaagtctggcagatggagacgattacagccacgtatgtgggcactctttgaggacccctatagcagtcgtgccgctcggtttatcgctttcgcatccctgttttttatactggtgtccatcaccacattttgtcttgagactcacgaagccttcaacatcgtcaaaaataagacggaacccgtgatcaacggcaccagcgtggtgctccagtacgagattgaaacggatcccgcacttacatacgtcgagggcgtctgcgtcgtatggttcaccttcgagttcctggtacgtatagtcttcagtccaaataagctcgagttcatcaagaacttactcaacattatcgatttcgtggcaattctccctttctatctggaggtggggctctcgggcctctcctccaaagccgcaaaagatgttctggggttcctgcgggttgtgagattcgtgaggattctgagaatcttcaagctgacacggcacttcgtgggactccgggtcctgggccacacccttagagcttcaaccaatgagttcctattgcttattatcttccttgccctgggagtgttaatttttgctaccatgatatattatgcagaacgggtcggcgcacagcccaatgacccatcagcttctgaacatacacaattcaaaaatatacctattggattctggtgggcagtggtcacaatgaccacactcggttatggtgacatgtatccccagacttggtcagggatgttggtgggagccctgtgcgccctggccggagttcttaccattgccatgccggtcccagtgatcgtaaacaattttgggatgtactatagtctcgcgatggctaagcagaagctccctagaaagcgaaaaaaacatattcccccagccccacaggccagctcacctaccttctgcaagaccgaattgaacatggcttgtaactcaacacaatctgatacctgtctgggcaaggacaaccgcctgttggagcacaatcgctctgtcctcagtggtgatgacagcactggatccgaacccccactatcccccccagagcggctgcctatcaggaggtctagcactcgagacaaaaaccgaaggggcgaaacttgtttcctcctgaccacaggcgattacacttgtgcctcggacgggggtatcagaaaggtcctgtaccgcatataccacgggttgctgaccgcagaaaagggtacagtcgagtttagtcacactaaggattataccggcaacagactgctgctgctcaacgtaccctag

SEQ ID NO: 235784 - DNA, 2187 bp, Artificial Sequence
  Description of Artificial Sequence: Synthetic coding sequence
atgctcagcagtgtgtgcgtctccagctttcgagggcgtcagggggctagcaaacaacagcctgcgcctcctccacagcctcccgaaagccctccaccacctccccttccccctcaacagcaacagccggcacaaccaggccctgcagcctcaccggctggaccccctgcacccaggggtccaggagacaggcgggcagagccgtgtcccggactgcccgctgctgccatgggcagacacggcggaggaggaggtgatagtgggaagatcgtcatcaacgtgggcggtgtccgccatgagacctataggtccactctcagaaccctccccggtacaaggttggccggtctgacggagcctgaggcagcagccaggttcgattacgatccaggggcagatgagttcttttttgatcgccatcctggtgtgtttgcctacgtgctgaactactatcgcaccgggaagctacactgtcctgccgacgtctgtggcccactcttcgaagaggagctgggcttttgggggattgatgagacggatgtcgaagcctgctgctggatgacctatcgccaacacagagacgcagaagaggcgttggacagctttgaggcccctgatcctgccggagccgctaacgccgctaacgcggctggcgctcacgatggaggactcgatgacgaggctggagctggagggggagggcttgatggtgctgggggagaattaaagagactgtgtttccaggatgccggtggcggtgcagggggacctcctggtggagccggtggggcaggtggcacatggtggaggcgttggcagccacgagtctgggcactgttcgaagacccatactcctcacgtgcggcacgctacgtggcctttgccagcctgttcttcatcctaatctccatcaccaccttctgtcttgaaacccatgaggggttcatccacatctctaacaaaacagttacccaagcgtcgcccatccccggagctccccctgagaatataactaacgtggaggttgagaccgagcccttcctcacctacgtggagggcgtgtgcgtggtgtggttcactttcgagttcctcatgagaattactttttgtccagataaggtggagttcctgaagagcagtttaaacatcatcgactgcgtagcaatcctccccttctacctcgaggtggggctatctggactttcaagcaaggcggcaaaagatgtcctgggttttttaagggtcgtgagatttgtcaggattctgcgaatttttaagttgaccagacacttcgtgggcctgagggtccttggccatacgctccgagcctcaaccaacgagttcttgctgctcattatcttcctcgctctgggggttttgatcttcgctacaatgatctactatgcagaacgaataggagcagatcccgatgatattctgggctccaaccacacgtactttaagaacattccaatcggattctggtgggccgtggtcactatgaccactctcgggtacggggacatgtacccaaaaacatggtctggcatgctcgtgggcgctctgtgcgctctggctggtgtcctgacaatcgcaatgcccgttcccgtaatcgtcaacaacttcggcatgtactacagtcttgcaatggctaaacagaaactgcctaagaaaaagaataaacacattcctagaccgcctcaacccggatcccccaattattgtaagcctgacccaccgccacccccaccacctcaccctcaccacggatctgggggaatctccccgccaccaccaatcacgcctccatccatgggagttacggtcgctggcgcttaccccgcaggcccacatacgcacccgggtctgctgaggggcggtgccggtggtctcgggattatgggtctgccccctctgccggctccaggagagccctgcccgctcgcccaagaagaagtcatcgagatcaatcgagctgatcctaggcccaacggcgaccccgctgctgccgctttggcacatgaagattgtcccgctatcgaccagccagccatgtcccctgaagataagagccccatcactcctggaagcagaggcagatatagccgggacagagcatgctttctgttgaccgactacgccccaagcccagacggttctatacgtaaagcccttgtgacggcctag

SEQ ID NO: 235785 - DNA, 468 bp, Artificial Sequence
  Description of Artificial Sequence: Synthetic coding sequence
atgggcatccgccagcaactgcggctgcctactcgaaccgcgcagcctctaacatcactgccctgccctaggaagacgcgggctccttcgcgcctagaagccgtggctgccatcgcaggcactgagcccgctagctcttctcctacaatgccgctgcctctaatggccccaagtgagaagctgctttccccacccgaaactagcagggattttcggtcgcctccccctcttccccctcgtttgagagagatcccccagccccagcaacatagaggtccggagcgaggggtgcctgcacctagagccccatgccatccaccttggcttagccctggtcgccctccaagatcacccgacccagccctacacccactcgctttgccttctcctctatggggcgatagtggagtgactgggaagaaggtcaagggagccggaggcggtggctgggggaagggcttcttttag

SEQ ID NO: 235786 - DNA, 1629 bp, Artificial Sequence
  Description of Artificial Sequence: Synthetic coding sequence
atgacctacagacagcacagagacgcagaggaggccttagatagcttcgaagccccagatcctgctggcgcagccaacgctgctaacgccgctggagcacacgacgggggtctggacgacgaggcgggagccggtgggggagggcttgatggtgccggtggagaactgaagaggttatgcttccaggatgccggtggcggagcagggggaccaccaggcggagccggtggcgctggaggtacctggtggcggagatggcagccacgagtctgggcgttgtttgaagacccctatagtagcagagccgctcgatacgtggccttcgcgtctttattttttattctgatttcgattacgaccttctgcctggagactcacgagggatttatccacatcagcaacaaaaccgtcacccaggctagccctatacccggtgccccacctgagaacattactaacgtagaggtggagacagagcctttccttacatatgtagagggagtctgtgttgtctggtttaccttcgagtttttgatgagaatcaccttttgtcctgacaaggttgagttcctcaagtcctcactgaacatcattgactgcgtagccattctgccattctacctggaagtgggactctcgggattgagctcaaaggcagccaaggacgtgctgggatttcttcgtgtggtgcgattcgttcggatcctgcggattttcaaactaacgcgtcactttgtgggcttgcgggtgttgggacacactttaagggcaagcaccaacgaatttctgctgctcattattttccttgccttaggcgtgcttatatttgccactatgatctattacgctgaaagaattggggctgacccagacgacattctcggctcaaatcacacgtactttaaaaatatccctattggcttctggtgggccgttgtcactatgacaacattgggctatggtgacatgtaccctaagacttggagcgggatgttggtgggtgcactgtgcgctttagcaggcgttcttactatagcgatgcccgtacctgtgatcgttaacaacttcgggatgtactactcactggctatggcaaaacagaaattgccaaaaaagaaaaataagcacatcccaaggccaccgcaacctggatcccctaattactgcaagcccgacccaccccctcctccaccaccccatccacatcacggcagtgggggaatttccccaccacctcctattacccccccatctatgggcgttactgtggcaggtgcgtatcccgcagggcctcacacccacccgggactcttaagaggaggtgctggtggactggggatcatgggcttaccgcctctgccagctccaggtgagccttgcccactagcacaggaagaagtgatcgagatcaacagggctgaccctcggcctaacggtgatcccgctgcggcagctttggcccacgaggactgtccagccattgatcagcctgccatgagccctgaagacaagtcacccattaccccgggaagcaggggacgctatagcagagacagagcgtgcttcctcttgacagattacgcccctagcccagacggctcaatcagaaaggcgctcgtgactgcttag

SEQ ID NO: 235787 - DNA, 2274 bp, Artificial Sequence
  Description of Artificial Sequence: Synthetic coding sequence
atgctgtcctctgtctgcgtctcgagcttccgcggacgacaaggagctagtaaacaacaaccagctccccctccacagccacccgagagccctcctcctcctccactgccccctcagcagcagcagcccgcacagccagggccagccgcttctcctgcagggccaccggctccgagaggccctggtgataggagagcggaaccatgtcctggtctgcctgcagccgcaatggggaggcatggaggcggtggtggcgacagtggtaaaattgtcatcaatgtcggaggagtcaggcacgaaacgtatagaagtaccctcagaacgctgcctgggactcgacttgcaggacttacggagccagaagctgccgcacggtttgattacgatcctggggcagatgagttctttttcgaccgacaccccggtgtcttcgcgtatgtgctgaattattacagaacaggcaagctccactgccctgcagacgtatgcggtcccttatttgaagaagaactgggcttctggggcatcgatgagacggacgtagaggcctgttgctggatgacctacaggcaacaccgggacgctgaggaagccctggatagttttgaggcacccgacccggcaggtgcggctaatgctgctaacgcagctggggctcatgatggagggctcgacgacgaagcaggagcgggtggaggtggactagacggggcaggcggtgaactgaagcggctttgcttccaagacgcgggaggtggcgcagggggaccacctggcggtgctggcggagcaggtggaacctggtggcggagatggcagcccagagtctgggccctgttcgaggatccgtattcctctcgggctgctcgctacgtagcctttgccagcctgtttttcatcctgattagcattaccactttctgcctggaaactcacgagggctttatccacatcagtaacaaaacagtcactcaagcgagcccaatccctggggcacctcctgagaatataaccaacgtggaagtagagaccgagccattcctcacatatgttgaaggggtctgcgtcgtctggttcacttttgagtttctgatgcgtatcacgttttgtcctgacaaggtcgagtttctaaaatccagccttaacatcattgattgtgttgccatacttccattctatttggaggtgggccttagtggactgtcatccaaggccgctaaagatgttctgggctttctgagagttgttagatttgtgaggatactccggatcttcaaactgacgaggcatttcgtagggctcagagtcttggggcatacgctgcgggcttcaactaacgagttcctgctgctgattatcttcctggcgcttggggtcttgatctttgctacaatgatctattatgccgaaaggattggggcagatccggacgatatcctgggctccaaccatacctacttcaaaaacatccccataggattttggtgggcagtggtgacaatgaccaccctgggatatggcgatatgtaccctaagacatggtccggcatgcttgttggggctttgtgcgctcttgccggtgtccttaccatcgctatgccagtccctgttatcgtgaacaatttcggtatgtattactcccttgctatggcgaaacagaaattgccaaagaagaaaaacaagcatataccacggcctccgcagcccggatctcccaattattgcaagcccgatcctccaccccctccgcctcctcatcctcaccatggcagcggagggatcagtccgcctcctcctatcacgcctcccagcatgggcgtcaccgtagccggtgcatacccagcaggccctcacacacatccgggattactgcgcggaggagcgggaggacttggtatcatgggcctgcccccactgcccgcacccggagaaccttgtccgctggcccaagaagaggtgatagagatcaaccgggcagatcctcggccaaatggcgatcccgctgctgccgctctggcccatgaggattgccctgccattgaccagcctgctatgtctcctgaagacaagagcccaattaccccaggctcccggggaaggtatagccgagaccgcgcatgttttctgctgaccgattacgccccttctcctgacgggagtattcgtaaagccacaggggctccacccctgcctcctcaggattggcggaagcccggacctcccagtttcttgccagacctcaacgcaaatgcagctgcatggataagcccctag

SEQ ID NO: 235788 - DNA, 1908 bp, Artificial Sequence
  Description of Artificial Sequence: Synthetic coding sequence
atgatcagtagcgtttgcgtttcctcataccgaggtaggaaatctgggaacaagcctccttctaagacctgtttgaaggaggagatggctaaaggcgaagcttcagaaaaaatcattatcaatgtcggtgggacacgtcacgagacctataggtccactctacgcacactgcctggaactagattagcatggctggccgatcccgatgggggaggtcggcctgaaacggacggaggaggagtagggagttccggctcttccggcggtgggggatgcgagttttttttcgaccggcatcctggtgtgttcgcctacgtgctgaattactaccgaacagggaaactgcattgccccgcagacgtgtgcggcccactcttcgaagaagagcttacgttttggggaatcgacgaaaccgatgttgaaccatgctgttggatgacctacaggcagcatcgtgacgcagaggaggcactagacattttcgagtctccggatgggggaggatcgggcgcaggcccatctgatgaagccggtgatgatgaacgtgagttggcgctgcagcgcctgggcccacatgaggggggagccggtcacggagccggttcaggcggatgccggggttggcagccacgtatgtgggctctgtttgaggatccttattctagccgggcagcccgagtcgtggcattcgccagcctgtttttcatcctcgtcagcattaccactttctgcttggagactcacgaggcgtttaatatcgaccggaatgtgactgaaattctgcgggtgggtaatattacctctgtgcatttcaggcgagaggtggagaccgagcccatcttgacgtacattgagggcgtctgtgtactgtggtttacacttgagtttctggtgagaatcgtatgttgccctgacaccttagactttgtaaaaaatttactgaacataatcgactttgtggccatcctccctttctatctggaggtcggtctatcaggtctgtcgtcaaaggctgccagagacgtgctgggctttctccgggtcgtacgattcgtcagaattttgaggatcttcaaactgaccagacatttcgttggcctccgggttctgggacacacgcttcgtgccagcacaaatgagtttttgctcctgattatttttctggccctaggcgtgctgattttcgcgactatgatctactatgctgaaagaattggagccagacctagtgaccccaggggaaatgatcatacagattttaagaacattcctatcggtttttggtgggctgtcgtaaccatgacaactttgggctacggcgatatgtacccaaaaacttggagcgggatgctcgtgggcgcactctgcgcacttgcaggggtgctcaccatcgccatgcccgttcccgtgattgtaaacaacttcggaatgtattattccttagccatggcaaaacaaaagctgcccaaaaaacggaagaagcacgtccccagacccgctcagcttgagtctcctatgtactgcaaatccgaagaaactagtccaagggatagcacttgttctgacaccagcccacccgctcgagaagagggcatgatcgaaaggaagagagccgattccaagcagaacggagacgcaaatgccgttctctctgatgaggagggagctggattaacacaaccactggcttcatcccccacacctgaagaaaggcgcgcactgaggcgctctacgacaagggaccgaaataagaaggccgcagcatgcttcctactctctaccggcgattacgcttgcgctgatggatcggtgcgcaaggggactttcgtcctgcgtgatctgcccttgcagcactcccctgaggccgcatgtccgccaaccgccggtacactattcttgccacactag

SEQ ID NO: 235789 - DNA, 1881 bp, Artificial Sequence
  Description of Artificial Sequence: Synthetic coding sequence
atgatttcatcagtgtgcgtttccagctatcgcggtaggaaaagcggaaacaaaccacccagtaagacctgcttgaaggaggaaatggccaaaggggaagcatcagagaagattattataaacgtaggcggaacgaggcatgagacctatagaagcaccctgagaacactgccaggcaccagactggcatggttagcagatcctgacggtggcggacggccagaaaccgatgggggtggtgttggctccagcggtagctctggcggaggcggttgtgagttcttcttcgatagacatcctggtgtctttgcatacgtgctcaactattaccgtacaggaaaacttcactgccccgctgacgtttgcgggcctctcttcgaggaagagctcacattttggggtatcgatgaaaccgatgtagaaccgtgctgttggatgacttatcggcagcatcgggacgctgaagaggctctagatatattcgagagtcctgatggaggcggaagtggtgccggaccgtctgatgaggccggtgatgatgaacgggaattggccctccaacgcttgggcccacacgaaggcggtgctgggcatggagccggaagtgggggatgccggggatggcagcctcgaatgtgggccctgttcgaagacccttactcctccagggctgctcgagtggtggcattcgcaagcctgttttttattttggtgagcattacaacattctgtttggagacacacgaagcgttcaacatagacaggaacgtgacggagatcctcagagtgggtaacataacatctgtgcactttcgcagggaggtggagaccgagcccatactcacttacatcgagggagtttgcgttctgtggtttacactagagtttcttgtgcgcatcgtgtgctgcccagataccctggattttgtcaagaacctgctgaacattatagattttgtggctatcctgcctttttaccttgaagtgggcttgtcaggactaagctccaaggcagccagagacgtgttggggttcctgcgtgtagtgcgattcgtgcgtattcttcgcatatttaagctgacacggcacttcgtgggcctgcgcgtcttgggccacacgcttagggcgtcaacaaacgagtttctccttctcatcattttcttagcactgggggtgcttatcttcgccacaatgatttactacgctgaacgtattggcgcacggcctagcgaccctaggggcaacgatcacacagatttcaagaatattcccattggattttggtgggctgtagtcacgatgaccactctgggctacggagacatgtacccgaaaacttggtctggaatgctggttggcgcactgtgtgccctggcaggggtgctgaccattgcgatgcccgtgccagttatcgtcaacaactttgggatgtattacagcctggctatggctaagcaaaaacttcctaagaagcgcaagaaacacgtccccaggcccgctcaactcgagagccccatgtattgtaaatctgaggagacttcgcctcgcgattctacatgttcagatacgagccctcccgctcgggaggagggaatgatcgaaaggaagagagccgatagtaaacagaacggggatgccaacgccgtgctgtctgacgaagaaggtgccggacttacacagcccctggcgagcagcccaacacctgaggaacggcgtgccctgagacggtcgaccacccgcgaccggaacaagaaggctgcagcctgttttctgctcagcacaggcgactatgcatgcgcagatgggagcgtccggaaagagacctgccaagacgctctctcttcgaactacgctcaggctgaggttcttacgcttagctag

SEQ ID NO: 235790 - DNA, 1908 bp, Artificial Sequence
  Description of Artificial Sequence: Synthetic coding sequence
atgatcagtagtgtttgcgtgtcctcttatagagggaggaagtcaggaaacaaacccccttcaaagacatgcctgaaagaagagatggctaagggagaagcaagcgagaaaatcattatcaatgtcggagggacgcgccatgaaacttatcggagcaccctgcgaactttgcctggcacccggctcgcatggctggctgaccctgacggtggaggtcgacccgagaccgatggcggaggcgtcggtagcagtggcagctcaggtggaggcggatgcgagttcttcttcgatcggcaccccggagtcttcgcctacgtgctgaattactaccggaccgggaaactgcattgccccgcagacgtttgtgggcctttgtttgaggaagagctgactttctggggtatagacgagactgacgttgagccgtgctgttggatgacctaccgacagcacagggatgcggaggaggcactagatatcttcgaaagtcctgacggagggggatctggcgctggcccatctgacgaggcgggtgatgatgagagagagctggccctgcagcgattaggtccacatgaaggcggagctggccatggcgctgggagcggcggttgcaggggatggcagccacgtatgtgggctcttttcgaagatccttacagtagcagagctgcccgagtggtagcgttcgcctcgcttttctttattctcgtaagcatcaccaccttctgcttagaaacgcacgaggcattcaatatcgaccggaatgttacggaaatcctgagagtgggcaatatcacttccgtccatttccggagggaagttgaaacagagccaatcctcacgtacatagaaggggtttgcgtcctttggttcaccctcgaatttttagtgaggatcgtgtgctgtccagacactcttgacttcgtcaagaaccttttaaatatcatcgacttcgttgccatccttccattttatcttgaagtgggccttagcggacttagctccaaggccgctagggatgtcctggggttcctccgcgttgtcagatttgtacgcatcctgagaatcttcaaactgacccggcacttcgtgggcctaagagtactcggtcacacactccgggcatccacaaacgagtttttgttacttatcatttttttggccttaggagtcctgattttcgctacaatgatctattacgcggagcgcatcggggctcgccctagtgaccctagagggaatgatcataccgacttcaaaaacatccctatcgggttttggtgggcggttgtgaccatgaccaccctgggatacggcgacatgtacccaaagacgtggtccggcatgctggttggggcattatgcgcgcttgccggagtgttgaccatcgcaatgcctgtgcccgtcatagtaaacaatttcggcatgtactactcgctagccatggcaaaacaaaaactgccgaaaaagcgcaagaaacacgttccaagacctgcccagctggagtctcctatgtattgcaagtcggaggagacaagtccccgagacagcacttgtagcgacacatccccccctgcacgggaggagggaatgatagaaaggaagagagctgactccaagcaaaacggggatgcaaacgctgtactgtctgatgaggagggcgctgggttaacacaacctctggcctcaagtcctacccccgaggaacggagagcactaaggcgatcaactactagagatagaaataagaaggctgccgcatgtttccttttgagtaccggcgattatgcttgtgctgatggatctgtcagaaaggggacctttgtgttgcgcgaccttcctctgcagcattccccggaggcagcctgccccccaacggcaggaactctttttcttccacactag

SEQ ID NO: 235791 - DNA, 1485 bp, Artificial Sequence
  Description of Artificial Sequence: Synthetic coding sequence
atggacggtagtggggaacgaagcctgcccgagcccggtagtcagtcatcagccgcaagtgacgacatagaaattgtggtgaacgtaggaggggtcagacaggtcctatacggtgacctgctctctcagtacccagagacccgcctcgcagagctgattaactgcttggccggtgggtacgatactatcttttctctttgcgatgattatgaccctgggaagcgagaattctattttgaccgtgatccggacgcctttaagtgtgtgattgaagtctattacttcggcgaagttcatatgaaaaagggaatctgtccaatctgcttcaaaaacgaaatggatttttggaaggtggacttaaaattccttgacgattgctgtaagtcacatctcagtgagaagagggaggaactggaggagatcgccagacgggtccagttaatattggatgatcttggagttgatgcggcagaaggacgttggaggaggtgccagaagtgtgtctggaagttcctggaaaagcctgagagctcttgccctgcccgagtggtggcagttcttagctttctcctgatcctggtgagctccgtggttatgtgtatgggcacgatcccggaattacaggtgctggacgcagagggaaaccgtgtcgagcatcctaccctggaaaatgtcgagacagcatgcatcggctggttcactctcgagtacctgctgagattgtttagcagtccaaataagcttcatttcgcgctctccttcatgaacatcgttgacgtgctggccatactgcccttctacgtttctcttaccctcacccacctgggcgctagaatgatggaactgactaacgtccagcaggccgttcaggccctcagaatcatgcgcatagcccgaatcttcaaactggccagacacagttctgggcttcaaaccctcacctatgctcttaagcggagctttaaagagttaggcctgctgctgatgtatctggcagtcggtatttttgtcttttccgcccttggctacactatggagcagtcacaccccgagacgttgttcaaatccatcccccaatccttctggtgggccatcattactatgaccaccgtggggtacggagacatttaccccaagacaacactcgggaaactgaatgcagctatttcattcctgtgtggagtgatcgcaatcgcattgcccattcacccaatcatcaacaattttgtgcggtattacaataagcagcgagtgctagaaaccgctgcgaaacacgaattggaactgatggagctgaactcttcttccggtggtgagggcaagaccggtggaagcaggagtgatttggacaacctgcctcccgaacccgctggcaaagaggcccctagctgttctagccgacttaagttgagccattccgacaccttcattccactcttgaccgaagaaaagcaccacaggactcgcctccagagctgcaagtag

SEQ ID NO: 235792 - DNA, 1542 bp, Artificial Sequence
  Description of Artificial Sequence: Synthetic coding sequence
atgaccttgcttccaggtgacaactcagactatgattattcagcactgtcttgtacatccgacgcttcttttcacccagcgtttctcccccagcgccaggccatcaaaggtgccttttacaggagagcccaacgactacgacctcaggacgaaccacggcagggctgtcagccggaagaccgccgacgccgaatcatcatcaacgtcgggggaatcaagtactctctgccatggacaactttggacgagttccctctgacccgcctgggacagctgaaagcttgcactaacttcgacgatattctgaacgtgtgtgatgactacgatgtcacctgcaacgagttttttttcgacaggaatcccggagccttcgggacgatcctaacgtttctccgggctggcaagttaaggctcctgcgggaaatgtgtgcactatcctttcaggaggaactgctttattggggcatcgctgaggaccatttggacggatgttgtaagagaagatatctgcagaagatcgaagagttcgctgaaatggtcgagagagaggaagaagatgatgcattagattctgagggcagggactctgagggaccagcagaaggtgaagggagactcgggagatgcatgcgtaggcttcgtgatatggtggagcggccacattccggtttgcctggcaaggtgtttgcatgcctgagcgtcctgtttgtgactgtgactgcagtaaatcttagcgtgtccactctgccaagcctgcgggaagaggaggaacaaggccactgttcgcagatgtgtcataatgtgttcattgtggaaagtgtctgcgtggggtggttctcgctcgagttcctgttgcgactgattcaggcaccctctaagttcgcttttttacgatcacccttgaccctgatcgaccttgtggcaattctgccctattatatcacacttttggtcgacggagctgcagccggtcggagaaaacctggcgctggcaattcatacctggataaagttggtctggtgttgcgcgtgttgcgagccctgaggatactttacgtgatgcgcttggctcgacattcgctgggcctgcaaaccctcgggctgactgccaggcgctgcacccgggaattcggcctcttgctcctgttcctgtgcgtcgccattgctctttttgcccctcttctgtatgtgattgagaacgagatggccgactctcccgagtttacaagtattcctgcttgctactggtgggcagtgatcacgatgaccaccgttggctatggagatatggttcccagatcaacgcccggacaggtcgtggcactgagttccatcctgtccggcattctcctgatggcctttcctgttacctctatcttccacacattctctagatcttacttggagcttaagcaagagcaggagcgggtgatgttccggagggctcagttcctgattaagactaagtcccagctgagcgtgtcgcaagattcagatattctgttcggatcagcttccagcgacacacgcgataataactag

SEQ ID NO: 235793 - DNA, 828 bp, Artificial Sequence
  Description of Artificial Sequence: Synthetic coding sequence
atgaccctgctgccaggtgacaacagtgattacgactactccgcactgtcctgtacttccgacgcttccttccaccctgcctttctgccccaacggcaggctatcaaaggcgctttctacaggcgcgcacaacgcttacgcccacaggatgagcccagacaggggtgtcaacccgaggataggaggcgacggatcatcatcaacgtgggtggtattaagtacagtctcccttggaccaccttggatgaattccccctgacccgcctgggccaattgaaagcctgcacaaattttgatgacatcctgaacgtctgtgacgactacgatgtgacgtgcaacgagtttttttttgatagaaatccaggggcttttggaacaattctgacgtttttacgcgctggcaaactgcgcttacttagggagatgtgcgccttgagtttccaagaggagctcctctactgggggatcgctgaggatcatttggatggctgttgcaagaggaggtacttgcagaagattgaagaatttgccgagatggtggagcgcgaggaggaggacgacgccctcgactccgaaggccgagattccgagggtccggcagagggcgagggtagattaggtagatgtatgagaagactgagagatatggtagaacgccctcactcaggactgcctggtaaggtttttgcttgcctgtccgttcttttcgtcaccgtcactgcggtgaacctcagcgtcagcacactaccctcactgagagaggaagaggagcaggtaagagctcatgctccacgcggaaatgcgcctccgcgtggcaagggtctctag

SEQ ID NO: 235794 - DNA, 543 bp, Artificial Sequence
  Description of Artificial Sequence: Synthetic coding sequence
atgactctattgccaggcgataattctgactacgactactcagcgctgagctgcacctccgatgcaagcttccaccccgcttttttacctcagcgccaggccattaaaggagccttctacaggcgagcccagaggcttaggccacaggatgaaccacgtcagggttgccaacctgaggataggcgcaggagaatcattattaatgtaggcggaatcaagtacagcctgccctggactacgctggacgaatttccactgacccggctgggacagctcaaggcctgcacaaactttgatgacatcctgaatgtgtgcgatgattatgacgtgacctgcaacgaattcttttttgaccgcaacccaggcgcatttggcaccattttgacctttctgcgcgcaggaaagttgcgcctgctgagagagatgtgcgccctgagctttcaggaggaactcctttattggggaattgcagaggatcatctggatggttgctgtaagcgacgctaccttcagaaaatcgaggagttcgcggagatggtatag

SEQ ID NO: 235795 - DNA, 291 bp, Artificial Sequence
  Description of Artificial Sequence: Synthetic coding sequence
atgaccctgcttccaggtgacaatagcgactatgattactctgccctatcttgtacgtctgacgcctcatttcaccctgccttcctgcctcagagacaagcaataaaaggcgctttctaccgtcgcgcacagagattacgtccacaggatgaaccccgtcagggatgccagccagaggataggaggagaaggataataattaatgtcgggggtatcaaatattcactgccctggaccacactggacgaatttccgctgaccaggctcgggcaactcaaggcatgcacttag

SEQ ID NO: 235796 - DNA, 777 bp, Artificial Sequence
  Description of Artificial Sequence: Synthetic coding sequence
atgacacttctcccaggcgataactctgactatgactattcagcactctcctgcacatctgatgcctcgtttcatccggcatttctgccccaaaggcaggctatcaaaggcgcattctatcggcgagcccagcggctccgtccacaggatgagccgaggcaaggctgtcaacctgaagaccgccgaagaagaattatcattaacgtgggcggtatcaagtatagcctgccatggaccaccctggatgagtttccgttgacccgtcttggacaactgaaggcgtgtactaactttgacgacattctgaatgtatgcgatgattacgatgtgacatgtaacgaatttttcttcgatcgcaacccaggagccttcggcaccatactgacttttttgcgagcaggtaaactgagattgctgagagaaatgtgcgcactgagcttccaagaggaactcctctattggggaattgcagaggaccatctggatggttgttgcaagagacgctatttgcaaaaaattgaggagttcgctgagatggtcgagcgtgaagaggaagacgatgccctggacagtgagggccgtgacagtgaagggccagccgagggagaggggaggctgggcagatgcatgagacgcctccgcgatatggtggaacgtccacactcaggactgccaggcaaggtgtttgcctgcctttcagttctgttcgtgaccgtaaccgccgtcaatctttccgtctcaaccttgccatctctgcgggaagaggaagagcagtag

SEQ ID NO: 235797 - DNA, 147 bp, Artificial Sequence
  Description of Artificial Sequence: Synthetic coding sequence
atgaccctcttgcccggagacaactctgactacgactactcagccttatcatgtacatctgacgcttcctttcacccggcatttctgccccagagacaggcaatcaaaggagctttttaccgtagggcccaaagactcagaccttag

SEQ ID NO: 235798 - DNA, 1311 bp, Artificial Sequence
  Description of Artificial Sequence: Synthetic coding sequence
atgacttttgggcgaagcggggcagcgagcgtggtgctcaatgtgggcggagcaagatattccctgtctcgtgaattactgaaagattttccgctgcggagagtcagcaggcttcatggttgccgaagtgagagagatgttctcgaagtgtgtgacgattacgatcgcgaaagaaacgagtatttttttgacaggcacagcgaagccttcggttttattctgctgtacgtgaggggccacggtaaactgcgattcgcacccaggatgtgtgaactgagtttttacaacgagatgatatactggggcttagagggcgctcaccttgagtactgttgccagcggagactcgacgatcgtatgagcgacacctatacattttatagtgccgacgaacctggcgtcctgggccgtgacgaggcgaggccaggtggtgccgaggcagctccctcacggaggtggttggaaaggatgaggcggacatttgaggaacccacgagttccctggccgcacaaatcctggcatccgtgagcgttgtcttcgtgattgtgtccatggtggtgctgtgtgccagcacactgcccgactggaggaatgctgctgctgacaaccgtagcctcgatgacagatctcggtacagtgccggtccgggaagggaaccgagcgggataatcgaagcaatctgcataggatggtttacagccgagtgtattgtgagattcatcgtgagcaagaacaaatgcgaatttgtgaagcgcccactgaacatcatagatttgttggccataaccccgtactatataagcgtcttgatgaccgtatttactggggaaaatagtcagctccagcgggctggggtcacccttagggtgctccggatgatgaggattttttgggtcatcaagttggcaagacactttattgggttacagacattaggactaacactgaaaagatgttatcgggaaatggtgatgctgctcgtgtttatctgtgtcgctatggccatattttcggccctgagtcagctcctcgagcacggtctagacctggagactagtaacaaggatttcacctcgataccggcagcctgttggtgggtgatcatttccatgacgacagtcggatatggggatatgtacccgatcaccgtgcccggtcgcattctgggaggggtctgcgtcgtgtccggtatcgtcctcctggccttgcctattacctttatctaccactcatttgtccagtgttaccacgaattgaagtttcggagcgccagatacagcagatcccttagcactgagttccttaactag

SEQ ID NO: 235799 - DNA, 1278 bp, Artificial Sequence
  Description of Artificial Sequence: Synthetic coding sequence
atgacattcggaaggagcggagccgcaagcgtggtattgaatgtggggggagcgagatatagcttgtcacgggaactgctgaaggattttccattaagaagagtgagtcgcttgcacggttgcaggtctgaacgggatgttctagaagtctgtgatgattacgacagggagaggaacgaatacttcttcgacagacactcagaggccttcgggttcattctgctgtacgtgagaggacacgggaaactgcgatttgcaccgaggatgtgcgaactgtcattttacaacgaaatgatttactggggactggagggcgctcacctcgagtactgctgtcagcggcgtcttgatgatcggatgagtgatacttatactttctactctgctgatgagcctggggtattgggcagggatgaagccaggcccggaggtgccgaagccgctccctcccgacgatggctcgaaaggatgaggcggacctttgaagagcccaccagttccctcgccgcacagattctggccagcgtcagcgtcgtattcgtaatcgtatccatggtggttctctgcgcgtcaacgctgccggattggagaaatgccgcagctgacaataggtctctggatgatcggagcaggatcattgaggctatctgcatcgggtggttcacagcagaatgcattgtccgatttatcgtcagcaaaaataaatgcgagttcgtcaagagaccgttgaatattatcgacttgctggcaatcaccccgtactacatttcagtcttaatgacagtgtttacaggagaaaactcccaattgcagcgggcaggtgtgacactcagggtcttgaggatgatgagaattttctgggttatcaaactggcaagacatttcatcggtctgcaaactctgggactcaccctgaagaggtgctatagagagatggtgatgctactggtcttcatctgcgtcgcaatggctatttttagtgccctgagtcaactgctggaacatggcctcgacctggagaccagcaacaaagatttcacctctatacccgcagcctgttggtgggtgattatctcaatgactactgtgggctacggtgacatgtaccctattactgtcccgggacggatactgggcggagtctgtgtggtctcaggtatcgtgctcctggcactccccattacgttcatctatcactccttcgttcaatgctaccatgagctaaaattcaggagcgccagatacagccgcagcctgtcaaccgagttcctcaattag

SEQ ID NO: 235800 - DNA, 1560 bp, Artificial Sequence
  Description of Artificial Sequence: Synthetic coding sequence
atgcctatgccatctagggatggcggattgcatcccagacatcaccactacggctcccattctccatggtcacaactcctctcatcacctatggagacgccgagtattaaaggcctttattatcgaagggtacgcaaggtaggtgccttggatgcttccccagtcgacctgaaaaaggaaattctgattaacgtgggcggtaggcggtatctgctcccttggtccacattggacagattcccgctcagccgcctgtcgaagctacgattatgccgcagctacgaagaaatcgtgcaattgtgtgatgactacgacgaggatagtcaggagttctttttcgatcgcagccccagcgcattcggcgtaatcgtgtcttttctcgctgcaggaaagttagttttactccaggaaatgtgtgctctctccttccaggaggagctggcctactgggggatcgaagaggcccatttggagcgttgctgcctcagaaaacttttaagaaaactcgaggagctagaagaactggcaaaactgcacagggaagatgtgttgcggcagcagagggagacccgaaggcccgctagccactcatccaggtggggactttgtatgaaccggttgagagagatggtggagaatccacaatcaggactgcctggcaaggtctttgcctgtctatccatcctgttcgtggctacgactgcagtctccctttgtgtatctacaatgcccgacctgagagccgaggaagaccagggcgagtgttctaggaaatgttactatatattcatagtcgagactatttgtgtcgcctggttttctttggaattttgcctgcggttcgttcaggcccaggacaagtgtcagttctttcagggccctttgaacatcattgacatcctcgcaattagcccatattacgtatctctcgccgtgtccgaagagcctccagaggacggagaacgacctagcgggtcctcttacctggagaaggtgggcttggtgcttagggtgctacgagccctgagaatcctttatgtcatgaggttggctagacatagtctggggctgcaaaccctggggcttacagtaagacgatgcacgcgtgagttcggtctcctgctcctgttcctagccgtggctataactttgtttagcccgctggtgtacgtggcagagaaggagtctgggagagtcctggagttcaccagcattccagcttcgtactggtgggcaatcatcagcatgaccactgtgggctacggggacatggttccaaggtccgtgcctggtcagatggtggcccttagctcaatcctgtcaggaatactcatcatggcttttcccgcaaccagcatttttcacaccttcagtcacagttacttggagctgaagaaagaacaagagcagttgcaggcacggctgcgccacctgcagaacacaggacccgcatcagaatgtgaacttctggacccacatgtggcatcagaacatgagctcatgaacgacgttaacgatttaattttagaggggccagcccttcctataatgcatatgtag

SEQ ID NO: 235801 - DNA, 2970 bp, Artificial Sequence
  Description of Artificial Sequence: Synthetic coding sequence
atgaccatggcaggcggacgacgagggctggtcgctccacagaatacatttctcgagaatatcgtcaggaggagcaatgatacgaatttcgtgttgggaaatgcacagattgtggactggccaatcgtctattccaacgatggtttttgtaaattgagcggatatcatagagcggaggtgatgcaaaaaagtagtacgtgttccttcatgtatggcgaactgaccgacaaggacaccatagagaaagttcgccagacgtttgagaactacgagatgaattctttcgaaattctcatgtataagaagaatcggaccccggtgtggttcttcgtgaagattgcgccaatcaggaacgaacaggataaggtggtgctattcctttgtactttcagcgacattaccgcgtttaaacagccaattgaggatgacagctgcaagggttgggggaagtttgccaggttgactcgggctctcacatcgtctaggggcgtactacaacagctggcaccttctgtgcaaaaaggggagaatgtgcacaaacacagtcgattggccgaggtgctgcagttggggtccgacattctccctcagtataaacaggaggcacccaaaacccctccccacataatactgcactactgtgttttcaaaacaacatgggattggatcattttgatactgacattctacactgcaatactggtgccttataatgtcagttttaagacacggcaaaacaacgtcgcctggctggtcgtcgacagcatagtcgatgtcatcttcctggtcgatatcgttctcaactttcataccactttcgtgggaccagcaggtgaggtgatctcagaccctaaactgatacgcatgaattatttgaagacgtggtttgtgatagacctcttgagctgtctgccatatgacgtgatcaacgcttttgagaatgttgatgaggtatccgctttcatgggagatcccggtaagatcgggtttgcagaccagatccctcctccactggagggcagagagtcccaagggatcagctccttattcagttctctcaaggtggttcgtttgctgaggttgggtcgagtggcacgcaagctggaccactacattgagtatggagcagctgttctagtgctcctggtgtgtgtattcggtctggccgctcattggatggcgtgtatctggtattcgatcggggattacgagattttcgacgaggacaccaagaccataaggaataatagctggttgtatcagctggccatggacattgggaccccttaccagtttaatggcagcggaagcggcaaatgggaaggtggtccctctaaaaattcagtctatatcagcagtctatatttcaccatgacttcgttgacgtctgtaggcttcggaaatatcgcccctagcaccgatatagagaaaatcttcgctgtcgctatcatgatgataggttcgctattatacgctactatattcggcaacgtgaccacaatctttcaacagatgtacgccaatactaacagataccacgagatgctaaactcagttcgcgatttcctaaaactgtatcaggtccccaaaggactttcagagagggtgatggattatatcgtgtccacttggtctatgtctcggggaatcgatacagagaaggtgctgcaaatctgtccaaaagacatgagagctgatatatgtgtccatcttaaccggaaggtgttcaaggagcatcctgcattccggttagccagtgatggctgcttacgggctctggccatggaattccagactgtacattgtgctccaggtgatttaatctatcacgccggagaatccgtggacagtctctgttttgtcgtttctggctctttggaagtcattcaggatgatgaagtggttgcaatccttggcaagggtgacgtctttggcgacgtgttctggaaagaagctactctggcacaatcctgtgccaatgtgcgcgctctgacatactgtgacttgcatgtgatcaagcgcgatgccctccagaaagtgcttgaattctacacagcgttctctcatagcttctctcggaacctcatcctgacatataacctgagaaaacgaatcgtgttccgcaagatttccgatgtgaagagggaggaggaagagaggatgaagaggaagaatgaggccccactcatcctacctcctgatcaccctgtccgcagactctttcaacgatttcggcagcagaaagaagctaggctagccgctgaacggggtgggagagaccttgatgacctggacgtcgaaaaaggaaatgtgctgaccgagcatgctagcgccaatcattctttggttaaggcctccgttgtgaccgtgagggaaagcccagcaacccctgtctcattccaggcagccagcacctcgggggttcctgaccacgccaaactccaagcaccaggctcagagtgcttgggccctaagggcggaggcggagattgtgcaaagcgaaagtcctgggctaggtttaaagacgcttgtgggaagtccgaggactggaataaagtcagcaaggccgagtccatggagacactccccgaaaggaccaaagcatctggagaagcaacactgaagaagacagatagctgcgacagcgggatcacgaaaagcgacctacgcctggataacgtaggagaggcacggtccccccaagatcggagtcctattctagctgaggttaaacacagcttctaccctatccccgaacagactctgcaggctacagtgctggaagtccgccacgagctgaaggaggatatcaaagcgttaaacgccaagatgactaatattgagaagcagctgagtgagattcttcgtatcttaacttccaggagaagttcacagtcaccacaggagctctttgagatttcccggccacagagtcctgaatctgagagagatatttttggcgcttcatag

SEQ ID NO: 235802 - DNA, 2889 bp, Artificial Sequence
  Description of Artificial Sequence: Synthetic coding sequence
atgaccatggcaggaggcaggagggggctggtggcaccacaaaataccttcctggagaatattgtcagacgctcaaatgacactaacttcgtactgggaaatgcccaaattgttgattggcccatcgtctattccaatgacgggttttgcaaactctctggctaccatagagccgaggtgatgcagaagtctagcacatgcagcttcatgtacggggaactcactgacaaagatactatcgagaaagtacgccagacatttgagaactacgagatgaattctttcgagatacttatgtacaaaaaaaaccgtactccagtttggttctttgtgaaaatcgcacctattcggaacgaacaagacaaggttgtgcttttcctgtgcaccttttccgatataactgccttcaagcagcctatcgaagatgattcctgcaagggttggggaaagttcgcaagattaacgagagccttaacaagctctaggggcgtactgcagcagctggctcctagcgttcagaagggtgagaacgtgcacaagcattcaagactcgccgaggtccttcagctgggcagtgacattctgcctcagtacaaacaagaggctccaaagacaccccctcacattatcctacactactgcgtttttaaaacaacctgggactggattatcttaattttgaccttctatacagcaatcctggtgccgtacaacgtttccttcaaaacccgccagaacaacgttgcctggcttgttgttgattctatcgtggacgtgatctttttggtggacatcgtgctgaactttcatacgaccttcgttggtcctgccggagaagtgatcagcgatcctaagcttattagaatgaactacctcaaaacatggtttgtgattgacctactcagctgcctcccctacgacgtaatcaatgcttttgagaatgtggatgaaggcatttcctccctgttttcttctctgaaagtggtgaggttattgaggcttggcagagtagcacgcaagttggaccactatatcgagtacggcgctgcagtcctagttcttctcgtgtgtgtctttgggctagcggctcattggatggcatgcatctggtactccattggcgactacgaaatcttcgacgaagacacaaagaccattcgaaataattcatggctataccaactggcaatggacatagggaccccttatcagtttaatgggagtgggtcaggcaaatgggagggaggtcccagtaagaattccgtttatattagttccctgtacttcactatgacttcactgacctccgtcggtttcggcaatatcgccccttcaaccgatatcgagaaaatttttgccgtggctattatgatgattggatctctgttgtatgcaacaatcttcgggaatgtcacaaccatctttcagcaaatgtatgccaacacaaatcggtaccacgagatgctgaactccgtcagggattttctcaagctttatcaggtgcctaaagggttgtctgaaagagtaatggactacatcgtgtctacatggtccatgtctagagggatcgacaccgagaaagtgctgcagatctgcccgaaggacatgcgcgctgatatctgtgtacatctcaaccggaaggtattcaaagaacacccagcttttaggctagcatccgatggatgtctacgtgccctagctatggaattccagaccgtccattgtgctccaggcgacctcatatatcatgccggtgagagcgtggactcattgtgtttcgtggtctctggaagtctcgaggtgatacaagatgacgaagtagtggccatactcggcaaaggcgacgtatttggcgacgtcttttggaaagaagccacccttgctcagagctgcgctaacgtgagggctctgacttattgcgatttgcacgtgatcaaacgtgatgcattacagaaagttctagagttctacacagccttcagtcattcttttagtagaaacctaatcctcacctataacctcagaaagagaattgtttttaggaaaatcagcgacgtgaaacgagaggaggaagagcggatgaaacggaagaacgaggcccctcttatcctgccgcctgaccatccggtcaggcggctgttccagagattccggcaacagaaagaagcccgactagccgctgagaggggaggtcgcgatctggacgacctggatgtggaaaaaggaaatgtgctcactgaacacgcaagcgccaaccacagtttagtaaaagcctcggtggtcaccgttcgcgaatcccctgcgactcctgtttcattccaagctgctagcactagtggcgtcccagatcacgccaaactccaagcccctgggagcgaatgcctaggaccaaagggcggaggtggagattgcgcaaagagaaagagctgggcacgcttcaaggatgcttgtggtaagtccgaagactggaacaaggtgagcaaggccgagtcgatggaaacgctcccagagaggaccaaggcaagcggcgaagccactctgaagaagactgattcatgtgattccggaataactaagtccgatttgaggctggataatgttggggaagccaggagccctcaggaccgctcacctattcttgccgaggttaagcactcgttctacccaatacccgagcagactctgcaggctacagtcctagaggttcggcacgagctgaaggaggacatcaaggcacttaatgctaaaatgactaatattgaaaagcagctcagcgaaatattacgaattctgaccagccgtaggtcctcccagagcccccaggagctcttcgaaattagccgtccacagtcacccgagagcgaacgggacattttcggggcaagttag

SEQ ID NO: 235803 - DNA, 3480 bp, Artificial Sequence
  Description of Artificial Sequence: Synthetic coding sequence
atgcccgtgcggagagggcacgttgcccctcagaatactttccttgacactattattcgtaagtttgaaggccagagtagaaaattcatcattgctaatgcgagagtagaaaattgcgctgtcatttactgcaacgatgggttctgcgagctgtgtgggtactcaagagctgaggtaatgcaaagaccatgcacctgtgacttcctccacgggcctagaactcagcgcagggccgctgcccaaatcgctcaggcactgttgggagcagaagagcgtaaagtagaaatcgcgttctacaggaaggatggctcttgcttcctctgcttggtggatgtggtgcctgtaaagaacgaagatggggcagttatcatgtttattctgaatttcgaagtcgtaatggaaaaagacatggtcgggtcccccgcacacgatacgaaccaccggggacctccaacgtcctggctggcccctggccgagccaaaacctttcggctgaaactgcctgctctgctcgctttgacagcaagggagagtagtgtgcggtccgggggtgccggaggggctggagctcccggtgcggtggtggtggatgtggatctgacaccagctgcaccctcttcagaaagcctggcccttgacgaggtcactgctatggataatcacgtggcaggtcttggacccgctgaagaacgccgtgctttagtggggccaggctctcccccacgatccgctcctggccagctcccatctcctcgcgctcacagcttgaacccggatgcctcaggaagctcgtgcagtttggcccgtacacgttcccgcgagagttgcgcctcagtgcgacgtgcttcctcagcagacgatatcgaggccatgcgcgctggggtcctgcctccacctcccaggcacgcctctaccggtgccatgcatcccctccggagcggcctgcttaactccaccagcgacagcgacttggtgagataccggaccatcagcaagattccacagattactctgaatttcgtggatctgaaaggtgatcccttcctggcttcaccaaccagtgatcgtgaaatcatagctcccaagattaaggaacgcacccacaacgtcacggagaaggtgacccaggtgttgtccctgggagccgatgtgctccccgagtataagctccaggcccctagaattcataggtggacaatccttcattattccccatttaaagcagtgtgggactggctgatcctgctcctggtcatttatactgccgttttcactccttacagcgcagcctttctgctgaaggagacggaggagggacccccagctactgaatgtgggtacgcatgccagccactggcagtggtcgatctaatcgtggacatcatgtttatcgtcgatatcctgataaacttccgcactacatatgtaaatgcaaatgaagaggtagtgtcccacccaggaaggatcgcagttcattactttaaaggatggtttctaattgatatggtagccgctatacctttcgacttgctgatcttcggtagtggtagcgaagaattgatcggcctcctcaaaaccgctcgactgctgaggttggtgcgcgtggcccgtaagctggaccgttacagcgaatacggcgctgctgtactcttcctgcttatgtgtacattcgcattgatcgcccattggctggcctgtatatggtacgctatcggcaatatggagcagcctcacatggattcccgcattggatggttacacaatcttggcgatcagataggaaaaccatacaattccagtgggctgggcggacccagtatcaaggacaagtacgtcaccgcgctgtactttactttttcaagtctcacctcagtggggttcggcaatgtgtccccgaataccaacagcgagaaaatttttagcatatgtgtcatgctcattggcagtcttatgtatgcttctattttcgggaacgtgagtgctataatccagaggctgtactccggcacagccaggtatcacacgcaaatgctccgagtgagggagttcattagatttcatcaaattccgaacccacttcgtcaacgacttgaggagtactttcagcacgcttggtcatacactaacggaatagatatgaacgccgtgcttaagggctttcccgagtgcctgcaggccgacatctgtttgcacctgaatcgtagcctgcttcagcactgtaagccatttcgaggcgctaccaaggggtgcttaagggctctcgccatgaaattcaaaaccactcatgcgccacccggtgacaccttggtgcacgccggtgatctgttaacggcactttactttattagccgcggatcgattgagatcctgaggggggatgttgtggttgccattctcggaaaaaacgacatttttggcgaacccttaaacttgtatgcacggccagggaagtctaacggcgatgtcagagccttgacatattgtgatctccataagatccacagagatgaccttctggaagtgttggacatgtatccagagttcagtgaccatttttggagctccttggagattacatttaacctgcgtgacaccaacatgatccctggcagccccggatctacggagctggaggggggtttcagccgccagcgaaagcgcaagctaagctttcggagaaggaccgataaagataccgaacagcccggagaagtgtctgctttgggtcctggaagggcaggtgctggccctagcagtagagggagaccaggaggaccgtggggtgaatcacccagctcagggccttcctcaccggaaagctctgaggacgagggaccaggaaggagtagttcccccttgcggcttgtgccattctccagtccacggcctccaggagaaccccctggaggagagcctctcatggaggattgcgagaaatcttcagacacctgtaacccactctcaggagcattttcaggtgtgtccaatatcttctcattttggggcgactcgaggggacgccaataccaggaactgccaagatgccctgccccaacaccatcactgctcaatattcccctctcttcacccggtcgtcggccaaggggcgacgttgagagccgcctcgatgcactccagagacaactgaatcgcctggaaacaagactgtctgccgacatggcgaccgtgctccagctccttcagagacagatgacactggtgccgccagcctacagcgctgtgaccacgcccggacctggccctacaagcacatcccctctactgcctgtaagtccactgccaacgttgacactagattctcttagtcaggtgtctcagttcatggcttgtgaggagcttccacctggcgctcctgaactgcctcaagagggccctactcggagactgtctctaccaggacaactgggtgcccttactagccagcctctacatcgccatggctctgatcctgggtcatag

SEQ ID NO: 235804 - DNA, 2460 bp, Artificial Sequence
  Description of Artificial Sequence: Synthetic coding sequence
atggctgctcctgctgggaaggcatcacgaaccggggctctccgacccagagcacagaaaggccgagttaggcgggcagtgagaatctcttccctagtggctcaagaggtgttatctcttggggctgacgtgttgccagaatacaagctccaagccccacgtattcacagatggaccatcttacactactcaccatttaaagccgtatgggactggttaatcttgcttctggtgatctacaccgcagtgtttacaccctattctgctgcttttctgctaaaggagactgaagaaggcccaccggctaccgaatgcggctacgcttgccagcccttggcagtcgtcgatttgattgtggatatcatgtttattgtggacattctgatcaacttccgtacaacttacgtgaatgcgaacgaggaagtcgtaagtcacccaggcagaattgcagtgcattatttcaaagggtggttcttgatcgacatggttgctgctattccctttgatctgctcatcttcggaagtggctcagaagaactaatcggactgctcaaaactgccagactactacgcctggttcgggttgcgagaaagttagatcgctattctgaatacggagccgctgtgctctttttgttaatgtgtacattcgcactgatagcacactggctcgcctgtatttggtacgccattggcaatatggagcagcctcacatggattcgaggatcgggtggctgcacaatctgggcgatcagatcggtaaaccctacaattcttctgggctgggcggaccttccattaaagacaagtacgttactgcgttgtacttcaccttctcaagtctcacatctgtgggctttgggaacgtctctcctaacacaaattctgaaaagattttcagcatctgcgtgatgctgatcggcagtctcatgtatgcctcaatcttcggaaatgtgagcgccattatccagcgcctgtacagcggtacagcgcgttatcatacccagatgttacgtgttcgcgagttcatcaggtttcatcaaattccaaatccattgagacagcggctggaggaatactttcagcacgcttggagctatacaaacgggattgatatgaatgccgtactgaagggcttccctgaatgcctgcaagctgatatctgccttcacttgaaccgcagtctgttgcagcattgtaaaccatttaggggagccactaaggggtgtctgcgcgcacttgctatgaagttcaagactacacacgcccctcctggggatactttagtacatgcaggcgacctgttgaccgccttatatttcatctcacggggaagcatagagatccttcgcggagatgtagttgtggctatcctcggcaagaacgacattttcggggaaccattaaacctctacgctcggccaggcaaatcgaatggggatgtgcgcgcactgacttactgtgacttgcataagatccatcgggacgacttgctcgaggtgctggacatgtacccagaatttagcgaccacttctggtcaagcttggaaatcactttcaatttgcgggatacaaatatgatcccgggttccccaggatcgacggagctcgaggggggattttcgcgacaaagaaaaagaaagttatcattccgccgacgaaccgacaaggatactgagcagccgggagaggtgtctgcactggggccaggcagagcgggagccggaccgagtagtaggggcagaccgggaggcccatggggggaatcgccatccagtgggccttccagtccagagtcatcagaagatgagggccctgggaggtccagttctcctttgcgtctggtccctttcagctctccgcgacccccaggtgaacccccaggcggagaacccctcatggaggattgtgagaagtcctccgacacatgtaaccctctaagcggcgcattttccggcgtgagcaacatcttctctttttggggcgacagtcggggacggcagtaccaggaactgcccaggtgtccggctcccaccccctcccttctgaatataccactgagcagtccagggaggagacctcgcggagacgtggaatctaggctggacgccctgcagcggcagcttaatcgcctggagactaggctctctgctgacatggccactgtgctgcagctcctccagcgacaaatgactttggtgcccccagcttacagtgcggtgacaacgccaggaccaggtccaactagtacatcccctcttctgcctgtctccccactgcccacccttactttggatagtctttctcaggtaagccagtttatggcctgtgaggaactcccccctggtgcccctgagctgcctcaggaagggcctacccggaggctttccctgcctggccagcttggagccctgacctcccagcctctgcataggcacggttccgaccctggatcctag

SEQ ID NO: 235805 - DNA, 1182 bp, Artificial Sequence
  Description of Artificial Sequence: Synthetic coding sequence
atggccgcaccggctggaaaagcaagccggactggcgcactgcgacccagggctcagaaggggcgagtccggagagctgtgaggatttcaagcctggtcgcccaagaagtactgtcccttggagctgatgtcttacccgagtacaagcttcaagctccaaggatccacaggtggactatattacattactcaccattcaaggccgtgtgggactggcttatactgctgctagtgatctacaccgcagtcttcacaccttattcagccgctttcctgctgaaagaaactgaggagggccctccagctacagagtgcggatacgcgtgtcagcctctggccgtcgtggatttgattgtggatatcatgttcattgtggacatacttatcaatttcagaacgacctacgtaaatgccaacgaagaggtggtttcccaccctgggagaatcgcagtgcactactttaaaggttggtttctgatagacatggtggccgctattccttttgaccttctgatttttggaagtggatctgaagagctgatcggactcctgaagactgccagacttctacgactggtgcgcgtggctcgcaaactggatcggtacagtgaatacggagccgcagtcctttttctgctaatgtgtacttttgccctcatcgcccactggctcgcctgtatttggtacgcgatcggcaacatggagcagccccacatggattcaaggatcggatggctgcacaacttgggagaccagatcgggaagccatataatagctccggccttggtgggccttctataaaggataaatacgttacagctctgtactttactttttcctccctgacctctgttgggttcggaaacgtcagtccgaatacaaactctgagaaaatcttttccatctgtgtgatgctcataggaagtctcatgtatgcgagcatttttgggaacgtgagcgctattatccaaagactgtattccgggaccgccaggtaccatactcagatgttacgggtcagagagttcatccggttccaccagatccctaaccctctgaggcagtgctgcgaccatcccggagcttggccgcacttccacataccagccgtggccagacaaccgccaccacacccccacctcggcctggccttttccggtttccctgttcacggagtttag

SEQ ID NO: 235806 - DNA, 3192 bp, Artificial Sequence
  Description of Artificial Sequence: Synthetic coding sequence
atgtcttcccacagcgccggtagttgttttttatgcctggtagacgtggtccctgtcaagaacgaggacggggctgttatcatgttcatcttgaacttcgaggtcgttatggagaaggacatggtcgggagtccagctcatgatacaaatcatcgtggtccacccacttcttggctagcccctggacgcgcaaagaccttcaggctgaagttgcccgctctcttggccctgactgctcgtgagagcagcgtccgctccggtggggcaggaggcgcaggagcacccggagctgttgttgtggatgtcgatttgactcccgcagctcctagctcggaaagcttagccttagatgaggttacagcaatggacaaccacgttgccggactcggacctgctgaggagaggagggctctggtggggcctggtagcccaccacggagtgctcccggtcagctgccttccccccgtgcccactcactcaacccagatgccagtggaagctcctgctctctggccagaacgcggagtcgcgagtcctgcgcttccgtgcgccgtgcaagcagcgcagacgacattgaagcaatgcgagctggcgtgctcccacctccccctcgccacgccagtacaggggcaatgcatccactgcgcagcggactgctgaactctacctcagacagcgatttggtcaggtaccgtacaatctccaaaataccccaaatcaccctcaactttgttgacctcaaaggcgacccatttttggcctcaccaacatcagatagggagattattgccccaaagattaaggagaggacacacaacgtcactgaaaaggtaacacaggttctgtcactgggagctgacgtcctgccagaatataagttacaggcaccgaggatccaccgttggaccatactccactatagccctttcaaggctgtgtgggactggttaattctattgctggtgatatatacagcagtgttcaccccttactctgccgctttccttcttaaggaaaccgaagagggaccccctgctactgaatgcggctatgcatgccagcccctcgcagttgtcgatctcattgtcgatatcatgtttatcgtcgacatcctgattaactttcgaacgacctacgtcaatgcaaacgaagaggtcgtatctcaccctggacgcattgccgtgcactacttcaagggttggtttctgattgacatggttgctgcaatcccctttgatctcctgattttcggctccgggagtgaggaactgattggcctcctgaaaacagctcgtctgttgcgtctggttagggtagcgcgaaaactggataggtatagtgagtacggagctgcagtactcttcctgctgatgtgcaccttcgcattgatcgctcattggctagcatgcatttggtacgccatcgggaatatggagcagcctcatatggactcacgaattggctggcttcataatctaggtgaccagatcgggaaaccctataatagttccggcctgggagggccaagcattaaggataaatacgtgacagccctatattttacatttagctctctcacttctgtgggtttcggtaacgtgtcacccaatacaaactcagagaagatttttagcatctgtgtgatgctgattggttctctgatgtatgcctctatttttggtaacgtttctgccatcatccagcggttgtattcagggaccgccagataccatacacaaatgctgcgcgtgcgagagtttattcgcttccatcagatccccaaccctttaaggcagcgcctggaggagtactttcagcacgcctggtcctacacaaatgggatcgacatgaatgctgtgctcaaaggcttcccagagtgcttgcaggccgacatttgcttacacctgaacagatcactcttacagcactgcaagccctttcggggagcaactaagggatgcctgcgagctttggcaatgaaattcaagacaacccacgccccacccggagacaccctagttcatgctggcgatctcttaaccgccttatatttcattagccgcggatctatcgagatcctccgtggtgacgttgtggtggccattctcggcaagaacgatatttttggggaacccctcaacttgtatgcccgtccaggcaagtccaatggcgacgttagagcactgacctactgcgacttgcacaaaattcaccgtgatgacctgctggaggtgctggatatgtaccccgaattcagcgatcacttttggtcttcactcgagatcacatttaatcttagggacacgaacatgatcccagggtctcctggatccacggagctcgaggggggtttcagtaggcagaggaaaaggaaactgtctttccgcaggaggaccgacaaagacaccgaacagcctggggaagtgtccgcactcggacccggaagggctggcgcagggccttcctcaaggggacggccaggcggaccatggggggaatctccgtcatcgggcccatctagtcctgagtcatccgaggatgagggccctggccgatcttcctctccgctgcgcttggtcccgttctcttctccgagacctcctggcgaaccaccagggggagagcccttgatggaagattgcgagaaatcaagtgatacgtgcaatcccctgtcaggagcctttagcggcgtgtctaatattttctctttttggggggatagccgcggtcggcaataccaggagctgccacgttgtcccgcacctacaccatcattgctcaacataccactttcttcacccggacgcaggcccagaggtgacgtggagtccaggctcgatgccctccagcgccagctgaaccggttagagacacgcttgagcgccgacatggctacagtgcttcagttgctccagaggcagatgactcttgtgccgccagcatactccgctgtcaccacaccaggacctggcccaaccagtacttcacctctgcttccagtgagtccacttccaactctcactctcgactccctctcgcaggtgagccagtttatggcctgtgaagagctgcctcccggtgctcccgagttgccccaggagggacccacgcggcgactcagcctgcccggtcagctgggcgctctcacaagtcagccgctgcaccggcatggctctgatcctggttcatag

SEQ ID NO: 235807 - DNA, 2667 bp, Artificial Sequence
  Description of Artificial Sequence: Synthetic coding sequence
atgccagttagacggggtcacgttgctcctcaaaacaccttcttggacaccatcatcaggaaattcgagggtcagtctcgcaagtttattatcgccaatgctagggtggaaaattgcgctgtaatctattgcaacgacggtttttgcgaactgtgcggatatagtcgggctgaggtgatgcagagaccgtgtacctgcgactttttgcacggaccaaggacacagaggcgcgcagctgcacagatcgcgcaggcactcttgggagcagaggagagaaaggtggagattgccttctataggaaggacggcagttgtttcctgtgtttggtcgatgtggtgcctgtgaagaacgaggatggagccgtaatcatgttcatcttgaacttcgaagtggttatggagaaggacatggtgggaagtccagctcacgatactaaccatcgcggacccccaacttcctggctcgccccagggcgagccaagacctttcgactcaagctgcccgcactgctcgctctcacggctcgggagtcttcagtgcgaagcgggggtgcgggaggggcaggcgcaccaggcgcagtggtggtggatgtagatctgactcctgctgcgccttcttccgagagcctcgctctagacgaggtgaccgccatggacaaccacgtcgctggcctgggccctgccgaggagcgcagagctctggtgggccctggatccccccctcggtccgctcctggacagcttcctagcccccgagcccactcactcaacccggatgctagcggatccagctgctcgctcgctcgcacgcgttctagagaatcatgcgcttccgtgcgcagggcatccagcgcagacgatatcgaggccatgagggccggagtgcttccccctccccctaggcacgcatccacgggcgcaatgcatcccctccggagcggactgctgaacagcacgtccgacagcgacctcgtgagatacagaactatctcaaagatcccccagatcactctgaacttcgtggacttgaagggcgatcccttcctggcctcccccaccagcgatagagagataattgccccaaaaattaaagagagaacccataatgtcacggagaaggttacccaggtactatcacttggagcagacgtactgcccgaatacaaactacaggcacctcgtatccatagatggaccatcctgcattattctccttttaaagccgtctgggactggctgatcttactcctggtaatctatactgctgtattcactccttacagtgctgcattcctgctcaaggaaacagaggagggcccacccgcaacagagtgtggttacgcatgccagccactcgccgtcgtggaccttatcgtggatattatgttcattgtcgacatactcattaatttccggactacatatgtgaacgcaaatgaggaagtggtttcgcaccctggcagaattgcagtgcactattttaaaggctggttcctcatcgacatggttgctgcgatcccttttgacctactcatcttcgggtcaggttcagaggagctcatcgggcttctcaaaacggcccgactactcagactggttagggtcgccaggaaattggaccggtatagcgaatatggcgctgcggtgctcttcttgctgatgtgcactttcgcactcatcgctcactggctggcctgcatctggtacgctatcggcaacatggaacagcctcacatggactctaggataggctggctccacaatcttggagaccagatcggcaagccttacaatagctctggtctgggcggtccttctatcaaagacaaatatgtgaccgctctttatttcaccttttcttccctcacttcagtggggttcggcaatgtgtccccaaatactaattctgagaaaatatttagcatctgcgtaatgctcatcggtagcttaatgtatgccagcatattcggaaatgtgtcagctattatccagagattatatagcggaacagctcgataccacactcagatgctgcgagtgcgcgagtttatccggttccatcagattccaaatccgctgcgccagagactcgaggaatactttcagcatgcctggagttatacaaacgggatagatatgaacgcagttctgaagggattccccgagtgtctccaggcagatatttgtttgcacctgaacaggtccctgttgcaacactgcaaaccatttcggggagccacaaaaggatgtctgcgcgctctggccatgaagttcaagaccactcacgccccacccggagacactctggtgcatgctggagacctgcttacagccctgtacttcatctctaggggaagtatcgagatattgagaggcgatgtggtcgtcgccatcttagggatgggctggggagctggcaccggtctggaaatgccttccgctgcaagtcgaggagcaagcctattaaatatgcaaagccttggcctttggacttgggattgtctgcagggccactgggcacctctcattcatctaaatagcggccctcccagcggagctatggagcggagcccgacctggggggaagcagccgagctgtggggtagccatatcctgctgccttttcgcatacgtcacaagcagaccctttttgcctccctgaagtag

SEQ ID NO: 235808 - DNA, 3252 bp, Artificial Sequence
  Description of Artificial Sequence: Synthetic coding sequence
atgcctgccatgcgcggtctgcttgccccacaaaacactttcttggacactatagccacaagattcgatggaacacacagcaattttgtgctaggcaacgcacaggtcgccggactctttcccgtagtctattgctctgacggcttttgtgatttgactggattttctcgcgctgaggtgatgcagcgtggctgcgcctgctcctttctctacggcccagatacttctgaattggtgcggcagcagatccggaaggcactggatgaacataaggaattcaaggccgagctcatcctctatcggaaatctggattacctttctggtgcttgcttgacgttatccccatcaaaaacgaaaagggcgaagtggcactttttctcgttagccacaaggatatctccgagaccaaaaatagaggtgggcctgatcgctggaaagagacagggggtggcaggaggagatacggacgcgctcgttccaaaggtttcaacgcaaatcggagacgtagtagggccgtcctgtatcacctttctggacatttacagaagcaaccaaagggcaaacataaactgaataagggggtcttcggtgaaaaaccgaaccttcctgaatacaaagtcgctgctatccggaagtccccttttatccttctgcactgtggcgctttgcgcgctacttgggatggttttatcttgctggccaccctttatgtggctgtgacagtgccctattctgtgtgcgtgtccactgcccgtgagccctccgctgcaagaggacccccatctgtctgcgacctggctgtcgaggtgctgtttatacttgacattgtgttgaatttcagaacaacatttgtgtctaaaagtggtcaggtcgtgtttgccccaaagtcaatatgccttcactacgtgaccacatggttccttctggacgttatcgcggctctgcctttcgatcttcttcatgctttcaaggttaacgtgtattttggagcacatctcctgaagaccgtgcgcctgctccgactattgagattactgccgaggctcgacaggtactctcagtactccgccgtggttctgacgctgttaatggcggtatttgcactgcttgctcattgggtggcctgtgtatggttttatattgggcagcgcgaaattgagtccagtgaatcagagctcccagagattgggtggctgcaggaattggctagacgtcttgagaccccctactaccttgtggggcgtcgacctgccggaggaaactcctcaggccagtcagacaactgctcttcatcatctgaggccaacggcactgggctagaactgttgggtggcccttccctccggtccgcctacatcactagtctgtacttcgctctcagctcactcacctcggtgggctttggcaatgtttctgctaacactgataccgagaagatattcagtatatgcaccatgcttattggagcacttatgcatgctgtcgtttttgggaacgtgaccgcaatcatacagagaatgtacgctagacgcttcctctaccacagcaggacacgggatttaagggactatattcgaatacatagaatcccaaaaccacttaaacagcgcatgctagagtacttccaggccacgtgggcggtgaataacggtatcgacaccacagagctgctgcagtccctgcctgatgaactcagagccgacatcgctatgcaccttcataaggaggtactccagctgcctctgtttgaagcagcatctcgtggctgcttgagagctctcagtttggccctgaggccagccttctgtactccgggtgagtatctgatccaccagggggacgccttacaggcactctattttgtgtgttctggatccatggaagttcttaagggaggcacagttctggctatcctggggaagggggacctgattggatgcgagcttccacgcagagagcaggttgtgaaggcaaacgcagatgtcaaaggtctcacttattgtgtgcttcagtgtctgcaactggcaggacttcacgactctctagcgctgtacccagagttcgctccacggtttagtcggggtttgcgcggagagttgagctacaatctgggtgcaggcggaggctcagctgaggttgacacaagctctctatctggggataacacgctcatgtcaactcttgaagaaaaggagacagatggggaacagggaccaaccgtgtcacccgcaccagcagatgaacctagttctccattgctgtctcccggttgcacatcttctagctccgcagccaagctactttctcctcgcaggacagctccccgacccagactgggagggagaggtcggccaggccgagccggagccctgaaggctgaagcaggcccatctgcccctccaagggcactcgagggcctgcgcctgccacctatgccatggaatgtaccaccagatctctctccacgggtggttgacgggattgaggatggctgcggaagcgaccagccgaaattctccttcagagtcggtcagagtggacctgaatgctctagctcccctagccccggacctgaaagcgggcttctcacggtcccgcatgggccaagcgaggcgcgtaacacagatacactcgacaaactgcgccaggccgtgaccgagctttcagagcaagttctacagatgagggagggcctgcagagcctgaggcaggcggtgcagcttgttctagctccacacagggaggggccttgtccaagggcatctggggaaggcccatgccccgcttccacctctggtcttctccagcctctttgcgtggatacaggtgcgtcgtcctattgtttgcagcccccagccggtagcgtgctctctggaacttggccccaccccagaccaggcccacctcctctgatggccccatggccttggggaccaccagccagtcagagcagtccctggcctcgagccactgccttttggacctcaacctccgacagcgagccccctgcaagcggggatctctgctctgaaccctctactcctgcctctcccccaccttctgaagagggagcccgaaccggacctgccgaaccggtgtcccaggccgaggctaccagcacaggcgaaccccctcccggaagtggcggtttagcgctgccctgggacccacactccttggagatggtcctcattggctgccacgggtctggaaccgtgcagtggacccaggaagaaggcaccggggtatag

SEQ ID NO: 235809 - DNA, 2967 bp, Artificial Sequence
  Description of Artificial Sequence: Synthetic coding sequence
atgccagggggtaagcgcggtttggttgcacctcagaacacattcctggaaaatatcgtcagaagaagctctgagagctcctttctgctgggaaacgcacagatcgtggactggcccgtggtctattccaacgacgggttttgcaaactgtccggctaccaccgcgctgacgtgatgcagaaatcgtccacttgttcgttcatgtatggcgagctgacagataaaaaaacaatcgaaaaggtgaggcagacttttgataactatgaatctaactgctttgaggttctgctctacaagaaaaatcgcacccctgtgtggttctacatgcagatcgccccaatccgaaacgagcatgagaaggtggtcctcttcctctgcacctttaaggacatcacactgttcaaacagccaatcgaagatgactccaccaaaggctggaccaagttcgcgcgtttaacacgggcactcacaaattctaggagcgtattacagcagctgactcccatgaataaaaccgaagttgttcacaaacacagcagactagccgaggtgctgcagctgggtagcgacatcctccctcaatacaagcaggaagccccaaaaacccctcctcacatcatccttcactactgtgctttcaagacaacctgggactgggtcatcctcatcttgaccttctacactgccatcatggtgccttacaacgtcagcttcaaaacaaaacaaaataacatcgcttggttagtgcttgattctgtggtcgacgtgattttcctggtggatattgttttgaactttcatacaacattcgtgggtccaggaggtgaagtcatttccgatccaaagttaatccggatgaattaccttaaaacatggtttgtcattgatttgttgtcatgcttaccctacgacatcattaatgcattcgagaatgtggacgaaggaatctcatctctgttcagctccttaaaagtggttagacttctgcgcttgggccgtgtcgctcggaagctggatcactacctggagtacggagcagcggtgttggtgctgctggtgtgcgtatttggacttgttgctcattggctcgcttgtatctggtactctattggggactatgaggttatagacgaggtcacaaacacgattcagattgattcatggctttaccagctagccttgagcattggcaccccttaccgatataataccagtgcaggtatttgggaaggcggaccatccaaagactccctctatgtgagttcattgtactttaccatgaccagcctaactacaatcggctttgggaatattgccccaaccactgatgtcgaaaagatgtttagtgtcgccatgatgatggtgggctctctgttatatgccaccatcttcgggaatgtgactacgatctttcagcagatgtacgcaaacacaaatcggtaccatgaaatgctgaacaatgttcgagattttttgaaattgtaccaggtcccgaaagggttgtccgaaagagtaatggactatattgtgtcaacgtggtcaatgagtaaaggaatcgacacagaaaaggtgctctctatttgcccgaaggatatgagggccgatatttgcgtacacttgaatcggaaagttttcaatgaacatcctgcgtttcggctggcatcagacgggtgtctgagggcactggctgtcgagttccagacaatccactgtgcgccaggagacctgatctatcacgctggcgaatccgttgatgctctgtgtttcgtggtgagcggctccctcgaggtgattcaggatgacgaggtcgtggcaatcctaggcaaaggtgacgtattcggggacattttttggaaggagacaacgttagcgcacgcctgcgctaacgtaagggccctgacctactgtgacctccacatcattaagcgggaagccctcctcaaggttctggatttctacacagcatttgctaatagcttctcaaggaatcttacccttacttgtaatttacgcaaacgtatcatcttccggaagatctctgatgtaaagaaggaggaagaggaacgcttgcggcagaaaaacgaagttaccctgagcatcccagtcgatcatccggtgaggaaactctttcagaaatttaagcagcagaaagaactgcggaatcagggaagcacccaaggggatccagaaaggaaccagcttcaggttgaaagtagatccctgcagaacggcgcttctattaccggaacctccgtcgtgactgtcagtcaaataacaccgatccagacctccctggcctacgtaaaaacatccgagagtctgaagcagaacaacagagatgctatggagttgaaacccaatggtggcgcagatcagaaatgtttgaaggttaatagcccaatcagaatgaagaacgggaacggtaagggatggctcaggttgaagaataacatgggcgctcacgaagagaagaaagaagactggaataatgtgactaaggcagaaagtatggggttactgtcggaggatcctaaaagctcagatagtgaaaacagcgtgactaagaatcctctgcgaaagactgattcatgcgatagcggaataaccaaatccgatctgcgcttggataaggctggagaggcccgtagtcccctggaacatagtcccatccaggctgacgccaagcatccattctaccccatccccgaacaggccctgcaaaccacgctgcaagaggtcaaacatgaacttaaggaggacatacagctgctgtcttgcaggatgacagctctggagaaacaggttgccgagatactgaaaatcctctcagagaagagtgttccccaagcctcaagtcctaaatcccaaatgccattgcaggtgcctcctcaaatcccttgccaggacattttcagtgtcagcagaccagaaagtccagagagtgacaaggacgagatacacttctag

SEQ ID NO: 235810 - DNA, 1269 bp, Artificial Sequence
  Description of Artificial Sequence: Synthetic coding sequence
atgcagaaaagtagtacttgcagtttcatgtacggggagctcacagacaagaagactattgagaaagtccggcagacatttgacaattacgagagtaattgctttgaagtcctgctctacaagaagaatagaactccagtgtggttttacatgcagatcgcgccaatccgcaatgaacacgaaaaggttgtgctattcttgtgtacatttaaagacattacacttttcaagcagccaatcgaggatgattctaccaagggctggactaagtttgcaaggctcacaagagctctcacgaatagtcggtccgtactgcagcagttaacacccatgaataagacagaggttgtgcacaagcactctagattggcagaggttctccagcttggaagtgatatcctcccacaatacaaacaggaagcaccgaagactcctccgcacattatcttgcattactgtgcctttaaaacaacctgggactgggttatcttgattttaaccttttataccgccattatggttccatacaacgtgagtttcaagaccaaacagaacaacatcgcatggctggtgctcgatagcgtggtggacgtgatatttctggttgatatcgtcttgaactttcacaccacctttgttggcccaggcggagaagtaatcagcgatcctaagctaattaggatgaattacctgaagacctggttcgttatcgaccttttaagctgcctcccgtacgatataattaacgcatttgagaatgttgacgagggtattagtagtttgttcagcagcttgaaggtcgtaaggctgctgcgcctggggagagtggccaggaaactcgaccactatcttgagtatggtgcagctgttttagtgctcctggtgtgtgtctttggtctggtggcccactggctggcttgtatttggtacagcattggcgactacgaagtgattgatgaggtgacaaatacaatccagatcgattcctggctgtatcagttagccctaagtatcgggaccccataccgatataataccagtgctggcatttgggaaggaggccctagtaaagatagcctttatgtgagcagtctgtatttcacaatgactagccttacaacaatcggttttggtaatattgctcctaccacagatgtcgagaagatgttcagtgtggcaatgatgatggtgggctgtaagtactttaattttttcatcgaaaactactgctattggcagttctcctggctacaaagccagatcgggtag

SEQ ID NO: 235811 - DNA, 2199 bp, Artificial Sequence
  Description of Artificial Sequence: Synthetic coding sequence
atgccagtaaggcgcggtcacgtcgctcctcagaatacgttcctgggtactatcatcagaaaatttgaaggacaaaacaaaaaatttattattgccaatgcccgtgtgcagaactgcgcaataatctactgcaatgatggtttctgtgaaatgacaggtttttctcgtccggacgtgatgcaaaagccatgcacttgcgactttctccatggccctgaaactaagcggcatgacattgcacagattgctcaggcccttctggggtctgaggaacggaaagtggaggtgacatactatcataagaatggctccacattcatctgcaacacacatatcatacctgtgaaaaatcaggaaggggttgctatgatgttcatcatcaatttcgagtatgtgactgacaacgaaaatgccgcaactccagagagagttaaccccatcctgcccataaagactgtcaatcgtaaatttttcggcttcaaatttccaggactgcgcgttctgacctataggaaacagtctctgccacaggaagacccagacgtggtagttatcgatagtagtaagcacagcgatgattccgtagcaatgaaacactttaagtctccaacaaaagagagttgcagccctagtgaggccgacgatactaaggccttgattcagccatccaaatgctctccattggtgaacattagtggaccactagaccactcctcaccaaaaagacagtgggaccgcctttatccagacatgctgcagtccagctcccagctgagccatagtcgctcccgagagtctttgtgttcgatccggagggcatcgagcgtccatgacattgaaggtttcggagtgcatcctaaaaatatatttcgtgacagacacgccagcgagggcccatttaatcacattaagagctcgctgctggggagtacaagcgactccaacttgaacaagtactccaccataaataaaatacctcagttaacgctgaacttcagcgaggtgaagaccgaaaagaaaaactcatcacccccatctagcgacaagacaatcatcgctcctaaggtcaaagatagaacacacaatgtgacagagaaggttactcaggtgctgagtctcggcgcagacgtgttgccagagtacaagctgcagactcccaggatcaacaagttcacaatcctccactactctccgtttaaagcggtatgggactggttaattctactacttgtaatctacaccgccatttttactccctattcagctgccttcctgttgaatgatcgggaggaacagaaacgcagggagtgtgggtatagctgctctccactgaatgttgttgacctcattgtggatatcatgttcatcatcgatatcttgatcaactttaggactacatacgttaaccagaacgaggaggtggtgtctgaccctgccaagatagcaatacattactttaaggggtggttcttgatcgatatggtcgccgcaattcctttcgatctcctgatcttcggatcaggtagcgacgagacgactaccctgattggtcttttgaaaactgctcggctgttgagactcgtgagagtcgcacgcaaattggacagatatagcgaatacggcgctgccgtgctgatgcttttaatgtgtattttcgctttaattgcacattggctagcctgtatctggtatgcgatcggaaacgtcgaacgcccatacttgaccgataaaatcggctggctggacagcttaggtcagcaaatcggcaagcgctataacgattctgactcttcttcaggcccatccattaaagataagtatgtcactgctctctattttacgttttctagtcttaccagtgtcggctttggtaacgtctccccaaacaccaactccgaaaagattttctcaatctgcgtgatgttgatcggctccttgatgtacgcaagcatcttcggtaatgttagcgccattattcagcgtctctactcaggcaccgctaggtaccacatgcagatgctgagggtgaaagaattcatcagatttcatcaaattcccaaccccctccgccagcgcttagaagaatattttcagcatgcatggacttatactaacggcattgacatgaacatggtgtgcatgagcgtctttcagaacgaaagtgccgctgggattattgtgattgcgaaaatggagtag

SEQ ID NO: 235812 - DNA, 3591 bp, Artificial Sequence
  Description of Artificial Sequence: Synthetic coding sequence
atgcccgtcagacggggtcacgtggcaccacagaacactttcttgggcaccatcatcagaaagttcgaaggtcagaataagaagttcataatcgcaaatgctagggttcagaactgcgcaatcatttactgtaatgatgggttttgcgaaatgacaggcttcagccgacctgacgtgatgcagaagccatgcacatgcgacttcctgcacggccctgaaactaaacgccacgacattgcgcagattgcacaggcactactaggatccgaggagcgcaaggtggaagttacttactaccataaaaacgggtccacctttatctgtaacactcacatcatccccgtaaagaaccaggagggtgtggccatgatgtttataattaacttcgaatacgtcacggataatgagaacgcggcaacgcccgagagggttaatcccattctacctatcaagacagtgaacaggaaatttttcggtttcaaatttccgggtttacgcgtcttgacatatagaaagcagtccctaccacaagaggatccagatgtcgttgtaatcgactcatctaagcattctgacgacagtgtggcaatgaagcacttcaagagtcctactaaggagagttgctcgccttctgaagccgatgataccaaggctctgatccagccctcgaaatgctccccactggtgaatatatccggtcccttggaccacagttctccaaagcgtcagtgggatcggttgtacccggacatgctgcaatcctcatcccagttatcacacagcaggtctagggaaagtttatgttctattaggagggcaagttccgtgcacgatatcgagggattcggtgtgcatcccaagaacatatttcgggaccggcatgcaagcgaagacaatgggcgtaacgtcaaagggcctttcaaccacattaagagcagtctcctcggctctacaagcgattctaatctaaataagtacagtactatcaataaaatcccccaacttacactcaatttctccgaagtaaagaccgaaaaaaaaaacagcagcccaccctcttctgataaaaccattatcgctcccaaggtgaaagatcgtacgcataacgtcacagagaaggttacacaggtcctctcactcggggcagatgtactgccggagtataagctacagacccccagaattaacaaatttaccatcctgcattatagtccctttaaggccgtttgggactggctgatcttactcctggtgatctacaccgccatcttcaccccatatagcgcggctttcttactgaatgatcgtgaggagcagaaaaggagggagtgtggttattcctgctcacccctgaacgtggtagatttgatcgttgatatcatgttcattattgacatcctcattaacttccggactacgtacgtcaaccagaacgaggaggtcgtcagcgacccagcaaagatcgcaatccattactttaagggttggtttctgattgatatggttgctgcaatcccatttgacctcttgatattcgggtctggcagcgatgagaccaccacacttatcggcctgctaaagacggcacggcttcttcgccttgtgcgggttgctcgtaagcttgatcggtatagcgagtacggggcagcggtgcttatgctgctgatgtgtatctttgcccttatcgctcactggctggcatgcatctggtacgctattggcaacgttgagcgcccttacttaaccgacaaaatcggatggctggattctctcggccagcagattggcaaacgctacaacgacagcgattccagctctggcccatctataaaagacaagtatgtgaccgccctgtattttacatttagttctctgacctccgtcgggttcgggaatgtctcccccaataccaactctgagaaaatctttagcatatgcgtaatgctgatcggctctctcatgtacgcaagtatctttggaaatgtaagcgcaatcattcagagattgtattctggcaccgctcggtaccacatgcagatgctgcgggtgaaggagtttattcggtttcaccagattcctaaccccttacgccagcgattggaagagtatttccagcacgcatggacctatacaaacggcattgatatgaacatggtgctgaaaggtttcccagaatgtctgcaagcagatatttgccttcacttgaaccagacactgctccagaattgtaaagcctttcggggagcctctaaagggtgtctgagagcactggccatgaaatttaaaaccacacacgcaccacctggggatacacttgtgcattgcggtgacgttttgacagccctttacttcctcagccggggttccatcgaaattttgaaggacgatatcgtagtggccatcctcggcaagaacgatatatttggcgaaatggtgcatctttatgccaagcctggcaagagcaatgctgacgttcgggcactaacatactgcgacttgcacaaaatacaacgggaggacctgttggaagtcctggatatgtaccccgagttcagcgaccatttcctaactaacctagaattaacatttaatctgagacacgagtccgcaaaggctgacctgctgcgatcgcagtcaatgaacgacagtgaaggagataattgcaagctgcgcaggcggaagctaagctttgagtctgagggagaaaaggaaaacagcacgaatgatccagaggacagcgctgacacaatccggcactaccagtcatcaaagcggcatttcgaggaaaagaaaagccgatctagctccttcattagtagtatcgatgacgaacaaaaacccctgttcagcggtattgttgattcaagtcctgggattggaaaggcctctgggttggactttgaggagactgtgcctacctcaggccgtatgcatattgataagcgctcccactcttgtaaggatattactgacatgaggagttgggagcgggagaacgcacatccacagcccgaggatagttcaccaagcgcattgcagagagccgcttggggcatcagcgagactgagagtgatcttacttatggcgaggttgagcaacgccttgatctgctgcaggagcagctgaaccgtctggaatcacagatgaccacagatattcagactatactgcagttgttgcagaagcagaccactgtagtcccacctgcatattccatggtcactgccggttctgagtaccagaggccaatcatacagctgatgcggacgtcccagcccgaggcgagtatcaaaactgatcgcagcttcagtccctcatcccaatgtcccgaattcctggaccttgaaaagtcaaagctgaagagtaaggagagcctgagttcaggtgtgcacttgaataccgcttctgaggataaccttaccagcctgttgaagcaggactccgatctgagtcttgaactccatctgaggcagcgcaagacctacgtgcatccgatcagacacccctccttacccgacagttcactgagcaccgtagggattgtcggccttcaccgacacgttagtgatccagggctgcccggtaagtag

SEQ ID NO: 235813 - DNA, 1755 bp, Artificial Sequence
  Description of Artificial Sequence: Synthetic coding sequence
atggtcgctgaggtgtgctcaatgccaaccgcttccacagttaagaagccttttgatctccgatccaaaatgggaaagtggtgtcatcataggttcccatgctgtagaggaagcggaaagtccaatatgggtacatcaggcgaccacgacgattcctttatgaaaatgctgcgcagcaaaatggggaaatgctgccgtcattgcttcccttgttgcagaggcagcgggacctcaaatgtcggcacctctggcgatcatgagaattcctttatgaaaatgctcagaagtaagatggggaaatggtgttgtcactgttttccctgttgtcggggatcagggaaatcgaacgtaggcgcatggggggattatgaccacagcgcctttatggaacccagataccatatccgacgggaggatctggacaaactgcatagagccgcttggtggggaaaagtgccaagaaaagacttgattgtgatgttaagggatacggacatgaacaagagggataaggagaaacgaacagcccttcacttggcttccgcgaacggaaattcagaggtcgtgcaattgctcttggaccgcaggtgccagcttaatgtgctcgataacaagaagagaactgccctgataaaagccatccagtgccaagaagatgagtgcgtgctcatgctgctggaacatggcgcagatcgaaacatccccgacgaatacgggaatacagcgctgcactatgcaatctacaatgaagacaaattaatggccaaggctctcttgttatacggggctgacattgagtcaaagaacaagtgcggactgaccccactgctcctaggagtgcatgaacagaagcagcaggtcgtaaagttcttaataaagaaaaaagccaatctgaacgtcctcgatcgctacggacgcacagccttgattctggctgtgtgctgcggaagcgcttcaattgtcaacctcctcctggaacagaatgtggacgtgagctcccaggacctctcaggacagaccgccagagagtacgccgtttcgtctcatcatcacgttatatgcgaactgctgagcgactacaaagaaaaacagatgcttaagatctcttctgagaacagcaatcctgagcaggacctaaagctcacatcagaagaggagtcccagaggctgaaggtaagtgagaattcccagccagaaaaaatgagtcaggaaccagaaattaacaaagactgcgaccgcgaggtggaagaggagataaaaaagcatggaagcaaccccgttggcctccctgaaaatttgacaaatggggcttccgcagggaacggcgatgacggattgatcccgcagcggagaagcaggaaacctgaaaaccagcagttccccgatacagaaaacgaggaataccacagtgacgagcagaatgatactcgcaagcagctatctgaagagcagaatacaggaatcagccaggacgaaatactgactaataagcagaaacaaatcgaggttgccgagcagaaaatgaactccgaattaagtttgtctcacaagaaggaggaggatttgctgagagaaaattctgtgttacaggaggaaatagcaatgctcagacttgaactggacgaaacgaaacatcaaaaccaactccgggagaataagatccttgaggaaatcgagagcgtgaaagaaaaaacagataagctactgcgtgcaatgcagctcaacgaagaagccctcacgaaaacaaacatctag

SEQ ID NO: 235814 - DNA, 1638 bp, Artificial Sequence
  Description of Artificial Sequence: Synthetic coding sequence
atggtagctgaggcgggatccatgccagcagcgagctccgtcaaaaaaccgtttggcctgcgctctaagatgggcaagtggtgcaggcactgcttcgcctggtgtcgcggatcaggcaagtccaatgtgggcacttccggagatcatgacgattccgctatgaaaactctccggagcaagatggggaagtggtgttgtcactgcttcccttggtgccgcggaagcggaaagagcaacgttggcacctcaggcgatcatgatgatagcgccatgaaaacgttgcgaagcaagatgggcaagtggtgttgtcactgcttcccctgttgtcgcggatctggcaagtccaacgtaggcactagtggagatcacgatgatagcgcaatgaaaaccctccgttccaaaatgggaaaatggtgctgccactgctttccttgctgtcgtggcagcggtaagaataaagtcggcccttggggtgattatgatgatagcgcattcatggagcctaggtaccacgtccggagagaagacctggacaagttacatcgggctgcatggtggggcaaggtgccccgaaaggatcttattgtgatgcttaaggacaccgatatgaataagaaagataagcaaaaacgcactgcgcttcaccttgcctcggcaaacggaaattccgaagtcgtgaagctcctattggatcgtcgctgccagttgaatatactggacaataaaaaacggactgcattgacaaaagccgtgcagtgtcaggaggatgaatgcgctcttatgctgctcgagcacggaaccgatccaaacatcccggatgagtacgggaacactgccttgcactacgccatttataatgaagataagctaatggcaaaggcacttttgctctacggggcagacatagaaagtaaaaacaagcatggactcacacctcttctccttggtgttcatgagcagaaacagcaggtggtcaagttcctgatcaagaagaaagccaaccttaatgctctcgatagatatggcaggacagctctgatccttgccgtgtgctgcgggtctgcaagtatcgtgtcgctccttctggagcagaacattgacgtctctagccaggacctaagtgggcagaccgccagagagtacgctgtgtcctcaagacacaatgtcatttgtcagttactgtcagactataaggaaaaacaaattctgaaagtttcatccgagaattccaatcccgagcaagaccttaaattaacaagtgaagaggaaagccaacgcctgaagggaagtgagaatagccaacccgaagagatgagtcaggaacctgagatcaacaaggggggagatcgaaaggtcgaggaggaaatgaaaaagcatggatctacgcacatgggattccccgaaaaccttacaaatggtgcaaccgccgataacggcgacgatgggctgattccacctcgcaaatcccgaacgccagaatcccaacaatttcccgacacggaaaacgaacagtatcatagtgacgaacaaaacgatacgcagaagcagttgtccgaggaacagaacactggtatccttcaggatgaaatcctgatccacgaagagaaacagatcgaagtggctgagaatgagttttag

SEQ ID NO: 235815 - DNA, 867 bp, Artificial Sequence
  Description of Artificial Sequence: Synthetic coding sequence
atggttgcagaggctggctctatgcccgctgcgagttcggtcaagaaaccctttggtctccggagcaagatgggtaagtggtgtcgtcattgtttcgcttggtgtcggggaagcggcaaatccaacgtcggaacatccggggatcacgatgactccgcaatgaagaccctgaggtcaaagatgggtaagtggtgttgccactgtttcccctggtgtagaggatccggtaagtcaaatgttggcacttccggggatcatgacgattctgccatgaagacgcttcgaagcaaaatggggaaatggtgctgccattgtttcccttgttgtcgaggcagcggaaagtctaatgtagggacatctggagatcacgatgatagtgcgatgaaaaccctgagaagcaaaatgggcaaatggtgttgccactgttttccctgctgccggggatccgggaagaataaggtgggcccttggggcgactatgacgacagcgccttcatggaaccgagataccatgtgagaagggaggacttggacaaacttcatagggcagcatggtgggggaaagtcccaagaaaagacttgattgtcatgcttaaggatactgacatgaacaagaaagacaagcagaagcgaaccgccctgcacctggcctctgccaatggcaacagcgaagtcgtgaaattacttctggaccggcgatgccagctcaatattcttgacaacaagaagcgaaccgcgctcacaaaagccgtgcagtgtcaggaggatgaatgcgccctcatgctcttagaacatggaacggatcccaacatccctgacgaatatggaaacaccgcccttcattacgctatctacaatgaggattag

SEQ ID NO: 235816 - DNA, 1527 bp, Artificial Sequence
  Description of Artificial Sequence: Synthetic coding sequence
atggtggccgaagctggtagcatgccggctgcttcctctgtgaaaaagcccttcggtctccgctcaaagatgggcaaatggtgccgccactgcttcgcgtggtgtaggggaagcggcaagtctaatgtaggaacctcaggagatcacgatgactcggctatgaaaacactgagatcaaagatgggcaaatggtgctgccattgcttcccctggtgcagggggagcggcaaatctaacgtggggactagtggtgaccacgatgattccgcaatgaaaacgctgaggtccaagatggggaaatggtgttgtcactgcttcccctgttgcaggggctccgggaagaataaggttggcccttggggcgactacgacgatagcgccttcatggaacctaggtaccacgtcagacgcgaggacctggataagctgcatagggccgcatggtggggcaaggtgcccagaaaagatctgattgtgatgttgaaggatacagatatgaacaaaaaggacaaacagaagagaactgcattacaccttgcgagcgcgaacgggaatagcgaagtggttaagctcttgctggaccggaggtgccaactcaatatcctggataacaagaaacgaaccgcactgactaaagctgttcagtgccaggaggatgagtgcgctctgatgctgttggaacacggaactgacccgaacatccccgacgaatatgggaacaccgctctgcattatgccatctacaatgaagataagctgatggctaaggcattacttctctacggcgcagacatcgagagtaaaaacaaacatggactgaccccactgcttttgggcgtgcatgagcagaagcagcaggtggtcaaatttctgatcaagaagaaggctaatttgaacgctttagatcgctacggacgaacggccctcatattagccgtttgttgtggctccgcctccatcgtgagtctcctgctagaacagaatattgacgtatcatcacaggatctgtctggccagactgcccgtgagtacgcggtcagctctaggcataatgtgatctgccagctgctgagtgattataaagagaagcagatcctgaaggtgagttccgaaaatagcaaccctgagcaggacttgaaattgactagtgaggaagagtcacagagactcaaggggtccgagaatagccagccggaagaaatgagtcaggaaccagagattaacaaaggcggagaccgaaaagtggaggaggaaatgaagaaacacggaagcacacacatgggattccccgaaaatttgacaaatggcgctacagcagacaacggagacgatggccttatccctccccgaaagtcgaggacgcctgagagccagcaattccctgacaccgaaaatgaacagtatcattcagatgagcagaatgacactcaaaagcagctctctgaggagcagaatacaggaatcctgcaggacgaaatcctgatacacgaagagaagcagattgaagtggccgagaacgagttctag

SEQ ID NO: 235817 - DNA, 954 bp, Artificial Sequence
  Description of Artificial Sequence: Synthetic coding sequence
atgagttgtcaggccttcacttctgcagatactttcattccacttaactcagacgcgagtgcgactctgcctctgatcatgcaccacagtgctgcagagtgtttaccagtttcgaaccacgctacaaatgtcatgagcacagtccccagcatcttgtcactcatccagactccaaagtgtctatgcacccactttagtgtgactacactcggcaatactgccacaggcctgcattattctgtgcccagctgtcattatggcaaccagcctagcacttacggcgtaatggctggaagcctcacaccttgcttgtataagtttcctgatcacaccttatcccacgggttccccccaatccaccaaccgctcctggcggaggatcctacagctgccgactttaagcaggaattgagaagaaagtcaaaactcgtagaggaaccgatcgatatggattcccccgaaatccgggagctcgaaaaattcgcaaacgagtttaaagtgaggcgcatcaaacttggatatactcagacgaatgtcggcgaggccctggcggctgtacatggcagtgaattttcccagactacgatatgcaggttcgagaacctgcaactcagctttaaaaacgcgtgtaagctcaaggctatccttagcaagtggctagaggaggcagagcaggtcggagcgctgtacaacgagaaggtaggcgcaaacgagcgcaagcgaaagcggcgaaccactatctccattgccgctaaggatgccctggaacgccactttggtgaacaaaacaagccttcgtcacaggaaatcatgcgtatggccgaggagctcaatctcgaaaaggaggtggtccgtgtctggttctgtaacaggcgccagcgtgagaaacgggtgaagacaagcctgaaccaatccctgttctccattagtaaagaacacctggaatgccggtag

SEQ ID NO: 235818 - DNA, 876 bp, Artificial Sequence
  Description of Artificial Sequence: Synthetic coding sequence
atgtcctgtcaggcgtttactagtgctgacacatttatcccccttaactctgatgcgtccgctaccctgcctctcatcatgcatcattccgccgcagaatgccttcccgtatccaatcatgctactaatgtgatgtctactgccaccggcctacactacagcgtcccttcctgtcactatgggaatcagccttctacctacggcgtcatggcaggaagtctgaccccttgcttatacaagttccccgatcataccctgtctcacggcttcccccctatacaccagcctctgctggctgaagatccgacagcagccgatttcaagcaggaactccgacggaagagcaagctggtggaagaacctatcgacatggacagtcccgagatcagagaacttgagaaatttgcaaatgagttcaaggtgcgcagaatcaagttaggctacacgcagacgaacgttggggaggccttggccgctgtccatgggagcgaattcagccaaactaccatatgtcgctttgagaatctgcagttgtcttttaagaatgcatgtaaattgaaggccatcctctctaaatggctggaggaagccgagcaggttggagccctgtacaacgagaaggtcggggctaatgagcggaagcggaaaagacgcacaaccatatctatcgcggctaaggatgcactcgagagacactttggtgaacaaaacaagccctcgtcacaggagattatgagaatggccgaagaactgaatctcgagaaagaggtagtaagagtttggttttgcaatcgccgacagcgtgaaaaaagggtgaaaacttccctgaatcaatcattgttttctatcagtaaagagcacttggagtgtagatag

SEQ ID NO: 235819 - DNA, 771 bp, Artificial Sequence
  Description of Artificial Sequence: Synthetic coding sequence
atgctctggcagaaacccacagctcctgagcaagctccagcacctgccaggccttaccaaggcgttagggttaaggaacccgtgaaagaactgcttcggaggaagcggggtcacgcctccagcggagcagcccctgcccctacagccgtggttttgccccaccagcctctagccacctatacgaccgtcggtccctcttgtttggatatggaaggaagcgtgagcgcggtgaccgaagaggcagcattgtgcgctgggtggctgagtcagcccacacccgcaaccctgcagcctcttgcaccatggacaccttatacagagtacgtaccacacgaggccgtaagctgtccttattctgcggacatgtatgtacaacctgtatgccccagctacacagtcgtcggcccttccagtgtgctgacatacgcaagtccaccattgatcaccaacgtgaccacaaggtcatctgccacccccgctgtaggaccacccctagagggaccagagcatcaggcccctctgacatattttccctggcctcagcccttgtctaccctgcctaccagcacgttacagtaccagcccccagcacctgccctgcccggaccgcaatttgtgcagttaccaatatcaatcccagagcccgtgcttcaggatatggaggaccccagacgcgctgctagtagcctgactatagataaacttctgcttgaggaagaagatagcgatgcatatgctctgaatcacacgctctctgtggagggcttttag

SEQ ID NO: 235820 - DNA, 1440 bp, Artificial Sequence
  Description of Artificial Sequence: Synthetic coding sequence
atggttcatagtagtatgggagctccggaaatccgcatgtcgaagccactggaggccgaaaagcaggggttggattccccatctgagcacaccgacaccgagcgcaacggacccgacaccaatcatcagaaccctcagaacaaaacgtcaccattctctgtctcacctacagggcctagtacaaagattaaggcagaggacccgtcaggcgattctgcccctgccgctcctttgccccctcagccggctcaaccacacctgccacaagctcaattaatgctgacgggtagtcagctggcgggagatatccagcaactcctgcagcttcaacagctcgttctggtgcctggccatcaccttcagccaccagcccagttccttctgcctcaggctcagcagtcccagcccggattgctgcccacgccaaatcttttccaactccctcagcagacccagggggcacttctgaccagccaacctcgcgcaggcctcccaacccaagccgttacgcgcccaacactccccgacccccacctttcccatccccaacccccaaagtgcctggaacctcctagtcacccagaggagccctctgaccttgaggagctagagcagtttgctagaaccttcaaacaacgcaggataaaactgggctttacacagggggatgtgggcctggccatgggtaagctgtatggaaacgatttctcccagactaccattagccgcttcgaggctttgaatttgagttttaaaaacatgtgcaaactcaagcccctgttggagaagtggttgaatgatgctgagactatgtccgtggatagcagtctccccagtccgaaccaactctctagcccaagcctcggattcgatggtctgcccggacggcgaagaaagaagagaacttctatcgagactaatgtgagatttgctctcgagaaatcatttttggccaatcagaaaccaacaagcgaagaaatcctcctgattgcagagcagctgcatatggagaaagaggtcatacgggtgtggttctgcaatcggaggcaaaaagagaaacgtatcaacccgtgtagtgccgctcccatgttgccaagccccggaaaaccggctagttattcacctcacatggttaccccgcagggaggagccggaactttgcctctctcccaggcttccagctcactgtctacaaccgtgactactttgtcttccgcagtcggcactctgcacccttctcgcactgcgggaggcggtggcggtgggggaggcgctgcaccacccctgaacagtataccatccgtgactcctcccccacccgctactactaacagcacaaatccttctccacaggggagccattctgcaattggcctgtcaggcctcaacccctccacaggcccaggcctgtggtggaaccccgctccgtaccagccatag

SEQ ID NO: 235821 - DNA, 1809 bp, Artificial Sequence
  Description of Artificial Sequence: Synthetic coding sequence
atggtccactcgtcaatgggagcccctgagattaggatgagcaagcccttggaggctgagaaacaggggttggattctccatctgagcacaccgatacagagcgcaacgggccagatactaaccaccagaacccacagaataagacatcccctttctctgtctccccaaccggtccatcaacaaaaatcaaggctgaagaccccagtggcgactcagctcctgctgctccactgcctccccagcccgctcagccacatctccctcaagcgcaactcatgcttacaggcagccaactggcaggcgacattcagcaactgctgcagcttcaacagctggtcttggtgcccggacaccatttgcagccgccagcacagttcctactgccacaggcccaacagagccagcccggacttttgcctacacccaacttgttccaactaccccagcagactcagggagctttgctcacctcccagcctagggccggacttccaacacaagccgtgacacggcctacgctgcccgacccccatctgtcacatcctcagcctccgaaatgtttggagccaccaagccaccctgaggagcctagcgacttagaggaactggagcaatttgctcgcacttttaagcagagaaggattaagctggggttcactcaaggcgatgtggggctggcaatggggaagttgtacgggaacgatttcagtcagactacaatcagtaggtttgaggcactcaacttgagtttcaaaaatatgtgtaagctgaagcctcttctggagaagtggctgaatgatgccgagactatgtccgtggatagcagcctgcctagtcctaatcagctttctagtccttctttaggctttgatggcttgccagggcgaagaaggaaaaaacgaacctctattgagacgaatgtaaggtttgctctggagaaaagcttcttggctaaccaaaaacctacttccgaagagatcctgctgattgccgagcagcttcacatggaaaaggaagtgatcagagtgtggttctgcaacaggcgccagaaagagaaacgaataaacccctgctcggctgcgcctatgctaccgtctcccggtaaacctgcctcatactcacctcacatggtgactcctcaaggcggagccggaacacttcccctttcacaagcatccagcagccttagcaccacggtgacaacactgtcctctgccgttgggacactgcatccttcccgcaccgctggcggaggcggaggaggtggtggcgctgcacctcctctgaactctatcccgagtgttacgccacctcccccagccacaactaacagcacaaacccatcaccccaaggctctcattccgctattggcttgtccgggctcaatccttcaacaggctctaccatggtgggtctgagttctggcctgtctccagccttgatgtccaacaatcccctggcgaccattcaggcacttgctagtggagggacacttcccctcacgtcgcttgacggttcgggaaacctagtgctaggcgcagcaggcgcagcccctggttccccgggactcgttacctcccccctttttcttaatcacgctgggcttccgctgctgtctacccctcctggagttggactcgtatctgctgctgctgctgcagtcgccgcttctattagcagcaaaagtccaggactgtcatccagtagttctagctcaagttcctccagcagctccacttgttccgagactgccgctcagacacctggcggacctgggggtcccgaggccggaagcaagcccgagtag

SEQ ID NO: 235822 - DNA, 1392 bp, Artificial Sequence
  Description of Artificial Sequence: Synthetic coding sequence
atggtccacagctctatgggagcccctgagataaggatgtcaaagcctttagaggccgagaaacaagggctagactcccccagcgaacacaccgatactgagcgaaacggcccagacacaaaccaccaaaacccacagaataagacatctccattctcggtttctccaaccgggccttccaccaagattaaggccgaagacccgtctggggactcagcgcctgcagctccgctcccaccacagcccgctcagccccacctgccccaagcccagctgatgctgaccggtagtcaactcgccggagacattcaacagttgctgcaactgcagcagttggttctcgtcccgggacaccacctccagcctccagcacaattcttgttgccccaggcgcagcagtctcagcccggacttttaccaactccgaatcttttccagctgccacagcagacccagggcgctctcctgacgagccaacccagggccggtctgccgacacagcctccaaaatgtctagaacctcccagtcatccagaagagccctccgatcttgaggaactggaacagttcgcacgcacttttaaacagaggcgtatcaagctgggattcacccaaggcgatgttggtctcgcaatgggaaagctctatggaaacgatttctcacaaactactatttcaagatttgaagccctcaatctctcgttcaaaaatatgtgtaaattgaagcctctgctcgagaaatggctgaacgacgccgaaacaatgtcagtagatagctccttgcccagtccgaaccagctgtcttccccttcgctggggtttgatggactcccaggcaggcggagaaaaaagcggacatctattgaaaccaatgttcgttttgctctggagaagtcgttcttagcaaatcaaaagccgactagtgaagagatcctgttaatcgcagaacagctgcacatggagaaggaggtgatccgcgtctggttctgtaataggaggcagaaggagaagaggattaacccctgcagcgcagctccgatgctgcctagccccggaaagcctgcgtcctattctccccacatggtcactccccagggcggtgccggtaccctgccgctgtcacaggcttcgtcaagtctgtcaaccacggtgactaccctgtcctctgctgtcggaaccttacacccgtcaaggaccgccggagggggtgggggaggcggaggcgctgcaccacccttgaactctatcccatctgtgacaccacctcccccagccacgaccaatagcactaacccttccccacagggatcgcatagcgcaatcggactgagcggactgaatccgagcactggccctggtctgtggtggaaccccgctccataccagccttag

SEQ ID NO: 235823 - DNA, 1425 bp, Artificial Sequence
  Description of Artificial Sequence: Synthetic coding sequence
atgggggctcccgaaattagaatgagcaaacccctcgaagccgagaagcagggtctggatagtccctccgaacatacggataccgagcggaacggaccagatacgaatcaccagaacccccagaacaagacaagtcccttcagcgtgtcaccgacaggcccatccaccaaaatcaaagcggaagacccatcaggggacagcgccccagcagccccactccctccacagcccgcacagccacatcttcctcaggcgcagttaatgctgacaggcagccagctcgccggtgacattcagcagctactccagctgcaacaactggttttggtgcctggtcaccaccttcaaccacccgcacagtttcttctgccccaggctcagcagtcccaacctgggctgctgcccactcctaatctcttccagttgccccagcaaacccaaggcgcactgctcacttcacaaccgcgagccggacttcccacacaggctgtgactcggcctacactgcccgatccccacctgtcccatccccaacctccgaagtgtcttgagcccccttcccatcccgaggagccgagcgatctagaagagcttgagcagttcgccaggacattcaagcagaggcgcataaagctcgggtttactcagggggacgtgggcctggccatgggcaagctgtacggaaacgatttttcacagaccaccatcagtcgtttcgaagccctgaatttgagctttaagaatatgtgcaagctaaagcctctccttgagaagtggctgaatgatgctgagactatgagtgtggatagctcattgcctagtcctaatcagctttccagcccatcattggggtttgatggcttaccaggaaggagacgcaaaaaacggacgtcgatcgagacgaacgtgagatttgccctcgagaaaagcttcttggccaatcagaaaccaacctctgaagagatcttactgatcgctgagcagctgcatatggagaaggaagtgattagagtgtggttttgcaacagaaggcagaaagagaagaggataaacccctgttctgctgcccctatgctcccctcccctggaaaaccggcatcgtacagtccgcacatggtcacaccacagggcggagcaggaacacttcctctgagccaagcatcttctagtcttagtacgacggttacaaccctgtcgtccgcagtgggcacgcttcaccctagcagaaccgccggaggcggtggcggaggaggcggagcagctcccccattgaactcaataccctctgtcacacccccaccacctgcaacaactaattctactaacccttctccacagggtagccatagcgcaatcgggttgtctgggctgaatccgtcaaccggtcctgggttgtggtggaatccagcaccttatcagccatag

SEQ ID NO: 235824 - DNA, 1203 bp, Artificial Sequence
  Description of Artificial Sequence: Synthetic coding sequence
atggtgcatagctccatgggtgccccagaaataagaatgtccaaacccctcgaagccgaaaagcaaggacttgacagcccctcagagcacaccgataccgaacgtaatgggcctgataccaaccaccaaaacccacagaataagacaagcccctttagcgtgagccctaccggaccttccaccaaaattaaggcggaggatccatcaggggactcggctcccgcagccccattgcccccacagccggctcagccacatctgccccaggctcaactcatgttgactggcagccaactcgccggagacatccagcagcttcttcagctccaacagctagttctggttccgggacatcacttgcagccgccagcacagtttctgctgcctcaagctcagcagtctcagcccggtctgttacccactcctaacttgtttcagctcccccagcaaactcaaggggctctgctgacatcccagccgagagccggtctccccacccagccgcctaaatgtctagaacccccttcacaccccgaagagccatcagaccttgaagagttggaacagtttgcgaggactttcaaacagcggaggatcaagctggggttcacccagggagacgtcggtctcgctatgggcaaactgtatgggaacgacttttcacagacgaccatttctcgctttgaggctcttaatctgtcctttaagaacatgtgtaaattaaagcctcttcttgagaagtggctgaacgatgcagagaccatgtccgtggattcatccttgccctccccaaaccaactcagcagcccttccttaggttttgatgggcttcccggacggagaaggaagaaaagaacatccattgaaacaaacgtaaggtttgcactggagaagagctttcttgctaatcagaagcccacatctgaggaaatcctccttattgccgagcagttacacatggaaaaagaagtcattcgggtctggttttgtaaccggagacaaaaagaaaagcggattaacccatgctctgcagcccctatgctcccaagcccgggtaaacccgctagctactccccccacatggtgacaccacagggcggagccggaaccctccccctcagccaagcatcatccagtttaagcaccaccgcccagacgcccgcactaaaagccgctacccgcctgagcgcctgccaggcctag

SEQ ID NO: 235825 - DNA, 1404 bp, Artificial Sequence
  Description of Artificial Sequence: Synthetic coding sequence
atggtgcatagttctatgggcgcacccgagatcagaatgtcaaaaccattagaggcagagaaacagggcctggatagcccatctgagcacacggacaccgaaaggaacgggccagacaccaaccaccagaacccacaaaataagacaagcccatttagcgtctccccaacaggacctagtacaaaaataaaggctgaagaccctagtggagactccgcccctgcagccccactcccaccgcagcctgcccagcctcacctgcctcaggcacagctgatgctgaccggctcccagttggcaggcgacattcagcagcttctgcaactacaacagctagtgctggtgccagggcaccacctccaaccaccagcccaatttctgctgccccaggcccagcagtcccaacctgggctgttaccaaccccgaacctgtttcagttgccacaacaaacccagggggctctcctgacatcccagcccagagccggactgcccactcaggctgtcacccgacccactcttcccgacccacacctcagccacccccagcctccaaagtgtctcgaacctccgtcccatccggaggagccttcggatctggaagagttggagcagtttgcacggaccttcaagcagagacgcattaagttggggttcacccaaggagacgttggtttggcaatgggcaaattgtacggaaacgacttcagtcagaccaccatctccaggtttgaggcactaaacctctcattcaagaacatgtgtaaattgaagcccctcctggagaaatggttgaacgacgccgagaccatgagcgtggactcttctcttccctcaccaaatcaactgtcatctccatccctgggctttgatggcctgccgggtcgcaggcgtaagaaaaggacaagcattgaaacaaatgtgaggtttgctctggaaaaaagcttcctagccaaccagaagccgaccagcgaggaaattctcttgattgccgagcaactccacatggagaaagaagtcattcgggtgtggttttgtaacagaaggcaaaaagagaaacgcatcaacccatgcagcgcggcacccatgctgccctcgccgggaaaacctgcgagttattccccacatatggtaaccccccagggcggagctggtacactgcccttaagccaggcatcaagctctctgagtaccactgtcaccactctcagtagtgcagtggggaccctgcaccctagccgtacagccggtgggggtggcggaggcggaggcgctgcaccaccgcttaacagcatcccttctgtcactcccccaccacccgcaacaaccaactcaacaaatccaagtccacagggctctcacagtgccattggcctgtccgggttaaatccatccaccggctag

SEQ ID NO: 235826 - DNA, 1761 bp, Artificial Sequence
  Description of Artificial Sequence: Synthetic coding sequence
atggtgcatagctccatgggagcaccagagatacggatgtctaaaccccttgaggccgagaagcaggggctcgattccccgagcgagcacaccgacacggagcggaacgggccagacaccaaccaccagaacccacaaaataaaacatcgccatttagtgtatctccgactggtccatcaacaaaaatcaaagccgaagatccgtcaggtgactcagctccggctgctcctttaccccctcagccggctcagcctcatctgccccaggcccagctcatgctcacgggcagccagcttgcgggagacattcagcaactgctacaactccagcagttggtgctggtgccagggcatcacctgcaacccccagcccaattcttgctcccccaagctcagcagtcccagccgggtttgcttcctacccctaacctgtttcaacttcctcaacaaacccaaggtgcattgttgacatctcagcccagagccggactgccaacccagcctccaaaatgccttgagcctccttcgcacccagaggagccttctgacctggaggagttggaacaattcgcccgaacgtttaaacagcgtcggattaagctgggctttacccagggcgatgtcgggctggccatgggcaaactctacgggaacgatttttcccagaccacgatcagtaggttcgaggccctgaatttgtctttcaaaaatatgtgtaagttgaagcccctccttgagaagtggttgaacgacgccgagaccatgagcgtggattcgtctctcccctcgcctaaccagcttagttccccctctctcggcttcgacgggctgccagggaggaggcggaaaaaacgtacgtccattgagaccaatgttaggttcgcattagaaaaaagctttttggccaaccagaagccaaccagcgaggaaattttgctaatcgccgaacagctccacatggaaaaggaagttattcgtgtttggttctgcaaccgtcgacaaaaggagaagcgcataaatccctgctcagcagctcccatgctgcccagccccggtaagccagcttcttacagtccgcacatggttacgccacagggcggagccggaactttacccctctcccaggctagttcctccctcagtactaccgtaaccacattgagcagcgcagtcggcaccctgcacccatcgcgcactgcgggtggtgggggtggcggaggcggtgcagctccccctctcaacagcatcccctcagtcactccccctcccccagccacgaccaactccaccaatccgagcccacaaggcagccactccgctatcggtctgagcggactaaaccccagcacagggagcaccatggtggggttgagcagcggccttagcccagccctcatgtccaacaatcctctggctacaatacaggctctggctagcggagggacactgcccctcacttcactggatgggagtggtaatctcgttttaggtgctgccggagctgcccctggctcgccgggtctggttaccagtccgctcttcctgaatcatgccggtctaccactattgtcaacacccccaggcgtgggcttggtttcagccgctgcagcagcagttgccgctagtatcagctcgaaatcccccggtctcagcagctcttctagcagcagctccagtagctcctccagtacttgttccgaaacggcagcacagacacctggaggacccggaggacccgaggctggatccaaacctgagtag

SEQ ID NO: 235827 - DNA, 1311 bp, Artificial Sequence
  Description of Artificial Sequence: Synthetic coding sequence
atggtgaacttggaatccatgcacacagatattaagatgtcgggtgacgtcgcggactcaaccgatgcacgttctacactgtcccaggttgaaccaggtaacgatcgtaacggactagacttcaaccggcaaatcaaaaccgaggatttaagcgattccctgcagcagaccctctcacacaggccgtgtcatctgagtcagggacccgctatgatgtctggaaaccagatgtcagggcttaatgcttcaccatgccaggatatggcctccctgcatcctctgcaacagctcgtgctggtccctggtcacctgcagtcagtgtctcaatttctcctgagtcaaacgcagcccggtcagcaggggttgcaacctaacctcctcccctttccccagcagcagagtgggctcttacttcctcagacgggcccaggcctggcatcccaggcgtttggccatcccggtctccccggatcgtctttggaaccacatctggaggcttcccaacacctgccagtacctaaacacctcccttctagcgggggtgccgatgaaccttctgatttagaggagttggagaagttcgctaaaaccttcaaacagaggaggatcaaactgggttttacgcagggtgatgttggcttggctatggggaaactctacgggaacgacttctcacagaccacaatcagcaggttcgaagctctgaacttgagcttcaaaaatatgtgcaagctgaagcccttgctggagaaatggctaaatgacgctgaaagctcgcccagtgatcctagcgtaagcaccccatcaagctatccctcactgagcgaagtgttcggacggaagcgtaaaaagaggacgagcattgagaccaatattaggttgacgctggaaaaacggtttcaggacaatcccaagccgtcctccgaagaaattagcatgatagccgaacagctgagtatggagaaggaggtggtaagagtgtggttctgcaatcggaggcaaaaggagaagcgaatcaactgtccagtggctacgcctatcaaaccaccagtgtataatagtcgcctcgtgtccccctccgggtcactgggaccactctccgttccccctgtgcatagtactatgcctggaaccgtgacttcgtcgtgctctcctggcaataacagccgcccatcctccccgggttcaggcctccatgctagctctccgactgcatcccaaaataattctaaagcggcagtgaattctgctagttcctttaatagctctgggagctggtaccggtggaaccactccacctacctacattag

SEQ ID NO: 235828 - DNA, 1317 bp, Artificial Sequence
  Description of Artificial Sequence: Synthetic coding sequence
atggaatcccccagaaccgctaaggggggaagggacataaagatgagcggcgacgtcgccgacagtactgatgccaggagcaccttgagccaagtggaacctggaaacgatcgcaacggcttggactttaaccggcagatcaagactgaagacctttccgattcactgcagcagacactgagtcacagaccctgccacctcagtcaagggcctgcgatgatgtcgggaaaccagatgagcgggcttaatgcgagtccgtgccaggatatggcctcattgcacccactccagcaacttgtacttgtgcccggacatcttcagtccgtgtcccagtttcttttatcccaaactcagccaggacagcagggcttacaacctaacctgctgcccttccctcagcagcagagcggccttctgctcccccagactgggcctggactagcctcccaagcttttggacaccccggtttgccagggagtagcctggagccccatctggaggcctcccagcacctgccggtaccaaaacatcttcctagctcaggaggggcagacgaaccaagtgatctggaggaactggagaagttcgccaagacctttaaacagaggcgaataaaattaggcttcacccagggggatgttgggttagcaatggggaagttatacggtaacgacttctcacaaacaaccatctctcgcttcgaggcacttaacctctccttcaagaacatgtgtaaactgaaaccacttttagagaaatggttgaacgatgcggagtccagcccatccgacccatccgtgtctacaccatccagttaccccagcttgtccgaagtgtttggacgcaagcggaagaagcgaacctctattgaaactaacatcaggttaactctggagaaacgctttcaagataatcccaagccctcatcagaagaaatcagcatgattgcggaacaactgtcaatggagaaagaagtggtgagagtgtggttttgcaatcgacggcagaaggaaaaacgcatcaactgtcctgtggcgacacctataaaaccacctgtctataacagccggttagtgagtccctccggctccctaggaccactctctgttccaccagtgcattcgacaatgccgggaactgttacttccagctgctcccccggtaataactctcggccatccagccccggatcaggcctgcacgcctccagccctacagcgagtcagaataattccaaagccgcagtgaactctgcctcttcgtttaattcatcgggctcatggtatcggtggaatcatagcacctacctccattag

SEQ ID NO: 235829 - DNA, 1356 bp, Artificial Sequence
  Description of Artificial Sequence: Synthetic coding sequence
atggccaccactgcccagtacttacctcgaggcccaggaggcggagcgggaggtaccggcccactgatgcatcccgacgcggctgccgctgcagctgccgctgcagctgccgagaggctgcacgcaggagctgcctacagagaggtccagaagctaatgcatcatgaatggctaggggcaggtgccggacatcccgtcggcctggctcacccccagtggctgcccaccggtggaggaggcggaggggattgggcaggtgggcctcacttggaacatggcaaagcagggggtgggggtacggggagggctgacgatggaggtgggggaggcggtttccacgccaggttagtgcatcaaggagcagctcacgctggagctgcctgggctcaaggctcaacagcccaccatttaggccctgctatgagcccctcccctggcgcttcggggggtcaccagccacagcctcttggcttgtacgcacaggccgcataccctggaggcggaggcggtggactcgccggtatgctggccgctggcggaggaggggcaggaccgggtctgcatcacgctctgcacgaagacgggcacgaggcccagctggaaccttcaccccctccccacctgggtgcgcatgggcatgctcacggacacgcacacgctggaggcctgcacgcggctgccgcacacctgcaccctggtgctggcggaggtggcagtagcgtcggtgagcatagtgatgaagatgcaccatcttctgacgacctagaacagttcgcaaagcagttcaagcagcggagaatcaagctaggatttactcaggcggatgtggggctggctctgggcaccctgtacggtaacgtgttcagccagaccactatctgtcgctttgaagccctgcagctgtccttcaaaaatatgtgcaagctgaaacctctgctgaacaagtggctcgaagagaccgactccagtagcggcagtccaacaaatttggacaagattgcagcccagggccgtaagcgaaagaagaggacgtctatcgaggtaggcgtaaaaggcgcactcgaaagtcattttctgaaatgtcccaaaccatccgcacacgagatcaccggcttagcagattcattacagctggaaaaagaagttgtgcgcgtgtggttctgtaacagaagacagaaagaaaagcgaatgactccagccgcaggagccggtcacccacctatggacgacgtttacgcccctggcgaactgggcccaggagggggtggcgcatccccaccatctgcccctccccctcctccccctgctgccctgcaccaccaccaccatcatacccttcccggtagcgtgcaatag

SEQ ID NO: 235830 - DNA, 1332 bp, Artificial Sequence
  Description of Artificial Sequence: Synthetic coding sequence
atggcgacggctgctagtaatcattactcactccttactagctccgcgtcaatcgtacatgcagaaccacccggaggaatgcagcagggagccggagggtacagggaagcccagagcctcgtacagggagactacggcgcattgcagtcaaacggccacccattatctcacgctcatcaatggattacggccctgtcacatggtggcggagggggtggcggaggcggaggcggtggaggcggagggggaggcggaggagggggtgacggcagtccttggtctaccagtccactgggtcagcccgacattaagccatcagtcgtggtgcagcaaggcggaagaggggatgagttgcacggccctggcgcactgcaacagcagcatcaacaacaacagcagcagcagcaacagcagcagcaacaacagcagcagcagcagcaacagcagcgaccgccacatctcgttcaccacgcagctaaccaccaccccggtcctggtgcctggagaagcgccgcagccgcagcgcaccttccgccttccatgggcgctagtaacggtggattgctctattcgcagccctcctttactgtgaatggcatgctgggcgcaggagggcagccggcaggcctacaccatcacgggctacgcgacgcccacgacgaaccccatcatgctgaccaccatcctcacccacattcacacccacatcaacaaccaccccctccccctccgcctcagggtcctcctggtcaccccggagcccaccatgacccgcactccgatgaggatacccccacctctgatgaccttgaacagttcgccaagcagttcaagcagagaagaataaagctgggtttcactcaagctgacgtggggttagcactcggaacactctatgggaatgttttctcccagacgacaatatgcaggttcgaggccttgcagttgagtttcaagaatatgtgcaaactcaaacccctgcttaacaaatggctcgaagaggctgattccagtagtggcagcccaacctcaattgacaagattgctgcacaagggcgtaagcgcaaaaagcgcactagcatcgaagtcagcgttaagggggcactggaaagtcatttcctcaaatgccctaaaccctctgctcaggagatcacctctctcgcagactcgctgcagctcgagaaggaagtcgtgcgagtttggttctgtaataggagacaaaaggagaaacgtatgacgcctcccggtggcactctccccggagccgaggatgtctatggagggtctcgggatactcctccacatcatggcgttcagacaccagtccagtag

SEQ ID NO: 235831 - DNA, 1131 bp, Artificial Sequence
  Description of Artificial Sequence: Synthetic coding sequence
atggcgacagcggcaagcaaccattacagcctgttgacatccagcgcatccatcgtgcacgccgaaccccctggcggtatgcaacaaggtgctggaggctatagggaggcccagtcgctcgtgcaaggtgactacggggcactgcagagcaatggccatcccctgtcacacgcccatcagtggatcaccgctctcagccacggtggagatgggtccccttggtctaccagccccctaggccagccagatataaagccttccgttgttgttcagcaaggtgggagaggcgacgagctccacggacccggagctctccaacagcaacatcagcaacaacagcagcagcagcaacaacaacagcagcagcagcagcaacagcaacagcaacagaggccaccacatttggttcaccacgccgcaaatcatcacccaggtcccggagcttggcgaagcgccgctgccgctgcacacttgcctccaagcatgggcgcatctaacggaggccttctttactctcagccacctccacctccacaaggaccacctggacaccccggagctcatcatgaccctcactcagatgaggacaccccaacatccgatgacctggagcagttcgcaaagcaattcaaacagcggcgaattaagctcggctttacacaggccgacgtaggtctggccctgggcactctgtatggaaatgtgttttctcagacaacgatttgcagatttgaggctctgcagctatcatttaaaaacatgtgtaaactcaagccactcttgaataagtggcttgaggaagcggactcatctagcggatcacctacctctatcgataaaatcgctgcccaaggcaggaaacgcaaaaagcggaccagcattgaagtctccgtgaaaggagccctggagtcacacttcctgaaatgccctaaacccagtgcccaggagatcacatctcttgccgactctttgcaacttgagaaggaggttgtcagggtgtggttctgcaacaggcgccagaaggagaaaagaatgactcctccagggggaactttgcctggcgcagaagacgtttacggaggttcccgggatacgcctcctcatcacggcgtgcagaccccagtgcagtag

SEQ ID NO: 235832 - DNA, 1503 bp, Artificial Sequence
  Description of Artificial Sequence: Synthetic coding sequence
atggctaccgcagcttctaacccttacttaccaggcaactccttgcttgcggctggttcaatcgttcactccgatgcggctggggctggaggaggcggaggcggaggcggagggggtgggggaggaggggctgggggtggaggaggtggcatgcagcctggcagcgccgcagtcacaagtggtgcctatagaggggacccttcgtccgttaaaatggtccagagcgatttcatgcaaggggctatggccgcaagcaacgggggacacatgttgtcccatgctcatcagtgggtgacggccctgcctcatgccgctgctgcagctgctgccgcagcagcggcagccgttgaagcctcttccccgtggtccggctccgcagttggtatggctggatccccccagcaaccccctcagcctcctccaccccctccccagggacccgacgttaagggtggcgctggaagggacgatttgcatgcgggaaccgccctccatcaccggggacctccacatttgggaccgcctcccccaccaccgcatcaaggacaccccggagggtggggggctgccgctgccgctgcggctgcagctgccgcagcagccgcagcggctcacctgccatctatggctggagggcaacagcccccaccccagagcctgctgtactcacagccaggcggatttactgtaaacggcatgttgtccgctccacccggtcccggtggcggagggggaggagctgggggtggcgcacagtccttggttcatcccggtctggtccgtggtgacacaccagaactagcagagcaccatcatcaccatcatcatcatgctcatccacaccctcctcacccacaccacgcccaaggccctcctcaccatgggggtggtggaggcggtgccggtcctggtctgaattctcacgatccccattctgacgaggacacacccacttcagacgacctggaacagtttgcgaagcagttcaaacagaggaggatcaagctgggatttacgcaggccgatgtcggactggcactcgggacgctttatggaaatgtgttcagtcagacgactatatgccgttttgaagccttgcagctttcatttaaaaacatgtgcaagctgaagcccctgctgaataaatggctggaagaagctgacagcagtacaggttcacccacaagtatcgacaagattgctgcccaggggcgaaaacggaagaagagaacctccatagaagtgagcgttaagggggcactcgagtctcattttttgaagtgccccaagccaagcgcacaggagataaccaacctcgcagactctctccagctcgaaaaagaggtcgtgcgtgtctggttctgtaatcgcaggcagaaagaaaaacgaatgactcccccaggcatccagcagcaaacccccgacgacgtctattctcaggttggcacggttagcgccgacaccccaccgcctcatcacggcctccagacatccgtccagtag

SEQ ID NO: 235833 - DNA, 1086 bp, Artificial Sequence
  Description of Artificial Sequence: Synthetic coding sequence
atggcaaccgcggcatccaatccttattcgatactctccagcacctctctcgtccacgcagattctgcgggaatgcaacaaggttctccattccggaatccacagaagctgctgcagagtgattacctgcaaggtgtcccaagtaatggtcatcccttggggcaccactgggtgacgagtctctcagatggcggaccatggtcatccaccctggcgacctccccactggaccagcaagatgtgaagccaggcagggaggatttgcagttgggagctatcatacaccatagatcaccgcatgttgcgcatcattcaccacacactaaccatcctaacgcttggggcgcttcacctgcccctaacccttctattacttcaagcggacagccgcttaatgtatactcacagcccggttttaccgtgtccggaatgctcgaacacggagggctaacacctcctccggcagcggctagcgcacagagtctacatccggtgctccgagagccaccagatcacggcgagctagggtctcaccattgtcaagaccacagtgatgaggagacgccaactagcgatgaattagagcaattcgctaaacagttcaagcagagacgaatcaagctggggtttacacaagcagacgtaggactcgccctagggactctgtatggaaacgtttttagccagaccacaatttgtagattcgaaggattacagctgtcctttaagaacatgtgcaagctgaaacccctcctaaataagtggctcgaggaagctgactctagcaccgggagtcccacctcaatcgataagatcgcagcccaggggagaaagcggaaaaagcgcaccagtattgaggttagcgtgaaaggtgtacttgagacccacttcttaaagtgccccaaaccagcggctcaagaaatctcctcacttgcagactctctccagctggaaaaagaggtggtgcgcgtttggttctgtaatcgccgtcagaaagaaaagcgaatgaccccgcctggtgatcagcagccgcacgaggtttacagtcacacggtaaaaaccgatacttcttgtcatgatctgtag

SEQ ID NO: 235834 - DNA, 1260 bp, Artificial Sequence
  Description of Artificial Sequence: Synthetic coding sequence
atgatgagtatgaattctaagcagcctcatttcgcaatgcaccccacgctgccagagcacaaataccctagcttgcactcctcctctgaagctatacgaagagcgtgcctcccgactcccccacttcagtctaacctgtttgcctccttggacgaaacgctgctggcacgggctgaagccctggcagcggtggatatcgccgtcagccaggggaaatcgcatccgttcaaacccgatgctacgtatcacactatgaatagcgtcccgtgcacaagtacttccactgtgccccttgcgcaccaccaccatcaccaccatcaccatcaggctcttgaacctggagacctgctagaccatatttcttcgccaagtctggccctgatggctggcgctggcggtgccggagcagccgcaggagggggaggcgctcatgacggcccaggcggtggcggaggaccaggtggagggggaggaccgggtggcggtcctggcggtgggggaggagggggtcccggtgggggaggcggagggccagggggaggcctgcttggcggttcggcacacccccatccccacatgcatagtcttggacacttgtcccaccctgctgctgctgccgctatgaacatgccgtccggcttgccccatccaggtcttgtcgctgcagcggcacaccacggggcagcagcggcagcagccgctgccgctgctggacaagtggctgcggctagtgctgccgctgcagtggtgggtgctgccggactggcttcgatctgtgatagtgatacggacccaagagaattggaagcctttgcagagcggttcaagcagagaagaatcaaactgggcgtgacacaggctgatgtgggctcggctctggctaaccttaagatccccggtgttgggagtctgtcccagtcgaccatttgtcgcttcgaatccctgactctcagtcataacaatatgattgccctgaaacctattctgcaggcgtggctggaggaagcagaaggggctcaaagggagaaaatgaataaaccagaattatttaatggcggtgagaagaaaagaaagcgcacatccatcgccgcacctgagaagcgcagcttggaggcgtacttcgccgtgcagcctaggccgagcagtgagaagatcgctgcaattgcggaaaagctggatctgaagaaaaacgttgtgagggtgtggttttgcaaccagcgtcagaagcagaagcgcatgaaattcagcgctacatactag

SEQ ID NO: 235835 - DNA, 1911 bp, Artificial Sequence
  Description of Artificial Sequence: Synthetic coding sequence
atgaaaaaactgcagggagctcacctgcggaagcccgtgaccccagacctattgatgacgccctcagatcagggtgacgtggacctcgacgtagatttcgcagcgcacagaggcaattggaccggcaagctggacttcctattaagctgtattggatattgcgtcggcctgggaaacgtgtggcgctttccctacagggcctacactaatgggggaggcgctttcctcgtgccatatttcttaatgctcgctatttgcggtattccactgttcttccttgagttgagtttagggcagtttagcagcctcgggccattagcagtctggaagattagcccactgtttaagggagctggtgccgctatgctgctgatcgtgggcttggtggctatctactacaacatgatcatcgcttacgttctcttttatctgttcgcttcgcttaccagcgatctaccttgggaacactgcggcaattggtggaacactgagctgtgtctagagcatcgggtgtctaaggatggtaacggggctttacctctgaaccttacttgtacagtctcaccgtccgaggagtactggagccggtatgtactacacattcaggggagccagggtataggatctccaggcgagatcagatggaatctgtgcttgtgtctcttgctggcgtgggtcattgtcttcttatgtatcttaaagggggttaagtcttcaggaaaggtggtttacttcactgctacctttccctacctcatcctgctgatgttgttagtccggggtgtcacactgccaggagcgtggaagggaatccagttctatctcaccccccagttccatcaccttcttagttcaaaggtgtggatagaggccgcactccagatcttctatagtctcggtgtggggttcggaggacttttaacgtttgcctcatataacacttttcatcagaacatttaccgggacacattcatcgtcactctgggtaacgccattacgtcaattttagccggattcgcaattttttccgtgttggggtacatgtcccaggaattgggcgtcccagtggatcaggttgccaaagcaggcccaggcctcgctttcgttgtgtatcctcaggctatgactatgctgccactgtccccattctggtctttcctgtttttttttatgttattaactcttggactggattcacagttcgcattcctggagacgatagtgacagccgtgacggacgagttcccttattacttgcgaccaaaaaaagcggttttctccggtctgatttgtgtggctatgtaccttatgggtctcatcctgacaaccgatggcggaatgtattggctcgtccttctggacgattatagtgccagcttcggcctgatggtcgtggtcattacaacgtgtctggctgtgacaagagtgtacggaatccagcgcttttgtcgcgatatccacatgatgcttggttttaaaccaggcctgtatttcagagcctgctggctctttctcagccctgctaccttacttgctttgatggtgtactccatcgttaagtatcaaccctcagagtacgggagttaccgtttccctccttgggccgagttattgggcatccttatggggctgctgtcatgcctgatgatccccgctggaatgcttgtggccgtacttcgggaagagggctccctctgggagagactgcagcaggcatcccgcccagctatggactggggtccctccctcgaggaaaatcgtacagggatgtacgtcgcaactctcgccggaagccagagcccaaagccactgatggtgcacatgcgcaaatatggcggtatcacctctttcgagaacaccgccatcgaggtggaccgggaaatcgccgaagaggaggaatcaatgatgtag

SEQ ID NO: 235836 - DNA, 798 bp, Artificial Sequence
  Description of Artificial Sequence: Synthetic coding sequence
atgcatttctatcgcctgttcctcggagccacacgccgatttctgaaccccgagtggaagggcgagatcgataattggtgcgtgtatgtgctgacaagcttgctgccttttaagatccagagccaagatatcaaggccttgcagaaggaactggagcagttcgctaagctgctcaaacagaagcggatcactctcggttatacccaggccgatgttgggttgacgctcggagtattgtttggcaaggtgttctcacagactaccatctgtagatttgaggccttgcagctttcctttaagaacatgtgtaaactaaggcccctgctccagaagtgggttgaggaagctgacaacaatgaaaatttgcaagagatatgcaaggcagaaacactcgtgcaggcaagaaaacgaaagagaaccagcatcgagaaccgggttcggggaaatcttgaaaacctatttctgcagtgtcccaaacctactctccagcaaatttcccatatcgcccagcagctagggttggagaaagacgttgttcgagtgtggttttgtaaccgccgacagaaaggtaagagaagttcctcagattatgctcaaagagaggacttcgaggccgctggaagtccgttttccggaggtcctgtttcctttccgctggccccaggaccacatttcggcactcctggttacgggtctccccattttaccgctttgtattcaagtgtgcctttccctgaaggcgaggctttcccacctgtgtccgttaccactctggggagcccaatgcattcaaactag

SEQ ID NO: 235837 - DNA, 1083 bp, Artificial Sequence
  Description of Artificial Sequence: Synthetic coding sequence
atggcagggcatctcgccagtgatttcgccttttctccaccacccggaggtggaggagatggtccaggaggtccggagcctgggtgggtcgatcctaggacatggttatcttttcagggtcctcctggagggcctggaattggacccggagtggggccaggttctgaagtgtggggtatccctccatgccccccaccctatgagttctgcggtggtatggcctactgtgggccacaggtcggcgtgggcctagttccacaagggggactggagacatcccagccggaaggagaagctggggtcggcgttgagagcaacagtgatggcgctagtccggaaccctgcaccgtgactcccggagctgtaaagctggagaaggagaagcttgaacagaaccccgaagaatcccaggacattaaagctttgcaaaaggagctggaacagtttgccaaactgctaaaacagaaaaggatcaccctcggatacacccaggctgacgtgggactaacacttggcgtgttgttcggaaaggtgttcagtcagactacgatttgtagatttgaggccttgcagctatcctttaaaaatatgtgcaaattgcgccctttgcttcagaagtgggtggaagaagctgataataatgaaaatttgcaagaaatttgcaaggccgagactctagttcaggctcggaaacgcaagcggacaagcatcgaaaatagggtccgaggcaatttagagaatctgtttctgcagtgcccaaagcctacattacagcagatcagccacatcgcccagcaactgggcctcgagaaggacgttgtcagagtgtggttctgtaataggcgccagaaaggaaagaggtctagcagcgattacgctcagagagaagacttcgaggcagctggatcacccttcagtggtggccctgtgagcttcccactggcccctgggccacactttggcactccaggctacgggtccccccactttaccgctctgtactcatcggtgcctttccccgagggcgaggcctttccaccagtcagtgtcacaacactgggatctccgatgcatagcaattag

SEQ ID NO: 235838 - DNA, 372 bp, Artificial Sequence
  Description of Artificial Sequence: Synthetic coding sequence
atggctggtcacttagcctccgattttgctttcagccccccaccgggtggtgggggtgacgggcctggcggacctgagccgggatgggtggaccctcgcacgtggctttcctttcagggcccaccaggagggcctggaatcggcccaggagtgggccctgggtctgaggtgtggggcataccaccttgcccacctccttatgaattctgcggcggaatggcctactgtggccctcaggtaggggtgggcctcgtgccccagggtggactagagacatctcagccagaaggcgaggctggcgtgggtgttgaaacccctatggggcctccaagaagcccggctccgcacccctttcctttcccgctcttgtag

SEQ ID NO: 235839 - DNA, 558 bp, Artificial Sequence
  Description of Artificial Sequence: Synthetic coding sequence
atggcaggccatctggcaagtgattttgcgttttcgcctcctccgggaggaggcggagacggcccaggcggacctgagccaggatgggtggaccctcgaacatggctgtctttccagggaccccctgggggtcctggtatcggccctggagtaggccctggctccgaggtgtggggtatccctccctgccccccaccatacgaattctgtgggggtatggcctactgcggaccccaggtgggggtgggtctcgtcccccagggagggttagagaccagccaacccgaaggcgaggccggagtgggcgtggaatcaaactctgacggtgcaagccccgagccttgcacagttacaccaggcgcagtgaagctggagaaggagaagttagagcaaaaccctgaagaatcccaagacatcaaggccctgcagaaggagcttgaacagtttgctaaactactgaaacagaaacggattactttaggctacacacaagccgatgtccacccgggtggctccatctgggagggcatccaaccgaacgaccatctccccctgtag

SEQ ID NO: 235840 - DNA, 558 bp, Artificial Sequence
  Description of Artificial Sequence: Synthetic coding sequence
atggctggacatctcgcaagcgacttcgctttttctccgcctccaggagggggtggagacgggcctggcggtcctgagccgggatgggtcgatccaagaacttggctgtcctttcaaggacctcccggtggccctggcataggccctggtgtaggcccaggcagcgaagtttggggcatacccccatgcccacccccatacgagttttgcggaggcatggcatattgcggacctcaagtgggggtcggccttgtacctcaggggggtctcgaaacatctcaacctgaaggagaggcaggagtgggagtggaaagcaattccgacggggctagccctgagccttgtaccgtgacaccgggagctgtcaagctggagaaggagaagctagagcaaaacccagaagaatctcaggacatcaaggcgctccagaaagaattggagcagttcgccaaattgctcaagcagaaaagaattacgctgggctatacacaggctgatgtgcatcccggaggctccatatgggagggaatacagcccaacgatcacctccctctgtag

SEQ ID NO: 235841 - DNA, 495 bp, Artificial Sequence
  Description of Artificial Sequence: Synthetic coding sequence
atgtgcaagttgcgtcccctcctgcagaagtgggtggaagaggctgataacaatgagaatctgcaggaaatttgcaaggccgagactttggtccaggccaggaagcgcaagcggacgagcattgagaaccgcgtccgaggtaatctggagaatctgttcctccagtgtccaaagcctactctccaacaaatttcacatattgcccagcagttagggctagagaaagacgtcgtgagggtgtggttctgcaacagaaggcaaaagggaaagagatcctcctccgactatgcccagcgtgaagatttcgaggcagctggctcccctttctcgggcggtcccgtttctttcccccttgccccaggccctcattttggcacaccgggatatggatctcctcacttcactgccctgtacagttctgtacctttccccgagggcgaggcattcccccctgtcagcgtgaccacgctcgggagtccaatgcacagcaactag

SEQ ID NO: 235842 - DNA, 495 bp, Artificial Sequence
  Description of Artificial Sequence: Synthetic coding sequence
atgtgtaaactacgccctctcctgcaaaagtgggtggaggaggccgataacaatgagaatcttcaagaaatttgcaaagccgagacgctggtgcaggcacgaaagaggaagaggacgagcatcgagaaccgggttcggggtaacttagagaatcttttcctgcagtgtcccaaaccaacgctacagcagatctcccacatcgctcaacagttgggcctcgagaaggatgttgtgcgggtctggttttgcaaccggaggcagaaaggcaaacggagctcttctgattacgctcagagggaagattttgaagcagcaggtagtccattcagtgggggacccgtctctttccctttggccccaggcccacacttcggtactccgggatatgggagcccccatttcacagctctgtatagtagtgtcccattccccgagggtgaggcctttccaccagtcagcgtcacaacactaggttccccaatgcattctaactag

SEQ ID NO: 235843 - DNA, 2076 bp, Artificial Sequence
  Description of Artificial Sequence: Synthetic coding sequence
atgagtgccttacttcaggatccaatgatcgccggtcaagtgtctaaacccctgctatctgtgcgatctgaaatgaacgccgagctgcggggagaggataaagcagccacgagcgacagcgaacttaatgagcccctcctagccccagtggagagcaatgacagcgaggacacacccagtaaactgttcggcgctcgaggaaacccagcactgtcggatccgggaacacctgaccagcatcaagcgtctcagacccaccctccatttccagtcggccctcagccgctgctgacagcacagcaactggccagcgctgtggccggagtgatgcccggaggcccacctgctctcaaccagcctatcttgattccctttaatatggctggacagctgggtggccagcagggtctggttcttacacttcctaccgccaatctgaccaacatccaaggcttggtagccgcagccgctgccggagggatcatgacgctccccctacagaatctgcaggccacttcatccctgaacagccagctccagcagctgcaactccagttacagcagcaacagcaacagcagcagcagcaaccacctcccagcaccaaccagcatcctcagcctgcaccccaggcccctagccagtcccagcaacagcccctccagcctaccccgcctcagcagccaccacccgcttctcagcaaccacccgcacccacgagccagctgcagcaggcacctcagccacaacaacaccagccacactctcactcacagaaccagaatcaaccatcccctacacagcaatcttcctcaccaccccaaaaaccatctcagtcacccggacacggcctcccttctccactcactccacctaaccccctgcagctggtgaacaacccattggcttcacaagcggcagccgcagctgcggctatgtcttccatagcaagcagccaggcctttgggaatgcactgagctctctgcaaggggttaccggccagctggtgaccaacgcgcagggccagatcattggaaccatacccctaatgcccaacccgggaccctcctctcaagccgctagtggtactcaggggttacaggttcagccaatcacgcctcagctcctgactaacgcccaggggcaaataatcgccaccgtgatcggaaatcagatacttcctgtcattaacacccagggcattacgttgtcccctatcaagcctggccagcagcttcaccagccatcccaaacttctgtgggacaggctgcttcgcaaggaaaccttctccacctcgctcatagccaggcttctatgagccagtctcccgttagacaggcctcttcctcgtcttccagcagcagttcaagcagcgccttaagcgtggggcaattagtgtccaatccccaaacagctgccggagaagtcgacggggttaatcttgaagagatcagagagttcgccaaggcctttaaaataaggagattgagccttgggcttacccagacccaagttggacaagctctctctgctacagaggggccagcgtatagccagtccgccatttgtaggcatactatcctgaggagccactttttccttccccaagaggcacaagagaacacgatcgcaagctctctgacggctaagctgaacccaggcttgctctacccagcaaggttcgagaaactcgacataactcctaagtcggcgcaaaagatcaaacctgtcttggaaaggtggatggccgaagccgaagcacggcacagggccggtatgcagaatctgacggaatttattggaagcgagccgtctaagaaacgcaaacgacggacctcttttacacctcaggccctcgagatactgaacgcccactttgagaaaaatactcacccttcggggcaagagatgacggagatagccgagaaattgaactacgatcgggaggtggtgagggtgtggttttgcaacaagagacaggccctgaagaatacaattaaacggcttaaacagcacgagcccgctacagccgtgcccttagaaccccttaccgatagcctggaggaaaactcctag

SEQ ID NO: 235844 - DNA, 1968 bp, Artificial Sequence
  Description of Artificial Sequence: Synthetic coding sequence
atgagcgccttactgcaggatcctatgattgctggacaggtttcaaagccactgctctctgtcagatcggaaatgaatgccgaactacgcggtgaagataaggccgctacatccgactccgagctgaacgaacctctactcgcacctgttgagtctaatgattctgaggacactccttcaaaacttttcggggcacgtggtaaccctgcactgtctgacccaggcacgccagaccaacaccaggcatcacagacacacccaccatttccggttgggccacaaccactgctgaccgcccagcagctcgcgtctgctgtagctggggtcatgcccggagggcctcccgctctgaaccaacctattctcatcccttttaacatggcgggacaattgggaggccagcaggggttagtgctgacgcttcccactgctaacctgacgaatattcaagggctggtggccgctgcagctgctggcggaataatgactttgccattacagaatcttcaggcaacttctagcctgaacagccaactgcaacagctgcagcttcagctgcagcagcagcagcagcagcaacaacaacagcctcccccaagtactaatcagcacccgcagccggcaccacaggcccctagtcagagccaacagcaacccttgcaacccactccacctcagcagccaccccctgcgagccagcaaccccctgcccctacatcccagcttcaacaggcccctcagccacagcagcatcagccacacagccactcgcagaatcagaatcagcccagcccaactcagcagtcaagcagcccgccacagaaaccttctcaatcaccgggtcacgggctgccctcccccctgacgccacccaaccctctgcagctggttaacaatccactggctagccaagccgcagcggctgctgccgctatgtcaagtattgctagttcccaggcctttggtaacgccctttcttcattgcagggtgtcacaggccagctcgttactaacgcccagggtcagatcatcggtaccattcctctgatgccaaaccccggtccatccagccaggcagcaagcgggactcaaggattacaggtacagcccatcacgccacagttgctcacgaacgctcagggccaaatcatcgcaacagtaatcggaaaccagatactgcccgtgatcaacacccagggcataaccctcagtcccattaagccaggccagcagctgcaccagcctagtcagaccagcgtgggacaagccgcaagccagggcaatctcctccacctggcgcactctcaggcctcgatgtcccagagtccagtgcgccaggcatccagcagctcctcttcctcttcaagcagcagcgctctatcagtaggccaactggtatctaatccacaaacggctgcaggagaggtagacggggtcaatctcgaggagattagggaatttgctaaggcatttaagatacggagactgagcctgggcctgacacaaactcaggtgggacaagccctgtccgcaactgaagggccagcatattcacagtctgctatttgcaggtttgagaagctcgacataaccccgaagtctgcgcagaagatcaaaccggttctggaaagatggatggccgaagcagaggcccgacaccgcgctggtatgcaaaacctcacggagtttatcggtagcgagccctcaaagaagaggaaaagacgcacctcatttacgcctcaggccttggagatcctgaacgcccattttgagaaaaacacccacccaagcggccaggaaatgaccgagatcgccgagaaattgaattatgacagagaggtggtacgagtctggttctgcaataagagacaggccctgaagaacacaatcaaaaggctcaaacagcatgaaccagctaccgcggtacccctggagcccctcaccgactcactggaggaaaacagttag

SEQ ID NO: 235845 - DNA, 2076 bp, Artificial Sequence
  Description of Artificial Sequence: Synthetic coding sequence
atggagaagatttacagtagaggggaactccatcatttcatcgacgggtttaacgaagaaaagtctaactggatgagatatgttaaccctgcccacagtcctagagagcagaacctcgcagcatgtcaaaacggcatgaacatatatttttacaccattaaaccaatccccgcaaaccaggagttgctggtctggtattgtcgcgatttcgcagagcgcctacattatccttatccaggcgagttgacaatgatgaatctaacacaaacacagtcctccttgaaacagccatcaaccgaaaaaaacgaattgtgccccaagaacgtgcccaagcgggaatattctgtcaaggaaattctgaagctcgattccaacccctcaaagggaaaggacctatatcgcagtaacatcagtcctctgacatctgaaaaggacctggacgacttccggagacgaggtagccctgaaatgcctttttatccacgggtcgtgtatcccatccgcgcacccctgccagaggattttttgaaagcatcattggcatatgggatcgaacggccaacatatataacccgatcgcccattccctctagtacaacaccatcaccaagcgccagatcttcacccgatcagtctctgaaaagctctagcccccactcaagtccaggaaataccgtctctcctgtggggccagggtcacaggagcaccgggattcctacgcatatttaaatgctagctacgggactgaaggcctcggatcttaccccggttacgcccctctcccccatctacccccagcttttattccatcatacaatgctcattatcccaaattcctgctccctccttatggcatgaattgcaatggacttagtgctgtctcctccatgaatggtatcaataactttgggctgtttcccaggctgtgccccgtctactcaaatctgctgggagggggaagcctgccccatcccatgcttaatccaacctctctgcccagcagtctgccttcggacggtgctaggcggttgctgcagccagagcacccacgcgaggtcttagtgcctgcaccccactctgccttcagcttcacaggtgcggcagcttcaatgaaagataaggcgtgttcccccacaagcggatctccgaccgctggcacagcggcaacagcagaacatgtggtccagccaaaggcaacaagcgcagcaatggccgcaccatcttcagatgaggcaatgaacctgataaagaataaaaggaacatgacaggctataagaccctgccttaccctctgaagaagcagaacggaaagatcaaatacgaatgtaatgtatgcgctaagaccttcgggcaactgtctaatttaaaagtgcacctgcgggtgcactctggagagcgaccattcaagtgccaaacctgtaacaaaggtttcacccagttggcccacctacaaaaacactatttggtgcatactggggagaagcctcacgaatgccaggtgtgccacaaacgcttttcgagcaccagtaacttgaagactcacctgcgcctgcactcaggcgagaagccttaccagtgtaaagtatgtccagcaaagttcacgcagttcgtgcacctgaagctgcataagcgacttcatacgcgggaaaggccacataagtgtagccagtgtcataagaactacatacacctctgcagtctgaaggttcatctgaaaggaaactgtgccgctgcccctgcccctggtctgccactggaggacctgacacgcatcaatgaggagattgagaagttcgatatatcggacaacgccgatcgtcttgaagacgtagaagatgacatctccgtgattagtgtcgtggaaaaggaaattctcgccgtggtgaggaaggaaaaagaggagaccgggcttaaggtctctttgcagcggaacatggggaacggactgctcagctccgggtgtagcctctatgagagttccgatttgccattaatgaaactaccacccagtaacccgcttccactggttcccgtgaaggtgaaacaggagaccgtggagccgatggatccctag

SEQ ID NO: 235846 - DNA, 2370 bp, Artificial Sequence
  Description of Artificial Sequence: Synthetic coding sequence
atgaagatggatatggaggatgcagatatgaccctgtggaccgaagccgagtttgaggaaaaatgcacttacatcgtcaatgaccacccatgggacagcggagccgacgggggtacttctgtgcaggccgaggcttctcttccacggaatctgctgtttaagtacgctactaattccgaagaggtgatcggcgtgatgtcaaaagaatatatccccaagggaacacgattcggaccacttattggggaaatttacaccaatgacactgtgcctaagaacgccaaccgtaagtatttctggcgcatctactccagaggcgagctgcaccactttattgatggttttaacgaggaaaagagcaattggatgcgctatgtcaaccctgcgcactcacctcgggagcagaatcttgccgcttgtcagaacgggatgaacatatatttttacaccatcaaaccaatccctgccaatcaggaactcctggtttggtattgtcgtgatttcgccgaaaggctccactacccttatcccggagaattgaccatgatgaacctgacacagactcagtctagcctcaaacaaccgagcactgaaaaaaacgaactctgcccaaaaaacgtgcctaaacgtgagtactccgtgaaagagatcctaaaattagattcgaaccccagtaaggggaaggacctgtataggagtaacatctcaccattgacatccgaaaaggatctcgacgactttcgcagacgagggtccccggaaatgcctttttaccctcgggtggtataccccattagagcaccactcccggaagacttcctgaaggcttcactggcctatggcatcgaaagacccacctacattacacgaagtcccatacccagctccactacgcccagtcccagtgcacgctcttcccccgaccaaagtctgaaatcttccagcccacattcctctccgggtaacaccgttagccctgttggtccaggttcccaagaacatagggattcttatgcgtacctgaatgcgagctacggcacagaaggactcggatcctaccctggatatgctcctctgccgcacctgccacctgctttcatcccctcgtacaatgctcattaccccaagtttctcctgccgccatacgggatgaactgtaatggactcagcgctgtgtcttccatgaatggcatcaataacttcggactgtttccgaggctttgccccgtgtattccaatcttctgggcggtggttccctgccacaccctatgctgaaccccacttccctgccttccagtttgcctagcgacggtgccaggcggttgctgcaacccgagcatccccgagaagtcctggtccccgctccccactcagcgttcagcttcacaggggctgccgcaagcatgaaggacaaagcgtgctctcccacatcaggcagccccacggccggaactgcagcaacggcggaacacgttgttcagcccaaagcaaccagcgctgccatggccgctccctcatctgatgaggccatgaatctcatcaaaaataaaagaaatatgaccggctataaaactcttccgtacccgctcaagaaacagaatggtaagattaagtacgagtgtaatgtttgcgccaagaccttcggccagctgagcaatttaaaggtccatctgagggtgcactcaggagaacgtccatttaagtgtcaaacctgtaacaaagggtttacgcagttggcccacctgcagaaacattacctagtgcatacaggtgagaagccccacgagtgtcaagtttgtcacaagagattctccagtaccagtaatctgaaaactcacttgcgtctgcactccggcgagaagccgtaccagtgtaaagtgtgcccggctaaattcactcagttcgtgcacctaaagttgcacaagcggctgcacacacgcgagagaccccacaaatgctctcagtgtcacaaaaattatattcacctctgcagcctgaaggtgcatctgaaaggaaattgcgccgcagccccagcgcctggtctgcccctggaagatctgacaaggattaacgaagaaatcgagaaattcgatatctctgataatgcagatcggctggaggacgtggaggatgatatctctgtgatatctgtagttgagaaagaaatcctcgcagtcgttagaaaggaaaaagaggaaacagggctgaaggtgtcactgcaacgtaatatgggaaatggtttactgtcttccgggtgcagcctgtacgagtcctcggatctccctctgatgaaactgccaccaagcaaccctttgccgcttgtccctgttaaagtcaaacaagagaccgttgagccaatggatccatag

SEQ ID NO: 235847 - DNA, 2478 bp, Artificial Sequence
  Description of Artificial Sequence: Synthetic coding sequence
atgctcgacatttgcttagagaagcgggttgggactaccctcgccgcaccgaagtgcaactccagtacagtgcggttccagggcctggccgagggcactaagggtacaatgaaaatggacatggaagatgctgatatgaccctgtggaccgaggcggagtttgaggaaaagtgtacctacatcgttaacgaccacccttgggactctggggctgatggtggaacatcagtccaggccgaggcatccctgcccaggaatctgctgtttaagtacgccaccaattccgaggaagttatcggcgttatgagcaaggaatacatcccgaaaggcacgcgcttcggaccactaattggagagatttacactaatgacacggtcccgaaaaacgccaaccgcaagtacttttggcggatctattctaggggggagctccatcattttatcgacggctttaacgaagagaaatctaactggatgcggtatgtgaatcccgctcactccccaagagaacagaacctggctgcctgccagaatggtatgaatatctacttttatacaattaaacccatccccgctaatcaagagctgcttgtgtggtactgccgagacttcgcagaacggttgcattacccgtatcccggtgagctcactatgatgaatctgacccagacccagagtagtttaaaacaaccatccacagagaagaacgagctgtgtcctaagaacgtgcctaaacgagagtattcagtcaaggaaatcctaaagctggacagcaatccaagcaagggaaaagacctttaccggtcaaatataagccctttaacgtctgaaaaggaccttgacgatttccggcgaagaggatccccagaaatgccattctatccacgggtggtgtacccaatacgagcgccactgcccgaagactttctgaaagcgtcactggcatacgggattgaaaggccgacctacattactagatctcctattcccagctcaacgaccccgtcaccgagcgccaggtcttctccggatcaatcccttaagtcaagctctccacactcatctcccggaaataccgtgtctcccgtggggccagggtctcaagagcatagagactcctatgcatatctgaacgctagttatggcaccgagggactgggaagttacccgggatacgcacccctgcctcacttgccccctgccttcataccaagttataacgctcattatcccaaatttctccttccgccatatggaatgaactgcaacggtcttagtgccgtctcctccatgaacggtatcaataacttcggattgttccccaggctctgtcccgtatattcaaacctcttgggcggagggagcctgccacaccccatgctgaatcccaccagcctgccaagcagcctgccgtccgacggcgcacgcagactcctgcagcctgagcatccgagagaggtgttagttccagccccacatagcgcgttttctttcacaggggctgccgcttcaatgaaggacaaagcctgctcgccgactagtggttctccaacagctggaactgccgctacagccgagcacgtggtgcagcccaaggccacgagtgccgcaatggcagcaccatcatccgacgaagccatgaatctaattaagaacaaacgaaacatgactggctataagactttaccttaccctttaaagaaacagaatggcaagatcaaatatgagtgtaacgtgtgtgccaagacattcggccagctctcaaacctcaaggtccatctgagagtccacagtggcgaaaggccctttaaatgtcaaacctgtaacaagggttttactcagttagcccacctccagaagcactacttggtgcataccggagaaaagccgcacgagtgccaggtctgccacaaaagattttcatccacttccaaccttaagactcacttacgcctccactccggggaaaaaccgtaccaatgcaaggtctgcccagcaaagttcacacagttcgtccatctgaaattacacaagagactccacacacgcgagcggcctcacaaatgctctcaatgtcataagaactacatacatctatgtagcttgaaagtgcacctgaaggggaattgcgcagccgcaccagctcctgggctgccactggaggacctcacccggattaatgaagagatcgagaaattcgatattagcgacaatgcagacaggctggaagatgtagaagatgacatttcagtcatcagcgtggtagagaaggagatcttggccgtagtgcgaaaagaaaaagaggagacaggtctgaaagtctcccttcaacgcaacatggggaatggcctgttaagctcaggctgtagcctgtacgaatcttccgatctgcctctcatgaaactcccaccatctaatcctctaccactggtgccagtgaaggtcaagcaagaaaccgtggagcccatggatccctag

SEQ ID NO: 235848 - DNA, 192 bp, Artificial Sequence
  Description of Artificial Sequence: Synthetic coding sequence
atgaaaatggatatggaagacgccgacatgaccttatggaccgaggccgagtttgaagagaaatgcacatacatcgtgaatgaccacccatgggattctggcgctgacggcggaactagtgtgcaggccgaggcttcacttcctcgaaatctgctttttaaatatgccacaaattctgaggaggttatctag

SEQ ID NO: 235849 - DNA, 2367 bp, Artificial Sequence
  Description of Artificial Sequence: Synthetic coding sequence
atgaagatggatatggaggatgctgatatgactttgtggacagaagccgagtttgaagagaaatgcacttacatagtgaatgatcatccatgggactctggagctgatggcggaacgtccgtgcaagccgaagcaagtctgcccaggaacctactgttcaagtacgctaccaattccgaagaagtgattggcgtaatgtctaaggagtatatacctaaaggaaccaggttcggaccattgatcggtgagatttacactaacgatacggtcccaaagaatgctaatcgaaaatacttttggagaatatattctcgtggtgagcttcatcattttatcgatgggttcaacgaagagaagtctaattggatgcggtatgtcaaccccgcacactccccaagagaacagaaccttgccgcttgccagaacggtatgaatatttatttttacactataaagccgatcccagctaaccaggaactgctggtttggtattgccgggatttcgctgaacgcctccactacccttacccaggcgagctcaccatgatgaacctcacccaaacacagtcatccctcaaacaaccctctacagaaaagaatgagctgtgtccaaagaacgtgcccaagagagaatactctgtgaaagagatattgaagctcgacagtaatcctagcaagggaaaggatctctacaggagcaatatatcccccctcacaagcgaaaaggatctggacgacttccgaaggaggggttctccagagatgcccttctaccctagagtagtgtaccccatcagagctccactcccagaggacttcctgaaggcttcccttgcttatgggatagaacggccaacctacattaccagatcccccattcccagcagcaccacaccaagtccgagcgccagatcctcccctgatcagtccctaaagagctcttcgcctcactcctcccccggtaatacagtttcccctgtggggccaggttcgcaggaacaccgggactcttacgcatatttaaatgcttcctatgggacagagggactcggaagttatccgggatacgccccattgccacacttgcccccagcattcattccctcctataacgcacactatcctaaattcctgttaccaccctacggaatgaactgcaatgggctgtccgcagtgtcttccatgaacggcatcaataatttcgggctgttccccaggttgtgccctgtttacagcaacctgctagggggtggctccttgccgactccctgcagtacccccctgctgcccagcagtctgccatcagatggagccaggcgactgttgcagccagaacaccctcgcgaggtactcgtgcctgcaccacacagcgccttcagcttcacgggcgctgccgctagtatgaaggataaagcgtgcagccccacctccgggtcaccgactgctggaacggccgctaccgctgagcacgttgtgcagcccaaagccaccagtgccgcaatggcagccccaagttcagatgaagctatgaatctgatcaaaaacaaaaggaacatgactggttacaagacactgccctacccactcaagaagcagaatggtaagattaagtacgaatgcaatgtgtgcgccaaaacctttggacagctgtctaatttgaaggtccaccttcgggtgcacagcggcgagcggcctttcaagtgccagacctgtaacaaggggttcacccagttagctcatctccaaaagcactatctagttcacacgggcgagaagccccacgagtgtcaggtgtgtcacaagcggttcagcagtacaagcaatctcaagacacacttgagactccactctggcgagaagccttaccaatgtaaagtttgccctgccaagttcactcagtttgtacacctgaaattgcacaagcgacttcatactagagagaggccacataagtgttcccaatgtcacaagaattacatacacctgtgttcccttaaagtgcacctgaaagggaattgtgcagccgctcccgctcctggtcttcccctggaggatctgaccagaatcaatgaagagatcgagaagttcgacatcagcgataacgcagatcgactggaggacgtggaggacgatatcagcgtgattagcgtggtggagaaggaaatcctggcagtcgttagaaaagagaaggaagaaaccgggctcaaggtgtctcttcaacggaacatgggcaacgggctgctttcgtctggctgttcactgtatgaatcaagtgaccttccgttgatgaaactgcctcctagcaaccctctgcctctagtgccagtgaaggtgaagcaagagaccgttgaacctatggacccctag

SEQ ID NO: 235850 - DNA, 1716 bp, Artificial Sequence
  Description of Artificial Sequence: Synthetic coding sequence
atggccttgccaagaccttctgaggctgtacctcaggataaggtgtgctacccaccggagagctctcctcaaaacttggccgcttattataccccttttcctagttacggtcactatcggaattccctggcaactgtggaagaggacttccaaccatttaggcagctggaagccgctgccagtgcagcgcctgctatgcctccctttcccttcagaatggccccacccctactatctcccggactagggctgcaaagagagccgctctacgacttgccatggtacagcaaactgccaccgtggtaccccattccgcatgtacccagagaggtcccaccctttctgagcagctcacatgagtacgcgggtgcaagctcagaggatttaggccaccaaattatcggcggagacaacgagtccgggccttgctgcggacctgacactctaatccccccaccccctgctgatgcaagcttgctcccagagggactccgcacatcccagctcctcccctgctccccttctaagcagtccgaagacggtcccaagccgagcaaccaggaaggcaaaagcccagctagattccaatttactgaagaggacctgcattttgtgttgtacggcgtgacaccgagtctagaacacccagcctctctgcatcacgcaatttcaggattgctggtccccccagactcaagcggctctgatagcttaccacaaacactggataaagactccctccaattgcccgaaggcctgtgcctgatgcagaccgtgttcggcgaagtcccacactttggcgttttttgctcttcattcatagccaagggcgtacggttcggcccattccagggtaaggtcgtaaacgcttccgaggtgaagacgtatggcgacaactcagtcatgtgggagatatttgaggatgggcatctgtctcatttcatagacggcaagggaggaactgggaactggatgagctacgtcaactgcgcacgctttccgaaagaacagaatctagtggccgtccagtgccagggccatattttttacgaatcttgtaaagagatacaccaaaatcaggaactgcttgtatggtatggcgactgttatgaaaagttcctggatatccctgttagcctgcaggttacagaacccggaaagcaaccgagcggcccaagcgaagagagtgccgaagggtatcgatgcgaaaggtgcgggaaggtgttcacctataaatactatcgggataagcacctcaagtacacaccgtgtgtcgacaagggggaccggaaattcccctgcagcctttgtaaacgctcattcgagaagcgtgatcgcctccgtattcacatcctgcatgtgcatgagaagcacaggccccacaagtgcagcacctgcggcaaatgcttctcacaaagtagctcactcaacaagcacatgagagtgcactctggcgaccgaccctatcagtgcgtctattgtactaagcggtttaccgcgtcttcgatactgcggacccatatccgccagcatagtggcgaaaaaccattcaagtgtaaatattgtgggaagtcttttgctagccatgccgctcacgatagccatgtcaggaggagtcacaaagaggacgacggctgttcctgcagcatatgcgggaaaatcttttcggaccaagaaaccttctattctcatatgaaattccacgaagattattag

SEQ ID NO: 235851 - DNA, 303 bp, Artificial Sequence
  Description of Artificial Sequence: Synthetic coding sequence
atggcgctgcccagaccaagtgaggcagtgcctcaggacaaggtgtgttaccctcctgaatcctccccccagaatctggcagcctactataccccctttccgagttatgggcactacagaaactctctcgctacagtcgaagaggacttccagcccttccggcagctggaggcggctgccagtgccgcacctgccatgcccccttttccatttagaatggccccaccactcctatcccctggcctgggcctgcagcgagagccattgtacgatctgccctggtatagcaagcttccaccctag

SEQ ID NO: 235852 - DNA, 3831 bp, Artificial Sequence
  Description of Artificial Sequence: Synthetic coding sequence
atgcgttctaaagccagagctcgcaaactggcgaagagcgatggcgatgtggtgaacaacatgtatgaacctaatcgggatttactagcaagccactccgctgaggacgaggccgaggattccgccatgagccccatccctgttggccctccttcaccgttccccacaagcgaagattttacacctaaagaagggtctccatacgaggctcctgtgtacatacctgaagatatcccaatccccgctgacttcgagcttagagagagcagcatcccaggtgccggacttggcgtttgggccaaacggaagatggaggcaggtgagcgattgggaccatgtgtcgtcgtgccccgagccgcagcaaaagagacagatttcggctgggaacagatccttactgatgtcgaggttagcccgcaggaaggttgtattacaaagatatcagaggatctgggtagtgaaaagttctgcgtggacgccaatcaggcaggtgccggatcgtggctcaagtacattcgcgtcgcttgttcctgcgatgatcagaatctgactatgtgccagatttctgagcagatatattacaaagtgataaaagacatagagccaggggaggagctgttggttcacgtaaaggagggggtttatccactgggcaccgtgcccccaggcctggatgaggaaccaacctttagatgcgatgagtgtgatgagctgttccaatcgaagttggatctgaggagacacaagaagtatacttgcggttccgtaggagctgccctgtatgagggcttggccgaagagctgaagcctgaaggactgggaggcggatctgggcaggcccatgaatgtaaggactgcgagagaatgtttcccaataaatattctctggaacagcacatggtgatccacaccgaggagagggagtataagtgcgatcagtgtcctaaagccttcaactggaagtcgaatctcatccggcaccagatgagtcatgattcaggaaagcgcttcgagtgtgagaactgcgttaaggtattcaccgatccgagtaacttgcagagacacattcggtcacaacatgtgggtgcccgagcacacgcgtgtcccgactgcggaaaaacttttgcgacaagctctggcctgaagcaacacaaacatatccatagcaccgtgaagccattcatctgcgaggtgtgtcacaaaagctacacccagtttagcaacctttgtcgccacaagcgcatgcacgcagactgccgcacccagatcaaatgcaaggattgcgggcagatgttcagcactactagtagtttgaacaagcatcgccgattctgtgaaggaaaaaatcactacactcccggtggaatatttgctcccggtctacccctgactcctagtcctatgatggacaaagctaagccctcccccagtttaaatcatgcatccctgggcttcaacgagtatttcccttcccgaccccacccagggtccttgcctttcagtactgccccacctacattccccgctcttacgccaggattccctgggatcttccctccttccctatatccgagaccacccctgttgcctcccacttctcttctgaaaagtccactgaaccatacacaggatgccaagcttccctccccactcggcaacccagccctgccattggtgtccgccgtcagtaatagcagtcagggaactaccgccgcagcgggacctgaagaaaagtttgagagtaggctggaagacagctgcgtggagaaattgaagacccggtcatccgacatgtcagacgggtccgacttcgaagacgtaaatactactactgggaccgacctggataccacaaccgggacgggaagtgaccttgattctgatgtggactccgaccccgataaagacaagggtaaaggtaaatccgcagaaggccagcccaaatttggcggaggactcgcccctccaggtgctccgaatagcgtggctgaagtgccggtgttttactcccagcatagcttttttcctccacctgacgaacagctgctgacagccacgggagccgctggtgattctatcaaagctattgcctcgatcgccgagaagtattttggacccggtttcatgggaatgcaggaaaagaaactgggatccctcccctaccatagtgcctttccttttcaattcctacctaattttccacatagcctttaccccttcactgatcgggctctcgcccacaatctcctcgtgaaagccgagccaaagagtccccgtgatgccttaaaagtggggggaccatctgctgagtgcccgtttgacctgacgaccaagcccaaggacgtgaagccaattctgccgatgccaaaagggccatcagctcctgcttccggggaggagcaacctctggatctgtctatcggatcacgcgctagagcctcccaaaacggcggaggacgggaacccagaaaaaaccacgtgtatggcgaaagaaagctgggagccggagaggggcttcctcaggtgtgtcccgcaagaatgccccagcagcctccacttcactatgccaaaccgagtccattttttatggatcccatttattcacgtgttgaaaagcggaaggtgaccgatcctgtaggcgcactgaaggagaagtacctccgccctagccctttgctgtttcatcctcagatgtctgccattgaaaccatgaccgagaagctggaatcgttcgccgctatgaaagccgacagcggctcctctctacaaccactgccccaccaccccttcaacttccggtcacccccacccacactcagtgatcccatccttaggaaaggtaaggaacggtacacatgtaggtactgtggaaaaatatttccaaggagcgccaacttaacacggcacctaaggacacataccggggaacagccgtaccgatgcaaatactgtgatagatccttcagtatttctagtaatctccagcgccatgtgaggaatattcataacaaagagaaaccttttaagtgccacctctgcaataggtgtttcggccaacagacaaacttggaccgacacctaaagaaacacgagcacgagaacgcccctgtcagccagcatccgggagtgcttacaaatcaccttgggacctctgccagctctccaactagtgagtcagacaatcacgccctgctggacgaaaaagaagatagttatttctctgagataaggaacttcattgcaaatagtgagatgaaccaggcctcgacacgtactgagaagcgcgcagacatgcagatcgtggacgggtctgctcagtgtcccggattagcatccgagaaacaggaagacgtcgaggaggaggacgatgacgacctggaggaggatgacgaagactccctggctggaaaaagtcaggacgacaccgtgagccctgcgccagaacctcaggccgcttacgaagatgaggaagacgaggaacctgccgctagccttgccgtagggtttgaccatacacgtaggtgcgcagaggaccatgaaggaggtttgttggccctcgaacctatgccaacattcggcaaaggtctggacctgcggagagctgcggaggaagctttcgaggtgaaggacgtgctgaatagtacgctggatagcgaggcgctcaaacatacactatgccgccaggccaagaatcaagcatacgccatgatgctgtcgctgtctgaagacactccccttcacactccctcgcaggggtctctagacgcctggcttaaggtgacgggggcaaccagcgagagcggcgcttttcacccaattaatcacctgtag

SEQ ID NO: 235853 - DNA, 3831 bp, Artificial Sequence
  Description of Artificial Sequence: Synthetic coding sequence
atgaggagtaaagccagagcaaggaaactggccaaatcggatggcgacgttgtcaataacatgtatgagcccaatcgtgatctgctggcctctcatagcgctgaggatgaagcagaggactccgcgatgagtccgattcctgtcggcccaccatcaccatttccaacctctgaagactttacccctaaggaaggtagtccctacgaagccccagtgtacatccctgaagacatcccaatacctgctgattttgagcttcgcgaatcaagcattcctggagccggactgggcgtctgggccaaacgtaaaatggaggccggtgagagactggggccatgtgtcgtggttccacgcgcagctgccaaggaaacggacttcggatgggaacaaatactcacggacgttgaagtgtccccccaggagggttgcataacaaagataagcgaagacctgggttcagaaaagttctgtgtggatgccaatcaagcgggagctgggtcctggcttaagtacatcagagtggcctgctcctgcgacgaccagaatctgactatgtgtcagataagcgagcaggtcatctattataaggttatcaaggacatagaacccggagaggaactgctcgtccatgtgaaggagggcgtctaccccctgggaacagtgcctccgggactcgacgaagaacccacatttaggtgcgacgaatgcgatgagctgtttcagtccaaactcgatcttaggagacacaagaagtatacctgcgggtctgtgggcgctgcactctacgaagggctcgcagaagaattgaagccagagggtctcgggggagggtcaggccaggcccacgaatgcaaagactgtgaacgcatgtttcccaataaatacagcctagagcaacatatggtaatccacacagaggagcgagagtacaagtgcgatcaatgccccaaggcttttaactggaaaagtaatctcatacgacaccagatgagccatgatagtggaaagcgatttgagtgcgaaaattgcgtcaaggtctttacagatccttctaatcttcagcgacatatcagaagccagcatgtgggcgcaagggcacatgcctgtccagactgtggaaagacctttgccacctcgagtggacttaagcagcataagcatatccattcaacagtgaagccattcatttgtgaagtctgtcacaagagctatactcagtttagcaatctctgtaggcacaagcggatgcacgccgactgtaggacacagataaagtgcaaggactgtggtcagatgtttagcaccacttccagcctgaataaacaccggagattttgcgaaggcaaaaaccactatacccctggagggatattcgcccctggcctgccactgaccccttcccccatgatggataaggccaagccatcgccgagtctgaatcatgccagcctgggctttaacgagtactttccttcaaggccacaccctgggagcctgccattctccaccgccccacccaccttccccgctctgactcccggatttcctggaattttcccaccgagcctgtaccccagacccccactcctgccaccaacatcactgctgaagtcgccgctgaaccatacgcaggatgcaaaactgccttcgccgctggggaatcccgcactgcccctcgtgagtgctgtgagtaattccagccagggcacaaccgcagctgcaggacctgaggaaaagtttgagtcacggctggaggattcctgtgtggaaaagctaaaaaccagatcctctgatatgagtgatggctctgactttgaagacgttaatacaaccacaggcaccgacctggacaccacaactggcaccggtagcgatctggatagtgacgtagactccgacccagacaaagataaaggcaagggcaaatcagctgaggggcagccaaagttcggcggtgggctagctcccccaggggcaccgaattccgttgccgaagtgcctgttttttactctcagcattccttcttccccccacccgatgagcagcttctgacagcaaccggcgcagcaggcgacagtataaaagcgattgcctctatcgctgagaagtatttcggtccaggctttatgggaatgcaggaaaaaaaacttggttctctgccataccactccgcattccctttccaattcctgcctaacttcccacactctctctatccattcaccgaccgcgctctggcccacaatctgttggtaaaggccgaacccaagagccctagagacgccctcaaggtcggtggaccatcggcggagtgcccgttcgatctgacaaccaaaccaaaagacgtaaagccaatacttcccatgcctaagggccctagcgcaccagccagtggcgaggagcagccactagacctctctatcggcagtagagcgagagcatcacagaacggcggagggagagaaccacggaagaatcatgtgtatggggagagaaaattgggtgctggggaggggctgccccaagtatgcccagcgcgtatgccacagcagcccccactgcactatgccaagcccagtcctttcttcatggacccgatctacagagtggagaaaaggaaggtgactgatcctgtgggggctttgaaagaaaaatacctgaggcctagtcccctgctctttcatccacagatgtcagcaatcgagaccatgactgaaaagttggagtcctttgctgccatgaaagctgactcagggtcatccctccaaccgttgccgcaccaccccttcaattttcgctccccacccccaaccctgtcggatcccattctacgaaaggggaaggagaggtacacgtgcagatattgcgggaaaatctttccaaggagtgccaatctgactagacatttgagaacgcataccggggaacagccttataggtgtaaatattgtgaccgctccttttccatctcctctaatttacagcgccacgtccgaaatatccataacaaggagaagcccttcaagtgtcatctttgcaaccgatgcttcggtcagcagactaaccttgaccgccatctgaagaagcatgaacacgagaatgcacccgtgtcccaacaccccggagtgctgaccaaccatctggggaccagcgctagctctccgaccagcgagtccgataatcatgcattgctggacgaaaaagaagatagctacttctcagagattaggaatttcatagccaattccgaaatgaatcaagctagcactcggacagaaaagcgcgcagacatgcaaattgttgatggttccgctcagtgtcccggacttgcctctgagaagcaggaggacgtagaggaggaagacgacgacgacttggaagaggatgatgaggattcacttgccggtaaatcccaggacgatacagtctcacccgctcctgagcctcaggccgcttatgaggatgaagaagacgaggagcccgctgcttccctggcggttggattcgaccatactcgacggtgtgcagaggaccacgaagggggattgttggcactcgagccaatgccaacattcggcaaaggcctcgacctaagaagggctgccgaagaggcattcgaggtgaaggatgtgttgaattctaccctggactccgaagctcttaagcacaccctatgtagacaggccaagaatcaggcttacgccatgatgcttagtttgtccgaggatactccactacatacaccaagccaggggtccctggatgcctggctaaaggtcacaggagccaccagtgagagtggtgcgtttcaccccatcaaccatttgtag

SEQ ID NO: 235854 - DNA, 3279 bp, Artificial Sequence
  Description of Artificial Sequence: Synthetic coding sequence
ttctgcgcttatagtgcaaagatctactataaagtcataaaggacatcgaacccggtgaggagctgctggtgcatgttaaagagggtgtgtaccccctaggcaccgtgcctccagggttagatgaggagcctacatttcgctgtgatgagtgtgatgaactctttcaaagcaagttggacctgcgcaggcacaaaaagtatacctgcggctctgtgggcgcagctctgtacgaagggctggctgaggagttgaagcctgaggggttgggcggaggatctgggcaggcacacgaatgtaaggattgcgagcgtatgtttcccaacaaatatagcctggaacagcacatggtgatacacaccgaggagagagaatataaatgcgatcagtgccctaaagcattcaactggaagtccaatttaataagacaccaaatgagccacgattcggggaagaggttcgagtgtgagaactgcgtgaaggtttttaccgacccctcaaatcttcagcggcacattcgtagccagcacgtgggggctagggcccacgcttgcccagattgcggtaaaactttcgctacatcctccggactgaagcagcataagcacatacattccaccgtgaaaccttttatatgcgaggtgtgccacaagagttatactcagttttccaacctgtgccgacacaagagaatgcacgctgattgccgaacccagatcaagtgtaaggactgcgggcaaatgttctctaccacctccagcctgaacaagcataggcgcttctgcgaaggtaagaatcattacacgcctgggggtatctttgcaccaggactgcccctcacacccagccccatgatggacaaagcaaaaccttcgccatctctgaaccacgcctcgctcggttttaatgaatacttcccaagccgtccacacccgggttcgctccccttttcaactgctccacccaccttcccagcattgacacctggctttccaggcatctttcccccttccctctatccccgtcccccactgctgcctcctacctctctcctgaaatcaccactgaatcacactcaggacgcaaaactgccctccccgctgggcaaccccgcacttccactggtgagtgccgtgagtaactcctctcaaggcacaacggcagccgcaggtcccgaggaaaagttcgagtcacgcctggaggactcatgcgtcgaaaaattgaaaacacgctcctcagacatgagcgatggttccgactttgaggatgtaaacactacaaccgggaccgatctcgatactacgactggtactggaagcgacctggacagcgatgtggacagtgaccccgataaagacaaagggaaaggtaagagcgccgagggtcagcccaaatttgggggtggactggccccacccggagccccaaactccgtggccgaggtgcctgttttttactcccaacacagtttcttcccaccccctgatgagcagctcctgacagcgacaggggcagcaggagacagtattaaggcaatagcctctattgcagagaaatactttgggcctggctttatgggtatgcaggaaaaaaaactcggatccctcccataccacagtgccttcccctttcagtttctgcctaactttccgcatagtctatatccattcacagaccgggcactagcacacaacctcctggttaaagcagagccaaagtctccacgtgacgcactcaaagttggcggaccctccgccgagtgcccttttgatctcaccacaaaacctaaagacgtgaaacccatccttcccatgccaaaagggcctagcgcacctgcaagtggcgaggagcagcccctggacctgtcaatcgggtcaagagccagggctagtcagaacggcggtggccgagagcctagaaaaaatcacgtttatggggagagaaagctgggagcaggagagggactgccacaggtctgccccgcaaggatgccccagcagcctccgttacactatgctaagccatctccttttttcatggaccctatttattccagggtggagaagcggaaagtgactgatccagtgggagccctgaaggagaaatatttgcgtccatcccctctgctatttcatccccagatgtcggccattgagaccatgaccgagaaactggagtcatttgccgcaatgaaggccgattctggctcttccctgcagcccttgccccaccacccttttaattttcgctccccaccacccacactgagtgacccaattctgaggaagggcaaagagcgctatacttgtcgatattgtggcaaaatattccctcggtcagccaacctgactcgtcatcttcgcacacatacaggtgagcagccctaccgttgtaaatactgcgatcgctcgttttctatctctagcaacctacagcgccacgttaggaatatccacaacaaggaaaaaccatttaagtgccacctttgcaaccgttgtttcggccagcagacaaacctggataggcatctaaagaagcatgagcatgagaacgcccctgtgagccaacaccccggtgtcctgacaaaccacctggggacgtcagccagctcacccaccagcgagagcgataaccacgctctgctggatgaaaaggaggattcctatttctctgaaatcagaaactttatcgccaatagcgaaatgaatcaggcatccacgcggacagaaaagagagctgatatgcaaattgtagacggctctgcccagtgtccgggactggcctctgagaaacaggaggacgtagaggaagaggacgacgacgacctggaagaagacgatgaggactccctagctggcaaatctcaggatgataccgtgtccccagcccctgagccccaggcagcctatgaggacgaagaagacgaagagcctgcagccagcctggcagtggggttcgatcacacccgacggtgcgccgaggatcacgaggggggactgctggcactggagcccatgccaaccttcgggaagggactcgatctcaggcgtgccgctgaggaagcatttgaggtcaaggacgtcttgaactctaccctcgactccgaggctctcaaacatacactgtgtcggcaggccaagaatcaggcatacgctatgatgctgtcactgtccgaggacacccctctgcacacgccaagccaggggagcctcgacgcctggctgaaagtgactggcgctacaagtgaaagtggcgcattccacccaattaaccacctttag

SEQ ID NO: 235855 - DNA, 3828 bp, Artificial Sequence
  Description of Artificial Sequence: Synthetic coding sequence
atgcgatcaaaagctcgggctaggaagctagctaaatcggacggcgacgtggtaaacaatatgtacgaacctaatagggacctgctcgcgtctcactccgctgaggacgaggccgaggactcggcgatgtctcccatccctgtgggtccccctagccctttcccaacctctgaggacttcacccccaaagagggaagcccatatgaggctcctgtgtacattcctgaagacatcccaatcccagccgactttgaactgagagaaagtagtatccccggtgccggtctcggtgtctgggcaaagaggaagatggaagccggagaaaggttaggtccatgcgtcgtggtccccagagccgcagcgaaggagactgacttcggttgggagcagatactaactgatgtggaagtgagtccccaggagggatgtattacgaagatttcagaggatcttggtagcgagaaattttgcgtcgacgcaaaccaggccggagccggtagctggctaaaatatattcgcgtcgcttgctcgtgtgatgaccagaacctgacaatgtgtcagatatctgaacagatttattataaggtgataaaggatattgagccaggcgaggaactcctcgtgcatgtaaaggagggcgtgtatcctcttggaacagtacctcccggtctggacgaggagcccacctttagatgcgatgagtgtgatgagttgtttcagtccaaactcgacctgcgcaggcataagaaatatacttgcggttcagtgggcgctgcactgtacgaggggctcgctgaagagctcaaacccgagggtctcggaggcggtagcggacaggctcacgaatgtaaagattgcgagcgcatgtttcccaacaagtattcccttgagcagcacatggttattcacacagaggagagagagtataagtgtgaccagtgtcccaaagcctttaactggaagtcgaatctaattaggcaccaaatgagccacgattctggtaagcgttttgaatgcgagaactgtgtgaaagtgtttacggatccatcaaacctgcaaaggcatatacgctctcagcacgtgggagctcgggctcacgcctgtccagattgtgggaaaacattcgccaccagcagcgggctcaaacagcataagcacatccatagcacagtgaagcccttcatatgtgaagtctgccacaaatcctacactcagtttagcaatctgtgccggcacaagaggatgcatgctgattgccgcacccagatcaagtgtaaggattgtggacagatgttctcgaccacaagctcactcaacaagcacagacgcttttgcgaggggaagaatcactacaccccaggcggtattttcgcccctggcctccctctgaccccttccccaatgatggacaaggcgaaaccatcaccgagcttaaatcatgcctcactgggtttcaacgagtactttcctagcaggccacaccctggttccctgcccttcagcaccgcacctccaacgttcccagctcttacgcccggttttcccggtatcttcccccctagcctgtatcccagaccacctttgctacctccaactagcctgctgaaatctcccctaaatcacacacaggacgcgaagctgcctagcccactgggcaacccagctctgccactcgtgtcagctgtctctaactcctcacaagggaccactgccgcagcaggccctgaggagaaatttgagtcccgcctagaggactcctgtgtggagaaactgaagaccaggtcatctgatatgtccgatgggtctgatttcgaagatgtgaacactacgacggggactgacctcgacactaccactggcactggctccgacttagatagcgacgtggatagtgatccggacaaagataaaggaaaaggcaaatccgctgaaggacagccgaagttcggcggaggcttggcaccgccaggggctcccaatagcgtggctgaagtccccgtgttctattcccagcattctttcttccctccccctgatgaacaattgctgaccgctactggtgcagctggcgactccattaaggctattgcgagcattgcagagaaatacttcggccctgggtttatgggaatgcaggaaaagaagctaggttctctcccctatcattccgcttttccctttcagttcttaccaaatttcccccacagtctgtatccattcacagaccgcgctctcgcgcacaatctccttgtgaaagcagagccaaaaagtcccagagacgctctgaaggtggggggacccagtgccgaatgccctttcgatcttactacaaagcccaaggatgtcaagcctattctcccaatgcccaaaggtcctagtgcccctgcaagcggagaggaacagccattagacctgagcatagggtccagggcacgcgcaagtcagaacgggggagggagagaaccgcgtaagaatcacgtctacggggaacgaaagctgggggctggtgaaggcttgccgcaagtctgtccagctaggatgccacagcaacccccactgcattatgccaaaccgtcaccattcttcatggacccgatctatcgggtagagaaaaggaaagttacagatccagtgggcgctctcaaggagaagtacctcaggccttctcctcttctgtttcatccccaaatgagcgccatcgaaactatgacagagaagcttgagtcttttgctgccatgaaggccgactcaggcagttctcttcagcccctgccacatcacccgtttaatttccgtagtccaccacctactctgtccgaccccatccttcgcaaaggaaaggagagatacacatgtcggtactgcggtaaaatattccctcggagcgctaacctcacccggcacctacgcacccataccggtgagcagccttacagatgtaaatactgcgacaggtctttctccatatcttcaaatctgcagagacatgtgagaaacattcataacaaagaaaagccattcaaatgccacttatgtaatcgatgtttcggtcagcaaacaaacctagaccgtcacctcaaaaaacacgaacatgagaacgccccagtaagtcagcacccaggcgtactcactaaccatttaggtacatccgccagtagtccgaccagcgagtccgacaaccacgcgctattggatgagaaggaagattcatacttctctgaaatccgcaacttcattgctaattccgagatgaatcaggcatccacccgtacggagaaacgagccgatatgcagatcgtggatggtagtgctcagtgtcctggcctggccagtgagaaacaggaagatgtggaagaggaggatgacgacgacctggaagaggatgatgaagactcgctggctggaaagtcccaggacgacaccgtttccccagccccagagccacaggcagcatacgaagatgaagaagacgaggaaccagctgcctctctcgctgtgggctttgaccatacccgccgatgcgccgaggaccacgagggagggctgctggcattggaaccaatgcctactttcgggaagggattggacctgaggcgagctgctgaagaagcttttgaagtgaaggatgttcttaattctacccttgactccgaggccctgaagcataccctgtgccgccaggctaaaaatcaggcgtacgccatgatgctgagcctgtctgaggatactccactgcatacgccttcacaaggaagcttggacgcctggctgaaggtcaccggtgcaacctctgagtcgggggctttccacccaattaatcacctgtag

SEQ ID NO: 235856 - DNA, 3771 bp, Artificial Sequence
  Description of Artificial Sequence: Synthetic coding sequence
atgagatccaaggcacgcgctagaaaactggcaaagtctgatggggatgtggtgaataatatgtacgaacctaaccgcgatttactggcttctcattccgctgaggacgaggccgaggatagcgcaatgagcccaattccagttgggcctcctagcccatttccaacctcggaggattttaccccaaaagagggcagcccgtatgaggctccagtctacatccccgaggatatccctatccctgctgacttcgagctcagggagtccagcatcccgggtgctggactcggggtgtgggcaaagaggaaaatggaggcgggagagaggctggggccatgtgttgtagtgcccagggcagccgcaaaagaaacagacttcggttgggaacagatactgactgacgtggaagtatctccccaagagggttgcataacaaagattagtgaagatcttggtagtgagaagttctgcgtcgatgcaaaccaggccggagcaggatcttggttaaaatatatcagggtggcctgtagttgcgacgaccagaacctgactatgtgccagatctccgagcagatctattataaggtaattaaggacattgagccaggtgaagagttgcttgtacatgtgaaggagggggtctaccccttaggtaccgttccaccgggactcgacgaggaacccactttccgctgtgacgaatgcgacgagctctttcagagcaaactcgatctccggagacataagaaatatacgtgcgggtccgtgggagctgctctgtacgagggactagctgaagagttgaagccagaaggactcggcggtggatctgggcaggcccacgagtgcaaggattgcgaacgtatgttcccaaacaagtactcccttgaacaacatatggtgatccataccgaggagcgcgagtataaatgtgatcagtgcccaaaagcattcaattggaaaagtaacctgatacggcaccaaatgagtcatgactccgggaaaagattcgaatgtgagaactgtgttaaggttttcaccgatccatcaaatcttcagcgccacatccgtagccagcacgtcggtgctcgggctcacgcatgtccagattgcggaaagacatttgccacatccagtggactgaagcagcacaaacacatccattctactgtaaagccgtttatttgcgaagtttgccacaagtcgtacactcaattttctaacctttgtagacataagcgcatgcacgctgattgtaggacacagataaaatgcaaggactgtgggcaaatgttttctacaacctcttccctcaacaaacatagacggttctgtgagggaaagaaccattacactccagggggtatattcgcacccggtctccctctcacccctagtcctatgatggacaaggctaaaccctctcccagtttgaatcacgcaagcttggggtttaacgagtattttcccagccgacctcatcccggttctctgccgttttccactgctcccccaacgttccccgctctcaccccgggatttcccggaatctttcccccaagcctgtatccacggcctcctctcctgccccctaccagcttgcttaaaagccctctcaatcacacccaagacgcgaagctcccgtctcctttagggaatccggctctccccctagtgtcagccgttagtaatagttcacaaggcaccacagctgcagcaggtcccgaggaaaaattcgagagtaggcttgaggactcttgtgtcgagaaactgaaaaccaggtcatcagacatgtctgatggctctgactttgaggatgtaaatactactacaggtacggacctcgacaccactacagggactgggagcgatctcgacagtgatgtggacagcgatccagataaggataaaggaaaaggcaagtccgcggaaggccaacccaaatttggcggaggcctggcaccacctggcgcaccaaactccgtggctgaagttcctgtattctactctcagcactcattctttcctccacctgacgagcaactcttgacagctaccggggcagctggagactctattaaagccatcgcgtcaatcgccgagaaatatttcggcccagggttcatgggcatgcaagagaagaaactaggctcattaccataccactccgcgttcccttttcagtttttacctaatttcccccacagtctttacccctttactgatcgagccttggctcacaacctcctggtcaaggcagagcccaaaagccctcgagatgctctgaaagtcggcggaccatccgcagaatgcccctttgacttaacaaccaaaccaaaggacgtgaagccaattcttcctatgccaaaaggacccagcgcacctgccagcggcgaggaacagcctctggatcttagcattggatcacgcgctcgtgccagccaaaatgggggtgggagggagccgcgtaaaaaccatgtatatggcgagcgtaaactcggagctggcgagggtttgccccaggtgtgcccagcacgtatgccgcagcaaccccctcttcactatgcaaagccaagccccttcttcatggaccccatctacagagtggaaaagcgaaaagtgaccgatccagtgggtgcactaaaagagaaatatttgaggccttctcccttgctgttccacccgcagatgtccgcaatcgagacaatgacggaaaagctcgagtctttcgcggctatgaaggccgacagcgggtcaagtctgcagccgctccctcatcaccccttcaatttccggagccctccacctacgttgagtgatccaatcttgaggaagggaaaagagcggtatacatgtcgctactgtgggaagatatttccacgtagcgccaatctgacgaggcacctgagaactcatactggggagcagccttacagatgcaaatactgtgataggagtttttccattagttccaaccttcaaagacacgtacgaaacattcacaacaaagagaaaccattcaaatgtcacctctgtaaccggtgcttcgggcaacagacaaacctggaccgccatttgaagaagcacgagcatgagaacgcacctgtgtctcagcatccaggggtcttaactaatcatcttggtacatcagcatccagtccaactagtgagagcgataaccatgccctgttggacgagaaagaggactcttatttctcagaaataagaaactttatcgccaattcagagatgaatcaggccagcactcgaacggagaagcgagctgacatgcaaatcgtcgatggaagcgctcagtgtccgggactggcaagcgaaaagcaggaagatgttgaggaagaagacgacgatgacctggaagaggatgatgaagactcgttagctggaaagtcccaagacgacactgtatcgcctgcccctgagccccaagcagcgtacgaggatgaagaagacgaggaacctgccgcttccctagctgtgggtttcgaccataccagacgatgcgctgaagaccatgagggtggcctcttagcccttgaaccaatgcccacttttggtaaaggcctcgacctgagacgggctgcagaggaggccttcgaagttaaggatgtactgaacagcaccctggattccgaagctctgaagcataccctctgtcgccaggcaaagaaccagggtagtctggatgcatggctgaaagtgacaggcgcaaccagtgagtccggagccttccaccctatcaaccacctgtag

SEQ ID NO: 235857 - DNA, 3255 bp, Artificial Sequence
  Description of Artificial Sequence: Synthetic coding sequence
atatactacaaggttattaaagatattgagcctggcgaagaactcctcgtgcacgtaaaggagggcgtgtacccactcggaacggttcctccaggtctcgatgaggagcccactttcaggtgtgatgaatgcgacgaactctttcaaagtaagttggacttgagacggcacaagaagtacacttgtggcagcgtcggagctgctctctatgaagggttggcagaggagttgaaaccagaaggactgggaggtggtagtggccaagcacacgagtgcaaagactgtgagcggatgtttccgaataagtactcactggagcaacatatggtcattcacactgaggagagggagtacaagtgtgaccagtgccccaaagcctttaactggaagtcaaatttgataaggcaccaaatgagccacgactcagggaaacgtttcgagtgcgaaaactgcgtgaaggtattcacagatccaagtaacctgcagcggcatatccgttctcagcacgtgggcgctcgcgcacacgcatgcccagactgtggaaagaccttcgcaacatcgagtggcctaaagcagcataaacacatccattctacagttaaacccttcatatgcgaggtgtgccataagagctacacgcagtttagcaatttatgtagacacaaacgaatgcatgccgattgccggacccaaattaagtgtaaggactgcggccagatgtttagtacaacttcatcattaaataaacataggcggttttgtgaaggtaaaaatcactacaccccgggagggatcttcgcaccaggtttaccactgacgcccagcccaatgatggataaggcgaaaccctccccatcactgaatcacgcaagcttaggttttaacgagtactttccgtctcggccacatcccggatctttaccgtttagcactgctcctccgaccttccccgctctgaccccagggttccccggaattttcccacctagcctctatcctcgaccccctctcctaccccctacgtccctcctcaaatcccctctcaaccacacccaggacgctaagctgcctagccccttaggaaacccagctctccctttggtctctgcagtttctaacagctcacaaggtaccactgcagcagcaggacctgaggaaaagttcgagtcccgcctcgaagactcctgtgttgagaagctcaagacccgcagttcagatatgagtgacggctcagactttgaggacgtgaacactaccaccgggactgacctggacacaaccacaggcactgggtccgatttagacagtgatgtcgatagcgacccggataaggataaaggaaagggtaaatcggccgaaggtcagccaaagtttgggggaggactggcaccccctggggctcccaattcagttgccgaggtgcctgttttttatagccagcatagcttttttccccctcctgatgagcagctcctcactgccacgggcgcagccggagacagtatcaaggctatagccagcatcgccgaaaagtattttggtccgggattcatggggatgcaagaaaagaagcttgggtctttgccttaccactcagctttcccgttccagtttctccccaacttccctcacagtctttaccccttcactgatcgcgctttagctcacaatctactcgtaaaagccgaacctaagtcacctagggacgccttgaaggtcggagggccaagcgccgagtgtccgttcgacctgacaaccaaaccaaaagatgtgaaaccgattttacctatgccaaagggcccttcggcaccagcctccggggaagagcagcccctggacctgagcattgggtccagggcacgggcaagtcagaacggaggaggcagggagccacgtaaaaatcatgtctatggcgaacgaaagctgggagcaggagagggactgccccaggtgtgtccggctagaatgccccagcagcctccactccactacgcaaaaccttcacccttttttatggatcccatttatcgcgttgaaaaaaggaaagtgaccgatcctgtcggtgccctgaaggagaaatatttaaggccgtcccctctactctttcaccctcaaatgtctgccatcgaaaccatgacagagaagctggagtcattcgctgctatgaaagcagatagtggttctagtctgcagcccctgcctcaccatccatttaacttcagatccccccctcccaccctgtccgaccccatccttcgcaaaggaaaggagaggtatacctgccggtactgcggcaagatctttccaagatctgccaacctgacacgtcacctacggactcacacaggggagcagccctacaggtgcaaatactgtgatcggtcattctccatttcgtcaaacttacaacgccatgtgaggaacattcacaacaaggaaaaaccttttaaatgtcatctttgcaatcggtgtttcgggcaacagacaaatctcgataggcacttaaagaaacatgagcacgagaatgccccagtcagccagcaccctggcgtcctgactaatcacttggggaccagcgcctcatctccgacctctgaatctgataaccatgccctcttggacgaaaaggaagattcctacttctctgagattcggaactttatagccaacagtgagatgaatcaggcctcgaccagaactgagaaaagagcagatatgcagattgtagacgggtctgcacaatgccccggactcgcctcagaaaaacaggaggatgtagaggaggaagacgatgatgacttagaggaggacgacgaagatagcttagcgggaaagtcgcaagatgacactgtgtcacccgctccggagccgcaggccgcttatgaggatgaagaagacgaagaacctgccgctagtctagccgtaggattcgaccatactcggcgatgcgccgaagaccacgaggggggacttttggccttagagcctatgcctacattcggaaaaggccttgacctgagacgagcagctgaggaggccttcgaagtcaaggacgtcttaaactcgaccctcgatagcgaagctctcaaacatactctctgtagacaagccaaaaaccaggcgtatgctatgatgctttcactcagtgaggacacacctctgcatacaccttctcagggatctcttgacgcctggttaaaggtcaccggagccacctccgaatccggagcctttcatcctatcaaccacttgtag

SEQ ID NO: 235858 - DNA, 3774 bp, Artificial Sequence
  Description of Artificial Sequence: Synthetic coding sequence
atgcgatcgaaagcccgagcgagaaaactcgcaaaatcagatggtgacgtcgtgaacaacatgtacgaacccaaccgggaccttttggcctctcatagtgctgaagacgaagctgaggactctgccatgagccccattcctgtcgggccaccttcgccattcccaacctctgaggatttcacaccaaaggagggaagtccatacgaggcacccgtttatataccagaagatatccccatccccgcagattttgaacttcgcgagagcagcatccctggggctggtcttggtgtgtgggccaagcggaagatggaggccggagaacggctagggccatgtgtggtagtccctagagcagccgcaaaagaaaccgattttggttgggagcagatcctgacagatgtcgaagtgtcaccacaagagggatgcatcactaagatatccgaagacctaggcagcgagaagttttgtgttgatgccaatcaggctggagctggttcctggctgaagtatattagggtggcctgttcatgcgatgatcagaacttgaccatgtgccagatttctgaacaaatttactataaagtgattaaagacatcgaacccggagaagaactgttggtgcatgttaaagagggagtttatcccttgggtaccgtgccacccggactagacgaggaaccaaccttccggtgcgatgagtgcgatgagctgttccagtcaaaactggacctgcgcagacataagaaatacacttgcggcagcgttggcgcagcactgtatgaagggcttgccgaggagctgaaacccgaaggcttagggggaggaagtgggcaggcccatgagtgcaaggactgcgaaaggatgtttcccaacaagtactccttggaacagcatatggtcatccatactgaagaacgcgagtataaatgcgatcagtgccccaaggcgttcaactggaaaagcaaccttattcggcatcaaatgtctcacgactcaggtaaaagatttgagtgcgagaactgtgtcaaagtgttcactgatcccagtaacctgcagcggcacattcgaagtcagcacgtgggtgctagggctcatgcctgccccgattgtgggaagaccttcgccacatcaagcggactgaagcagcataaacacattcactccactgtgaaaccgttcatctgcgaagtctgccacaagagttatactcagttttccaacctgtgccgtcacaagcgcatgcatgccgattgcagaactcagattaagtgcaaggactgcgggcagatgttctccaccacatcttccttgaacaagcataggcgtttttgtgaaggtaaaaatcactatacccccggtggaatcttcgctcctggcttgcctctgacaccaagccccatgatggacaaggccaagccaagtccaagcctgaatcacgctagcttgggattcaatgaatacttcccctctcgacctcaccctggatccttacccttttccacagccccacccacatttcctgccctcactcccggatttcccggtatttttccgccttctctttatcccaggccaccactacttcccccaacctcactgttgaagagcccgctcaaccatactcaggacgccaagctgccaagcccactcggtaacccagccttaccattggtaagtgccgtgagcaactcctcccaggggaccacggccgctgctggtcctgaggagaaatttgagagcaggctcgaggatagctgcgtggaaaagctcaagactaggagttctgacatgagcgacggctcagactttgaggacgtgaatacgaccacagggaccgacttagatactaccactgggacgggctccgaccttgatagtgacgtggactccgacccagacaaggataaaggcaaaggaaaatcagctgaagggcaaccaaaatttggaggcggactcgccccaccgggagcaccgaattccgttgctgaagtgcccgtattttacagtcagcactctttctttccacctccagacgagcaactccttacagcaactggtgccgcaggggattccattaaagctatagcttcaatcgccgaaaagtattttgggcctgggttcatgggcatgcaggagaagaagctgggctccctgccttaccactcagcattccctttccagtttctcccaaattttccacactctctgtaccccttcacagaccgggcactggcccataatctcctggtgaaagctgaacccaagtcaccaagagacgcgttgaaggtggggggaccaagtgccgaatgtccctttgatctgacgacaaagccaaaggatgtgaaaccgatcttaccgatgcctaaaggaccatccgcgcctgcctccggcgaggaacagcctctggacctctccatcggcagtcgtgcccgagcctctcagaacggcggaggcagagagccgcgaaaaaaccatgtgtatggagaaaggaagctaggggcaggggagggcctgccgcaagtttgcccagcgaggatgccccagcagccacctctccactatgctaaaccttctccattttttatggaccctatctattcccgcgtggaaaagaggaaagtcaccgatcccgttggcgctctgaaggaaaagtatctgcgaccttctcccctgttattccaccctcagatgagtgctatcgagacaatgaccgaaaaactcgagtcattcgcggcaatgaaagctgactcaggatcttctctgcagccgctgccgcatcacccctttaattttagatcaccgccacctactctgagtgaccccatccttaggaagggtaaggaacggtatacatgccgatactgcggaaagattttccccagaagtgcgaacctgacacggcacctgcggactcacactggagagcagccctaccggtgcaagtactgtgatagatcttttagtatcagcagcaacctccagcgacacgtcaggaacatccacaacaaggagaaacctttcaaatgccacttatgtaatagatgcttcggtcagcagactaaccttgaccgccatcttaagaagcacgagcacgagaacgcgccagtgtcacagcatcccggagttcttactaatcatctgggtacgagcgccagttcaccgacctctgagagcgataaccacgccctgttggacgaaaaggaggatagttacttctctgagatacggaattttatcgccaacagtgagatgaaccaggcctctactcgaacagaaaagcgcgctgatatgcagatcgtcgacggctctgctcagtgtcccggacttgcatctgagaaacaggaggacgttgaggaagaggacgacgatgaccttgaggaagacgacgaggacagccttgcgggaaaatcacaggatgacacagtgtcaccagcacccgaaccacaagcagcttacgaggatgaggaggatgaggagccggcagcctctctggctgttggctttgatcatactaggaggtgtgctgaagatcatgagggagggcttctcgctctcgaacctatgcccactttcggtaagggactggacctccgaagggccgcagaggaagcgttcgaggtaaaggatgtgctcaattcaactctcgatagcgaggcgctcaaacataccttgtgtaggcaggctaaaaaccagggatccctggatgcatggctgaaagtgactggggctacaagcgaatccggtgcctttcaccccatcaaccatctgtag

SEQ ID NO: 235859 - DNA, 600 bp, Artificial Sequence
  Description of Artificial Sequence: Synthetic coding sequence
atgagcagcgaaaattgcttcgtggccgagaattcgtccctgcacccagaatccggccaggagaacgacgctacttcaccacattttagtactcgacatgagggttcttttcaggtgccagtgttatgtgccgttatgaacgtggtattcataaccatcctcatcatcgccttaatcgcactgtcggtggggcagtacaattgtcctgggcagtacactttcagcatgccctcagacagccatgtgtcaagctgttctgaggactgggtgggctaccagcggaagtgttattttatatctactgtaaaacggagctggacatcagcccagaatgcctgttctgaacatggggctacactcgctgtgatcgactctgagaaggatatgaactttctgaagagatacgctggcagggaggaacactgggtgggcctcaaaaaagaaccaggtcacccttggaagtggagcaatggcaaggagtttaataattggtttaacgtaaccgggtcggacaagtgtgtgttcctcaagaacactgaggtgtcaagtatggagtgcgaaaaaaacctgtactggatttgcaataagccatataaatag

SEQ ID NO: 235860 - DNA, 228 bp, Artificial Sequence
  Description of Artificial Sequence: Synthetic coding sequence
atgcatcatagaatgaatgagatgaaccttagtccagtcggtatggaacaactgacatccagcagcgtctccaacgctctgccagtgtccggatcccatctaggcctggctgcgagtcctacccattctgcaattccggcacccggactgccagtcgccattccgaatctaggcccatcactttccagcctgcccagcgctctttcattgatgctgcctatgggctag

SEQ ID NO: 235861 - DNA, 1893 bp, Artificial Sequence
  Description of Artificial Sequence: Synthetic coding sequence
atgctggggatgtatgtccccgatcgtttcagcttgaagagcagtagggtgcaggatggtatgggactttataccgctaggcgggtgaggaaaggtgagaagttcggccctttcgctggcgagaagaggatgccagaggatctcgatgagaacatggattaccgcctcatgtgggaggtgcggggtagcaaaggggaggtcctgtacatcctcgacgcaactaaccccagacatagcaactggctaagatttgtccacgaagccccatcccaggagcagaaaaacttagctgctatccaggaaggcgaaaacattttttatctcgcagtggaggacatcgagaccgatacagagttacttatagggtaccttgactctgatatggaagccgaagaggaggagcagcagattatgacggtgattaaagaaggcgaagtcgagaacagtaggcggcaaagcaccgccggaagaaaggacagattaggatgtaaggaagactacgcttgccctcaatgtgagagcagtttcacgagcgaggacattttggctgagcacctgcaaacacttcatcagaaacctactgaggagaaagagtttaagtgtaaaaactgcggcaaaaaattccctgtcaaacaggctcttcagcgccacgttctccagtgtacagcaaagagctccttaaaggaatcaagtcgatcattccagtgcagcgtttgtaatagtagcttctcatcagcctcatcgttcgaacaacatcaggagacctgtagaggcgatgctcgctttgtctgcaaggccgattcgtgcgggaagagattaaaaagtaaggacgctcttaagcggcaccaggagaacgtccacactggggatcccaaaaaaaagctgatctgcagcgtttgtaacaagaagtgtagcagcgctagttcactgcaggagcatagaaagattcatgagatctttgactgtcaggagtgtatgaaaaagttcatctctgccaatcagttaaaacgacacatgattacccacagcgaaaaaagaccctacaactgcgaaatatgcaataaatctttcaagcgcctcgaccaggtaggagcccataaggtgatacactccgaggacaagccttataaatgtaagctgtgcggcaaaggtttcgcccaccgcaatgtttataaaaaccacaaaaagactcactctgaagagagacctttccagtgtgaggagtgcaaggccttgtttcgaacaccattttccctgcagcgccatctgctgatccacaattctgagcgaacctttaagtgtcaccactgtgatgccactttcaaacggaaggacacgctgaacgtacacgtccaggttgtgcatgagagacacaaaaaataccgttgtgagctgtgcaacaaggccttcgtgactccctccgtcctcaggtcccacaaaaagacacataccggggaaaaggaaaagatctgtccttactgcggtcagaagttcgctagctcgggtacactacgggtccacatacgttctcacactggggaacgcccttatcaatgtccctactgtgagaagggattcagcaaaaatgacggtctaaaaatgcatatccggacacatacccgcgagaagccgtacaagtgttctgagtgcagcaaggccttcagtcagaaaaggggactagatgagcataagcgaactcacactggcgagaagcctttccaatgtgacgtgtgcgatctagctttctcgctaaagaagatgctcatccggcataaaatgacccacaatccgaataggcccttggctgaatgtcagttttgtcacaagaagtttaccaggaatgactatcttaaggtgcatatggacaatatacacggcgtcgccgactcatag

SEQ ID NO: 235862 - DNA, 336 bp, Artificial Sequence
  Description of Artificial Sequence: Synthetic coding sequence
atgctggggatgtatgtgccggatcgattttctcttaaatcctcaagagtgcaggatgggatgggactttacactgcgaggagagttaggaagggtgaaaaatttgggccatttgcaggagagaagcggatgccagaggatcttgacgagaacatggattaccgcttgatgtgggaagttcggggatccaagggggaggtactgtatattttggatgccacaaaccctagacacagcaattggcttagattcgtgcacgaagctccatcccaagaacagaagaacctcgcagctattcaggataagaacctcggacctgcagagtggcggggatag

SEQ ID NO: 235863 - DNA, 1800 bp, Artificial Sequence
  Description of Artificial Sequence: Synthetic coding sequence
atgctggggatgtacgtgcctgatagatttagtcttaagtcctcaagggtacaggacggcatgggtctttacactgctcggcgagtgaggaagggtgaaaaattcggaccttttgctggtgaaaagaggatgcccgaagaccttgacgagaatatggactataggctgatgtgggaggtgagaggcagtaagggtgaagttttatatatcctggacgccactaaccccaggcactccaactggctgcggtttgtccacgaagccccaagtcaagaacagaaaaacctggcggcaatccaggaaggagaaaacatcttctatctggccgtggaggatatagagactgataccgagctcctgatcggttatctagactcagatatggaggccgaagaagaggaacaacaaatcatgacagtcatcaaggagggggaggtggaaaactccagaaggcagagcaccgccggtagaaaagaccgactggggtgtaaagaggattacgcctgtccacagtgcgaatcgagtttcacctccgaagacatacttgctgaacacctgcagaccttgcaccaaaagcccactgaggagaaagagtttaaatgcaagaactgcgggaaaaagtttcccgtaaaacaggccctgcaaaggcactttgagcagcaccaggaaacatgccgcggagatgccaggtttgtatgcaaagcagatagctgtggaaagagactgaagtcaaaggatgcccttaagagacatcaggagaatgtccataccggcgacccaaagaagaagctcatctgctctgtgtgcaataagaagtgtagcagcgcctctagccttcaagaacaccgcaaaatccacgagatctttgattgtcaagaatgcatgaagaagttcatcagtgccaaccaactgaagcgccacatgatcactcattctgaaaagaggccttataattgtgaaatctgtaacaagtccttcaagaggcttgatcaggtaggtgctcacaaagttatacactctgaggacaaaccctataaatgcaagttatgtggcaaaggtttcgcccatcgcaacgtgtacaaaaatcacaagaaaacccattctgaggagcgcccattccaatgtgaggagtgtaaagccctttttcggacacctttctccctacagcgtcacctgctgatccataatagcgaaagaacattcaaatgtcaccactgcgatgcgaccttcaagcggaaggatacactaaacgttcacgtgcaggtggtgcatgagcggcacaaaaagtaccggtgcgaattatgtaataaagcgttcgtgaccccctctgtgctgcggagccacaaaaaaacccacacaggagagaaggaaaaaatttgtccctactgcggacaaaaatttgccagttcgggaacgttgagggtacatattcgcagccataccggagagaggccctaccagtgtccttactgcgagaagggcttctctaagaacgatggattaaagatgcacattcgaactcacactagggagaagccctataaatgctccgaatgttcaaaggccttttcccagaaacgtggcctcgatgagcataaacgtacccacacgggagaaaaaccctttcagtgtgatgtgtgcgacctggcctttagcctgaaaaaaatgctgatcagacataaaatgacccacaatccgaaccggcctctcgccgagtgtcagttctgtcataaaaagtttacccggaacgattacctgaaagtgcacatggacaacatacacggcgttgctgactcctag

SEQ ID NO: 235864 - DNA, 1506 bp, Artificial Sequence
  Description of Artificial Sequence: Synthetic coding sequence
atgctgggcatgtacgtgcctgaccgctttagcctgaagtctagtcgggtgcaggatggtatgggactctatacggccaggcgagtacggaaaggggagaagtttggcccattcgccggagagaagagaatgccagaagacctcgatgagaatatggactatagattgatgtgggaggtgcgaggcagtaaaggagaggtcctctacatcttggatgccactaatccccgtcacagcaattggctccgattcgtgcatgaagctccatcccaggagcagaagaacctcgcagccattcaagaaggcgagaatattttttacctggcggttgaggatattgagacagacaccgagcttcttattggttatttagactctgatatggaggctgaggaagaggagcagcagataatgacagtaattaaagaaggggaggtggaaaactctcgacgacagagcacagctggacgcaaagacaggctggggtgcaaggaggattacgcttgtcctcaatgtgagtcgtcgtttacgagcgaggacatcttggccgaacacctacagacattgcaccaaaaacctacggaggagaaagaatttaaatgtaagaattgtggcaagaagtttccagtcaaacaggcactgcagaggcactttgagcagcaccaggagacctgtcgcggagatgccagattcgtttgtaaagcggactcatgtggcaaacggctgaagtcgaaagatgccttaaaacggcaccaggagaacgtgcataccggggatcccaagaagaagttaatttgctcagtgtgcaataagaaatgcagctccgcatcatcactgcaggaacatcgtaaaattcatgaaattttcgattgtcaggagtgtatgaagaaattcattagcgccaatcagttaaagcgccatatgatcacacattccgagaaacggccttacaactgcgagatatgcaacaagtcattcaaaagactggaccaggtaggagctcataaggtaatacatagtgaagataagccttacaaatgcaagctttgcgggaaaggattcgctcacagaaacgtatacaagaatcataagaaaacccacagtgaggaacgtccctttcaatgcgaagaatgcaaggccctgttccggacgccgtttagccttcagagacacctgctgatacacaacagtgagaggaccttcaaatgccaccattgcgatgcaactttcaagcggaaggatactttgaatgttcacgttcaagtcgtacacgagcgacacaagaagtaccgttgtgagctatgcaataaagctttcgtgactccatctgtgctgcggtctcacaaaaagacacacacaggagagaaagagaaaatctgcccttattgcggacagaagttcgcctcatcaggcacgcttcgtgttcatatccgctctcatacaggggaagccgtgcaggtcttacgcgtacaacaagggctacagccggaagctcgaccaggatag

SEQ ID NO: 235865 - DNA, 1227 bp, Artificial Sequence
  Description of Artificial Sequence: Synthetic coding sequence
atgtgtcagaatttttttatagattcctgcgccgctcatggcccaccaacgttcgtgaaggatagtgccgttgacaaaggccaccccaacagatctgccctaagcctccccccagggctgcgtatcggcccatccgggattccacaggcaggacttggcgtctggaacgaggctagcgacctcccattaggattacactttgggccttatgagggccgtatcacggaggacgaggaagctgccaacaatggatactcgtggctgattaccaaaggacgcaattgttatgagtatgtcgacggaaaggacaaatcttgggctaattggatgcggtatgtgaactgcgccagggatgacgaggaacaaaatttggttgcatttcaatatcacagacagatcttttatagaacgtgccgagtcatccggccaggatgtgaactcctggtgtggtacggcgacgaatatggccaggaattaggaatcaagtgggggtctaagtggaagaaagaattgatggccggaagagaacccaagccagagatacacccctgtccatcgtgctgcctggctttcagttctcagaagttcctgagccagcatgtcgagcggaaccacagcagccagaattttccagggccaagcgcccgaaagttacttcagccagaaaatccttgtccaggtgaccagaatcaggaacaacagtacccagatccacattcccgtaacgacaaaaccaaaggccaggagattaaagagaggagtaaactccttaataaaaggacctggcagcgcgagatcagccgcgcttttagtagcccacctaaggggcagatggggagttgtcgggtcgggaagcgtattatggaggaagagtcgaggacaggacagaaggttaatcccggtaacaccggtaagttattcgtgggggtcggtattagtcggatcgccaaagtcaagtacggggagtgtggacagggatttagcgtcaagtcggacgtaatcactcaccaacgcactcacaccggggaaaaaccttacgtgtgccgggagtgtggcagaggcttctcttggcagtcagttcttctgacccatcagagaacccacaccggagagaagccctatgtgtgtagggaatgcggccgtgggttcagccgacagtccgtactattgacccatcagcgtacccacacgggcgagaagccatatgtttgccgagaagacgagtag

SEQ ID NO: 235866 - DNA, 2685 bp, Artificial Sequence
  Description of Artificial Sequence: Synthetic coding sequence
atgtcccccgagaagagtcaggaggaatcccccgaagaagataccgagagaacggaacggaagccaatggtcaaggacgcattcaaagacatcagcatttattttacaaaggaagaatgggcagaaatgggggattgggaaaaaactcgctatcgcaacgttaagcggaattataatgcattgattaccatcgggctccgggctaccagaccggcattcatgtgccacaggagacaggccataaaattgcaggtggacgacaccgaggactctgacgaggaatggactccccgacagcaagtgaagccaccttggatggcactccgcgtggaacagagaaagcaccagaaaggcatgccaaaagcatcgttcagcaatgagtcatcacttaaagagctgtctcgcaccgctaacttgttaaacgcaagcggctcggagcaggctcaaaagccagtgagcccatctggcgaagcatcgacttcgggccagcacagcagactcaagctggagctacgcaaaaaagaaacggagcgtaaaatgtactctctcagagagagaaagggccacgcctacaaagaggttagtgaaccacaggacgacgactatctgtactgtgagatgtgtcagaatttttttattgatagttgtgcagcccacggacctcccaccttcgtgaaagacagcgctgtcgataaaggccaccctaaccggtctgccctgtctctccctccaggactcagaatcggaccttctggtattccccaggccggactaggcgtgtggaatgaagccagcgaccttccactcggactccacttcggaccctacgagggcagaatcacagaggatgaggaggccgcaaacaacggatactcctggctcatcaccaagggacggaactgctatgagtatgtcgacggcaaagacaagagctgggcaaactggatgaggtacgttaattgtgcccgagatgacgaagagcagaacctggtagcctttcagtaccaccggcagatcttttacaggacatgccgcgtgatcagacccggttgcgagctgctcgtgtggtatggggatgaatacggtcaggaacttggcattaaatgggggagcaaatggaagaaagagctgatggcagggagagagcctaagcccgaaattcatccatgcccctcctgctgcctcgcattctctagtcaaaagttcctgagccaacacgtagaacgcaaccactctagccagaatttccccggaccgagtgcaaggaaacttttacagccggaaaatccatgtccgggtgatcaaaaccaggagcagcaatacccggatccacactcacgcaacgacaaaacaaaagggcaggagattaaggaaaggtcaaaactgctcaataaacggacatggcagagggaaatctctagagcctttagcagccctccaaaagggcaaatggggtcttgcagggtggggaagagaataatggaggaagagtctcgcacggggcagaaggtaaatcctggtaataccggcaaacttttcgttggcgttggcatctccagaatcgctaaggtaaagtacggagagtgcgggcagggatttagcgtgaagtcagacgtcatcacccaccagcgaacccacacaggagagaagctttatgtatgccgtgagtgtggtcggggattctcctggaaaagccatctcttgatccatcagaggatccatactggagagaagccttacgtttgcagagagtgtgggagggggttcagctggcagagcgtacttcttacccaccagaggacccacacaggcgagaaaccctacgtttgtcgggagtgcggcagagggttttctcgacagtcagtattgctaacgcaccagagacgtcatacaggcgaaaagccatatgtgtgcagagaatgcggaaggggcttttctcggcagagtgtgctgctaacgcaccagcgcaggcacacaggcgagaaaccctacgtatgccgcgagtgcggtagggggttttcatggcagagcgtattactgactcatcagcgcacacacactggggagaagccgtacgtgtgtcgtgagtgtgggcgaggcttcagttggcaaagtgttctcctgacccatcagcgcacccatactggtgagaagccttacgtgtgccgagaatgcggacgcggatttagcaacaaaagccatctcttacgccatcagaggactcatacgggtgagaagccatacgtatgccgcgagtgcggccgagggtttcgggacaaaagccaccttctgcggcaccagaggacccatacaggtgaaaaaccatatgtttgtagagagtgcgggcgaggcttcagagacaaatctaatttgttaagtcaccaacgcacccacactggagagaagccttacgtctgccgtgagtgcgggcgagggttcagtaacaaaagtcatctcctgaggcaccaacgcactcataccggtgaaaaaccctacgtgtgtagggaatgtggacgcggattccgaaacaagagccacctcttaaggcatcagagaactcatactggcgaaaaaccttatgtttgcagggaatgcggacgagggttctcagaccggtcaagcctgtgttaccatcagcgcacccataccggggaaaaaccttacgtttgccgggaagacgagtag

SEQ ID NO: 235867 - DNA, 303 bp, Artificial Sequence
  Description of Artificial Sequence: Synthetic coding sequence
atgtccccggagaagtctcaggaggagagtcctgaagaggacacagaaagaaccgaacgcaaaccgatggtaaaagacgcgtttaaagatattagcatttactttactaaagaggaatgggcagagatgggcgactgggaaaagacaaggtatcgcaatgtgaagcgaaactacaacgctctgattactatcggacttcgtgccaccaggcctgctttcatgtgccaccgtagacaagccataaagctccaagtcgatgataccgaggactcagacgaagagtggacccctcgacagcaatag

SEQ ID NO: 235868 - DNA, 537 bp, Artificial Sequence
  Description of Artificial Sequence: Synthetic coding sequence
atgtccgaagtcagattgccccctctgagggctctggatgatttcgtacttggcagcgcacgtctggcagctcccgatccatgtgacccacagcggtggtgccaccgcgtgattaacaatctgctctattaccagaccaattatttgctctgcttcggcattggtctggcactcgccggatatgtaagacccctacacaccctcctcagcgctctggtagtcgcagtcgccctaggggtgctcgtgtgggccgctgaaacccgcgcagccgtacgccgttgtcgccgatcgcacccagccgcatgcctcgctgctgtcctggcagtcgggctcctggtgctctgggttgccggaggagcatgcacgttcctcttcagcatagccggaccagtgctcttgatccttgtccacgcttctctaagactgcgaaacctgaagaacaagatagagaacaagatcgagtctattggactcaaaaggacccctatgggtctgctgctggaggctctgggccaggaacaagaggcgggatcctag

SEQ ID NO: 235869 - DNA, 846 bp, Artificial Sequence
  Description of Artificial Sequence: Synthetic coding sequence
atggcaggtacgtggctcctgttgctcctggcactggggtgtcccgcactccctaccggcgtcggcggaacaccattccctagcctggctcctcccattatgctgttggtggacggcaaacagcagatggttgttgtttgtctcgttctcgacgtcgctcccccaggactggattctcctatctggttctccgcagggaacggttcggcactggacgcctttacatatgggccatctcccgctacggatgggacatggacaaacctggcgcacctaagcctaccctcagaggaactggcaagctgggagccattagtatgccacacaggaccaggagctgagggccactcacggtctactcagcctatgcacctgagcggagaggcatctacggctcgaacatgcccacaggaaccattacggggaacgccgggaggggctctgtggctcggggtgctgagacttcttctcttcaaacttttattgtttgaccttctcttgacctgttcttgtctgtgtgatccagccggacccctcccatcccctgccaccaccacccgactgcgcgctttggggtcccaccggcttcatccagccactgagactggaggcagggaggccacatcttcgccacgtccacaacccagagataggcggtggggggatactccacctgggagaaaaccgggttctcctgtctggggcgagggcagctacttgagcagctacccaacctgtccggcacaggcgtggtgcagcagaagcgccctacgcgcaccctcctctagcctcggcgcatttttcgctggggacctcccaccaccgctgcaggccggtgccgcttag

SEQ ID NO: 235870 - DNA, 384 bp, Artificial Sequence
  Description of Artificial Sequence: Synthetic coding sequence
atggctgcaacatctccaggaccctgggtctccagccctacacatcggtcatgttttctaccatttttgacaaggggatgtcataacagagtgtgggccgcacatccattcttactctggccccatcagagctgttgctggtggatggagagttcgagatggtggtggtccgcatggagcctcatgcttcaccccctcgcactgactgctcccggacgaaaacctggaagccccgtgtggggggaaggctcatacctgtcatcgtatcctacatgtcctgcccaggcctggtgtagtcgcagtgcactgagagcccctagcagttcactgggggctttttttgcaggtgacttgcccccaccgctccaggcaggggcagcttag

SEQ ID NO: 235871 - DNA, 771 bp, Artificial Sequence
  Description of Artificial Sequence: Synthetic coding sequence
atggcaggaacatggttgctccttctgctcgctctggggtgccctgcccttccaacaggcccagtttcctttcctagtagcccggaggccgctaccacagggccaatttggttctcagctggaaatgggtccgcgctggatgctttcacctatggaccgagtcctgcgaccgatgggacctggacaaatctggcccacctgtccctgccttcggaggagctggcaagttgggagcctctcgtgtgtcatacaggtccaggcgctgagggacactcccggagtacacagccgatgcacctgtccggcgaggctagcacggcaaggacttgtccacaagagcccctaagagggacaccaggcggagccctgtggttgggtgtactgagactcctgttgtttaagttactgctctttgacctgttgctcacatgctcatgcctgtgtgaccctgcgggaccattgccttcaccggcaacgactactagactgcgagcactcggctcacatagactgcacccagctactgaaactgggggaagagaggccacgtctagtccacggcctcagccacgagatcgacgctggggggacactcctcctgggagaaaacctggttcaccagtttggggagaaggtagctatctgagttcatatccaacctgccccgcacaggcttggtgttctcgttcagctctgcgggcaccatccagtagcctgggagctttcttcgcgggagatttgcctcccccactgcaggccggagccgcatag

SEQ ID NO: 235872 - DNA, 525 bp, Artificial Sequence
  Description of Artificial Sequence: Synthetic coding sequence
atggcaggaacctggctcctcctgctgctcgcacttggctgtccagccctgccaaccggcgaagcctccaccgccagaacctgccctcaagagcctctccgaggcacaccagggggtgcactgtggctgggtgtattacgcctgctcctgttcaagttactcttattcgacctcttactcacctgctcctgcctttgcgaccctgcaggccctcttcccagccccgctacaaccacccggcttcgagccctcggcagccaccggctgcatcccgcaaccgagaccgggggaagggaagcgacaagctctccaaggcctcaaccacgcgacaggcggtggggcgacacaccaccagggagaaaacctgggagtccagtctggggagagggatcatacctgagctcatacccaacctgcccggctcaggcgtggtgtagtcgctccgctctgagggccccatcaagctccctcggagccttcttcgcgggtgacctaccaccccctcttcaggcaggagccgcttag

SEQ ID NO: 235873 - DNA, 438 bp, Artificial Sequence
  Description of Artificial Sequence: Synthetic coding sequence
atgtcttgggccccagtgttgttgatgctcttcgtgtactgtaccggctgtgggccacagccagtgctccatcagcccccagccatgtccagtgcgctggggaccactatccggctaacatgcaccctgcgtaacgaccacgatatcggcgtgtactccgtctattggtaccagcagaggccagggcatccgcctcggttccttctgagatatttctcccagagcgacaaaagccagggtccccaagtaccgcctagattttctggatccaaagacgtggctagaaaccgcggatacctctccatttctgaactgcagcctgaggacgaagccatgtactactgcgcgatgggcgcaagaagcagcgaaaaggaagagagagagcgtgagtgggaagaggagatggaaccaaccgcggcaaggacccgcgtcccctag

SEQ ID NO: 235874 - DNA, 372 bp, Artificial Sequence
  Description of Artificial Sequence: Synthetic coding sequence
atggcttgcaggtgtctgtcatttctgctgatgggcacattcttatccgtcagccagactgtattagctcagctggacgctctcctcgtgttccccggacaggtggcccagctttcatgcactctctccccccagcatgtgacaatcagagactacggtgtgagctggtaccagcagcgtgctggcagcgccccacgctatctgctttactataggtccgaggaggatcaccataggccagctgatatacctgatagattcagtgcagccaaagacgaagcccacaatgcctgtgtgctgaccatttcccctgtgcagcccgaggacgacgccgactattattgtagtgtaggctacggattctcgccatag

SEQ ID NO: 235875 - DNA, 513 bp, Artificial Sequence
  Description of Artificial Sequence: Synthetic coding sequence
atggacgagcagcctagattgatgcattcacacgcaggagtgggaatggccggacatcctggcctgagccaacatctgcaggacggagccggtggcaccgaaggggaggggggacgtaaacaagacatcggcgatatcctacaacagataatgactataaccgatcagagcctcgatgaggcccaggccagaaagcatgccctgaactgccatcgaatgaaacccgctctgtttaacgtgctgtgtgagatcaaggagaagactgttttgtcgattaggggcgcacaggaagaggaaccaactgaccctcagctcatgcgtctggacaatatgttattggccgagggtgtggctgggccagaaaaggggggtgggagcgccgctgccgctgccgctgccgctgctagcggcggtgctggcagtgacaactcagtggagcactcagattaccgtgcaaagctgtcccagataagacagatataccatacagaactcgagaaatatgaacaatag

SEQ ID NO: 235876 - DNA, 1044 bp, Artificial Sequence
  Description of Artificial Sequence: Synthetic coding sequence
atggatgagcagcccagactcatgcactcccacgctggcgtcggtatggcagggcatcctgggctcagccaacatctgcaggatggcgcagggggtacagaaggcgagggagggcgtaagcaggatatcggggacatactgcagcagatcatgactattaccgatcagagcctggacgaagcccaggcgagaaaacacgcgctgaattgccacaggatgaaaccagcactattcaacgtgttatgtgagatcaaggaaaaaacagtcctgtcaattcggggagcccaggaggaagagcctactgacccccagctgatgaggcttgataatatgctcttggcggaaggcgtagcaggacccgagaaaggcggaggcagtgccgctgccgcagccgcagcggctgcaagcggaggagccggtagcgacaactcggttgagcactcagattaccgggctaagcttagtcagatcaggcagatttaccacaccgagctagaaaaatatgaacaagcttgcaacgaatttactactcatgtgatgaaccttctcagagaacagagtcgaacaaggcccattagtccaaaggagatcgagcggatggtgtccataatccacagaaaattctcttctatacagatgcaactgaaacaatctacatgcgaggcggtgatgattctcagatcacgtttcctggacgcgagaaggaagcgacgaaacttcaataaacaggccaccgagatcctaaatgaatacttctactctcacctgagtaacccatatccatctgaggaagcaaaagaggagcttgccaaaaagtgtgggataacagtatcccaggtgagcaactggtttgggaacaagcgaattcgatacaagaagaatattggtaagttccaggaggaggcaaatatttacgccgcaaaaacagccgtaactgccacgaatgtctcagcgcacgggagtcaagccaactcaccatctacccctaactcagctgggggttaccccagcccatgctatcagccagaccggaggattcaatag

SEQ ID NO: 235877 - DNA, 1044 bp, Artificial Sequence
  Description of Artificial Sequence: Synthetic coding sequence
atggatgaacaaccccgacttatgcattctcatgctggcgtgggcatggccggtcatccgggactgtcccagcatctccaagacggggctgggggaacagagggggagggcggtaggaagcaggacattggggacatcctgcagcaaatcatgaccattactgaccagagtttggacgaagcccaggcccgaaagcacgcactgaattgccatcgcatgaaacccgctctatttaatgtcctctgcgaaataaaagaaaaaaccgtgctttcgataaggggggcacaagaggaggaacctacggatccacagctgatgcgtctggataatatgctactcgccgagggggtagcgggtcccgagaagggcggaggtagcgcggcagctgcagctgccgctgcggctagtggcggagccggttctgacaacagcgtggaacacagcgactatcgggcaaagctgtcgcagatccgtcaaatataccatactgagctggagaagtatgagcaggcttgtaacgagtttaccacccacgtgatgaatctactgagagaacagtcaaggacacgaccaatttcccctaaagagattgagagaatggtgagcataattcatcggaaattttcgagtatacagatgcaacttaaacagagcacatgtgaggccgtaatgatcctccgctctcgcttccttgatgcacgccgaaagaggagaaatttcaataagcaggcaaccgaaatcttaaacgaatatttttattcccaccttagcaacccttaccccagtgaagaagcgaaagaggaactggctaagaagtgcggcatcacagtcagccaggtgtctaattggtttggcaataaaaggatcagatataagaagaatatcggaaaatttcaagaggaagcaaacatctatgcagctaagactgcagtcacagctactaatgtgtcagcacatgggtcgcaggctaactcacccagtacccctaattccgccggtggctacccatcaccttgctatcagcctgatagaaggattcaatag

SEQ ID NO: 235878 - DNA, 1293 bp, Artificial Sequence
  Description of Artificial Sequence: Synthetic coding sequence
atggacgaacagccgaggctcatgcattcccatgcaggcgtgggtatggcaggacatcccggtctttcacagcacctccaggacggggctggcggtacagagggagagggcggacgtaagcaggatataggagatatccttcagcagattatgacaatcacagaccagtcgcttgacgaggcccaagctcgcaagcatgccttgaattgtcatcggatgaaaccagctctatttaacgtgctgtgtgagataaaggaaaagactgttctttctattcgtggcgctcaggaggaagagccgactgatccccagctgatgcggctggataatatgctactggcagaaggtgtagcaggtcccgagaagggtggcggatcggcagcagccgcagccgctgccgcagcctcgggaggcgctggttcagataatagcgtcgagcattcggactatagggctaaactgagccagattcgccagatctaccataccgagctggaaaagtatgagcaagcctgtaatgagttcactacacatgtcatgaacctgttgcgtgagcagtcgcgcacccggcctatttcccctaaggaaattgagcgaatggtaagcatcattcataggaagttttccagtatccaaatgcaactcaaacagtcaacttgtgaggcagtgatgatcttaaggtcccgcttcttggatgcccgaagaaaacggaggaacttcaacaaacaggcaactgagatcttgaacgaatatttttattcccatctctcgaacccttacccatctgaggaggcgaaggaggaactggccaagaagtgcggtataaccgtcagccaggtgtccaactggttcggcaataaacggatcagatataagaaaaatattgggaagttccaggaagaagcaaatatatacgctgccaagacggcagttacagctacaaatgtatcagcgcacggcagccaagcgaactcaccaagcactcctaatagcgctggctctagctcttccttcaacatgtcaaactcaggagatctgttcatgtccgtgcagtcactgaacggggactcctaccagggagctcaggtcggcgctaacgtccagtcccaggtggatactttgcgtcatgtgatttcccaaaccggtgggtatagtgacggcctggccgcttcccaaatgtattctccccagggaatcagcgctaacggcggttggcaagatgccactacacctagtagtgtcacatctccaacagaaggacccggaagtgtccattctgatacctctaactag

SEQ ID NO: 235879 - DNA, 978 bp, Artificial Sequence
  Description of Artificial Sequence: Synthetic coding sequence
atgcgtctggacaatatgctgctggccgaaggtgtcgctggacccgaaaaggggggtggtagcgctgccgctgctgccgcagctgctgccagcgggggagccggatcagacaatagcgtggaacattcagattatagggccaagctttcacagattcggcaaatataccatacagaactggagaagtatgaacaggcctgtaatgagtttacgacgcacgttatgaatctcctgcgtgagcaaagcaggacacgccctataagcccaaaggaaatcgaaaggatggtcagtataattcaccggaagttttcctccattcagatgcagctgaaacagagcacttgtgaagccgtgatgatcctccgaagcaggttcctggacgctcgacggaaacgtcggaatttcaataaacaggccaccgagatcctcaatgaatacttctattctcacctatccaatccttatccctcagaagaggccaaggaagagctcgcaaaaaaatgtgggataacggtgagccaggtgtccaattggtttgggaataagaggatacggtataaaaagaacatcggtaaatttcaagaagaggcaaatatctatgccgctaaaacggctgtgacagctaccaatgtgtccgcgcacggcagccaggcaaactctccatcaacccctaactccgcagggagttcttcctcttttaacatgtctaactctggggatttgttcatgtcagtgcagagcctcaacggggacagctatcagggggcacaggtgggcgcaaacgtccagtcccaggtggacacgctgaggcacgtgatatcccagacaggaggatactccgatggccttgccgcttcacaaatgtactccccccaaggcatctccgccaatggcggatggcaagatgctactaccccgtcctcagtcacgtcccccacggaaggccctggctcagtacattccgatactagcaattag

SEQ ID NO: 235880 - DNA, 1113 bp, Artificial Sequence
  Description of Artificial Sequence: Synthetic coding sequence
atgctgctagtgtttttcgtgttgtggacgtgtagtctggcccttctggcatctagccagtctcccccaccaccatgcgccagcgtcctgtctatccggggtgcccaggaggaggagccgaccgacccccaactgatgaggctcgacaacatgctcctagccgagggtgtggccggtccagagaagggcggaggatccgccgctgcggcagcagccgctgcggctagtggaggtgctggttcagataactccgtggaacacagcgattatagggcgaaactatcccagattcggcaaatttatcacaccgagctcgaaaagtacgagcaggcctgtaacgaatttacgacacacgtaatgaatttgcttcgggaacaatcaagaacaagacctattagccctaaggaaatcgaacggatggtctccatcattcacagaaagttctccagtatacagatgcagctcaaacagtcaacctgcgaagctgtcatgatcctaagatctcgtttcctcgatgcacggaggaaaagacgcaatttcaataagcaggccacagagatcctgaatgaatacttctattcccacctgtcgaacccctatcccagtgaggaggccaaggaagagttggcaaagaaatgtgggatcacagtgagccaggtgagcaactggtttggcaacaagcggatcaggtataaaaagaatattgggaaatttcaggaggaggcgaacatctacgctgccaagaccgctgttacagccaccaatgtgtctgcccacggttcccaagcaaactccccaagcactccgaacagtgctgggtcgagctctagcttcaatatgtccaactctggcgatcttttcatgtctgtccagtctctgaatggcgattcctaccaaggcgctcaggtgggagcaaatgttcagtcgcaagtggataccttgaggcacgtgatttcccagactgggggatatagcgatgggctcgccgcttcccagatgtactcacctcaagggatctctgccaatgggggatggcaagacgccacaacaccatcctcggtgacaagtcccacggagggcccaggtagcgtccattctgatacatctaactag

SEQ ID NO: 235881 - DNA, 1263 bp, Artificial Sequence
  Description of Artificial Sequence: Synthetic coding sequence
atggacgagcaaccgcgactgatgcacagccatgcaggcgttgggatggcgggtcatcctggcctgtctcagcacctgcaggacggtgcagggggaaccgagggtgagggcggtcgcaagcaggacattggcgatatcctccagcagattatgaccatcacggaccaatccctcgatgaggctcaggcacgcaagcacgcactcaactgtcatagaatgaaacccgcactttttaatgtgctgtgtgagatcaaggagaagaccgtgctcagtatccgcggagcacaagaagaggagcctacggacccccagttgatgaggctggataatatgttgcttgctgagggtgtggccggaccagaaaaggggggtggcagcgccgcagctgccgcagcagccgctgcatcgggaggggcaggttccgacaacagcgttgaacatagtgattatcgagctaaactcagccagatccgacagatttaccacacagagctagaaaagtatgaacaagcgtgcaatgagtttaccactcacgttatgaacctgctgcgggaacagtctcgcactagacctatttcccccaaggaaattgaaaggatggtgagcatcattcaccggaagttttcctccattcagatgcaactgaaacagtcgacctgcgaggccgtgatgatactgagatcccgctttctggacgccaggcgaaaaagacggaattttaacaagcaggccactgaaatcctgaacgagtatttctattcgcacctatccaacccatatccaagcgaggaagccaaagaagaactggcaaagaaatgtggcatcacagtctcacaggtgtcaaattggtttggcaacaagaggatcagatacaagaaaaatattggcaagtttcaggaggaagctaacatttatgctgctaaaacagctgttactgctactaatgttagtgcccatggatcccaggcaaattcgcccagtaccccaaattccgccggatcctcgagttctttcaatatgagtaattcgggcgacctttttatgtccgtgcaaagtctgaacggggactcttaccaaggtgcacaagtaggtgcaaatgtgcagagccaggtggatactctgagacacgttatttcgcagaccggcggatatagcgacggcctggcagcgagccagatgtactcaccacagggcatctctcatctgcctagacaccccagacaggcacattatcacttccgcttgcccacatggcatccgtag

SEQ ID NO: 235882 - DNA, 906 bp, Artificial Sequence
  Description of Artificial Sequence: Synthetic coding sequence
atgagattggataatatgctgctggccgagggagttgctggccctgagaagggtgggggatccgcagcagcagctgcagccgcagcagcctctgggggagctggctccgacaatagtgtagaacactccgattacagggccaagctgagccaaatccgccaaatctatcacacagaactcgagaaatacgagcaggcatgtaacgagttcactactcatgtgatgaatctgctgagagagcagtccaggacacggcctattagccccaaggagatcgaaaggatggtgtccataatccaccggaaattctccagtattcagatgcagctcaagcagtctacttgtgaggctgtgatgatcctgcggtcaaggtttttggatgcaagacgaaaaagacgcaattttaacaagcaagctactgagatcctcaacgagtacttttactcccaccttagcaatccatacccgtccgaggaggctaaggaagagctcgctaaaaagtgcggtattacagtatcccaggtcagcaactggttcgggaacaaaagaatccggtacaaaaagaacatcggcaaattccaggaggaagccaacatttatgctgcaaagacggcagtcaccgctactaatgtcagcgcccacggatcacaggccaactccccttctactccaaatagcgccggatcttcctcctcatttaacatgtccaattcaggcgacctctttatgagtgtccagtcattaaatggtgacagttatcagggggctcaagtcggcgctaacgtgcagtctcaagtcgacaccttacgacacgtgatctcccagacgggtggatattctgacgggctggccgcatctcagatgtactctcctcagggaatatcggagattgccaggacctattag

SEQ ID NO: 235883 - DNA, 1020 bp, Artificial Sequence
  Description of Artificial Sequence: Synthetic coding sequence
atggacgagcagccacgactaatgcattctcacgccggagtagggatggccggacaccccggattatcacagcatcttcaggacggggctgggggtaccgaaggagagggtggtcgaaagcaggacatcggcgacatccttcagcagatcatgacaataactgatcaatctttagacgaagctcaggcgaggaagcacgcacttaattgccaccggatgaaaccagctctttttaatgtgctgtgtgaaatcaaggaaaagacagttctgagtattagaggggctcaggaagaggaaccgacagatccacagctgatgcgcctcgataatatgttgctcgctgaaggggtggctggccctgagaagggcggtgggtccgccgcagccgcagctgctgctgcggcttcaggaggtgccggaagcgataattctgttgaacatagtgattatcgagccaaactcagccagatccgtcagatctatcacaccgagctggagaagtacgaacaggcttgtaatgaatttactactcatgttatgaacttactaagggaacaatcccggaccaggcccatttcaccaaaagagatcgaacggatggtttctatcatccaccgcaagtttagctccatccagatgcagctgaagcagtccacatgtgaagccgttatgatcctgagatctagatttctagatgcgagacggaaaaggcgcaatttcaataaacaggctactgagattcttaatgagtacttctattcccatttgagtaacccttacccttcggaggaggccaaggaagagctggccaaaaaatgtggaattactgtgtcacaagtggatacactccgacatgtgattagccagactggaggttactcagatggactcgcagcctcccagatgtactcccctcagggaatctctgcaaatgggggttggcaggacgcaacaaccccaagcagcgtgacctcgcccacagagggccctggatcagttcacagcgatactagtaactag

SEQ ID NO: 235884 - DNA, 978 bp, Artificial Sequence
  Description of Artificial Sequence: Synthetic coding sequence
atgcgcctggacaatatgctgctggctgaaggtgttgctggtcctgaaaagggcggaggtagcgccgctgccgctgcagctgctgccgcttcaggcggagcgggtagcgacaactcagtagaacatagtgactacagagccaaattgtctcaaatacgccagatatatcataccgagttggaaaagtatgagcaagcctgtaacgagtttacaacccacgtgatgaatctgctgagggagcagagtcggacgcgcccaattagtccaaaagagatagagagaatggttagcatcatccaccgaaagttctcatctattcaaatgcagctgaaacagagcacctgtgaggctgtgatgatcctaaggagccgctttctcgacgccaggaggaaaaggaggaacttcaacaagcaggccacagagattctgaatgagtatttctacagccatctgtccaatccctacccaagtgaagaagccaaggaggagctcgctaaaaaatgtggaatcaccgtgtcccaggtgagcaattggttcggtaataagagaatacgctataagaagaatattggcaagttccaggaagaggccaatatatacgccgctaagactgccgtgacagcgacgaatgtcagtgcacacggttctcaagcaaactccccatctactccaaacagcgctgggtcttcctcttccttcaatatgagtaattccggggatttgtttatgtcggtgcaatccctgaacggggactcttatcagggcgcacaagtaggcgcaaatgtgcagtcacaagtagacacactccggcatgtaatatctcaaacgggaggatacagtgatggactcgccgcatctcagatgtattctccccaaggcataagcgccaatggaggctggcaggacgccacaacaccgtccagcgtgacttcccctaccgagggccctggatctgtgcacagcgatacaagtaactag

SEQ ID NO: 235885 - DNA, 978 bp, Artificial Sequence
  Description of Artificial Sequence: Synthetic coding sequence
atgcgtttggacaatatgctcctcgccgagggagtggcaggacccgagaagggtggtggtagcgccgctgctgctgcagccgctgccgcatccggaggtgcagggtccgacaacagcgtggaacacagcgattacagggccaagctgtcccagattaggcagatctatcatactgagctggagaagtacgagcaggcttgcaacgagtttacaacccacgtgatgaatcttttacgggaacagtctcgcacaagacctatctcccccaaagaaatagagcgaatggtgagcatcatacaccggaaattctcatctatccagatgcagttgaagcaatccacctgcgaggcggtcatgattctacgcagccggttcctcgatgccagaagaaaacggaggaactttaataagcaagctacggagatattgaatgagtacttttactcccacctgtcgaatccttatccctcggaagaagccaaggaagagctcgccaagaagtgtggcataaccgtaagccaggtgtccaactggtttggcaataagaggatcagatataaaaagaatattggtaagttccaagaggaggcaaacatttatgctgcgaagaccgcagtgacggctacaaatgtctccgcgcatggtagtcaggcaaacagcccttcgacccccaattcagccggatcatccagttcctttaacatgtctaactccggtgacctcttcatgtccgtgcagtcactgaacggcgactcataccaaggcgctcaagtgggggctaatgtccaaagccaggtggacacactgagacatgtaatatctcagaccgggggatatagcgatggcctcgcagcgtcccagatgtatagtccccagggcatatctgcaaatgggggatggcaggatgcaacaacacccagttcagtaacatcacctaccgaggggcctggaagtgttcatagtgacacatctaattag

SEQ ID NO: 235886 - DNA, 1293 bp, Artificial Sequence
  Description of Artificial Sequence: Synthetic coding sequence
atggacgagagactgttaggcccaccgcctcctgggggagggcgtggaggcttgggactcgtttccggggaaccaggtggtcccggtgagcccccaggcggtggggatcccggtggcggaagtgggggtgtcccaggaggccgaggaaagcaggacattggtgacatcctgcagcagattatgacgattaccgaccagtctttggatgaggctcaagctaagaagcacgcacttaactgtcacaggatgaagccagcgctgttttccgtgctgtgcgagataaaggaaaaaacaggcctgtctattaggagctcacaagaggaggagcctgtggacccccagcttatgcgcctagacaatatgttgttagccgaaggtgtggccggacccgaaaaaggaggcggaagtgcggcagccgcagcggcagccgcagcttctggcggaggtgtgtcgcctgacaatagtatcgaacatagtgattacagaagcaaactggcccagatccgccatatttaccactccgagttggagaagtacgaacaggcctgtaatgagttcacaacacatgtgatgaacctgctccgggaacaatctaggacccggcctgtggccccaaaggagatggagcggatggtctcaatcattcataggaagttttctgccatccagatgcagttaaagcaatcgacttgcgaagctgtgatgatcctccgctcccgatttctggacgctagaaggaagagacgcaactttagcaagcaggcaacggaagtgctcaatgagtatttctactctcacctgtcgaacccttacccttctgaagaggcaaaagaagaactagcgaagaagtgcggtattactgtctcccaggtgtccaactggttcggcaacaagagaatccgatacaaaaaaaacattggcaaatttcaggaggaggctaacatctacgctgtgaaaaccgccgtttccgtgacccagggcggacactccagaacttcctctcctacacctcccagctctgccggatctggcggttctttcaacctctccggcagtggagatatgtttctgggcatgccaggccttaacggagacagctatagtgctagtcaggtagagtcattgcggcattccatggggccaggcggttatggtgataacctgggcggtgggcagatgtactccccacgagaaatgagggccaacggatcctggcaggaagccgtaaccccatcatccgtgacatctccaactgagggaccgggttctgtgcattccgacacgtccaattag

SEQ ID NO: 235887 - DNA, 1293 bp, Artificial Sequence
  Description of Artificial Sequence: Synthetic coding sequence
atggacgaacgccttcttggaccaccccctcctggcggaggcagaggcggactgggtctggtgagtggagaacctggaggaccaggcgagccgccagggggaggagaccccggagggggatcgggcggagtgcccggaggcaggggcaagcaggacatcggggacatccttcagcagattatgactataacagaccagtctctggatgaggcccaggccaaaaaacacgctttgaactgccataggatgaagcctgctctgttcagcgttttgtgtgaaatcaaagagaagacagggttgtctattaggagttcacaggaggaggagccagtggacccacaactgatgcgtctggacaacatgctactggccgagggcgttgcgggacctgagaagggaggtggaagcgccgcagcggctgccgcagctgcggcttctgggggtggagtgtccccagacaatagcatcgagcacagcgattataggagtaagctggcacaaatcagacacatttatcacagcgaactggaaaaatatgagcaggcatgtaacgagttcaccactcatgtgatgaatctcctgagagagcagtcacgcacaagacccgtggcccctaaggagatggagcgtatggtaagcataatccacagaaagttctccgctattcaaatgcaacttaaacagtcgacctgcgaagccgtgatgattctcaggagccgcttccttgacgctagaaggaaaagacgcaacttttcaaagcaggcaaccgaggtgcttaacgaatacttctatagccacctgtccaatccctacccatctgaagaggccaaggaagagctcgctaagaagtgcgggatcaccgtgagtcaagtgtccaactggtttggcaacaagaggatcagatacaaaaagaatattggtaagttccaggaagaggccaatatctacgctgtcaagactgcagtgtccgtgacccagggaggacacagccgaacgtcatctcccaccccaccctcttccgccggatcaggaggttcctttaacttaagcgggagcggtgacatgttccttggtatgcccggactgaatggcgattcatactccgcaagccaggtagaatccttgcggcactcaatggggccaggcggttatggcgataatctaggagggggacagatgtatagccctcgggaaatgcgggctaatggcagctggcaggaggctgtgacaccttcaagcgttacgtcccccactgaagggccaggctccgtacactctgacacctccaactag

SEQ ID NO: 235888 - DNA, 1293 bp, Artificial Sequence
  Description of Artificial Sequence: Synthetic coding sequence
atggacgagagactgttgggacccccacctcctgggggaggcagaggcggactggggctggtgtcaggtgagcctggcggaccaggggaaccgcctgggggaggggatccgggaggtggatccggcggtgtacccggaggaagaggtaagcaagacataggcgatattctacaacaaattatgaccattaccgatcaatctctggatgaagcccaggctaagaaacatgctctcaattgccacagaatgaagcccgctctgttctctgtgctgtgcgaaattaaagaaaaaacaggactgtctattcggagctcccaggaagaagaaccagtggatccacagttgatgaggttggacaacatgctgttggccgaaggcgtcgcgggtcccgaaaagggcggaggcagcgctgccgcagccgctgccgctgcagcctccgggggtggcgtgagcccagacaactcaatcgagcactctgactaccgaagcaaactagcacagatccgccacatctaccacagtgagctggaaaagtatgaacaggcttgtaatgagttcacaacccacgtgatgaacctgctccgggagcagagccgtacccgcccagtggcccctaaggagatggagcgaatggtctcaattatccataggaaatttagcgccattcagatgcagctgaaacaatccacatgcgaagcagtcatgattttacggtcgaggttcttggatgctcggcgtaagcgcagaaacttttcgaagcaggccacagaagtgctgaacgagtacttttacagtcacctgtccaatccttatcctagcgaggaggccaaggaggagctcgcaaaaaaatgtggtatcaccgtctcacaggtgagtaactggtttggcaataaaaggatacggtataaaaagaatattgggaagttccaggaagaagcaaatatctatgccgtaaagacagcggtctccgtgacccaaggaggacatagtcgtacgagttcccctacgcccccatccagcgcaggctctggaggcagttttaacctttccggtagtggcgacatgttcctgggtatgcccggtttgaatggggactcttactctgcttctcaggtggagagtttacgacacagtatggggccaggtgggtacggggataatctcggaggaggccagatgtactctcccagggagatgagagctaacggatcctggcaggaagcagtcacaccatcttccgtgaccagtcccaccgagggccctgggagtgtccattctgacacgagcaactag

SEQ ID NO: 235889 - DNA, 1293 bp, Artificial Sequence
  Description of Artificial Sequence: Synthetic coding sequence
atggatgaacggctcctcggtccccctccccctggcggaggcagggggggtctggggctggttagtggcgaacccggaggaccaggcgagccccctggcggaggcgatcctggaggcggttctggcggagtgcctggcggacggggaaaacaagacattggcgacattttgcagcagatcatgacaatcacagaccagtctctggacgaagcacaagcgaaaaaacatgctctgaattgccaccggatgaaaccagccttgttttcagtgctgtgtgagattaaggaaaagaccggactttctattaggtcctcacaggaagaagagcctgtggatcctcagctcatgcgattagacaatatgcttttggctgagggtgtggccggtcctgaaaaagggggagggagcgcagccgcagcagcagcggcagctgcatccggcggaggcgtgagcccggataattccattgagcattctgattatagatctaagctggcccagatcagacacatttaccactccgaactcgaaaagtatgagcaggcctgtaacgaatttaccacacatgtgatgaacctactaagggagcaatcccggacacggccagtggctcctaaagaaatggaacgcatggtgtctatcatacatcggaaatttagtgctatacagatgcagctcaaacagagtacctgcgaagcagtgatgatcctgagatccaggttcctggatgctcggcgaaagagacgaaatttttccaagcaggccaccgaggtcctcaatgagtatttctattcccatttaagtaatccataccccagcgaggaagcaaaggaagagctcgccaagaagtgtgggataaccgtgagccaggtgtccaactggttcggcaataagcggatacggtacaaaaaaaatatcggcaaatttcaggaggaagctaatatctatgccgtgaagacagccgtaagcgttacgcaagggggacacagtaggacgtcttcacccacgccccctagctctgcaggctctggcggttccttcaatctgtcgggatcaggcgatatgttcctcggaatgcccggattgaacggcgattcctattctgcctctcaggttgagtctctccgccatagtatgggacccggaggttacggtgacaacttaggaggcggacagatgtactcaccccgagaaatgagagccaatggctcttggcaggaagctgtgactccctcgagtgtgacttctccaacagagggcccaggatccgtccatagcgatactagcaactag

SEQ ID NO: 235890 - DNA, 1293 bp, Artificial Sequence
  Description of Artificial Sequence: Synthetic coding sequence
atggacgaacgcctgttggggcctcctcctcctgggggaggaagggggggactaggactggtctcaggagaacctgggggtccgggagagccacctggagggggagatcccggtggagggtctggaggtgtcccgggaggaagaggcaagcaggatattggagacatcttgcagcagattatgacaatcaccgatcagtccctcgatgaggcccaggcaaaaaaacacgccctgaactgccaccgcatgaagccggctctattctcggtgttatgtgagattaaggaaaaaacaggactctcaattcgcagcagccaggaagaggagccggttgatccacaactcatgagactggataatatgttgctagccgaaggcgtggctgggcctgagaaaggcggaggtagtgccgcagctgcagccgcagcagcagcctctgggggaggcgtcagcccggataacagcatcgagcattcagactatcgatcaaaattggctcagataaggcatatctaccattccgaattagagaaatacgaacaggcatgcaacgagttcacaacccacgtgatgaatcttctgcgggagcagagcagaactcggcctgtggctcctaaggagatggagcggatggtaagcatcatccacaggaagttcagcgccatccaaatgcaactgaaacagagtacctgcgaggcagttatgatcctgcggtctagatttttggacgctaggcgaaagcggaggaacttctcaaagcaagctactgaagtactgaatgagtacttctattcacatctgagtaatccttacccaagtgaggaggctaaagaagagttggcgaaaaaatgcggtatcacagtgagtcaggtgagtaattggtttggcaataaaaggatccgctataagaaaaacatcgggaaattccaggaggaggccaacatttacgccgtcaaaactgccgtgagcgtaactcaagggggacactcccgcacctcttcgccgaccccccctagcagcgctggttctggcggatcctttaaccttagcggctcaggcgatatgtttctcgggatgccaggtctgaatggcgatagctacagcgcatcccaagttgaatcactgaggcactccatggggccaggtgggtacggcgacaaccttggaggcggtcagatgtattcccccagggagatgcgagccaacggcagctggcaggaggccgtgactcccagttcggtgacatcccccactgagggtccgggaagtgtgcatagcgacacttctaactag

SEQ ID NO: 235891 - DNA, 1293 bp, Artificial Sequence
  Description of Artificial Sequence: Synthetic coding sequence
atggacgagcgcctgctgggaccccctccacctggcggtgggaggggcggtcttggcctggtatctggcgagccagggggacctggggaaccacctggtgggggtgacccaggcggaggctccgggggtgtccctgggggacggggtaaacaggatataggagacatcttgcagcagatcatgactatcacggaccagtcattggatgaggcccaggctaaaaagcatgcacttaattgtcatcggatgaagccggcactgttctcagtgttgtgtgaaattaaggaaaagacggggttgagcattcggagctcccaggaggaggaacctgtcgaccctcagctgatgcgcctcgacaacatgttgctcgcagagggggtggccggaccagagaagggcggaggcagcgccgctgctgcagccgcagccgctgcgagcggcggaggagtgtctcctgataactctatcgagcattcggattacaggtcaaagctggctcagattaggcacatctaccatagtgagcttgagaaatatgagcaggcctgtaatgagtttacaacccacgtaatgaacctgctgcgtgagcagagcaggactagacctgtggcccctaaagaaatggagagaatggtctcgatcatccataggaagttttccgccatccaaatgcagttaaaacaatccacttgcgaagccgtgatgatattacggtcccgcttcctcgatgctaggcgcaaacggagaaattttagcaagcaggcaaccgaggtgcttaatgagtacttctactcccacctctctaatccatatccctccgaggaggctaaggaggaattggcaaaaaaatgtggaatcacagtgtcacaggtctccaattggtttggcaacaagagaatcaggtataagaagaatataggaaaatttcaggaggaagccaacatctacgccgttaagaccgccgtgtccgtgacccaaggtggtcactcaaggacctcgtccccaacacccccatcctctgctgggagtggaggctccttcaatctcagtggatcaggggatatgttcctgggcatgcctggcctcaatggggactcctattccgcctcacaggtcgaaagtttgaggcactcaatggggccagggggatatggcgacaacttaggcggtggtcaaatgtactcccctagggagatgagggcgaatgggtcctggcaggaggccgtcaccccgtcatccgtcacgtcgcctactgagggccctggcagcgttcacagtgatacatcaaattag

SEQ ID NO: 235892 - DNA, 1293 bp, Artificial Sequence
  Description of Artificial Sequence: Synthetic coding sequence
atggatgagcgcctcctcggcccaccccctccaggtggaggtagagggggactcgggctcgtttccggtgaacccggagggcctggtgagcctccgggtggcggagacccaggaggagggagtggtggggtgccagggggtagaggcaaacaagatattggagacatactccaacaaatcatgacaatcacagatcagagtttggatgaggcacaggccaagaaacacgcccttaattgtcaccgtatgaaacccgcactgtttagtgtgctgtgcgagattaaggagaaaacaggactctccatccgaagctcccaagaagaagagcctgttgatcctcagctaatgcggttagacaacatgctcctggctgagggagtggcgggaccggaaaaaggaggagggagtgctgccgcagctgcagccgctgcagcctcagggggaggcgtttccccggataactctattgagcacagcgactacagatctaaactggcacagattcggcatatctaccacagcgagctggaaaagtacgagcaggcctgtaatgaattcaccacccacgtcatgaacctgctgagagagcaaagccgcacgagacccgtggcacctaaagaaatggaacggatggtcagtatcatccaccggaagttctcagcaatacagatgcagctgaaacagtccacatgtgaggcggtgatgattctgcgctccagatttttggatgcgcgtcgtaaacgcaggaatttcagtaagcaggccacggaagtgttgaacgaatatttctactcacatctctcaaacccctacccctccgaagaggccaaggaggagctggccaagaaatgtggaataacggtgtcgcaagtgtccaactggttcggcaataaaaggatccgctataagaagaacattggcaaatttcaggaagaagcaaacatatacgccgtgaaaactgctgtgtctgtcactcaggggggtcactcacgcacttcgagccccacgccgccatcctccgcaggcagcgggggaagctttaacctgagcggctccggggatatgtttttaggtatgcctggactgaacggggattcttacagtgccagccaagtagaaagtctccggcacagcatggggccaggaggatacggagataatctcggcggagggcagatgtattccccacgcgagatgcgagctaacggctcatggcaggaagctgtgaccccgagttccgtcacctctcctacggagggacccggatctgtgcatagtgatacatctaactag

SEQ ID NO: 235893 - DNA, 1392 bp, Artificial Sequence
  Description of Artificial Sequence: Synthetic coding sequence
atggatgaaaggctgcttggccctccacccccagggggtggcagaggcggactcggcctcgtgtccggcgagcccggaggaccaggtgagccgccaggcggtggcgaccctggcggtggttcaggaggggttccagggggaaggggtaaacaggacatcggcgatatactgcagcagatcatgactattaccgatcaaagcctggacgaagctcaggctaagaagcatgcgctcaactgtcaccgaatgaagccagctttattttcagttctgtgtgaaatcaaagaaaagactggtctttccatcaggtcttctcaggaggaagagccagtggacccacaactaatgaggctcgataatatgctgttggccgaaggtgtggcagggcctgaaaaggggggaggatcagcagctgccgcagctgcggctgcagcgtccggcggaggagttagtcccgataactcaatagagcactcggattatcgcagcaaactggcacagattcgacatatctaccacagtgagctggagaagtatgagcaggcgtgtaacgagttcaccactcatgtaatgaacctgcttagagagcagtcgaggactcggccagtggccccaaaagaaatggagcggatggtatccataatccaccggaaattttcggccatccagatgcaactgaagcagagcacctgtgaggctgtgatgatcttgaggtctcgcttcctggacgcaagacggaaaagacgcaacttttccaagcaggccaccgaggtactaaatgaatacttttacagccatttgtccaacccctatccatctgaagaagcgaaggaagaattggctaagaaatgcggaatcactgtgagtcaagtcctgtggagactccgggaggagctgtccggcaaggtgcatgccagccagctaggagccgtggtaagtaattggtttgggaataagagaattaggtataagaagaacattggcaagttccaggaggaagccaatatttacgctgtaaagacagctgtcatcattgctgagcgaggcccttttggggtgcgaggcaccgagctgtccttgccctctctcccaccccagggcagcggcggaagcttcaatctgagcggctccggggacatgtttctgggtatgcctggcttgaatggcgattcgtattccgcgtcacaggtaagatgtccgagtcccctacaggtggaatctttaagacactcaatgggccctggcggatacggggacaacctggggggtgggcagatgtacagtccacgggagatgcgagcaaacggaagctggcaggaggccgtgaccccctcaagcgtaacatctcctaccgaaggcccagggtctgttcactccgacacttccaattag

SEQ ID NO: 235894 - DNA, 1392 bp, Artificial Sequence
  Description of Artificial Sequence: Synthetic coding sequence
atggatgaacgcctgctcggtcccccacctcccggagggggacgcggtggcctgggactggtatcaggagagcctggtggacctggcgagccccctggaggaggagatcctggtgggggaagcgggggtgttcctgggggtcgcggtaagcaagatattggagatattctacagcagattatgactataacagatcaaagtctggatgaagcccaggccaaaaaacacgccctgaattgtcacaggatgaaacctgctctgttcagcgtgttatgtgaaatcaaggagaagacaggcttgtcaattcgttcatcccaagaggaagaacctgtagacccccagttgatgcgcctggacaacatgctccttgcggagggcgtggccggacccgagaagggtggtggcagcgcagccgctgccgcagccgctgcagcctctggagggggagtgagtcccgataacagcattgaacactccgactaccgctccaaactcgcgcagattcgtcacatctatcactctgagcttgaaaaatatgagcaggcttgcaatgagtttacgacacatgtcatgaatcttcttagagagcaatcccgcacaaggccagttgcccctaaagaaatggaaagaatggtgtctatcatacatcgtaagtttagcgcaattcagatgcagctgaagcagtctacctgtgaggcagtcatgatattgaggtccaggttcctcgacgcgcgtagaaagagaagaaactttagtaagcaggcaaccgaggtgctgaacgaatacttttacagccacctttccaacccctacccatcagaagaggctaaggaagaacttgccaagaagtgcgggattaccgtcagtcaggtgctatggcgtctgagggaggagttgtctggtaaggtgcatgcgagccagctgggggctgttgtgtcgaactggttcggcaacaaaaggatcagatataagaaaaacatagggaagtttcaagaggaggctaacatttacgcggtgaagacagccgtcataattgccgaacggggaccttttggcgtgcgaggcacagaactgtcgctgcctagcctgccaccgcagggatcaggcggtagctttaaccttagtggttctggcgatatgtttttaggcatgcctggactaaatggtgactcttactcagctagtcaggtacgatgcccctcacctttgcaggttgagtcactcagacattccatgggaccaggcggatacggtgacaatctgggcggtggacagatgtactcaccccgagagatgcgcgctaatggatcctggcaggaagcagttaccccaagcagcgttacaagtcctactgaaggtccagggagtgtgcattcagatacctccaattag

SEQ ID NO: 235895 - DNA, 1317 bp, Artificial Sequence
  Description of Artificial Sequence: Synthetic coding sequence
atggacgaacgactcctcggtccaccccctcccggtggcggaaggggtgggctaggcctcgtctccggcgaacccggtggcccaggcgagccgcctggagggggagacccgggaggaggatccgggggtgtgcctggtggacggggtaaacaggacattggcgatatcctgcaacagatcatgaccatcaccgaccaaagtttggacgaggcacaggcaaaaaagcacgcacttaactgccatagaatgaaacctgccctattcagcgtcctttgtgaaatcaaagagaagacagggctgtccattaggagcagccaggaggaggaacccgtggatccccagctgatgagactagacaacatgttacttgctgaaggcgtggccggaccagaaaaaggcggagggagcgctgcagccgcagcagccgctgcagcgagtggagggggtgtctcccccgacaattctatcgagcattctgactaccggagcaaactggcgcaaataaggcacatctatcacagcgaactcgaaaagtacgagcaggcatgcaatgagtttacaacgcacgtgatgaacctgttgcgggaacagagccgcacccgtcccgtcgcccctaaagaaatggaaaggatggtgagcatcatacataggaagtttagcgccatccagatgcagctgaagcaaagtacctgcgaggccgtgatgatcctgcggagcagattcttggacgctagaagaaaaagaaggaacttttccaaacaagcaactgaagtgctcaacgagtacttttactcacacctttctaacccttacccctcagaagaagcgaaagaggaattggccaaaaagtgcgggattactgtgtcccaggtttccaattggtttggtaacaagcgcatccgctataagaaaaacattggtaaatttcaggaggaagccaatatctacgcagtcaaaaccgccgtatctgttacccagggagggcatagtcggacttctagtcctactcctccctcttctgccggatctggaggctcttttaaccttagcggctccggcgacatgtttttaggaatgcccggtctgaacggcgatagttattcagctagccaagtgaggtgccccagccctctgcaggtggagtctcttagacacagcatgggccctggtgggtatggcgacaacctggggggtggacagatgtatagcccaagggagatgcgcgctaacgggtcctggcaggaggctgtcactccctcatctgttacatctcccactgagggtcccggtagtgtgcactccgatacctcgaattag

SEQ ID NO: 235896 - DNA, 1317 bp, Artificial Sequence
  Description of Artificial Sequence: Synthetic coding sequence
atggatgaacgcctcttgggtcctcctcccccaggcggtggaagaggagggctgggactggtgtctggggagcccggaggacccggagagccacccggaggcggagatcctgggggtggaagtggcggagtgcccggtggacggggaaaacaggacatcggcgacatactacagcagatcatgactattacggatcagtccttggacgaggcacaggcgaaaaagcacgccctgaactgccatcgaatgaaaccagccctgttttccgtcctgtgcgagattaaggagaagaccggactgtcaattcgaagttcgcaggaggaggaacctgttgatccacagctgatgcgcctcgataatatgctgctggcagaaggcgtcgctgggcctgaaaaaggaggtggcagtgcagctgcagcggcagccgctgcagccagcggcggtggggtctccccagacaactcaatcgaacatagtgactataggagcaagcttgcacagataagacacatttatcattccgagctggagaaatacgagcaagcctgcaacgagtttaccactcacgttatgaatttactgcgtgaacagagccgcaccaggcccgttgctccgaaggagatggagcgcatggtcagcatcattcaccgcaagttcagcgccatccaaatgcagctgaagcagagcacctgcgaagcagtgatgatcttacgctctcggtttctggatgcccgacgaaaacggcgaaatttttctaagcaggctacggaggtccttaacgaatacttttactctcacctgtccaacccatacccttctgaagaagctaaagaagagctggcgaagaagtgtggcatcacagttagtcaggtgtctaactggttcggaaataagagaattaggtataagaagaacatcggtaagtttcaggaggaggctaacatatacgccgtgaaaaccgcagtctccgtgacccagggcggtcattccaggactagtagtcctacacctccaagctcggccggatccggtggttctttcaacctcagtggttccggcgacatgtttttgggcatgcctggcttgaacggagacagctatagcgccagtcaggtcagatgtccttcgccactgcaggtagaaagcttgaggcattccatgggaccaggagggtacggcgacaacctgggaggtggccagatgtactcaccacgtgaaatgagagctaatggttcctggcaggaagccgtgaccccatcaagtgtgacatctccgaccgaaggccctgggtcagtgcacagtgatactagcaattag

SEQ ID NO: 235897 - DNA, 1392 bp, Artificial Sequence
  Description of Artificial Sequence: Synthetic coding sequence
atggacgagagactcttgggccctcccccacctgggggagggcgtgggggactgggattggtttctggggaacctggaggcccaggggagccacccggtggcggtgatcctggaggcggttccgggggtgtcccgggtggacggggaaagcaggacattggagacattctgcagcaaattatgacaattactgaccagtctctggatgaggcccaggcgaaaaagcacgccctgaattgtcacaggatgaagccagccttgttcagtgtcctgtgtgagatcaaagaaaagacaggactgtcaatacgttcatcacaagaggaggagcccgtggatccgcaactcatgcgacttgacaacatgttacttgctgaaggggtggcaggacccgaaaagggtggcggatctgcagcagccgctgccgctgctgctgcttctgggggaggggtgagcccagataatagcattgaacactctgactaccggagtaaactggctcagatccggcatatctatcactcagagctggaaaagtacgaacaggcatgcaacgagttcaccacgcatgtgatgaatctgctgcgagagcaatctcgtacccgccctgttgctcctaaggagatggagcggatggtcagcatcatccaccgcaagttttctgccattcaaatgcagctgaagcagtcgacttgtgaagctgtgatgatcttgaggtctcgctttcttgacgccaggcgcaagcggagaaacttctctaagcaagccaccgaggtgctgaatgaatatttttacagccacctgtccaacccatatcccagtgaggaggctaaagaagagctggccaagaagtgcggcatcacagtgtctcaagtcctttggaggttgcgcgaggagctttccgggaaggtgcatgcttcccagctgggggctgtcgtcagcaactggttcgggaataaacggattcgctataaaaagaacattggtaaatttcaagaagaggctaacatctacgctgtcaaaactgcagttataatcgcagagagggggccattcggcgtacgaggcaccgaactgtcactgccatcactgccaccccaaggatctggaggcagcttcaatttatctggaagcggcgacatgttcttaggtatgcctggattgaatggggatagctatagcgctagccaggtccgctgccctagtcccctccaagttgagtccctccgacactccatggggcctggcggttatggagataaccttggtggcggacagatgtactcacctagggagatgagagcaaacggcagttggcaggaggcagtcacaccatcctccgtgacatcgcccacggaagggcctggttctgtgcacagcgacacatctaattag

SEQ ID NO: 235898 - DNA, 1392 bp, Artificial Sequence
  Description of Artificial Sequence: Synthetic coding sequence
atggatgaacgtctgctgggacctccgccacctgggggtggacgtggaggactgggccttgtatccggggaaccgggaggacccggtgaacctcctggaggcggagaccccggtggcggttccggcggtgttccgggaggcagagggaagcaggatataggagacatattgcaacagatcatgacgatcacggaccagagcctcgatgaagcccaggctaagaagcacgctctgaactgccaccgcatgaaacctgctttgttcagtgtgttgtgtgagattaaggagaaaaccggtctgtcaattcggagttctcaggaggaggaacctgtagaccctcagttgatgcggctggacaatatgctcctcgccgagggcgttgccggaccggagaagggcggaggctctgccgctgctgctgccgctgctgcagcgtctggcggaggcgtctccccagataattccatcgagcattctgattatagatcaaaactcgctcagattcggcacatataccactccgagttggaaaaatatgagcaggcctgcaacgagttcaccacccacgtgatgaatctgcttagagagcagtcaaggacccggcctgtcgctccaaaggagatggagagaatggtgagcataatacatcgtaagttttcagctatacagatgcagctgaaacaatcaacatgtgaagccgtgatgatcctacgatctcgatttctagacgctcggcgtaagcggaggaactttagcaagcaggccaccgaggttctgaacgaatatttttactctcatttgagcaatccctacccgtccgaggaagccaaagaagagctagctaagaagtgtggaatcacggtgagtcaggttctgtggaggcttcgcgaagaactcagcggcaaggtccacgccagccagcttggggcagttgttagcaactggttcgggaacaagcgaattaggtacaagaagaacattggcaagttccaggaggaggcaaatatatatgcagttaagaccgcagtgataatcgctgaaaggggtcctttcggggtgagaggcactgaactatctctgcctagtcttccaccccaaggttccggagggtccttcaatttgagcggcagtggggacatgtttctgggtatgccaggcctcaatggcgattcgtactccgcatcccaggttcgttgcccttcgcccttgcaggttgagtctttacggcattccatgggtcccggagggtacggcgacaacctgggcggaggacagatgtacagtccccgagagatgagagctaatggtagctggcaagaagcggtgactccctccagtgtgaccagtcctacagaaggcccaggctctgtgcacagtgacaccagtaactag

SEQ ID NO: 235899 - DNA, 1332 bp, Artificial Sequence
  Description of Artificial Sequence: Synthetic coding sequence
ggcgcagaacaggggggtggcctgcgcgctccgcctcaactgtggacaaacggctactggggacgcccactgcaggccggagcgggtggcctggggcttgtttctggcgaaccaggtggacccggagagccacccggtggcggtgatcccggtggaggcagcggtggcgtgcctggcggaaggggaaaacaggatataggcgatatcctgcagcaaattatgaccatcaccgaccaaagcctcgatgaggcccaggcaaaaaaacacgcgctcaattgtcataggatgaaacctgccttgttctccgtgctctgcgagattaaagaaaagaccggcctgtctataaggtcaagccaggaggaggaacccgtggacccccagctgatgaggctggataatatgttactcgcagagggggtggccggacctgaaaaaggaggcggatctgcggcagctgcggcagctgctgcagcaagcggtgggggtgtgtctcccgacaattctatcgagcattcggattatcggtcaaaactggcccagattcggcatatatatcacagcgagctggagaagtacgaacaggcatgtaatgaatttacaacccacgtgatgaatcttctccgggaacagtctcgcactaggccggtggccccaaaggaaatggagagaatggtgtccattatccataggaaattcagcgcgatacagatgcaattaaaacaatctacttgcgaagccgtgatgatactgagatcgcgtttcctggatgcccgtcggaaacgcagaaatttctccaaacaggccaccgaagtcttaaatgagtatttctacagccatctctctaatccttatccgtccgaagaggccaaagaggagctcgcaaagaaatgcggcatcactgtttctcaggtcagcaattggttcgggaataaaaggatccgttacaagaaaaatattggcaagttccaagaagaagccaacatctacgcagtgaagaccgcagtgtctgtgacccagggcggacacagccggacctcttcccctaccccaccgagctccgccggatcaggcggatcgtttaatcttagtggcagcggggatatgttcttgggcatgcccggtctgaatggtgatagttacagtgcctcgcaggtcgaaagcctgcgccattccatggggccaggcggatacggtgataacctcgggggagggcagatgtattcccccagagaaatgagggccaacggttcctggcaggaggctgtgacaccctccagtgtcactagtcctacggaagggcctgggagcgtccatagcgacacatccaattag

SEQ ID NO: 235900 - DNA, 1332 bp, Artificial Sequence
  Description of Artificial Sequence: Synthetic coding sequence
ggtgccgagcagggtggcggactccgggcaccgccacagttatggacaaatggctattggggcagacccctgcaggcgggtgccggtggcttgggccttgtgagtggggaacccggtggccctggcgagccacctggcggaggcgaccccggaggaggttccggtggagtccctggcggaaggggtaaacaagacattggcgacatccttcaacagatcatgactatcaccgatcaaagccttgacgaagcacaggctaaaaagcatgcgctgaattgccacaggatgaagcccgcactgttttctgtgctgtgcgaaatcaaagagaaaaccggcctctctatcaggagcagtcaagaggaagagcctgtggatcctcagttaatgagacttgacaacatgctgctggctgaaggagttgcaggaccagagaaggggggaggatctgccgctgcagccgctgccgctgccgcaagtgggggaggcgtgagtcctgataacagtattgagcactctgattacagatcaaagctggcccaaatccgccacatatatcattcagagcttgagaagtacgaacaggcatgcaatgaattcacaacacatgtgatgaacctgctgcgtgagcagagccgaacacggcctgtggcacccaaagagatggaaagaatggtgagcatcatccatagaaagttctccgccattcagatgcaattaaaacagagcacctgcgaggccgtgatgattctgagaagtagatttctggatgccaggaggaagagaagaaactttagcaagcaggccactgaggtgctgaacgaatacttttactcgcatctgtcaaatccttaccccagcgaagaggccaaggaagaactggccaaaaagtgcgggattactgtgtcacaagtgagcaactggtttggtaacaaaagaattcgatacaaaaaaaacataggcaaattccaggaggaggccaatatttatgcagtgaagacagccgtctcagtgacacagggcggacactctcgtacttccagcccgactccaccttcaagcgccggaagcggagggagttttaatctttctggatcaggagatatgttccttggaatgccaggactgaacggggacagctactctgcaagtcaagtcgaatctctcaggcatagcatgggacctggcggatacggagacaaccttgggggaggacagatgtactctccacgtgagatgcgagctaacggctcatggcaagaggccgtaaccccatcctccgtcacttcgcccaccgaaggcccaggttctgtccacagcgacacatccaattag

SEQ ID NO: 235901 - DNA, 1317 bp, Artificial Sequence
  Description of Artificial Sequence: Synthetic coding sequence
atggacgagcgcctgcttggcccaccccctcccggtggcggacgcggtggccttggcctcgtctccggtgagcctggtggcccaggtgagccacccggtggtggggacccgggaggtggaagcgggggagtgcccggaggcagaggaaaacaggatattggcgatattctccagcagattatgacaataaccgatcagagtctcgatgaagcacaggcgaagaagcacgccctcaattgccatcgaatgaagcctgctctgttttccgttctatgtgagataaaggaaaagaccggcctctccatcaggtctagtcaggaggaggagccggtcgaccctcagcttatgcgacttgataacatgctgttagcagagggcgtagcgggtcccgagaaaggtgggggaagtgccgcagccgctgccgcagccgctgcctctgggggaggcgtgtcgccagacaactctattgaacatagcgattaccgctccaagttggctcagatacgccacatttatcactcggagctagagaagtatgaacaagcatgtaacgagtttacaacgcacgtgatgaacttgctccgggagcagtcccgaacgcgtcccgtggctcctaaagagatggagagaatggtgtctatcattcaccgcaagttttccgcaattcagatgcaactcaaacaatcgacgtgtgaggcagtgatgattctgcgatcccgctttctggacgcaaggcgcaaaaggagaaactttagcaagcaggcgaccgaggtcctgaacgagtacttctactcacacctgtccaacccctatccttcagaagaagcaaaggaggaactcgcgaagaaatgtggcatcaccgtgagccaggtgagcaactggtttggtaacaagcggattcgctataagaagaatattgggaaattccaggaagaagccaatatctacgcagttaagacagccgtttctgtgacacaaggcggtcattcaagaaccagtagcccgacaccaccttcgtccgccggatccgggggaagctttaatctgtctggctctggagacatgttcctgggtatgcctgggctgaatggggacagttactccgccagccaagttagatgtccctcacctttgcaggtggaaagcctgcgtcactcaatggggcctggtggatacggtgataatctgggcggtgggcagatgtactcccctcgcgagatgcgtgccaacggcagctggcaagaggcggttaccccatcctcagtgacatcacccacagaaggtccagggtccgtccattcggataccagcaactag

SEQ ID NO: 235902 - DNA, 1380 bp, Artificial Sequence
  Description of Artificial Sequence: Synthetic coding sequence
atggacgaaagactgttgggacctccgccaccgggaggcggtagaggcggactgggactcgtaagcggcgagcccggtggtccaggcgagccccctggcggaggagaccccggaggtggcagcggaggggtgcctggcggtcgtggaaagcaggatatcggagatattctgcagcaaatcatgaccatcaccgaccaaagcttggacgaggcgcaggctaagaagcacgcattaaactgccacaggatgaaaccagctctattttccgtactttgcgagattaaggagaaaacgggtctgtccatcagaagctcccaggaagaggagcccgtcgatccccagctgatgcgactggataacatgctcctggctgagggcgtcgccggacctgaaaagggaggaggttccgcagctgccgcagccgcagctgcagcatctggcggtggagtctcccctgataactccatcgagcatagcgattacagatcaaagctggcacaaataaggcatatctaccatagcgagttggagaagtatgaacaggcctgtaacgagtttactacacacgtcatgaaccttctgagggagcagagccggactaggccagttgcgcctaaagagatggaacgaatggtcagtatcatccacaggaaattctccgccatccagatgcagttgaaacaatctacatgcgaggccgtgatgatactgagatcccggttcctcgatgccaggcgcaaacgtagaaacttctcgaaacaggccacagaggtgctgaacgagtacttctattctcatttgagtaatccatacccttccgaagaagccaaagaggaacttgctaaaaagtgcgggatcacggtcagccaagtgctctggagattaagggaagaactgtctgggaaagttcacgctagtcaactcggtgccgtcgtgagcaactggttcggcaataagcggatccgctacaagaagaatattgggaaattccaagaggaggccaacatctacgctgtgaaaacagcagttagcgttacacagggaggacactctaggaccagttcgcccacacccccttcatctgcgggaagcggaggttcattcaacctgagtgggagcggagatatgttcctgggcatgccgggactaaatggcgatagttacagtgcaagtcaagtgcggtgtccgagccctcttcaggtcgaaagcttgaggcactccatggggcctgggggatatggcgacaatcttggcggtgggcaaatgtacagcccacgcgagatgagagcgaatggctcttggcaggaggcagtaaccccgagtagtgtgacttctccgactgagggcccaggtagcgtgcactcagatacatcgaactag

SEQ ID NO: 235903 - DNA, 1332 bp, Artificial Sequence
  Description of Artificial Sequence: Synthetic coding sequence
ggtgctgagcagggagggggactaagagcccctccccagctatggaccaacggctactggggcagaccattgcaagcgggagccggaggtctgggcctcgtgagtggtgagcctggaggccctggtgagccccctggcggtggtgatccaggaggcggtagcggcggagtgccaggagggaggggaaagcaggatattggcgatattctccagcagatcatgaccattaccgaccaatcgctggatgaagctcaagcaaagaagcatgccttaaactgtcatcgaatgaagcctgccctattcagtgtcctctgcgagattaaggagaaaactggactatcgatcaggagtagccaggaggaggagcctgtggaccctcagttaatgaggctggataatatgctcttagccgaaggagtggccggacctgaaaaaggcggaggatcagcggctgcagctgccgctgccgctgcgagtggagggggtgtttcaccagataacagcatcgagcacagcgactatagatctaaacttgcacaaatccggcacatatatcactcagaacttgaaaagtatgagcaggcgtgcaacgagttcacaacacacgtgatgaatctcctccgcgaacaatctaggaccaggcccgtggctccaaaagaaatggaaagaatggtgtctatcattcaccgaaagttctctgctatccagatgcagttgaagcagagtacctgtgaagccgtgatgatccttagatcccgatttctcgatgcacgcagaaaacgccgtaacttctcaaaacaggcgaccgaagtgttaaacgagtatttctacagccacctctccaacccttaccctagtgaggaggccaaagaggaactagccaagaagtgtggcatcaccgtaagtcaggtgtcaaattggtttggtaataagaggattcgctacaagaagaatattgggaagtttcaggaggaagctaatatttatgccgtgaagactgctgtctccgtgacacagggagggcatagtaggacatcatcccccacccccccaagttctgccggttcgggcggttcttttaatctgagcggctcaggcgatatgtttctgggaatgcctgggctaaacggtgattcatacagcgctagtcaggtcgaatccctcaggcatagcatgggtccagggggttatggggataatctgggtggaggtcagatgtactcccctagagagatgagggcaaacggaagctggcaggaagcggtgacaccctcatcggtcacctcaccaactgagggaccagggtccgtgcactcagacacctctaattag

SEQ ID NO: 235904 - DNA, 1317 bp, Artificial Sequence
  Description of Artificial Sequence: Synthetic coding sequence
atggatgagagacttcttggccctccacctcctgggggtggtcgcggtgggctggggctggtgtctggtgagccaggaggcccaggggaacctcccggagggggagatcctggtgggggtagcgggggagtgcccggtggacgcggtaaacaagacatcggggatatcctgcagcagattatgaccattaccgatcagtctctggatgaggcccaggcaaagaaacatgccctcaactgccatcggatgaagcctgcactcttctccgtactttgcgaaatcaaggagaagactggcctatccattcggtcgagccaggaggaggagcccgtagaccctcagcttatgcggctcgacaacatgctgctggctgaaggagtggcgggtcccgaaaaaggcggtgggagcgctgccgcagctgccgctgcggctgcttcagggggtggagttagcccagataatagtatcgagcattccgactaccggagtaaactggcccagattaggcatatataccactctgagctggagaaatatgaacaggcgtgcaatgagttcacgacacacgtgatgaatctcctgcgagagcagtctcgaactcggccagtggcacccaaggagatggagcgcatggtgtcaatcatacaccgaaagtttagcgcaatccaaatgcaactaaagcaaagtacatgcgaggctgtgatgatcttgaggtctaggtttcttgatgctaggcgcaagcggaggaatttcagcaagcaggctactgaagtgctaaacgagtacttctacagtcatctgagcaacccatatccttccgaggaggccaaggaagagctggcgaaaaagtgcggcatcacagtcagccaagtgtccaattggttcggcaacaagaggatcagatacaagaagaacatcgggaaattccaggaggaggcaaatatctacgccgtgaaaaccgcggtttctgttacccagggaggccacagtcgtaccagtagccctacccctccaagctccgccggatccggcggtagtttcaacttgtcgggcagtggcgatatgttcctgggcatgccaggccttaatggtgatagttatagcgctagccaggtgcggtgcccaagcccactgcaggtcgaatcactgcggcatagtatggggcctggaggctatggggacaatctaggcggagggcagatgtacagccccagagaaatgcgtgctaacggaagttggcaggaagcagttaccccaagctcagtgacatctccaaccgaaggtcctggttccgtgcacagcgataccagcaattag

SEQ ID NO: 235905 - DNA, 1317 bp, Artificial Sequence
  Description of Artificial Sequence: Synthetic coding sequence
atggacgagaggttgctgggcccacccccacctggtggaggcaggggcggactcggactagtgtcaggagaacctgggggacctggagaaccccctgggggaggcgaccctggcggtgggagtggaggtgttcccggaggtcggggtaaacaggatatcggcgacattctgcagcagatcatgacaataacggaccagtctctggatgaggcccaggctaagaaacacgcgctgaactgccaccggatgaagcccgcacttttttctgtgctctgtgagatcaaggaaaaaacaggactgagcattcgctccagccaggaggaggagcctgtggatccccagctgatgaggctggataacatgctccttgccgaaggagtggccggtcccgagaaagggggaggctctgcggctgcagctgcagccgcagccgcaagcggtggtggggtttcacccgataattctattgagcacagtgactacaggtcaaagttagcccagattcgtcacatttatcactctgagctggaaaaatacgaacaggcctgtaacgagtttaccacccacgtgatgaacttactgagggagcagagtcggacccgacccgtcgccccaaaggagatggaacggatggtgtcaataattcaccggaaattcagcgccatacagatgcagctcaagcaaagtacctgtgaggctgtgatgatcctgcgaagcaggttccttgacgctagacgaaagagaagaaacttttcgaagcaagcaactgaggtgctgaatgagtatttttattcgcacctctcaaacccttatccatcggaggaagccaaggaggagttggccaaaaagtgcggtattactgtttcccaggtgtccaactggtttggcaacaagcgaattcgatataagaaaaacattgggaaattccaggaggaagcaaatatttacgccgtgaaaaccgctgtgtccgtcacccaggggggtcactctagaaccagttccccaacacctcctagttccgcaggcagcggcggaagcttcaatttatctggctcgggcgacatgttcttgggcatgcccggtctcaatggcgacagctacagtgccagccaggtgagatgtcctagccccctgcaagtcgagagtctgcgccactctatgggaccagggggttacggagacaatctcggtggtggccagatgtattctccccgtgagatgagggctaacgggagctggcaggaagccgtgactccctcttctgtgacctcacccactgaaggcccaggatctgttcacagcgatacgagcaactag

SEQ ID NO: 235906 - DNA, 1332 bp, Artificial Sequence
  Description of Artificial Sequence: Synthetic coding sequence
ggagctgaacaggggggtggcctgcgggctcccccacaactctggactaacgggtactgggggaggcccttgcaggccggtgccggtggattgggattggtgtctggcgaacctggcggacccggagaacctcccggtggaggtgaccccggaggtgggagtggcggtgtgcctggagggagaggaaaacaggacatcggggacatcctccagcagatcatgaccatcaccgatcaaagtttagacgaagcccaggccaagaagcacgcacttaactgccatcgcatgaagcctgcgctgttctcagtgctgtgcgagatcaaagagaagactggactgtccattaggtcttcccaagaggaggagcccgtggacccccagctgatgcgcttggacaacatgttgctggccgagggggtggccggtccggagaaggggggaggttcagccgcagcagcggctgctgccgcagcctccgggggtggagtgagtccagataactccatcgaacatagtgactacagaagcaagctggctcagatcagacatatttaccactctgagctggagaaatacgagcaggcatgtaacgaattcacaacccatgtgatgaacttactgagagaacagtcacggacccgtccagttgccccaaaggaaatggagaggatggtatctataatccacaggaagttctctgcgattcagatgcagctgaagcagtctacatgtgaggctgtcatgatcctgaggtcccggtttttagacgccaggagaaagcgcagaaattttagtaaacaggctaccgaagtgcttaacgagtatttctacagccatctttccaacccctatccgtccgaggaagccaaagaggagctcgctaaaaaatgcgggatcacagtgtcccaggtgagtaactggttcggcaacaagaggatacgctataagaagaacatagggaaattccaggaagaagctaacatatatgccgtcaaaactgccgtgagcgttacccagggtgggcactcacggacctccagcccaacacctccaagcagcgcaggaagcgggggaagttttaacttgtctggatctggcgatatgttcctaggcatgccaggcctgaacggcgattcttacagcgcatcccaagtggagtccctaagacatagcatggggcctggcggatacggtgacaacctgggtgggggtcagatgtattcaccacgcgagatgagagctaacggcagttggcaggaggccgtgaccccatccagtgtaacgagccctactgaaggacctggctccgttcattcagacaccagtaattag

SEQ ID NO: 235907 - DNA, 1392 bp, Artificial Sequence
  Description of Artificial Sequence: Synthetic coding sequence
atggacgagaggctgctcggcccaccgcctcccggagggggtcgcggaggcctggggctcgtgagcggtgaaccagggggtccaggagaacccccagggggaggcgaccccggaggaggctcaggcggagttccaggaggacgtggaaagcaggatataggggatatcctgcagcaaattatgaccatcactgatcaatctctggacgaggcacaggccaagaaacatgcgctcaactgccatagaatgaagccggcactgttttctgttctgtgtgagatcaaagagaagactggcttgagcatccgcagttctcaggaagaggagcccgttgacccccaactgatgaggttagataacatgctcctcgccgaaggggtggcagggccagagaaaggaggcggatcagcggctgccgctgccgctgccgctgcctctggcggtggcgtctccccagacaactctatcgaacactcggactacagatcgaaacttgcacagattaggcacatttaccattcggagctcgaaaaatatgaacaggcctgcaacgagttcacaacccatgtcatgaatcttttgagggaacagtcccggaccagacccgtggcccctaaggaaatggaacgaatggtaagcatcatccatcggaagttctctgccatccaaatgcaattaaaacagagtacctgcgaagcagtgatgattctcagaagccgtttcttggacgcaagaaggaaacggagaaattttagcaagcaggctactgaagttctcaatgaatatttttattcgcatctgtccaacccttatccatctgaagaagcgaaggaggaactcgccaaaaaatgcggcataaccgtgtctcaggttctatggcggctgcgggaggaactttctggcaaggtccatgcctcacagctgggcgctgtggtaagcaattggttcggcaacaaacgcatcaggtacaagaaaaacattgggaagttccaggaagaagcaaatatttatgccgtcaaaacagccgtaatcatagcagagcggggaccttttggtgtgaggggaaccgagctctcgcttccatctcttcctccacagggctcgggcggatcgtttaacttaagcggctctggcgatatgtttctcggcatgcctgggcttaatggggatagttattccgcctcccaagttcggtgtccatctcctctgcaggtggagtcactgagacattctatgggacctggcggatatggggacaatctaggcggaggccaaatgtacagtcccagggagatgcgggctaacgggtcctggcaggaagccgtaacccccagttctgtaacatcacccacggaaggacccggatccgttcattccgacacttccaattag

SEQ ID NO: 235908 - DNA, 1332 bp, Artificial Sequence
  Description of Artificial Sequence: Synthetic coding sequence
ggcgctgagcagggtggaggccttcgagcaccacctcagctctggactaacgggtattggggcaggccactgcaggcgggagcgggtggactgggactggtgtctggtgagccaggaggccctggagaaccacctgggggaggggatcctggcggtggatccggaggtgtgccaggtggcaggggcaagcaggacataggcgatatccttcagcagatcatgaccattactgatcagtctctggatgaggcacaggccaaaaaacacgccttgaactgtcatcgaatgaagcctgcgctctttagcgtcctctgcgagattaaggagaagactggcctctctatacggagcagccaggaggaggagccagtcgatcctcagctcatgcgactggacaatatgctgctggcagagggagttgcaggacccgaaaaggggggtggctccgccgctgccgctgctgccgctgcagccagtggcggaggtgtgagtccggacaattcaatagagcacagcgattacagaagtaaattagctcagatcaggcatatctaccacagcgagctggagaaatacgagcaggcatgtaatgagtttacaacccacgtgatgaatctacttcgagagcagagcagaacacgacccgtcgccccaaaggagatggagcgcatggtcagtatcatccacaggaagttcagcgccattcagatgcagctgaaacagtctacttgtgaagctgtaatgattctgcggtctaggttcctggatgccagaaggaagcgtaggaatttttctaagcaggccaccgaggtcctgaacgaatatttctattctcatctgtctaacccctatccctctgaggaggccaaagaggaattggcaaaaaaatgcggcataacggtgtcacaagtctccaattggtttgggaataaaaggataaggtataaaaaaaatatcgggaaattccaggaagaggcaaatatctacgccgtgaagactgccgtatccgttacacagggcggacacagccggacatcttcacccacccctccatcttcagccggatctggtggatcttttaacttgagcggatcgggggatatgttccttggtatgcccggacttaatggcgacagttactcagccagtcaggtcgagagcttgcgccattcgatgggccctggtgggtatggggataacttaggtgggggtcagatgtactcgccccgagaaatgcgtgctaacggaagttggcaagaagctgtaacccctagctccgtcacgtcacctacagaggggcctggtagcgtgcacagcgacacatcgaattag

SEQ ID NO: 235909 - DNA, 1332 bp, Artificial Sequence
  Description of Artificial Sequence: Synthetic coding sequence
ggggcagagcagggcggaggactgcgcgcacccccacagctatggaccaacggctattggggaaggccactccaggcaggtgcgggaggtctggggcttgttagcggggagccaggaggtcctggtgaaccacctggtgggggtgatcccggaggaggaagcggcggagtccccggagggagagggaaacaggacatcggcgacatcctgcagcagatcatgactatcactgatcagtcgctcgacgaagctcaggccaagaagcatgccctgaattgtcataggatgaaaccagcattgttctcagtcctgtgtgagatcaaggagaagactggcctgagtatcaggtcttctcaggaagaggagcctgttgaccctcagctcatgagactggacaacatgcttcttgcagaaggagtggcgggacccgaaaagggtggtggctcagcagccgctgcagccgctgccgctgctagcgggggaggagtttctccggacaactcaatcgagcactccgattatagaagcaagcttgcacagatcagacacatttatcactccgagctggagaagtatgagcaggcatgcaacgagttcaccacacacgtaatgaacctgctaagagaacaaagtaggacccggcctgtggcccctaaggaaatggagcggatggtgtccatcatccatcggaagttttcggccatccagatgcagctgaaacagtccacgtgcgaggccgtaatgattttgcgcagtaggttcctcgatgcacgtcggaaaaggaggaatttcagtaagcaggccactgaggtgttgaacgagtatttctactcccacttgtcaaacccatatccctctgaagaggcaaaggaagaactcgctaaaaaatgcgggatcacagtgtctcaggtgagcaactggttcggtaataagcgcattcgctataagaaaaatatcggtaagttccaggaggaggcaaacatatacgctgttaagaccgccgtctctgtgacgcaggggggtcattcacggacttcctcacccacccctccgtcttctgccggaagcggcggatcttttaatctatctgggtccggggatatgttcttgggaatgcctggcttaaatggtgactcatattccgcctcacaggtcgaaagtctccgacattctatgggtccaggtgggtacggagataacctcggcggtggccaaatgtattcccccagggaaatgagggccaacgggagctggcaagaggcagtgacccccagttcggtcacctcaccaacagaagggcctgggagcgtgcactccgacacaagcaattag

SEQ ID NO: 235910 - DNA, 1056 bp, Artificial Sequence
  Description of Artificial Sequence: Synthetic coding sequence
atggatgaccaatctcggatgctccaaactctcgccggagtaaacttggcaggccacagtgttcagggcggaatggcactgcctccaccccctcacgggcacgaaggggcagatggtgacggcaggaagcaggatattggggacatcctgcaccaaatcatgacaataacagatcagtcactcgatgaggcacaggcaaaaaaacacgcgctgaattgccacaggatgaaaccagcactgttctctgtactctgcgagattaaggagaagactgggctttccattcgaggggctcaggaagaagaccctcccgacccgcaactgatgcgccttgacaacatgctgctggctgaaggggtcagcgggccagagaaaggcggaggctccgctgccgctgctgcggcagccgctgcgtccggaggatctagtgataattcaatcgagcacagcgactacagagctaagctaacccagatccgtcaaatctaccacactgaattggagaagtacgagcaggcctgtaacgagtttactactcacgtgatgaatctgctgcgcgagcagtccaggacacggcctatctctcctaaagagatcgagcgcatggtggggataatacacagaaagttcagttccattcagatgcagctgaagcagagtacctgtgaagccgtcatgatcctcagaagcaggtttctggacgccaggcggaaacggagaaatttttcaaaacaagccacagaaattctcaatgaatatttttactctcatctgtcaaatccatatccatcagaagaggcaaaagaagaattggccaagaagtgctctattacagtgtcccaagtcagtaactggtttgggaacaaaagaattcgttataagaaaaatattggaaagttccaggaggaagccaacctgtacgccgctaagactgctgttacagccgctcacgctgttgcagccgctgtgcaaaacaaccaaaccaattctcccaccactccgaactcaggaggctatcccccatcttgctaccagtctgatggtcggctgcagtag

SEQ ID NO: 235911 - DNA, 762 bp, Artificial Sequence
  Description of Artificial Sequence: Synthetic coding sequence
atgaacctgctgagggagcagtccaggacccgacccatcagccctaaggaaatagagcgcatggttgggattattcatcggaagttctcatctatccagatgcagctgaagcaatcaacctgcgaggccgttatgatcctccgttccaggtttctggatgccagaaggaaacggcgaaattttagcaaacaagccaccgaaatcctcaacgagtatttctactcccatctgtccaacccctaccccagtgaggaggcaaaagaggagcttgctaagaaatgttccatcaccgtgtcacaggtgagcaactggttcggcaataaaaggattcggtataagaaaaatataggcaagtttcaggaagaggcaaacttatatgctgcgaaaaccgctgttaccgcagcccacgccgtggctgccgcagttcagaacaaccaaacaaacagtcccacaacaccgaattccgggtcatccggctcattcaatctaccaaactctggtgatatgttcatgaatatgcagtcgctgaacggtgatagctatcaaggcagtcaggtgggtgctaatgtgcagtctcaggtggatacattgagacacgttatcaaccagactgggggttattctgacgggctaggaggcaactctctgtatagccctcataatctgaacgcaaatggcggatggcaagacgccacaacaccgtccagcgttacatccccaactgagggaccagggtcagtgcattccgatacaagtaactag

SEQ ID NO: 235912 - DNA, 1368 bp, Artificial Sequence
  Description of Artificial Sequence: Synthetic coding sequence
atggacgatcaatcgcgcatgctccagactctcgccggagtgaatttggcaggccactcagtgcaggggggtatggctcttccaccgccacctcacggccacgagggagccgatggcgatggccgaaagcaggatatcggggatatcctgcaccagattatgaccattactgatcagtccctcgacgaggctcaggccaagaagcatgccctcaactgccaccgcatgaaaccggcattgttctcagtcttgtgtgaaattaaggagaagacggggctgtccatcaggggcgctcaggaggaagatcccccagatccacaactgatgcgtttggataatatgctgcttgctgagggcgtctcaggccctgaaaaaggaggagggagtgctgcggctgctgccgctgctgccgcaagcggaggctcttctgataattccattgagcactctgattatcgggcaaagctgacccagatcagacaaatatatcacacagaactggaaaaatatgagcaggcctgcaatgagtttactacccatgtgatgaatctcctgcgcgagcagagcaggacgcgacctatttccccaaaggaaatagagaggatggtcggcatcattcacaggaagttctcctcaatccagatgcagctgaaacagtcgacatgtgaggcggtcatgattctgcgcagtaggtttttggacgctcgtaggaagaggcggaatttttctaaacaagcgaccgagattctgaacgagtacttctacagtcacttgtctaatccttacccctccgaagaggctaaggaagagctagccaaaaaatgctctattactgtcagtcaatcactggtcaaggatcccaaagagaggggcagtaagggatcggacatccagcctactagtgtggtgtctaattggttcggcaacaagaggattcgctacaagaaaaatatagggaagtttcaggaggaggcgaatctatacgcagctaagaccgccgttactgcagcacacgccgttgcggcagcggttcagaataaccaaactaactcaccaaccacaccaaactccggctcttccggatctttcaacttgccaaattccggggatatgttcatgaatatgcagtccctcaacggtgactcctatcaggggtcccaagtgggcgctaatgtccaatcccaggtggatacattgagacacgtgatcaaccagacaggtgggtactctgacggacttgggggaaacagtttatactctccccacaatctgaacgcaaatggaggttggcaggacgccaccaccccgagctctgtgacctcacctaccgaggggccagggtcagtacactcggatacaagcaattag

SEQ ID NO: 235913 - DNA, 1305 bp, Artificial Sequence
  Description of Artificial Sequence: Synthetic coding sequence
atggacgatcagagtcgcatgctgcaaacgttagccggagtaaacctcgctggccactctgtccagggagggatggctctccctccaccccctcatggtcatgagggcgctgacggggacggcaggaaacaggatattggcgacattctccaccagatcatgactatcaccgaccaatcacttgatgaagcccaagccaaaaaacatgccttgaattgtcatagaatgaagccggcattattctctgtcctctgcgagatcaaggagaagactggcctgagtatacgcggtgcccaggaagaggatcctcccgacccccagctcatgagactggacaacatgttgctcgctgagggcgtctccgggccagagaaaggcggtggctccgctgcagcggctgccgctgccgcagcttcaggcggatcttccgacaactctatcgaacactcagactacagggccaaactcacccagatcaggcaaatttaccataccgagctcgagaaatatgaacaggcatgcaacgaatttaccactcatgtcatgaatttgctcagggagcaaagccgcacacggccaatctcccctaaggaaatagaaaggatggtgggaattattcatcggaaattttctagcatccaaatgcagctgaaacagagtacctgcgaggcagtcatgattctacgttctagattcctggacgccagaaggaagagaagaaactttagcaagcaagccacagagattctgaatgagtacttttactcccatttgtcgaatccgtaccccagtgaagaagcgaaagaagagctcgcgaagaaatgctcaattaccgtgtcgcaggtgagcaattggtttggcaacaaacgcattagatacaagaagaatattgggaagttccaggaggaggccaatttgtacgccgcaaagacagccgtgacagcggctcatgccgtggcggctgcggtacagaacaatcaaaccaatagtccgactactcccaatagtggaagtagcggaagctttaacctccctaactctggcgatatgttcatgaatatgcaaagccttaacggggattcttaccaggggtcacaggtgggcgctaatgtgcaatcccaggttgatacattgaggcacgtgatcaatcaaactggcggttacagcgatggactcgggggaaattccctgtactcaccacacaacctgaatgcaaacggaggatggcaagatgccacaactcccagttcggtgacctcacctactgagggcccaggctccgtccacagtgacacctccaattag

SEQ ID NO: 235914 - DNA, 789 bp, Artificial Sequence
  Description of Artificial Sequence: Synthetic coding sequence
atgcggggactgagcatccgaggagcacaggaggaagatcctccagacccacagctcatgcgtcttgataatatgctcctggctgagggcgtctctggccctgagaaaggagggggttctgcggctgctgctgcggctgcagctgcttctgggggtagcagtgataattcgatcgaacactccgactacagagccaagctgactcagattcggcagatttatcataccgagctggaaaagtacgagcaggcctgtaatgaattcactacacatgttatgaatctgctgcgcgaacagtccaggaccaggcctatttcccctaaggagatcgaacgcatggtgggcatcattcaccggaagttctcatcaatccagatgcaactgaagcagagcacatgtgaggctgtgatgattttgcgtagcagattcttagatgccaggaggaaacgcaggaattttagcaaacaggctaccgaaatccttaatgaatatttctactcccacctttcaaatccttatcccagtgaggaggccaaggaagaattggctaaaaagtgctctattacagtgtcccaggtgagcaactggtttggaaacaaacgaatccgttacaaaaagaacatcgggaagttccaagaggaagctaacctgtatgcagcaaagacagctgtgactgccgctcacgcagttgctgcagcagtgcagaataaccagaccaactcgcctactacacctaattctggcggatatccaccttcatgttatcagtccgacggcaggctccagtag

SEQ ID NO: 235915 - DNA, 1080 bp, Artificial Sequence
  Description of Artificial Sequence: Synthetic coding sequence
atgaaacctgcgctgttttcggtgctgtgtgaaattaaagagaaaacggggttatcaatcagaggggctcaagaagaggacccacccgacccacaactgatgcgcctcgacaacatgctcttggccgagggagtctccggcccagagaaaggcggtggttcagccgcagccgctgcagccgctgccgctagcgggggttcatcagacaactctattgagcatagcgactaccgcgctaaactcacacaaattaggcaaatctatcacactgagcttgaaaaatatgagcaggcgtgcaacgagtttacaactcatgtcatgaaccttttaagggagcaatctcgcaccagacccatttcccccaaggaaatcgagcggatggtcggaattatccacagaaagtttagtagtattcaaatgcagctcaagcaatccacctgtgaggccgtgatgattctgagatcgcgctttttggacgcgaggcgtaaacgacggaatttcagcaaacaggctaccgagatactcaatgaatatttctactcacacctgagcaatccctacccctccgaagaggctaaggaagagctcgcaaagaaatgttccataactgtgtcacaagtcagcaattggttcggaaacaaacgaatcaggtacaagaaaaatattgggaaattccaggaggaggccaacctgtacgcagcaaagacggctgttaccgccgcacacgcagtggcagccgctgtacagaacaatcagaccaattcgcccaccactcctaattccggttcatctgggtcgtttaatctccctaattcaggagatatgtttatgaatatgcagtctttaaatggggattcctaccagggatcccaggtgggggcaaacgtccagtcacaggtcgatactcttcggcacgtcatcaaccaaacggggggatatagtgatgggttgggcggaaatagcctgtactctccccacaatctgaatgccaacggcggatggcaagacgccacaaccccttccagcgtgacatccccgactgaaggaccaggttctgtccactcagatacttctaactag

SEQ ID NO: 235916 - DNA, 1530 bp, Artificial Sequence
  Description of Artificial Sequence: Synthetic coding sequence
atggagcggagaagactgtggggcagcatccaatcccgctacattagcatgtcagtgtggactagcccaagacgtctcgtcgagcttgctggacagagcttattgaaggacgaggctcttgcgatcgctgcactcgagctgttgccacgcgaactgttccctcctctatttatggccgcattcgacgggagacactcacagactctaaaggccatggtacaggcctggcccttcacatgcctccctctgggagtcctgatgaagggccaacacttacatctagaaactttcaaggccgtcctagacggcctagatgtcctcctggcccaggaagttcgacctcggagatggaagttgcaggtcctggatcttcgaaaaaacagtcaccaagacttctggacggtctggtctgggaaccgggctagcttgtacagttttccggaaccagaggcggctcagcctatgactaaaaaacgcaaagtggatggtctgtccaccgaggccgagcagcccttcatacctgtggaagtccttgtggacctgttcctgaaagagggggcttgtgatgaattattttcatatctgattgagaaagtcaaaagaaagaagaacgtccttcgattgtgttgcaaaaagctgaagatattcgcaatgccgatgcaggacatcaagatgatcctcaagatggtccagctcgattcgattgaggacctcgaagtcacctgtacatggaagctgccaacactggccaagttttctccttatctcggtcaaatgataaacctccgtaggctattgctgtcacatatccacgcttcctcctacatcagtccggaaaaagaggagcagtacatcgcccagtttacctcacaatttctcagtctccagtgtttgcaggcactgtatgtcgatagcttatttttcctgcggggaaggctcgatcaattactgaggcacgtgatgaaccccttagagacactgagcataacaaactgcaggcttagcgagggagatgtcatgcacctatcccagagtccgtccgtttctcagttgtccgtgcttagcctgtctggggtaatgttgactgatgtatcacctgagccactccaggctcttctagagagggcgtccgctaccctacaggatctcgtcttcgatgagtgtggcattaccgacgaccaactgctcgccctgctgccaagcctttcccattgtagccagctaacaactctaagtttctacggaaacagtatatctatctccgctcttcagagtcttctgcaacatctgattggccttagcaatttaacccacgtcttgtaccctgtgcctctagaatcctacgaggatatccacggtacgctgcacctcgagagactagcctatcttcatgcacggcttagagagcttctttgtgaattaggtcgcccttctatggtttggttgtccgcgaacccatgcccacattgtggcgatcgcacattctacgaccccgaacctattctgtgcccctgttttatgcccaactag

SEQ ID NO: 235917 - DNA, 1530 bp, Artificial Sequence
  Description of Artificial Sequence: Synthetic coding sequence
atggagcgtcgtagattatgggggtccattcagagcaggtatattagtatgtcagtctggacatcccctagaagactcgttgagctggccggacagtcgctgctaaaggacgaagccctcgccatcgccgctcttgagctgttgccaagggaactctttccccctctgttcatggccgcatttgatgggaggcactcgcaaaccctgaaggccatggttcaagcttggccatttacgtgtttaccactaggagtgctgatgaaggggcaacatttgcatcttgaaacgttcaaagctgtactggatggcctggacgttctgctggcgcaggaagtgagacctagacgatggaaactgcaagtcctggacctccgaaagaattcccaccaggacttctggaccgtgtggtccggtaaccgtgctagcctgtatagttttcctgagcccgaggccgcacagcctatgaccaagaaacgcaaggtggacgggctgtctactgaagcagagcagccctttattcctgtcgaagtgctggtcgatctttttctgaaagagggtgcctgtgacgaactgttctcctacttaatcgagaaggtcaagaggaagaagaacgtcttgagactctgctgtaagaaactgaaaatctttgcaatgccaatgcaggatatcaaaatgatcctcaagatggtccaactggactccatagaggacctcgaggtgacctgcacttggaaactccctaccctggcgaaattttcgccctacctgggccagatgatcaacctgcggaggctgttgctgagccacattcatgcatcttcatacatctctccggaaaaagaggagcagtacatagcgcaattcacttcccagttcttatctttgcagtgccttcaggctctgtacgtggatagcttgtttttccttagaggtcgactcgaccaactgctacgtcacgtcatgaatccgctggagaccctcagtatcaccaactgccgactcagcgaaggcgacgtgatgcacctcagtcaatcacctagtgtaagccaactcagtgtgctctcattgtctggtgtgatgctgacggatgtgagtccggagcctctgcaggccttgcttgagcgagctagcgccacattgcaggatttagttttcgacgagtgtgggattactgacgatcagctgcttgccttgctgcccagcctgagtcattgttcccaacttaccaccctgagcttctatggcaatagtatcagcatctctgccctgcagagccttcttcagcaccttatcgggctttcgaacctcacccatgtgctctaccccgtgcccctggaatcttacgaggacatccacgggacacttcatcttgagaggctggcgtatctgcatgccagacttcgtgagcttctatgcgaactcggacggccatccatggtatggctttccgctaacccatgtccccattgcggcgatagaaccttctacgaccccgaacccattttgtgtccttgctttatgcccaactag

SEQ ID NO: 235918 - DNA, 1530 bp, Artificial Sequence
  Description of Artificial Sequence: Synthetic coding sequence
atggagagacgtagactgtggggaagtattcagtccagatacatcagtatgtcagtatggaccagcccacgccgtctagtcgagctggccggacagagtctgctcaaggatgaggctcttgctatagcggcactcgagctcctgccccgagaactctttccccctttgttcatggcggctttcgacggtaggcattctcagacgctgaaagccatggtgcaagcctggcctttcacgtgcctgcctttaggggtacttatgaaaggacagcacctgcacctagaaactttcaaggccgtcctcgacgggctggatgtgctcctggcccaggaggtgaggcctaggagatggaaacttcaggttctggacctgcggaagaacagccatcaggatttctggacagtttggtctggcaatagggcctcgctttatagctttcctgagccagaagctgctcagcccatgacgaaaaagaggaaggtggacgggctgtctactgaggccgagcagccattcataccagtggaagttctggttgacttgtttttgaaggagggcgcatgcgacgagctcttttcttatctgattgagaaggttaagcgcaaaaaaaatgtgctgcgtctctgctgcaaaaagctcaaaatattcgcaatgccgatgcaggacatcaaaatgatccttaagatggttcagctggattctatagaagatctcgaagttacctgcacgtggaagctcccaacccttgctaaattttctccatatctcggacagatgatcaatcttagacgactgctcctgtcccacatccacgcctcgagctacatatcgccagaaaaagaggagcagtacatcgcacagtttactagccagtttctcagcctgcagtgcctccaagcactatacgtggactctctctttttcctccggggaaggctggaccagctgttgcggcacgtgatgaatcctctagaaacattatccatcacgaattgccggctctctgagggcgacgtcatgcacctgtcacaatccccatctgtgtcacagctctcagtgctcagtttaagcggggtgatgttgaccgacgtgtccccagaacccctgcaggccctactggagcgagcttctgccacactccaagacctggtgttcgacgagtgcggcattacagacgaccagctacttgctttactacctagcctgtcgcactgctcgcagctgactactctctctttctatggcaatagcatcagcatatccgcgctccaaagtctgttgcagcatcttatcgggctcagcaatctaactcacgtactgtaccctgtgccactggaaagctacgaggatatccatggcacacttcacctcgaaagactcgcatacctgcatgctcggctgcgagagttgttgtgtgaactggggagaccatcaatggtttggctgagtgcaaatccatgcccccactgcggggacagaaccttctacgatccagaacctatcctctgtccctgcttcatgcccaattag

SEQ ID NO: 235919 - DNA, 261 bp, Artificial Sequence
  Description of Artificial Sequence: Synthetic coding sequence
atggagcgtcgcaggttgtggggctccatccagagcaggtatataagcatgtccgtgtggacgtcccctcgccgattggtggagttggccggtcagtccctattaaaagatgaggctctggcaatcgcagctctcgaactcctgcctcgcgagctcttccctccactcttcatggcagcattcgacggtagacattctcagacactgaaagccatggtgcaagcatggccttttacttgtctgccactgggagtgctgtag

SEQ ID NO: 235920 - DNA, 1530 bp, Artificial Sequence
  Description of Artificial Sequence: Synthetic coding sequence
atggagaggaggcgcctgtgggggtccatccagagcaggtatatctcaatgtccgtttggaccagtcctagacggctcgtcgaattggcaggccagagtcttctgaaggatgaagcccttgctatagccgcactggagttgctgcccagggaactattcccccctctttttatggccgcatttgacgggagacattcccagaccctgaaagcaatggttcaggcttggccattcacatgcttgcctctcggggttctgatgaaggggcagcacctccatcttgagaccttcaaagccgtccttgacggcctagacgtgctgcttgcccaggaggtgagacccagacgctggaagctgcaagtgctagaccttagaaaaaatagtcaccaggacttttggacagtgtggagtggcaacagggcctctttatacagctttcctgaaccagaagccgctcagcctatgaccaaaaaaagaaaggtggacggcctatcaactgaagccgaacagccgtttattccagtcgaggtgttggtcgacctatttttgaaggaaggagcatgcgacgaactttttagctacctcatcgagaaggtgaaacgtaagaagaatgtgcttcggctttgttgcaagaagttaaaaatctttgccatgccgatgcaagacataaagatgattctgaagatggtccagctcgattccatcgaagacctggaggtcacatgtacctggaaattacctaccttagccaagtttagcccgtacctcggccagatgataaatttgcggagactactgctgtctcacatccacgccagctcatatatctccccggagaaggaggagcaatacatcgctcagtttaccagtcaatttttgtccctgcagtgtctgcaggccttgtacgtcgactccctctttttccttagaggacgcttggaccagctgctgcgccatgttatgaacccgctggagaccctgagcatcaccaattgtcggctcagcgagggcgacgtgatgcacctgagtcagagtcccagtgtctcacagctgtctgtattgtcactctctggtgtgatgctgacagacgtatcccccgagcccctccaggccctgcttgagagggcctctgctactctgcaggatcttgtgtttgacgagtgtggcatcacagatgatcagctcctcgcgcttctgcctagcctctctcactgcagccaactaacgacactctctttctatggaaactctatttctatctccgcactccagtccctgctccagcacctcatagggctctccaacctgacacatgtgctgtaccccgtgccattagagtcctacgaggacattcacggtaccctgcatctggagcggctggcgtatctacatgctagactgagagaactgctatgtgagctgggacgccctagcatggtgtggctgtcagcaaacccctgcccccattgcggagaccggactttttacgatcctgagccaattctgtgcccgtgcttcatgcctaattag

SEQ ID NO: 235921 - DNA, 348 bp, Artificial Sequence
  Description of Artificial Sequence: Synthetic coding sequence
atggaacggagacggctgtgggggtcaattcaatctaggtatatctccatgtccgtgtggacatcaccccgaagattggtcgagctggcgggtcagagtctgctgaaggacgaggcactggctatagccgcattagaactgctcccacgggagctgttccctcccctctttatggctgccttcgacgggaggcatagccaaacacttaaagcaatggttcaagcttggcccttcacgtgcctgccattaggggttctgatgaagggccaacatctacacttagagacctttaaggccgtcctcgatgggctcgacgtgcttctggctcaggaagttagaccgagatag

SEQ ID NO: 235922 - DNA, 459 bp, Artificial Sequence
  Description of Artificial Sequence: Synthetic coding sequence
atggaacggcgacggctctggggctctattcagagtaggtatatttcaatgtccgtttggacgtcccctaggcggctggtggagctcgctgggcaatctttactgaaggatgaggccctggcaattgctgcactggagctcctgcctagagaactgttcccccctttgttcatggccgcttttgatggccgtcattctcagacacttaaagctatggttcaggcttggccgttcacctgccttccgcttggggtgttaatgaagggacaacatttacatctggagacatttaaagccgtgctggacggacttgatgtgctgctggcccaggaggtgcgacctcggcgttggaagctacaggtgctcgacctccgtaagaattcacaccaggatttttggaccgtttggtctgggaatcgcgctagtctgtattctttccctgaaccagaggccgcatag

SEQ ID NO: 235923 - DNA, 1482 bp, Artificial Sequence
  Description of Artificial Sequence: Synthetic coding sequence
atgagtgtttggacatcccctcgcagacttgtggagctcgccggacaaagcctgctcaaggatgaggccttggccatcgccgcactggagttgctcccccgtgagctatttccacctctcttcatggctgctttcgacggcagacactctcagacacttaaagccatggtccaagcctggccatttacttgtttgcctctgggtgttctgatgaaggggcagcatctccacctagagacctttaaggccgtcctggatggattggacgtgcttctggcccaggaagtgaggcccagacggtggaagctgcaagtcctggatctgaggaagaatagtcaccaggatttttggaccgtatggtcaggtaacagggcctccctgtattcgtttccagaaccagaggctgcacagccgatgactaagaaacgtaaagtcgatggcctttccactgaagctgagcagccctttatacctgtcgaggtactggtggatctttttttgaaagaaggagcctgcgacgaacttttcagttatctgattgagaaggtgaaacgtaagaagaacgtgctgcgactgtgttgcaagaagctgaagattttcgcaatgcctatgcaggatatcaagatgatcctcaagatggtccagcttgacagcatcgaagacctagaagttacctgtacctggaaactccctaccctggccaaattctccccttatctgggacagatgattaatctccgtcgtctgctgctgagccatatccacgcatcctcttacatctcaccagagaaagaggagcagtacattgcacagttcacttcgcagttcctgtccctccaatgcttacaggcgctgtacgtggatagtctgtttttcttgcgaggcagactggaccagctcctgcggcacgtgatgaatcccctggagaccctatctatcacgaactgtagactaagtgagggcgatgtgatgcatttgtctcagagcccttccgtttctcagcttagtgtacttagcttgagtggcgttatgcttacggacgtgagcccagagccactccaggcacttttggaaagggccagtgccaccctgcaggacttggtgttcgatgagtgtggaattactgacgatcagctgttggctctgctcccgagcttgtcccactgtagccagctgacgaccttgagtttttatggcaactccatcagcatttccgccctacaaagcctcctgcagcacctcatcggcctatctaatctgactcatgtgttgtaccccgtgcctctcgaaagttatgaggacatacacggcactctacacctggaaagactagcttacttgcacgcgcgtcttcgggaattgctgtgcgaactgggccgaccctccatggtgtggctttccgcaaacccttgtcctcactgtggagacaggaccttttacgacccggagcctattctctgcccctgtttcatgccaaattag

SEQ ID NO: 235924 - DNA, 606 bp, Artificial Sequence
  Description of Artificial Sequence: Synthetic coding sequence
atggaaagaaggcgcctctgggggtccattcagtcccgttacattagtatgtccgtttggacaagcccacgcagattggtggagctggccggacagagcctgttgaaggatgaggccctagcaatcgctgccctggaacttctgccacgtgaactgttcccccctttatttatggcagcttttgatggaaggcattcccagactcttaaggcaatggtgcaagcttggccctttacatgccttcccctcggcgttttgatgaaaggacagcacctgcatctcgaaaccttcaaggcagtgctggatggcctggatgtgttgttagcacaggaggtgcgccctaggagatggaagctccaggtgctggacttgagaaagaattcacatcaagatttctggaccgtgtggtccggcaacagggcatctttatactctttcccagagccggaagctgctcagccgatgactaaaaagcgcaaagtcgacggccttagtacagaggccgaacagccatttattcccgtcgaagtgctggtggatctctttctaaaggagggtgcttgcgacgaactgttttcttatctcatcgaaaaagttaagcggtag

SEQ ID NO: 235925 - DNA, 1482 bp, Artificial Sequence
  Description of Artificial Sequence: Synthetic coding sequence
atgagtgtttggaccagtccacggaggctggttgaattggcgggacaaagcctcctgaaagacgaagccctcgccatagccgctctcgaactgctacctcgagaactctttccacccctttttatggctgcctttgacggcaggcacagccagacgctgaaagcaatggttcaggcatggcccttcacgtgccttcctcttggggtactgatgaagggccaacatctgcacctagagacatttaaagcagtcctggatggacttgacgtgctactcgcccaggaagtccgtccacgacgatggaagcttcaggttctggatctgcgcaaaaactcccaccaggacttctggaccgtttggtcaggaaacagggcatcgttgtatagttttcctgaacccgaggccgctcagcctatgacgaagaagagaaaagttgatggcctatcgactgaagcggagcagcccttcatcccagtagaagtgctcgtcgatctgtttcttaaagagggcgcttgtgatgaactgttcagctacctcatcgagaaagttaaaaggaagaaaaatgttctacgcctctgttgcaagaagcttaagatcttcgcgatgccaatgcaggacattaaaatgattttaaaaatggtgcagctggacagcatcgaagatctggaagttacttgtacatggaaattaccgactctcgccaagttctccccctatctgggccagatgatcaatctgagacgactgctgctctcgcacatccatgcttcttcgtatatcagtcctgagaaggaggaacagtacatagcgcaattcacatcccagttcctgtctttgcagtgccttcaggctctatatgtggacagcctgttcttcctgcgagggaggctcgaccagttactgagacacgtgatgaaccctctggagacactctcaattaccaactgtaggttaagcgagggcgacgtgatgcacctgtctcaatcaccgtcggtatcccagctaagcgtcctgtccctgtccggtgtgatgttgactgacgtatccccggaacccctacaggcacttttggaaagggcctccgccactttgcaagacttggtgttcgacgagtgtggcatcacggacgatcaactgcttgcgcttctgccaagcctgtcacactgctctcagttaaccacattaagtttttacggaaactcgatctctatcagtgccctgcagagtctgttgcagcacctcatcgggcttagcaatctgactcacgtgctgtacccagtcccacttgaatcttacgaggacattcacggtaccctgcacctggagcgattggcttatttgcatgctcgcttgagagagctgctctgtgagctggggaggccttcaatggtatggctctctgctaatccctgcccccactgcggtgacagaactttctacgaccctgaaccgatcctgtgtccttgcttcatgcccaattag

SEQ ID NO: 235926 - DNA, 1530 bp, Artificial Sequence
  Description of Artificial Sequence: Synthetic coding sequence
atggagcgaaggagactctggggatcgatacagagccgctacatttccatgtcagtgtggacctcaccccgaagacttgtggagttggccggtcaatccctattgaaagatgaggcacttgcaattgcagcactagagttgcttcctcgcgaactgtttccccctctgttcatggccgcttttgatggccgtcacagtcaaaccttaaaggccatggtccaggcgtggccgtttacttgcctcccgctgggagtgctgatgaaaggacagcatctgcatctcgagacattcaaggccgttctcgatggacttgatgtgctactagcgcaggaagttagacccaggcgatggaagctgcaggttctggatcttagaaagaattctcatcaggacttttggaccgtttggagtggaaaccgtgcaagcctttatagctttcctgagccagaagccgcacagccgatgacaaaaaagaggaaggtcgatggactgagtacagaggctgaacagcccttcataccagtggaagtactggtcgatctgttccttaaggaaggagcctgtgacgagctcttttcttacttaatcgagaaggtcaaaaggaagaagaacgtcctgcgtttatgctgcaagaagctcaagatattcgccatgcctatgcaggatattaagatgatcctgaaaatggttcagcttgacagcatcgaagacttggaggtaacctgtacctggaaacttcctacgctagccaaattctccccctacctgggccagatgatcaatctgcggcgactgctgttaagccacattcatgcttcatcttacatcagtcctgaaaaggaggaacaatacatagctcagttcacttctcagttcttaagcctacagtgtttgcaagcactttacgttgattccctcttctttctgcggggacgtcttgaccagcttctccgccatgtaatgaatcccctggaaaccctctccatcacgaactgcagattgtccgagggagacgtgatgcacctgtcgcagagtccatccgtgtcccagctgtcagtgcttagtctaagtggtgtgatgctcacagatgtaagcccagaaccacttcaggcactgcttgaaagagcatccgccactttgcaggacctggtctttgatgaatgtggcataactgatgaccagcttctcgcccttctgccttctctttcccactgcagccagctgacaaccctgagcttttacggtaattctatctcaatctctgcgctccaaagcctcttacagcacctaatcgggctctccaatctgacacacgtgctgtaccccgtgcctctcgagagctatgaggacattcacggcaccttgcatttggagcgcctagcttatctccacgctagactacgtgagctgctctgcgaattgggcagaccatcaatggtatggctgtcagcgaacccttgcccccactgtggcgataggacattttacgaccccgagcctatcttatgcccctgcttcatgccaaactag

SEQ ID NO: 235927 - DNA, 369 bp, Artificial Sequence
  Description of Artificial Sequence: Synthetic coding sequence
atggctgccccagtcgacctggagcttaaaaaggccttcaccgagttacaggccaaagtaattgacacacagcaaaaagtcaaactagccgatatacaaattgaacagctgaatcggactaagaaacacgctcacctgactgatacagagattatgacccttgtagacgagactaacatgtatgagggcgtaggccgaatgtttatcctacagtctaaagaggccattcattcacagctcttggaaaagcagaagatagccgaggagaagattaaagaacttgagcagaagaagagctatctggagcggagtgtgaaagaagccgaagataacattcgggagatgttgatggccaggcgcgctcagtag

SEQ ID NO: 235928 - DNA, 465 bp, Artificial Sequence
  Description of Artificial Sequence: Synthetic coding sequence
atggccgaaaattccggtcgggcagggaagtcctcaggttcaggagccggtaagggagccgtttccgctgagcaagtgattgctggattcaaccggctgcgtcaggagcagagaggcctggcttccaaggccgctgaactggaaatggagctcaatgagcactcactggttatagatactcttaaggaagtggatgaaacaaggaagtgctatcgcatggtgggaggggttctcgtggagcggactgtgaaggaggtgctgcccgcactggagaataacaaggagcaaatccagaagattattgagaccttaactcaacagctacaggccaagggcaaagagctcaatgagttccgcgagaagcacaacatcaggctcatgggggaggatgaaaagcctgccgcaaaggagaactccgaaggcgcaggagcaaaggcctctagcgccggagtgttggtttcttag

SEQ ID NO: 235929 - DNA, 405 bp, Artificial Sequence
  Description of Artificial Sequence: Synthetic coding sequence
atggccgctaccatgaagaaggccgctgctgaagatgtgaacgttacgttcgaagaccagcaaaagatcaacaagttcgcaagaaatacctcccgtatcaccgaactgaaggaagagatagaagtcaagaagaaacaactgcagaacctcgaggacgcatgcgacgacataatgctggccgacgacgactgtctgatgatcccctaccagataggagacgtgttcataagtcactctcaagaggagacacaagagatgctggaggaagccaagaaaaacctccaggaggaaatcgacgccttggagtcccgagttgaatcaattcaaagagtgttagctgatctgaaagttcagctttatgcaaagttcggctccaatattaacctagaagccgacgaaagctag

SEQ ID NO: 235930 - DNA, 465 bp, Artificial Sequence
  Description of Artificial Sequence: Synthetic coding sequence
atggcacaaagcatcaatattacggagctgaacctgcctcagcttgaaatgctgaagaaccagcttgatcaggaggtggagttcctcagtacatctatcgcgcagctaaaagtcgtccagacgaagtacgttgaggcgaaggactgtctcaacgtcttgaataagtctaacgaaggaaaagagctgctggtgccacttacctcttcaatgtatgttcccggaaagctccacgatgtggagcacgttctgatcgatgtaggcaccggttattacgtggagaagacagccgaagatgcaaaggacttctttaaacgcaagatcgattttctcaccaagcagatggaaaagatccagcccgctttacaggagaagcacgccatgaagcaggcggttatggaaatgatgagccagaaaattcagcagttaacggccttgggtgcagcccaagccacagccaaggcctag

SEQ ID NO: 235931 - DNA, 330 bp, Artificial Sequence
  Description of Artificial Sequence: Synthetic coding sequence
atggctcaaagcatcaatattactgagctcaacctgcctcagcttgaaatgctgaagaatcagctcgaccagatgtacgtgccaggaaagctgcacgacgtggagcacgtgctaatcgatgtgggtacggggtactatgtggagaaaacggccgaggatgcaaaggactttttcaagcgaaaaattgacttcctgaccaagcaaatggagaaaattcagcctgcactccaggaaaaacatgctatgaagcaggctgttatggagatgatgtcccaaaagatacagcaactgacagctttgggcgctgctcaggcaactgccaaagcctag

SEQ ID NO: 235932 - DNA, 465 bp, Artificial Sequence
  Description of Artificial Sequence: Synthetic coding sequence
atggcccagagcatcaatatcaccgagcttaatctaccacagttggaaatgctgaagaaccagttagatcaggaggtcgagtttctctccaccagtatcgcccagctgaaagtagtacaaacgaaatatgttgaggctaaagactgtctgaatgtgctgaacaagagcaatgagggcaaagagctgctggtgccgttgacttcgtccatgtacgttcccggaaagctgcacgatgtcgaacacgttctaattgatgtgggaactgggtattacgtggaaaaaaccgctgaggacgccaaggatttttttaaaagaaaaattgactttctgactaagcagatggagaaaatccaacccgctcttcaggagaagcacgccatgaaacaggcagtgatggaaatgatgtctcaaaaaattcaacagctcactgctctgggtgccgcacaggctacagccaaggcgtag

SEQ ID NO: 235933 - DNA, 1281 bp, Artificial Sequence
  Description of Artificial Sequence: Synthetic coding sequence
atgggaacactgtcagccccaccatgtacacaacggattaaatggaagggtctgctgctgacggcttctttactgaacttctggaatttgcctacgactgcacaggtgaccattgaagcggagcccacaaaagtatccgaggggaaggacgttcttcttttggttcataatctcccccagaacctcaccggatacatttggtataaagggcagatgagggatctctaccactatatcaccagttatgtggtcgacggtgaaataatcatttacggtcccgcatacagtggtcgcgagactgcatactcaaacgcatctttactgatccagaacgttacgcgggaggacgccggttcctacacactgcacattatcaagggcgacgacggcacacggggtgtcaccggccgttttacatttactttgcatctagagaccccaaagccttcaatctcctcttccaacctgaaccccagagagacaatggaggccgtgtccctgacatgtgacccagagacgcctgacgcaagctacctttggtggatgaatggacagtctctgcctatgacccattcgcttaagctttctgagacaaatcggacgctgttcctcctgggggtcacaaagtatacagccggtccctacgagtgtgagatacgtaaccctgtgtccgctagccgatctgatcccgtgaccttgaatctgctgcccaaactccctaagccctatatcactatcaacaaccttaatccgcgtgaaaacaaagatgtgctaaatttcacctgtgagcccaaaagcgagaattacacttacatctggtggctcaatggccagagcctgccggtgtctccccgtgtcaagcggcctatcgaaaatcggatactgatcctccccagcgttacccgcaatgaaactgggccttatcaatgcgagataagagataggtatgggggtataaggtcagatccagtgacattgaatgttctgtacgggccagacctcccccgtatttatccatcgtttacttactatcgctcaggggaggtgctgtatctttcttgttccgcggacagcaacccccctgcccagtactcttggaccattaacgagaagttccagctgcccggacagaagctgttcatcagacatataacaaccaaacactcaggcctctatgtgtgcagtgtcagaaattccgcaacaggcaaggagtcaagcaagagcatgaccgtcgaagtctcaggaaaatggattcccgcatctttggccataggcttctag

SEQ ID NO: 235934 - DNA, 432 bp, Artificial Sequence
  Description of Artificial Sequence: Synthetic coding sequence
atggggaccctctccgcaccgccttgtacccagcggatcaagtggaagggattactattgactgcctccttgttaaatttctggaatctgcccaccaccgcgcaggtcacgatcgaagccgagccaaccaaagtctccgagggcaaggatgtcttattactggttcacaacctaccccagaatctgactgggtatatctggtacaaagggcagatgcgggatctctaccattacatcacgtcctacgtggttgacggcgagatcattatctatggaccggcatactccggcagagaaaccgcgtactctaatgcaagcctcctgatccagaacgtgacacgggaagatgcaggatcatacacccttcacatcattaagggcgacgatggtactcggggtgtaaccggcaggtttactttcaccctgcactag

SEQ ID NO: 235935 - DNA, 1287 bp, Artificial Sequence
  Description of Artificial Sequence: Synthetic coding sequence
atgggtaccctctcggccccaccctgcactcagcgaattaaatggaaggggctcctacttactgcatctctgctgaatttctggaacctgcccacgacagcccaggtgactattgaagccgaacctactaaagtgtctgagggcaaagacgtgctgctgcttgttcacaacctgccacagaacctgactggttacatatggtataaggggcagatgagagacctgtatcactatattacatcctacgtagtagacggggaaatcattatctacggcccagcttactcaggtcgcgagaccgcctatagcaacgcctctctgctcatacagaacgtaacacgcgaagacgctgggtcttacacgctccatatcatcaagggcgatgatggtacccgcggtgttaccggacggttcacattcaccttgcacctagagacgcccaagccttctatatcttcgagcaatctcaatcccagggagacaatggaggccgtcagcctgacatgtgacccggaaacccctgatgcatcctacctctggtggatgaacggacagtctctgcctatgactcactccctgaagctgtcggagacaaatcgcaccctattcttactgggagtgaccaaatatacagctgggccttatgagtgcgaaatcaggaacccggtgagcgcttccagatccgatcctgtaactcttaatctcttacccaagctcccgaaaccctacatcactataaataacctgaacccaagagaaaacaaggacgtgctcaattttacgtgcgagcccaagagcgaaaactacacctatatttggtggctaaacggacagagcttacctgtttccccgagggtgaaaaggccaatagaaaacaggattctgattctgccaagtgtgaccaggaatgaaacaggcccatatcagtgtgagatcagagacagatatggagggataaggagcgacccagtcacgttgaatgtactatacggcccagacctgcccaggatctacccttccttcacgtattatcgatccggcgaggttctgtatttgagctgctcggccgactccaatcctcctgcacagtactcctggacaataaacgagaaattccagctccctggacagaaactttttattaggcacatcaccaccaaacattctggtctttacgtttgtagtgtgaggaattccgcaactgggaaggaatcttccaaaagcatgacagtcgaagtctcggcctatagcagcagcattaactacacaagcggaaaccgcaattag

SEQ ID NO: 235936 - DNA, 1260 bp, Artificial Sequence
  Description of Artificial Sequence: Synthetic coding sequence
atggggacactcagcgcacccccttgtacacagaggattaaatggaagggactactgcttacagcctcactgctcaatttctggaacttgcctacaacggcccaggtaacaatcgaggcagagcccactaaggtgtctgaaggaaaggacgtgctgttgcttgtgcacaacttgccgcaaaacttgacagggtacatctggtataaagggcagatgagagacctgtatcattacataacatcctatgtggttgacggggaaattattatctatggccctgcttacagtggtagggaaacagcgtacagcaatgcatcgctgctgattcagaatgttaccagggaggacgccggatcatatacattgcatatcatcaaaggagatgacgggaccaggggtgttacagggcgatttacatttaccctgcacctcgagacccccaagccatcaattagttcctctaatctgaatcctcgggagaccatggaagctgtctcactgacgtgcgacccagagacccctgacgcgtcatacctgtggtggatgaatggccaaagtttgccaatgacccacagccttaagctgagtgagactaatcgcaccttattcctcctaggggtgacgaagtacacagccggaccctatgaatgcgagatccgcaatcccgtgtcggccagtcgctctgaccccgtgactctgaatcttctgccgaagttgcccaaaccttatataacaataaataatcttaatcccagggaaaataaagacgtgctcaatttcacctgtgaaccaaagtctgagaattacacgtatatctggtggttgaatggtcagtcgcttcccgtgagccccagggtcaagcgtccaatcgagaatcgcatcctcatattgccgtctgtcacccggaatgaaacaggcccatatcagtgcgagatccgggatcgctacggcggaatacggagtgaccccgttacattgaacgtgctgtatggcccagatttgcctaggatctacccttccttcacatactacagaagtggcgaggtgctttaccttagctgctctgccgactctaatcccccagcccagtattcttggacgatcaacgagaaattccagctgcccggacagaaactctttatcaggcacatcaccactaagcacagtggcctctacgtctgcagcgttcgcaattctgctaccgggaaagagtcgtccaagtctatgacggtggaggtctccgactggacagtcccgtag

SEQ ID NO: 235937 - DNA, 1254 bp, Artificial Sequence
  Description of Artificial Sequence: Synthetic coding sequence
atggggaccctatccgcacctccatgcacccagaggatcaagtggaaaggcctgctgcttaccgcctcacttttaaatttctggaatctcccaaccactgctcaggttactattgaagctgagccaactaaagtaagcgaaggaaaggacgtgctgttacttgttcataacctgccccagaacctgaccgggtatatctggtataagggccagatgcgcgatttgtaccactacatcactagctatgtcgtggacggcgaaatcatcatctacggccctgcctactctggcagagagaccgcctattctaatgccagccttctcatacagaatgtgaccagggaagacgccggatcgtacaccctccacatcattaagggagacgacggcactcgcggagtgacaggccgatttacttttacattacacctggagacgcctaagccatccattagttctagcaatcttaacccgagagaaactatggaggcagtctctctgacctgtgatccagaaacccctgacgccagctatttatggtggatgaacggtcagagccttcctatgactcactcactgaaattgtcagagacgaatcggactctgtttctgctcggtgtgaccaagtacacagctgggccttacgagtgcgagattcgaaatccagtatcagcttcccgatctgatccagtaacgcttaacctgctgcctaagctccctaagccctatatcacaatcaataacctgaaccccagggagaacaaggacgtactgaattttacttgcgagcccaagtccgagaattacacatacatttggtggctaaacggccaaagtctgcccgtctcccctcgggtgaagcgccctatcgagaacaggattctgatccttcctagcgtgactcgcaacgagaccggcccttatcagtgcgagattcgagacaggtatggcggaattcggtccgacccggtgaccctaaacgttttatacggcccagatctgccccgaatttaccctagctttacttactatcggagcggagaagtgctctatctgtcttgcagcgccgattccaatcctcctgcacagtactcctggacgattaacgagaagttccagctccctggccagaagttgtttattcggcatatcaccactaaacactctgggctgtacgtatgctctgtgaggaattctgccacgggtaaagagagctccaagtctatgactgttgaagtcagcgaggcactgtag

SEQ ID NO: 235938 - DNA, 642 bp, Artificial Sequence
  Description of Artificial Sequence: Synthetic coding sequence
atgggccctttatcagctccaccttgcacagagcatatcaagtggaaggggttactgcttactgttgagactcctaaaccttccatatcatcctctaacctcaaccctcgcgaggcaatggaaacagtgattcttacctgcaaccccgagaccccagacgcatcttatctctggtggatgaacggccagtctctgcccatgacgcatcggatgcagctcagcgaaactaaccgaaccctctttctgttcggagtaacaaagtacactgccggaccgtatgaatgcgagatctggaatagcgggagtgcttcacgatcagatcccgtaacactgaatttgttacacgggcctgacctgcctagaattttcccctctgtgacgagttattactccggagagaaccttgatctgtcttgcttcgctaacagcaacccacccgcacagtacagttggaccatcaacgggaaattccagctctccggccagaagctatttataccccaaattacccctaagcataacggtctctacgcgtgtagcgccagaaacagtgcgacgggggaagaatctagcaccagtctcactattagagtcatcgctcccccaggcttggggactttcgcttttaacaatcctacctag

SEQ ID NO: 235939 - DNA, 1008 bp, Artificial Sequence
  Description of Artificial Sequence: Synthetic coding sequence
atgggccctctgtccgctcccccatgtaccgagcatattaagtggaagggcctgctcttgactgctttgctactgaacttttggaatctcccgaccaccgcccaagttatgattgaagcacagcctcctaaggtgtccgaaggaaaagacgtcctgctgctagtacacaatcttcctcagaacctcacaggctacatctggtacaaaggacagataagagacctataccactacataacatcctacgtggtagacggccagattatcatttatggccctgcttactcgggcagggagaccgtctactctaatgcttccttgctgattcagaacgtgacaagagaagacgctgggtcctacaccctgcacattattaagagaggcgatggcactcgtggagtcactggctacttcaccttcacactctatctggagactcctaaaccatctatcagctctagcaatttaaaccccagggaagccatggaaaccgtgatcttgacttgtaatcccgagaccccagatgcttcatacctgtggtggatgaatgggcaatccttacctatgacccacagaatgcagctatcagaaactaatcggacattgtttttgtttggcgtgacaaaatacacagcgggaccatacgaatgcgagatttggaattcagggagtgcctctaggagtgacccagtgacccttaacctgctccatggacccgatctgccgaggatttttccatctgttactagttattattcaggtgagaacttagatctaagctgcttcgcaaattccaacccaccagcgcaatattcctggacgatcaatggtaaattccagctgtctggccagaagctgtttatccctcagatcacaccgaagcacaacggcctgtacgcttgttccgcgcgaaatagcgctacgggtgaagagagcagtactagcctgaccatccgagtgatcgcacctcctggcctgggtacatttgcctttaataacccaacctag

SEQ ID NO: 235940 - DNA, 1008 bp, Artificial Sequence
  Description of Artificial Sequence: Synthetic coding sequence
atggggccattatcagccccaccctgcactgaacacatcaagtggaagggactgctcctaacagcccttctgcttaatttctggaacttaccaaccacagcccaggtgatgatcgaggctcaacctcctaaagtaagcgagggtaaggacgtcttgctcttggtccataacctcccacagaatctgaccggctacatctggtacaaagggcagatccgcgacttgtaccactatataaccagttatgttgtggacggtcagattatcatatatggccctgcttattcgggccgtgagacggtgtatagtaacgcctcactcttaatccagaacgtaactagagaggatgcgggatcatacacacttcacattattaagaggggggatggaacacggggtgtcaccggatactttacctttactctgtacttggagacaccaaaaccatcgatctcttcaagcaacctgaatcccagagaggcgatggaaacagttatcctaacgtgcaatcctgagacacctgatgcctcatatctgtggtggatgaatggccaatcgctacctatgacacaccggatgcagctcagcgagacaaatcggacattgttcctgttcggtgtgaccaagtatacagccggtccttacgaatgcgagatttggaacagcggctcagcaagtcgctccgacccggtcactctcaatctactgcacggtccagacttgcccaggattttcccttctgtcacaagctactattccggggagaaccttgatctcagttgtttcgccaactctaaccccccagcgcaatattcctggacaattaatggcaaattccagctgagtggacagaagctgtttattccccaaatcacccctaaacataacggcctgtacgcctgtagcgcccgaaactcagccacaggagaagaaagtagcacatccttaacgatccgtgttatcgcacccccagggctcggtacattcgcattcaacaatcctacctag

SEQ ID NO: 235941 - DNA, 642 bp, Artificial Sequence
  Description of Artificial Sequence: Synthetic coding sequence
atgggaccccttagcgctcctccctgcacagaacacataaagtggaaaggactcctcctgactgtcgagactccaaaacccagcataagttctagtaatctcaacccaagagaagcaatggaaaccgttatcctgacgtgtaatcccgaaactcctgatgcctcttatctatggtggatgaacgggcagagtctccctatgactcatcgaatgcaactcagcgaaacaaatcggaccctgtttctttttggcgtcactaagtacaccgccggaccctatgaatgcgagatatggaactccggttccgcctcacgttctgatccagtgactcttaacctattgcacggaccagacctgccaaggattttcccaagcgtgacctcttattattctggagagaacttggatctgtcgtgttttgctaattccaatcccccagcacagtattcttggactattaacggtaagtttcagttgagcggacagaaattattcattcctcaaataaccccaaaacacaacgggctgtacgcctgctctgccaggaatagcgctacaggggaagagtcatcgacgagccttactatccgcgtcatcgcaccccctggcctgggcaccttcgctttcaacaacccaacatag

SEQ ID NO: 235942 - DNA, 1008 bp, Artificial Sequence
  Description of Artificial Sequence: Synthetic coding sequence
atgggccctctgtccgcacccccttgcacggaacatataaaatggaagggactgcttgtgacagccagtctgctgaacttctggaacttaccaaccaccgcacaggtgactatcgaagcccaaccccctaaggtgtccgagggaaaagatgtccttctactagtccacaacctgcctcagaatttgacgggttatatctggtataaggggcagatccgggacctgtaccactatatcacatcgtatgttgtagatgggcagataatcatttatggcccagcttactctggtagggaaactgcttacagcaatgcgtccttacttatccaaaacgtgaccagggaagatgccggtagctataccctccacattatcaaaagaggcgatgggacccggggtgtgaccggttatttcactttcacgctttacctcgaaactccaaagcctagcattagctcctctaacctgaacccgagagaggccatggaaactgtcatactgacttgcgaccctgagaccccagacacttcctatcagtggtggatgaacggtcagtcactgcctatgactcacaggttccagctgagcgaaacaaacaggacactcttcctcttcggcgtcaccaaatacaccgctgggccttatgaatgcgaaattcggaacagtggatcagccagccgttccgaccctgtgaccctgaatcttctgcatgggccagatctgccacgcatccatccctcatacacaaactacagatccggcgataacctgtatctcagttgcttcgccaacagcaacccaccggcacaatattcctggaccatcaatggcaaatttcaacagagcggccagaatctgttcatccctcagattactaccaagcatagtggcctgtatgtctgctctgtgaggaactccgccactggtgaagaatcaagtacaagcctgaccgttaaggtctccgcttccacccgaatcgggctgcttcctctgctgaatccaacttag

SEQ ID NO: 235943 - DNA, 1008 bp, Artificial Sequence
  Description of Artificial Sequence: Synthetic coding sequence
atggggccactgtccgcccctccctgcaccgagcacattaagtggaagggcttgctggtgactgcatccctactcaatttttggaacctgccgaccaccgcccaagtgaccatcgaggcacagccgcctaaagtttccgaggggaaggatgtccttctcttggtgcataacctgccacagaatctgaccggttacatttggtataaaggacagattcgcgatctgtaccactacatcacgtcttatgtggttgatggacagatcataatttacgggccagcgtatagtggcagggagactgcttattccaatgctagccttctcattcaaaatgtgactcgggaggacgctgggagctacacccttcacatcattaaacggggagacggcaccagaggagtgactggctacttcacgtttactctgtatctcgagacccctaaaccttcaatctcctcatccaatttaaacccaagagaagccatggagacggtgatactcacttgtgacccagaaactccagacacaagctaccagtggtggatgaatggtcagagccttcccatgacccaccgttttcagttgtcagaaacgaataggaccctgttcctctttggtgtaactaaatacacagctgggccatacgaatgtgagatcagaaactccggctctgctagcagaagcgatcctgtgaccctaaacctgttacacggtcccgacctgcccaggatccacccctcttatacaaattaccgcagcggagacaatctgtacttgagttgcttcgcaaatagcaatccccctgctcagtatagctggacgattaacggcaagttccagcagagtggacagaacctgtttatcccgcagatcaccacaaagcacagcggactctatgtctgtagtgttaggaattctgcaaccggagaggaatcctccacatcactcactgtgaaagtctctgcttccactcggatcgggctgttacctcttctgaaccccacctag

SEQ ID NO: 235944 - DNA, 1008 bp, Artificial Sequence
  Description of Artificial Sequence: Synthetic coding sequence
atgggtccactttctgcccctccttgcactgaacacatcaaatggaaaggactgctcgtgacagcaagccttctcaacttctggaacttgccaacaaccgctcaggtgactatcgaagctcaaccgccaaaggtttcagagggcaaggatgtgctgcttctggtccataacctgccacaaaatctgaccggatatatctggtacaagggccaaattcgcgacttgtatcattacatcacctcctatgtcgtcgacggtcagattatcatatatggccctgcatactcgggcagagagaccgcttacagcaatgcctctctgctcatacaaaacgtcactagggaggacgctgggtcttacaccttgcacataatcaaaagaggagacgggaccaggggggtaactggttacttcaccttcacactatacctcgagacacctaagccctccatttcttcatcaaatcttaatccccgtgaagctatggagacggtgatcctaacctgtgaccctgagacacccgatacctcatatcagtggtggatgaatgggcagagcttgccaatgacgcaccgcttccaattatccgagacgaatagaactctgttcctttttggagtcactaagtatactgctggaccttatgaatgtgagatccggaacagcggatctgccagtaggtccgaccccgtgaccctgaatctgttacatggtcctgatttgcctcggatccatcccagctacactaactacagaagcggagacaatctttatctgtcttgcttcgctaactccaaccctccagctcaatatagttggacgataaatggaaaattccagcagagtgggcagaatttgttcatcccccagatcaccacgaagcatagcggcctctatgtgtgttcagtgagaaatagtgctactggcgaggagtcctccactagtctcacagtgaaagtaagcgctagcacccgaattgggctgcttccgctattaaatccaacgtag

SEQ ID NO: 235945 - DNA, 1287 bp, Artificial Sequence
  Description of Artificial Sequence: Synthetic coding sequence
atgggcccattgagtgcaccaccatgcacacagagaatcacatggaagggactactgttgaccgccctgctgcttaacttttggaacctgcccactacggctcaggttactatagaagctgagcctacaaaagtaagcaagggaaaagacgtgctccttctggtccataacctgccacaaaacctcgctggctacatctggtacaagggacaaatgaaggatttataccactacattacttcttatgtggtcgacggacaaattatcatttacggtccagcttattcagggagagaaacggtgtactctaacgcctctttactcattcagaatgtaacacgggaagacgctggctcctatacactgcatatcgtcaaaagaggcgacggcactcggggtgagacaggacacttcacatttacactttatctggagactccaaagccaagtataagcagtagcaacctttacccacgggaagacatggaggccgtaagcctcacttgtgatccagagacaccagacgcatcatacctgtggtggatgaacgggcagagtctgccgatgactcattcactacaactctccaagaataagcgaactttattcttgtttggtgtcacaaaatacactgctggaccctatgagtgtgagattcgtaaccctgtatcagcttccaggtctgatccggtgacgctcaaccttctgccaaagttacccaaaccatacatcaccatcaacaatctcaacccccgagagaacaaggacgtgctcgctttcacctgcgagcccaaaagtgagaactacacttacatttggtggctcaatggacagtcactgccggtgtcccctcgggtgaaaagacctatcgaaaataggatcttgattttaccttcggtgacaagaaacgaaactggaccatatcagtgtgagatccaggaccggtatggaggaatccggagctatcctgttacactcaacgtgctctatggccctgacctcccacgtatttacccctccttcacttactatcactccggtgaaaacctgtatctgtcctgctttgccgatagcaatccgccagctgaatactcttggactataaatggtaaattccagctgagtggacagaaattgttcatacctcagatcacaacgaaacactccggcttatacgcctgcagtgtaagaaacagcgcaacaggcatggagtcctctaaatcgatgacagtcaaagtgtctgctccctctggcactgggcatctgccagggctgaaccctctttag

SEQ ID NO: 235946 - DNA, 981 bp, Artificial Sequence
  Description of Artificial Sequence: Synthetic coding sequence
atggggcctttatccgcccctccctgtactcagcgcattacgtggaagggtgtgctcttgactgcaagccttctaaacttctggaacccgccaacgactgctcaggtaaccatagaggctcaaccaccaaaagtgagtgagggaaaagacgtgctgttattggtccacaacctgccacagaatctcgcaggctatatctggtataaagggcagatgacatatctttaccattacataacgtcttatgtcgtagacggtcagagaatcatctatggacccgcatacagcgggagagagagagtttattctaatgcctcccttctcatacagaatgtgactcaggaagacgctggttcatataccctccatatcataaagcgaagagacggcactgggggagtcaccgggcatttcacttttaccctccacttggaaacgcccaagccatcaatatcgtcgtctaatctgaatccgagggaagctatggaggctgtgatattaacctgtgaccccgcaaccccggcagcaagttatcagtggtggatgaacggacagtccttgccaatgacacacagactgcagctaagcaaaacaaaccgcacgctgtttatttttggggttaccaaatatattgccggaccatacgagtgcgaaatacgcaaccccgttagcgcttctcgcagcgatcctgtcacactcaacctgctgcatggtccggatctgccatctatctacccctcgttcacatattaccgcagcggcgagaatctgtatctcagctgttttgcggagtctaatccccgagcgcaatattcctggaccataaacggtaaattccagctttccggacagaagctcagcatccctcagatcaccaccaaacactctggactctacgcgtgttcggttaggaattcggctaccggcaaggaaagtagcaagtcaatcactgtgaaggtctccgattggatcctcccttag

SEQ ID NO: 235947 - DNA, 1260 bp, Artificial Sequence
  Description of Artificial Sequence: Synthetic coding sequence
atggggcctctctctgcccctccgtgtacacaacggatcacttggaagggcgttttgttgaccgctagccttcttaatttttggaacccacctacaaccgcacaggtgaccatcgaggcacagcctccaaaagtgagtgagggtaaagatgtgctgctgttggtgcacaaccttcctcagaacttagcaggctatatctggtataaaggtcaaatgacatatctctaccactacatcacctcctatgtcgtggacggacagaggattatatatggtccagcctattccggtagggaaagggtttactctaatgcgtctctgcttattcagaacgtgacacaagaggacgctggctcttacaccctccacattattaagaggcgggatggaaccggaggcgtcaccggccattttacttttactctacacctggagacgcctaagccaagcataagctcctccaatctgaacccgagggaagctatggaagccgtgatcctgacttgcgaccccgcaacacctgctgctagctaccaatggtggatgaacggacagtccctgcccatgacccacaggcttcagttgagtaagaccaacagaaccctgtttatttttggagtcacaaagtacatcgccggaccttatgagtgtgaaattcgtaaccccgtctctgcatcgcggtccgatccagtgaccctgaacctgcttcctaaattgagcaaaccttacatcaccataaacaacctgaatcccagggagaataaagacgttctgaccttcacatgtgaacccaaatccaagaactacacctacatttggtggcttaacggccagtcactccctgtctcacccagggtgaaaaggcctatcgagaacagaatactcattctgcctaacgtaacacggaatgagaccggaccctatcaatgcgagatccgagatcggtatgggggaatccgcagtgatcccgtcaccctgaacgtgctctatggcccagacctgccctccatttatccatccttcacctattatagatcaggcgagaatctgtacttatcatgcttcgctgagagcaatccacgtgcccagtacagttggaccattaatggaaagttccagctcagcgggcaaaaactttcgattcctcagattactacaaaacattctgggttgtacgcctgctcagtcaggaattcagccactggaaaggagtccagtaagtcgatcacagtgaaagtctcggactggatcttgccctag

SEQ ID NO: 235948 - DNA, 981 bp, Artificial Sequence
  Description of Artificial Sequence: Synthetic coding sequence
atgggtcctctttccgctcctccctgcactcagagaatcacatggaagggagtcttgctgacagcctccctgcttaatttttggaatccacccacaactgcacaggttactatagaggctcagcctccgaaggtaagcgagggtaaagatgtgctgctgctggtgcacaacctccctcaaaacctggctgggtatatttggtataaggggcaaatgacctacctgtatcactatattacctcctacgttgttgatgggcagaggatcatctacggaccggcatattctggcagggagcgggtctactctaatgcttcgctcttaatccagaatgtgacccaggaagacgcgggtagctatactttacatattattaagagacgtgatgggacgggtggcgtgaccggccactttacgtttactctccatcccaagttgtccaaaccctatataaccatcaataacctcaatccgagggagaacaaggacgtgctgaccttcacatgcgaacctaaatcaaagaactacacttacatttggtggctgaatggccagagccttccagtgagccccagagttaagcggccaatcgagaatcgcatactcattctgccaaatgtgacacgaaatgagactggtccttatcagtgcgaaatccgtgatcggtacgggggtatacggtcagaccctgtgacactgaacgtgctctatggccctgaccttccttcaatttaccccagcttcacttattatagaagcggcgaaaacttatacttgtcctgcttcgccgagagcaatccaagggcccagtatagctggactatcaatggcaaattccagctgtccggccagaaactttctatcccgcagattacgactaagcactcaggcctgtatgcgtgcagcgtccgcaacagtgccactggtaaggaaagctccaagtccatcacagtgaaagtttcggattggattttgccttag

SEQ ID NO: 235949 - DNA, 1008 bp, Artificial Sequence
  Description of Artificial Sequence: Synthetic coding sequence
atgggccctctctccgcccctccttgtacccagcacatcacctggaaggggctgctgctgaccgcgtccctcctgaatttctggaatctgccaatcactgcgcaggtcactattgaggcgttacctcccaaggtctccgaaggcaaagacgttttgctgctcgttcataacctccctcagaatcttgcaggatatatctggtacaagggacagctgatggatctgtatcactacattaccagctatgtggttgacgggcagatcaacatctatggccctgcttatacagggcgagaaaccgtatactccaacgccagtctgttgatccagaacgtgactcgagaagacgcaggcagttatacattacatattattaagcgcggagaccgcacacgtggagtaacaggatattttacattcaatctgtacctcaaattacccaagccatacattacaatcaacaacagtaaacccagagagaataaggacgtacttgcgtttacatgtgagcccaagagcgagaactacacatacatttggtggctgaatggccagagtctccctgttagtcccagggtgaaaaggccaatcgagaatagaattctcatccttccaagcgtcactcgcaatgagacgggaccctacgaatgcgaaattcgagatcgggatgggggaatgaggtctgaccccgtcaccctgaatgtgctgtatggacccgatctgccaagcatctatccgtcattcacttactacaggagcggggagaacttgtacctctcctgtttcgccgagagcaacccacccgcagaatacttttggacaatcaacggaaaattccagcagtccggtcagaagctgtccataccccagatcactaccaaacatagaggcctatatacctgttcggtccgaaattcagcgacagggaaggagagcagcaagagcatgacagtggaggtgagcgccccatcagggattggccgactgcccctgctgaacccaatatag

SEQ ID NO: 235950 - DNA, 1008 bp, Artificial Sequence
  Description of Artificial Sequence: Synthetic coding sequence
atgggccctttaagtgcacctccttgtacgcaacacatcacatggaaggggcttctactgacagcctccttgctgaatttctggaacctgcccatcactgcccaagttacaatagaggctctgccccctaaggtctcagaaggaaaggacgtgttgctgctggtgcacaatcttcctcaaaatctcgctggatacatctggtataagggccagctgatggatttgtatcattacattacttcgtatgttgtggacggccagatcaatatttacgggcctgcttacacgggccgagagacggtctactcaaacgcaagtttgctcatccagaacgttactcgcgaggacgctggctcttatacgctccatataatcaaaaggggcgatcgtacacgaggggtgaccggatactttacgtttaatctgtatctgaagctgcccaagccttatattaccattaacaactccaagcctcgcgagaataaggatgtgctggcgtttacatgtgaaccaaagagtgagaactacacttatatctggtggttaaatgggcaatctctgcctgtgtcaccaagagtaaagaggcccattgaaaaccgcatcctgatactgccgtctgtgacccggaatgagactggaccatatgagtgtgagatccgggaccgagacggaggtatgcgctccgatcccgtgacattaaatgtcctttatgggccagacctgcccagcatctacccctcttttacctactatagatccggtgaaaatttatatctgtcttgctttgcggaatctaatccaccagctgagtatttttggacaatcaatggaaagttccagcaatcgggccagaaactgagtatcccccagattacaacaaagcatcggggattgtacacttgtagtgtccgcaacagcgcaaccggcaaggagagtagtaagtccatgacggttgaggtgtcagcccctagcgggattggacgcctacctctgctcaacccgatctag

SEQ ID NO: 235951 - DNA, 1008 bp, Artificial Sequence
  Description of Artificial Sequence: Synthetic coding sequence
atggggcctctttcagcacctccctgcacccaacatatcacttggaaggggctgctcttgaccgcaagtctgctgaacttctggaatctgccaatcaccgcccaggtgaccattgaggcactgccacccaaggtgagtgaaggcaaggacgtgctgttgcttgttcacaatcttccacagaatttggcaggttatatttggtacaaaggtcagctaatggacctgtaccactatattacatcatatgttgtagatggtcagattaacatatatggcccagcttacacgggtagggagaccgtctactcgaatgcttcgcttctaatccagaatgtgacaagggaggacgcagggagttataccctgcacattatcaaacgaggtgaccgtaccaggggcgttaccggttactttacattcaacctgtacctaaagctgcccaaaccatacattacgatcaacaacagcaagcctagagaaaataaggatgtcttggccttcacatgtgaacctaagtctgagaattacacctatatatggtggttgaatgggcagtcacttcctgtcagtcccagggtaaaacggccaattgaaaacaggattctcattcttccttctgtgacacgcaacgagacaggcccatatgagtgtgaaattagggaccgagatggtggcatgcgatcagatccagttaccttgaatgtgttgtacgggccagatctgccttccatttacccaagctttacatattaccggtctggggaaaacctttatctctcctgctttgccgagtctaacccccctgcggaatacttttggactatcaacgggaagttccaacagtcaggacagaagctcagcatcccccagattaccaccaaacaccggggactgtacacttgctccgtgaggaatagtgccactggcaaggaatcctcaaaatcaatgacagttgaagtctccgctccatccggcattggacggctccccctgctgaaccccatctag

SEQ ID NO: 235952 - DNA, 1275 bp, Artificial Sequence
  Description of Artificial Sequence: Synthetic coding sequence
atggggcctttgtcagcgccaccatgtactcagcacatcacctggaaaggtcttctcctgactgcttccttactgaacttttggaatctgcctaccactgcccaagtaatcatcgaggccaagccccctaaagtgagcgaaggaaaagatgtgttgctgttggtgcataacctcccacagaacttaacaggctacatctggtataaggggcagatgaccgatctatatcactatatcacaagctacgtggtccacggtcaaatcatctatggaccagcctactctggcagggaaaccgtgtatagtaatgctagccttctgatacagaacgtgacgcaggaagatgccggatcttacacactccatatcatcaagcggggagacgggacgggcggagttactggatattttaccgtgacactctattctgagacacctaagcctagcatctctagcagtaatctaaacccacgggaggtcatggaggccgtgcgcctaatttgtgacccagagacacccgatgccagttacctgtggcttctcaacggccaaaatttgccaatgacccaccgactgcagctgtctaaaactaatcggaccttatatcttttcggagtcaccaagtatatcgcaggaccatatgaatgcgagattagaaaccccgtctccgcctcacgctctgatcctgtgacattgaatcttctccccaagctgccaatgccttatataacgatcaacaatctgaaccctcgagagaaaaaggacgtgttggcattcacttgtgagccaaagtctcggaactacacttacatctggtggctcaatggacagagtcttcccgtgtcgcccagagtcaaaagacccatcgagaatcgcatactgattttgccatccgtcacaagaaatgaaacagggccttaccaatgcgagattcgagaccggtacggaggcattaggtcaaacccagtcaccctcaatgtgctctacggtcctgacctcccaaggatttatcccagttttacctactatagatcaggtgagaacctggatctctcctgctttgccgacagcaatccacccgctgagtactcatggaccatcaatggaaagttccagttgagtggccaaaaactgttcatcccccaaattacaactaaccactcaggcctctatgcctgttccgtgagaaacagcgccaccggcaaagagatcagcaagtcaatgattgtgaaagtgtctggtccatgccatgggaaccaaactgagagccattag

SEQ ID NO: 235953 - DNA, 1308 bp, Artificial Sequence
  Description of Artificial Sequence: Synthetic coding sequence
atggggcctctgtctgctcccccatgcacccagcacattacgtggaaagggttgctcctgaccgcctccttattaaatttctggaacctaccgaccaccgcccaggttataatcgaagcgaaaccacctaaggttagtgagggcaaagacgtgttgcttttggtgcacaacctccctcaaaacctgaccggatacatatggtacaaggggcaaatgacagacctgtaccactatatcacctcttacgttgtgcatggccagatcatttacggtccggcatattctgggcgagagaccgtgtattcaaacgcctccctcctcattcagaatgtgacccaggaagatgcaggctcatacacactgcacatcataaagagaggcgatgggaccggaggggtaactggatacttcaccgtgactctttactccgaaacaccaaaacccagtattagctcaagtaacttgaaccctcgggaggttatggaagcagtcagattgatctgtgaccccgagactcccgatgctagctacctgtggctattaaacggccagaaccttcccatgactcaccgtcttcagttgtccaagaccaatagaactttatacctgttcggcgtaaccaaatacatagctgggccatatgaatgtgagattcgcaatcctgtttctgcttcacggtccgatcccgtgacactcaacttgctgcccaaactccctatgccttacattaccattaataaccttaaccctcgtgaaaaaaaggacgtgctggcttttacatgtgagcctaaatcccgcaactatacatacatatggtggctgaacggtcagagccttccggtgtcccctagagtgaaacggcctattgagaataggatcctcattctgccaagtgtgactcggaacgaaaccggaccctatcagtgtgaaataagagaccggtacggagggatccgttcgaatcccgtgaccctgaacgttctgtacgggcctgatttaccacgaatatacccaagcttcacctactacaggtcaggtgagaacctggacctctcatgctttgcggattccaatccaccggctgagtacagctggacaattaatgggaagttccagctcagcggacagaaactgttcattccgcagataactactaaccactccggcctatacgcctgttcagttaggaatagcgctacaggaaaggaaatttccaaatccatgatcgtgaaagtgtcagaaaccgcaagcccgcaagtgacttatgccggaccaaacacatggttccaggagatcctgctgctttag

SEQ ID NO: 235954 - DNA, 606 bp, Artificial Sequence
  Description of Artificial Sequence: Synthetic coding sequence
atgggaggcgatgagaaccggggtgtcactggccatttcactttcactctgtatctggaaacaccaaagccatcaatttccagttccaaacttaatcctcgagaggccatggaggcggtgtcgctgacttgcgatcctgaaactcccgacgccagctacctgtggtggatgaacggccaatctttgcctatgtctcaccggttgcagctgagcgagaccaatcggacactattcctgttgggggtcaccaaatacacggcaggaccatacgagtgtgaaatcaggaatccggtttctgcaagcagatccgaccctttcacactgaatctgctgcatggcccagatctccccagaatttacccatcttttacttattatagatctggcgaagtgctctacctgagctgtagcgctgattcaaaccctccagctcaatatagctggacaataaacggaaaattccagctcagcgggcagaaactgtttatacctcagatcacaactaagcattcaggactgtacgcctgctccgtccgcaactctgctaccggcaaggagtcctctaagtccatgacggttaaagtatccgactggacactgccctag

SEQ ID NO: 235955 - DNA, 1281 bp, Artificial Sequence
  Description of Artificial Sequence: Synthetic coding sequence
atgggcctgctcagcgcaccaccgtgcacccagcgcataacttggaagggactcctgctaaccgcttcactactcaatttttggaatcctccgaccactgctcaggtcacaatcgaggcccagcccaccaaagtgagcgaaggcaaggatgttctgctgctggtccacaatctgccccagaacctgaccggatacatttggtacaagggacaaatccgtgacctctaccattacatcacatcctacgtggtggatggacagattatcatctacggacctgcgtattccggacgagaaactatatacagtaacgcatcccttctaatacagaacgtgactcaggaagacgccggatcctacacactccacatcatcatgggaggagatgagaaccggggtgttacagggcatttcacgtttactctgtacctggagacaccaaagccgagcatcagttcaagcaaactgaacccaagggaggcaatggaggccgtgtccctgacatgcgaccccgagacaccagatgcatcatacctttggtggatgaacgggcagtctctgcccatgtcacatcggctacaactgagtgagacaaacaggaccctgtttctccttggcgtgactaaatacacagcaggaccgtacgagtgtgagatccggaaccctgtgagtgcctctagaagcgacccgttcactctgaacctcctccctaaactgcctaaaccctacataacaataaacaacctgaaacccagggagaacaaggatgttctgaatttcacatgtgaacccaagagcgagaattatacgtatatttggtggctgaacggccagagcttgcccgtttcgcctcgcgtgaagagacccatagaaaatcggatcctgatcctcccatccgtgacccgcaacgaaaccggcccataccaatgcgagatacgagaccagtacggtggcattcgttcctaccccgtgaccctcaatgtcctgtacgggccagaccttcccaggatctatccaagtttcacgtactatagatcgggcgaggtcctctacttgagttgttcagccgattcgaatcctcccgcacagtactcatggacaattaatggcaagtttcagctgtccggccagaagctgttcatccctcaaataacaaccaagcattctggcctctatgcgtgtagtgtccgtaactcagctaccggaaaggagagctccaaaagcatgactgtgaaagttagcggcaagcgaatccccgtgagtctggcgatcggtatctag

SEQ ID NO: 235956 - DNA, 717 bp, Artificial Sequence
  Description of Artificial Sequence: Synthetic coding sequence
atgagtcatcgtttgcaattatccgaaaccaaccgaacgctgttcttactaggcgtcacaaagtatactgccggaccttatgagtgcgaaataaggaatcctgtctccgcaagcagaagtgatccgttcacattgaacttactccccaagcttccgaagccatacatcactatcaataatttaaagccccgtgagaataaggacgtgctgaattttacgtgtgagcccaaaagcgagaactatacctacatctggtggctgaacggacagtcccttcccgtgtcacctcgggtgaagcggcctatagaaaaccgaattcttattctaccttccgtgacaagaaacgaaacaggcccatatcagtgcgaaatccgcgatcagtatggcggaatccgctcctaccccgtcactctaaatgtgttgtatgggccagatctacctcgaatttacccttcattcacctactaccgctccggggaggtgctctatctcagttgctctgccgactctaatccccctgcgcagtattcctggacaatcaatggcaaatttcagctgtccggccagaagctctttattccgcaaattacgactaagcacagtgggctgtacgcatgtagcgtgaggaactctgccaccggaaaagaatcttcaaaatcaatgacagtgaaggtctcagcgtactccagttccatcaactatacagctgtctactag

SEQ ID NO: 235957 - DNA, 1260 bp, Artificial Sequence
  Description of Artificial Sequence: Synthetic coding sequence
atggggcttctctccgccccaccatgtacccagaggataacctggaaaggcctgctgttaaccgcatcattattgaacttctggaatccccctacgaccgcccaagtgacgattgaagcccagcccaccaaagtaagcgagggtaaggacgtgctgcttttagtgcacaatttgccccagaacctaacagggtatatttggtacaaggggcagattcgagatctttatcactacatcacatcttacgtcgtggacggccaaatcatcatctatggaccagcttattctggcagggaaactatctactctaacgcaagcttgcttatacagaatgtgacccaggaggatgccggatcttataccctgcacattatcatgggcggagacgagaacagaggcgttacaggccatttcacctttaccttgtacctggagacacctaagcctagcatatccagttccaagctaaatccacgagaggcgatggaggcagtcagcttgacatgtgatccagaaacccctgatgcctcatatttgtggtggatgaatggacagtccctgcccatgtcccaccggttgcagctgtctgaaacgaaccgcaccctgttcctcctgggcgtgacaaaatacaccgccggaccatatgagtgcgagatccgcaaccctgtgtcagcttcccggagcgatcctttcacccttaatcttttgcccaaactgcccaaaccatatatcactattaataatctgaagccacgagagaataaggacgtactcaactttacttgtgagccgaaatctgagaattatacttacatatggtggttgaacggccagagcctgcctgtcagcccgagggtcaagagacctattgaaaatagaattcttatattgccgtccgtcactagaaacgagactggcccatatcaatgcgaaattagagaccaatatgggggaatccggtcttatcctgtcaccctgaatgtcttatatgggcctgatttgccgagaatctacccatctttcacatattaccgttcaggggaggtcctgtatttatcttgcagcgccgattcaaaccccccagctcagtattcttggactataaatgggaaattccagctgtctggacaaaagttatttatcccccagattacaaccaagcacagcggcctttatgcctgttccgttcgaaactctgcaacaggcaaagagtcctcaaagtcgatgacggttaaggtctcagattggacgctaccctag

SEQ ID NO: 235958 - DNA, 894 bp, Artificial Sequence
  Description of Artificial Sequence: Synthetic coding sequence
atggggctgctgtctgccccaccctgcacgcagcggatcacatggaaaggcctcctcttgacagttgagacacctaagccaagcatttcttcaagcaagctgaatcctagagaggcaatggaggctgtgagcctgacttgtgacccagagacgcccgatgcaagctacctttggtggatgaacggccagtcactgcctatgtcccacaggcttcagctgtcagaaacaaataggaccctttttttgcttggtgtgaccaagtacacggctggtccatacgaatgcgagatccggaatccggtttccgcctccaggtctgatccttttacactgaacctcttgccaaagttaccgaaaccctatattaccattaacaacctgaagccccgagagaataaagacgttctcaatttcacatgcgagcctaagagcgagaactacacctatatctggtggctgaacggacaatctctgccagtctctccacgtgtaaaacgtcctatcgagaaccgtatactgattctaccttctgtgacacgaaatgaaaccggcccttatcagtgtgagatcagagatcagtacggcggtattcgcagctaccctgtgactctgaatgtgctctatgggcctgatctacctaggatttacccaagtttcacatattaccgcagcggggaggtgctctatctctcatgctccgcggatagcaacccaccagctcaatactcatggacaataaacgggaaatttcaactgtccggccagaagctgttcattccccagattactactaaacacagcgggctgtatgcttgctctgttcgcaactcagctaccggcaaggagtcttctaaatccatgaccgttaaagtaagtgattggactttgccttag

SEQ ID NO: 235959 - DNA, 1209 bp, Artificial Sequence
  Description of Artificial Sequence: Synthetic coding sequence
atgggtcctctaccagcgccatcctgcacacaaaggattacatggaagggcttactcttgactgcttcacttctgaatttttggaacccccctacgactgcggaagtgacgatcgaggcacagccgccaaaggtgtcagaggggaaggacgtcctcctcttagttcacaacctaccccaaaatctccccggttatttttggtacaagggggaaatgaccgacctgtatcactacatcatatcttatatcgtcgatggtaaaatcataatttatgggccagcctatagtggtcgtgagacagtttattctaatgcctcactgcttatccagaacgtgactcgaaaagacgctggcacctatactctccacatcatcaagcgcggagacgaaacacgcgaggaaattcgccactttacatttacactgtacctggagacacctaagccatacatctcttccagcaatctaaatcctcgggaggcaatggaggctgtgaggctcatctgcgatcctgagacactggatgcttcttatctctggtggatgaatggacaatccttgcctgtgacccatcgattgcagctaagcaagaccaaccgcacgctctacctgttcggggtcacgaaatacatagccggaccctatgagtgtgagatccgcaaccccgtttcagcatcgcggtccgatccagtgacacttaacctactgcacggccctgacctgccgaggatttatccctccttcacatattacagaagcggggagaatctagatctaagctgttttacagagtctaaccctcctgccgaatacttctggaccataaacggcaagttccagcagagcgggcaaaagctttttattccccagatcactcgcaaccactctgggttatacgcctgctcagtgcacaactcagcaaccggcaaagagatttctaagtccatgacagtcaaggtatctgggaagtggatccccgcttcgctggccgtaggcttctacgtcgaaagtatttggctgtctgagaagtctcaggagaacatctttataccctctctgtgtcctatggggacctctaaaagtcagattctgctgttaaacccacctaacctatccctgcagaccttatttagcctctttttctgctttttgatggccgacctagtgtcaggactgaagaaggtgggacgaggactgtaccaaccatag

SEQ ID NO: 235960 - DNA, 1281 bp, Artificial Sequence
  Description of Artificial Sequence: Synthetic coding sequence
atgggaccactccccgcaccaagctgtacccagcgaattacctggaagggccttctgctcaccgcctctctccttaacttctggaatcctcctactactgccgaagtaactatcgaagctcagccgccaaaggtctctgagggcaaagatgtcctgctgctagtgcataacctcccccaaaatcttcccggttatttctggtacaagggcgagatgactgacttataccactacattattagttacatcgtggacggcaaaatcattatttacgggcctgcttattctgggcgagaaactgtttactccaacgcatccctgctcattcagaacgttacacgaaaggatgccggaacttataccctgcacatcatcaagcgaggcgatgagacaagagaggagatccgccacttcacattcacactgtacctagagactccgaagccctatatctcatctagtaacctcaatccgcgtgaggcgatggaggccgtccgattgatctgtgaccctgagactctcgatgcgagctatctgtggtggatgaacggccagtcgctcccggtcacccataggctccagctgtctaagactaaccgcactttatacctgttcggtgtgacgaaatacatcgctgggccatatgagtgcgaaatcaggaatccagtgagcgccagccgttctgaccccgttactctgaacctgctgcccaagctccctatcccttatatcacaattaacaacctgaacccacgcgaaaataaagacgtgttggccttcacgtgtgagccaaagtccgaaaactacacctatatctggtggttgaacggccagagtctgcccgttagccctggtgtcaagaggccaattgagaaccggatattgattcttccatcagttacacgaaatgaaaccgggccttatcagtgcgaaattagggatcgatacggcggtctgcgctcaaacccggtcatcctgaatgtgctgtacggtcccgatctgcccagaatttacccctcctttacgtactaccggtctggcgagaatctcgatcttagctgctttactgagagtaacccccctgcggaatatttttggacaatcaatgggaagtttcagcagtctgggcagaaattgttcatccctcaaatcactagaaatcattctggcctttacgcgtgctccgtacacaacagcgccactggaaaggaaatcagcaagagcatgactgtgaaggtcagtggtccatgccacggcgaccttactgaaagccagtcatag

SEQ ID NO: 235961 - DNA, 723 bp, Artificial Sequence
  Description of Artificial Sequence: Synthetic coding sequence
atgggccctctcccggcaccgagttgtactcaacgcatcacctggaaaggcctgctgctgacagcctctttgcttaacttctggaatcctccaaccacagccgaggtgacaatagaggctcagccacctaaagtgtcggagggcaaagatgtcctgttgctggtccataatctgccccagaacctccccggttatttctggtataaaggggagatgaccgatttgtaccactatattatttcatacattgtcgatggtaagattatcatttatggcccagcatatagcggcagggagacggtctactctaatgcgtcactgcttatccagaatgtcactcggaaagacgccggtacctatactcttcatatcataaagagaggagacgaaacgcgcgaggagatccggcatttcactttcactctttactacggaccagatctccctcgcatctacccaagctttacatactacagatcgggcgaaaacctggatttgtcctgtttcactgaaagtaatcctcctgcggaatacttttggaccatcaacggcaagtttcagcagtcagggcagaagctctttatacctcaaattaccagaaaccattccgggctgtacgcttgcagcgttcacaattctgccacagggaaggagatttccaaatccatgaccgtaaaggtgagcggcccttgccacggggacctaacggagagtcagagttag

SEQ ID NO: 235962 - DNA, 1164 bp, Artificial Sequence
  Description of Artificial Sequence: Synthetic coding sequence
atgggccctctgcccgctcctagttgcactcagaggatcacttggaaggggctgctgcttaccgcgtccctcttgaacttctggtacaaaggagaaatgaccgatctgtatcattacatcatctcatacatcgtggacggcaaaatcataatttatggtcccgcttattcgggtcgtgaaacagtgtattcgaacgctagtttgctgattcagaacgtgacccggaaagacgccggtacatataccctccatattataaagaggggtgacgagacaagagaagagattcggcatttcacattcacgctctacttggagacaccgaaaccatatatttcctcaagcaacctgaatcccagggaggctatggaagccgtaagactgatttgtgacccggaaacgttggatgcgtcatatctatggtggatgaacggacagtccctccctgtgacgcatcgtctccagctgagcaaaacgaaccgaaccttgtatctgttcggagtgacaaaatacatcgccggtccttatgagtgtgagatccgcaacccggttagcgccagccgttcagatccagttaccttaaacttactcccgaaactgcctattccttatataacaatcaataaccttaacccgagagagaataaagatgtattggcattcacctgcgaaccaaagtcggagaactacacatacatctggtggctgaatgggcagagcctgcctgtcagccctggggttaaaagaccaatagaaaaccgtatcctcattctccctagcgtgaccagaaatgagactggcccttatcaatgcgaaatacgggaccgatacggagggctgagatccaaccctgtgatccttaatgtcttatatggtccggacttacctcggatctacccttcctttacgtattaccgcagtggagagaatctggacctctcctgcttcacggaatctaacccgccagccgagtacttttggacaatcaatggaaaattccagcagagcggccagaagttatttatcccccagatcactcgcaatcattctgggctatacgcctgttccgtacacaactccgccacgggcaaggagattagtaaatctatgactgtgaaggtgtccggcccttgccacggtgatctgactgaaagccagtcctag

SEQ ID NO: 235963 - DNA, 1002 bp, Artificial Sequence
  Description of Artificial Sequence: Synthetic coding sequence
atgggaccactgcctgctccctcgtgcacccagcgcatcacctggaagggcctgttactaaccgcctccttattgaacttctggaatcccccaactaccgctgaggtaacaatcgaggcccagccgccaaaagttagcgaaggcaaggacgtgctgctgctagtacacaacctgccccaaaatctgccgggttacttttggtataagggagagatgaccgatttgtaccattacatcattagctatattgttgacggtaagatcatcatctatggcccagcctactcagggagggagacggtctactccaacgcttcgctgctgatccaaaacgtaacccgtaaggatgcaggtacctatacgcttcatattattaagcggggtgatgaaacgagggaggaaattcgacacttcaccttcacactgtattctaagctgcctatcccctacattacaataaacaacctgaaccctcgagagaacaaggacgtgctggcattcacgtgtgagcccaagagtgaaaattatacctatatctggtggctcaatggccagtccctaccagtgtcccccggagtgaagcgtcccattgaaaaccgaatcctgatccttccgtctgttactcgcaatgagacaggcccatatcagtgcgaaatccgggatcgatacgggggactgagatctaacccagttatcctcaatgttttatatgggccagacctgcctaggatctaccctagcttcacgtattaccgtagcggcgagaatctggacctatcatgttttactgaaagcaatccacctgccgagtatttctggacaattaatggcaagtttcaacagtccggtcagaagctttttattcctcaaattacacggaaccattctggactgtacgcatgtagcgttcataactctgctaccggcaaagaaatttcaaaatcaatgacggtcaaggtttctgggccttgtcacggtgaccttacggagtcccaaagttag

SEQ ID NO: 235964 - DNA, 1032 bp, Artificial Sequence
  Description of Artificial Sequence: Synthetic coding sequence
atgctactgctgaaaaagcacaccgaggacatatcaagcgtgtacgaaattcgggagcggctgggcagtggcgctttttctgaggttgtcctggcccaggaacgtggtagtgctcatctggtggcgttgaaatgcatccccaaaaaagccctgcggggtaaagaagcgctcgtggagaatgagatcgccgtcctgagacgcatcagccacccaaacattgtagccctggaggacgtgcatgaatcaccctcccacctatatctcgccatggagctggtcaccggaggcgagttgttcgatcgtattatggaacgtggttcctacactgaaaaagacgcgagtcatcttgttgggcaagttcttggtgcagtgagttacctgcactctctgggaatcgtgcacagggatctgaaacccgagaacctgctatatgccactccctttgaggactctaaaatcatggtgtccgactttggcctttctaaaatccaggcaggaaacatgctgggcaccgcatgcgggaccccaggctacgtcgcccctgagctgctggagcagaagccatacggtaaagccgtggacgtgtgggctctaggcgtgatctcgtacatcctattatgcgggtatccccctttttacgatgagtccgatccagagctgttttcacagatcctcagagcttcctacgagtttgattcacctttctgggatgacatctccgaaagtgcaaaggatttcatcagacatctgctcgagcgggatcctcagaaacggttcacatgccagcaagccctaaggcatttatggataagtggcgacactgccttcgaccgcgacatcctgggtagcgtatctgagcagattaggaaaaattttgccaggactcattggaagagggccttcaacgcaaccagctttttgagacacattagaaaactgggccaaattcccgaaggtgaaggggcttccgaacaaggcatggcccgacatagccatagtgggctcagagctgggcagcctccaaaatggtag

SEQ ID NO: 235965 - DNA, 1101 bp, Artificial Sequence
  Description of Artificial Sequence: Synthetic coding sequence
atgcttctcctgaaaaagcacactgaggacattagttccgtgtacgagattagagagcggctgggctccggtgcattctcggaggttgtactcgcacaggaaaggggttcggctcacttagtggccctcaaatgcatcccaaagaaggcccttagagggaaggaggctcttgtggaaaacgagatcgcagtattacggagaatcagtcaccccaacattgtggctctggaggatgttcatgagtccccttctcacctgtatctggcgatggaattggttaccgggggagagctgttcgataggattatggagcggggtagttacacagaaaaagacgcttcccatctggtagggcaggtgctgggagctgtgtcctacttacactctctgggcatcgtgcacagggatctgaagccagaaaacctcttgtacgccaccccatttgaggactctaaaatcatggtctccgattttggcctatctaaaatccaggcgggtaacatgctgggcactgcctgtggaacaccagggtacgctgaaccagtgacattgtctggaatggctgcgtgcgtgcccgtgcgagccagcgtgtgtttgtggccaccagctcctgaactgctggagcagaagccttatggaaaagcggttgatgtgtgggccctgggggtgatcagctacattctgctgtgcggataccctcctttctatgacgaatcagacccagagctgttctctcagattttgcgggcatcctatgaattcgattcacccttttgggacgatattagcgagtctgctaaagatttcatcaggcacctgctggaacgcgatcctcagaagcggttcacctgccaacaagcacttcgccatctgtggatttcaggtgacacagcctttgacagggatatcctcgggagtgtctccgaacagatacggaagaatttcgctagaacccactggaagcgggcttttaacgccacgagcttcctgcgtcacattaggaagctcggccaaatccccgagggcgaaggggctagtgagcaaggcatggccagacactctcactctggcttgagggccggacaacccccaaagtggtag

SEQ ID NO: 235966 - DNA, 1083 bp, Artificial Sequence
  Description of Artificial Sequence: Synthetic coding sequence
atgtggcgccgagtgtgcggtgggctcgctgggagacggcctagcggcgacatgctgctcctgaaaaaacacacagaagatatttccagtgtgtatgagatccgagaacgattgggaagcggtgccttttcagaggttgtgctggctcaggagaggggctctgcccatttggtggcgctaaagtgtatccccaaaaaagctctacgaggaaaagaggcgctagtggaaaacgagatcgccgttctccgaaggatttcccaccccaatattgttgccctcgaggatgttcatgaatctccttcacatctgtacctagccatggaactagtaaccggcggagaactgtttgatcgtattatggagcggggtagctacacagagaaggatgcatcacacctcgttggtcaggtgctaggggctgtctcctatctccattcgctaggcattgtacaccgggaccttaaaccagagaatttgttatacgcaactccattcgaggacagtaaaatcatggtgagtgactttggcctctcaaagatacaggctgggaatatgctgggaaccgcttgtgggactcccggttacgtcgcgcctgagctgctggaacaaaaaccatatggaaaggcagttgacgtttgggcactcggggtgataagctatatactgctgtgcgggtacccgccattctacgatgaatctgaccctgagcttttcagccagatacttagagcgtcatacgagttcgacagcccattctgggatgatatatctgaatccgctaaagacttcatccggcaccttttagaacgagacccacagaagcgcttcacatgccaacaagcgctgcgtcatttgtggatctccggagacaccgcatttgacagagacattctgggctctgttagtgaacagattcgcaagaactttgccagaacgcattggaaacgggcatttaatgccacctcgtttctgaggcacatcagaaaactggggcagattccagaaggcgagggcgctagcgagcaagggatggccaggcattctcactctggcctgcgggctggccagccaccaaaatggtag

SEQ ID NO: 235967 - DNA, 1032 bp, Artificial Sequence
  Description of Artificial Sequence: Synthetic coding sequence
atgctcctcctgaagaaacataccgaggacatttcatcagtatacgagattagggagcgtctcggaagtggcgcatttagcgaggtagtcttggctcaggaaagaggaagcgcccatctagtggccctgaaatgtatccctaagaaggcactacgcggtaaagaggccctcgttgaaaatgaaatagcagtgttgcggaggatcagtcaccctaacatcgtcgctctggaagatgtgcatgagtccccctcccacttatacctggccatggagctggtgactgggggagaattatttgatcggatcatggaacggggatcatataccgagaaagatgccagccatctggtcggccaggtgttaggcgctgtgagctacttgcattctctgggcatcgtacatcgggacctcaaacctgagaacctgctatatgcgactccatttgaggactcgaaaattatggtctcagattttgggctctctaaaattcaggccggaaatatgcttgggaccgcctgtggtactcctggttacgtggcccctgaactgctggaacagaaaccttatggcaaggcagtggacgtctgggcccttggcgtcatctcgtatattttgttatgtggttatccccctttctacgatgaaagcgacccagagctcttctcccaaatcctccgcgcatcctatgagttcgacagcccattttgggatgatatttcggagagtgccaaagacttcatccgacacctgttagagcgggatccccagaagcggtttacctgccagcaagcgctgcgccacctttggatcagcggggacacggcctttgacagagacattctcggtagtgtcagcgagcagatacgcaagaacttcgcacgcacacactggaagagggcttttaatgctaccagctttctcaggcacatccgaaaactcggccagattcctgagggagaaggagcatccgaacaggggatggctcggcactctcactccggactccgagcaggtcagcctcctaagtggtag

SEQ ID NO: 235968 - DNA, 1101 bp, Artificial Sequence
  Description of Artificial Sequence: Synthetic coding sequence
atgttgcttttgaagaaacatacggaggacatctcctccgtttacgagatccgggaacggctgggctcaggcgcattttccgaagtagtgctagctcaagaacgcggaagcgcccatttggtcgccctgaaatgcatccctaagaaggccctgagaggcaaggaagcattagtggagaacgaaatagcagtgctgaggcgtatttcacatcctaatattgtggctctggaagacgtgcacgagtctccctcacacctgtatttggccatggagctcgttactggcggtgaactgttcgacagaatcatggaaagaggttcctacacagaaaaggacgctagccatctggtggggcaggtgctgggcgcagtgtcttacctgcactccctggggatcgtgcaccgggacctgaagcccgaaaatctcctgtacgcaactccttttgaggacagcaaaatcatggtttctgattttggtttgagcaaaatccaagcgggaaatatgttgggtactgcctgcggcacccccggatatgccgaacccgtgactctgagtggaatggcggcatgtgtccccgtcagagcttccgtctgcctctggccacccgctccagaactgctggaacaaaaaccttatgggaaagcagtggacgtctgggccctgggggtcatttcatatatactgctgtgtggatacccacccttctacgatgagagcgaccccgagctgttctcccaaattctgcgtgccagttatgaatttgatagcccattctgggatgacatttctgagtcagctaaagatttcatccgacatctcctcgagagagatccccagaagagatttacatgccagcaagctcttcggcatctttggatctcaggagacacagcctttgacagggatatattgggcagcgtcagcgagcagattagaaagaatttcgccagaactcactggaagcgggctttcaacgcaacatctttcctgcgccatattaggaagctggggcagataccagaaggcgagggcgctagcgaacaaggaatggccaggcactcccattccgggctccgcgcaggacagccaccgaagtggtag

SEQ ID NO: 235969 - DNA, 132 bp, Artificial Sequence
  Description of Artificial Sequence: Synthetic coding sequence
atgctgctgctgaagaaacatacagaggatatctccagcgtgtacgaaatccgcgagcgcttaggatccggcgcattttccgaggtggttctggctcaggagagagggagcgctcacttagtcgccttgtag

SEQ ID NO: 235970 - DNA, 675 bp, Artificial Sequence
  Description of Artificial Sequence: Synthetic coding sequence
atgctcttactgaaaaagcataccgaagatatttcatccgtgtacgagattcgcgagcgtctgggcagtggggctttcagtgaggtggtgctcgcgcaagaaagaggttctgctcacttagtggccctgaaatgcatccctaaaaaagccctgcggggtaaggaggcactagtggagaacgagatagctgtgctgaggcgaatctcccacccaaatattgtggccctggaagacgtccacgagagtccctctcatctttacctggccatggaattggtcacaggcggtgaattgttcgacaggatcatggaaaggggatcttataccgaaaaggatgcatctcacctcgttggccaggtcctgggcgcagtctcatacctgcactccctgggtatcgtgcatagggacctgaaacctgagaatctcctgtacgccaccccgtttgaagactctaagatcatggtttccgatttcggactgtccaaaatacaggccggtaacatgctgggcaccgcatgtgggacaccgggatatgttgctccagaactgctggagcagaagccctatggcaaagcagtggatgtgtgggctctgggtgtgatatcatatattctgctgtgcggctatcctccattttacgatgaatcagaccctgaattattttctcaaatttag

SEQ ID NO: 235971 - DNA, 132 bp, Artificial Sequence
  Description of Artificial Sequence: Synthetic coding sequence
atgctgctgttgaaaaagcacaccgaagacatttcttcagtgtatgagataagagagcgactgggctctggcgcattttctgaggtggttttggcccaggaaagggggagcgctcacctagtggcactgtag

SEQ ID NO: 235972 - DNA, 132 bp, Artificial Sequence
  Description of Artificial Sequence: Synthetic coding sequence
atgcttctccttaagaaacataccgaagatattagcagcgtgtacgaaatccgcgaaaggctgggatcaggagctttctctgaggttgtgctggcacaagaaagaggctcagcccacctggtggcgctctag

SEQ ID NO: 235973 - DNA, 261 bp, Artificial Sequence
  Description of Artificial Sequence: Synthetic coding sequence
atgctgctgctaaaaaaacatacagaagatataagcagtgtgtatgagattagggaaagactggggtcaggggctttctccgaggttgtgttagcacaggaacgtggatccgcacatctagtggcgctgaagtgcattcctaagaaggccctgcgagggaaggaagctctagttgagaacgagattgctgtgctgcggaggatatcacacccaaacatcgtcgcgcttgaggacgttcatgagagtccttcccacttgtag

SEQ ID NO: 235974 - DNA, 246 bp, Artificial Sequence
  Description of Artificial Sequence: Synthetic coding sequence
tgaatatctggtgacacagcatttgatagggacattcttggatctgtttccgagcagattagaaaaaactttgcccgaactcactggaaacgtgcttttaatgcaaccagtttcctgaggcatatccgcaaactggggcagataccagagggggagggggcttctgaacagggtatggcgcgacacagccacagcggtggccctcagggtctttccttcctccacgggtgctgcgtgctgcggtag

SEQ ID NO: 235975 - DNA, 681 bp, Artificial Sequence
  Description of Artificial Sequence: Synthetic coding sequence
atgctgttactgaagaagcacacggaagatatttcgtccgtgtatgaaattagggaaaggcttggcagtggtgcattctctgaggtggtgctcgctcaggagcgcggtagcgctcatttggttgcattgaagtgcatacccaagaaggcactcaggggaaaagaggccctggttgagaatgagattgctgttttgagaagaatatctcaccccaacatcgttgcactggaggacgtgcatgaatctccatctcacctgtaccttgccatggaactggttacaggaggcgaactttttgaccgaatcatggaacggggttcctacaccgagaaggatgctagtcacttggtcggccaggtgctgggagccgtgagctacctgcatagcctaggcatagtgcatagggatctgaaaccggaaaacctgttgtatgcgacaccatttgaggattcaaagatcatggtatcagatttcgggctctctaaaatccaggctggaaacatgcttggtaccgcgtgtggcactcccggatatgtcgcacctgaactcctggagcagaagccttacggtaaggctgtggatgtctgggctcttggcgtgatctcttacatccttctctgcggttatcccccattttacgacgaaagtgatcctgaacttttctcacaaatccttagatag

SEQ ID NO: 235976 - DNA, 1281 bp, Artificial Sequence
  Description of Artificial Sequence: Synthetic coding sequence
atggaggcagctttcggtcaggtggctggttccgcttgtccccgacggggaggagagggcagggactggaaggcagaaagcttggcagatttatggcccaagtcttcacccggagattctcaccgttggtgtaaggggccaggagctggaccagccggaccccagttgcgggaagctgcccgagcgtcgtcggggttgggcggtggaggtcgtcatccctctcgtatacccgctattgctctccaggatatgttgcttcttaagaaacacactgaggacatcagcagtgtgtacgagatccgcgagagactgggaagtggcgcattctctgaagtggtgctggcgcaggagcgcggttccgcacatctggtagcactgaaatgcattccaaaaaaggctttacgcggtaaggaggccctcgtggaaaatgagattgctgttctccgcaggatctctcatccaaacatcgtcgcccttgaggatgtccatgagtctccctcacacttgtacctcgctatggagctggtgaccggaggcgagctgtttgatagaatcatggagcgtggatcttacaccgagaaagatgcttcacacctcgttggacaggtcctgggggcagtgagttatcttcacagcctcggtatcgtgcaccgcgacctaaaaccggagaatttgctttacgccacaccctttgaagactcgaagattatggtttcggacttcggcttgagtaagattcaggcagggaatatgctgggaactgcatgtggcaccccgggatatgtagccccagagctgctggaacagaagccttatggtaaggccgtggacgtctgggccctgggggtgatcagctatattctcttatgtggataccctccattttacgacgaatccgaccccgagctgtttagccagatcctgagagctagttacgaattcgatagtccattctgggacgatatttccgaaagcgctaaggatttcattagacaccttctcgagcgcgatccgcaaaagcgctttacatgtcagcaggccttgaggcacctgtggatatccggagacacagcctttgatcgggacatattgggctccgtgagtgagcaaatcaggaagaatttcgccagaacccactggaaacgtgctttcaacgccaccagctttctgcgccacatccgcaagctgggccaaattcccgaaggggagggcgcatccgagcagggaatggcacggcatagccactctggcttgcgagcaggccagcccccaaaatggtag

SEQ ID NO: 235977 - DNA, 132 bp, Artificial Sequence
  Description of Artificial Sequence: Synthetic coding sequence
atgctgctgctcaaaaaacacaccgaagacatcagctcagtgtatgagatacgcgagcgcctaggaagcggcgcattcagcgaagtcgtattggcccaggagagggggtccgcacatctggtggccttatag

SEQ ID NO: 235978 - DNA, 4883 bp, Artificial Sequence
  Description of Artificial Sequence: Synthetic coding sequence
atgcggttgtggtcatgggtcctgcaccttggattgctgagtgcagccctcgggtgcggcctggcagagcgtcccaggagggcacggagagatcctcgcgctggtcggccaccaaggcctgcggctggccctgccacttgtgcaactcgcgctgctagagggcgacgagcatctccgcctccacctccgccacctggaggggcttgggaggcagtgcgagtgcctaggcgcaggcaacagcgggaggccagaggcgcaacagaagaaccctccccaccgagtcgggcactgtacttcagtggacggggagagcagctccgactgagagcagatctagaactgccgagggatgcctttacactgcaggtttggttgagggcagagggaggtcagaggtcacccgcagtgataactggtttgtatgacaagtgtagctacatctcccgggataggggctgggttgttggtattcacactatttcagaccaggataacaaggatcccagatacttcttctcgcttaaaaccgatcgggctaggcaggttactacgattaacgctcacagatcatatctacctggacagtgggtgtatttagctgccacttacgacggccaatttatgaagctttacgttaatggggcacaggttgcaacctccggggagcaggtgggcggtatcttcagcccgctcacacagaaatgtaaagtcctgatgctggggggttccgcactcaaccacaactacagggggtacattgagcacttttctctgtggaaggtcgctaggacacagcgagaaattctctcagatatggagacgcacggcgcacacactgccctgcctcagctgctgctacaagagaactgggacaatgtgaaacatgcctggtcacctatgaaggacggctcctctccaaaggttgagttctccaatgcccacggatttttgctggacacctcactggagcctcccctctgcgggcagaccctgtgcgataatacggaggtgattgcctcctataaccaattgagctctttcagacagccaaaggtggttagataccgtgtggtaaacctttacgaagacgatcataaaaaccctaccgttacacgggagcaggttgacttccagcaccaccagctggctgaagctttcaagcaatataatatttcttgggaactagatgtactggaggttagtaactcttccctccgccgaaggctgatacttgctaattgcgatatatctaagattggagatgagaattgtgatcctgagtgtaatcatacccttacaggccacgatggcggagattgccggcatctccggcatccagctttcgtgaagaagcaacataacggagtgtgcgacatggattgtaactatgaaagattcaactttgacggtggcgagtgctgcgaccccgagattactaacgtgacacagacctgctttgatccagactcgccccacagagcctacctggacgtaaacgaacttaagaatatcctgaagctcgacggcagtacccatctaaatattttcttcgcaaaatctagcgaggaggagttggctggtgtcgctacctggccctgggacaaggaagctctcatgcatttgggtggcattgtcctgaatccttctttctatgggatgccaggccacactcataccatgatacatgagatcggtcactccctagggctgtatcacgtgttccggggaataagtgaaatacagagctgctcagacccctgcatggaaactgagccttcctttgaaacgggagacttgtgtaacgacaccaatccagcccctaagcataagtcttgtggagaccccggtccgggaaatgacacatgtgggtttcacagtttttttaacaccccctacaataatttcatgtcttacgccgacgacgactgcacagattcttttactcctaaccaggtcgctaggatgcactgttacctagacctcgtgtaccagggttggcaaccatctaggaaaccagccccagtggccctggcccctcaggtgctcggacatactaccgattccgtcactctcgagtggtttcctccaatcgacgggcacttctttgagcgagaacttggctctgcctgccacctttgccttgaaggcaggatcctggtgcagtatgcaagcaatgccagcagccccatgccatgttcccccagcggacactggagcccaagggaggccgagggccatcccgatgtggaacagccatgcaaatcctccgtgcggacttggagccccaactcggctgtgaacccacacacagttccacctgcttgcccggagccccaaggatgttacttggagctggaattcctgtacccactggtgccagaaagccttacgatttgggtgacttttgtctcaacagactgggattcctccggcgcagttaatgatattaaacttttagctgtgagcggaaagaacatctctcttggacctcagaacgtattctgcgacgtcccactgacgatccgcctttgggacgtgggcgaggaggtctacggaatacaaatatatacactggatgagcacctggaaatcgacgccgcaatgcttaccagtactgccgataccccactgtgccttcagtgcaaacccctaaagtataaagtggtcagagatcctccactacagatggacgttgctagtatcttgcacctgaatagaaaatttgtcgatatggatctaaaccttggaagcgtgtatcagtactgggttattactatctcagggaccgaggaaagtgagccctctcctgccgttacgtacatccacggcagcggctactgtggcgatgggattatccaaaaggaccagggtgaacagtgtgatgacatgaacaagattaacggggacggatgttccctgttctgcagacaggaggtgagttttaactgcatcgatgagccctcaagatgctattttcatgatggcgacggggtttgcgaggaatttgaacagaagacatcaattaaggattgtggagtgtacaccccacagggtttcctggaccagtgggccagcaatgccagcgtgtctcaccaagaccagcaatgtccaggttgggttatcatcgggcagccagctgcaagccaggtctgtcgcaccaaagtcattgatctttccgagggaatttcgcagcacgcatggtacccctgcactattagttatccttattcccagctcgcccagacaaccttttggttaagagcctacttctcccagccaatggtggctgccgcagtaattgtacacctggttactgatgggacctattacggagaccaaaaacaggaaacaatctccgttcaactgctggacactaaagatcagtctcatgacctgggtctacatgtcctctcctgtaggaataatcccttgatcatacccgtcgtgcacgatctcagccagcccttttaccacagccaggctgtgagagtcagcttttcaagccccctcgtagccatttctggagtcgccctccggagtttcgacaactttgatcccgtaacgctgagtagctgtcagaggggcgagacctactcacctgccgagcaatcatgcgtccatttcgcatgtgaaaaaaccgactgccctgagctggccgtggagaacgctagtcttaattgttcctccagcgaccgctatcacggtgctcaatgtacagtctcatgtcgtacaggatatgttctgcaaatccggagagatgatgagctgataaagagtcaaacgggaccttcagtgacagttacgtgtaccgaagggaagtggaataagcaggttgcatgcgagcctgtggactgttctatccctgaccaccatcaggtatacgcagcctctttttcctgcccagaaggcaccacctttggcagccagtgctctttccagtgccgacaccccgctcagctcaaaggtaataactcacttctgacctgcatggaagatggcttatggagtttcccagaagcactgtgtgagttgatgtgtctggctcccccacctgtccccaacgccgaccttcagacggccaggtgcagagagaacaagcacaaggtcggctctttttgcaaatacaaatgtaaacccggatatcacgtcccaggaagttctaggaaatctaagaagcgggcttttaaaacacagtgtacccaggatggttcttggcaggaaggagcatgtgtgcctgttacctgcgacccaccccctcccaagttccacggcctctaccaatgcactaatggtttccaatttaactcggagtgccgcatcaaatgtgaggattcagatgccagtcagggattaggaagcaacgtgattcactgccgcaaagatggcacatggaacggctcattccacgtatgccaggagatgcaggggcagtgctctgtgccaaacgaacttaactctaatctcaaacttcaatgtcccgatggctacgctattggatccgagtgcgcaaccagttgcctggaccataactccgagagcatcatcctcccaatgaatgtcaccgtgagagacataccccactggctcaaccctacccgggtagaacgtgtggtgtgcactgcagggctgaagtggtatccacatcccgctttgatacactgcgtaaaaggctgcgaacctttcatgggtgacaattattgtgacgccatcaataaccgggcattttgcaattacgacggcggagattgctgtactagtacagtgaaaaccaagaaagtgactcctttcccaatgagctgcgacctacagggagattgcgcctgccgcgacccacaagctcaggaacactcccgtaaggatttgcgtggatacagccatggata

SEQ ID NO: 235979 - DNA, 1701 bp, Artificial Sequence
  Description of Artificial Sequence: Synthetic coding sequence
atggactgtaattatgaacgcttcaattttgacgggggagagtgctgtgatcctgagataacgaatgtaacgcagacgtgttttgatccggattcgcctcacagagcctacctggacgtgaacgagctcaaaaatatactgaaactggacggctcgactcacctgaatatattcttcgctaagagttccgaggaggaattggctggggtggcaacctggccatgggacaaagaggcacttatgcaccttgacgatgattgcacggattccttcacacctaaccaagtggctagaatgcactgttacctggacctagtctatcagggatggcagccatctaggaagccagctcctgtggccttggctcctcaggtgctcggccataccacagactctgtgacactggaatggttcccccctattgacggtcactttttcgagagggagctggggtccgcatgccacctctgtcttgaggggagaatactggtccaatatgccagcaatgccagttctccaatgccatgcagcccctcaggacattggtctccaagggaggcagagggccacccggatgtggagcagccatgcaaatcttccgtgaggacatggtccccgaactccgccgtgaatccacatactgtgcccccagcctgcccagagccgcagggttgctacctagagctggagttcttgtatcctttagttccagaaagcctcaccatctgggtaacattcgtttctaccgattgggactcatctggggcagttaacgatataaaactcctggcggtaagtggaaagaatatatcactcggtcctcagaatgtcttctgcgatgtcccactcactattcggctgtgggatgtcggcgaggaagtgtacggcatccagatatacactcttgacgagcacctggagatcgatgccgcaatgctgacctctacggctgacactcccctgtgtctgcagtgcaaacctctgaaatataaggtggtgagggatccacctttgcagatggatgtggcttcaattttgcatctcaaccgcaagttcgtggacatggatttaaatctgggctcagtgtaccagtactgggtaatcacaatttctggtaccgaggagtcggagccttctcccgcagttacatatatacacggcagcgggtattgtggcgacgggatcattcagaaagaccagggggaacaatgtgacgacatgaataaaataaacggggacggctgcagcctgttctgcaggcaggaggtgtcctttaactgcattgatgagcccagtcgctgctacttccatgacggcgatggagtgtgcgaggagttcgagcaaaaaacctctataaaagactgcggagtgtacactccccaaggcttcctggaccagtgggcctcgaacgctagtgtgtcccaccaggatcagcaatgtccgggttgggtgatcataggccagcccgctgcctcccaggtctgccggaccaaggtcatagatctctccgagggaataagtgcttgcctcgtgcctctgcaccaccagctacctattttcccagccggtagtgatcattttcttgctccaggcgtgttttttagtacaaatggctgccggtcctgtcattgcccgcctggggatgggtgggacatcttgtggggacccaaagccggtgaccatcagcgggcagctgcttag

SEQ ID NO: 235980 - DNA, 1998 bp, Artificial Sequence
  Description of Artificial Sequence: Synthetic coding sequence
atgaacaagataaacggagacggctgctctcttttctgtcgacaggaggtcagcttcaattgcatcgatgagccgtcacggtgctatttccatgacggagacggagtttgtgaggagttcgagcagaagacttctattaaggactgcggcgtgtacacacctcagggcttccttgatcagtgggcctctaatgccagcgtttctcatcaggatcaacagtgtcctggctgggttattattgggcagccagctgcctctcaagtctgtcggacgaaggttattgatctgagcgaggggatctctcagcacgcatggtatccttgcacaataagttacccctattcccaactggcccagacaaccttctggctgcgggcttacttcagccagcctatggtagctgcggcagtgattgtccatctcgtgactgatggcacgtattacggagatcagaagcaggagactattagcgtgcagcttctcgacaccaaggaccagagccacgaccttggactgcatgtactgagctgcaggaacaacccactgatcataccggtcgtgcatgacctgtctcagccgttctatcactctcaggcggttcgggtgtctttctcctctcctttggtcgctattagcggagtcgctctgcggtcattcgacaattttgaccccgttacactgagctcatgtcagaggggggagacctacagcccggctgaacagtcttgcgtgcatttcgcatgcgaaaaaacagattgtccggagctggccgtagaaaatgcttccctaaactgtagctcatccgacaggtatcatggcgctcagtgtacagtttcttgcagaacaggctatgtgcttcagatcaggagggatgacgagctgatcaagtcccagactggcccaagtgtaaccgtgacctgcactgaaggcaagtggaacaaacaggtcgcctgcgagcccgttgattgcagtattcccgaccatcatcaagtttacgcagctagtttctcttgtcccgaaggtaccacttttggaagccagtgttccttccagtgtcgtcatcctgctcaacttaagggaaacaatagtctcttaacctgcatggaagacgggctgtggagctttcccgaagctttgtgtgagcttatgtgcctggcgcctcctcccgtgcccaacgcagacctgcagaccgcccgatgtcgtgaaaacaaacataaagttggatcattttgtaagtataaatgcaagcccggatatcatgttccgggaagctcaaggaagagcaaaaagcgagccttcaaaacgcagtgcacacaagacggatcatggcaggagggagcatgcgtgcctgtcacttgtgatcctcccccacccaagttccatggcttgtaccagtgtacaaacggcttccagttcaattccgagtgcagaatcaaatgtgaggacagcgatgcttctcaggggctgggtagtaatgtcatacattgtcgtaaggatggcacatggaatgggagcttccacgtctgccaggagatgcagggtcagtgttccgtccccaatgaattgaacagtaatcttaagctgcagtgtccagacggctatgccatcggaagcgaatgtgccacatcttgtcttgatcacaattctgaatcaatcatcctaccgatgaatgtcaccgtaagggacatcccacactggctgaacccaaccagggtggaaagagtcgtttgtaccgccggtctcaaatggtatccacatcccgctctgattcattgtgtcaagggttgtgaaccctttatgggggataactactgcgatgctataaacaaccgcgctttttgcaattacgacggaggggattgttgcactagtacagtgaaaaccaaaaaggtaaccccttttcctatgtcgtgcgatcttcagggtgattgcgcatgcagggacccgcaggcccaggagcattcgagaaaggatctgcggggttattctcacggatag

SEQ ID NO: 235981 - DNA, 4449 bp, Artificial Sequence
  Description of Artificial Sequence: Synthetic coding sequence
atgagaaaggaccgactgttgcacctttgcttggtcctgttactcatcctcctgtccgcatccgattctaattcaacagaaccccagtatatggtgttagtcccgtccctgctacacacggaagcaccgaagaaaggatgcgttcttctttcccatcttaacgagacagttaccgtatctgctagcctcgagtccggtagggagaatagaagtctcttcaccgatctcgtggccgagaaggatctgttccattgtgtatcattcactctgcccagaatctctgcttcgagcgaggtggctttcctgtccatacagattaaaggacctactcaagatttccggaagaggaatacagtgctggtgctcaatacacagtcgctggtgttcgtgcagacagataaacccatgtataaaccaggtcagacagtgcggttccgcgtcgtgtcagtagacgaaaattttcggcctagaaacgagctgatcccccttatttatctagagaatcccagacggaacagaatcgcccagtggcagtccttgaagctcgaggccggaatcaaccagcttagtttcccattgtcttctgaaccaatacaggggtcttacagagtggtggttcagacggagtctggcggtcgcatccaacacccttttaccgtggaggagttcgtcctgccaaaatttgaggtcaaggtccaggtaccaaaaattatctcaattatggatgagaaggtgaacatcaccgtgtgcggtgagtacacatacgggaaaccggttccaggtctagcgactgtgagtctgtgccgtaaactttctagagtgctgaattgtgacaagcaagaggtgtgtgaggagttctcccaacagctcaatagtaatggatgtatcacccaacaggttcacaccaaaatgctgcagataaccaatacaggttttgaaatgaaactgcgcgtggaggcacgcattcgtgaagaaggcacggacctcgaggtgacggcaaatcgaatttcagaaattacaaacatagtgagcaaacttaaattcgtgaaggtggatagccacttcagacaagggattccgttcttcgcacaagtgttgttggtcgacgggaaaggagtgcctatacccaacaagcttttctttatttctgtcaacgatgctaactactacagcaatgcaacaactaacgaacagggcctcgctcaattctccattaacacaacgtccatctccgtcaacaagctgtttgtcagggtcttcaccgtccatccgaatttgtgtttccactatagttgggtggcggaagaccaccagggcgctcagcacaccgcaaatagagtattctccctcagtggatcatacatccatcttgagccagtcgccggtaccctgccctgcggccatactgagactattactgctcactacactctgaatcgacaggccatgggcgagctatctgagctcagctttcattacctgatcatggctaagggggtgattgtcaggtccggcacacataccttgcccgttgaaagcggagatatgaagggaagctttgcgctttctttcccagtcgagagcgatgtcgcaccaatcgcgagaatgtttatttttgccatcctccctgacggagaggtagtcggtgactcagagaagtttgagattgaaaactgccttgccaacaaagtggatctcagcttctctccggcacaatccccaccagcaagccacgcacacctgcaggttgctgccgcaccacagtccctttgcgccctgagggcagtggaccagtcagtgttgctgatgaaacccgaagcggaattgtccgtttccagcgtgtataatctgctaacagttaaagatttaaccaattttcccgataatgtcgatcagcaggaggaggaacagggccattgtcctagacccttctttattcataatggagccatttacgtgcctttgagctccaatgaagcagatatttacagctttctgaagggtatgggactgaaggtgttcaccaatagcaaaatccgcaagcccaaaagctgtagtgtgattccatctgtcagcgctggggcagtcggccaggggtactacggagcaggtctgggtgtggtcgaacgaccatacgtgcctcagctaggcacctataatgtgattccccttaataacgaacagagctcaggtcccgtcccagagaccgtgcgcagctattttcccgaaacctggatctgggaactcgtcgctgtcaacagtagcggcgtggcagaagtcggagtgactgtccccgatactattacggagtggaaagcgggagcgttctgtttgtccgaagacgccggactgggcatcagcagcaccgcctctcttcgagcattccagcctttcttcgtggagctgacaatgccttacagtgtgatccgaggagaggtgttcactctgaaggccacggtcttgaattacctgcctaagtgcattagagtcagcgttcagctgaaggctagccctgcatttttggcctcccagaacaccaagggggaggagtcctattgtatctgtggaaatgagaggcagactctctcctggaccgtgacgcctaaaacactgggcaatgtgaactttagcgtgtccgcggaggccatgcagagtctagaactgtgcgggaacgaggtggtcgaggtgccggagattaaaagaaaggacacagttatcaagacactgttagtcgaggccgagggcatcgagcaggagaagaccttctcctcaatgacttgcgcatccggcgcaaatgtctccgagcagttgagcctcaagttgccctcgaacgtggtgaaggaatccgctagagcctcattcagtgtgcttggggatattctgggcagcgccatgcaaaatatacagaaccttcttcagatgccttacggttgcggagagcagaacatggtgctgttcgcgcctaatatatacgtattaaattatttaaatgagacccaacagttgacccaggagatcaaagccaaggccgtaggctatctgataaccggctaccagcggcaactcaattacaagcaccaggatggctcatattcaacattcggcgagcgatatggacgcaaccaagggaatacatggctcacagcatttgtattgaagacttttgctcaagcacgctcttacatatttatcgacgaggcacacataacacagagtctgacttggctatctcagatgcagaaagataacggatgtttccgaagctccggctcactgttaaacaatgctattaaaggaggtgtggaagacgaagccacgctgtccgcttatgtgacaatagcccttctcgaaattcccctgcccgtaactaatcctatagtgaggaacgccctgttctgcctggagtccgcttggaatgttgccaaggaggggacccacggcagccatgtctacaccaaagcactgctggcatacgcattctccttgctagggaaacagaatcaaaatagggaaatcttgaattcactggacaaagaggctgtcaaggaggacaatctggtgcactgggagaggccccagcggcctaaggcccctgtgggccatctgtaccagacccaggcacccagtgccgaggttgaaatgacatcctatgtgttgttggcctacctgaccgcccagccagccccaacgagtggtgatctgacgtcagccactaacatcgtgaagtggattatgaagcagcagaatgctcagggcggtttcagctcgacacaggacacggtggttgcgctgcacgcactgagccggtacggtgctgctaccttcacccgtacagaaaagaccgcccaagttactgtgcaggactcgcagaccttcagtacaaacttccaggtggataacaataacctgttgctgctccagcagattagcctgcccgaattaccaggggaatacgttatcacagttaccggggagcgatgcgtctatctgcaaacctccatgaagtacaatatcctgccggaaaaagaagactccccattcgcacttaaagtgcaaaccgtgccgcagacctgcgatggccataaggcccatacatctttccaaattagcctgactatttcctacacaggcaatcggcctgcgtcaaatatggtgatcgtggacgtgaaaatggtctctggtttcatcccgcttaagccaactgtgaagatgttagaaagatcctcctctgtcagccgaaccgaagttagcaacaatcacgtccttatttacgtcgaacaggtcaccaatcagacgctgtcattcagctttatggtgctgcaagatatcccagttggagacctgaagccagccatagtcaaggtgtatgattactacgagaccgacgagtcagtggtcgccgagtatattgctccatgtagcacagatacagagcacggcaatgtttag

SEQ ID NO: 235982 - DNA, 3807 bp, Artificial Sequence
  Description of Artificial Sequence: Synthetic coding sequence
atgagcgagagctaccgtcgcacaactttccccgtacggtttagggttgtgagcgtcgatgagaacttccgccctcgaaatgaactgatccctctgatttacttggagaaccccaggagaaatcgtatagctcagtggcaaagcctgaaactggaagctggtatcaaccagttgtctttccccctgtcttctgagcctatccagggctcttatagggtggtcgtgcagacggaatccggtggacgtattcagcacccatttacagtggaagaattcgttctgccgaagttcgaggtgaaagttcaagtgcctaaaatcatcagtattatggacgagaaggtgaacatcactgtgtgtggagaatatacctacgggaagcccgtccccggactggcaactgtgtccctatgccgcaagctctccagggttttgaactgcgataagcaggaagtatgcgaggagttcagtcagcagttgaatagtaatggatgtattacgcaacaagtgcacactaagatgctgcaaatcacaaacaccggatttgagatgaagcttagagtggaggctagaatccgggaggagggaacagatttagaagtcaccgccaatcgtatttctgagatcacaaatattgtgagcaagttgaagttcgtaaaggtagatagtcactttcggcaaggtatacctttctttgcacaagtgctgctagtggatggaaaaggagtcccaatacccaacaagctcttttttatatccgtgaatgatgctaactactactccaacgccaccacaaatgaacagggcctggcccagtttagtatcaacaccactagtatatccgtgaataaactgttcgtccgcgtattcacggtgcatcccaatctgtgttttcactattcgtgggtggccgaagaccaccagggtgcgcagcacactgccaatcgtgtgttctcactgagcgggtcctacatccatttggagccagtcgctggtaccctcccctgcggccacaccgagactattaccgcacattataccttaaacaggcaggcaatgggagagctgtccgaactgtcatttcattacctcatcatggctaagggggtgatagtgcggagtggcactcacacactgcctgttgagtcaggagacatgaagggtagtttcgctctttccttccctgtggagtccgatgttgcacctatagccagaatgttcatttttgcaattttgcccgatggtgaagtggtcggagatagcgagaagttcgaaattgagaactgcctggccaacaaggtggacctttctttcagcccagctcagtccccacccgctagtcacgcccacctgcaggtggccgctgcccctcaatctctgtgtgccctgcgtgcagtcgatcagagcgtccttctgatgaagccagaggccgagctctcagtcagtagcgtctataacctgctcacggtcaaggacctgaccaactttccagataacgtggaccaacaggaggaggagcagggtcactgcccacggccatttttcatacataatggtgccatctatgtgcctctttcctcgaatgaagcggatatttactcctttttaaaaggcatgggactcaaggtttttactaattctaagattagaaagccgaaatcctgctctgtgatcccaagcgtgtctgccggtgctgttgggcagggttactacggagcaggtctgggcgtagtggagagaccatatgtgccacaactgggcacctataacgttattcccctgaacaatgaacagtctagcggccctgtcccggagacagtacgctcttacttccccgagacctggatctgggagttggtggccgtcaatagctctggtgtggctgaggtgggcgtgacggtacccgatactatcactgagtggaaagccggagccttctgcctctctgaagatgcgggactcggcatctcgtcaacggccagcctccgtgcctttcagccttttttcgtggagttgacaatgccttattcggtgattcggggagaagtgtttacgttgaaggcgacagttctgaactacctgccgaaatgtattcgcgcagaaggcattgaacaggaaaaaaccttcagttctatgacttgtgcgagtggggcaaatgtgagcgagcagctcagcctgaagttacctagcaacgtcgttaaagagagcgcacgagccagcttttctgttctgggcgacatcctgggatccgctatgcaaaatatacagaatcttctgcagatgccttacggatgtggagaacagaacatggtgctgtttgccccaaatatctacgtactcaattatctcaacgaaactcagcaattgacccaggagattaaggcaaaagccgtaggataccttatcactggctaccaaaggcagcttaattacaagcaccaggatgggtcttatagcacattcggcgagcgatatgggaggaaccagggtaatacttggctcaccgcctttgtgctaaagacatttgcgcaggccaggagttacatcttcattgacgaggcacacattactcagagcctcacatggctgagtcagatgcagaaggacaatggctgctttagaagttcaggcagcttgctgaataacgcaattaagggcggtgtagaagacgaagccaccctcagtgcgtatgtgactatcgctctcttggagataccgctgccagttacaaatccaatcgtacggaacgctctcttctgcctggagagcgcatggaacgtggccaaagagggtacccacggtagtcatgtgtatactaaagcactgctggcttatgcatttagcctccttggcaagcagaatcagaaccgggagatcctgaattcgctggataaggaggccgtcaaggaagacaacctggttcactgggaacgtcctcagcggcctaaggccccagtgggtcatctatatcagactcaggccccttccgccgaggtagagatgacttcatacgtactgctggcctatctgactgctcaacccgctcccacgagcggggatctgacctctgccaccaatatcgttaaatggatcatgaagcagcagaacgcccagggcggattcagctcaactcaggatacagttgttgccctccatgccctcagccggtatggtgccgctacttttactcgcaccgaaaagaccgcgcaggtcaccgtgcaggactcccagaccttcagcactaacttccaagtggataataataatctcttactccttcagcagatctccctgccggaattgcctggggagtacgtgattacagtgacaggcgagagatgtgtttacctgcaaacttcaatgaaatacaacatactccccgagaaagaggatagcccctttgctctgaaagtccagaccgtgccacagacctgcgacgggcataaggcccacacttcttttcagatctcactcaccattagctacacgggaaatagacccgcttctaatatggtgatcgtcgacgttaagatggtctccggattcatccctctgaaacctaccgtgaagatgctggagcgctcgtcaagcgttagcaggaccgaggtttccaataaccacgtactgatttacgtggagcaggtgacaaaccaaacactctctttttctttcatggtcctccaggacatccctgtgggagacctaaaaccagctattgttaaggtctacgattactacgagacagacgagagtgttgtggcagaatacatcgccccttgttctaccgacacagagcatggcaacgtgtag

SEQ ID NO: 235983 - DNA, 660 bp, Artificial Sequence
  Description of Artificial Sequence: Synthetic coding sequence
atggtgaaatactttcttggccagagcgtattacgatcctcttgggatcaagtgtttgcagcattctggcagaggtacccaaacccgtactccaagcacgtgctgaccgaggatatcgtacaccgagaggtgactcctgaccagaaactgttaagccggcgtttgcttactaaaaccaacaggatgcctcgctgggccgagcggctgttccccgctaacgtcgcacatagcgtttacgtgcttgaggatagcatcgttgatcctcagaaccagaccatgacgacattcacctggaatattaatcatgctcggctgatggtggtggaagagcgctgtgtttattgtgttaattccgataatagcggctggactgaaattcgacgcgaggcgtgggtctcgtcctcattattcggagtctctcgggcagttcaggaatttggcctggctagatttaagtctaacgtgacaaagaccatgaaagggtttgaatacatactggctaaactccagggcgaggcaccgtccaaaaccctggtggagaccgcgaaagaagccaaggaaaaggccaaagaaacagcgctagccgctacagaaaaagcgaaagacctcgcttcgaaggcagctacaaaaaagcagcagcagcaacagcaatttgtgtag

SEQ ID NO: 235984 - DNA, 1770 bp, Artificial Sequence
  Description of Artificial Sequence: Synthetic coding sequence
atgtctagtagttactggagcgaaacatcttcctcttcatgcggaacgcaacagcttcccgaagttctccagtgccagccgcagcactaccactgctaccaccagagcagccaggcccaacagccccctgaaaagaatgttgtgtatgagagggtacggacttactccggccctatgaacaaagtggttcaggctctagaccccttcaattcaagagaggtactgagtcctctcaagactactagcagctaccagaatttggtgtggagcgaccacagccaggaactccacagtcccactttgaagatctcgacctgcgcacctagcacccttcatatcacacagaataccgaacaggagctgcattcccctactgtaaaattaacaacctaccctcagactaccatccgcaagtacgttgtacagaaccctgaacaagaacctctgtctcaattcctcaggggatcccatttcttcccagggaacaatgtaatatacgagaaaaccatccggaaggtggaaaagctgaacacagaccaggggtgccatccgcaagcccagtgccatcaccacataattcagcagccacaggtgattcattccgctcattggcagcagcctgattcctcacagcagattcaggccattacaggcaataatccaatttccacccatatcggaaatgaactctgccattccggatcttcacaaatatgcgaacaagttattatacaggacgacggcccagagaaacttgatccccgatattttggcgagctccttgccgacctgagtcgcaagaataccgatctgtatcactgccttctggaacatttgcagcgcatcggtggcagtaagcaggacttcgagtccacagacgagagcgaggatatcgaaagcctaatccccaagggcctgtctgagttcaccaagcagcaaatacgatatatcctgcaaatgagaggcatgagtgataagtccttgaggctggtgctttctaccttcagcaacattcgagaagagctgggacaccttcaaaacgatatgacatcgctggaaaatgataagatgaggctagagaaggacctctcatttaaggatacccagttaaaagaatacgaggagctgctcgcctcagtgcgtgcaaacaatcatcagcagcaacagggtctgcaagactcctctagtaaatgccaagcactggaggaaaacaatttgtcacttaggcatactttgtctgatatggagtatcgcctcaaagaacttgagtactgtaagcgtaacctggaacaagagaatcagaaccttagaatgcaggtgagcgagacgtgcaccgggccaatgctgcaggccaaaatggacgaaataggcaatcactataccgaaatggtcaagaatctgcgcatggaaaaagatagagaaatttgcaggctacgcagtcagctcaatcaatatcataaagatgtcagtaaacgcgaagggtcctgctcagatttccagtttaaattacacgaactgacttctctgctggaggagaaggatagcctgatcaaaaggcagtccgaggaattatctaagcttcgccaggagatctactcctcacataaccaaccatccaccggagggcgtacaacaattaccacaaaaaagtatcggacccaatatcctatccttgggttactctatgacgactatgaatatattcctccaggcagtgaaacacaaaccattgtcatcgagaagacggaagataagtacacttgcccatag

SEQ ID NO: 235985 - DNA, 921 bp, Artificial Sequence
  Description of Artificial Sequence: Synthetic coding sequence
atgtccagcagctactggagcgaaaccagttcctcttcttgcggaacacagcagctgcctgaagtacttcagtgtcagccgcagcactaccattgttaccatcaatcttcccaagcacagcagccacccgagaaaaatgttgtttatgaacgggttagaacctacagtggcccaatgaacaaagtagtacaggccctggatccatttaattctcgggaagtgcttagtcctctgaaaaccacatcatcctatcaaaaccttgtgtggtccgatcacagccaggaactgcactcgccaactctgaagatttctacgtgtgcaccatctaccctgcatatcactcaaaatacagagcaggagcttcattctccaaccgtaaagctgaccacctaccctcagaccactatacgcaaatacgttgtacagaaccctgaacaggagccactatcccagtttttaaggggctcccacttcttcccaggaaataatgtgatctatgagaagaccattcggaaagtggagaaactgaacacagaccagggttgtcacccccaggcccagtgccatcatcatataattcagcagccccaagtcatccattcagcacactggcagcagcccgatagtagtcagcagatccaggctatcaccggaaataaccccattagcacccacataggcaatgagctgtgccacagcgggtcatctcaaatctgtgaacaggttattatccaggatgatggaccggaaaagttggaccctcgatactttggcgagttgctcgccgatctgtcgcgaaagaataccgacctatatcactgccttttggaacacttacaacgcatcggcagaaagcagtcactttcttcaacttacaccattcgccatggaatccagactaaacgtacaggtattttatag

SEQ ID NO: 235986 - DNA, 1788 bp, Artificial Sequence
  Description of Artificial Sequence: Synthetic coding sequence
atgtccagcagctattggagtgagacctcgtcttctagctgtgggacccagcagctccctgaggtattgcaatgccagccccagcactatcattgttaccaccaaagctcccaggctcagcagccacccgaaaaaaatgtggtatatgagcgggttcgaacctacagcggccctatgaacaaagtggtccaggctctggacccatttaacagccgagaagtgctttcccctcttaagacaacatcctcctatcaaaatctcgtgtggtcagaccattcccaggaactccactcaccaacccttaaaatcagtacgtgtgcgccaagcacattgcacattacccagaacaccgaacaggagttgcactctccgacagtcaagttgactacatacccacagactacgatccgcaagtatgtcgtgcagaatccagagcaggagcccttgtcccaattcttgcgaggtagccacttcttccccggaaacaatgttatttatgagaagaccatcagaaaagttgagaagcttaatactgaccaagggtgtcaccctcaagcccaatgtcaccaccatattatccagcagccccaggtcattcacagcgcccactggcaacagcctgatagcagtcaacagattcaagctatcacagggaataaccctattagtacacacataggaaacgagctatgtcattcggggagttcacagatctgtgagcaagtaataattcaggatgatggaccggagaagttggatcccagatactttggcgagctgttggcagacctctcgaggaagaataccgacttataccactgcctcctggagcaccttcaaagaatagggggtagcaagcaggacttcgaatctactgacgagagtgaagatattgagtccctgattcctaagggcctgagcgagttcacaaagcaacagattcgatacatcttacagatgaggggcatgtccgataagtcattgaggctggtcctcagtacattcagcaacatccgcgaagaactgggtcatttacagaatgacatgacctcgctggaaaacgacaaaatgaggctcgagaaagatctgagcttcaaggacacacaactcaaagaatatgaagagctgctcgcaagcgtgagagcgaataaccatcaacagcagcaaggcctgcaggacagctcctccaagtgtcaggccttggaggagaataacctctctcttcgccatactctaagcgacatggaataccgactgaaagaacttgagtactgcaagcgcaatttagagcaggagaaccagaatctccgaatgcaggttagcgagacatgtacggggccaatgctgcaagcgaaaatggatgaaatcggcaatcactataccgagatggtaaaaaatctgagaatggagaaggatcgcgaaatctgcaggctgcgctcacagctcaaccaataccataaagatgtctctaagcgggagggcagctgtagtgattttcagttcaagctccacgaattgactagtctcctcgaggagaaggattccctcataaaacggcagagcgaggagctgtccaagcttaggcaggaaatttattccagtcataaccagccgagcacaggcggacgcaccactattactaccaagaaatacaggactcagtaccccatattaggtcttttgtatgatgattacgaatatattccacctggatctgagacgcaaacgatcgtgatcgagaagaccgaggacaagtacacttgcgtgagttcattggggcacttctag

SEQ ID NO: 235987 - DNA, 921 bp, Artificial Sequence
  Description of Artificial Sequence: Synthetic coding sequence
atggcaagtaggtggtggagatggaggagggggtgctcatggaagcccgcagctcgcagcccaggcccagggtcccccggaagagctggccctctggggccatcagccgctgctgaggtaagagcacaagtccatagacgaaaaggactggaccttagtcagatcccctacattaatcttgtcaaacaccttacatcagcttgtcctaatgtgtgccgcatcagccgttttcaccatactactcccgattcaaaaacccactcaggagagaagtacactgacccgttcaaactgggctggagagacttgaaaggcctgtatgaggacataaggaaggaattattgatatccacctcagagttgaaagagatgtctgagtactacttcgacggcaaaggcaaggccttccgccctataatcgtcgctctcatggcccgagcttgcaatatccaccataataacagtaggcatgtacaagcaagccaacgggctatagccctaattgctgaaatgatccataccgcttctctggtgcacgacgatgtgatcgacgatgcctccagccgtcggggaaagcacacagtgaacaagatatggggtgagaaaaaggctgtcctggcaggggacctgatcctgtcagcagcgtccattgccctcgcaaggatcggcaacaccacagtcatttccatactaacacaggtcatcgaggatctggtcaggggggaattcctgcaattgggaagcaaagaaaacgagaacgagcgcttcgcacattacttagaaaagacgttcaaaaaaactgccagcctgattgccaattcgtgtaaagccgtctttccaagaaacgagtgttacgatcatgcgaccgtccagttcgcctggcggtgtcggcagtcctcaacggtctgcaccaccgaatag

SEQ ID NO: 235988 - DNA, 1248 bp, Artificial Sequence
  Description of Artificial Sequence: Synthetic coding sequence
atggcatctcgctggtggaggtggaggagaggatgtagttggaagcctgccgctagaagcccaggtcctgggtcacctggaagggcaggccctctgggaccatctgccgcagctgaagtgcgggctcaggtccaccggcgtaaaggactggatctctcccagataccttatattaacctcgtgaaacatttaaccagcgcgtgcccaaatgtgtgcagaatctctcgctttcaccacaccacccccgactcaaaaacgcactctggagagaagtatacggaccccttcaaattaggttggagagatctgaaaggtctctacgaagacatccggaaggaattgctgatcagcacaagcgaacttaaagaaatgtccgaatattatttcgatggaaaaggcaaagcatttagacccattatcgtagcactgatggccagggcctgtaatatccaccacaataacagtagacacgttcaagcgtctcaaagagctatcgcacttatcgccgagatgatccacacagcgagcctggtacacgacgatgtgattgatgatgcaagctcccggagaggcaaacataccgtcaacaaaatatggggggagaaaaaagctgtgcttgctggcgatctgatcctctccgcagccagcatcgcactcgccagaattgggaataccaccgtaatttcaatcctgacccaggtgatagaggacctcgtgagaggagagttcctacaattaggcagtaaagagaatgagaacgaacggtttgcccattatctggaaaagacctttaagaaaaccgcatccctcatcgccaattcctgcaaggcagtgagcgtactcggatgtcccgatccggtggtacatgagatcgcctaccagtacgggaagaacgttggaattgcctttcagctcatcgacgacgtcctggactttacttcatgctctgatcaaatgggtaaacctactagcgcagatcttaagctagggctggcaacaggcccagtgctcttcgcatgtcagcagtttcccgagatgaacgcgatgatcatgagacggttcagtttgcccggtgatgttgatcgcgctcgacagtacgtcctccagagcgatggggtccagcaaactacatacctggcccagcagtactgtcacgaggctatccgcgagatcagcaaactacgcccatcacccgagcgggacgccctaatccagctgtcggaaattgttctgacacgggacaagtag

SEQ ID NO: 235989 - DNA, 1131 bp, Artificial Sequence
  Description of Artificial Sequence: Synthetic coding sequence
atgcccgcacacgtacacagacgaaagggactggatctgagtcagatcccgtatattaatttagtgaagcatctcaccagcgcatgtccaaatgtatgccggatctccagatttcatcacaccacgcctgatagtaagacccattctggggaaaagtacacagacccgtttaagctggggtggcgggacctgaagggcctgtacgaggatatacggaaagagttgttaatatccacatccgagttgaaggaaatgagtgaatactattttgacggtaaggggaaagcctttagaccaattatcgtggctttaatggcgagggcctgcaacatccatcacaacaacagcagacacgtgcaggcaagccagagagcgatcgccttaattgccgagatgattcacactgccagcttagtgcacgacgatgtcatagacgacgcatcttctcggagaggcaaacatactgtgaacaaaatctggggtgagaagaaagcagtgttggccggagacctcatcctgtcggcagcttcaatcgccctggccaggattggcaataccaccgttatcagcattctgacgcaggttatagaggatttggtgagaggcgagttcctgcaactgggatctaaggagaacgagaacgaacggttcgctcactaccttgagaaaacctttaaaaagacagcctcccttatcgccaatagttgtaaagcagtctctgtgcttggttgtccagaccctgtggtgcatgagatcgcataccaatacggcaaaaacgtggggattgcctttcaactgatcgacgacgtcctggacttcaccagttgctctgatcagatggggaaaccgaccagtgcagacctgaagctggggctggcgaccggcccagtgcttttcgcatgtcaacaattccctgagatgaacgccatgatcatgagacgcttcagtctccctggagatgtagatagagccaggcagtacgtgctacagagtgatggcgtgcagcagactacctacttggcacagcagtactgccacgaagctatcagggagatatccaagttacgcccaagccccgaacgggatgcgctgattcagttaagcgaaattgttctgacccgtgacaaatag

SEQ ID NO: 235990 - DNA, 723 bp, Artificial Sequence
  Description of Artificial Sequence: Synthetic coding sequence
atgaatttccgtcagctgttactgcacttgcctcgatatctgggtgcatcaggctcgccaagacgtctttggtggtcacctagcctagatacaatatcaagcgtcggatcatggcgcggtcggtcgtcaaagagccccgcacattggaatcaggtggtgagtgaagcggaaaagattgtgggatacccaaccagcttcatgtcccttcgttgtttactgagtgatgaactctctaatatcgctatgcaagtccgtaaactggtgggcacccaacaccctctgttgacaactgcacgcggactggtgcacgacagttggaactccctgcagctcaggggcttagtggtccttctgatctccaaggccgctggcccaagcagcgtgaacacgagttgccagaactatgacatggtgagcggaatctatagctgtcagaggtcactcgccgaaattaccgaactgatccatatcgcactgctagtacataggggtatcgtgaatctgaatgaactgcagagctcagacggcccactgaaggacatgcagtttggcaataagatcgccatccttagcggcgattttctgttggccaacgcgtgtaacggtctggccctgctacaaaatactaaaagcttttctttcaatgggccaattgctatttaccagatgggcgactgcgaaagcgcctggatccttagcaaacatccccgagccttatcgtag

SEQ ID NO: 235991 - DNA, 270 bp, Artificial Sequence
  Description of Artificial Sequence: Synthetic coding sequence
atggaacttgccaaacacgatgcggaggttcaaaatatggcctttcaatacggaaagcatatggctatgtcccacaaaataaactcggacgtgcagccatttattaaggaaaaaacatcagacagcatgactttcaacctgaattccgcacctgtggtgctccaccaggaattcctcgggagggatctttggattaaacagatcggggaaagctcctcaaccgaagtgcaacttagcaacttccagcagatgctgctgtcaacactgtag

SEQ ID NO: 235992 - DNA, 1200 bp, Artificial Sequence
  Description of Artificial Sequence: Synthetic coding sequence
atgaactttaggcagttgcttttgcatctcccaaggtatcttggagcgtcagggtcccccagacgactgtggtggagcccctccctggacactatttcttctgtgggcagctggcgtggtcgtagcagtaagtcacccgctcactggaaccaggtggtgtcagaggcagagaaaatcgtgggatatcccacaagcttcatgtctttgaggtgcctgctgtcagacgaactgtcaaacattgccatgcaggtgcggaagctagtgggaacacagcatccactactgaccacagccagagggcttgtgcacgattcatggaactcactgcaattaagaggattggtggtgctcctgatatcgaaggcggcaggaccatcctccgtgaatacctcatgtcagaattacgacatggtctccggaatttatagctgccagagatctcttgctgagattaccgagctcattcatatcgcactgctcgtacacagggggattgtaaatctgaacgagttgcaaagctccgacgggccactgaaagatatgcagttcggcaataaaatcgcaattcttagcggtgattttctcttggcgaatgcttgcaacgggctcgctctgctccagaatacaaaggtggtggagctgttggcttctgctctgatggacctggttcagggagtctaccatgaaaactccacttctaaggagtcctatatcaccgatgatatcgggatcagtacatggaaggagcagactttcttgtcccacggcgctttgctcgcaaaatcctgtcaggccgctatggagctggccaagcacgatgccgaggtccagaacatggctttccagtacggaaaacacatggctatgagccacaagatcaattctgatgtgcagccattcataaaggagaaaacatctgacagtatgaccttcaacttaaacagcgcccctgtcgtcctgcatcaggagtttctcggtcgggacctgtggataaagcagatcggggaggcacaggagaaaggacggctcgactacgcaaagctacgggaaaggatcaaagccggtaaaggagttacttctgccatcgatctgtgtaggtaccacggaaataaggcattggaggcactcgagtcctttccaccatccgaggcccgatcggcactcgaaaatattgtgtttgccgtcacaagattcagctag

SEQ ID NO: 235993 - DNA, 243 bp, Artificial Sequence
  Description of Artificial Sequence: Synthetic coding sequence
gtgcagaacatggcattccagtacggcaaacatatggccatgtcccacaaaattaattctgatgtccagcccttcatcaaagagaaaaccagtgattccatgacttttaacctaaacagtgccccagtagtgttgcatcaggaatttttggggagggacctctggataaaacagattggtgaaagctctagtactgaggtgcagctttctaactttcagcagatgttactctccacactgtag

SEQ ID NO: 235994 - DNA, 894 bp, Artificial Sequence
  Description of Artificial Sequence: Synthetic coding sequence
atgaactttcgccagctgctcctccatctgccaagatacctaggggcatcaggctcaccgcgacggctatggtggtcaccgtctctggataccatctcctcagttgggtcctggcgaggtcgcagcagtaagtcccctgcacactggaatcaagtggtgtcagaggccgagaaaatagtgggatacccaacctcgttcatgtccctgcggtgtctgctgagcgatgaactgagcaacatcgcaatgcaagtacgaaagctcgttggcacccagcacccccttctgacaaccgccagaggcctggtgcatgacagttggaactcccttcaacttcggggactggttgtgttgttgatcagcaaagcagctggaccgtccagcgtgaacaccagctgccaaaactacgatatggtgagtgggatctacagctgccagagatctttggccgaaataacagagctaatacacattgcccttctcgttcacagggggatcgttaatctgaatgagctgcagtcctctgacgggcctctgaaggatatgcagttcggtaataaaatcgctatcctgtccggtgattttctcctggcaaacgcttgcaacgggctggcccttctacaaaacactaaagtggtggagctattagcatctgctctgatggacctcgttcaaggtgtctaccatgagaactcgacctctaaagcgcaggagaagggcagacttgactatgctaagctgcgcgagaggattaaggccggaaagggagttactagcgccatcgatctatgccgttaccacggtaataaggcacttgaagctttagaatcctttccaccaagtgaagccaggagcgctttagagaatattgtgttcgcagttactcggttttcctag

SEQ ID NO: 235995 - DNA, 882 bp, Artificial Sequence
  Description of Artificial Sequence: Synthetic coding sequence
atggggagggtggtcgccgaactggtgtcttccttattgggtctctggttgctgctttgctcctgcgggtgtcctgagggagcagagctacgcgctccgcctgacaagatcgccattatcggggcagggattggagggacatctgcagcatactacctgagacagaagttcggcaaggacgtgaagatagatttattcgagagggaggaggttggtgggagactggccaccatgatggtgcaggggcaggaatatgaggctgggggatccgtcatccatcctctgaaccttcacatgaagcgctttgtgaaagatctggggcttagcgcggtacaagcatctgggggattactgggcatctacaatggcgaaaccctcgtattcgaagaatccaactggttcattatcaatgtgataaagctggtctggcgctatgggttccagagtcttcgcatgcacatgtgggtcgaagacgtactggataaattcatgagaatataccgctaccagagccacgattacgccttttcttctgtcgaaaagctgctccacgcactcggcggagacgactttctgggcatgctgaatcgtacactgttggagacactgcaaaaagcaggattctccgaaaagttccttaatgagatgattgctccagtaatgcgcgtgaactacggccagtccacagacattaacgcttttgtcggggctgtgtcactctcgtgctctgatagcggtttgtgggccgtggaagggggtaacaaacttgtgtgctcgggtctgctgcaggcatctaagtctaacctgatttccggctcagtcatgtacattgaggagaagactaagaccaagtacacagtcctgggactgtgtcctctttag

SEQ ID NO: 235996 - DNA, 1518 bp, Artificial Sequence
  Description of Artificial Sequence: Synthetic coding sequence
atgggcagggtcgtcgccgagttggtgtcttcactgttggggctgtggctgctgctctgctcatgcggatgtccggagggagcagagcttcgtgcaccacccgataaaatcgccatcatcggtgcgggaatcggaggaacctctgctgcatattatttgagacaaaaattcgggaaagatgtgaagattgacctgttcgaaagagaagaggtcgggggacgccttgccaccatgatggtgcaagggcaggagtatgaggctggcggaagcgttatccaccctcttaatttgcatatgaagagattcgtaaaagacctcgggttgagcgcagtgcaggccagtggcggtctcttgggaatttacaatggcgagaccctcgtctttgaagaaagtaactggttcatcataaacgtgatcaaactcgtttggagatacggatttcagagtctgaggatgcatatgtgggttgaagatgtccttgacaaatttatgcggatttaccgatatcagtctcacgactatgcattcagctctgtcgaaaagctcctacacgccttgggcggagatgacttcttgggcatgctgaatagaacactcctcgagacactacaaaaggctggcttcagcgagaagttcttgaatgaaatgatcgccccagttatgagagttaactatggccaaagcacagacatcaacgcttttgtaggcgctgtcagtctgtcatgcagtgacagcgggttatgggcagtggaaggaggcaataaactggtgtgctctggcctgctccaggctagcaagagtaatctgatctccggcagcgtgatgtacattgaagagaagactaagacgaaatataccggaaaccccacgaaaatgtatgaagtagtgtaccagattggtacagaaacccgttcagacttctacgatatagttttggtggcaacacctttgaatagaaaaatgagcaatattacatttctgaattttgatcctcctatcgaagagtttcatcagtactaccagcatatcgtcacaacgctagtgaaaggagagttaaacacgtcaattttttcatcccggccaatagacaagttcggcctgaataccgtgctcaccaccgacaattctgacctctttatcaatagtatcggtatcgtgccgtccgtgcgtgagaaggaagacccagaaccctccactgatggaacctacgtgtggaagatcttttctcaggagaccctcaccaaggcccaaatattaaagttattcctatcatacgactacgccgtcaagaagccttggctggcatacccacattataaaccacccgagaagtgccccagtatcatcttgcatgacaggctgtattatctgaacggaatcgaatgtgccgcttctgccatggaaatgtccgctatcgccgctcataatgcagcactgcttgcctatcacagatggaatggacatactgatatgatagatcaggacggactctatgagaaactcaaaacagagctctag

SEQ ID NO: 235997 - DNA, 1287 bp, Artificial Sequence
  Description of Artificial Sequence: Synthetic coding sequence
atgatggtgcagggacaggagtatgaagcaggaggttcagtaattcaccccctgaatctccacatgaagcgatttgtcaaggatctgggactgagcgctgtgcaagcttcagggggacttttaggtatatacaacggggaaactctggtttttgaggagtcaaactggttcatcatcaatgtaatcaaattagtgtggcggtatgggttccagagtctgagaatgcacatgtgggtggaagacgtactggataaattcatgcgaatctatcgttatcagtctcatgactatgcattcagtagcgtggagaagctgctgcacgcccttggcggagatgacttccttggtatgcttaaccggacccttctggaaacactgcagaaggcaggatttagtgagaagttcctcaatgaaatgattgcccctgtgatgagggtcaactatggacagagtactgatattaatgcgttcgtgggcgctgtttcgctgagttgctccgactcgggtctttgggctgttgaggggggtaataaactggtttgtagtggcttactgcaggcaagcaaatccaacctgatatccggtagtgtgatgtacatagaggagaaaaccaaaactaaatacaccgggaaccctacaaaaatgtacgaagttgtgtatcagataggcactgaaacacgctccgacttctatgatattgttctcgtggcgacccccctcaatcgaaagatgtccaatatcactttcttgaatttcgatccccctatcgaggagttccaccaatactaccagcacatagtaacaaccctggtgaaaggagagctaaacactagcatattttctagccggccaattgataaatttggcctgaatacagttttgacgacggacaattcagatcttttcatcaacagcattggaatcgtcccaagcgtgagggagaaggaggatccggagcctagcacggacgggacttacgtttggaagatcttttcacaggaaaccttaacaaaagcacaaattttgaagctgtttctcagttacgattacgcagtgaaaaagccctggctggcctatccgcattacaaacccccagaaaaatgtccctccattatactgcacgatcgtttatactacctcaacggtatcgaatgtgccgcatctgccatggagatgtctgctatagcggcacataatgctgcactgctggcctatcacaggtggaatggccacacagacatgatcgatcaggatggcctgtatgagaaattgaagacagagctctag

SEQ ID NO: 235998 - DNA, 1284 bp, Artificial Sequence
  Description of Artificial Sequence: Synthetic coding sequence
atggtgcagggtcaggagtacgaagctgggggttcggtgattcaccctttaaacctgcacatgaagaggttcgttaaggatttgggcctgtctgcggtacaagccagcggcggactgctaggaatctataacggcgaaaccctggtatttgaggagtctaactggttcatcattaatgtgattaagctcgtgtggcgctacggctttcagagtctgaggatgcacatgtgggtggaagatgtcctggacaaatttatgcgcatctatcggtaccagtctcatgattatgcttttagttcagtagaaaagcttctgcacgctctcggcggagatgattttcttggaatgctcaaccgaaccctcttagagactcttcagaaagcaggctttagtgagaaattcttgaatgagatgatcgcccctgtcatgcgggtcaattacgggcagtccactgacataaatgctttcgttggcgctgttagtttaagctgctccgacagcgggttgtgggccgtggagggaggcaataaattggtttgttctgggctgctgcaggcctcgaaatcgaacctcatcagtggaagcgtgatgtacattgaggaaaaaacgaaaacgaaatataccgggaaccccactaagatgtacgaggtagtatatcagatcggaacggagacccggagtgacttctatgatattgtgctggtggctacacccctgaacagaaaaatgagtaatatcacctttctcaatttcgacccacccattgaagaattccaccaatattaccagcacattgtgactaccctcgtgaaaggcgagctaaataccagtatcttcagtagtaggccaatcgataaattcgggctgaatactgtactgacgaccgataacagcgacttgttcataaattcaatagggattgtaccctccgttagggaaaaggaagatccggagccttccaccgatggcacttacgtgtggaagatttttagccaggaaactctgactaaagcccagatactgaaactgtttctgagttacgattatgccgttaagaaaccctggttggcctacccccactacaagccacctgagaagtgtccgtccatcatattgcacgatcgactttactatctaaatggcatcgaatgcgcggcatccgccatggaaatgagtgcaatagccgctcacaacgcggcacttctcgcttatcatcggtggaacgggcataccgacatgattgaccaagacggtctgtacgaaaagctgaaaaccgagttgtag

SEQ ID NO: 235999 - DNA, 1485 bp, Artificial Sequence
  Description of Artificial Sequence: Synthetic coding sequence
atggccagagctgcaccactgttagccgctttaacagcactcctggccgcagctgccgcaggaggagatgcaccaccgggtaagatcgcagtagtgggcgcaggcattggtggctccgctgttgcccacttcctgcagcaacacttcgggcctcgtgtgcagatagatgtgtacgagaaaggtacagtggggggtagactcgcgacaatcagcgtgaacaagcagcattatgaaagtggcgctgccagttttcatagcctatcacttcatatgcaggatttcgtgaaattactgggcctgagacatcgcagagaggttgtagggagatccgctatcttcgggggagaacactttatgttggaggagacagattggtatctccttaatctgttcaggttgtggtggcactatggaatttcgtttctgcggctccagatgtgggtggaagaggtgatggagaagttcatgagaatctacaagtaccaggcccacggatatgctttctccggagtggaggagctcctttatagtttgggcgaatcaactttcgtgaacatgacacagcatagcgttgctgaatcactgctccaggtgggcgtgactcagcgatttatagatgatgtcgtgagtgctgtcctccgcgcaagctatggacagtccgccgcaatgccagcttttgccggagccatgtccttggccggtgcccaggggtcactgtggagcgtcgaggggggaaacaaattggtctgtagcggcctgcttaagctgacaaaagctaacgtaatccatgccacggtcacctccgtaactctccattcaaccgaggggaaagcactttaccaggttgcttatgaaaatgaagtgggcaactcatccgacttttacgacatcgttgtgatagccacccccctgcatctcgataactcctcaagcaacctgacatttgcagggtttcaccctcctatcgacgacgtccaaggcagcttccaacctacagtggtgtctctcgtccacggctacctcaactcaagctattttggattccccgatcccaaactttttcccttcgccaatatccttactaccgattttcctagtttcttttgtaccctggacaacatatgtcccgtcaatatctctgcctcattccggagaaagcagccccaggaagctgccgtctggcgcgtgcaatcccccaagccacttttcaggacgcaactgaaaacactattcagatcctactacagtgtccagactgctgaatggcaagctcacccactctacggatcacgtccgacccttcctagatttgcactgcatgaccagctgttctacctgaacgctttggagtgggctgcatcttccgtagaagtaatggctgtggcagcgaaaaacgtggcactgctggcctacaaccggtggtaccaggatctggataagatagatcaaaaggatctaatgcataaagtgaagacggagctgtag

SEQ ID NO: 236000 - DNA, 531 bp, Artificial Sequence
  Description of Artificial Sequence: Synthetic coding sequence
atgaaggtgcttttgtgcgaccttctacttttgagtctgttctcatccgtgttttcttcgtgccaaagagactgcctaacttgccaggaaaagctgcacccagctctggattcttttgacctcgaagtgtgtatcctagagtgcgaagagaaagtctttccaagcccgctgtggactccatgtactaaggtcatggcacggtccagctggcagctctcgcccgcagctccagagcacgtagcagcagccctctaccagccaagggcctcggagatgcaacacctgcgcagaatgccaagagttcgctccctcttccaagagcaagaggagccagagccaggtatggaagaagctggcgagatggagcaaaaacagctacaaaagagattcggaggattcacaggtgccagaaaaagcgcccgtaagctcgccaaccagaagagatttagcgaatttatgcggcaatacctggtcctttctatgcagtccagccagcgcaggagaacactccatcagaacggcaacgtgtag

SEQ ID NO: 236001 - DNA, 465 bp, Artificial Sequence
  Description of Artificial Sequence: Synthetic coding sequence
atgaaggtgttgctgtgcgacttgcttctcctgtctctgttttcatctgtgtttagctcgtgccagcgggactgtctaacctgccaggaaaaactccatcccgcacttgactccttcgatctagaagtgtgtatcttggagtgtgaagagaaagtctttccctctcccttgtggacaccctgtaccaaagttatggcaagaagttcctggcagctgtcccccgcagctccagagcacgtcgccgctgctctgtaccagccacgagcaagcgagatgcaacatttgcgcaggatgccacgcgtgaggtcactgttccaggagcaggaagagcctgagccaggtatggaggaggccggtgagatggaacagaagcagctgcaaaagcgctttgggggttttactggagcaagaaaaagtgcaagaaaactggccaaccagaagcgttttagcgagttcatgcgctag

SEQ ID NO: 236002 - DNA, 1230 bp, Artificial Sequence
  Description of Artificial Sequence: Synthetic coding sequence
atgaccgagctgcctgccccactgtcatattttcagaacgcgcaaatgagtgaggataaccatctgtcgaacacggtgaggtcacagaatgataatagagagcgtcaggaacacaacgatagacgttctctaggccacccagagccgcttagtaacggcaggcctcagggcaacagccggcaggtagtggaacaggatgaggaagaggatgaagagctcaccttaaaatatggagccaagcatgtgatcatgctattcgtacccgtgacattgtgcatggtagttgtggtcgctaccataaagagcgtttctttctacacccggaaggacggacaactaatctatactcctttcactgaggatacagaaaccgtcggccagagggccctccactcaatcctgaacgccgctataatgatctctgtgatcgttgtgatgaccattctcctagtcgtgctctacaaatatcgatgttacaaggttatccacgcctggctcatcatttcatcactcttgctgctctttttctttagctttatatacctgggtgaggtctttaagacctacaacgtggcagtggattatattactgtagcgctcttgatttggaacttcggcgtggtgggaatgattagcatccattggaaaggcccattacggttgcagcaggcctacctgatcatgatctccgcgctgatggccttggtgttcatcaaatacctgccagagtggactgcctggttaatccttgcggtgattagcgtttacgaccttgtggcagttttgtgccctaaggggcctctacgcatgctggtcgaaactgcccaggaacgcaacgaaacactgttcccagcactgatttacagctctacgatggtgtggctggtcaacatggctgagggcgacccagaagcacagcggcgtgttagcaagaacagtaagtacaatgcagaacgtggggtgaagttgggactgggagactttatattttactccgtgcttgtgggtaaagcaagcgccacagctagcggcgactggaataccacaatcgcgtgtttcgtcgccatcctgataggactctgtctaactcttttgctgctggcaatctttaaaaaggcattacccgctctgcccatttccataacattcgggctagtgttctactttgctaccgattatctagttcaaccctttatggaccagctggcttttcaccagttttacatctag

SEQ ID NO: 236003 - DNA, 1404 bp, Artificial Sequence
  Description of Artificial Sequence: Synthetic coding sequence
atgacggagcttcctgctccgctgagttacttccagaatgcccaaatgtctgaagacaaccacttgagcaatacagttcggagccagaacgataatcgggaacgtcaggaacataatgatagacgttccctgggacaccctgagccactgtccaacggcaggccccaagggaactcgcggcaggttgttgagcaggacgaggaggaggacgaggagctcactctgaagtatggcgcaaaacacgtcataatgttattcgtgcccgtgactctgtgtatggttgttgttgtggctaccatcaagtctgttagtttttatacacgcaaggacggacagttgatttacacccccttcaccgaggacaccgaaaccgttgggcagcgcgctttacattccatcttgaatgctgctatcatgatctctgttattgtggtcatgacaatcctgctggtagtcttgtataagtatcgatgctacaaggtcatccatgcatggctaatcatttcctccctgctgttgctcttctttttctccttcatttatctgggtgaggtctttaaaacgtataacgtggcagttgactacataacggtcgccctcctgatttggaacttcggggtggtgggcatgatctctattcactggaaaggcccactacgcctgcagcaggcctatctgatcatgatcagcgccctgatggctttggtgttcatcaagtacctgcccgagtggaccgcctggctgatcttggccgttattagcgtctacgacctcgtggctgttctgtgcccgaaggggcctcttagaatgctggtcgaaactgcccaagaacgaaatgagaccttgttccctgcactgatttattcttccaccatggtgtggctggttaatatggctgaaggagacccggaagcacagaggagggtctccaagaattctaagtataacgctgaatccaccgagcgcgagtcccaggatacagtagccgagaacgacgacggcggttttagcgaggagtgggaggctcagagggattctcacctggggcctcatcgttcaactccggagtcccgcgctgccgtgcaagagctaagctcctctatcctcgccggtgaggaccccgaagaacggggagtaaagctggggcttggtgatttcatattctattcggttcttgtgggaaaggctagcgcaaccgctagcggagattggaataccaccatcgcctgcttcgtagcaatccttatcggcctgtgcctgaccctccttctgctggcaatcttcaagaaggcactccctgcgctgcctatcagcatcacatttgggctggtgttctatttcgccacggactacttggtgcaaccattcatggaccaattggcttttcaccagttttatatatag

SEQ ID NO: 236004 - DNA, 1137 bp, Artificial Sequence
  Description of Artificial Sequence: Synthetic coding sequence
atgacagagcttcctgctcctttgagctacttccagaacgcacagatgtccgaagataaccacctgagtaacacagtgcgatctcaaaacgacaatagagaacgacaggagcataatgacagaaggagcctcggtcacccggagccactgtccaacggaaggcctcaggggaactcccgtcaggtcgtagagcaagatgaggaagaggacgaagagctcaccttgaagtatggtgcgaagcatgtgattatgctctttgtgccagtcactctgtgcatggtcgtggttgtggcgacaatcaaatcagtatccttttacaccagaaaggacggtcagctcatatataccccttttaccgaggatacagagactgtgggacagcgcgcactccactctatactgaatgcagctatcatgatctcagttattgtggtgatgaccatactgcttgtggtcctgtataagtaccgttgttataaagtcatccacgcttggctcataatcagttctctgttactgctgtttttcttttcattcatttatttgggcgaagttttcaagacatataatgtagctgtggattacattacagtagcattgctgatctggaatttcggggtcgttggaatgatttcaatacattggaagggacccctcaggctgcagcaggcgtacctaataatgatttccgctctcatggcactggtctttatcaaatacctccctgaatggaccgcttggctgatcctggcagtgatcagtgtgtacgatctagttgcagtgctttgccccaaaggcccacttaggatgctagttgagaccgcacaggagagaaatgagaccctgttccctgctctaatttattctagcaccatggtgtggctggttaacatggcagagggggaccctgaagctcaaagacgcgtgtcaaagaactccaaatataacgctgagcgtgcttgcctgccacctgcagcaatcaaccttctgtccatcgctcctatggcacctcggctattcatgcctaagggagcctgtcggcctacagctcaaaaaggctctcataaaaccttgttgcagagaatgatgatggctggaagcgtccgaaatggtaaacctcggggaaccgttatctag

SEQ ID NO: 236005 - DNA, 1392 bp, Artificial Sequence
  Description of Artificial Sequence: Synthetic coding sequence
atgaccgaactacctgcgcctctctcatacttccagaatgcccagatgagcgaagacaatcatctaagcaacacgaacgataaccgcgagcgtcaagagcataacgatcggaggtcactgggacacccagaacccttaagtaatggcaggccacaaggcaacagtagacaagtggtagagcaggatgaggaagaagacgaagagctgacgctcaaatacggcgcaaaacacgtcattatgttgtttgtgccagtgacactttgtatggtcgttgtggtcgccacaatcaagtccgtgtccttctacacccggaaagatggccagctgatctacacaccctttacagaggacactgagactgttggccagcgggcactacattcaatcctcaacgcagccattatgatctctgtaatcgttgtaatgacaatcctgcttgtggtgctgtacaaatacaggtgttacaaggtaatccatgcatggttgatcatctctagccttctcttgctgttcttcttctccttcatttaccttggcgaggtgtttaaaacgtataatgtagccgtcgactacatcacagtcgcactattaatctggaattttggcgtcgttggcatgatatccatccactggaagggtcccctccgtctgcagcaggcgtacctcatcatgatctccgcactgatggcgctcgtttttatcaagtatttgcccgaatggaccgcctggctcatcctggctgtgatcagtgtgtatgatttggtggctgtcctgtgtcctaaagggcctctgagaatgctggtggaaacagcccaggaaagaaatgaaaccctgttccctgccctcatttactcgtccactatggtatggctcgtcaatatggccgagggcgatcccgaggcccaacgaagggtcagcaagaactctaagtataacgccgagtcgacggagagggagtcccaggatactgtggccgaaaacgacgatggaggtttctcagaagaatgggaagcacaacgagacagccatcttggaccacatcgctccacaccggaatctcgtgcagcagtgcaggagctgagtagctcaatcctcgcaggggaagacccagaagaaagaggcgtgaagcttggattgggagactttatcttctactctgtcttagttggcaaagcgtctgcgacagccagcggagactggaacactacaatcgcatgtttcgtcgccattttaattggactatgtttgaccctactactcctcgccatcttcaagaaggccttacccgcacttcctatttccattaccttcgggctggtgttttactttgctaccgattatcttgtgcagccctttatggatcagcttgcattccaccagttctacatatag

SEQ ID NO: 236006 - DNA, 555 bp, Artificial Sequence
  Description of Artificial Sequence: Synthetic coding sequence
atgaccgaactcccagctcctctaagttactttcaaaacgcgcagatgagtgaagataatcacctcagtaacacggtgagatctcagaatgataaccgcgaaagacaggaacataatgatcgcagaagcctgggacaccccgagccactaagcaatgggaggcctcaagggaactcccggcaggtggtcgaacaggacgaggaagaggatgaggaactgaccttgaaatacggagctaaacacgttataatgctgttcgtgcctgtcaccctgtgcatggtagtagtcgtcgccactatcaagtccgttagtttttacactagaaaagacggccaactcatctataccccgttcaccgaggataccgaaacagtgggacaacgcgcactccactccatcctgaacgctgcaatcatgatttctgtcatcgtagtcatgaccatcctccttgtcgtcctctacaagtaccgatgctacaaagtgagcatgcggcacagaagtctgttatctacgcttttcttcctgtggctgggcatcctggtgaccgtgacatag

SEQ ID NO: 236007 - DNA, 1392 bp, Artificial Sequence
  Description of Artificial Sequence: Synthetic coding sequence
atgacagagctgcctgcccctttgtcgtatttccagaacgcccagatgtcagaggacaatcacttgtccaacacaaatgataacagagaacggcaggaacataatgacagacggtccctggggcatcccgaacccctatcaaatgggaggccacaagggaattctaggcaggtggttgagcaagacgaagaggaggacgaggaattgactctgaagtacggagccaaacacgttattatgctcttcgtgcctgtaacattgtgtatggtggtcgtcgtggcaacaatcaaatctgtgagcttttacacaaggaaggatggccagctcatttacaccccatttacagaagataccgaaacagtgggccagcgagctctgcacagtatattgaacgccgctatcatgatttctgtgattgtagtaatgacaatcctgttagtcgttctgtataagtaccggtgttacaaagtgatccacgcttggttgatcatctctagtctgctgctgctgttcttcttcagtttcatctacctgggggaagttttcaaaacgtacaatgtggcagtggattatattaccgtcgctctgctcatctggaactttggcgtggttggcatgatctccatccattggaaaggtcccctgagactgcagcaggcctacctgataatgatctctgcgttaatggctctggtgtttattaagtaccttcccgagtggacagcgtggctgattctagccgttatatccgtgtacgatctcgttgctgtcttatgccccaaaggtcccctgcgtatgctggtggagacagcccaggaacggaatgagaccctattcccagctctgatttactcaagcacaatggtgtggcttgtgaatatggccgagggcgatcccgaagcccagcggcgagtgtccaagaactctaaatacaatgctgagtctaccgaacgagaaagccaagacaccgtcgcagagaacgatgacggcggattttcagaggagtgggaagcccagcgagactctcacttaggtccacaccgttccacccctgagagtagagcggctgtacaggaattgtcgtcgagcatcctagctggggaagatcccgaagagcggggtgtcaaattgggcctgggcgacttcatcttttattctgttttagtgggcaaggcgtcagctaccgcatccggcgactggaatacaacgatcgcatgtttcgtggccattctgattggcttgtgtttgacactcctcctgctcgccattttcaagaaggcccttcccgcactgccaatcagtattacgtttggtctggtgttctactttgccacagactaccttgttcagccttttatggaccaacttgcctttcatcagttctatatttag

SEQ ID NO: 236008 - DNA, 279 bp, Artificial Sequence
  Description of Artificial Sequence: Synthetic coding sequence
atgaccgaactgcccgcacccctctcatactttcaaaacgcccaaatgtcagaagataaccacctgagtaacactaacgacaaccgggagcgtcaggagcacaacgaccgaaggagcctgggacatcccgagccattgtctaacggacgccctcagggtaattcccgccaggttgtggaacaggatgaagaggaagatgaggaactgacgttaaagtatggggctaaacacgtgatcatgttgtttgttccagtgactttgtgcatggtcgtcgtctag

SEQ ID NO: 236009 - DNA, 444 bp, Artificial Sequence
  Description of Artificial Sequence: Synthetic coding sequence
atgaccgaactccctgccccattgtcctattttcagaatgcccagatgagtgaggacaatcatctgagcaacaccaatgataatcgagagagacaggaacacaacgaccggcgttccctggggcatccagagcccctatccaacgggagacctcaggggaacagtagacaagtggtggagcaggacgaagaagaggatgaggagctgacattgaaatacggcgcaaaacatgtaattatgctgtttgttcccgttacattgtgcatggtcgtcgtggtggctaccatcaagtcagtgagcttctatacgagaaaggacgggcagctgatctacacacccttcaccgaggatacggagacagtgggccagcgcgctctccactcaattctcaacgcagcaattatgatttcggtgattgtcgtgatgaccattctgctggtgtag

SEQ ID NO: 236010 - DNA, 330 bp, Artificial Sequence
  Description of Artificial Sequence: Synthetic coding sequence
atgacagagcttcccgctcccctttcctacttccagaacgctcagatgagtgaagacaaccacctgtctaacaccgtgaggtcccagaatgataaccgcgagcggcaggagcataatgacagacgctcgctcggccatcctgagcctctctctaatggtcggcctcaaggtaactcccggcaagttgtagagcaagacgaggaggaggacgaagagctgacactgaagtacggcgctaaacacgtgatcatgctgttcgtccctgtgactctgtgcatggtggtggtagtggctaccattaaatccgtctcgttttacactcggaagtag

SEQ ID NO: 236011 - DNA, 468 bp, Artificial Sequence
  Description of Artificial Sequence: Synthetic coding sequence
atgaccgagctcccggcaccattatcttattttcagaatgcccagatgagtgaagacaatcatctgtctaataccgttcgctctcagaacgataaccgcgagagacaggagcacaacgaccgaagatctctaggccaccctgagcccttgtcaaatggaagaccgcagggtaacagccgtcaagtggtcgaacaggatgaggaggaagacgaagaactgaccctcaaatacggagcaaaacacgtgatcatgttatttgtgccggtgacgttgtgcatggtggtggtggtcgctaccattaagagtgtctcattctacacacggaaagatggccagttaatctacacaccctttaccgaagatactgagaccgtaggccagagagcactgcactctattctgaatgccgcaataatgatttctgtcattgtggtcatgacaatcctgcttgttgtactgtataagtag

SEQ ID NO: 236012 - DNA, 177 bp, Artificial Sequence
  Description of Artificial Sequence: Synthetic coding sequence
atgactgagcttcctgccccactgagttactttcaaaacgcgcagatgtctgaggacaaccacctctcaaatactaacgacaacagagaacggcaagagcacaacgatcgtcgatcattaggccatccagagcccctttctaatggaaggcctcagggaaatagtcgacaggtgtag

SEQ ID NO: 236013 - DNA, 279 bp, Artificial Sequence
  Description of Artificial Sequence: Synthetic coding sequence
atgacagaactgcctgcgcctttgtcatatttccaaaacgctcagatgtcagaagataatcatctctctaatacaaacgataatcgggagagacaggaacacaatgaccgccgttctcttggccatccagagcctctaagcaatggtaggccgcaaggtaattctcgccaagttgttgagcaggacgaggaagaggacgaagaactcaccctcaagtacggagctaagcatgttattatgttgtttgtacccgtgaccttgtgtatggtggttgtgtag

SEQ ID NO: 236014 - DNA, 192 bp, Artificial Sequence
  Description of Artificial Sequence: Synthetic coding sequence
atgacggaactcccagctcccctgtcctatttccagaatgctcagatgagcgaggacaatcatctcagcaataccaacgacaatcgcgagcggcaggagcataatgatcggaggagcttaggacatcccgaaccgctgtcaaacggccgacctcagggcaatagcaggcaggtcgttgagcaggacgaatag

SEQ ID NO: 236015 - DNA, 276 bp, Artificial Sequence
  Description of Artificial Sequence: Synthetic coding sequence
atgaccgaactgccggcacccctctcgtattttcagaacgcccagatgtccgaggacaatcacctttccaacactaatgacaaccgggagcggcaagagcacaacgaccggaggagcctcggacatcctgagcctctgtcaaatggcagaccacaaggaaactctaggcaggtagtcgagcaagacgaggaggaggatgaggagctcacattaaagtatggggctaagcatgtgatcatgctgttcgtgcctgtgaccctatgtatggtggtgtag

SEQ ID NO: 236016 - DNA, 189 bp, Artificial Sequence
  Description of Artificial Sequence: Synthetic coding sequence
atgacagaactccccgctccactgtcttatttccagaacgctcagatgtccgaagataatcacctttcaaacactaacgacaatcgagaaagacaagagcacaacgatcggcgatcactcggacacccggaaccgctttctaacggccgacctcaaggtaattcaaggcaggtggttgagcaggactag

SEQ ID NO: 236017 - DNA, 300 bp, Artificial Sequence
  Description of Artificial Sequence: Synthetic coding sequence
atgactgagttaccagcccctctgtcatactttcagaatgcacagatgtcagaggacaatcatctgtcaaacaccgttagaagtcagaacgataatagagagcgccaggagcacaacgaccggagatctctgggtcatcccgaaccactctcgaatgggagacctcaggggaacagtaggcaggtggtggaacaggacgaagaagaggacgaggagctgaccttaaagtatggtgccaaacatgtaattatgctattcgtgccagtaaccctatgtatggtggtggttgtggccacgtag

SEQ ID NO: 236018 - DNA, 408 bp, Artificial Sequence
  Description of Artificial Sequence: Synthetic coding sequence
atgacggagctaccggctcccctgagctacttccaaaacgcccaaatgagcgaagataaccatctcagcaataccaatgacaaccgggagcgacaggagcacaatgaccgccgttccctggggcatcctgagcccctgagcaatggcagacctcaaggcaactcacgccaagtcgttgaacaggatgaagaggaggatgaagaacttactctgaagtacggagccaagcacgtgataatgttgttcgtacctgtaaccctgtgcatggtggtcgttgttgccacgattaaatcagtgagcttctacactaggaaggacggccagctgatttacaccccttttactgaggataccgaaacggtggggcaaagggccttgcatagcatcctgaatgctgctatcatgtag

SEQ ID NO: 236019 - DNA, 330 bp, Artificial Sequence
  Description of Artificial Sequence: Synthetic coding sequence
atgactgaactgcccgctcctctgagctatttccagaatgcacagatgagcgaggataaccacctgtccaacaccaacgataaccgagagagacaggagcataatgatcgcaggtcactgggtcaccctgaacccctgagcaatggcagaccgcagggtaattctaggcaagtggtggagcaggatgaggaggaagatgaggaactgacccttaagtatggtgcaaagcatgtaatcatgctattcgtgcccgtgacattgtgcatggtggttgtggtggccaccatcaagagtgtgtctttctataccaggaaggacgggcagctgtag

SEQ ID NO: 236020 - DNA, 1248 bp, Artificial Sequence
  Description of Artificial Sequence: Synthetic coding sequence
atgttaactttcatggcatctgattcagaggaggaagtgtgcgacgagagaacatctctaatgtccgcggagtcccccacaccccgatcctgtcaggagggacggcagggcccagaagacggagagaatactgcccaatggagatcacaggagaacgaggaggatggagaggaggatcctgatagatacgtgtgttctggcgtgcccggacgcccacccggactcgaggaagagctcacgctgaagtacggcgctaagcatgtgatcatgctgttcgtgccagtgaccctttgtatgatcgtcgtagtggccacaattaagtcggtgaggttctacacagaaaagaacggtcaattgatttacacgccattcactgaggacactccttctgttggccagagactgttgaattccgtgctcaacacacttatcatgatctctgtcattgtggtgatgaccatcttcctggttgtgttgtataaatacagatgctataaattcattcacggatggctcattatgagtagcttgatgctgttgttcctgtttacctacatctacttgggggaagtgctgaagacatacaacgtggctatggattaccccaccctgttactgacagtatggaactttggggcagttggcatggtttgcattcactggaaaggacctctggtcttgcagcaggcctacctaatcatgatatccgcactgatggcactggtgttcatcaaatacctccctgaatggagcgcatgggtgatcctcggcgctataagcgtttacgccgcaatggtgtggacggtcgggatggctaagctggatccaagtagccaaggagccctccagttgccttatgatccggagatggaagaggactcttatgattcgtttggtgagcccagttatccggaggtgtttgagccgccacttacagggtatcccggagaggaactcgaggaggaagaagagcggggtgtgaagctggggttaggtgacttcatattttattcagtgctggtgggaaaggccgctgcgaccggtagcggggactggaacaccactttggcctgcttcgtggccatcctgatcggactgtgcttaactctgcttttgctggccgtgttcaagaaagccctgcccgcactcccaataagtattacatttgggctcatcttttatttttccacagacaacctagtgcgaccattcatggacacactggcatcccaccaactctatatttag

SEQ ID NO: 236021 - DNA, 1446 bp, Artificial Sequence
  Description of Artificial Sequence: Synthetic coding sequence
atgctggctggcacagtgcggtttgccaggcactgcctcaagttttttccggctcagaaacccgcttgcgtggactttggtgcaagccggggacgcgctatgctgaccttcatggcaagtgactccgaggaggaggtctgtgatgaaaggacgagtctaatgagcgcagagtcgccaactcctcgctcatgtcaggaaggcaggcagggacccgaggacggcgagaatactgcacaatggagatcacaggagaatgaggaagacggggaggaggacccagatcggtacgtatgtagtggtgtcccaggacgacctccgggactagaggaggagcttaccctcaagtacggggctaagcacgtcattatgctattcgtgccagtcaccctgtgcatgatcgtcgtggtggcgaccattaagagtgtgagattttacaccgagaagaatgggcagcttatctatactcccttcactgaggacacccctagtgtcggccagcggcttctgaacagcgtgctcaacactctaatcatgatctcagtgatcgtcgtcatgactattttccttgtggtgctgtacaagtatcgatgctataaattcatccatggctggttaatcatgagctcgctgatgctactgttcctgttcacttacatctacctgggggaggtcttgaaaacatataacgtggccatggattatccgacactgctactgacagtttggaatttcggagctgtgggtatggtctgtatccattggaaaggccctctagttcttcagcaggcatacctcattatgatctcagccctcatggcactggtctttattaagtaccttcccgagtggagtgcatgggttatccttggggcaatatccgtttatgacctcgtcgcggtactgtgtccaaagggtcccttgaggatgcttgtggagactgctcaagaaagaaacgaaccgatctttcctgctctgatttacagttctgcaatggtttggactgtagggatggctaaactggaccccagctcgcagggagccctgcagctaccttacgaccccgaaatggaagaggatagctacgattccttcggcgaaccctcctaccccgaggtgttcgagccgccattgacagggtacccaggcgaggaactggaggaggaggaggagcggggagtgaaattaggactcggagatttcatattctattcggtgttagtcggcaaggctgccgcaacaggctctggcgactggaacaccacacttgcctgttttgttgcaatcctgatcggcctgtgtctcactctgctccttctggcagtgttcaaaaaagctctccccgctcttccaatcagcattacttttggcctgatcttctatttttccacagacaatctggtgcggcctttcatggacaccttggcctcacaccagttatatatttag

SEQ ID NO: 236022 - DNA, 1347 bp, Artificial Sequence
  Description of Artificial Sequence: Synthetic coding sequence
atgctgacgttcatggcgagtgacagcgaggaggaagtatgcgatgaaaggacatcactgatgagcgccgaaagcccaacccccaggagctgccaggaggggagacagggtccagaggatggcgagaacaccgcacagtggagatcacaagagaacgaggaggacggagaagaggacccggacagatatgtctgcagtggtgtgccaggtcggccaccagggcttgaagaagagctcacactgaagtacggagctaaacacgttatcatgctgtttgtgcccgtcactctctgtatgattgttgtcgtggctaccataaagagcgtgcggttttataccgagaaaaacgggcagttgatctacacgcccttcacagaggatactccatctgttgggcagagactgttgaactcggtgctcaatacacttattatgattagcgttatcgtcgtaatgacaatttttctggtggtgctctataagtatcggtgttataagtttatccacggttggttgatcatgagctccctaatgttactcttcctgttcacgtatatctatctgggggaggtccttaagacctataacgtggccatggactatcctacactgctcctgaccgtgtggaactttggagctgtgggaatggtttgcatacattggaagggcccattggtgctccagcaggcctatctgatcatgatcagcgctctgatggcgttggtttttattaagtatttgccagagtggtctgcctgggtcatactgggcgcaatctcagtgtacgacctcgtcgctgtcctgtgccccaagggcccactgagaatgctggttgaaacagcccaggagcgcaatgaaccaatttttcctgcactgatctactcatcagccatggtgtggactgtaggtatggccaagttggacccctcttcccagggtgccctgcagctgccttacgacccggaaatggaagaagacagctacgatagtttcggcgaaccctcgtacccagaggtgtttgaaccacccctaaccggctatcctggcgaggaactcgaggaggaagaggagcggggagtaaaacttggcctgggggattttattttttattctgtcctggtcggaaaggcagccgctaccggctcgggggattggaacaccactctggcctgtttcgtggctattttgattggcttgtgcttaactctgctgctccttgcggtcttcaagaaagctttgcccgcactcccaatctcaatcacattcggcctcatattctatttcagtacagacaatctagtgcggccttttatggacacattggcatcacatcaactctacatctag

SEQ ID NO: 236023 - DNA, 1446 bp, Artificial Sequence
  Description of Artificial Sequence: Synthetic coding sequence
atgctggctgggacagtccgcttcgctagacactgcctgaaatttttccctgctcagaagcccgcatgcgtagattttggcgcaagccggggtagagccatgctgaccttcatggcctcagactcagaggaggaggtttgcgatgaacggacatccttgatgagtgccgagagccccactcctcgaagttgtcaggaagggcgtcagggccctgaggatggagaaaataccgcgcaatggcgcagtcaagaaaacgaggaggacggcgaggaggaccccgaccggtacgtttgttccggtgttcccggacgcccacccggacttgaggaagagctcacccttaagtacggagcaaaacacgttattatgctcttcgtgcccgtgacgctgtgcatgattgtggtcgtggcgactataaaatcggtcagattttacacagagaaaaacgggcagctaatttacaccccattcacggaagacacgccaagtgtggggcagagactactgaactctgtgctaaacaccttgattatgattagtgtaatagtggttatgacaatctttctcgtggttctctacaaataccgttgctacaaattcatacatgggtggctgatcatgtcctccctgatgcttttattcctgttcacctacatttacctgggggaggttctcaagacgtacaatgttgccatggactatccgacgcttttgctcaccgtgtggaatttcggagccgttggtatggtctgcatacactggaagggcccactggttttgcagcaagcctatctgatcatgatttcggctttgatggcccttgtcttcatcaaatacctgccggagtggtcagcatgggtcatcctgggggcaatttctgtttacgacttggtagcagtactctgcccaaagggcccactgcggatgctggtggagacagcccaggaacggaacgagcctatttttcccgcactaatctacagttctgcaatggtgtggacagtaggaatggccaagttagaccccagctcgcagggagcgctccagcttccctacgatccagagatggaggaggattcttacgacagctttggcgaaccatcttatccggaggttttcgagcctccgctgactggttaccctggcgaggaacttgaagaggaagaggaacggggtgtgaaactgggactgggtgatttcatcttttacagcgtgctggtcggtaaggcagctgcaactggaagcggagactggaacaccactttggcctgcttcgtcgcaatcctcatcgggttatgtctcaccctcttattgttggctgtgtttaaaaaggcactgcccgcactgccgatcagtataacctttggcctgatcttttatttctctaccgataacctggtacgcccatttatggatactctcgcatctcatcaactatatatatag

SEQ ID NO: 236024 - DNA, 1344 bp, Artificial Sequence
  Description of Artificial Sequence: Synthetic coding sequence
atgttgacattcatggcaagcgactcagaagaggaggtgtgtgacgagagaacatcgctaatgtctgcagaaagtcctactccacgtagctgtcaggagggacgccagggccctgaggacggtgaaaacacagcccagtggagatcccaggagaacgaagaagatggagaggaggatcctgatagatatgtatgtagtggggtcccaggcagacccccaggtctcgaagaggaattaactttgaagtacggtgcaaaacacgtgattatgctgttcgtcccggtgacattatgcatgattgtcgtggtcgctacaataaaaagcgtgagattctacactgaaaaaaatggccagctgatatacacaccctttacggaagatacccctagtgttggccagaggctgctcaactcagtactgaacaccctgatcatgattagcgtgatcgtagtgatgaccattttcttggtcgtgctgtacaaatacaggtgctacaagttcattcatggctggctcattatgagctccctgatgttactgttccttttcacgtatatctatcttggggaagtactcaagacttacaatgttgcaatggattatccaaccctcctgctgacagtgtggaatttcggcgctgtgggcatggtgtgcatccactggaaaggcccactggtacttcagcaagcttatctgattatgatctcagccctgatggccctcgtgttcattaagtacctgccagaatggagcgcctgggtgatcctcggcgctataagcgtatacgacctggtggctgttctttgcccgaagggccctctcagaatgctggttgaaacagcccaggagcggaacgagcccatattcccagccctcatatattcctctgctatggtatggactgttggtatggccaaactagatccaagttcacagggtgcattgcagctcccgtacgatcccgagatggaagacagctacgactcttttggagaaccctcataccctgaggtgttcgagcctccactgaccgggtacccaggcgaggaacttgaggaagaggaagaaagaggcgtgaagctgggcctgggagatttcatcttctatagcgtcctggtaggcaaagctgccgctaccggcagtggcgactggaatactacacttgcgtgctttgtcgccatcctcataggcctctgtctgacactcctgctccttgccgtatttaaaaaggcactgcctgccctgcctatcagcattacttttgggcttatcttctacttttcgaccgacaatcttgtccggccttttatggacacactcgctagtcaccagctttacatctag

SEQ ID NO: 236025 - DNA, 390 bp, Artificial Sequence
  Description of Artificial Sequence: Synthetic coding sequence
atgctcacatttatggctagtgatagcgaggaggaggtatgcgacgagcgaacatccctcatgtctgctgagtccccgacaccccgtagttgccaggagggcagacagggccctgaggacggagagaatactgcccagtggcgctcgcaggaaaatgaggaggacggagaggaagaccccgaccgctacgtctgctctggagtacctggacggcctcctggacttgaggaagagctcactttgaagtatggcgctaaacacgtgatcatgctgtttgtacccgtgacgctctgtatgattgtggtggtcgcaacaattaaaagtgtgaggttctatacagagaagaacggccagctgatctatacccccttcaccgaggataccccgtag

SEQ ID NO: 236026 - DNA, 66 bp, Artificial Sequence
  Description of Artificial Sequence: Synthetic coding sequence
atgttgactttcatggcctccgatagcgaggaagaggtctgcgacgaaaggacatcattgatgtag

SEQ ID NO: 236027 - DNA, 990 bp, Artificial Sequence
  Description of Artificial Sequence: Synthetic coding sequence
atggcatggcgaggctgggcacagcggggatgggggtgtggccaggcatggggggcatctgtgggcggacgtagctgtgaggagttaactgcagtacttactccgcctcagctgctggggaggcgctttaacttcttcattcagcaaaaatgcggcttcagaaaggctcccaggaaggtggaaccccgacgtagtgacccgggtacttccggagaggcttataagagaagtgcgctgatacctccagttgaagagactgtattctacccatccccttatccgattagaagtctgattaagccactcttttttacggttggattcaccgggtgcgcctttgggtcagccgctatctggcagtacgaaagtctcaagtctagggtccaatcttatttcgacgggataaaggcggattggcttgactcgatccgcccacagaaagagggggatttcagaaaagaaataaacaagtggtggaacaacttaagtgacggccaacgcacggtcaccggaattatagccgctaacgttctggtgttctgcctgtggagagtccccagcctacaacgtaccatgattcgttattttacttccaaccccgcatcaagtgtgatcagcaacttcgtctcctatgtgggtaaggtggccaccggcaggtatgggccttcgctgggcgcttccggcgctatcatgacagtgttggctgcagtctgcaccaaaatccctgagggacgcctcgccattattttcctacccatgttcacgtttacagcgggaaatgctttgaaggcaattattgcgatggatacagccggaatgattctcggttggaaattcttcgatcatgccgctcaccttggtggagcccttttcgggatctggtatgtaacctacggccatgagttgatatggaagaacagggaacctctagttaaaatttggcatgagatccggactaacggcccaaagaagggaggcggttccaaatag

SEQ ID NO: 236028 - DNA, 1140 bp, Artificial Sequence
  Description of Artificial Sequence: Synthetic coding sequence
atggcttggcggggttgggcacagcggggatgggggtgtggacaagcttggggagcgagcgtggggggtaggagctgcgaggagcttaccgcagtgctgacacccccacagttgctcggaagaagatttaacttcttcattcaacagaagtgtggcttccggaaggccccaaggaaagtcgaacctcggaggtccgaccctgggacgagcggtgaggcatataaacgatccgccctgataccccctgttgaggagacagttttttacccgtcaccctatcccatccggtctttaattaagccactgttcttcaccgtgggcttcactggatgtgcgtttggcagtgccgctatctggcaatacgagtccctgaagagccgcgtccagtcctatttcgatggcatcaaggctgattggttggacagcatacggcctcagaaggagggagactttagaaaagagatcaataaatggtggaacaatctgtcagatgggcaaaggactgtgactggtataattgctgccaatgtgctcgttttttgtttgtggcgagtgccaagcctgcaacgaacaatgatcaggtacttcacctcaaacccggcaagtaaggtgttgtgttctcctatgctgctgtccacttttagccatttttctctgttccacatggccgctaacatgtatgtcctctggtctttctcatcatcgatagtcaatattctgggccaggagcaattcatggccgtgtatctgtctgccggtgtgatctccaactttgtgagctacgttggaaaggtggccaccgggaggtatggcccaagtctgggtgccagcggcgctatcatgactgtgttggcagccgtgtgtactaaaattcccgaggggcgattggccataatatttcttcccatgttcaccttcactgctggcaatgcattaaaggcaatcatcgcaatggatacagcaggtatgatcttggggtggaaatttttcgatcatgctgcccaccttggaggggcactgttcggcatttggtatgtaacatacggccatgagctgatatggaaaaaccgggaaccactggtcaagatttggcatgaaattcgaacgaacggcccaaagaaagggggtgggtcaaaatag

SEQ ID NO: 236029 - DNA, 663 bp, Artificial Sequence
  Description of Artificial Sequence: Synthetic coding sequence
atggcttcagcaactgactcacgatacggtcagaaggagtcttctgatcaaaacttcgactatatgttcaaaatcctcatcattggcaatagctccgtggggaagaccagttttctcttccggtacgcagatgacagtttcacccccgctttcgtcagtacagttggcatcgacttcaaagtcaagaccatttatagaaatgacaagaggatcaaactccaaatttgggataccgctggccaagagagataccgcactattaccacggcctactacagaggggcaatgggatttatcttgatgtatgatatcaccaacgaggagagctttaacgctgtgcaggattggtccacacaaatcaaaacctactcctgggacaatgctcaggtcctcctggttgggaataagtgcgacatggaggacgagagggtggtgtcatctgaaagaggacggcagttagccgatcacctgggatttgagttttttgaggcatctgccaaagataacataaatgtgaaacaaacctttgagagactcgtcgatgtgatttgcgagaagatgtccgaatctctggataccgcagaccctgctgtgacaggcgctaaacagggcccacagctttccgatcagcaggttccaccccaccaggactgcgcctgctag

SEQ ID NO: 236030 - DNA, 306 bp, Artificial Sequence
  Description of Artificial Sequence: Synthetic coding sequence
atgaacctggaaagggtttcgaatgaggaaaaactaaatctatgcaggaagtattatttaggagggttcgcattcctgccatttctctggctggtcaatatcttttggttcttcagggaagctttcctcgtgccagcatacactgaacaaagccagattaaaggatatgtgtggcgctctgcggtgggatttctgttttgggtgatcgtgcttactagttggattacaatctttcagatctacagacctcgatggggcgcactaggggattatctgtcctttacaattccccttggaacaccgtag

SEQ ID NO: 236031 - DNA, 378 bp, Artificial Sequence
  Description of Artificial Sequence: Synthetic coding sequence
atggccaaatacctcgcacagataattgttatgggagtccaggtggtgggaagagctttcgcgagagctctgaggcaggagtttgccgctagcagagccgcagctgatgcacgcggtcgggctggacaccgctcagcagccgcatcaaacctgagcggtttgtccttgcaagaagcccagcagatccttaacgtgagtaaactgtctccagaggaggtgcagaagaattacgaacatcttttcaaggtgaacgacaaaagcgtgggaggctccttttatctacagtccaaggtggtaagagctaaagagcgactagatgaggagttgaaaatacaagcccaggaggaccgggagaagggtcagatgccccatacttag

SEQ ID NO: 236032 - DNA, 2496 bp, Artificial Sequence
  Description of Artificial Sequence: Synthetic coding sequence
atgccactggaaatggaacctaagatgtctaaactggcgttcggctgtcaacggtcaagcacctcagacgatgacagcggatgcgcacttgaggaatatgcctgggtgccacctggcttgcggcctgaacagatccaactgtattttgcctgtttgcccgaggagaaagttccatatgtgaactcgcctggtgagaagcatcgaatcaagcagctgttgtaccaacttccacctcacgataacgaggtgaggtactgccaaagcctatctgaagaggaaaagaaggaactccaggtgttcagcgctcagcgcaagaaagaagcactcggcagaggcacgattaaactgctttcaagagcggtaatgcacgccgtttgtgaacagtgtggactgaaaatcaacgggggagaggtggctgtttttgcaagtagggccggaccaggagtgtgctggcacccatcctgctttgtctgctttacatgtaacgagttgctcgtagatctcatctacttttatcaggatggtaagatccactgcgggcgacatcacgccgagcttctcaagcctagatgttctgcctgtgatgagattatcttcgctgatgagtgcacagaggccgaaggacgtcattggcacatgaagcacttttgttgcctcgagtgcgaaaccgtgctgggaggacagcgctatattatgaaagatggtagacctttttgttgtggatgcttcgagtccctctacgccgaatactgcgagacatgtggcgagcacatcggagtggatcacgcgcaaatgacttatgacggccagcactggcacgcaaccgaggcttgcttctcctgcgcccagtgcaaagcaagcttactggggtgcccctttctgccaaagcaaggccagatctattgcagcaagacctgctcgctgggggaggacgtgcatgcatctgactctagcgactctgcctttcagtccgctcgaagccgtgatagccgcagatccgttcggatgggaaaaagttcaagatcggccgaccaatgtcggcagtccttactcctgagccctgcgctcaattataagttcccagggctgtccggaaatgcggacgatacactctctaggaagctggacgatctgtccctgtcccggcagggcacgagttttgcttccgaagaattttggaagggaagggtagagcaagagactccagaagatcccgaagagtgggcagatcatgaagactatatgactcaactgctcctgaaatttggggataagtctctgtttcaaccacagcccaatgagatggatatccgcgcatcagagcattggatcagtgataatatggttaagagtaagaccgaactgaaacagaacaatcagtccttagcctcaaaaaaatatcagagtgatatgtattgggcccaatcccaggatggactcggggacagcgcttatggtagccatccgggaccagcttcttcgcgccgattgcaggaacttgagctggaccatggtgcttcagggtataatcacgatgagactcaatggtatgaggactcactcgaatgtctgtccgatcttaaaccagaacagagcgtccgtgattccatggacagtctggctctcagtaatattaccggagcctctgtggacggggaaaataaacccaggccttccctttactccctccagaatttcgaggagatggagactgaggactgtgagaagatgtccaatatggggactcttaactcttccatgctccatcggtcagctgaatccctgaaatcactctcgagcgaactctgtcccgaaaaaattttgcccgaggagaagccggtacacctacccgtcctccggaggtctaaatcgcaatcacgcccacagcaggtgaagttttcggatgatgtcattgataacgggaactacgatatcgaaatcagacagcctccaatgtccgagaggacccggaggcgcgtctacaactttgaagagcgcggatccagaagccaccatcacaggagacgacgtagccggaagtcgagaagcgataacgcccttaatctggtgaccgagagaaaatattcgccaaaagatcgactgcggttgtatacccctgataattatgagaagttcattcagaataaatctgccagggagatccaagcctacatccaaaatgccgacctttacggtcagtacgcccacgcgacttccgactatggactgcagaatcccggtatgaatcggtttctcggactgtacggcgaggacgacgacagttggtgttcaagctcatccagttcctccgactctgaggaggagggttatttcctggggcagccaatcccgcagccacggccacagcggtttgcatattatacggatgatctgtcgtcacctccctcagctttgcccacccctcagtttggccagaggactaccaagtccaagaaaaagaaaggacacaagggcaagaactgcatcatcagttag

SEQ ID NO: 236033 - DNA, 2496 bp, Artificial Sequence
  Description of Artificial Sequence: Synthetic coding sequence
atgccgctcgaaatggaacctaagatgtctaaactggctttcgggtgccaacgatccagtacatctgacgacgactcgggatgtgcccttgaggaatacgcatgggtgccacctgggctaaggccggaacagattcagctgtactttgcatgcttgccagaagagaaagtgccttatgtcaactcgccaggagagaagcaccgaatcaagcagctcctgtatcaactccccccacatgacaatgaagtcagatactgtcaaagtctgagcgaggaagagaaaaaggagctgcaggtattctctgctcagcggaaaaaggaggctctgggacgcggaacaatcaaactgttatcgcgcgctgttatgcacgcggtgtgcgaacagtgtggactgaagatcaatggtggggaggtcgccgtgtttgctagccgggctgggcctggcgtgtgctggcacccatcttgtttcgtttgctttacatgtaatgagctgttggttgacctgatctatttctaccaggacggcaaaatccattgcggaaggcatcacgccgagttactgaagccgaggtgctccgcttgtgacgagataatcttcgctgatgagtgcacggaggccgaaggacggcattggcatatgaagcacttctgttgtctagagtgcgaaaccgtgctgggaggccagcgctacataatgaaggatgggcgacccttttgctgcggttgttttgaatccttatacgctgagtactgtgagacatgcggcgaacacatcggcgtcgaccacgctcagatgacctatgacgggcagcactggcatgcaacagaagcctgttttagctgcgcccaatgtaaggcaagcctccttgggtgcccctttctccccaaacagggtcagatttattgtagtaagacatgttcactgggtgaagacgtgcatgcttccgatagcagtgattccgctttccagtctgcacgtagtagagacagtcggagatctgtgcgcatgggaaagtcttccagatcagccgatcagtgcaggcagtcactcttattgtcccctgcactaaactataaattccccggactcagcggtaacgccgatgataccctgtctcgcaaactggacgatctatctctgtcaagacagggcacctccttcgcgagtgaggaattttggaagggtagggtcgaacaggagacgccggaggacccagaggagtgggccgaccatgaggactacatgacgcagcttctactcaaattcggcgataaatctctttttcagccccagccaaacgaaatggacattagagcatctgagcactggatcagcgataatatggtaaaaagtaagacagaactcaagcagaacaatcagagcttggccagcaaaaaataccagagtgatatgtattgggcacagagccaggatggcctgggagacagtgcttatggatctcatcctgggccagcatcttcccgtcgcctccaagagctggaactggaccacggcgcatctgggtacaaccacgatgaaactcaatggtacgaagatagtctggagtgcctgtcggacttgaagcctgagcaaagtgtcagagattctatggacagccttgcactgtccaatatcaccggcgcttccgttgacggtgaaaacaagccacggccttccctatacagtctgcaaaatttcgaagaaatggaaaccgaggactgcgagaagatgtcaaacatgggcacgctcaacagctcaatgctgcatagatctgcagaatctctgaagagtcttagctcagagctttgcccagagaaaatcctgccggaggagaagccagtacatctgccagtgctgagacggtcaaaatcgcaaagtaggccacagcaggtaaaattttccgacgatgtcatcgataatgggaactatgacatcgaaataagacaaccacccatgtctgaaaggacgcgacggagagtctataacttcgaggaaagaggaagcaggagtcatcatcatcggaggaggagatcacgtaaaagccggtcagacaatgcgctgaacctggtgaccgaacgcaaatattccccgaaggatcgattgcggctttacacccccgataattacgagaagttcattcaaaacaagagcgccagggagatccaggcgtatatccagaatgccgatctctacggacagtatgcccatgctactagcgattatggattgcagaacccaggcatgaatcgtttcctaggactgtatggggaggacgatgactcctggtgttcttcatcctcttcaagctcagattcagaggaagagggctatttcctcggtcaaccaataccgcagcctcgcccacagagattcgcgtactatacggacgatctgagcagccccccatctgctctgcccaccccacagtttggacaaagaacgaccaagtctaaaaaaaagaagggacacaaaggaaaaaactgcatcatcagttag

SEQ ID NO: 236034 - DNA, 2496 bp, Artificial Sequence
  Description of Artificial Sequence: Synthetic coding sequence
atgccactggagatggaaccaaagatgagtaaactcgcctttggatgtcagagatcctctacttcagatgatgactctgggtgcgcccttgaggaatatgcatgggtgccaccaggactgaggcccgaacagattcaactctatttcgcctgccttcccgaagaaaaagtgccctacgtcaatagccccggtgaaaagcacagaataaagcaactgctctaccagctgccaccccatgataacgaggttagatattgccagtctctctcagaggaagaaaaaaaggaactgcaggtcttcagtgctcaacgcaaaaaggaggccctgggcaggggcaccattaaactcctgtctcgggctgtgatgcacgctgtgtgtgagcagtgcgggcttaagatcaacgggggtgaagtggcagtttttgccagccgcgctggcccaggcgtgtgttggcacccaagctgctttgtctgttttacatgcaatgagctgctggtagatctgatttacttctaccaagacggaaagattcactgtggccgacatcatgctgaactcttgaagcctcgctgctcagcctgtgacgaaatcattttcgccgatgaatgcactgaagcagaaggcagacattggcacatgaagcacttttgctgcctggagtgtgagacagtcttaggtggacaaagatacataatgaaagacggcaggcccttctgctgcggatgtttcgaatcactttatgctgagtactgcgagacctgcggtgagcacatcggagtggatcatgcccaaatgacctatgatggacagcactggcacgcgacagaagcttgcttctcgtgcgcccagtgtaaggccagcctcttgggatgccccttcttgcctaaacagggccaaatctattgttccaagacatgtagtttgggagaggatgttcatgcctccgactcttccgacagcgcttttcagagcgcacggagccgagacagcaggcgttcggtgcgcatggggaagtcatctcgatcagccgatcagtgccggcagtccctccttctttctcctgccttgaattataaatttcctggcctgtccggcaacgctgacgacaccctatcccggaagttggacgacctgagcctttccagacagggcacatctttcgcctccgaggaattttggaaagggagggtggaacaggagactcccgaggatcccgaagaatgggccgaccacgaagattacatgacccagctcctgcttaagttcggcgataaatcactgtttcagccacagcctaacgagatggacatacgcgcatctgaacattggatctccgacaatatggttaagtccaagacggagctgaagcagaacaaccagagcctggcctccaagaagtaccagtctgacatgtattgggcacaatcccaagatggactcggggatagtgcctacggcagccaccccggacctgcctcttcacgcagactgcaggagctggagctggaccatggcgctagtggttataatcatgacgagactcagtggtatgaggactccttagagtgcctgagcgatctaaagcccgagcagagcgtgcgcgatagcatggatagcctggctctgtccaatattaccggtgccagcgtagatggcgaaaacaaaccacggccatctttatacagcctgcagaacttcgaggagatggagaccgaggattgcgaaaagatgtccaatatgggaaccctcaatagttcaatgctacatcgatctgccgagagtttgaagagtctctctagtgagctctgtcccgagaagatcctgccggaggagaagccagttcatttacctgtgctgcgccgttcaaagagtcaatcgcgacctcaacaggttaagttcagcgacgacgtcatcgataacggaaattatgacatagagattagacagccacctatgtctgagagaacccggcgaagagtgtacaacttcgaagaacggggtagtcgttcgcaccatcaccgacgcaggagatctagaaagtcccgcagcgataacgccctgaacttggttactgagcgcaaatattcacccaaggaccgtctgcgcctctacactcccgacaattatgaaaagtttatacaaaacaagtctgcccgagagattcaggcctatattcagaatgccgatctgtacggccagtacgcgcatgcgaccagcgactatggattgcagaatccaggtatgaacagattcctcgggctgtacggagaggatgacgattcgtggtgttcctctagctccagttcctctgacagcgaggaggagggatactttctggggcagcccatcccccagcccagaccgcagcgctttgcctactataccgatgatctgtccagcccaccctccgcactcccaactccacagttcggccagagaaccactaagtccaaaaaaaagaaaggtcacaagggcaaaaactgtatcatcagctag

SEQ ID NO: 236035 - DNA, 333 bp, Artificial Sequence
  Description of Artificial Sequence: Synthetic coding sequence
atgcctctggaaatggagccaaaaatgtcaaagctagcgttcggctgccagcgctcttctacctctgacgatgatagcgggtgtgcgcttgaggagtacgcctgggttccccctggccttagacccgaacagattcagctttacttcgcctgtttgccagaagagaaggttccttacgttaactcaccgggagagaaacacagaatcaaacaactgttataccagctcccgcctcatgacaatgaggtgcggtactgtcaaagcctgtcagaagaagagaagaaggagctgcaggtgttcagcgcacaaagaaaaaaggaggcactgggatag

SEQ ID NO: 236036 - DNA, 2496 bp, Artificial Sequence
  Description of Artificial Sequence: Synthetic coding sequence
atgccgttggagatggaacccaagatgtccaaactggcattcggatgtcagcgtagttctacttccgacgacgacagtggctgtgcccttgaggaatatgcctgggtcccacccggacttcgccctgaacagattcagctttacttcgcgtgcttgcccgaggagaaagtgccttatgtcaattcccctggcgagaaacatcgaattaaacaattgctgtaccaactgcccccacacgataatgaggtgcgctattgtcagtcattgagcgaggaggagaaaaaagaactgcaggtgttctccgcccaacgtaaaaaagaagctcttggaagaggcactattaaactgctatctcgagcggtgatgcatgccgtgtgcgaacagtgcggtctgaagatcaatggcggagaggtcgcagtcttcgcgagccgcgctggcccaggtgtgtgttggcatccctcctgctttgtatgttttacctgtaacgagctgttggtagacttgatttacttttatcaagatggtaaaatccattgtggacgccaccacgccgaactgcttaaacctaggtgcagtgcgtgcgacgagatcatatttgctgatgaatgtaccgaagcagaagggagacattggcatatgaaacacttttgttgcctggagtgcgaaaccgtactcggtggccagaggtatattatgaaggatggcaggcctttctgttgtggttgctttgaatcgctttatgccgagtactgcgagacgtgcggcgagcacattggcgtggaccatgcgcaaatgacctatgacgggcaacattggcatgcgacagaagcttgcttcagctgcgcccagtgtaaagcctcgctgctgggctgtcccttcctacccaaacaggggcagatttattgtagcaaaacatgttcgttgggggaggacgttcatgcatccgactcctctgattccgcttttcaatccgccaggagcagagactcacgtagaagcgttcgcatgggtaagtcctcgcgaagcgcggatcaatgccgacaatccctgctcttatccccagcactcaactacaaattccctggcctgtccgggaacgcggacgacacccttagcaggaagctggacgacttaagcttaagccgacagggcacatcctttgcctccgaagagttctggaaaggacgggttgagcaggagaccccagaggatcccgaggagtgggcagaccacgaggactacatgactcagctgctgctcaaatttggtgacaaatccctgtttcagcctcagcccaatgaaatggacattagagcttctgagcactggattagcgataatatggttaagagcaagacagaactgaaacagaacaaccaaagcctggcctccaaaaagtaccagtcagacatgtattgggctcaatctcaggatgggctgggagattcggcctacggtagtcaccccggacctgcatcgtcccggcgacttcaggaactcgaattagaccatggagcatcaggatataaccacgacgagacccagtggtacgaagactccttggaatgtttgagcgatctaaagcctgagcaatcagttcgcgactcgatggactcacttgcgttatccaacattactggcgcttctgtcgacggtgagaataaaccgaggcccagtttatacagccttcagaacttcgaggagatggaaactgaggactgtgagaaaatgtctaacatgggcactcttaactcctccatgctccacaggtcagccgagtccctgaagagtctctcaagtgagttgtgtcctgagaaaatcctgccggaggagaagcccgtccacctccccgtgcttaggcgcagcaagtcccaatccagaccccaacaggtgaaattttctgacgatgtaattgacaatggcaattatgatatcgaaatcaggcagccaccaatgagtgaacgcacccggcgtagagtgtataacttcgaggagcgtgggtccaggagtcaccaccacaggcgcagacgatcacgtaaaagcaggagcgacaacgcccttaatttggttacagagcggaagtacagccccaaggataggttgcggttatacaccccagacaactacgagaagtttatacagaacaagtcagctcgcgaaatccaggcgtacattcagaacgctgacctttacggccagtacgcccacgccactagcgattacggtctgcaaaatccagggatgaaccggtttctgggactatacggtgaggacgacgactcgtggtgcagctcatcctcttccagcagcgacagcgaggaagaaggctatttcctcggccagcccattccacaaccgcgtccacaacggtttgcctactacaccgacgatctgagctctcctcccagcgctctgccgacgcctcaattcggtcagagaacaacaaagagtaagaagaaaaaaggccacaagggaaaaaactgcattattagctag

SEQ ID NO: 236037 - DNA, 360 bp, Artificial Sequence
  Description of Artificial Sequence: Synthetic coding sequence
atgccactggaaatggagcctaagatgtcaaaactggctttcgggtgtcagaggtctagcacatccgatgatgatagcgggtgcgcattagaagaatacgcttgggtcccaccgggattacgccctgagcagatccaactttacttcgcgtgtctgcctgaagagaaggtgccctacgtgaattctcccggtgagaagcacaggattaagcagctgctgtatcagctgcctccccatgacaatgaagtgaggtattgtcaatctctgtccgaggaggagaagaaggagctgcaggtgttcagtgcccagaggaaaaaggaagcactgggcagagggaccatcaagctgttgagccggtag

SEQ ID NO: 236038 - DNA, 480 bp, Artificial Sequence
  Description of Artificial Sequence: Synthetic coding sequence
atgccattggagatggaacctaaaatgtctaagcttgctttcgggtgtcagagatcttcaacaagtgatgatgactccggctgcgccctcgaggagtatgcttgggtgccaccaggtcttaggcccgagcagattcagctgtactttgcatgtcttcctgaggagaaagtcccatacgttaatagccccggagagaagcatcggatcaagcagctcctttatcagctccctccccacgacaacgaggtgcgatactgccagtctttgtcagaggaagagaaaaaggaattgcaggtgttcagtgctcagcgcaagaaagaggctctcgggagaggcactattaagttattgtcccgagccgtgatgcacgctgtttgcgaacagtgcggcctgaaaattaatggcggtgaggtcgccgtcttcgcaagccgcgctggtcctggagtgtgttggcacccatcttgcttcgtctgcttctag

SEQ ID NO: 236039 - DNA, 2496 bp, Artificial Sequence
  Description of Artificial Sequence: Synthetic coding sequence
atgccactagaaatggaacctaaaatgtcgaaactggccttcggctgtcagcggagctccactagcgacgatgactctggttgtgctctggaggaatatgcatgggtaccacccggactcagaccagagcagattcagctttactttgcctgcctcccagaggagaaggtgccgtatgtgaactcacccggagagaaacatcgcatcaaacaactgctctaccaattaccaccacacgataacgaggtcagatactgtcagagcctgtccgaagaggaaaagaaagagctccaggtcttctccgcccaaagaaaaaaagaggccctgggccgaggaaccattaaactgctcagccgggctgtgatgcacgcagtgtgcgaacagtgtggacttaagatcaacgggggagaggtggcggtctttgcgagcagggcaggacctggagtatgttggcatccaagctgcttcgtctgctttacatgcaacgagttgttagtcgatcttatttatttctatcaagatggaaaaattcactgcggcaggcatcatgccgagctacttaaaccacggtgcagcgcatgcgacgagattattttcgccgacgaatgtaccgaagcggaggggcgacactggcatatgaaacacttctgctgtttggagtgtgagaccgttctgggcggtcagcggtatattatgaaggatggcaggcccttttgctgtggttgctttgagtccctgtacgccgagtactgtgaaacatgtggagaacacattggcgtggatcatgcgcaaatgacttacgacggccagcactggcacgcaaccgaagcctgctttagctgcgcccagtgcaaagcctctcttcttggatgtccatttctccctaagcagggacagatctattgctcaaagacatgttcattgggcgaggatgtgcacgcgagcgattcctcggactccgcctttcagagtgctagatcaagagacagcagacggtcagtccggatgggaaagtcatctcggtcggcagatcagtgccgccagagcctcctcctgagccccgcactaaactacaaatttcccggactctctggcaatgcagatgatacgctgagtagaaagctcgatgacttgagcctgagtcgccagggcacgtcatttgcctccgaggagttttggaagggccgtgtggaacaggagacccctgaagatccggaggagtgggcagatcacgaagattacatgactcagctgctcttgaaattcggggataagtctctcttccaaccccagccgaatgaaatggatattagggcctcagagcactggatctccgataatatggtgaagtccaagacagagctaaagcagaataatcagagtttggcctctaaaaaatatcagagcgacatgtactgggcacaatctcaggatgggctgggtgacagcgcttatggttctcacccaggcccagccagctccaggaggctccaggagctcgaactggaccacggtgccagcggctacaaccatgacgagacacagtggtacgaggatagcctggaatgtcttagcgatctcaaaccagaacaatctgttagggattcgatggactctctcgcgctgtcaaacattaccggagctagcgtggacggcgagaacaaacctagacctagcctgtacagcctccagaattttgaggaaatggagaccgaagattgcgagaagatgagtaacatgggcactctaaatagcagcatgttacacagaagcgcagagagcctgaaaagcctatccagtgaactgtgtcctgaaaagattctgccagaggaaaagccggtgcatcttccggtcctgaggcggtctaaatcccagtcgcgaccgcagcaggtgaaattcagcgatgatgtcattgacaatggtaattacgacattgaaattcggcagcccccaatgagcgaaaggacgcgccgtcgggtgtataacttcgaagaacgcggatcgcggtcacaccatcataggaggagacggagtcgcaaaagccggtcagataatgctctgaacctcgttaccgagagaaaatattctcccaaggacaggctacggctctatactcccgataattacgagaagttcattcagaataaatccgcgagagagattcaggcatacattcagaatgcagacttgtacggacagtatgcccacgctacaagcgattatgggctgcagaaccctggtatgaacagatttctggggctttacggggaagatgatgactcttggtgtagctctagctcttcctcctccgattctgaggaagagggttatttcctgggccaaccgatcccgcagcctcggcctcaaaggttcgcatattacactgatgacctctccagtcctcctagtgcacttcctactccccagttcggccagcgcacaactaaatctaagaaaaagaaagggcacaagggaaaaaactgcataatctcctag

SEQ ID NO: 236040 - DNA, 2535 bp, Artificial Sequence
  Description of Artificial Sequence: Synthetic coding sequence
atggttaccgtcatgcccctggagatggagaagacaataagtaaactgatgtttgactttcagcggaatagtactagtgatgacgatagcggttgcgctctcgaagaatacgcttgggtgccacccggtctgaagcctgaacaggtgcaccagtactactcgtgtctgcccgaagagaaggttccgtatgttaattcccctggggaaaaactgcggatcaagcagctgctgcaccagcttcctcctcacgataatgaagtcagatactgcaattctctcgacgaggaggaaaagcgcgagcttaaactgttttcctcacaaaggaagagggagaatttgggcaggggcaacgttcggccattccccgtcacgatgactggggctatttgtgagcaatgtggcggtcagattaacgggggtgacatagccgttttcgctagtcgtgccggacacggagtgtgttggcaccccccatgcttcgtctgtacagtgtgcaacgagctgctggtggatctgatctacttctaccaggacgggaagatttactgcggccgacatcacgccgagtgccttaagccccgatgcgcggcttgcgacgaaattattttcgcagatgagtgtacagaagcggagggcagacattggcacatgaagcacttttgctgcttcgagtgcgagactgtgctgggaggccagcgttatatcatgaaggagggaaggccatactgttgccactgcttcgaaagcttgtacgctgaatactgtgatacctgcgcacaacacataggtatagaccagggccagatgacgtatgacgggcagcattggcacgcaaccgagacctgcttttgttgtgctcactgtaaaaagagccttctgggtaggccatttctcccgaaacaagggcagatcttctgttctcgggcttgctccgccggagaggatcccaatggttccgacagttctgattcggcttttcagaacgcccgagcaaaggagtctaggcggtccgctaagatcggaaagaacaagggaaaaaccgaggaacctatgttaaatcagcactcccagttgcaagtgagttctaatcgcctgtcagctgatgtcgaccccctctccctccagatggacatgttgtctctctccagccagacgcctagcctcaatcgggatcccatttggcgtagcagagaggaaccatatcactacgggaataaaatggagcagaaccagacccagagccccctccaactgctgagccagtgtaatattaggacatcatacagtcccggaggacaaggtgctggtgcacagcccgaaatgtggggcaagcacttttccaatcccaaaagatcgagcagcctagcaatgacaggacatgccggttcattcatcaaggagtgcagagaagattactaccccggaaggctgcgatcccaggagagttattcagacatgtcctcccagagtttcagtgagaccagagggagcatccaggtacctaaatatgaagaggaagaggaggaagaagggggtctgtcaacccagcagtgccggactcgccacccaatctcttcactgaagtacaccgaggacatgactccaaccgagcagacaccaagaggctctatggagagcctcgctctgagtaatgcaacaggcttatccgcagatggaggtgctaaaaggcaggaacacctgtctagattcagtatgccggatctgtctaaggattccggaatgaacgtctccgaaaagctttcaaacatggggactttaaattccagtatgcagttcaggtccgccgaaagtgttcgcagcctcctttctgcacaacagtatcaggaaatggagggaaatctgcatcagctgtccaatccaattgggtaccgggacctccagtctcatgggaggatgcaccagagttttgactttgacggaggcatggcaggctccaagctgcccggacaggagggggtcagaatccaaccaatgagtgagcgcaccagaaggcgggctaccagcagggacgacaataggcggtttcggcctcaccgctctagaagatcacgaaggtctcggtccgacaatgccctgcacctggcatctgaaagagaggccattagccgccttaaggatcggccaccactgcgggctcgtgaggactacgatcagtttatgaggcaaaggagtttccaggagagcatgggccacggcagtcgcagggacctgtatggacaatgtcctcggactgtgtccgacctggccctacaaaatgcgttcggagacagatgggggccttattttgcagagtacgattggtgtagtacgtgttccagttcaagtgaaagcgacaacgaaggctacttccttggtgaacctattccgcaacctgcaaggctccggtacgtgacctcagacgagctgctccacaaatactcgagctatggactgcctaagtcatccaccctgggtggccgtggtcagcttcactctagaaagcgccagaagagtaaaaattgcattattagttag

SEQ ID NO: 236041 - DNA, 453 bp, Artificial Sequence
  Description of Artificial Sequence: Synthetic coding sequence
atggtaactgtcatgcctctggagatggagaaaaccatcagcaagctcatgttcgattttcagagaaatagtacatctgacgatgactctggctgtgcccttgaagagtatgcgtgggtgcctccaggtttgaaaccggaacaggtccatcagtactactcctgcttgccggaagaaaaggtgccatatgtcaacagccccggagaaaagctgcggattaaacaactgctccaccagctgccaccacatgacaacgaggtgcgttattgcaattcacttgatgaagaggagaaacgtgagttgaagctctttagcagtcaacgcaaacgggagaatttaggaaggggaaatgtgcggccttttcccgtgactatgactggcgcaatttgcgagcaatgtggagggcagattaatggcggagatattgcagtgttcgcctcacgggctggttag

SEQ ID NO: 236042 - DNA, 1263 bp, Artificial Sequence
  Description of Artificial Sequence: Synthetic coding sequence
atggaaacttttgatcccactgaattgcccgaactcctgaaactttactaccgccgtctcttcccctacagtcagtattaccgctggttaaactacggcggagtgatcaagaactattttcagcacagagagttctcattcaccctgaaagatgatatctacatcagatatcaaagctttaataaccagtctgacctggagaaagagatgcagaaaatgaatccatacaaaattgacatcggcgctgtgtacagccatcggcctaatcagcacaatactgtgaagctgggagcctttcaggcacaggaaaaggagctcgtctttgatatcgacatgactgactacgatgacgtgcggagatgttgctctagcgccgacatctgcccaaagtgttggaccctcatgaccatggccataagaattattgacagggcccttaaagaagacttcggcttcaagcatagattatgggtctattccggtagacggggagtgcattgttgggtctgtgatgaatctgttagaaagttgtcctcagctgtgcgctctggtattgtggagtacttgtccctggtcaagggaggacaggacgtgaaaaagaaagtgcatctgtcagagaaaattcaccctttcatcagaaagagcataaacattattaaaaaatactttgaggagtatgcactcgttaaccaagatattctggaaaataaggaaagctgggacaaaatcctggctctggttcccgagacaattcacgatgagctgcaacagtcattccagaaaagccacaattcactgcagaggtgggagcatctaaaaaaggtcgcctcccgttaccagaataatatcaagaatgacaagtacggcccttggctcgagtgggaaatcatgctgcagtactgttttcccaggctagatattaatgttagtaaaggcattaaccatctgcttaaaagcccattcagcgttcaccccaagaccggacgtatcagtgtgcctattgatttgcagaaagttgaccaattcgacccatttaccgtccctaccatatcatttatttgccgcgagctggatgcaatctccacgaatgaggaagaaaaggaggaaaacgaggccgagagcgatgtgaaacaccgcactcgggactacaagaaaacttctctggccccttacgtgaaggtgttcgagcactttctcgagaatctggataaaagccgtaagggagagttgcttaagaaaagcgatctgcagaaggacttctag

SEQ ID NO: 236043 - DNA, 1284 bp, Artificial Sequence
  Description of Artificial Sequence: Synthetic coding sequence
atggagacattcgatccaaccgagttgccggagctgctgaaactttattatcgccgtctgtttccatacagccagtattaccgctggctgaactacggcggagtgatcaagaactattttcaacatcgagagtttagtttcactctcaaggacgatatctacatcaggtaccaaagctttaacaatcaaagtgatctggagaaggaaatgcagaaaatgaatccatataaaatcgacatcggagccgtgtatagtcaccggccaaaccagcataataccgttaagctgggtgcttttcaggcacaagagaaagaattagtctttgacatcgacatgaccgattacgatgatgtgcgtcggtgttgctcgtcagcagacatctgccccaagtgctggacattgatgaccatggcgattcggataattgacagagccctcaaaggaaaggattttggcttcaagcatcgtctttgggtctatagtgggaggcgcggtgtgcactgttgggtctgtgacgagtcggttaggaaactgagttcagccgtaagatctggcatagtcgagtatttgtctttagtcaaggggggacaggacgtaaaaaagaaggtgcacctatcagaaaagatccacccatttattcgaaaatctatcaatataatcaagaagtatttcgaagagtacgcacttgtaaatcaggatatcctcgaaaacaaagagtcttgggataaaatcttggctcttatgggattattcctgaatgatccttccccaattcacgatgagctacagcagtccttccagaaaagccacaattctcttcagcgttgggagcacctgaagaaggtcgcttctagatatcaaaacaatatcaagaacgataaatacggcccttggctcgagtgggagataatgttgcagtactgcttcccaagactggatatcaatgtctcaaagggaattaaccacctactcaaatctccgttctctgtccatcctaagactggtaggatatccgtgccaatcgacctgcagaaagtagatcagtttgatccctttacagtgccgaccattagcttcatctgccgcgagctggatgccatctctactaatgaagaggagaaagaggaaaacgaagccgaatctgatgttaagcacagaaccagagattacaagaaaaccagtctggccccatatgtaaaagtgttcgagcatttcctggagaacctcgacaagtcccgcaagggggaacttctcaaaaagtcagacctgcagaaggacttttag

SEQ ID NO: 236044 - DNA, 762 bp, Artificial Sequence
  Description of Artificial Sequence: Synthetic coding sequence
atggcgaatctgggctgctggatgctggttcttttcgttgctacatggagcgaccttggactctgtaagaaaaggcccaagcccggaggctggaatacaggagggtctaggtaccctggacaggggagtcccggaggcaaccggtatccccctcagggaggaggcggttggggccagccccacggcggaggatggggacaaccccacggagggggatggggtcaaccccacggaggaggatggggacaaccacatggtgggggttggggacagggaggcggaactcatagtcagtggaataagccctcaaaacctaagaccaatatgaaacatatggccggtgcagccgcagctggggcagttgttggaggacttggagggtacatgcttggctccgccatgtcgagaccaatcatccattttggcagcgactacgaagacagatactaccgggaaaacatgcatagataccccaatcaggtgtattacagacctatggacgaatattcaaatcagaacaatttcgtgcatgactgcgttaacattacaattaaacagcacaccgtgacaactactaccaagggcgaaaatttcaccgaaacagacgttaagatgatggagagggtcgtcgaacagatgtgcatcactcagtatgaaagagagagccaggcatattatcagaggggatcctcaatggtgctgttttcttcccctccggtgatcctcctgatctcatttctcatttttctcattgtaggttag

SEQ ID NO: 236045 - DNA, 750 bp, Artificial Sequence
  Description of Artificial Sequence: Synthetic coding sequence
atggcgaaccttggatgttggatgttggtcctcttcgtggccacatggagtgaccttggtctgtgtaagaaacgccctaagcccggaggctggaacacaggcggaagtaggtatcccggacagggatcccccggtggaaacagatacccaccccagggtggaggcggatggggccaaccccatggcggagggtggggccaaccgcatggagggggttggggccagccgcacgggggtggctggggccaacctcacggaggcggttggggccagggcggaggcacccacagccagtggaacaagccctccaaacctaaaaccaacatgaagcatatggccggtgccgctgctgccggtgccgtggtggggggattgggagggtacatgctcggctctgctatgtcccgccctatcattcacttcggcagcgactatgaggacagatattatcgggagaacatgcataggtatcccaaccaggtgtattatagacccatggatgagtacagcaatcaaaataatttcgtgcatgactgcgtgaatatcacgattaagcagcacacagtcactactacaaccaaaggtgaaaacttcactgagactgatgtcaaaatgatggaacgggttgtggagcagatgtgcataacccagtacgaacgggagtcccaggcttattatcaacgaggaagtagtatggtcctattcagctcccctcccgtgatccttctcatctccttcttgatcttttag

SEQ ID NO: 236046 - DNA, 762 bp, Artificial Sequence
  Description of Artificial Sequence: Synthetic coding sequence
atggctaacttaggatgctggatgctggtcctcttcgtggcaacgtggagcgacctggggctctgtaagaagcgccctaagcctggaggctggaacacagggggaagccgctaccccggacaaggcagccctggcggaaacagatatccacctcaggggggaggcggatggggccagccacacggcggaggctgggggcaaccccacggagggggttggggacagcctcatggtgggggatggggccagcctcatggaggcggatgggggcaggggggaggtactcatagccagtggaacaaaccctctaaaccaaagacaaatatgaagcacatggcaggggctgccgcagccggtgcagtggtgggcggactgggaggatacatgctcggaagtgccatgtcaagacccatcattcatttcggtagtgactacgaggaccgctattatcgtgagaacatgcacaggtaccccaatcaggtgtactatcgccctatggacgagtactccaaccagaacaactttgtccacgactgcgtcaatatcacaatcaagcagcatactgtcactacaacaacaaaaggcgaaaattttaccgagactgatgtgaagatgatggagagagtcgtggagcaaatgtgcatcacccaatatgaaagggagtcacaggcatattaccagcggggatccagcatggtccttttttcttcccctcctgtcatcctgctgatatcctttttgattttcctgattgtggggtag

SEQ ID NO: 236047 - DNA, 579 bp, Artificial Sequence
  Description of Artificial Sequence: Synthetic coding sequence
atggaacattgggggcagcctcacggcggaggttggggccagccgcacggaggaggatggggccagccacacggcggtggctggggccagggtggtggcacccacagccagtggaacaagcccagcaagcccaagaccaatatgaaacacatggcaggcgcagccgcagccggagcggtggtcgggggactgggcggatacatgctggggtcagctatgagtcgcccaatcattcacttcgggtcagactatgaggatcgctattaccgggagaatatgcaccgatacccaaatcaggtatattatcgacccatggatgaatatagcaatcagaataacttcgtgcacgactgtgtcaacattactataaaacagcacacagtcacaactactaccaaaggcgaaaattttactgagactgatgtgaagatgatggaaagagtcgtggagcagatgtgcatcacacagtacgaacgcgagagccaggcatattaccagcggggaagttctatggtactcttttcttcgccccctgtcatccttctgatctcctttctgatattcctcatcgtcgggtag

SEQ ID NO: 236048 - DNA, 654 bp, Artificial Sequence
  Description of Artificial Sequence: Synthetic coding sequence
atggccaacttgggctgctggatgctcgttttgtttgtggcaacctggtcggatctgggcctgtgcaagaaacggccaaagcccggaggctggaacaccggcggatcccggtatccaggccaaggcagcccgggaggcaacagatatccaccccagggagggggtggatggggtcagccacacggaggcggatggggacagccccatggaggcggttggggccagcctcatggcggaggttggggccaaccccatggcggaggctggggacaaggcggtggcacccacagtcagtggaataaaccttcaaaacccaagaccaatatgaagcacatggcgggagctgccgctgccggagcagtcgtgggagggttaggcggttatatgctgggatctgccatgtcccggcctatcattcactttggaagtgactacgaagacaggtattacagagagaacatgcaccgctaccctaaccaggtgtactaccgaccaatggatgaatatagcaaccagaacaactttgtccacgactgcgtaaatatcacaattaaacagcacaccgtaacaaccaccactaagggtgaaaatttcactgaaaccgacgtcaaaatgatggagagggtggtcgaacagatgtgtattacacagtag

SEQ ID NO: 236049 - DNA, 531 bp, Artificial Sequence
  Description of Artificial Sequence: Synthetic coding sequence
atgcgcaaacacctgagttggtggtggcttgcaactgtgtgcatgctcctgttctcccacttgtcggccgtgcagactcgcggtatcaagcacaggatcaaatggaacaggaaagctctgcccagcaccgcgcaaatcaccgaagcccaggttgccgagaaccgcccaggcgctttcatcaaacagggaagaaagttggatattgactttggggcagagggtaaccgttattatgaggccaactattggcagttccccgatggtatccactacaacggatgcagcgaagctaatgtgacaaaggaggctttcgtaaccggatgtatcaacgctactcaggctgcaaaccagggagagtttcaaaaacctgataataagttacatcagcaggtgctttggaggctggtgcaggaactctgttcactcaaacactgcgaattttggctggagcggggagcaggcctgcgtgttaccatgcatcagcctgtactgctgtgcctgctggccttaatctggctgaccgtgaagtag

SEQ ID NO: 236050 - DNA, 1023 bp, Artificial Sequence
  Description of Artificial Sequence: Synthetic coding sequence
atggcgacaggtggataccggacttcaagcggcttaggcggatctacaactgacttcttagaggaatggaaagcaaaaagagaaaaaatgcgcgcaaaacagaatcccccagggcctgccccacccggaggaggatcatcagacgccgctggcaaacccccagcaggcgcactggggactcccgctgccgctgcagctaatgagttgaacaataacctgccaggcggagcccctgccgctcctgctgttccgggaccaggaggagttaattgtgctgtgggtagcgccatgctgacgcgcgctgccccaggccctagacgatctgaagacgagcctcccgcagcatctgccagcgccgctcctccaccgcagagggacgaagaggaaccggatggggtccccgagaaaggtaagagttccggaccaagtgcccgaaaggggaaagggcaaattgagaaacgaaaactgcgggagaaacgaaggagtactggggtcgtgaacatccctgccgcagaatgcttagacgagtacgaagatgacgaggccggacagaaagaacggaagcgcgaggacgctatcacacagcagaatacgatccaaaatgaggccgttaatctgctagaccctggctctagttacctcctccaagaaccaccgagaacagtcagcggtcggtacaagtccactacctccgtgtctgaggaggacgtttcaagtcgttacagccgaacagaccgcagcggattcccgaggtacaatagagatgcaaatgtgtctggtacactggtgtccagttcaactctcgagaagaagattgaggatttggaaaaagaggtggtgagggagcgacaggaaaatctgagactagtgagactgatgcaagataaggaggagatgattggcaagctgaaggaagagatcgacttgttgaatcgcgacctcgatgatatcgaagatgaaaatgaacagctgaaacaggaaaacaagacattgctgaaagtggtaggccagctcactcggtag

SEQ ID NO: 236051 - DNA, 231 bp, Artificial Sequence
  Description of Artificial Sequence: Synthetic coding sequence
atggccactggtggttaccgaacttcgagtggcttgggaggctccacaacggattttttggaggaatggaaagctaagcgcgaaaagatgcgcgctaagcagaaccctcctggacccgctccccctggcggtggatctagcgacgccgcaggcaaacctccagctggtgccctgggaactccagccgcagctgccgctaacgagttaaataataatctgcccggtggttag

SEQ ID NO: 236052 - DNA, 195 bp, Artificial Sequence
  Description of Artificial Sequence: Synthetic coding sequence
atggcaacagggggataccgaaccagcagtgggctcggtggatcaacaacagattttttggaagagtggaaggccaaaagggaaaaaatgcgggctaagcagaatccacctggcccagccccacctggaggcggttcctccgacgctgctggcaaacctcccgctggagccctcgggacgcccgcagctgcctag

SEQ ID NO: 236053 - DNA, 663 bp, Artificial Sequence
  Description of Artificial Sequence: Synthetic coding sequence
atgaaatcagtaatataccacgctctgagccaaaaggaggctaatgatagcgatgtgcagccctctggggctcagagggcagaggccttcgttagggcgtttctcaaacgttcaacacccaggatgtccccccaagcacgcgaagaccaactccaaaggaaagccgtggtgctcgaatacttcactcggcacaagcggaaggagaagaaaaagaaagctaagggactctccgctcgccagagaagagagcttcgcctgttcgatattaagcctgagcaacagcgttacagcttgtttctgccactgcatgaactttggaagcaatatatccgggacttgtgctctggcttgaagccagacacccagccccagatgatacaggctaagctgctaaaagcagatctgcatggggcaattatctcggttaccaagtctaaatgcccaagctacgttggaattacaggcatcctactgcaggagacaaaacatatctttaagatcatcactaaggaagataggctgaaagtcattcctaagttgaactgtgtgtttaccgtagagaccgatggattcatttcatatatttacggatccaagttccaactgcggtcatcagagcgaagcgccaaaaaattcaaggcaaaagggacgattgatctgtag

SEQ ID NO: 236054 - DNA, 1695 bp, Artificial Sequence
  Description of Artificial Sequence: Synthetic coding sequence
atgagtagccatgggaatagcctttttttaagggagagtggccagcgtcttggaagagtcggctggctacaacgtctacaggagtcactgcagcagagggctctccggacccgtctccggctgcagacaatgacgcttgaacacgtgctccgatttctgagacgcaatgctttcattttactaactgtctccgccgtcgtgatcggagtgagcctggctttcgctcttcgcccatatcagctcacataccggcagatcaagtatttttcatttccaggcgagctgctcatgcgaatgttacagatgctggttctccctctgatagtatccagtttagtgactggcatggcaagcctcgataacaaggctaccgggaggatgggtatgcgcgcagccgtgtattatatggtgaccaccatcattgctgtcttcattgggatcttaatggtgaccatcatccacccagggaagggatcgaaggaaggccttcaccgcgagggacgcatagagacaattccaactgccgatgcttttatggatcttataagaaacatgtttcctccgaacttggttgaggcatgttttaaacagttcaaaacccagtatagcaccagggtggtcactcgaacaatggtgcgcactgagaatggctctgagcccggtgcgtctatgccacccccattcagtgtggaaaacgggacaagttttctggagaacgttacgcgggctctcgggacattgcaggaaatgttgagttttgaagaaacagtccctgtccctggtagcgccaacggaattaatgctctgggactcgtagtcttttccgtcgcttttgggctggtgatcgggggtatgaagcataagggccgtgttctccgggacttcttcgactcattgaacgaggctatcatgcgcctggtgggcattatcatctggtacgccccagtcggcattctgtttctgattgctgggaagatactggaaatggaggatatggctgttctggggggtcaactcggcatgtacactcttactgtaattgtcggactgtttctacatgcaggcattgtcctccctctgatctatttcctggtgacccataggaacccattcccgttcatcggcggtatgcttcaggctctgatcacagccatggggacctcgtcttcttccgctacactacccattacttttcggtgtctggaggagggccttggcgtggatcgtagaatcactcgattcgtgctgcccgtgggcgcaacagtaaatatggacggaactgccctgtatgaggcactcgctgcgatcttcatcgcccaggtcaacaattatgagctgaatttgggccagatcacaactatttcaatcacggcaactgcggctagcgtcggggctgcaggcataccccaggccggtctggttacaatggtgatagtgctgacatcagtgggactgcccacggaggacatcactctgatcattgcagtcgattggtttctcgacagactgcgcaccatgactaatgttctcggagatagtatcggcgcagccgtgattgaacacctgtcccagcgagagctggagctccaagaggccgagctcacccttccttccctaggtaagccttacaaaagccttatggcccaagagaagggcgcttcacggggacgaggagggaacgagtccgcaatgtag

SEQ ID NO: 236055 - DNA, 420 bp, Artificial Sequence
  Description of Artificial Sequence: Synthetic coding sequence
atgcactgcctgcggaagcggaggatgacccccatgtccagatattctctgttccttccgcttcatgagctctggaagcagtacatccgcgatctgtgcagcggactgaaaccggatacgcaaccacaaatgatccaggcaaaactcctcaaggcggatctgcacggcgctatcatttctgtgactaaaagcaaatgcccaagctacgtggggatcaccggaatactcctgcaggagaccaagcacatattcaagattatcacaaaggaagacagactgaaagtgattcctaagctgaattgcgtgttcaccgtagagaccgacgggtttatttcctatatatacgggagcaaattccaactccggtcgagcgaaagaagcgcaaagaagtttaaagcaaagggcacaatcgatttatag

SEQ ID NO: 236056 - DNA, 342 bp, Artificial Sequence
  Description of Artificial Sequence: Synthetic coding sequence
atggtccgtttcaagcatcgctatctgctgtgcgagttggtctccgacgatccgcgatgcagactgagcctggacgatcgggtgctgtcctctttagtacgtgatactattgccagagtccatggaacattcggggctgcggcttgttccatcggtttcgcgggtacaatccgcacctgccaaaagtttttaatacagtacaacaggcgtcagttattgatactcctgcagaactgcactgacgagggcgagagagaggccattcagaaatcagtaacgagaagctgtctgttggaggaggaagaggagagcggagaggaagccgcagaggccatggagtag

SEQ ID NO: 236057 - DNA, 492 bp, Artificial Sequence
  Description of Artificial Sequence: Synthetic coding sequence
atggtgcggtttaagcatagatacttgctgtgcgagcttgtcagcgacgacccccgttgccggctgtccctcgatgatcgggtgctgagttctctcgtgagggataccatcgcgcgagtgcacggtactttcggtgccgctgcttgtagtatcgggttcgcggtgcgctacctgaatgcttacactgggatcgtccttctccgatgcaggaaggagttctatcagttagtgtggtccgccttaccgttcattacatacctcgagaataagggccaccgatacccctgtttcttcaacacgctccatgtagggggtaccattcggacctgtcagaaatttttgatccagtataatcggagacagctcctaatactgctgcagaactgcaccgatgagggcgagcgagaagccattcagaaatctgttactagaagctgcctgttagaggaggaagaggagagcggagaggaagcggctgaagctatggagtag

SEQ ID NO: 236058 - DNA, 423 bp, Artificial Sequence
  Description of Artificial Sequence: Synthetic coding sequence
atggctgagaatcgcgaaccgcgtggtgccgtagaagctgagctagatcctgtcgaatatactctgcgcaaaagactgccgtctcgactgccgaggcggcctaatgatatctatgtaaatatgaaaacagactttaaagcccagttggctcgttgccagaaacttctggacgggggagcacgtgggcagaacgcctgctccgagatttacatccatggcttggggctggccattaatcgggcaatcaatatcgcgctccagctgcaggcagggtcattcggttctttgcaggtggccgcaaatacctccacagttgaacttgtcgatgagctagagcccgagacggacacgagagaaccacttactcggattagaaataactcagccatccacattagagtgttccgcgtgacccctaaatag

SEQ ID NO: 236059 - DNA, 414 bp, Artificial Sequence
  Description of Artificial Sequence: Synthetic coding sequence
atggcagaaaaccgggagcctcgaggggctgtggaagccgaactagatcctgtagaatacacgctccgcaaaaggctgccatctcgtctgccacggaggcccaatgacatctatgtcaatatgaagacagactttaaggcccagttagcaaggtgccagaaactccttgacgggggagcacgtggccagaacgcctgcagtgaaatctacattcatggattgggactggcgattaatcgcgcaatcaacatagctttacaactgcaggctggttcctttgggtcactccaagtggccgctaacacgtccactgtggagctggttgacgaactcgaaccagagactgatacccgagaacccttaactcgcattcggaataactccgctatacacatccgggtgtttcgcgtctag

SEQ ID NO: 236060 - DNA, 708 bp, Artificial Sequence
  Description of Artificial Sequence: Synthetic coding sequence
atgaggcgtggggcacctcaggatcaggaattagtgggccctggcccaccgggacggggaagtaggggagccccacctcctctggggccagtggtccccgtcctcgtgttcccaccagacctggtattccgggctgaccagcgtagcgggccacgccagctgttaactttatataatcccactggaacggccctaaggttccgcgttctgtgtacagccccagctaagtacactgtcttcgatgcagaaggctacgtcaagccccaatcctgtatcgatatcgttattcgccacgtggccccaatccctagccactacgacgtgcaagacagattcagaattgagttaagcgaggagggagcagaaggaagggtcgtcggaaggaaagacattacttctattttgagggctccagcttaccccctagagcttcagggtcagcctgatcccgcacccaggcctggtccacccgctggaacaccaccccctactgctaggcactttcaggaacatccgagacagcagctcgccacctcaagttttctgctcttcctgctgactggtattgtcagcgttgccttcttgctgcttcctctgcctgacgaattgggaagccaactaccacaggttctacatgtatctctgggtcaaaagctggttgccgcatacgttctgggccttttaacaatggtgttcctgaggacatag

SEQ ID NO: 236061 - DNA, 1248 bp, Artificial Sequence
  Description of Artificial Sequence: Synthetic coding sequence
atgcgtggggcaaacgcctgggcccctctatgcctgttgttggcggctgccacccagctgagcagacagcagagcccagaaagacccgtcttcacgtgcgggggaatccttacaggcgagagcggctttatcgggagtgaggggttccctggggtatacccgccaaattcaaagtgtacctggaagataaccgttcctgagggcaaggtcgtcgtgctgaattttagattcatcgatctggagtcagacaatctgtgccgttacgacttcgtggatgtctataacgggcacgccaatgggcagcggatcggcagattttgtgggacctttaggcccggagcccttgtcagtagtggaaataagatgatggtgcagatgatctccgatgccaataccgctggtaatggctttatggccatgtttagcgccgcagaaccaaacgagaggggcgatcagtattgcggtgggctgctggacagaccctccggatcattcaagacgcccaactggcctgatcgcgactaccctgcgggagtcacatgcgtgtggcacattgtcgcccctaaaaaccagttgattgagctgaaatttgagaaattcgacgtagaaagagacaactattgccgatatgactacgtcgctgtgtttaatggcggagaggtgaatgatgcgaggaggattggtaagtactgtggtgacagcccacctgccccaatcgtgagcgagaggaatgagctgttgatccagtttctctctgacctgtcactgactgctgatggcttcatcggccactatattttcaggcctaaaaagctaccaacaactaccgagcaaccagtgacaacaacgtttccagtgaccaccggcctgaaacctacggtagcgctctgtcagcagaaatgccgtcggactggaactctggagggcaattattgttcaagtgactttgtactggcgggaaccgtgatcactacaattactagggacggatctttgcacgccacagtgtccatcataaatatctacaaggaagggaatctcgctatacagcaggccggtaaaaacatgagtgctcgactcaccgttgtctgcaagcaatgccccctccttcgacgcggactcaattacataattatgggacaggtcggcgaagacggaaggggcaaaattatgccgaattcgttcattatgatgtttaagactaaaaaccagaagctgctggatgcactgaagaataagcagtgctag

SEQ ID NO: 236062 - DNA, 2184 bp, Artificial Sequence
  Description of Artificial Sequence: Synthetic coding sequence
atgcggcctcttctgctgctcgccctcttgggatggctgctcttagcagaggccaagggggacgcaaaacccgaggacaacttgctagtgctgactgttgccaccaaggagaccgaaggattcaggcgtttcaaaaggagtgcccagttcttcaattataaaattcaggccctcggcctgggcgaggactggaacgtagagaagggtacttcggccggaggcggtcagaaggtacgcctgcttaaaaaagcgctggaaaaacatgccgacaaggaagaccttgtgatactgttcgccgattcctatgatgtgctgttcgcctcaggccctagagagctgctaaaaaagttcaggcaggcaagatcgcaggtcgttttttctgccgaagagcttatttaccccgataggcggctggagactaagtaccctgtcgtgagcgacggcaagcgttttctcgggtcgggcggttttatcggatacgcgccaaacctgtcgaagctcgttgcagagtgggaaggccaggacagcgacagtgatcagctgttctacactaaaatcttcctggatcccgaaaaaagggagcagataaacataacgctggatcataggtgcagaatctttcagaacctagacggggctctggatgaggtcgtgttgaaatttgagatgggccacgtacgggctcgaaacctggcctatgacactctgccagtactcattcacggaaacggccctaccaagctgcagctaaactatctgggcaactatatccctcggttctggaccttcgaaactgggtgtacggtgtgcgacgagggactaaggagtctgaaggggatcggtgacgaggctctcccaacagtacttgttggtgtcttcattgagcaaccaaccccctttgtgtctttgttcttccaacggctgctccggctgcattacccacagaagcacatgaggctcttcattcacaatcacgagcagcaccacaaggcccaggtcgaagagttcttggcgcaacacggttcagaataccagtccgtgaagctggtgggtcctgaagtgcgcatggcaaacgcagacgccaggaacatgggcgctgacctttgtaggcaggatagatcatgcacgtactacttcagtgtagacgcggacgtcgctcttaccgagcccaacagcttacggctgctgattcagcagaacaagaacgtgattgcaccgctcatgacaaggcacggtcggttatggagtaatttttggggagccctcagtgccgatggatactacgccaggagcgaagactacgtcgatattgttcagggcaggagggtgggtgtgtggaacgttccttacatatctaatatctacctgatcaaaggtagtgctttgcggggagagctgcagagctcggacctgttccaccatagtaagctggaccccgacatggccttctgcgccaacatccgccaacaagatgtgtttatgtttctgacaaataggcacactctgggacacttactctctttggattcctatcgcaccactcacttgcacaacgatctgtgggaggtcttttccaaccccgaagactggaaggagaaatacatccaccagaattacaccaaggcactagccggtaaactcgtagaaacaccatgtcctgacgtgtactggtttccaatattcactgaggtggcatgcgatgaactcgtggaggagatggaacacttcgggcagtggtcgctaggcaacaataaagacaataggatacagggcggatatgaaaacgtacctactattgacatccatatgaaccaaattggattcgagcgcgaatggcacaagtttcttctggagtacatcgctcccatgaccgagaaactttatcccggatactacacaagggcacagttcgatctggccttcgtcgtccgttacaagcccgatgaacagccgtccctcatgcctcatcacgacgctagtacatttaccatcaacatcgccctcaacagggtgggagtcgactacgagggcggaggttgtcgattcctccggtataattgtagcatcagagcacctaggaaaggctggacgttaatgcaccccggacgcctgacgcactatcacgaaggccttcccacaacccgagggacacggtatatcgccgtctcttttgtggatccatag

SEQ ID NO: 236063 - DNA, 600 bp, Artificial Sequence
  Description of Artificial Sequence: Synthetic coding sequence
atgagacctctgctgctcctggctcttctcggttggctgctattggccgaggccaaaggagacgctaaacccgaggataacctcctggtcctgacagtggctacaaaagaaaccgagggtttccgtcgcttcaagagatcagctcaattttttaactataagatccaggcgctgggtctcggcgaagattggaacgtggaaaagggcactagcgcagggggagggcagaaggtgcggctgttgaagaaagccctggagaaacatgccgacaaggaggacttggttattctattcgcagatagctacgatgtcctgttcgccagcgggcctcgagaactgctgaagaaattccgtcaagcccgaagtcaggtggttttttcagctgaggagcttatttacccagacaggcgcctagaaacaaaatatcctgttgtcagcgacggcaagaggtttctcggcagtgggggattcatcgggtatgctcccaatctcagcaaactcgtggctgagtgggagggtcaggattcagacagcgaccaactgttctataccaaaatatttttagacccagaaaaaagagtgagccgcttgcattcgtag

SEQ ID NO: 236064 - DNA, 2325 bp, Artificial Sequence
  Description of Artificial Sequence: Synthetic coding sequence
atgaggcccctgttgctcttggcgctgttggggtggttgctccttgctgaagctaagggtgacgcaaagccggaggccccatgttgtcaggaaggactgcgtgccggtggcagcggaagtctccacctgggacgcgactttaccgtcctcgcaggggctaggggttcaccatctccctctgttagttcgattcctcgattctggatacctggcagcgataatctgctggtgcttaccgttgcaaccaaggagaccgagggttttaggcggttcaaacgcagcgctcagttttttaactataagattcaggcactcgggttgggagaggactggaacgttgagaagggaacttcagcagggggtgggcagaaggttcgactcctcaagaaggccctggaaaagcacgcagataaggaagacctggtgattctgttcgctgatagttacgacgtgcttttcgcctcaggcccacgagagctcctcaagaagttccgccaggcaaggtcacaagtagtgttttctgccgaggaactgatttatcctgataggcggctagagacaaagtaccccgtggtaagcgatggtaagcgcttcttgggaagtggcggttttatcggttatgctccgaatcttagcaagttggtggccgaatgggaagggcaggactcggactcagaccagcttttttacaccaagatatttctcgacccagagaagcgcgagcagatcaatatcacgttggaccacaggtgtcgaatctttcagaatctagacggagctttagacgaagtggttctcaaattcgagatgggtcacgttagagctcgaaacttagcctatgacaccctgccagtgctgattcacggaaacggtcctaccaaactgcaactgaattatctgggcaattatataccacggttctggaccttcgagaccggctgcacggtctgtgatgagggcctacgcagcttgaaaggcataggggatgaggcgctgccaaccgttctcgtgggagtttttatcgagcagcccactccatttgtgagcctgttttttcagagacttttgcgcctgcactaccctcagaagcatatgcggctcttcatacacaatcacgagcagcaccataaagctcaagtcgaggagtttcttgcccagcatggctccgaatatcagtctgtcaaactggtgggaccggaagtccggatggcaaacgcagatgctaggaatatgggcgctgacttgtgcaggcaagatcggagttgcacctactatttcagtgtcgatgctgacgtcgccctgacagaacccaatagtctccgcttgctcatccaacaaaataaaaatgtgattgcccctctgatgaccaggcatggacgcttgtggtcgaacttctggggagctctgagcgcggacggctactacgcgagatcagaagattacgtggacattgtccaggggcgaagagtaggcgtgtggaacgtgccgtatatctcaaatatttatcttatcaaggggagcgctctccggggtgagctacagagcagcgacctcttccaccactccaaattagatcctgacatggccttctgtgccaacattagacaacaggacgtgttcatgtttctgactaatagacacaccctcggacaccttctgtccctcgactcctaccggacgactcatctccataatgacctgtgggaagtattctccaatccagaggattggaaggagaagtatattcaccagaattacacgaaggccttagccggtaaactggtcgagaccccctgccccgacgtgtactggttcccaatctttacagaagtcgcctgcgatgagttggtggaggagatggagcattttggccagtggagcctgggaaacaacaaggataaccgcatccagggcggatatgaaaacgtgccaaccatagatattcacatgaatcagattggcttcgagcgcgagtggcataagttcttactagagtatattgcaccaatgacagaaaagctgtacccgggttactacaccagagcacaattcgatctggccttcgttgtcagatataagcctgatgagcaaccgtcattaatgccgcatcatgatgcctctacatttactataaacatcgctctgaatagagtcggcgtcgactatgagggaggaggatgtagattcctgcggtataactgctccattcgggcacctaggaagggttggacattgatgcatcccggtaggctgacccactaccatgaaggtctaccaaccaccaggggtacacgatatatcgcagtgtcttttgtcgatccctag

SEQ ID NO: 236065 - DNA, 1176 bp, Artificial Sequence
  Description of Artificial Sequence: Synthetic coding sequence
atgcgtcctcttctgctgctagcccttcttggatggcttttactggctgaagctaaaggcgatgccaaacctgaggataacctcctggttttaacagtcgccaccaaggaaacggaggggttcaggcgctttaagaggagcgctcaattctttaactacaagatccaagccctgggtctcggggaagactggaatgtggaaaaaggcacctccgcaggaggaggccagaaggtgaggctcctgaaaaaggcccttgagaaacacgcagataaagaggacctggttatactctttgctgatagttacgatgttctgtttgcctcgggacccagagaactccttaagaagtttcgacaagccaggtctcaggtggtgttctctgcagaggaactcatttaccccgaccggagactggagacaaagtatccagtcgtgtccgacggaaaacggttcctactagaagatgtttttatgtttctgacgaatagacacactctgggtcaccttttgtccttggattcttatcgaacaactcatttacacaatgacctgtgggaggtgttttctaaccctgaagattggaaggagaaatatattcatcagaattatacgaaggccttggccggaaagctggttgaaaccccatgcccagacgtgtattggtttcccatctttactgaagtggcttgtgacgaactggtagaggagatggagcattttggccaatggagtctgggtaataacaaggacaatcggatccaaggaggctatgaaaacgttccaaccatcgacatccatatgaatcagatcggatttgagcgggagtggcacaagtttcttctagagtacatcgcgcctatgacggaaaaactgtatccaggctattatacacgagcccaattcgacctcgcatttgtggttcggtacaaacccgacgaacagcctagccttatgccccatcatgacgccagcacgttcactatcaacattgccctcaatcgcgtgggtgtggattacgagggagggggatgccgattcctgcgttataactgtagcatcagagcaccccgaaagggctggactctgatgcatcctggcaggctgacacattatcacgaggggctcccaaccactcgcggaactcgctacattgctgtatcatttgttgacccgtag

SEQ ID NO: 236066 - DNA, 852 bp, Artificial Sequence
  Description of Artificial Sequence: Synthetic coding sequence
atgagaccattactgctgttggccctgctcggctggctcctgctcgctgaggccaagggggacgccaaacctgaggacaacctattggtgttaactgttgccacaaaggagacagaaggtttccggcgattcaaaaggtcagctcagttcttcaactataagatccaggccctcgggctgggggaggattggaatgtggaaaagggtacttcagcaggaggtggccagaaggtcaggctgctcaagaaagccctcgaaaaacacgccgataaagaggacttggtgatcctcttcgccgattcttacgatgtcttgttcgcctctggacctcgagagctcctgaagaaattcagacaagccagaagccaggtcgtcttctctgccgaagagcttatctaccccgaccggagattggaaactaaataccctgtggtgagcgacggaaaaaggttcttaggcagtggcggatttataggctatgctcccaacctctctaagctcgttgccgaatgggaaggccaggattccgacagcgatcagttgttctacactaagatttttttggacccagaaaagagagaacagataaacataactcttgaccatcggtgccggatttttcaaaacctggatggagcactcgtctctccatggggacaaggccacctccccggtgcttgctatgagctgactgcgagcgtgcttacgtccgagctgtccgtgatgcctagtttccctgccgtggttctccagctcaattacttgggaaattatatcccgaggttctggacttttgagaccggttgtactgtgtgtgacgagggcctccgatcacttaagggaattgggtag

SEQ ID NO: 236067 - DNA, 678 bp, Artificial Sequence
  Description of Artificial Sequence: Synthetic coding sequence
atgcgaccactcctcctactggcattactgggctggctactcctggcagaagctaagggcgacgcaaagcccgaagcaccgtgctgtcaagagggactgagagccggtggtagtggatccttgcatttgggacgagattttacagttctggccggtgcacggggtagtccttcaccgtccgtttcctcaatccctcggttctggatcccgggaagcgataacctcttggtccttacagtggccacaaaagagaccgagggattcaggagatttaagcggagtgcccagttcttcaactacaagatccaggccttaggactaggggaagactggaacgtggagaagggaaccagcgctggagggggtcagaaggtcagactgctcaagaaagcccttgagaagcatgccgataaagaggacctggtgatcctgttcgctgatagctatgacgtgttgttcgcttctggcccaagggagctgctcaagaaattccggcaggcgcgtagtcaggtggtttttagtgccgaggagctgatttaccccgacagacgactagagacaaaatatccggtcgtgagcgacggaaaaagattccttgggtctgggggattcatcggatacgcacccaatctgtcaaagctcgtggccgagtgggaagggcaggacagcgattcatag

SEQ ID NO: 236068 - DNA, 2277 bp, Artificial Sequence
  Description of Artificial Sequence: Synthetic coding sequence
atggggggatgtacagtgaagccccagctactcctgctggcccttgtcctacatccttggaatccgtgccttggcgcagacagtgagaagccaagttccataccgactgataagttacttgtgattactgtcgcaactaaagagagcgacgggtttcacagattcatgcagtctgccaagtactttaattataccgtgaaagtgttaggccagggagaagagtggagagggggtgacgggataaatagtatcggaggcggtcagaaggtacgcctgatgaaagaagtcatggagcactatgcggatcaggacgatctggtggttatgttcacagagtgtttcgacgtgattttcgccggtgggcctgaggaagtcctgaaaaagttccagaaagccaatcacaaggttgtctttgctgcagacggaatcctctggcctgataagcggctggctgataagtacccagttgtccatatcggcaaaagatacctcaactctggtggatttattggatatgcaccatacgtgaatcgcatagtgcaacaatggaatctccaggataacgacgacgatcagcttttctacaccaaggtttatatcgatccactgaagagagaggctatcaatatcaccctggaccacaaatgtaagatcttccagaccctcaacggtgcagtggatgaagtcgtgttgaagtttgagaacggtaaagctcgcgcaaaaaatacgttctacgaaaccctgcctgtagccattaatggcaacggacccactaagatactgctaaattactttggcaattacgtacccaatagctggactcaggacaatggctgcacactttgtgaatttgacacagttgatctgtcagcggtcgacgtccatccaaacgtgtctattggcgtgtttatagaacagcctactccatttttaccaagattcctggacattctcctgacgctggattaccccaaggaagccctaaagcttttcatacataacaaggaagtgtaccacgaaaaagacatcaaagtgttctttgataaggccaaacacgagattaagacaatcaagatagtgggacctgaagaaaatctatctcaggcagaagctcgaaacatggggatggatttttgtaggcaagacgagaagtgcgactactacttttccgttgatgccgacgttgtactgactaaccctcgaacattgaaaatcctcattgagcagaatcgcaagatcatagctccgttggtcaccaggcacggaaagctctggagcaacttctggggtgctctctcaccagatgggtactacgccaggtctgaagactacgtggacatcgtccaaggtaaccgggtgggggtgtggaacgtcccttacatggcaaatgtgtatctcattaagggcaagactcttcggtcagagatgaatgaaaggaactactttgtacgggataaacttgaccctgatatggctctttgtcgtaacgcccgagaaatgaccttgcaaagagaaaaggatagcccaacaccagagaccttccagatgctctctccgcctaaaggagtctttatgtacataagcaacagacatgagtttgggaggctgctctcaacagccaattacaacaccagtcactacaataatgacttgtggcagatctttgaaaatccggtcgactggaaggagaaatacataaaccgcgactacagcaaaatctttactgaaaatattgtggagcagccttgccctgacgtcttttggtttccgattttttccgaaaaagcttgtgatgagctcgtcgaagagatggaacattacggcaaatggtccggcggaaagcaccatgactcaaggatttccggcggatacgaaaacgtcccgacagatgacatccacatgaaacaggttgacctcgagaatgtgtggctacactttattcgagaattcattgcaccagttaccctgaaggttttcgcgggttactataccaagggcttcgcactccttaacttcgttgtcaagtactctcccgagaggcagcggtctctgcggccacaccatgatgcaagcactttcactattaatatagcactcaacaacgtcggagaggacttccagggcggaggatgtaagttcctgcggtataattgctccattgagtccccgcgtaaagggtggagttttatgcaccctggcagactgacacatctccatgaaggattgcctgttaagaatggcactcgctacattgccgtttccttcattgatccttag

SEQ ID NO: 236069 - DNA, 2214 bp, Artificial Sequence
  Description of Artificial Sequence: Synthetic coding sequence
atggggggatgtacagtcaaaccgcagttgctcctcttggctctggtactacatccctggaatccttgcctgggcgctgactctgaaaagccctccagtatccccaccgacaaactgctggttattaccgtcgcgacaaaggaatcagacgggttccaccgtttcatgcaaagcgccaagtatttcaactatacagtgaaggtcctgggacagggcgaggagtggcgcggaggagacgggatcaactcaatcggcggagggcaaaaggttaggctgatgaaggaggtaatggaacattacgccgaccaggatgacctggtcgttatgttcactgaatgtttcgatgtaattttcgcgggtggtcccgaggaggtgctcaagaagtttcagaaagcaaaccacaaggtggtgtttgccgctgatggtatactatggccagacaagaggctcgccgataagtatcctgtggtgcatattgggaagaggtacctcaattcagggggatttataggatacgctccttacgtgaatcggattgtgcaacagtggaatctgcaggataatgacgacgatcagcttttctataccaaggtttacatagatccccttaaaagagaggccatcaatattactctcgaccacaagtgcaagatatttcagacactgaacggcgcagtggatgaggttgtcctgaagtttgaaaacggcaaggcccgtgctaagaacaccttttacgaaacgctacctgtcgcaataaacggcaatggcccaaccaaaatcttacttaactacttcggcaattatgtgcctaatagctggacgcaggacaatgggtgcacactgtgtgaattcgatacagttgatttaagtgccgtcgatgtccatcccaatgtgtccataggggtcttcatagaacaacccacgccctttctgccaaggttcctcgatattcttcttaccttggactatcccaaggaggcattgaagttgttcatacacaataaggaggtgtaccacgagaaagacatcaaagttttcttcgacaaagccaagcacgaaatcaaaactattaagatcgtgggaccagaagaaaatctatcccaggctgaggccaggaatatggggatggacttctgccggcaggacgaaaagtgcgattattatttttcagtcgatgccgatgtggtcctgacaaatccaaggacactgaaaattctgatagagcaaaacagaaaaatcatcgcaccactcgtgacaaggcacggaaaactctggtcaaatttttggggtgcattgtcaccggatgggtattatgctcggtccgaagactatgtcgatatcgtgcaagggaacagggtgggggtgtggaacgttccctacatggcaaatgtgtatctcatcaagggcaaaaccttgcgctccgagatgaacgagaggaactactttgttcgggacaaactcgaccccgatatggccctgtgccgtaatgccagggagatgggcgtgttcatgtatatctcgaataggcatgaatttggcagacttcttagcacagcaaattataacacttcccactacaacaacgacttgtggcagatatttgaaaatcccgtggattggaaggagaagtatatcaatcgtgactactctaaaatatttactgagaacatcgtggaacagccctgcccagacgtgttctggttccccatcttctctgagaaggcctgcgacgagctggtcgaagagatggagcattacggtaaatggagcggtggtaaacaccacgattctcggatctccgggggatatgagaatgtgcccaccgacgacattcatatgaagcaggtggacttggagaacgtctggctccattttattcgagaattcattgcccctgtgactctcaaggtatttgcaggctactataccaaaggctttgcactcctgaacttcgttgtgaaatattctccagaacggcaaagaagcctgcgccctcaccacgacgcatccacctttaccattaacatcgcgttgaataacgtgggggaagacttccaggggggagggtgtaagttccttaggtacaattgttccatagagtcccctaggaaaggctggtcttttatgcaccctggacgcctgacccaccttcatgagggcctcccagtaaaaaacggtacccggtacatcgcagtcagcttcattgacccatag

SEQ ID NO: 236070 - DNA, 1257 bp, Artificial Sequence
  Description of Artificial Sequence: Synthetic coding sequence
atgctggaaaaccatatactccataaaagaatttatatactaaccttcttttcgcagcaaatcttcatcctgtgtcatgctcatttcattttctttttcacagtgcgtgatttctgtcgccaggacgaaaaatgtgattattatttctcggtggacgctgatgtcgtgttgacgaatccacggacattgaagattttaattgagcagaaccgaaaaattatagccccactagtgacacggcacgggaagctatggagcaacttttggggtgctctgtccccagacggctactacgcacgatccgaggactatgtggatatcgttcagggaaacagagtgggagtctggaacgtgccctatatggctaatgtataccttataaaagggaagacactgcgctcggaaatgaacgagcggaattattttgtgagggacaagttggacccagacatggccctgtgtagaaatgcaagagaaatgaccttgcagcgggagaaggattcacccacccccgagacatttcagatgcttagccctcccaagggagtctttatgtatattagtaataggcacgagttcggacggttgttgtctactgcaaactacaatactagtcactacaacaacgatctctggcagatctttgagaatccggtggattggaaggagaagtacataaacagggactacagcaaaatatttacagaaaatatcgtagaacagccctgcccagacgtgttttggttccctatattttccgagaaggcctgcgacgagctggtggaggaaatggagcactacggcaagtggagtggcggaaagcaccacgattccagaataagtggcggatatgagaatgtccccaccgacgacatccacatgaagcaggtggacctcgagaacgtgtggttgcactttatcagagagttcatcgccccagtgaccctaaaggtattcgctggatattacaccaagggcttcgccctcttgaactttgtggttaaatattcaccagagaggcaacggtcactgagaccgcatcacgatgcctccacgtttaccatcaacattgctctgaacaatgtcggggaggattttcagggaggaggctgcaagttcctcagatacaattgtagcattgaaagtccccgaaaggggtggtcattcatgcacccaggaagactcactcatctgcacgagggccttcccgtcaagaacggaacccgatacatcgcggtgagcttcattgacccctag

SEQ ID NO: 236071 - DNA, 2112 bp, Artificial Sequence
  Description of Artificial Sequence: Synthetic coding sequence
atgcaaagcgctaagtactttaattatacggtcaaagtgctgggacaaggcgaggaatggcggggtggggatggcattaattctatcggagggggacagaaagtacgactgatgaaagaggtgatggaacactacgctgaccaggacgacctcgtagtcatgtttacggagtgctttgatgtgatctttgccggtggcccagaagaagtgctcaagaagttccaaaaagccaaccacaaagttgtgtttgccgcagacggaattctgtggccagacaagcgtttggcagacaagtatcctgtggttcacattggcaagagataccttaattccggagggttcatcggctacgctccttacgtcaacagaatcgtgcaacagtggaatctgcaagacaatgacgacgaccaactgttttacacaaaggtttacatcgaccctctgaagagggaggcaattaatattaccttggatcacaaatgtaagatcttccagacactgaacggggctgtggacgaggtcgtgctgaagttcgagaacggcaaagcgagggcaaagaataccttctacgagacgctgccggttgcaattaacggtaacgggccaaccaagatattgctcaactacttcggaaattacgtcccgaattcctggacccaggacaatggctgtactctctgcgaattcgatactgtagatctgagcgctgtggacgtgcacccaaacgtgagtattggagtcttcatcgaacagccgacccccttcttacctcggtttctcgacattcttttgactctggactaccccaaagaggctttgaaactgtttatacacaataaggaagtgtaccacgagaaagatattaaggtgtttttcgacaaagcgaagcacgaaatcaagactatcaagattgtgggccctgaggagaacctgagccaggcagaagcacggaacatgggcatggacttctgccgacaggacgaaaaatgcgactattacttctccgtcgacgccgatgttgtcctaacaaaccctcgtacactcaaaattctgatcgagcagaatcggaaaataatagcacctctcgtgactaggcatggcaaactttggtccaacttctggggcgcactaagtcccgacggttattacgcacggagtgaggactatgttgatatagtgcagggcaaccgagttggcgtatggaatgtcccctacatggctaacgtgtacctgattaagggcaaaaccctgaggtctgaaatgaacgagcgtaattacttcgtccgcgataaactggacccagatatggccttgtgcaggaacgctagagagatgactcttcagcgagaaaaggattcacctacacccgagacgttccagatgttgtcacctccaaagggtgtgttcatgtacatctcaaacaggcatgaattcgggcgacttctctcgacagccaactataatacatcacactacaacaatgatctatggcagatcttcgagaatcctgtggactggaaggagaaatacattaatcgtgactactccaaaatctttacggagaatatcgtcgaacagccctgcccagacgttttctggttccctatttttagcgagaaagcctgtgacgagctggtcgaggagatggaacactatggaaagtggagcggcggtaaacaccatgattctagaatctcggggggttacgaaaatgtccctacggacgacatccatatgaagcaggtggatcttgagaacgtgtggttgcatttcatacgggaatttatcgcacccgtgaccttgaaggtgtttgcagggtactacacgaagggctttgccttgctgaacttcgtcgttaaatactcccctgagaggcagaggtcgctgagaccccatcacgatgccagcaccttcaccatcaacatcgccctgaacaacgtgggggaggattttcaaggcggaggctgcaagtttctgcgatacaattgttctattgagagccctaggaagggatggtcttttatgcaccctgggaggttgactcatctccatgagggcctgccggtgaagaacggcacacggtatatcgctgtttccttcattgatccttag

SEQ ID NO: 236072 - DNA, 1092 bp, Artificial Sequence
  Description of Artificial Sequence: Synthetic coding sequence
atggcttcaaaatcctggctaaacttcttgacatttctttgtgggtccgcgatcggctttctgttgtgctctcagctattttccatcctgctgggtgaaaaggtagatacccagcccaacgtactgcataatgacccacacgctcggcacagcgacgacaatgggcagaatcacctagagggccagatgaacttcaatgctgattctagtcagcacaaggatgaaaacacggatatcgctgaaaacctatatcagaaagtccggatcctgtgttgggtgatgaccgggcctcagaacctggagaaaaaagcgaaacatgtgaaagcaacctgggcacagagatgcaataaggtgcttttcatgagctcagaggaaaataaagacttccctgctgtcggcttgaaaaccaaggagggcagagaccaattgtattggaaaaccattaaagcctttcagtacgtacatgagcattatctggaggacgccgactggttcttgaaagccgacgacgacacatatgtcatcttggataatttgcggtggctgctgtctaaatatgaccccgaggagccaatctatttcgggcgtcgttttaagccttacgtaaagcagggctacatgtccggaggtgctggctatgtgctgagcaaggaggccctgaagagattcgtggatgcctttaagacagataaatgcacccactctagctcaatcgaggacctggctttaggacggtgtatggaaattatgaatgtggaagccggagactctcgggatacgatcggcaaggaaacattccacccattcgtgcctgagcaccacctcatcaaaggatatctgcctagaacattctggtactggaactataactattaccctcctgtcgaaggcccaggatgttgcagcgacctagcagtttccttccattatgtcgactctacaaccatgtacgagcttgagtaccttgtctaccacttgcgaccatacggctatctgtaccgatatcagcccacccttcctgagagaattctgaaggaaatcagccaggcaaataaaaatgaagacactaaggtgaaattgggcaacccatag

SEQ ID NO: 236073 - DNA, 231 bp, Artificial Sequence
  Description of Artificial Sequence: Synthetic coding sequence
atgaccagcagcggacctgggcctcggttcttattgttgctccccctcttattacccccagccgcaagtgcctctgacaggccgaggggcagagacccggtcaatcctgaaaagctgctcgtaatcaccgtggccacagccgaaacggaggggtatctgaggtttcttaggagcgcagagtttttcaactacaccgttcgtaccctgggcttgggggaagagtggaggtag

SEQ ID NO: 236074 - DNA, 732 bp, Artificial Sequence
  Description of Artificial Sequence: Synthetic coding sequence
atggaaaaatatgccgaccgggaagatatgataattatgttcgtggattcctatgacgtgattctggcaggaagtcctactgaactgctgaaaaaatttgtgcagtcagggagtagattgttgttctccgccgagtcgttctgctggccagaatggggcctcgcggagcagtatcctgaagttggcactgggaagcgttttcttaacagcgggggattcatcgggttcgccacaactattcaccagatcgttcgccagtggaagtataaagacgatgatgacgatcagctcttttacactaggctgtatttggaccccggactacgtgagaaactgtctcttaatttagatcataagtcacggattttccagaatctgaacggcgctctcgatgaagtggtgcttaaattcgatagaaaccgtgtccgcattcggaatgtggcatatgatacacttcccatcgtcgtccacggaaatggacccactaaactgcaactcaactatctcggcaattatgtgcccaatgggtggactcctgagggtggttgtggtttttgcaatcaagaccgcaggacactccctgggggtcctgccagccctccaggtgtgagtggccgtgtgtgcgggactgcttattccgtgtctgcccctctgcccgctgcggcagcgactcctggtctgtcacctaggcaaggtcacccctttcccgctcagcagcgtgggttaccgtag

SEQ ID NO: 236075 - DNA, 1740 bp, Artificial Sequence
  Description of Artificial Sequence: Synthetic coding sequence
atggctgccaagtctgacggcgctgcggcttccgcaagtccagatcctgagggcgctgccggtggcgcaaggggtagtgccggtgggaggggagaagcagccgctgcagccggtccgcctggggtggtgggggcaggcggacctgggccacgctatgaattgcgggattgttgctgggtgctctgtgccttactggtcttctttagcgatggagccactgatttatggctagcggcatcctactaccttcagaaccaacatacctacttttccctcaccctcctgttcgtactgctgccaagtctggtagtacagctgctgtccttccgatggttcgtgtacgattattctgagcccgctggttcccccggtcctgcagtgtcaactaaagacagcgtggcagggggagcggcaataagtaccaaggacagcgcaggcgcatttaggacaaaggaagggagccctgagcctggacctcaacccgcaccctcatccgcctccgcttatcgacgtaggtgttgccgcctatgcatctggctcttgcagacactcgttcacctcttgcaactcgggcaggtgtggaggtacctcagagccctgtacctcggtctccagtcaaggtggagaggcgaaagactccggagacatttttactggcagatgctgtttgaatccgccgatgtatcaatgctccgcctcttggagaccttcttgcgatccgctcctcagttggtgctacagctttcgttgctggtacacagggggggtgcaccagatcttctgccagcactctctacaagtgcgtctctcgtgtccttggcctggacactggcatcttaccaaaaggtgttgcgggactcaagggatgacaagaggcccctgtcatacaaaggagcagtggcgcaggtattatggcatctgttttcgattgcagccaggggacttgcatttgctttgttcgcaagcgtttacaagctttactttggaatcttcatcgtggcccattggtgtgtcatgacattttgggtgattcaaggggagacggacttctgtatgtcgaagtgggaagagataatctataacatggtagtcggaattatctacattttttgctggtttaatgtcaaggaaggcaggtcacgtcgtagaatgactctgtatcattgcatcgtcttgctggagaacgctgctctgaccggcttctggtattctagccgcaatttttcaacagatttctattccctcatcatggtatgcgtcgtcgcctcgagctttgccctgggcattttttttatgtgcgtatactactgtctgctgcaccccaatgggccaatgctggggcctcaggccccaggttgtatattccggaaggcttccgagccttgcgggcctccagcagacgctattactagccctcctcggtccctccctaggacaactggagccgagagagacggagccagtgccggtgagcgggctggcacaccgacccctccagtgtttcaggtcaggccaggactgccacctacaccagtcgctaggactctgaggaccgaaggtcccgtgattcgaattgacttgcccagaaagaagtacccagcctgggatgcacatttcatcgaccgcagacttagaaagaccatcttggccctggaatattcttctcctgcgaccccgagactgcaatataggtccgtggggacctctcaagagctgttggaatacgaaaccacagtgtag

SEQ ID NO: 236076 - DNA, 765 bp, Artificial Sequence
  Description of Artificial Sequence: Synthetic coding sequence
atggcttggcagggccttgtgctagccgcttgcttgttgatgtttcccagcaccactgccgactgcttgagccgttgcagtctctgtgctgtgaaaacacaggacggacccaagcccattaatccactgatctgcagcctgcagtgccaggcggctttactgccttccgaggagtgggagaggtgtcagtccttcctttccttcttcaccccttcgaccctgggcctgaacgacaaagaggatctgggcagtaagagtgtcggcgagggaccatattcggaactcgctaaattgagcggctcatttctgaaagaactagagaaatccaagttcctgccctctatcagcacaaaggaaaacaccctaagtaagtcactcgaagagaagttgcgtggactgagcgacggatttagggagggagccgagtctgagcttatgcgcgatgcacagctgaatgacggtgcaatggaaacaggaacattgtacctggcagaagaagatcccaaggagcaggtcaagaggtatggcggatttctgcgtaaatatccaaagaggagcagcgaggtcgcaggagagggtgacggtgacagcatgggacacgaagatctgtacaagcggtacggaggctttctgcggagaatccgcccaaagctcaagtgggataaccagaagagatatgggggattcctgcgcaggcaattcaaagtagttacccggtcccaggaggacccaaacgcctactcgggagagttgttcgatgcctag

SEQ ID NO: 236077 - DNA, 765 bp, Artificial Sequence
  Description of Artificial Sequence: Synthetic coding sequence
atggcgtggcagggactggtgctggccgcatgtctcctgatgttcccttctaccacggccgattgtctcagtagatgtagtttatgcgcggtcaagactcaggacggacccaaaccaataaatccactcatttgtagtttacagtgccaggccgcactgctcccctctgaagagtgggagagatgccagagcttcctcagtttctttacgccatctactctgggtctcaacgataaggaggacctggggtctaaaagtgtgggcgaagggccatattcagagctcgccaagctcagtgggagcttccttaaggagctggaaaagtccaaattcttgccatctataagcaccaaagaaaatacattgagtaagtcacttgaggagaaattgcgagggctgtctgatggcttccgggagggggctgagtccgaattaatgcgcgacgctcagttaaatgatggtgccatggagactggtaccttgtatctggcggaagaagatcccaaggagcaagtgaaacgttatggtggctttctccgtaaatacccaaaacgatcctctgaagtggccggtgaaggggacggagatagtatgggacacgaggacctgtataaacgatatggagggtttctgcgaagaattcgacctaaacttaaatgggacaatcagaaaagatatggagggttcttacgcagacagtttaaagtagtcacacgttctcaggaggaccctaacgcctacagtggggagttgtttgatgcctag

SEQ ID NO: 236078 - DNA, 804 bp, Artificial Sequence
  Description of Artificial Sequence: Synthetic coding sequence
atggcccgttttctcaccctgtgcacttggttgctgctcctgggcccagggcttctggcaactgtgcgtgcagagtgcagccaggactgcgcaacttgttcttatcgtcttgtccggccagcagacatcaactttcttgcctgtgttatggagtgtgagggaaaattgccatcactgaaaatttgggagacctgcaaggaactgctccaactcagcaaaccggaactgccccaggacggtacctcaaccctcagggaaaactccaagccggaagagagccacttgctcgcaaagcggtacggtggctttatgaaaagatatggcggatttatgaagaaaatggacgaactgtaccccatggaacccgaggaggaggccaatggaagcgaaattctggccaaaagatatggcggattcatgaagaaagacgccgaagaggatgattcattggcgaactcttcagaccttttgaaggagctgttggagacgggagataatcgggaacgttcacatcaccaggacggctctgataacgaggaagaagtgtcaaagcgttacggaggctttatgaggggcctcaagaggtcaccgcagctcgaagatgaggccaaggaattacagaaaaggtatgggggatttatgaggcgcgtaggaagacctgagtggtggatggattaccagaaaaggtacgggggattccttaaaagatttgcagaggctttgcccagtgatgaggaaggtgaaagttattccaaggaggtaccagagatggagaagcgctacgggggattcatgcgcttctag

SEQ ID NO: 236079 - DNA, 804 bp, Artificial Sequence
  Description of Artificial Sequence: Synthetic coding sequence
atggcaaggtttttgacgttgtgcacatggcttcttctgctagggccagggcttctggctactgtgagggctgagtgctcacaagactgtgccacatgtagctaccgtttagttagaccagccgatattaactttcttgcatgcgtaatggaatgcgaagggaagctgcctagtctgaagatctgggaaacttgcaaggagctcttgcagctgtctaaacccgaacttccacaggatgggacttccactttaagggaaaatagcaagccggaagagtcacacctgctggcaaagagatacggtggctttatgaagaggtatggcggatttatgaaaaaaatggatgaactgtacccgatggagccggaagaagaggctaatggatctgaaatccttgcaaagagatacggagggttcatgaaaaaagatgcggaggaggacgatagcctggccaatagttctgacctgttgaaggagttgctcgagactggtgataacagggaaagaagccatcaccaggatggaagtgacaatgaggaggaggtgagtaaacgatacgggggattcatgcgcggactcaagaggtcccctcagctggaagacgaggcaaaagagctacagaagcgctacggcggtttcatgcgcagagtcggcagaccggaatggtggatggactaccagaaaaggtatgggggttttctgaagcgctttgcggaagccctgccaagcgacgaagaaggcgagtcctattcgaaagaggttcctgaaatggagaaacgttatggaggattcatgaggttttag

SEQ ID NO: 236080 - DNA, 318 bp, Artificial Sequence
  Description of Artificial Sequence: Synthetic coding sequence
atggccagattcttaacactgtgcacctggcttctgctgctagggcctggtctgctggctaccgttagagccgagtgcagccaggattgcgctacttgctcataccgcctggttcgtcccgctgacattaacttcctagcgtgcgttatggagtgtgaaggcaagttgccaagcttaaaaatctgggagacctgcaaagaactgctgcagttgtcaaagccagagttgccacaggatggaactagcacattgagagaaaattctaagcccgaggaatctcatcttctcgccaagcgatatggcggattcatgaaatag

SEQ ID NO: 236081 - DNA, 570 bp, Artificial Sequence
  Description of Artificial Sequence: Synthetic coding sequence
atggcacgtttcctgaccctctgtacatggttgctactgctcggtccaggcttgctcgccactgtcagggccgagtgttcccaggactgcgctacatgctcctatcgcctggtgcgccctgcagacattaacttcttggcttgcgttatggagtgcgaaggaaagctgcccagcctaaagatctgggaaacatgcaaagaattgctccagctttcaaagcctgagttgccccaggatggtactagcaccctgcgcgagaatagtaagcctgaggagtctcacctgctggccaaacgatacgggggtttcatgaagaggtacggcggattcatgaaaaagatggatgagctctacccgatggagcctgaagaagaagcgaatggctcagagattttagccaagagatacggcggatttatgaagaaggacgctgaggaagacgactcactcgctaatagttcagaccttcttaaggagttactggagacaggggacaatagagaacggagccaccaccaagatggttccgacaacgaggaggaaaaaaaaaagaaaaagcgcaaagagtag

SEQ ID NO: 236082 - DNA, 423 bp, Artificial Sequence
  Description of Artificial Sequence: Synthetic coding sequence
atggccggatggcagagctacgtggacaatctcatgtgtgacggctgttgtcaagaggcggcaatagtcggatactgcgacgccaaatacgtctgggctgcgaccgccggaggcgtgttccaaagcattactcctatcgagatcgatatgatcgtggggaaagatcgggaggggttctttaccaacgggctcacactgggagctaagaagtgcagtgtgataagggacagcttgtacgtcgacggcgattgcacgatggacatccggaccaagtctcagggaggcgagcctacctataatgtggctgttggaagagcagggcgagtcctagtcttcgtcatggggaaggaaggggtgcacgggggtggtctcaacaagaaagcctattctatggctaaatacctacgcgactcgggcttttag

SEQ ID NO: 236083 - DNA, 423 bp, Artificial Sequence
  Description of Artificial Sequence: Synthetic coding sequence
atggctgggtggcaaagttacgtggacaatctgatgtgtgatggttgctgtcaggaggccgcaattgttgggtattgcgatgccaaatacgtctgggcagctactgctggaggggtgtttcagtctattacacccattgaaatcgatatgatcgtcggtaaggacagagagggattcttcacaaatggactaactctaggcgcaaagaagtgtagcgtgattagggatagtctttatgttgacggcgactgcaccatggacattagaacaaaatcccaaggtggagaacccacatacaatgtggcggtgggtcgcgcaggacgggcattagtgatcgtcatgggcaaagaaggagtgcacggcggtaccctcaataaaaaagcctacgaattggccctgtatttgaggaggtctgatgtgtag

SEQ ID NO: 236084 - DNA, 414 bp, Artificial Sequence
  Description of Artificial Sequence: Synthetic coding sequence
atgggtgactggaaagtgtacatctccgcagttcttcgagaccagagaatagacgatgtggccattgttggccacgctgacaatagttgtgtatgggcctcaaggccaggcggactgctggctgccatctctcctcaagaagtcggcgtcctcactggccctgatcggcacacttttctacaggctggcctatctgtcggcggtcgaaggtgctgtgtgatcagagaccatttgcttgccgaaggtgatggggtgcttgatgcccgtactaaggggttagacgccagagccgtctgtgtcggacgggctccgcgagccctcctcgttctaatggggaggcgcggagtccacggtggaatccttaataaaactgtccatgaactgattagaggcttgcgtatgcagggcgcttag

SEQ ID NO: 236085 - DNA, 1167 bp, Artificial Sequence
  Description of Artificial Sequence: Synthetic coding sequence
atgaaatggatggtcgtcgtcttagtgtgcctccagctcctggaggcggcagtcgtaaaagtccctctgaagaaattcaagtccatccgcgaaaccatgaaagagaaaggtctcctgggcgaattcctgcgcacacacaaatacgatcctgcctggaagtatcggtttggcgatctttccgtgacctatgagcccatggcatacatggatgcagcctactttggagagatatcaattggcactcccccacagaactttttggttttgttcgatacaggcagctcgaatctctgggtcccttcggtgtattgccagtcccaggcctgcacctcccactcacgatttaacccgtcggagtcgtccacgtactctaccaatgggcaaaccttcagtctgcaatacggaagcgggagccttaccggatttttcggatatgatactcttactgtgcagtctatccaggtgccgaatcaggagttcggcctttctgaaaatgagccgggaactaactttgtgtacgcgcaatttgatggcatcatgggcctggcatacccagcactcagtgtcgatgaggccaccacagctatgcagggtatggtgcaagaaggcgctttgacctccccagtgttcagcgtgtacctttcaaatcagcaaggatcgtctggcggtgccgtagtgtttggcggagtagactccagcttgtacacaggtcagatatactgggccccagtcacccaggaactgtactggcagattggtatcgaggaattcttgatcggaggccaggcgtcgggatggtgttccgaggggtgccaagccattgtagataccgggacatctcttctgactgtcccacagcagtatatgtctgctttgctgcaggccactggagctcaggaggacgaatacggacagttcctagtgaattgtaattccattcagaatctcccttcgttgacctttatcatcaacggcgtggaatttcccctgcccccatcctcctacatactttccaacaacggatattgtacagtgggcgtcgagccaacctatctctcaagccagaatggccagcctctgtggatactcggggacgtgttcctacgcagctactattccgtatacgacttaggaaataacagggtgggattcgccacagcggcttag

SEQ ID NO: 236086 - DNA, 315 bp, Artificial Sequence
  Description of Artificial Sequence: Synthetic coding sequence
atgaaatggatggttgttgtcctcgtttgcctacagctgctcgaagccgctgttgtcaaggtgcctcttaagaaatttaaatccattcgcgaaacgatgaaggagaaaggcttgctgggtgaatttttacgcacgcacaagtacgacccagcatggaagtaccgattcggagatctaagcgttacatatgagcccatggcctacatggatgccgcatatttcggagaaattagtattgggactccccctcagaatttcctagtcctgttcgatacagggagtagccccctgcccctggatcctgcccctagttag

SEQ ID NO: 236087 - DNA, 411 bp, Artificial Sequence
  Description of Artificial Sequence: Synthetic coding sequence
atgaagtggatggtcgttgtactcgtgtgcttgcagctcctggaggctgcagtggtcaaggtgcctctaaagaagttcaaatccatccgcgagaccatgaaggaaaaggggttgttaggcgaatttcttcgaacccacaaatacgaccctgcctggaaatatcggtttggcgatttatccgtcacctatgagcccatggcctatatggacgtgcaaagcatacaggttcccaaccaggagttcgggctctccgaaaacgagccaggcacgaactttgtgtatgcgcagttcgacggcataatggggcttgcttatcctgcgttgtccgtggacgaagccaccacagcgatgcagggaatggtccaagaaggggctcttacctctcccgttttttctgtgtacctgtcatag

SEQ ID NO: 236088 - DNA, 948 bp, Artificial Sequence
  Description of Artificial Sequence: Synthetic coding sequence
atgaaatggatggtcgtagtcctggtgtgcctacagcttcttgaggcagctgtggtcaaggtgccattaaaaaagttcaagtcaattcgcgagacaatgaaggagaagggattgcttggagagtttctgagaacccacaagtatgatcccgcatggaagtatcggtttggcgacctgagcgtgacctacgagccgatggcttacatggatgccgcttatttcggtgaaattagcattgggaccccacctcagaatttcctggtactattcgatacaggcagctctaacctgtgggtgcccagcgtctattgtcagtctcaggcctgtacatctcattctcgatttaaccccagcgagagctcaacctatagcacaaacggacaaacgttctcactccagtatggaagcgggtcactgacaggctttttcgggtacgacaccctgaccgtccagagcatccaggttcccaaccaggaatttgggctttccgagaacgaaccaggcaccaattttgtctatgcacaattcgacggcatcatgggactggcttacccagcactgtcagtcgatgaagccaccactgctatgcaaggaatggttcaggagggagctctcacatctcctgtctttagcgtgtatctgagtaacctggtgctggagagctccggactcggtcccctgctcaccccaagtcgcgctgctccaccttcgagtacattgcagctgccagaaaaaccattggagcagacttggaacattttgacaccttttactaagaccttaccggtgagcaacctgagtagaaaagtaaccagctgggcaggagtcggaattccagttacctgtctgcccgaggcaggttctggaggcgagagacgagccgaatgtggtttgggggtccccactacgaggggaccccctaggtctcagcaccactctggggcatag

SEQ ID NO: 236089 - DNA, 543 bp, Artificial Sequence
  Description of Artificial Sequence: Synthetic coding sequence
atgctgtgcctgctcctgaccctgggtgttgctcttgtctgcggcgtgccagccatggatatcccacagacaaagcaagacctagagctgcctaaactcgcaggaacctggcactctatggctatggccacaaataatattagtttaatggccacccttaaagcccctttgcgggtgcacatcaccagcctgctgcctaccccagaggacaatctcgaaattgtgctgcaccggtgggaaaataattcctgtgttgaaaaaaaagtgctgggggagaagacagagaacccgaagaaattcaaaatcaactataccgttgcaaatgaagctaccctcctggatactgattatgacaacttcctgtttctttgcttgcaagacaccaccacacctattcagtccatgatgtgtcaatatttagcgagggtgctagtggaagacgatgaaatcatgcaggggttcatccgagcctttaggcccctgccacggcacctttggtaccttctggatctgaaacagatggaggagccctgccgtttttag

SEQ ID NO: 236090 - DNA, 261 bp, Artificial Sequence
  Description of Artificial Sequence: Synthetic coding sequence
atgctctgccttctcttgactctcggcgtggctctcgtttgtggagtgccagccatggacataccccaaacgaaacaggacctggaacttcctaaggacacgacaaccccaatccagagtatgatgtgccagtacctggccagggtcctggtcgaagatgacgaaatcatgcagggctttatcagagcctttcgaccgttgccacgccatctgtggtacttattggacctgaaacagatggaagccccttgttggctgtag

SEQ ID NO: 236091 - DNA, 543 bp, Artificial Sequence
  Description of Artificial Sequence: Synthetic coding sequence
atgctatgtttgctcctgacactgggagttgcccttgtctgtggcgtacccgcaatggacatcccccagacgaaacaggacctggaacttcccaaactggcaggcacctggcactctatggccatggcgaccaataacatttctctgatggccaccctgaaagcccctcttcgggtgcatattacaagcctcttacctactcccgaagacaacttggaaatcgtattgcacagatgggagaacaatagctgcgtggagaagaaggtcttgggcgagaagaccgaaaatccaaaaaagtttaagatcaattacacagtggcgaatgaggcaactctgctcgataccgactatgacaatttcctgtttctgtgtcttcaggatactaccacccccatccagtccatgatgtgtcaataccttgccagagttctcgttgaggacgacgagattatgcaggggtttatcagggcatttcgccctctcccaagacacctgtggtacctgctggacctgaagcagatggaggaaccatgccggttttag

SEQ ID NO: 236092 - DNA, 438 bp, Artificial Sequence
  Description of Artificial Sequence: Synthetic coding sequence
atgttgtgtctactcttgacgctgggggttgcgcttgtgtgtggcgtccctgctatggacataccccagaccaagcaggatttagaacttccaaaggcgccacttagagtgcacattacatccctgttgcccactccagaagacaacctggaaatcgttctgcatcggtgggaaaataactcttgcgtggaaaagaaggtgcttggcgaaaaaaccgaaaatcccaagaagttcaaaattaattgtaaggctagcggagcccctcagctgagttggaagccacagggaccgagaaccgaccccgcaagtagcactgcccgtgtgctcgtcgaagacgacgagatcatgcaggggtttatccgggcatttagacctctaccccgacacctgtggtatcttctggatctgaaacagatggaagagccatgccggttctag

SEQ ID NO: 236093 - DNA, 399 bp, Artificial Sequence
  Description of Artificial Sequence: Synthetic coding sequence
cttatggctactttgaaggcccctctcagggtgcacattacctctctacttcccacaccagaagataatctggaaattgtgctgcacagatgggaaaataactcttgcgtggagaagaaagttctgggcgagaagaccgaaaaccctaagaagttcaaaataaattacactgtagccaacgaagccactctgctggataccgattatgataactttctgtttctttgcctccaggacacaacgactcccatccagtccatgatgtgccagtatctggctcgagtccttgtggaggatgacgaaataatgcaagggtttattagagcgttccgccctctgccgcgacatctgtggtacctgctagacctgaagcagatggaggaaccctgccggttctag

SEQ ID NO: 236094 - DNA, 396 bp, Artificial Sequence
  Description of Artificial Sequence: Synthetic coding sequence
tgagtccctgccatggatattcctcagacaaaacaggacctcgagctgcccaaagcaccgctgcgtgttcacatcacttctctgttgcctacaccagaggataatctggaaatcgtcctccacagatgggagaataactcctgtgtcgaaaaaaaggttctgggggagaagacagagaaccctaaaaaattcaaaatcaattgcaaagccagcggcgctccacagctgagctggaagccccaggggccacgcaccgatcctgccagtagcactgctagagtacttgtagaagatgacgagataatgcagggattcatacgcgcattcaggcccctccccaggcacctgtggtatttgctagacctgaagcagatggaagaaccctgccgcttttag

SEQ ID NO: 236095 - DNA, 381 bp, Artificial Sequence
  Description of Artificial Sequence: Synthetic coding sequence
tgacctctgagggtccacataacaagcctcctacctacccccgaagataacctggagatagtgctacatcggtgggagaacaactcatgtgttgagaaaaaagtcctgggagagaagacagagaatccgaagaagttcaagattaattacaccgtcgctaacgaagccaccctgttagatactgactacgacaacttcttgttcctgtgtctgcaggacacaaccaccccaattcaaagcatgatgtgtcagtacctcgccagggtgctggtcgaagacgatgagattatgcagggtttcatcagggcttttagaccccttcctcggcatctctggtacctcctggatctaaagcagatggaggaaccttgtaggttttag

SEQ ID NO: 236096 - DNA, 102 bp, Artificial Sequence
  Description of Artificial Sequence: Synthetic coding sequence
tgagagattatgcaggggttcatccgagcgttccgcccactccctaggcatctatggtatttactcgacctaaagcagatggaggagccttgtcgtttttag

SEQ ID NO: 236097 - DNA, 543 bp, Artificial Sequence
  Description of Artificial Sequence: Synthetic coding sequence
atgctctgcctgcttcttacactcggagtggccctcgtctgcggggtgccagccatggacattcctcagaccaaacaggatttggagctgccgaagctcgccggaacatggcacagcatggccatggccacaaacaacatttctctcatggccacactgaaggctcccctgagggtgcacatcacaagcctgctgccaactccagaggacaacctggaaatcgtgctacaccggtgggagaacaactcatgtgtcgagaagaaggttcttggcgaaaagaccgagaatcccaaaaagttcaagattaattataccgttgccaatgaggctaccttgttggacaccgactatgacaacttcttatttttatgcctccaagacacgaccaccccgatccagagcatgatgtgtcaatacttggcaagagtgctcgtggaagacgatgaaattatgcagggctttattcgagccttccggccactcccacgacacctgtggtacctcttggacttgaaacaaatggaggagccctgtcgcttttag

SEQ ID NO: 236098 - DNA, 510 bp, Artificial Sequence
  Description of Artificial Sequence: Synthetic coding sequence
atgctgtgtctattacttaccctaggggtggcgctggtctgtggtgtgccagccatggatataccacaaacgaagcaggacctggagctgccgaaactagcaggaacctggcactctatggccatggcaaccaataacatttccctgatggcaaccctgaaagcaccattgagagtacacatcacgtccctccttcccactcccgaggacaacctggagatcgtcctgcacaggtgggagaataactcctgcgtggagaagaaggtcctgggggaaaagactgagaacccaaagaaattcaaaattaactataccgtggcaaatgaagctacattactggacaccgactacgacaactttctgtttctgtgtctgcaggacacgacaactccaattcaaagtatgatgtgccaatacttggaaagctggtggcgaacaatgcgcagctgccgcgatagtagtggcctttccggcccatgtcccggaacttatggtacatgctggacttag

SEQ ID NO: 236099 - DNA, 2274 bp, Artificial Sequence
  Description of Artificial Sequence: Synthetic coding sequence
atgtctcggaagatcagtaaggagtccaaaaaagtgaacatcagctcttctctggagtccgaagacatttcgttggagaccactgtacccacagatgatataagctcgtcagaggagagagaggggaaagtgcgcattactcgtcaacttatcgagcgcaaagaactgctgcacaacatccaacttctgaagatagagctgagccagaaaaccatgatgattgataaccttaaggttgactatcttaccaagattgaggaacttgaagaaaagctgaacgacgcgttgcaccaaaagcagctgttgaccttacgcctcgacaatcagctcgcctttcagcagaaggatgcctctaagtatcaggagctcatgaagcaggagatggagacaatactgctgcggcagaaacagctcgaggagaccaacctgcaactgagagagaaggcaggcgacgtgaggaggaacctccgggacttcgaactcactgaagagcaatacattaagctcaaggcatttcccgaggatcagttgtctattccggagtatgtctcagtgcgtttttatgagttggtcaatccacttcgaaaagagatctgtgaacttcaggtgaagaaaaatatcctggccgaagagttatccacgaataagaaccagttaaagcagctcactgagacttacgaagaggatagaaagaactactctgaagtccagattaggtgccaacggctcgccctagagctcgcagatacaaaacagctcatacagcagggtgactatagacaagagaactacgataaagtcaagtctgagcgcgatgctctggaacaggaagtgatcgagctgcgcagaaagcatgaaatcctggaagctagccacatgatccagaccaaggagcggtcagagctgtcaaaagaagtggtgaccttagagcagacagttacattactgcagaaagacaaggaatacttgaatcggcaaaacatggaattgagcgtacgttgtgcgcatgaagaagatagactcgagcgcctccaggctcaattagaggagagcaagaaggcacgagaagagatgtacgaaaagtatgtggcttcgcgcgatcattacaagacagaatatgaaaataagcttcatgacgagctcgagcagatcaggcttaagaccaatcaagagatcgaccagctcaggaacgcctcccgcgagatgtacgaaagagagaataggaacctgcgtgaagcaagggacaatgccgtcgccgagaaagaacgcgctgttatggctgagaaggatgccctggagaaacacgatcaactgttagacaggtacagagagctacagttgagtactgagagcaaggtgaccgagtttttacaccagtccaaactgaagtccttcgagagcgagcgcgtgcagctgctacaggaggagaccgcgcgtaatctgacccagtgccagctagagtgtgaaaaataccagaagaagttagaggtgcttaccaaggagttttactcgctccaagcttcatccgagaaaaggattaccgagctccaggctcaaaactcggagcatcaagctcgtctggatatctatgagaagttagaaaaggagttggacgagattattatgcagaccgccgagattgagaacgaagacgaagctgagagggtcctcttttcatacgggtatggcgctaacgtgccgacaacagccaagcgcaggcttaaacagtcagtacatctggcccgacgagtactgcagctggaaaagcagaatagtctgattctaaaggatctggagcacaggaaagaccaggttacgcaactgtcccaggaactggacagagccaacagtctgttgaaccaaactcaacagccgtacagatatctcatagagtccgtacgccagcgggacagtaagatcgactctctgactgaaagcatagctcagctcgagaaagatgtgagcaacctgaacaaagagaagtccgctctcctgcagaccaaaaaccagatggccctcgatttggaacagctgctgaatcaccgcgaggagctggccgcaatgaaacagatcctggtgaagatgcactctaaacatagcgagaactccctactgctaacaaagactgaaccaaagcacgttaccgaaaatcagaagtctaagacactaaacgtgcctaaagagcatgaagataacatctttactccaaagccaaccctgtttaccaagaaggaggcccctgaatggtcaaagaagcagaagatgaaaacctag

SEQ ID NO: 236100 - DNA, 651 bp, Artificial Sequence
  Description of Artificial Sequence: Synthetic coding sequence
tttagaacagctaaggttgaaaatgaggacgaggcagaacgcgtccttttttcttacggctacggtgctaacgtgcccaccacagcgaaaagacgacttaaacagtccgtccacctcgccaggagagttctccagcttgaaaagcagaatagtctgattctaaaagacctggagcataggaaggaccaggtgacccagctgagtcaggagttagatcgcgctaactctctactcaaccagacccagcaaccctaccgatacctgattgagtctgttcgacaacgggacagtaaaatagacagcttgaccgaatcaattgcccagctcgagaaagatgtgagcaacctgaacaaggaaaagagtgcgttactgcagactaagaaccagatggctctggacttagaacagctactgaaccatcgggaggagctggcagcgatgaaacagattctagttaagatgcactcaaaacacagtgagaactccttgctgcttaccaagactgaacctaagcatgtaaccgaaaaccagaagtctaaaacactgaacgtgcctaaggaacacgaggacaacatcttcactccaaaacctacactgtttactaaaaaggaagcacctgaatggtccaaaaaacagaaaatgaagacttag

SEQ ID NO: 236101 - DNA, 1245 bp, Artificial Sequence
  Description of Artificial Sequence: Synthetic coding sequence
atgtcaagaaagataagcaaagaaagtaaaaaggtgaatatctcctcctctctagagtccgaagatatctcacttgaaaccacagtacccaccgacgacatcagctcctctgaggaaagagaaggcaaggttcgcattacccgtcagttaatcgagagaaaagagctgcttcacaatattcagctgctgaagattgaacttagtcaaaaaaccatgatgatcgataacctgaaagtcgattatcttaccaaaatcgaggagttggaagagaagctaaacgacgcccttcatcagaagcaactgttgactcttaggctggataatcagttagcctttcagcagaaggacgcctctaaatatcaggagttgatgaaacaggagatggagaccattctcctgagacaaaaacagttagaggagacaaacctacagctccgcgagaaagctggagatgtgaggcggaaccttcgggattttgagttaactgaggagcagtatatcaagctcaaagcctttccagaggaccagctgtccattcctgaatacgtatccgtgcgtttctatgaactggtgaatcccctgcgaaaggagatctgcgaactgcaagtaaagaagaatatcctagctgaggaactgtctacaaataagaatcagttaaaacagctgactgaaacttatgaggaggataggaagaactatagcgaggtgcagatcaggtgtcagagactcgccttagaactggcagacaccaagcagcttatacagcagggagattacaggcaggaaaactatgacaaagttaaaagtgaacgggatgcacttgagcaggaagtgattgaactgcgcagaaaacacgagatcctggaggcatctcacatgatacaaactaaagagcgctccgagttatctaaagaggtagtaacgctggaacaaaccgtgactctgctgcagaaggataaggagtacctgaatagacagaatatggaactgtctgtgcgttgtgcacatgaagaggacagactggagcggctgcaggcgcagcttgaagaaagtaagaaagccagggaggagatgtatgagaagtatgttgctagccgggaccactacaagactgaatatgaaaacaagctccatgacgaactggagcaaatacgactaaaaacaaaccaggagattgaccaacttagaaatgcctcacgtgagatgtacgagagggagaacaggaagaaacgcaagaagaaatag

SEQ ID NO: 236102 - DNA, 1734 bp, Artificial Sequence
  Description of Artificial Sequence: Synthetic coding sequence
atgaccgaactagctggagcttccagtagctgctgccacaggcctgcagggagaggcgctatgcaatccgttctgcaccattttcagcgattacgcggacgcgaggggggtagccactttatcaatactagtagccccagaggagaagccaaaatgtcaatcacatcggacgaggtgaatttcttggtgtacaggtatctgcaggagagtggcttctcccactctgccttcacgttcggtatcgaatctcatatctcccagtccaacataaacgggactttagtgccccctgccgcactgatatccatcctacagaaaggtcttcagtacgtggaggcggagattagcataaacgaagatggaactgtgttcgacgggcgtccaatcgagagcctgtctctgatcgacgcagtgatgcccgatgtcgtccagacgaggcagcaggccttccgggagaaattagcacaacagcaggcaagcgctgctgctgctgccgcagcagccacagctgcagctacggccgctacgaccacaagcgcaggagtcagccaccaaaatccttcaaagaaccgggaagcgactgttaacggggaggagaatagagcccattccgtgaataaccacgcaaaacccatggagattgatggcgaggttgagattcctagttcaaaagcaaccgtccttcgagggcacgagtccgaagttttcatctgcgcgtggaacccagtctcagatcttctcgcgagtggctcaggcgattccactgctaggatttggaacctgaatgagaattccaacgggggatctactcagctggtgttgcgccactgcatcagagaggggggtcatgacgttccgagcaacaaagatgtaacaagcctggattggaatacaaatggaacattattggcgactggaagctacgatggcttcgctagaatatggactgaggatgggaacttggcatcgactctcggacaacataaaggaccaatttttgctctgaagtggaaccgcaaaggaaattatatcctgtccgccggagtggataaaacaaccattatctgggacgctcataccggcgaagcaaagcaacaattcccttttcactcagcacctgcccttgacgttgattggcagaataatacaacttttgcatcatgctcaacagatatgtgtatccacgtttgccgcctaggatgcgacagacctgtcaaaaccttccaggggcataccaatgaagtgaacgctatcaaatgggacccgagtgggatgttgcttgcctcatgtagtgacgacatgactttgaaaatatggagcatgaagcaagaggtgtgcattcatgatctgcaggcgcacaataaggagatttacaccatcaagtggtctcctaccggcccagcaacctctaatccgaactcaaacatcatgctcgccagtgcttcctttgatagcaccgtgcgcctgtgggacatcgagaggggcgtgtgcacacataccttgacgaagcatcaagagcccgtgtactctgtcgcattctcccccgacggcaaatacctggcatccggttctttcgataagtgcgtccacatctggaacactcagagtggcaatctggtacattcctataggggcactgggggaatcttcgaagtatgttggaatgctcgcggagacaaggtaggagcgtcagcatcggatggttctgtttgcgtattggatctgcgtaaatag

SEQ ID NO: 236103 - DNA, 432 bp, Artificial Sequence
  Description of Artificial Sequence: Synthetic coding sequence
atggcggcagaagatgttgttgcaacaggcgcagacccttcggacttggaatctggcggactgctccacgaaatttttacctctcccctcaatttgctgctgctaggcctgtgcatcttcctactgtacaagatcgtgaggggtgaccagcctgcagcctccggcgactccgatgatgatgaaccaccacctctgcccaggctcaagcgacgtgattttacccctgctgaactccgaagatttgacggagtgcaggaccctcgtatattaatggcaattaatggcaaggtgttcgatgtgacaaagggtcgaaagttctacggccctgtcaagtatcaccacgttggcaaattactcaaggagggcgaagaacccaccgtgtacagtgacgaagaggaacctaaagacgagtcagctagaaagaacgattag

SEQ ID NO: 236104 - DNA, 672 bp, Artificial Sequence
  Description of Artificial Sequence: Synthetic coding sequence
atggcggctggagacggggacgtgaagctgggaactctgggctctggttccgagtcatcaaacgatggaggatccgagtcacctggtgacgccggagctgcggctgaggggggaggctgggctgccgctgccctagcccttcttaccggaggcggtgagatgctgctgaatgttgccctcgtggccctggttctgctgggagcatataggctctgggttcggtggggacgcagaggcctgggcgcaggcgctggcgctggggaagaaagccctgctactagcctgcctaggatgaagaaacgggacttcagtctggagcagctgcggcagtatgacggatcacgcaatcccaggattctgctcgccgttaatggcaaggttttcgacgtcactaaagggagtaagttttacggccctgcagggccttacgggatctttgccggacgagatgcaagccggggattggccactttctgccttgacaaagacgctcttagagacgagtatgacgacctgtcagacctgaatgctgtccagatggagagcgttcgggagtgggagatgcagtttaaggaaaagtatgactacgtgggccgactgctgaagcccggtgaagaaccttccgagtacacagatgaggaagacaccaaagatcataacaaacaggactag

SEQ ID NO: 236105 - DNA, 402 bp, Artificial Sequence
  Description of Artificial Sequence: Synthetic coding sequence
atggccgctggcgacggggacgtcaagctgggcactctgggcagtggcagcgagtctagtaatgacggcggatcagagtcccccggagacgcaggtgccgcagcggaaggcggtggatgggcggctgctgcactggctcttctgaccggtggaggcgagatgctgcttaatgttgccttggttgccctggtgctgctgggtgcttatagactttgggtgcggtgggggagacgcggactgggggctggggcaggtgccggtctccagttaggagccgctgcacctgttcgtcgacttccccagcccgctcaccccgctaggggccagtgggaatccctgcgacgggatcagcggcagcaggtgctgcgccctggagggagtatatggaacatttgctggtag

SEQ ID NO: 236106 - DNA, 744 bp, Artificial Sequence
  Description of Artificial Sequence: Synthetic coding sequence
atgggaggagcagggcgaggggtgggcgaaggacgtgggagagggggaggtggcagaaggtggcgagccgtcatggcagctggggacggtgacgtcaagctgggcaccctggggagtgggtccgagagctctaacgacggcggtagcgagagtcctggcgacgctggagcggctgccgagggcggaggctgggcggctgcagccctcgctttattgacaggcggaggggagatgctgctcaacgtggctctggtggcactagtgttactaggggcttacagactctgggtgagatggggcaggcgcggtttaggagccggtgcgggtgctggtgaggagagtcccgctactagtttgcctcggatgaaaaagcgcgatttcagcttagaacagcttaggcagtacgatggatcacgcaatcctagaatcctgttagcggtgaacggcaaggtatttgatgtcaccaagggatctaagttctacggcccagcaggaccctacggcatctttgccggacgggacgcctcaagaggactcgcgaccttttgtctggacaaagacgcactgagggatgaatatgacgacctgagtgatttaaacgcagtccaaatggaatccgtgagggagtgggagatgcagtttaaagagaagtatgactacgtcgggaggctgctgaagcctggtgaagaaccttcagaatacaccgacgaggaagatacgaaggaccacaacaagcaggattag

SEQ ID NO: 236107 - DNA, 1041 bp, Artificial Sequence
  Description of Artificial Sequence: Synthetic coding sequence
atggccatggcccagaagctctctcaccttcttccctcgctgcgccaggtcatccaagagcctcaactgtcactacagccggagccggtctttaccgtggaccgagctgaggtcccaccgcttttttggaaaccttatatttatgcaggttacagaccgctgcaccagacatggcgattctacttccggactctctttcagcaacacaatgaagccgtgaatgtttggacgcatctgctcgccgcacttgtgcttctactgcgcctggccctgtttgtcgagacagtcgatttttggggagacccccacgctctgcccctgtttataatagttcttgcttcttttacctacctgtctttcagcgccctcgcccacctactgcaagcgaagagcgaattctggcattattcttttttcttcctcgactatgtcggcgtggcagtgtaccagttcggttccgccctggcacacttttactacgccattgagcctgcctggcatgcccaggtacaagcagtctttctccctatggccgctttcttggcttggctttcctgcatcggatcttgttacaacaagtatattcagaaaccaggcctgcttggtagaacatgtcaagaagtgccatctgtgttggcctacgccttggacattagtccggtggtccacaggatctttgtgtcatctgatcctaccaccgacgaccctgctctgttgtaccacaagtgtcaggtcgtgttctttcttttggctgcagccttctttagcacttttatgcctgagcggtggttccccggttcttgtcacgtgtttggccaagggcaccagctctttcacatcttcttagtgctctgcacactcgctcagcttgaagctgtggcactagactatgaagctcggagacctatatacgagcccctccatacacattggcctcataatttttcagggctgttccttctgactgttggctcatcaattctgaccgctttcttgctgagccaactggtgcagcggaagttggaccagaaaacaaagtag

SEQ ID NO: 236108 - DNA, 867 bp, Artificial Sequence
  Description of Artificial Sequence: Synthetic coding sequence
atgcagatcccccaagcaccatggccagtcgtctgggccgtattacagctgggctggcgaccaggatggtttttggactctcctgacaggccttggaaccctcctacattctctcccgctttgctcgtggttactgaaggggataacgccacgtttacatgtagcttcagcaacacatccgagagttttgtcttgaattggtaccggatgtcacccagcaaccaaacagacaaactcgcggcttttcctgaagaccggtcgcagccaggacaggactgcagatttcgagtgacacaactgcccaacgggcgagacttccacatgagtgtggtgagagctcggagaaacgactctggcacatacctgtgtggagccatcagcctggcgccaaaggcccagatcaaagagtccctgcgggctgaactgcgtgttaccgagcgcagggcagaggtcccaaccgcccatccatctccaagcccccgaccagctggacaatttcagactctggtggtgggagtagtcggcggacttctggggtctctggtcctgttggtgtgggtgctggccgtaatatgcagcagggccgctaggggcacaattggggcaagacgtaccggccagccgcttaaagaggatccttcagcagtacctgtatttagcgtcgactacggcgaacttgacttccagtggcgagaaaagactcccgaacctcctgtgccttgtgtgcctgaacagaccgagtacgccaccattgtctttcccagcggcatgggaaccagcagccccgctcgacgcggtagtgctgacgggcctcgctccgcgcagccgcttaggcccgaagatggccattgctcctggccgctttag

SEQ ID NO: 236109 - DNA, 540 bp, Artificial Sequence
  Description of Artificial Sequence: Synthetic coding sequence
atgcagatccctcaggcaccatggccagtggtgtgggctgtcttgcagttgggctggagaccgggatggttcctagattcacctgatagaccttggaatccacccaccttctcccctgcgttgctcgtcgtgactgaaggtgataatgcaacttttacgtgctccttctctaacacctccgagtcgtttgtcttaaactggtaccgcatgtccccatcaaatcagactgataagctggctgcattccccgaggaccgatctcaaccgggtcaggactgtaggtttcgtgtgacccagcttcctaacgggagagacttccacatgtccgtagtaagagcaagaaggaacgattccggcacctatctgtgtggagctatcagtctggcaccgaaagcccaaatcaaggaatcacttagagcggagttgcgagtgacagggactatcggggcaagacgcaccggacaaccactaaaggaggacccatctgccgtccctgtgttttcagtggactacggggaactggattttcagtggcgatag

SEQ ID NO: 236110 - DNA, 639 bp, Artificial Sequence
  Description of Artificial Sequence: Synthetic coding sequence
atgcggatgaccatggaggagatgaagaatgaggccgagaccacatccatggttagcatgccgctatacgcggtgatgtatcccgttttcaacgagttggagcgcgtgaatctttcagccgcacaaactttgcgcgctgctttcatcaaggcagagaaagagaatcccggtctgacccaggatatcataatgaaaatcctggaaaaaaagagcgtggaagtgaactttaccgaatcacttctgcggatggccgcagatgacgtcgaggagtacatgattgagagaccagagcctgagtttcaggacctgaacgaaaaagcccgtgctctgaagcagattctttcaaaaatacccgacgagattaacgacagagtacgattccttcaaaccattaaggacatcgcgagtgctatcaaggagttgcttgacaccgtaaataatgttttcaagaaataccagtaccagaataggcgcgctttggagcatcagaagaaagaatttgtgaagtattcgaagagcttttcagataccttgaaaacttatttcaaagatggaaaggcaattaatgtctttgtgtcagccaatagactcattcatcaaacaaatctgattctgcagacgtttaaaactgtagcctag

SEQ ID NO: 236111 - DNA, 639 bp, Artificial Sequence
  Description of Artificial Sequence: Synthetic coding sequence
atgcgaatgactatggaggaaatgaaaaatgaggctgagactacatccatggtgtctatgccactttacgccgttatgtaccccgtgtttaacgaactggagagagtgaacctgtccgcagcccagaccctccgtgccgcattcatcaaggccgaaaaggagaacccaggccttacacaggatattatcatgaagattctggaaaagaagagtgtcgaagtcaacttcacggagtcactccttaggatggccgcagatgacgtggaagaatacatgatcgagcgccctgagcctgaattccaggatttaaatgagaaagcgcgagctctgaaacagatcctgtctaaaattccagacgagatcaatgatagggtgcgctttctgcagactatcaaagacatagcctccgcaatcaaggaactcctcgatacggtgaataacgtgttcaagaaataccagtaccaaaacagaagagcactcgagcatcagaagaaagagtttgtcaagtattccaaaagtttttccgacaccttaaagacctacttcaaagatgggaaagccattaacgtgtttgtgtccgcgaacagactcattcaccagacaaatctcatacttcagaccttcaagaccgtggcttag

SEQ ID NO: 236112 - DNA, 441 bp, Artificial Sequence
  Description of Artificial Sequence: Synthetic coding sequence
atgcggatgacgatggaggagatgaaaaatgaagccgagactaccagtatggtctccatgcctctgtacgccgtaatgtatccagtatttaatgaattagagcgggtcaacctttccgccgcacaaacactcagagccgctttcatcaaggctgaaaaggagaaccccggactgacacaggacataataatgaaaattttggaaaaaaagagtgtggaggttaatttcaccgaatccctccttcggatggctgcagatgacgtggaagagtatatgatcgagaggcctgaacccgagtttcaagatctcaatgagaaggcacgcgctttaaagcagatactaagtaagattcccgatgagataaacgacagagtgagattccttcagaccattaaggatattgcgtcagcaattaaggaactgctcgacacagtgaattag

SEQ ID NO: 236113 - DNA, 240 bp, Artificial Sequence
  Description of Artificial Sequence: Synthetic coding sequence
atgcgtatgacaatggaggaaatgaagaacgaggccgagactacctctatggtgagcatgccattatacgccgtgatgtaccctgtcttcaacgaacttgaacgcgttaacctgtccgctgcccaaacgctgcgagccgcatttataaaggccgagaaggagaatcctggcttgacacaggatattatcatgaaaatactggagaagaagtccgtggaggttaattttacagaatcatag

SEQ ID NO: 236114 - DNA, 639 bp, Artificial Sequence
  Description of Artificial Sequence: Synthetic coding sequence
atgaggatgacaatggaggagatgaagaacgaggctgagactacttcgatggtctctatgcccctctacgcagtgatgtacccggtgttcaatgagctggaaagggttaacttgagcgctgcacagaccttgagagctgcattcattaaagcagagaaggaaaacccaggtctcacccaggatatcataatgaagattctggagaagaagtctgtggaagttaacttcaccgaatcattattgagaatggctgcggatgatgtggaagagtatatgatcgaaagaccagaaccggagtttcaggacctaaatgagaaagcgagggccctaaaacagattctgagcaagattcccgacgagatcaacgacagggtgcgctttttgcagacaatcaaggatatcgcctcggccatcaaagaactgttagatacagtcaataatgtgttcaagaaatatcagtatcagaataggagagcattggagcatcagaagaaagaattcgttaaatatagcaaaagcttcagcgatacgttgaagacctactttaaagatgggaaggccattaatgttttcgttagtgccaacaggttgatccaccagaccaatctgattctgcaaacctttaagaccgtcgcctag

SEQ ID NO: 236115 - DNA, 639 bp, Artificial Sequence
  Description of Artificial Sequence: Synthetic coding sequence
atgaggatgactatggaagagatgaagaacgaggcagagacaacgagtatggtgtctatgcccctgtacgctgtcatgtatccagtatttaatgaacttgagcgcgtgaatctgtcagccgctcagactctgagagccgctttcattaaagcagaaaaggaaaatcccggtttgactcaagacatcattatgaaaatccttgagaaaaaaagcgtggaggtcaactttactgagtccttactgcgcatggcagccgacgacgtcgaggaatacatgattgagcgaccggaaccggagttccaagaccttaacgagaaggccagggccctgaaacagatcctgtccaagatcccagatgagattaatgatagggtgagatttctgcaaacaatcaaggatatcgcttctgccattaaggaactcctcgatactgtcaacaacgtattcaagaagtatcagtaccagaaccgtcgggcactcgaacaccagaaaaaggagttcgtgaagtactctaagagcttctccgataccctgaagacatacttcaaagacggcaaggctataaacgtcttcgtgagcgcgaacaggctgatccaccagaccaacttaatcctgcagaccttcaagactgtggcctag

SEQ ID NO: 236116 - DNA, 609 bp, Artificial Sequence
  Description of Artificial Sequence: Synthetic coding sequence
atgcggatgacaatggaggagatgaaaaacgaagctgaaacaacctccatggtaagtatgcctctctacgcagtgatgtaccccgtgttcaacgagcttgaacgtgtgaacttaagcgccgctcagaccctccgtgccgcatttataaaagccgagaaagaaaaccccggtctgacacaggatatcatcatgaagattctggagaaaaaatccgtggaagtgaatttcaccgaaagtcttttgcgtatggcagctgatgacgtggaggagtatatgatcgaaaggcctgagccagagtttcaggacctgaacgaaaaggccagggcccttaagcagatcctttccaagatccctgacgagatcaacgacagagtaaggtttttgcagacgattaaggacatcgcatctgcgattaaggagctcttggatactgtaaacaacgtgttcaaaaagtaccagtatcagaaccgccgagccctcgaacatcagaaaaaggaattcgtcaaatattcaaagagcttttcagacacattaaaaacttattttaaagatggtaaagcaattaacgtgttcgtaagcgccaacagactgatccaccaaactaattag

SEQ ID NO: 236117 - DNA, 561 bp, Artificial Sequence
  Description of Artificial Sequence: Synthetic coding sequence
atgcggatgacaatggaggagatgaaaaacgaggccgaaaccacctcgatggtctccatgcccctgtacgctgttatgtaccccgtgtttaacgaactggagagagtcaacctgagcgccgctcagacccttcgcgctgccttcattaaggcggagaaggaaaatcctggcctcacgcaagacatcatcatgaaaattctggaaaaaaagtctgtcgaagtgaactttaccgagtctttgttgcggatggccgcagatgacgtggaagagtacatgatcgagagaccagaaccagagtttcaggacctgaatgaaaaagcccgtgcattaaaacagatcctatccaagatcccagatgaaattaatgacagggtgaggttcctgcagactatcaaggacatcgccagcgcaattaaagaactgctcgataccgtcaacaatgtgtttaagaagtaccagtaccaaaaccggagggctcttgagcatcaaaagaaggagtttgttaaatatagtaagtcattctctgacactctgaaaacctattttaaggacggaaagtag

SEQ ID NO: 236118 - DNA, 405 bp, Artificial Sequence
  Description of Artificial Sequence: Synthetic coding sequence
atgaggatgactatggaggaaatgaaaaatgaagcagagaccacgagcatggttagtatgccgctctatgctgtgatgtaccccgtgttcaacgaactggaacgggtcaatctttccgctgcgcagacgctgcgcgcagccttcataaaagccgagaaagagaatcctgggctcactcaggacatcatcatgaaaattttggaaaagaaatcagtggaggttaactttacagagtctctgctcaggatggccgctgacgacgtcgaggagtatatgatagaacgacctgagccggagtttcaagatctgaatgaaaaggccagagctctgaagcagatcctcagcaagattccagacgaaatcaatgaccgggtgaggttcctgcagacaatcaaggatatttag

SEQ ID NO: 236119 - DNA, 639 bp, Artificial Sequence
  Description of Artificial Sequence: Synthetic coding sequence
atgcggatgaccatggaggagatgaagaacgaagctgagacaactagcatggtttctatgccactgtatgcagtgatgtaccccgtcttcaatgagctggaacgggtgaatctgtctgccgcacagaccctgcgagcagcttttataaaggcagagaaagagaaccctggtctcacacaggatattataatgaagatcctcgagaaaaaatcagtggaggtgaacttcacagagagcttacttcggatggctgctgatgacgtcgaagagtacatgatcgaacgacctgaaccagaatttcaagacctgaatgaaaaagcgagagccctgaagcaaatactttccaagataccagacgaaataaatgatagagtgcgctttctccaaacaatcaaagacatcgcgagcgcaataaaggaacttctggacactgtgaataatgttttcaaaaagtaccagtatcagaatcgcagggcgctggaacaccagaagaaggagtttgtgaaatattccaaatcattctccgacacactgaagacctactttaaggatggtaaggctattaacgtgtttgtgagtgcgaacaggctgatccaccagaccaaccttatcctccagacctttaagactgtcgcttag

SEQ ID NO: 236120 - DNA, 5615 bp, Artificial Sequence
  Description of Artificial Sequence: Synthetic coding sequence
atggccaacctggaggagtcttttcctagaggcggaacccgaaaaatccataaaccagagaaagcttttcagcagagcgtggaacaggataacttattcgatatctctaccgaggagggtagtacaaagcgcaagaagtctcagaagggtcctgccaaaactaagaaactgaaaatagagaaaagggagtcgagcaaaagtgcccgagaaaaatttgagattctcagcgtggagtcattgtgtgagggaatgcggatccttgggtgtgtcaaggaagtcaacgagctggagttggtgatatccttgccgaacggactgcagggttttgtgcaggtcacagagatttgtgacgcctacacaaagaagctgaatgagcaggtgacgcaggagcaacccttgaaggacctgctccacctaccagaactgttctctccgggaatgcttgttcggtgtgtagtgtcatcactaggcatcacggataggggcaagaagagcgtaaaactgagccttaaccctaaaaacgtcaacagagtgctttccgctgaagcccttaagcctggtatgctgctcaccggaactgtttcttctctggaagaccacggatatctggtggacattggagtagatggcaccagagcctttcttcctctgcttaaagctcaggaatacatcaggcagaagaacaaaggggcaaagctgaaagtaggccagtacttgaactgtattgttgagaaggtcaagggcaacgggggagtagtcagcttgagtgttggacacagtgaggtcagcaccgccatagctacagagcaacagtcctggaacctgaacaacctcctcccaggcttagtggtgaaggcacaggttcagaaagtcactccttttggcctgacacttaattttctaacattttttactggtgttgtggattttatgcacctggatccaaagaaggctgggacatacttctccaatcaggccgtgcgagcatgtatcctttgcgttcacccacgcactcgtgttgtccacctgtccctgcgccctatttttttacagcctgggaggcctctgactcgattatcttgccaaaatctaggcgcagttttggatgacgttcctgttcagggcttcttcaagaaagccggtgccacctttcgcttaaaagacggggtgttggcttacgccagactgagccatcttagtgatagtaagaatgtgtttaatcccgaggccttcaagccaggaaatacacacaagtgcaggatcatcgactacagccagatggacgagctggctcttctcagcttacgcacctcaatcatcgaagcccagtatctgagataccacgatatcgaacctggagctgttgtgaaaggcaccgtgttgacaattaaatcttacggcatgctggttaaagtcggcgaacaaatgcgtggcctggtaccacccatgcatcttgcggatatactcatgaaaaaccccgagaaaaagtaccacatcggcgatgaggtgaaatgtagagtgttactgtgtgatcccgaggcaaagaagttgatgatgactcttaaaaaaaccttgattgagtctaaactcccggtcatcacttgctacgccgatgccaaacctggtctgcagacgcacgggtttataattcgggtgaaagactacggctgtatcgtcaagttttacaacaatgtccagggtctggtccccaaacacgaactctccacagagtacattcccgatccagagagagtgttctacactgggcaggtcgttaaggttgtagttctgaactgtgaaccctccaaagagagaatgctgctttcttttaaactgtcaagcgacccagaacctaaaaaggagcctgccggacatagccaaaaaaaagggaaagcgattaacattgggcagctggttgacgtgaaggtcctcgaaaagacaaaagatggattggaagtggcagtgttaccacataacatacgggcatttcttccaacctctcacctctccgatcatgtagccaacggacctctgctgcaccactggctccaggccggtgatatacttcaccgcgtcttgtgtcttagtcagtcggaaggtagagtcttgctgtgccggaagccagccctggtctccacagtcgagggaggccaagaccccaagaactttagcgaaatacaccccggaatgcttctcattgggttcgtcaagagcattaaggactatggcgtgttcatccagttcccttctggcctgtcaggcctcgctccaaaagccattatgagtgacaagtttgtgacaagtacctccgaccacttcgtcgaaggccagacagtcgccgcaaaggtaaccaacgtggacgaggagaaacagaggatgttactgtccctgcggttgtccgactgcggccttggagatctggcgattactagcctcttacttctcaaccagtgtctggaggagctgcagggcgtcaggtcactgatgtcgaaccgggatagtgtgctcattcagaccttggctgaaatgacacctggaatgttcctggatctcgttgtgcaggaggtgcttgaggatggatcggtcgttttttcaggcggacccgtgcctgaccttgttctgaaggcctcccgctaccacagagccggacaagaggtggagtccggacagaagaagaaagttgtgatcctcaatgtcgatctgctaaaactcgaagtgcacgtgtcactgcatcaggatctggtgaatagaaaggccagaaagctgaggaagggctctgaacatcaggctattgtgcagcatctggaaaagagcttcgccatagcaagcctggtagaaaccggccacctcgccgcattctccctgacaagccatctgaacgacacgttcagattcgactccgagaaactccaggtaggacagggcgtcagtctgacacttaagactacggagccaggggtgaccggccttctgttggcagtagaaggacctgctgccaaacggactatgaggccgacacagaaagactcagaaacagtagacgaggacgaggaggttgatccagctcttactgtgggtactatcaagaagcatacattgagcatcggagacatggtcacaggcaccgtcaagagtattaaacctacgcacgtggtggtcacactggaagatggtataatcggttgcattcatgctagccatattctggacgacgtcccagaggggacaagtcctactaccaagctcaaggtggggaagaccgtaacggccagggtaatcgggggacgcgacatgaagacattcaagtacctgcctatcagtcaccccaggtttgttcggacaattccagagctgtctgtgcgtccatctgaacttgaagacggacataccgccctcaatacccacagtgtgagtcccatggaaaagattaaacagtaccaagccggacagacagtgacttgtttcctcaaaaaatacaacgtggtgaagaagtggcttgaggtcgaaatcgcgcctgacatcaggggacgtattccgttactactgaccagcctgagctttaaagtgctgaagcaccccgataaaaaattcagggtcggacaggcattgagggcaacagtggtgggcccagattcttctaaaacattattatgtctgagcctgaccgggccacacaaactggaggagggtgaagttgcaatggggagagtggttaaggtgactcctaatgagggcctgacggtgtctttcccctttggcaagatcggaaccgtgtcaatttttcacatgtctgacagctatagcgaaacccctctggaggacttcgtccctcagaaagtcgtcagatgttacatcctcagcacggctgacaacgtgctgacactctctctccggagcagccgcacaaacccagagacaaaatctaaggtggaagatcctgagataaactctattcaggatatcaaagagggccagctgcttcggggatacgtgggctcgattcagccccatggagtcttttttcggctgggcccaagcgtggtagggctggcacggtacagtcatgtcagccagcactctccatccaagaaggccttgtataataaacacctgccagagggcaagctgctcaccgcacgggtgctccgactcaaccatcagaaaaatctggtcgagctgtcctttctccccggtgataccggaaagccagatgtcctttctgcgagcctcgagggtcagctgactaaacaggaagagaggaaaactgaggccgaggaacgggatcagaaaggggagaagaagaatcagaaacggaatgagaaaaagaaccaaaaaggacaggaagaggtggagatgccgagcaaggagaagcagcagccacagaagcctcaagcccagaagcgaggcggacgcgagtgtcgggaaagtgggtctgaacaggaaagggtgtccaagaaacctaagaaagccggtcttagtgaagaggacgactccctggtggacgtttactaccgcgaagggaaagaagaggccgaggagaccaatgtactcccaaaagagaagcagacaaaacctgccgaagcccctcgtctccaactctcctctgggtttgcctggaatgtcggactggattccctcacgccagccctgccaccattagctgagtcttcggacagcgaggaggatgaaaaacctcatcaggctacaataaagaaaagcaagaaagagcgcgagctggaaaaacagaaagcagaaaaggagttgtctagaatcgaagaagcactaatggaccccggtcggcagcccgagagcgccgacgatttcgacaggttagtcctttcatcaccaaactcctccatcttatggttgcaatacatggccttccatttacaggctaccgagatagagaaggctcgtgccgtggccgaacgggcattaaagaccatcagcttccgagaggaacaggaaaaactcaatgtctgggttgcactccttaacttggagaatatgtatggatcacaagagtcactcaccaaggtgtttgagcgggctgtgcagtacaacgaacccctgaaggtgtttttgcacttagccgacatttatgccaagtcagaaaaattccaggaggcaggcgagctctataaccgaatgctgaaaagatttcgacaggagaaggccgtgtggattaaatacggcgctttcctgctcaggagaagtcaggcagccgcttcacaccgggtcctgcagcgagcccttgagtgtctgccctcaaaggagcatgtggacgtgatagccaagttcgcgcagctggaattccagctaggcgacgccgagagagcaaaagccatcttcgagaacacattgagcacttatccgaaacgaacggacgtgtggtccgtgtatatcgatatgaccatcaagcatggcagtcagaaagatgtgcgcgacatcttcgagagagttatccatctcagcctagcaccaaagaggatgaagttcttttttaagaggtacttggactacgagaaacaacatggcacagagaaggacgtacaggctgtgaaggcaaaggcattagaatatgtcgaggccaaatcctcagtgcttgaggacta

SEQ ID NO: 236121 - DNA, 3705 bp, Artificial Sequence
  Description of Artificial Sequence: Synthetic coding sequence
atggcaaatcttgaggaatcgttccctagagggggtacgaggaaaattcataaacctgaaaaggcctttcagcagtctgttgagcaggataacctgtttgacatctccaccgaggaggggtcaactaagaggaaaaagagccagaaaggccctgccaaaacaaagaaactgaaaatagagaagagagaaagctccaagagcgcaagggaaaagttcgaaatccttagcgtcgagtctctgtgtgagggcatgcgtatcctcggctgtgtcaaggaggtgaatgagttggaactagtcatctccctccctaacggtctgcaaggctttgtccaggtgacggagatctgcgatgcgtacaccaagaaacttaatgaacaggtgacacaggagcaaccactgaaagacctgttacacctgcctgaactgttctctcccggaatgcttgtacgctgtgtggttagcagtctggggataacagatcggggtaaaaaatcagtgaaactgtcccttaatccaaaaaacgtgaaccgcgtgctgtccgctgaggccctcaaacccggtatgctgcttaccggaacagtgtctagtttagaggaccatggctatttggtggacattggcgtcgacggtactcgcgcattcctgccactgctgaaagctcaggagtacattaggcagaagaacaaaggggcaaagctcaaagtggggcaatacctcaactgcattgtagaaaaagtaaaaggcaatgggggtgtggtgtctctgtccgttgggcatagcgaagttagtacggctatcgccacagagcagcagtcctggaacctcaataatctgcttccaggactcgtggtgaaggcccaggtccagaaagtcactccattcggcttaaccctcaacttcctaaccttctttacaggagtagtagacttcatgcatcttgatcccaagaaagccggaacttacttctcaaatcaggctgtgagagcctgtattctctgcgtgcacccacgaacgagagttgtccacctgtccttaaggccaatttttctccagcccggaagacctctgacaagactgtcatgtcagaacctgggcgctgtgcttgatgacgttccagtacaaggcttctttaagaaggcaggggctacctttcgcttgaaggacggggttctggcatatgcaagactatcccacctttcagacagtaaaaatgtgttcaacccagaggcattcaagccaggcaacactcacaaatgtaggattatcgattattcgcaaatggatgagcttgcactactctccctgcgcacctccatcatcgaggcacaatacttgagataccatgatatcgaaccaggcgcagtggttaaagggaccgtgttaactataaagagctatggaatgctcgttaaggtgggcgaacaaatgcggggactggtcccccctatgcacctggccgatattctgatgaaaaacccagaaaagaaataccatattggcgacgaagtgaagtgtcgggtgctcctttgcgaccccgaggccaaaaaattaatgatgaccttaaaaaagacactgatcgagtctaagcttcctgtgatcacctgttacgctgacgctaagcccggattgcagactcatggcttcatcattcgagtgaaagactatggatgcatcgtgaaattctacaataacgttcaaggcttggtccccaaacacgagttgtctacagagtacatccctgatccggaacgcgtgttttacactggccaagtagtcaaagtggttgttctgaactgtgagccatccaaagagaggatgcttctctctttcaagttatcatccgaccctgaacccaagaaagaacctgcgggacatagccaaaagaaaggcaaagccattaacataggtcaactcgtcgatgtgaaagtgctcgagaagacaaaggacgggctggaggtggccgttctgccacacaacattcgggcatttctgcctacatcacacctttcagatcatgtggccaacggtcccctgctgcatcattggctacaggctggggacatcctccacagggtactctgcctatcacagtccgaaggcagagttctgttgtgccgtaaaccggcactggtgtcaaccgtggaaggcggtcaggaccccaagaacttctccgagatacatcctgggatgctgctgataggcttcgtaaaatccatcaaggattacggggtttttatacagtttccatcagggttatcaggactggcgccaaaagccatcatgtctgataagttcgttacatctacaagcgatcattttgtcgaggggcagaccgtagccgcaaaagtcacaaatgtggacgaggagaaacagcgcatgctacttagtctcaggctgtcagattgcggccttggggacctcgccataacttcacttctcctactgaaccagtgtctagaggaattgcagggcgttcgctcactgatgtccaacagggattctgtgcttatccagactctagccgagatgacccccggaatgtttctcgacctggtggtccaagaggtgcttgaggatggctcagtcgtgttttcaggcggaccagtcccagacttggtactgaaggccagcaggtatcaccgcgcaggacaggaagtagaaagtgggcagaaaaagaaggtcgtcatcttgaacgtcgatctgcttaaactagaagttcacgtatccctgcaccaagatctggtaaatagaaaagcacgaaagctgcgaaagggttcagagcaccaggcaatcgtccagcatttggagaagtcgtttgccattgcatctctggtcgaaacgggccacttagctgcattttcgctgacatctcaccttaacgacaccttcaggtttgattctgagaagctgcaggtaggacagggagtgtccttaactctcaaaactactgaacctggtgtgactggattgttgctggctgtggaagggcctgctgcaaagagaacaatgagacctacacaaaaggactcagaaaccgtggacgaagatgaggaggttgatcctgcgctgacagtgggaactataaagaagcacactctctcaattggcgacatggtgacaggcacagtgaagtccatcaaaccaacacacgtggtagtcactcttgaagacgggattattggttgcatccacgcaagccacattctcgatgacgtccccgaaggaacttcaccaaccactaaactgaaggtcggaaaaaccgtgaccgcaagggtaatcggagggcgagacatgaagaccttcaaatatctgcctatctcacacccaaggtttgtgcggaccattcccgagttgtcagtcaggccatcagagcttgaagatgggcatactgcactgaacacacacagcgtatccccaatggaaaagattaagcagtaccaggccggtctctcagaggaagacgattcactagtggacgtttattaccgcgagggcaaggaagaagctgaggagacgaacgtcttacccaaagagaaacagacaaaacccgctgaagcccctcgcttgcagctttcttccggcttcgcttggaatgtcggactcgactctctgactccagcgctgcccccactagccgaatcatctgactctgaggaggacgagaagcctcaccaggctactcagatcaaaaaaagcaaaaaatag

SEQ ID NO: 236122 - DNA, 936 bp, Artificial Sequence
  Description of Artificial Sequence: Synthetic coding sequence
atggcggctgcgggagctcgtccggtagaactcggatttgccgaatccgcacccgcatggagattaagaagcgagcagtttccgagcaaggtctacgccccactgccaggacgcccagatgcctttcatcgctgtatctttctgttttgctgtagggagcaaccttgttgcgcaggcctgagagtctttcgaaatcagctaccaaggaagaatgatttttattcctatgagcctccgagtgagaatccaccccctgaaaccggggagagcgtttgtctccagcttaaaagcggagctcacctttgccgagtgtgtggatgcctcgggccaaaaacctgttctaggtgccacaaggcttactattgttctaaagagcaccagaccctggattggcggctgggccacaaacaggcctgcgctcagcctgaccacctggaccacatcataccagatcacaatttccttttccccgaatttgaaattgtgatcgagaccgaggacgagattatgcccgaggtcgtagagaaggaggactattccgagatcattggatctatgggggaagcgctcgaggaggaacttgatagcatggccaagcatgagtcccgggaagataagattttccagaagtttaaaacacagatcgctctagagcctgaacagatcctcaggtatggaaggggaatcgctccgatatggatctccggagaaaatatcccccaggagaaggatatccccgactgcccctgcggggcaaaaagaatccttgagtttcaagtaatgccccagttactgaattatctaaaggctgaccgcctggggaaatctatcgactgggggatactcgctgtcttcacttgcgcagagtcttgttccttgggaaccggatacaccgaagagttcgtctggaaacaggatgtcactgatactccatag

SEQ ID NO: 236123 - DNA, 687 bp, Artificial Sequence
  Description of Artificial Sequence: Synthetic coding sequence
atggctgccgctggcgctcgcccagtggagctggggtttgctgaatctgcccctgcttggagactgagatccgagcagtttccatcaaaagttggaggacgccctgcctggttaggggctgccggattgccaggtccccaggcgctagcctgtgagctgtgcggaagacccttaagcttcctgctccaagtctacgcacctctgccagggagaccggatgcatttcacaggtgcatttttctcttctgctgtcgagaacagccctgctgtgcaggcttgcgcgtgtttcgaaatcagctgcccagaaagaacgacttctatagttacgaacccccttccgagaaccccccacctgagaccggcgagagcgtgtgcttgcagctcaaaagcggagcccatctttgtagggtctgcgggtgcctgggcccaaaaacatgttcacggtgccataaggcatattattgtagcaaggagcaccagaccctcgattggagactaggtcataagcaggcgtgtgctcaaccggatcacttggatcatatcatcccagatcataattttctgttcccagagttcgaaattgttattgaaactgaggatgagatcatgccagaggttgtggagaaggaagactatagtgaaattataggttccatgggcaaacagttccaggacttcatccactag

SEQ ID NO: 236124 - DNA, 1035 bp, Artificial Sequence
  Description of Artificial Sequence: Synthetic coding sequence
atggccgctgctggcgcacgaccagtagaactgggattcgccgaatcggcgcctgcatggaggttgcggtccgaacaattcccatccaaagttggcggacgaccggcatggctgggggcagccggactcccgggtcctcaagctctggcttgtgaactttgcggtcggccactatctttcttgcttcaggtgtacgcgcctttgcctggcaggcccgacgcttttcatcgctgcattttcctgttttgctgccgtgagcagccttgttgtgctggccttagggtctttcgcaaccaactgcctagaaagaacgacttttactcctatgaaccccctagcgaaaacccaccaccagagaccggagaatccgtctgtctacagctgaagtcaggcgcacacttatgccgggtatgtggctgtctcggccctaagacctgcagcaggtgccacaaggcctactactgctcaaaagaacaccagactttagactggagactgggccacaagcaggcctgcgcccagcccgaccacctggatcacattatccccgatcataatttcctgtttccggagttcgaaattgtcattgagactgaagacgagataatgccagaggtcgtggaaaaggaagactacagcgagataattggatctatgggcgaagccctggaagaggagctcgattccatggctaaacacgagtccagggaagataaaattttccagaaattcaagactcaaattgcgctcgaaccagagcaaattttgagatacgggaggggcatagctcccatctggattagtggcgagaatattccccaggaaaaggacatccccgattgcccttgcggcgctaaacgtatacttgaattccaagtcatgcctcaactcttaaattacttgaaggctgaccgcttgggcaagtctatcgattgggggattctggccgtgttcacatgcgccgaatcctgtagtctgggaactggctacacagaagagtttgtttggaagcaggacgtgacagatacaccgtag

SEQ ID NO: 236125 - DNA, 588 bp, Artificial Sequence
  Description of Artificial Sequence: Synthetic coding sequence
atggccgctgccggtgcacgccctgtggagctggggtttgcagaatcggccccagcttggaggctgcgctctgaacagttcccgtctaaagtttatgccccactgccaggtaggccagatgcatttcacaggtgtatctttttgttctgctgtagagagcaaccttgctgcgccggactgagagttttccgcaatcaactgcccagaaagaacgacttttactcgtacgagcccccaagtgagaatccaccacccgagacaggagagagtgtttgtttacagttgaagagtggagctcacctgtgccgggtgtgcggatgtttggggcctaagacatgttcgcggtgtcataaggcctactattgttctaaagagcatcaaaccctggattggagactggggcacaagcaggcctgcgcacagcctgatcacctcgatcatatcatcccagaccataactttctgttcccagaattcgaaatcgtgatcgaaactgaggacgagatcatgcctgaggtggtggagaaagaagattattccgaaatcattggctccatggggaagcagttccaggacttcattcattag

SEQ ID NO: 236126 - DNA, 567 bp, Artificial Sequence
  Description of Artificial Sequence: Synthetic coding sequence
atggccgcagcaggagctcgccctgtggagctcggattcgccgagagtgccccagcttggcggctgagatccgagcagttccccagtaaagtgtatgcgcctctgcccggacgccctgatgcctttcacaggtgcattttcctcttctgctgtcgcgaacaaccctgttgcgccggattacgggttttcaggaaccagctgccacgaaagaatgacttttactcctatgaaccaccatccgaaaacccgcctccggagactggagagtccgtttgcctgcagcttaaatccggggctcacctgtgcagggtgtgtgggtgtctggggcctaaaacttgctctaggtgtcataaggcttactattgtagtaaggagcaccagacgctcgactggagattggggcacaaacaggcctgcgctcaaccagatcacctcgaccatatcattcccgaccacaacttcctcttccctgagttcgagatcgtgatcgagactgaggatgaaatcatgcccgaagtggtcgaaaaagaggactactcggagataatcggatctatggggatttag

SEQ ID NO: 236127 - DNA, 2607 bp, Artificial Sequence
  Description of Artificial Sequence: Synthetic coding sequence
atggccaccttcatttcagtgcagcttaaaaaaacgtccgaagtcgatttagcgaaaccactggttaaatttattcagcagacttacccatcagggggagaggagcaggcccagtattgtcgcgcagcagaggaactgtctaaacttcgtagggcagctgtcggcaggcccctggataaacacgagggcgcactcgaaactttgctgcgttattatgaccaaatctgcagtatcgagcccaagtttcctttcagcgagaaccagatctgtttaacatttacgtggaaggatgccttcgataaaggttccttgtttggagggagcgtcaaactggctctggcaagcttaggctatgagaaatcctgcgtgttgtttaactgcgctgctctggccagtcagatagccgctgagcagaatctcgataatgacgagggactgaagattgcagccaagcattaccaattcgcaagcggcgctttcctgcacattaaagaaactgtgctttcggccctttctcgggaaccaactgtggatattagtcccgacactgttggcacactttcactcattatgctggcccaggctcaggaggtgttcttcctgaaagccacacgcgataaaatgaaggacgcaataatagccaaactggccaatcaggctgccgactattttggggatgcgttcaagcaatgccagtataaggacacactccctaaggaggtgttccccgtcctcgcggctaagcactgtataatgcaggctaacgccgagtaccaccagtcgattctggcaaagcagcagaagaaatttggggaggagatcgctaggcttcaacacgcagccgagctgatcaaaaccgttgccagccggtacgatgagtatgtgaacgtgaaagatttttctgacaagataaatagagccctagcggctgctaagaaggataatgattttatataccacgacagagtgccagatctgaaagacctcgatccgataggcaaagccacactggtcaagagcacaccagtgaacgtgcctattagccagaaatttaccgacctgtttgagaaaatggttcctgtgtctgtgcaacagtctctcgcagcgtacaaccagcgtaaggctgatctagtgaatcggagcatcgctcagatgagggaggccacgaccttggccaatggcgtgctcgcgagcctgaacctgccagccgcaatcgaggacgtgagtggcgacaccgttccccaaagtattctgaccaagtccagaagcgttattgagcagggaggaattcagaccgtcgaccagcttataaaggaacttcctgagctgcttcagcgcaatcgagaaatacttgatgaatctttgaggctgctggatgaagaagaagctacggacaatgatttgcgcgcaaaatttaaggaaaggtggcagagaacaccatccaacgaattgtacaagccattgagagctgaaggaaccaatttccgcaccgttctggacaaagcagtccaagctgacggtcaggttaaggaatgctaccaatctcaccgcgatactattgtgctcctatgcaaaccagagcccgagctcaacgctgccattccctctgccaaccctgccaagactatgcaaggctctgaggtggtaaatgtgctgaaatcactgctttcgaatctcgacgaagtgaagaaagagcgtgagggtctggagaatgatctcaagagcgtaaacttcgatatgactagcaaatttctgactgcactcgcacaggatggcgtaattaatgaggaggctctgtccgtgacagaactcgaccgagtctatggtggattgaccacgaaggtgcaggaatctctcaaaaaacaggaagggttgttaaagaatattcaggtctcacatcaggaattctcgaaaatgaaacagagcaataacgaagcgaatctgcgcgaggaggtactcaagaatttggcaacagcgtacgacaattttgtcgaacttgtggcaaatctcaaggagggcacaaagttttataatgaattaaccgagatattagttaggttccagaataaatgtagtgatatagtgtttgccagaaagactgagcgggatgagcttctgaaagatctgcagcagtcgatcgcacgcgagccaagtgctccgtcgattcccacccccgcttatcagtcctcaccagcaggaggccacgcaccaactcccccaactccggcacctcgtactatgccaccaaccaaacctcaacccccagctagaccccctccgcctgtgttgcccgcaaaccgcgctccgtcagccaccgctccttcaccggtgggggctggcacagcagcgccagcgcctagccagacaccaggcagcgccccaccaccacaggcgcaggggcctccttacccaacataccccggatatcccggatattgtcagatgccaatgcccatgggatataatccctacgcttacgggcagtacaacatgccgtatccccctgtttatcaccagagccctgggcaagctccataccccggtccccagcagccttcatacccttttccccagcctccacagcagtcctactatccacagcagtag

SEQ ID NO: 236128 - DNA, 2622 bp, Artificial Sequence
  Description of Artificial Sequence: Synthetic coding sequence
atggcaacttttatctctgtacagctgaagaagacatcagaagtcgacctcgcaaagccactggtgaagttcattcagcagacctatccctccgggggagaggagcaagctcagtattgtagggccgcagaagagctgagcaaactccggcgtgcagccgtgggcagaccactcgacaagcatgaaggtgcactggaaactctcctccgatactatgaccagatctgctcgatcgagccgaaatttcccttcagtgaaaaccagatctgtctcacttttacctggaaggacgccttcgataaagggagtttatttggcggatcggtcaagttagccctcgcaagtcttgggtacgagaagtcttgcgtgttgttcaattgcgcagccctggccagccagatcgccgcagaacaaaatcttgacaatgacgagggcctgaagatcgccgcaaagcactaccagtttgcatctggagccttcctacacattaaggaaaccgtcctctcagccctgtcaagagagccgacagtcgatatatccccagatacggtgggtaccctaagcctgattatgcttgctcaagctcaggaggtgttttttctcaaagctaccagagataaaatgaaggatgcgattatcgctaagctggccaatcaggctgccgattattttggggatgcgtttaagcagtgtcaatataaagacaccctcccgaaatacttctattttcaggaagtgtttcctgtgctggccgcaaaacactgcatcatgcaggcaaacgctgagtaccaccagtctattcttgccaagcaacagaaaaagttcggcgaggaaattgctcgcctgcagcacgcggcagagctcattaagaccgtcgcaagccgatacgacgagtatgtgaacgtcaaagatttttcagacaagatcaatcgcgcattggcagccgcaaagaaggacaatgacttcatttaccatgaccgggttccagatttgaaggatctcgatccaatcggtaaagcaacgctcgtcaaatctacccctgtcaatgttcccattagccagaagttcaccgatctgtttgaaaagatggtcccagtgagcgtacaacagagccttgccgcatataaccagaggaaggccgacctggtcaaccggagcattgcacagatgagagaggccactacactggcgaatggtgtactcgcatctctcaacttgcctgctgcgattgaggacgtttctggagataccgtgccacagtcaatactgacaaagagcaggagcgtcatcgaacagggagggatacagaccgttgaccaacttatcaaagagcttcctgaattgctccaacgcaatagggagatccttgatgaatccctgagattgctggacgaggaggaggcaactgataacgacctgcgagccaagtttaaggagagatggcaacgcaccccgagcaacgaactgtacaagccgctccgcgcagagggtaccaatttccggactgtgctagacaaggccgtacaggccgatggacaggtgaaggagtgttaccagtcccatcgcgataccatcgtgttgctctgcaaacctgagcctgagttaaatgccgctatccctagcgcaaatccagccaagaccatgcagggatctgaggtcgtcaacgtgctgaagtccctgctttccaacctggacgaagtgaagaaggaacgcgagggcctcgagaatgatctgaagtctgtgaatttcgatatgacgtcaaagttcctgacagccctggctcaggatggcgtcatcaacgaggaggcgctgtctgtcactgagctagacagagtgtacgggggtctgacaacaaaagtacaagaatcattaaagaagcaggaggggttgttgaagaatatccaggtttcacaccaagagtttagtaagatgaagcagagcaataatgaggctaatcttagggaggaggtcctcaaaaacttggccactgcttacgacaacttcgtcgagctggtcgccaatttaaaggaaggaactaaattctataacgaactgaccgagattctcgtccggttccagaataaatgttctgacattgtgttcgcacgcaaaacagaacgggacgaactgctgaaagaccttcagcaatccattgctcgggaaccctccgcgccatccatcccgactcccgcttaccaatcatcccctgcgggagggcatgcccctacccctccgacccccgctcccagaacgatgcctccaaccaaacctcagcctccagctagacctccaccccctgtcctgcccgctaatagagccccatcagcaacagcaccttccccagtgggcgcagggacagccgcacctgcaccatcacagacacctggctccgcccctccccctcaggcccagggacctccttatccaacatatccgggataccctggttattgtcaaatgcccatgccgatgggatacaacccatacgcctacggacaatacaatatgccttaccctccagtgtaccaccaaagccctgggcaagcgccttatcccggaccacagcaacccagttaccccttcccgcagccccctcagcagtcgtattacccacaacagtag

SEQ ID NO: 236129 - DNA, 1458 bp, Artificial Sequence
  Description of Artificial Sequence: Synthetic coding sequence
atggccttacctcctttctttggacagggccgaccaggtccacccccaccacagcccccacctcccgctcccttcgggtgccctccaccacctctaccgtcccccgctttcccacctccgctaccgcaacggccaggcccatttccaggagctagtgcacccttcctccagccccctctggcactgcaaccacgcgcttctgcagaggcatctcgcggtgggggaggtgcaggcgctttctacccagtcccgcctccacctctgccgcctccccctcctcagtgtaggcctttccccggtaccgatgcaggcgaacggcctcgaccacccccacccggacccggacccccttggagcccgagatggcccgaggcccctcctcctcctgcggatgtcttaggcgacgctgctctacagcgcctgagagataggcagtggttggaggcggtgttcgggaccccgaggagagctggatgcccggtgccccaacggacccacgccggaccctccctgggtgaagtgcgggcaaggctgctgagggccttgcgactcgtgcgaagattgcgtggcctgtcccaagcgctccgcgaggctgaggccgatggcgcagcctgggtgctcttgtattcgcagaccgccccactgcgggcagaacttgccgaacgtctacagcctctgacacaggcagcctatgtcggagaagccagaagaagactcgaacgcgtcaggagaagacgcttgaggctcagagagcgtgctagggaacgcgaggcggagcgcgaggcagaggcagccagggctgtcgagcgggagcaggagattgatcggtggcgtgtgaaatgtgttcaggaggtggaagagaaaaaaagggagcaagagctcaaggccgcagccgacggcgtgctgtccgaggtgagaaagaagcaggccgacaccaagcgcatggtcgacattttaagggcactagaaaagttgcgtaagctacgaaaagaggctgctgctcgtaagggagtgtgtccacctgcaagcgccgacgagaccttcacgcatcacttacaacgactgcgcaaactcattaagaaacggtctgagttatacgaggctgaagaaagagctctgcgcgtgatgctcgaaggggagcaggaggaagaacggaaacgcgagctagagaaaaaacagagaaaagagaaagagaagattctcctgcagaaaagggagatcgagtcaaaacttttcggggaccccgatgaattcccattggcacacctgcttgagcccttcagacaatactacttgcaagcagagcatagcctgcctgccctgattcagatcagacatgattgggatcagtatctggtcccttccgatcaccctaaaggaaatttcgtgcctcaagggtgggtgttaccgcctttaccttctaacgacatttgggctactgccgtgaaactgcactag

SEQ ID NO: 236130 - DNA, 840 bp, Artificial Sequence
  Description of Artificial Sequence: Synthetic coding sequence
ctgatgcggtctcattcggatagttgccacttcagcaaacatctgaggcgcgagcacggacctgctaccattctcagacccggtagccctaggccgccacctccgccaagcttctcactcagaaggttgagagagcgcgctagggagcgtgaggctgagagagaggctgaagcggcaagggccgtcgagcgcgaacaggaaatagatagatggagggtgaaatgcgtgcaggaggttgaagaaaagaagcgggagcaggagctgaaggccgcagcagacggcgtattgtcggaggtgcgcaagaagcaggccgacacaaagcggatggttgacattttgagggctctcgagaaactgcggaagctacggaaagaggccgcagctcgaaagggcgtctgtccacctgccagtgccgacgagactttcacacaccatcttcagcgcctcagaaaactgatcaagaaacgctcggagctctacgaggctgaagaaagagccctgagggtaatgttggaaggcgaacaggaagaggaaagaaagcgagagttggaaaagaagcaacgcaaggagaaggagaaaatcctccttcaaaaaagagagattgaatctaagctgttcggagatcctgacgagtttcctctggcccatttgctcgaaccctttagacagtactacctgcaggcagagcattctctgccagctctgattcagattcggcacgactgggatcaataccttgtcccctccgatcaccctaaagggaacttcgtgccacagggatgggtgctgccacccttgccatccaacgacatttgggcgaccgcagtaaaacttcactag

SEQ ID NO: 236131 - DNA, 813 bp, Artificial Sequence
  Description of Artificial Sequence: Synthetic coding sequence
tcccactcagactcttgtcatttttctaaacatttaaggcgcgaacacggtcctgctacaatcctcagacccggatcccccagaaggaggcgtcttaggctgcgcgaacgcgcacgtgagcgagaggccgaaagggaagctgaggcagccagggcggtggagcgggaacaagaaattgatcggtggagagttaagtgcgttcaggaggtcgaggaaaagaagagagagcaggaacttaaggcggcagctgatggcgtcctctcagaggtgcgaaagaaacaggctgacaccaagagaatggtggacatcctgcgcgctctggaaaaacttagaaagttgcgcaaggaggctgcagccaggaagggagtgtgcccacctgcttccgccgatgagacgtttactcaccacttacaacgcttgagaaaactcattaagaagcggtctgaactctatgaggctgaggaaagagctctaagggtgatgttggagggcgaacaagaggaagagcgcaagcgagaacttgaaaagaagcagcgcaaggagaaggaaaagatactgctgcagaagagggaaatcgagagcaagcttttcggcgacccagacgaatttcctctggcgcacctgttggagccgtttaggcagtattatctgcaggcggagcattctctcccagcgctgatccagattcgacacgactgggatcaatacctcgtgccatcggaccacccaaaaggcaacttcgtcccgcagggttgggttctgcctcccctgccaagcaatgatatatgggctacggccgtgaagctccactag

SEQ ID NO: 236132 - DNA, 165 bp, Artificial Sequence
  Description of Artificial Sequence: Synthetic coding sequence
atgtgtactaccctctttctgctctcaacactggcaatgctatggcggagaagatttgcaaacagggtgcagccagagcctagcgatgtagatggggcagcgagaggaagttccctggacgcagaccctcagagttccgggagagaaaaggaaccattgaagtag

SEQ ID NO: 236133 - DNA, 246 bp, Artificial Sequence
  Description of Artificial Sequence: Synthetic coding sequence
atgactcgcacagagagccctgccacctggatgggtcaactgggggctgccgcttggatgcgcacacttagcccgcaggccgcacaggtgcttgtgcgaccgcttgcgcaagaagatgcagtcggggctgccgcagcagcaagaggtcggatgggcggttcctccacccgcgaagtgccaagggcacaccccgtgaccgggtgctctgcggagattatcaacaagaagtgtcaactggacctttag

SEQ ID NO: 236134 - DNA, 819 bp, Artificial Sequence
  Description of Artificial Sequence: Synthetic coding sequence
atggctgctaaagtattcgagagtatcggcaagttcggtctggctctcgcagtagctgggggtgtggttaactctgcactttataacgtcgacgctgggcacagagccgtgatcttcgatcgcttcagaggagtgcaggacatcgtggtcggggagggcacccattttcttatcccctgggtgcaaaagcccattatattcgactgccgtagccggcctagaaacgtgccggtgattaccggatcaaaagatctgcagaatgttaacataacattgcgtatcttgttccggcctgtggccagccagctcccacgaattttcacgagcattggcgaggactacgacgaaagggtattgcccagtatcaccacagaaatcttgaaaagtgtagttgccagattcgacgcaggcgaactcattacccagcgggaactcgtctctcgccaggtgtctgatgacctcaccgaacgagctgccacatttggcctgattctggatgacgtgtcattgacccatctcacatttgggaaagagtttactgaagctgttgaagctaagcaggtggcgcaacaggaggcagagagagcaaggtttgtggttgaaaaagctgaacaacagaagaaagccgcaatcatttcagctgagggtgactctaaggctgctgaactgatcgctaattcgctcgccactgctggggacggcctgattgagctcaggaaattggaggctgcagaagacattgcatatcaactgagcaggtcaagaaacatcacctaccttcctgcaggtcagagcgtactgcttcagttgccccagtag

SEQ ID NO: 236135 - DNA, 741 bp, Artificial Sequence
  Description of Artificial Sequence: Synthetic coding sequence
atggccgcaaaggttttcgaatccatcgggaaatttgggttagccctggctgtcgcaggtggcgtggtgaatagcgctctgtacaatgtggacgccggtcaccgcgctgtaatctttgaccggttccgaggagtccaggacattgtggtcggggagggtactcattttctgattccttgggttcaaaagcctattatcttcgattgccgatctcgtccaagaaacgtgcctgtcattactggcagcaaggatctgcaaaacgtgaatattaccctgcgcatcctgttccgacctgtggcttcacagttgccccgaatatttaccagcatcggcgaggactatgacgagagagttctaccctcaataactactgagattctcaaatccgtggttgccaggtttgatgcgggagaactcatcacccaacgggagctggtttcacggcaggtcagcgatgatttaactgaaagagccgctacattcggcctgatcctggacgatgtatcgctgacacaccttacctttggcaaggaattcacggaggccgtggaggcgaaacaagtggcacagcaggaggctgaacgggctcgttttgttgtcgagaaagccgaacagcaaaagaaagctgcaatcatctctgccgaaggagattcaaaggcagccgaactgatcgcaaactcacttgctacagccggtgatggactgatagagttaaggaagcttgaagccgcagaggactag

SEQ ID NO: 236136 - DNA, 375 bp, Artificial Sequence
  Description of Artificial Sequence: Synthetic coding sequence
atggctgccaaagtcttcgagagcataggaaagtttggcctagctctggccgtcgcgggtggggtggtcaactccgctttatataacgtcgatgcaggccatcgggctgtgatttttgaccgcttcagaggtgtgcaggacatcgtggtgggcgagggcactcatttcctcatcccctgggttcagaaacctatcatcttcgactgtcgttctaggccgcgtaatgtgcccgtgataacaggtagcaaagatctgcagaatgtgaacattacactgaggattttattccgcccagtcgcctctcagctgcctaggatattcacctctatcggtgaagactacgatgaaagggtgctcccaagtataactacctag

SEQ ID NO: 236137 - DNA, 606 bp, Artificial Sequence
  Description of Artificial Sequence: Synthetic coding sequence
atggccgctaaggtgttcgaaagcatcggcaagttcgggctcgcgcttgcagtagcaggaggggttgtgaattccgctctttataatgtggacgccggtcaccgggctgtgatctttgacagattccgaggggtccaggacatagttgtcggtgagggtactcactttcttattccgtgggtgcagaaaccaattatttttgattgtcgctccagacctaggaacgtccccgtcataactggatcaaaagacctccaaaacgtgaacattaccctaaggatcctgtttcgacccgtcgccagccagcttccacggatttttacaagcataggtgaagattatgatgagagggttctgccgtctatcaccaccgagattctgaagtctgtggttgctcgatttgatgccggagaattaatcacacagagagagctcgtgtcacgtcaagtttccgacgacctaacagagcgcgcagctactttcggcctcatcctagacgacgtgtcactaactcatctgaccttcggcaaagaattcacagaggcagtggaggcaaagcaggtggcccaacaggaagctgagcgggcaaggttcgtagtggaatag

SEQ ID NO: 236138 - DNA, 645 bp, Artificial Sequence
  Description of Artificial Sequence: Synthetic coding sequence
atggctgccaaggtctttgagagtatcgggaaatttggtctggcactggccgtcgcgggaggtgtagtgaactccgctctttataacgtggatgctgggcatcgcgcagtcatttttgaccgtttcaggggcgttcaggatatagtcgtgggtgaagggacacactttctgatcccctgggttcagaagcctataatttttgactgtcggtcgcgaccgaggaatgtgccggtcatcacaggaagcaaggacctccaaaacgtgaacatcactctcaggatcctgtttcgccctgtggctagccagctgccacggattttcacaagcattggggaggattatgacgaaagagtgctgccatccatcacgaccgaaatcttgaagagtgtggtggctcgattcgacgccggagagttgataacacagagagagctagtttcacgtcaagttagcgacgacctgactgaacgagccgctaccttcggtctgatcttagatgacgtgagcttgacccatctaaccttcgggaaggaatttaccgaggctgtagaggctaagcaagttgcccagcaagaagccgaaagagcacgttttgtcgtcgagaaagcagagcaacagaaaaaggctgcaatcattagtgcctag

SEQ ID NO: 236139 - DNA, 468 bp, Artificial Sequence
  Description of Artificial Sequence: Synthetic coding sequence
atggcagcgaaggtattcgaatcaataggcaagtttggtctggcattggcggtcgctggcggtgtggtaaacagtgccctgtataacgttgatgctggacaccgggcagtgatattcgatcgttttcggggtgtgcaggacatcgtagtaggtgagggcacccacttcctgatcccttgggttcaaaaacctataatcttcgactgtcgaagtaggccacgtaacgtccccgtgatcactggatcgaaagacctccagaacgtgaatatcaccctccgaatattatttcggccagtggcttctcagcttcctcgcatctttacaagcattggggaggactatgatgagagggtcctcccctctataactaccgagatattgaagtctgtggtcgcgagatttgacgcaggtgaactcattacatacctgccagctggtcagtctgtgttgctccagcttccccaatag

SEQ ID NO: 236140 - DNA, 615 bp, Artificial Sequence
  Description of Artificial Sequence: Synthetic coding sequence
atggcagccaaagtgttcgaatccattggaaagttcggacttgctttggcagtagccggaggtgtggtgaacagtgcactctataacgtggatgccggacacagagcagtaatattcgatagattccgaggcgttcaagatatcgtggttggggaaggcactcactttctcattccctgggtgcaaaagcccatcatctttgactgcagaagccggccacgtaacgtcccggtcattacaggctctaaggatctacaaaacgttaacataacactgcggattctgttcaggcccgttgccagccaactcccgagaatcttcacctctattggtgaggactatgacgaaagagtgctgccgtctattaccaccgaaatcctgaaaagcgtggttgcacgctttgatgctggtgagcttattactcaacgggagctcgtcagtcgtcaggtgtccgacgacctgacagagcgggctgctaccttcgggttaatcctcgatgacgtctccttgacccatctcacttttggtaaagagtttaccgaagctgtcgaagcaaaacaggtcgcccagcaggaagctgagcgagctcggttcgtcgttgaaaaggtgtcttag

SEQ ID NO: 236141 - DNA, 900 bp, Artificial Sequence
  Description of Artificial Sequence: Synthetic coding sequence
atggcccagaacttaaaagacctggccggacggttaccagcgggtccaagggggatgggcacggccttgaagctgcttctgggtgctggagccgtagcctacggagtgagggagagtgttttcacggtagagggtgggcatagggccatcttcttcaaccgcatcggcggtgtccagcaagataccattctcgcagaggggttgcacttccgaattccctggtttcagtacccaatcatttacgatatccgggcaaggccaagaaagatcagctccccaaccggatcgaaggatcttcagatggtcaacattagtctgagagtcttgtctaggcccaacgcacaggagctacccagtatgtaccagcgactgggtctcgactacgaggagagggtcctgccttctatcgtgaacgaggtattgaagtccgtggtcgccaaattcaacgccagtcagctgatcacgcagagagcacaggttagtctcctcatcagaagggaactaactgagagggcaaaggacttcagcctcatactcgacgacgtggctatcacagagctgtcgttcagccgcgaatacaccgcggcagtggaagcaaagcaggtcgcccaacaggaggcccaacgtgcccagtttttggtggagaaggccaagcaagagcagcgtcaaaagatcgtccaagccgaaggcgaggctgaggcagcaaagatgctcggggaggctttgtctaaaaaccctggctatatcaaattgcgtaagattagggcagctcagaacatttctaagaccattgccacttcccagaacaggatatacctcacagctgataacttggtgttgaatctccaagatgagtcattcaccagatactccgacagcttgattaagggaaagaagtag

SEQ ID NO: 236142 - DNA, 786 bp, Artificial Sequence
  Description of Artificial Sequence: Synthetic coding sequence
atggcacagaaccttaaagatttagcagggaggctgcccgctggaccaaggggcatgggcacagcactgaagctgctgctcggagccggtgccgttgcgtacggagtgagggagtctgtatttactgtagagggtggccacagggcgatattctttaatcggattgggggagttcagcaggataccatcctggcagaaggacttcattttcggataccgtggtttcaataccccattatttacgacatacgggctcggcctagaaagatcagctccccaacaggaagcaaggacctgcaaatggtcaacatctcgcttcgtgtattgtctcgccctaacgcacaggaattgccgtctatgtatcagcgacttggcttggattacgaggaaagagtcctgccatctatcgtgaatgaggtgctgaaatccgtggtcgccaaattcaacgcgtcccagctcatcacacagagggcccaggtgagcctgctcatccggagggagctcaccgaaagggcaaaagacttctctctaatcctggatgacgtcgctatcactgagttgtcctttagcagagaatacacagctgcagtggaggcaaaacaggtcgctctttctaagaatccaggttatattaagctgcgaaagatccgggctgcacagaatatttcgaagacaatagcgaccagccaaaatcggatctatctcaccgctgataacctagtgctgaatctccaagatgaatctttcacccggggatccgactcactcataaagggcaaaaagtag

SEQ ID NO: 236143 - DNA, 900 bp, Artificial Sequence
  Description of Artificial Sequence: Synthetic coding sequence
atggctcagaacttgaaagacctggccggtagacttcccgctggacccagaggaatgggaaccgctcttaagctactgcttggagccggtgccgtggcctatggggtacgggagtctgttttcactgtggagggaggccatagggccattttcttcaaccggattggaggcgttcaacaggatactatcctcgctgagggactccacttcagaatcccctggtttcagtaccctatcatttatgacatacgggctcggcctcgaaaaatttcctccccaaccggctcgaaggacctgcagatggtcaatatcagtctgagagttctgtctagacctaacgcccaagaactgccctccatgtatcagcgattgggcctagactacgaggaacgcgttcttccttctattgtgaacgaggtgcttaagagcgtggtggccaagtttaatgcgtctcagttgatcacccagcgagcacaagtgtcactgctgattcgacgggaattaaccgaacgggctaaagacttttccctgatactggatgacgtggcaattactgagttgtctttctctcgggagtatacagccgcagtcgaagcaaaacaggtggcccagcaggaagcacaacgcgcacagtttctggtggagaaggccaaacaagagcagcgtcagaaaattgttcaggccgagggcgaggctgaagcagccaaaatgctgggcgaggctcttagtaaaaatccaggctacattaagctccggaaaattagagctgcccaaaacatttcaaaaacaatagcaacctcacaaaatcgcatttacctcactgctgacaacctggtgctgaatttgcaggatgagtcttttaccagggggtcagattctctcatcaaaggcaagaagtag

SEQ ID NO: 236144 - DNA, 642 bp, Artificial Sequence
  Description of Artificial Sequence: Synthetic coding sequence
atggcacaaaacctgaaggacctggccggtcgacttcccgctggaccacggggtatggggactgcattaaagctcctactcggagccggagcggttgcctacggcgtgcgggagagcgtctttactgtagagggaggacacagggctatttttttcaaccgcatcggcggagtgcagcaggacacgatactggcggagggtctccacttcaggataccgtggtttcaataccctattatttacgacatcagagcgcgtccccgaaaaattagtagccccacaggtagcaaagacctacagatggtgaacatttctctgagagtcctgtctcggcctaacgcccaggagctgcccagcatgtaccagaggcttgggctcgactatgaagagcgggtcttaccctctatagtgaacgaagttctcaagtccgtggttgccaagtttaatgctagccagttaatcacccagcgggctcaggtgtctctcctcatcagacgtgagctcacagagcgggcaaaggacttcagcttgattttggatgatgttgcaatcaccgaactgtcctttagtagggaatacaccgccgctgtcgaagccaagcaggtgggagagagccaggagccttggggagaaggcttctag

SEQ ID NO: 236145 - DNA, 318 bp, Artificial Sequence
  Description of Artificial Sequence: Synthetic coding sequence
atgcgtggagcgacacgggtgtcgatcatgctactcctggttactgtgtccgattgcgccgtgataaccggagcctgcgagcgcgacgttcaatgtggggcaggcacttgctgcgctatctcactttggctgcgcggactaaggatgtgtactcccctcggtagggagggggaagaatgccatccaggttctcacaaggttccattcttccggaagcggaagcatcacacatgcccttgcctgcccaatctactgtgctctcggttccccgatggacgatataggtgcagcatggatcttaagaacatcaacttttag

SEQ ID NO: 236146 - DNA, 390 bp, Artificial Sequence
  Description of Artificial Sequence: Synthetic coding sequence
atgcgcagcctttgctgtgctcctttgctcctcctcctgctcctgccccctttactcctgactcccagggccggagatgccgctgtgattacaggggcatgtgacaaagatagccaatgcggtgggggtatgtgctgcgcggtgagcatttgggtgaagtccatccgcatctgcacccctatgggcaaattgggtgactcttgtcaccccctgactaggaaaaacaactttggcaacggaagacaggaacgtcggaagcggaaaaggtccaaacgtaagaaagaggttccattcttcggcaggcgcatgcaccacacttgtccttgcttgcctgggctggcctgtttgcggacctcatttaatcgattcatttgcctcgcacagaagtag

SEQ ID NO: 236147 - DNA, 327 bp, Artificial Sequence
  Description of Artificial Sequence: Synthetic coding sequence
atgaggagcctgtgctgcgcaccattactgctgctgctgttactgccacccctgctgctgacgcccagagcaggcgacgcagctgtgatcacgggtgcttgcgataaggattcacagtgtggaggaggcatgtgctgtgctgtgtccatctgggtgaagtctattaggatttgtacacccatgggcaaactcggagactcatgtcacccactgacccggaaagtgccctttttcggcagacgtatgcaccatacatgcccttgtctccctgggctagcctgcctgagaacatcgttcaatagatttatctgtctagcacagaagtag

SEQ ID NO: 236148 - DNA, 705 bp, Artificial Sequence
  Description of Artificial Sequence: Synthetic coding sequence
atgcgcgctccactttgcctgctgctgctggtggcacatgccgtggacatgctggcactgaatagacggaaaaagcaagttgggactgggcttggcggaaactgcaccggttgtattatctgctccgaggaaaacggttgctcaacatgtcagcagagactgtttctctttattcggcgtgagggcattagacaatatgggaagtgcctccatgactgccctccagggtacttcggcatccgagggcaggaagtcaatagatgcaaaaagtgcggggctacatgcgaatcttgttttagtcaggacttttgtattaggtgtaagcgtcagttttacttgtacaagggtaaatgcctccctacatgccccccagggaccctggctcaccagaatactagggaatgccaaggcgaatgtgagctgggaccctggggtggttggagcccgtgtactcacaacggcaagacatgcgggtctgcctggggcttggagagcagggttcgggaagccggaagggctggacacgaggaagccgctacctgtcaggtgctgagtgaaagcagaaagtgtccaatccagcggccttgtccaggcgagagatctcccggtcaaaaaaagggccgtaaggacagacgcccaagaaaggaccgcaagcttgacaggcgacttgatgtgcggccacggcagcccggactgcagccgtag

SEQ ID NO: 236149 - DNA, 1155 bp, Artificial Sequence
  Description of Artificial Sequence: Synthetic coding sequence
atggcagctcaaaatggcaatacctcattcaccccaaactttaacccccctcaggaccatgcaagcagtctgtcatttaatttctcttatggagactatgatctccccatggacgaggatgaggacatgacaaagaccagaaccttttttgccgcaaagattgtaattgggatagccctggcaggcattatgttggtctgcggaataggcaatttcgtctttattgcggcactgacacgttataagaaactccgtaacctcaccaatctgttgatcgcgaaccttgcaatttcagacttccttgtggccatcatctgttgcccctttgagatggattattacgtcgtgcgtcagctgagctgggagcacggacacgtgctatgcgcttcagtcaattaccttaggactgtgagtctctacgtatctacaaacgcgctgcttgcgattgccatcgacaggtatttggccatcgtacaccccctcaagcctagaatgaattaccagaccgcctcatttctcatcgcattggtgtggatggtatccatcttgattgccatccctagcgcatacttcgctactgaaacagtgcttttcatcgtgaaatcccaggaaaaaatcttttgcggtcaaatctggcccgtggaccagcagctgtattacaagagctacttcctcttcattttcggcgttgagttcgtgggcccagtggttaccatgactctgtgctacgcaagaatctctcgtgaactgtggttcaaagccgtcccaggctttcagacagagcagattcgtaaacggctgcgatgccgccgaaagacagtactggttctcatgtgcatactcactgcctacgtgttgtgttgggcccctttttatgggttcacaatcgtccgggattttttcccaactgttttcgtgaaagagaagcattacttgacagctttttacgtagtagaatgtattgctatgtctaattctatgattaataccgtctgtttcgtgactgtgaagaataacaccatgaaatacttcaaaaagatgatgctcttacactggcggccttcccagagaggctcgaagtcctcagcggacctcgatctcaggactaacggcgttccaactacagaggaagttgattgtatccggctgaaatag

SEQ ID NO: 236150 - DNA, 684 bp, Artificial Sequence
  Description of Artificial Sequence: Synthetic coding sequence
atgaacataaaaggctcaccgtggaagggctcattactgctgctcctagtgtctaacttattattgtgtcagtccgtggcacctctgcctatctgtcctgggggagctgcacgatgtcaggtcaccctccgcgaccttttcgacagggccgttgttctcagtcactacatccacaacctgtcttccgagatgttttccgaatttgataaacgctacacccacgggcgtggattcattacaaaggctattaactcctgccatacctcttcgctggccacacctgaggataaagaacaggcccagcagatgaaccagaaagatttcctgtcactgatcgtgagcatattgcggagttggaacgagcccctgtaccaccttgtgactgaggttcggggtatgcaagaagctcctgaagccattttgtctaaagctgtcgagatcgaggaacagacaaaacgactgttggagggcatggagctaattgtctcccaggtccatcccgaaaccaaagaaaacgagatataccccgtctggagtggactcccatctctgcagatggctgacgaagaaagtcgactgtccgcctactacaacctcttgcactgtcttagacgcgatagccataagattgataattatctcaagctcctgaaatgccgtattatacataataacaattgctag

SEQ ID NO: 236151 - DNA, 591 bp, Artificial Sequence
  Description of Artificial Sequence: Synthetic coding sequence
atgaacatcaaaggttccccttggaaggggagcctgctcctgttactggtgagcaacctgctactgtcccactacattcacaatctgtctagcgaaatgttttccgagttcgataaaagatatacgcacggtaggggctttatcaccaaggccatcaacagttgccacaccagctcccttgccacacctgaagataaggaacaggcgcagcagatgaaccagaaagatttcctctctctgattgtgtctattctcaggagctggaatgaacccctgtatcacctcgtcacagaagtgcggggaatgcaagaagcccctgaagctattctcagcaaagctgtcgaaattgaagaacagaccaagcgtcttctggagggcatggagcttattgtcagccaggtgcatccagaaacgaaggagaacgaaatctatcccgtttggtcgggacttccctctctgcaaatggctgatgaagagagccggctgtcagcctactacaacctcttgcactgcttgcggagggactcgcacaagattgataattatctcaaactgctgaaatgccgaataattcacaataataactgctag

SEQ ID NO: 236152 - DNA, 1545 bp, Artificial Sequence
  Description of Artificial Sequence: Synthetic coding sequence
atgaccctcatctggagacacttactgcggccactgtgtctggttaccagcgcaccccgaattctggaaatgcacccgtttctgtctttggggacatcacgaacaagcgttaccaaactgtccctgcataccaagcctcgcatgcccccttgcgatttcatgcccgagcggtatcagtccctaggatacaaccgagtgcttgaaatacacaaagaacatctgtctcccgtggtgactgcttatttccagaaaccgctgcttctacatcaagggcatatggagtggctgttcgatgcggaggggagtaggtatctcgatttcttctctgggatcgtgaccgtctccgtgggccattgtcatcccaaggtgaacgctgtggcacagaagcagctgggcaggctgtggcacacttctacagtcttcttccaccctccaatgcatgagtacgccgaaaagcttgccgctctcctgccagaacctctgaaggttatctttctggtcaatagcgggtcagaagctaacgaactggcaatgctgatggctagggctcactctaataacatcgatattatctctttccgcggtgcataccacgggtgctccccgtacactcttgggcttaccaatgtgggtacctataaaatggaattgcctggaggtacagggtgccagcccactatgtgcccagatgtgtttcgcggaccctgggggggaagccattgcagagattcgcccgtgcagacaattagaaagtgttcctgcgcgcctgattgctgccaggcgaaggaccagtatattgagcagtttaaagatacactcagcacgtctgtagccaaatcgatagctggattcttcgctgaacccattcagggggtcaatggagtggtgcagtatcccaaaggattcctgaaggaagcgtttgagcttgtgagagccaggggcggtgtgtgtatcgcggacgaggtacaaaccggctttgggagactgggatcacacttttggggttttcagacgcacgatgtattgcctgatattgtgaccatggccaaaggcatcggaaacggcttccccatggccgcagtgatcactaccccggagatcgcaaagtctctggctaagtgcctgcagcacttcaacactttcggagggaaccctatggcttgcgcaattggttccgcagtcttggaggtaataaaagaggaaaacttacaggaaaactcccaagaggtgggcacctatatgctcctcaaattcgccaagctaagggacgaatttgagatcgtaggggatgtgcggggaaagggcctcatgataggcatagaaatggtgcaggacaaaatctcttgtcgccctcttccccgagaagaggtcaaccagatacatgaagattgtaagcatatgggactcctggtgggaagggggagtatcttttcacagacctttcggatcgccccatcaatgtgtatcacaaagccagaggtggacttcgccgttgaagtgttccgcagtgccctgacacaacacatggaacgcagggccaagtag

SEQ ID NO: 236153 - DNA, 1050 bp, Artificial Sequence
  Description of Artificial Sequence: Synthetic coding sequence
atgaaggagaatgtggcgtcagcaaccgtgttcaccctccttctctttctgaacacttgccttcttaacggtcaactgccgcctggcaagcccgaaattttcaaatgtagatcacccaacaaggaaacattcacatgctggtggaggcctggcaccgatgggggtctcccgaccaattactccttaacatatcatcgcgagggtgagactcttatgcacgagtgtcccgattacattactggaggcccaaattcatgccactttggaaaacaatatacgagcatgtggcgtacctacattatgatggtgaatgctaccaatcaaatggggagcagttttagcgatgagctgtatgtggacgtcacatatatcgtgcaaccagacccacccttagagcttgccgtggaggtcaaacagcctgaagatcgcaaaccctacctctggattaagtggagcccccctactctcatcgatctgaaaacaggctggtttacactcctgtacgagatcaggctgaaacctgagaaggcagctgaatgggagattcacttcgcgggacaacagacagaattcaaaatcctgagcttgcatcccggacagaagtacctggtgcaggtccggtgcaaacctgatcatgggtactggagcgcttggtcacccgcaacatttatacaaattcctagtgatttcaccatgaatgacactaccgtttggatcagtgtggcagtgctttccgcagtgatctgtctgatcattgtgtgggccgtggcgctgaaggggtactcaatggtaacgtgtatcttcccgccagtccccggtccaaagatcaagggatttgacgcacatctgttagaaaagggaaagtccgaggaactgctgagcgccctcggatgtcaggatttcccccctacctctgattatgaggaccttttggtggagtatctggaggtggatgacagcgaggaccagcacctcatgtcagtacacagtaaggaacatcctagccaggagcgcgagcagaggcaagcacaggaggcacgcgactcatag

SEQ ID NO: 236154 - DNA, 1566 bp, Artificial Sequence
  Description of Artificial Sequence: Synthetic coding sequence
atgaaagagaatgtcgctagtgcgacagtgttcaccctcctgctttttttgaatacgtgcctcctcaacgttcagcctgacccgcctctcgagcttgccgttgaagttaagcagccagaagaccgcaaaccatacctgtggatcaagtggtcaccgcctacattgattgaccttaaaacaggctggttcactctactttacgagataagacttaagcccgagaaagccgctgaatgggagattcacttcgcaggccaacagaccgagttcaaaatcctgtctctgcacccaggtcagaagtaccttgtgcaggtgcgatgtaaacctgaccacggctactggagcgcgtggtcccccgcaacattcatacagataccctccgactttactatgaatgacactaccgtatggattagcgtggccgtgctctccgccgtgatatgcctgatcattgtgtgggcagtggcgctaaaaggttatagcatggtgacatgcatctttccgccagtccccggacccaaaatcaagggattcgatgcccacctgcttgaaaagggtaagagtgaagagttattgtctgctttgggttgccaggattttccgccaacaagcgactacgaggatctcttagtagagtatcttgaggtcgatgacagcgaagaccagcacttaatgagcgtccattctaaagagcacccgtcccagggcatgaagccaacctacctagatcctgacaccgatagtgggagaggctcctgcgatagtccctcgctcttgtcagagaaatgtgaggagcctcaggctaatccctcaactttctacgaccccgaggtgatcgaaaagcctgagaatcccgagacaactcacacgtgggacccacagtgcatttccatggaagggaagataccatacttccatgcagggggaagtaagtgctccacatggcctctgccacagccttcacagcataaccctcgcagcagctaccataacattacagacgtgtgcgagctggcggtgggacccgcaggcgcacccgcaaccttgctaaacgaagcaggaaaagatgccctcaagtccagccaaaccattaaatcacgggaggaggggaaagccacgcaacaaagggaggtggaaagctttcacagcgagaccgatcaggacactccgtggttactgcctcaagagaaaacccctttcggctccgcgaaaccactggactacgttgagatccataaggtaaataaggatggggctttgagtctgcttccaaaacagcgtgagaacagcggtaagccaaaaaagcctggcactccagaaaataacaaggagtatgcaaaagtgtccggggtaatggacaacaatattctggtcctggttcccgatccacacgctaagaacgtggcctgcttcgaagaatccgccaaagaagctcccccttctctggaacaaaaccaggccgagaaagctcttgcaaattttaccgctacctcatctaagtgtcgactccagctggggggactagattatctggaccccgcatgtttcacccactcattccactag

SEQ ID NO: 236155 - DNA, 807 bp, Artificial Sequence
  Description of Artificial Sequence: Synthetic coding sequence
atgaaagaaaatgtcgcttcagctactgtgtttaccctgcttctgtttctcaacacttgcttgctgaacggtcagctgccgccaggtaagcccgagatattcaagtgccggtctcccaacaaggagactttcacttgttggtggcggcctggtaccgatggcggacttccaaccaactactcacttacgtatcaccgggaaggggaaacactcatgcacgagtgcccggattacatcaccggcggtcccaattcttgtcattttggaaaacaatacacttctatgtggagaacttacatcatgatggtcaatgcaacaaaccagatgggatcttcattctctgacgagctgtatgtagatgtcacctacatcgtgcagcccgatcccccactcgaattggccgttgaagtgaagcaacctgaggatagaaaaccctacctgtggataaagtggagtcctcccacattaatcgatctgaaaactgggtggttcactctgttgtatgaaattaggctgaaacccgaaaaggcagccgaatgggagatacatttcgccggacagcagacagagtttaaaatccttagcctacacccgggacagaaatacctggtgcaggtgcgctgtaaacccgatcatgggtactggtcagcttggtccccagccacgttcatacagatcccaagcggtgaccctctgatgctcggagcgtcccattacaaaaatctgaagtcataccggcctcgcaaaatctccagtcaggggcgtttagctgtattcaccaaggctactctgaccacagtgcagtag

SEQ ID NO: 236156 - DNA, 1869 bp, Artificial Sequence
  Description of Artificial Sequence: Synthetic coding sequence
atgaaggagaatgttgcgagcgctaccgtgtttaccttgctgcttttcctcaacacctgccttctgaatggacagcttccaccagggaaacccgaaattttcaagtgcagatctcctaacaaagagaccttcacttgttggtggcggccaggaactgatggcggactccctaccaactattctctgacatatcaccgcgaaggtgagacactgatgcatgagtgtccagattacattaccgggggaccgaatagttgccacttcggcaagcaatatacttccatgtggcgcacatatataatgatggtgaatgcgaccaatcagatgggatcctctttttctgacgagctctacgttgacgtaacatacatcgtccaacctgaccctccattagagctggcggtggaagtcaagcagcccgaggatcgaaaaccttatctttggataaaatggagcccccctacactaatagatctaaagactggctggttcaccctgctgtatgagatccgcctgaaacccgagaaagctgcagagtgggagatccacttcgccggtcagcagactgagtttaaaatcttatctttgcatccagggcaaaaatacttggtccaagtgcgctgtaaacccgaccacggatattggagtgcgtggagccctgccacctttattcagattccgtccgactttaccatgaacgatacaaccgtctggatttctgtggcagtgctgagtgctgtcatttgcctgatcattgtgtgggctgtcgccctcaagggctattctatggtgacatgcatatttccgcctgtgcctggtcctaagattaaaggcttcgatgctcacctactcgaaaaagggaaaagcgaagagcttctatcagctcttggttgtcaagactttcctcctacatctgattatgaggatctcctggtcgagtaccttgaggtggatgattcggaggaccagcacctgatgtcagtccactcaaaagagcacccttcacagggtatgaagccaacttacctagatcctgataccgatagtggccgtggatcttgtgacagtccctctcttttgtcagagaaatgcgaggagcctcaggctaatccaagcactttttatgaccctgaagtgattgaaaaacccgaaaaccccgagacaacacacacatgggatccccagtgtatctccatggagggtaagatcccatatttccatgcaggtggaagcaaatgtagcacttggcccttgccacaacctagtcaacacaacccacgatcttcttatcataacataaccgacgtctgcgagctggccgtcgggccagccggtgctcccgcaacactgctgaacgaagcaggtaaagacgccttaaagtcttcccagacaattaagagtcgcgaggaagggaaggccactcagcagagagaggtagaatctttccactcagaaaccgaccaggataccccctggctcctgccgcaggagaaaacaccatttggctcagcgaagcccctggattatgtggagatccataaagtcaacaaggacggagccttaagtctgttgccaaagcaacgcgagaatagtggcaagcccaagaaacccggtacccccgaaaataataaagagtacgcgaaagtctctggtgttatggacaataacatcttggtgcttgttcctgacccgcacgccaaaaacgttgcatgcttcgaagagtctgccaaagaggctcctccttcgcttgagcagaaccaagccgagaaggcattggctaattttactgcaacaagtagtaaatgccgcctccaattaggcggactggattacttggaccccgcttgctttactcactcctttcattag

SEQ ID NO: 236157 - DNA, 594 bp, Artificial Sequence
  Description of Artificial Sequence: Synthetic coding sequence
atgcatgaatgtccagactatatcacgggcggacctaacagctgccacttcggcaagcaatacacgtctatgtggcgcacctatattatgatggtgaatgccacgaaccagatgggtagcagcttcagcgatgaactctacgtggatgttacctatatcgtccagcccgatccgcctctggagttagcagtcgaggttaaacaacctgaggaccgcaagccttatttatggattaagtggagtccgcctactctgattgacctgaagactggttggttcacactgctttacgaaattagattaaaacctgagaaagcagcagaatgggagattcactttgccggtcagcagaccgaatttaagatcttgtcacttcacccaggtcaaaaatacctggtccaggtgagatgtaaaccggaccacggctattggtccgcttggagcccagccacatttatccagatacctagtggcgaccccctaatgttaggcgcaagtcattataagaatttaaagagttaccgcccaagaaaaatcagctctcagggcaggctagctgtttttaccaaagcgactttgaccacggtacagtag

SEQ ID NO: 236158 - DNA, 312 bp, Artificial Sequence
  Description of Artificial Sequence: Synthetic coding sequence
atgaaggagaacgtcgccagcgctaccgttttcacacttttgttattcctcaatacctgcttgctcaacggtcaacttccccctggcaagccagagatcttcaaatgtaggagccctaacaaggagactttcacctgttggtggaggccaggcacggatggcggactgcctacgaattatagcctcacctaccatagggagggcgaaacattgatgcacgaatgccccgattacattactgggggtcctaattcctgccactttggtaaacagtacacgagcatgtggcggacttacattatgatggtttag

SEQ ID NO: 236159 - DNA, 189 bp, Artificial Sequence
  Description of Artificial Sequence: Synthetic coding sequence
atgaaagagaatgtggctagcgcaaccgttttcacactgctgctgtttctgaacacatgcctactcaatggccaactcccgccaggaaaaccggaaatctttaaatgcaggtctccaaataaagaaacattcacgtgttggtggcggcctggcacagacgggggtctgcccacgaactatagcctctag

SEQ ID NO: 236160 - DNA, 336 bp, Artificial Sequence
  Description of Artificial Sequence: Synthetic coding sequence
atgaaggaaaatgttgcttccgctacggtcttcactctcttgcttttcctcaacacctgcctgctgaacgggcagttaccaccaggcaaacccgagatcttcaagtgccggtcccctaacaaagagacattcacttgctggtggagacccggaacagatggcggactgcctactaattactccttgacttaccacagagagggcgagacactcatgcacgagtgccctgactacatcactggcggacccaactcatgtcactttggtaagcaatacaccagtatgtggaggacttacataatgatggtgaacgccaccaatcagatgggctcatag

SEQ ID NO: 236161 - DNA, 1566 bp, Artificial Sequence
  Description of Artificial Sequence: Synthetic coding sequence
atgaaggaaaacgtggcatccgcgacagtgttcacactgttactgttcctgaacacttgcctattaaacgtgcagccagatcctcccctggagctggcagtcgaggtaaagcagccagaagatagaaaaccgtacctgtggattaaatggtcccctcccaccctgatcgacctcaaaactggctggttcacccttttatacgaaattcgtcttaagccggaaaaggcggcagagtgggaaatccattttgccggacaacagaccgagttcaaaattctgagtctccatccaggacaaaaatatctcgttcaagttaggtgcaaacctgatcatgggtactggagtgcctggtcgcctgcgactttcattcagattcccagcgactttactatgaacgacaccactgtgtggatctctgtcgcagtactctctgcggtaatctgtctgattatcgtgtgggccgtagccctcaaggggtactcgatggtgacatgcatcttccccccagtgcccggacctaagattaagggcttcgacgcccaccttttggagaagggaaagagcgaagagcttctttccgcactgggttgccaggacttccctcctacaagcgactacgaagatctgctggtcgagtacctcgaagtggatgactctgaggaccagcatcttatgtcagttcactcaaaggagcacccttcccaggggatgaaaccgacttatctggaccccgatacagacagcgggagggggtcttgcgactcaccatcccttttatcggaaaagtgcgaggaaccacaggcaaacccctccactttttatgaccccgaggtgatagagaagccagaaaacccagagacaacacatacctgggaccctcagtgtatttcaatggagggcaagatcccctattttcatgccggtggatccaagtgctcaacgtggcctcttcctcaaccatctcaacacaacccccgtagcagctaccacaacataaccgacgtgtgcgaactagcggtcggtcctgccggagcaccagcgaccttgctgaacgaggcgggtaaagatgcgctgaaaagttcccagaccatcaagtctagagaggaaggcaaggccactcagcagagagaagttgagtcatttcacagcgagacagaccaggacacgccatggcttttgccacaggagaaaactcccttcggctctgctaagcctttagattatgttgaaatccacaaggttaacaaggacggcgcattgtctctattgcctaagcaaagggagaactcggggaaaccaaagaagccagggaccccagagaacaacaaggagtacgccaaggtgagcggcgtcatggataacaacatcctggtactcgtgcctgatccacatgccaaaaacgtggcctgctttgaagagtctgccaaagaagcaccacccagcttggagcagaatcaagccgagaaggctcttgccaactttaccgctacgtcatcaaaatgccgtttacaactgggcggactagattacctcgatccggcatgttttacacactcctttcattag

SEQ ID NO: 236162 - DNA, 867 bp, Artificial Sequence
  Description of Artificial Sequence: Synthetic coding sequence
atgaaagaaaatgttgcgtcagccactgtgttcacactactccttttcttgaatacatgtttattgaacggtcagctgccacctggtaaacctgaaatttttaaatgccggtcccctaataaagagactttcacgtgttggtggcgacccggtaccgacggaggcctgcctacgaactattctttaacataccacagagagggtgagacacttatgcacgagtgtccagattacatcactggtgggcctaactcatgtcactttgggaaacagtacaccagcatgtggaggacctacatcatgatggtgaatgccacgaaccaaatgggttcgtctttttccgatgaactgtacgtggacgttacatacatagtgcaacctgacccaccgctggagctcgctgttgaggtcaaacagcccgaggacaggaagccatatctatggatcaagtggagtccaccaacactgattgacttgaagactggatggtttactttgctgtatgagatccggttgaaaccagagaaggcagctgagtgggaaatccacttcgccggacagcaaactgaattcaagattctgtcactgcacccgggacagaagtatctggtgcaggtcagatgcaaaccagaccacggctattggagcgcgtggtcacctgcaacatttattcaaatcccctctgatttcaccatgaatgacactacagtatggattagtgtggctgtgctgtccgcagtgatctgtctgatcatcgtgtgggcggtggcactgaaaggatacagtatggtgacttgcatttttcctccagtccctgggcctaagataaaaggcttcgacgcacacctgctagaagtcactccatag

SEQ ID NO: 236163 - DNA, 363 bp, Artificial Sequence
  Description of Artificial Sequence: Synthetic coding sequence
atgaaggaaaacgtagctagcgccactgtcttcactctcctgctgtttctgaacacatgtctgctgaacggccagctcccgcctgggaagccggagatttttaaatgccgctcccccaataaggaaaccttcacgtgctggtggagacccggtaccgacggaggcctcccgacaaactattctttaacatatcatagggagggcgagacactgatgcatgagtgtccggactacattacaggtggccctaactcctgtcactttggtaagcagtacacctctatgtggcgtacctacataatgatggtgaatgcgaccaatcagatgggttcatccttttcagacgaactgtacgtcgattag

SEQ ID NO: 236164 - DNA, 105 bp, Artificial Sequence
  Description of Artificial Sequence: Synthetic coding sequence
atgaaggagaatgtcgcctccgcgaccgtgtttaccttgttactcttcctgaatacctgcctgctcaacggccagctgcctcctggtaagcccgaaatcttttag

SEQ ID NO: 236165 - DNA, 930 bp, Artificial Sequence
  Description of Artificial Sequence: Synthetic coding sequence
atgaaagagaacgtggcctctgccacagtgttcaccctgctgctcttcctcaatacctgtctgctgaacggccagctgcccccaggcaagcccgagatctttaaatgccggagccccaacaaagagaccttcacctgttggtggcgtcccggaacagacgggggtctcccaaccaactattctcttacgtatcacagggagggcgaaactctgatgcatgagtgtcccgactacattacaggaggaccgaactcttgccactttggcaagcagtatacctccatgtggagaacctatattatgatggttaacgcaacaaaccaaatggggtccagcttctcagacgagctgtatgtggatgtgacttatatcgtccagccggacccacctctggaactggcagttgaagttaaacagccggaagatcgtaaaccctacctgtggatcaagtggtcacccccaactttgatagatctgaaaaccggctggttcactctcttatatgaaatcagactgaagccagagaaggccgctgagtgggagatacacttcgccggacagcagaccgagtttaagattctttcactgcatccaggtcaaaaatacctggttcaagtgaggtgcaagccagatcacggatattggtctgcatggagccctgcaacgttcatccagatcccttccgattttaccatgaacgatacgacagtctggatctccgtggctgtgctaagtgccgttatctgtttaattatcgtgtgggccgtggcgttgaaaggatactcgatggtgacttgtatttttccacctgtcccagggccaaagattaagggtttcgatgcccacttgttggaagataggttgtgtactcctggacgatgctgtgtaagcactggtctgacagacctggactacagttgctctacttag

SEQ ID NO: 236166 - DNA, 1254 bp, Artificial Sequence
  Description of Artificial Sequence: Synthetic coding sequence
atggggaggcgtcgtgcaccagagttatatagggctccttttcccctttatgcacttcaggtggaccctagcacaggcctcttgatcgctgcaggagggggaggagccgctaagaccgggattaagaacggtgtgcacttcctccagctcgaattaatcaacggacgtctgtcggcttcactcctccacagccatgacacagagacacgtgcaactatgaacctggccttagctggggatattttagccgcaggccaggacgcccattgtcaactgctgcggttccaagcacaccagcagcaggggaataaagccgagaaagccggatcaaaggagcaagggccacgacagcgcaaaggagcagcccctgccgagaagaaatgcggggcagaaacacaacatgaggggctggagctgagggttgaaaatctacaagccgtacaaaccgacttttcaagcgaccccctacagaaagttgtgtgctttaatcacgacaacactttacttgccactggcggtactgatggatatgtacgggtctggaaagtgccctctctagaaaaggtactcgagttcaaagcacacgaaggcgagatcgaagatctcgctctagggccagatggcaaactggtaacagtgggtcgcgacttgaaggcgagtgtgtggcagaaggaccagctggtgacccagcttcattggcaggagaacgggcctacgttctcgtctactccctatcgttatcaggcctgtcgattcgggcaggtgcccgatcagccggctggtttgagactatttacggtccagattccacacaagcgcctgagacagcccccaccatgttacctcaccgcatgggatggtagcaacttcctccccctgagaactaagtcatgcggccatgaggtggtcagttgtctcgacgtgtccgagagcggcactttcctgggcctgggtaccgtgaccggctccgtcgccatctacattgccttctccctgcagtgtctgtactatgtgagggaggctcacggcattgtggtaacagatgtcgcctttctgcctgagaaaggtcgagggccagagctgctcggttctcacgagaccgctctctttagtgtggctgtggacagccggtgccagcttcatctcctgccttcccgcaggtccgttccggtatggcttcttttgttactgtgcgtaggcctgatcatcgtgacaattctgttgttacagtccgcttttccagggttcttgtag

SEQ ID NO: 236167 - DNA, 1254 bp, Artificial Sequence
  Description of Artificial Sequence: Synthetic coding sequence
atgggacggagaagggcccctgaactgtatagagcacccttccccctgtatgcgctccaagtcgacccctcaaccggactgctgattgcagccggtggcggtggcgcagctaagacgggcattaagaacggggtacatttcttgcagttagagctgattaatggacggctgagtgccagcctgttacattctcacgatactgagacaagagcaaccatgaatcttgctcttgctggagatatcttggccgcagggcaggacgcccactgccaattgctccggtttcaggctcaccaacagcaaggcaataaggcagagaaggccggtagcaaggagcaaggacctcgccaaaggaagggtgccgctccagccgagaaaaaatgcggggctgaaacccagcatgagggccttgaactgagagtggagaacttgcaggcagtgcagaccgatttctcatcagaccctctccagaaagtggtctgttttaatcacgacaacacgctgctcgctacaggagggaccgacggatacgtgagggtgtggaaggtgccatccctggaaaaagtcctcgaatttaaagcccatgagggcgagatagaagatttggcactcggaccagatggcaagctggtgactgtgggcagggacttgaaggcatccgtctggcagaaagaccagctagtcacccaactgcattggcaggaaaatggccctactttcagttcaaccccctaccgctaccaggcctgtagattcggacaagtgcctgatcaaccagcagggctccgactgttcacagttcagattcctcacaaaagacttagacagccccctccatgctacctgaccgcctgggatggatctaatttcctacctctcagaacgaaatcgtgcgggcatgaggtggtatcctgtctcgatgtcagtgagagcggtacattcctggggctcggcactgttacagggtcggtcgctatctatattgcattctcccttcagtgcctctattatgtcagggaagctcatggaatcgtggtgacggatgtggccttcctcccagaaaagggccgtggccctgagctgctggggtcacacgaaacggctctcttcagtgttgccgtggactcgcggtgccagcttcatctgctgccctcgagacggagtgtccctgtgtggctgcttctgctattgtgcgtagggctgatcattgttaccattctccttttgcagtctgcattccctgggtttctttag

SEQ ID NO: 236168 - DNA, 441 bp, Artificial Sequence
  Description of Artificial Sequence: Synthetic coding sequence
atgcgtctgctacaattacttttcagagccagtcctgcaaccctgctactggtcttatgtctgcagctgggtgccaacaaggcccaggataatacacgaaagatcatcattaagaactttgacatccctaagagtgttcgccctaatgacgaagtgacggcggtgttggctgtacaaacagagttgaaggaatgtatggtggtgaagacctatctgatctctagtataccacttcagggcgcattcaattacaagtacacagcctgcctgtgtgacgacaatcctaagactttttactgggatttttatactaatcgaactgtccagattgccgctgtggtggacgtcattcgggaactggggatctgccccgacgacgcagctgtaattcctattaagaacaatcgtttttacaccatcgaaatcctcaaagttgagtag

SEQ ID NO: 236169 - DNA, 1185 bp, Artificial Sequence
  Description of Artificial Sequence: Synthetic coding sequence
atgtctggcgaagatgaacagcaggaacagaccattgccgaagacctcgtggtcaccaaatataaaatgggcggtgatatcgccaaccgggttctaagaagtctagttgaggcctctagttccggcgtctcagttctgagtctttgcgaaaaaggcgatgcgatgataatggaagagacgggaaaaattttcaagaaagaaaaagaaatgaagaagggcatcgctttcccaacctcaatttctgtgaataactgcgtgtgtcatttttctcctctgaaaagtgatcaggattacatactcaaagagggcgacttggtgaagatcgatctgggagtacatgtcgacggattcattgcgaacgtggcccatactttcgtcgttgacgtcgcacagggaacccaggtgacagggagaaaggccgatgtcataaaggctgcccatctgtgcgccgaggccgcacttcggctggtgaagcccggtaaccagaacacccaggtgacggaagcttggaacaaagtcgctcacagtttcaactgcactccaatcgaggggatgctgtcccaccagcttaaacagcatgtgatcgacggggaaaaaaccattattcaaaaccctaccgaccagcagaagaaggatcacgagaaagctgagttcgaggtacacgaggtctatgccgttgacgtcctggtgtcttcaggtgaaggcaaggcaaaggacgcaggccagcggaccaccatctataaaagagacccatctaaacaatatggacttaaaatgaaaaccagtagagccttcttctcagaggtcgagcgcaggttcgacgctatgccatttacgctgcgcgcttttgaggatgaaaagaaagctcgcatgggggttgttgagtgtgctaagcacgagctcctgcagcccttcaacgtgctctatgaaaaggaaggtgagttcgtggcccagtttaaatttaccgtcctgctgatgccaaacggccctatgcgcattaccagtggccctttcgagccagacctttataagtccgagatggaggttcaggatgcggagctgaaggcactccttcagtcttccgcctcaaggaagacgcaaaaaaagaagaagaagaaggcatccaaaaccgcagaaaacgccaccagtggggagactctcgaagagaacgaagccggtgattag

SEQ ID NO: 236170 - DNA, 1218 bp, Artificial Sequence
  Description of Artificial Sequence: Synthetic coding sequence
gcatgtcctgcgcctcagcccgctcgctcccagctgctagccctggcgtgtctgccagcgccattgctagcccgagccttcgcccgacctctgctggaagaccggggagactcagaccacagtccagaggatctagtggtcacaaaatacaaaatgggcggtgatattgccaatcgagttctccggagtcttgtagaagcttctagcagcggagtcagtgtcttatcgctatgtgagaaaggggacgcaatgatcatggaagaaacagggaaaatattcaagaaggagaaggagatgaagaaaggaatcgcattccctacatccatatctgttaacaactgtgtgtgtcatttcagtcccctgaaaagtgaccaggattacatcctgaaggagggggacctcgttaagatcgatctgggcgttcatgtagacggattcatcgccaatgtcgcccatacattcgtcgtggacgttgcacaaggaactcaagtgacgggcaggaaggcagatgttataaaggccgctcacctgtgcgccgaggccgcactccggctagtaaaaccgggaaatcagaacacccaggtaacggaagcctggaataaagttgcgcactccttcaactgcaccccaatcgagggaatgctttcccaccagcttaagcagcacgtgatcgacggcgaaaagaccattatccagaaccccactgatcaacagaagaaggaccatgaaaaagccgagttcgaagtccatgaagtctacgctgttgatgttttggtgtcctctggggaggggaaagccaaggatgcgggtcaaagaactaccatctataaaagagatccctctaagcagtacggtctgaaaatgaaaacaagtagggccttcttttccgaagttgaacgacggttcgacgctatgcctttcacgttacgcgctttcgaggacgagaaaaaggccagaatgggagtagtggagtgcgctaagcacgagctcctgcagcccttcaacgttctttatgagaaggagggcgagttcgttgcccagtttaaattcacagtccttttgatgcccaacgggccaatgagaatcacaagtgggccttttgaacccgacctgtataagtcggaaatggaggtccaagatgccgaactgaaagccctgctgcagagcagtgcctcgcggaagacacaaaaaaagaagaagaagaaaaagaaaaagtag

SEQ ID NO: 236171 - DNA, 738 bp, Artificial Sequence
  Description of Artificial Sequence: Synthetic coding sequence
atgacgcgcatgctgcaacgtatggatgtcctggctaagaaggcaaccgagatgggcgtgcgactgatggtagatgcggaacaaacttattttcagcctgccatatctcggcttactcttgagatgcaaaggaagtttaatgtggagaagccactgatttttaatacctaccagtgctacctgaaagatgcctatgacaatgtgactctggacgttgagctggcccgacgggagggctggtgtttcggggcaaagctggtcagaggggcttacctagcccaggagcgcgctagagcagccgagatcggttacgaggatcccattaaccctacttatgaggctacgaatgccatgtaccacagatgcctagattacgttcttgaagagttgaaacataacgcaaaggcaaaagtaatggtagcctcccataacgaagacaccgtgaggttcgccctgcggcgaatggaggaactcggcttgcatcccgcagatcatagggtgtattttgggcaattgctgggcatgtgcgatcaaatttcttttcctctgggtcaggcagggtacccagtctacaagtacgtaccctatggaccagttatggaggtgctcccttacctaagtcgcagggcattggagaatagcagtctcatgaaagggactcatagggaaaggcagctactgtggctcgagctcctgcggagacttaggacaggaaatttgttccatagacctgcgtag

SEQ ID NO: 236172 - DNA, 1803 bp, Artificial Sequence
  Description of Artificial Sequence: Synthetic coding sequence
atggcactgcggagggctctcccagccttaaggccctgcattccgagatttgtgcccctctctacagctcccgcatcgcgtgagcagccagctgcaggacccgctgcagtccccggtgggggatcggcgaccgcagtgcgaccgcctgtccccgcagtggattttggcaacgctcaggaggcttaccgcagcagaaggacatgggagctcgctagatcccttttggtgttgagattatgcgcttggccagccctcttggcaagacatgagcaactactgtatgtgtctcgaaaactacttggccagcggcttttcaataaactcatgaaaatgaccttctatggtcacttcgtcgcaggtgaggaccaagaatcaattcagccactgctgagacactatcgggcattcggagtgagtgcaatcctggattatggtgtggaagaggatttgtccccagaagaagcggaacataaggagatggaaagctgtacttcagctgcagagagagacgggtcggggaccaataagagagacaaacagtaccaggctcactgggcctttggggatcgtcggaatggcgtcatcagcgccagaacgtatttctacgctaacgaggccaagtgcgatagccatatggagacatttcttcggtgtatcgaggcctctggtagagtaagtgatgacggttttatcgcaataaagctgactgcacttggcagaccccagttcctgctgcagttctccgaggttctggctaaatggcggtgcttcttccaccaaatggctgtggaacagggccaggcagggcttgccgcaatggatactaaattggaggtagccgttctgcaggagtcagtagcgaaactcggcattgcttcccgcgcagagattgaagattggtttacagctgaaacactgggcgtgtcaggaactatggacctgctggattggagctcactcattgactcccggaccaaactgagcaagcaccttgttgttccgaacgcacagaccgggcagctggaacctctgctctcgaggttcacagaagaggaagagctgcaaatgacgcgtatgctgcagcgtatggacgttctggcaaagaaagcaacggaaatgggcgtcagactgatggtagatgctgagcaaacctactttcagcctgccatctcgaggctgacactggagatgcaaagaaaattcaatgtggaaaaaccattgatcttcaatacataccagtgctatttgaaagacgcttatgataacgtgacacttgatgttgaactcgctcggagagagggctggtgtttcggtgcaaaactggttcgaggagcctacctggcgcaggagagagctagggcagccgagatcggctacgaagaccccatcaatcctacctacgaggccacgaatgctatgtaccaccggtgcctcgactacgtgctggaagagctgaaacacaatgccaaagccaaagttatggtggcatcacataacgaggacacagtgaggtttgctctacgcaggatggaggagctaggactgcacccagccgatcaccgggtttactttgggcagcttctgggaatgtgtgatcagatctcctttcctctgggccaggccggataccccgtctataagtacgtgccatatggtccagtgatggaggtcttgccttacctttccagacgcgcattagagaatagctcattaatgaagggaacacaccgcgaacggcagctgctgtggctggagcttttgaggagactgcgcactgggaacctgtttcaccggccagcatag

SEQ ID NO: 236173 - DNA, 1479 bp, Artificial Sequence
  Description of Artificial Sequence: Synthetic coding sequence
atgaagatgaccttctatgggcattttgtggctggggaagaccaggagtccattcaacctcttttaaggcattaccgcgctttcggcgtgagcgccatactggactacggtgtggaagaggacttgtctcccgaggaagcggagcacaaggaaatggagtcctgtacatccgcagccgagcgggacggctcaggcacgaacaaaagggacaaacagtaccaagcgcattgggcatttggggatcgccgaaatggtgtgatctcagctagaacatacttttatgctaacgaggctaagtgcgacagtcacatggagaccttcctgagatgcatagaggcatccggcagagtgagcgacgacgggtttatcgctatcaagctaaccgctctggggaggccccaatttttgctccagttttcagaagtactggctaaatggaggtgtttcttccaccaaatggccgtggaacagggacaggctggactggctgccatggacaccaaactggaggtggccgtactgcaggagagtgtggccaagctcgggatcgcaagcagggccgaaatcgaggattggttcaccgccgagacattgggcgtcagtggaacaatggacctcctggactggagcagcctgatcgactctcgtactaagttgtctaagcatctggtggtgcctaatgctcaaactggccaactagagcctttactgtcaaggtttaccgaggaggaagaacttcagatgacccggatgttgcaacgtatggacgtcctggcgaaaaaagcaacagagatgggagtgcgtcttatggtagatgcagagcaaacctactttcaacctgccatctcccgcctcactcttgagatgcaacgtaaattcaacgtggagaagcctctgatcttcaacacctatcagtgctacctcaaggatgcctatgacaacgtaacacttgacgtcgaactcgcgagaagggagggatggtgtttcggcgctaagctggtgcggggagcctatttggcgcaggaacgggctcgggcagcagaaattgggtacgaggaccccattaaccctacttacgaagcaacgaacgctatgtatcacagatgtttggattacgtcctggaagaactaaagcataacgcgaaagcaaaagtaatggtggcttcccacaatgaggacactgtccgcttcgctctaaggagaatggaggagctgggacttcacccggcagaccatagggtctacttcgggcagctgttagggatgtgtgaccagatatcctttcctttaggccaggccggatatcctgtatataaatatgtaccttatggcccagtgatggaggtcctgccctatctaagccggagggctctggaaaattcatccctgatgaagggaacacaccgagaaagacagctgctgtggcttgaacttcttagaagactgcgcaccggcaacctctttcacaggcccgcatag

SEQ ID NO: 236174 - DNA, 1611 bp, Artificial Sequence
  Description of Artificial Sequence: Synthetic coding sequence
atgtcacctagagtagtctcgaacagttctgttctggcatcccagagcgtcggaattaccaatgtgcggacagtgttcagcaacgtgtttaacaatactacagccttccccattttgagaggtagcaattgtcacaaaattacagccccagggctgggaaaaggtcaactggtgaatctgctgcctccagagaatctgccttggtgcgggggaagccaagggccaagaatgctgcggacttgctacgtactgtgtagccaggccggaccgcctagtagaggatggcaaagcttgtcctttgacgggggtgctttccacctgaaaggtactggggaactcactagagctctgcttgtgctcaggctttgcgcctggcctccattggtgacccatggcttgctcctgcaggcttggtcccggcgactacttggatctcgcctttcaggggctttcctccgcgcatctgtttatggtcagttcgtggccggagagacagcagaggaggtgaaggggtgtgtgcagcagttgcgcaccctgagtctgagaccactgctggctgtcccaacagaggaggagcctgatagtgctgccaagtctggagaggcgtggtacgagggcaatttaggcgctatgctcaggtgcgtcgacctgagtcgaggcctactagaacccccatccttggccgaggccagcttgatgcaacttaaggtcaccgcccttacctctacaagactgtgcaaggagttagcgagctgggtccgcaggcccggtgccagtctggaactatcacctgagcggcttgccgaagctatggactcaggccagaatttgcaggtaagttgcctgaatgcagagcagaaccaacatcttcgcgcatcactctcacggcttcatagagtcgcacagtacgccagagcccagcacgtcaggctcctggtcgacgcggaatatacatctctgaaccctgcattgtccctgctcgtggcagctctcgccgtcaggtggaattctcccggagagggtggtccctgggtgtggaacacttatcaggcttgtctcaaggacactttcgaaaggctgggacgggacgccgaagcagctcacagagctggactagcattcggagttaagttggtgagaggggcttacctagataaggaacgcgcagtagctcagctgcacggtatggaggaccccacgcagccagattacgaggctacttctcagagttatagccgctgcctcgagttaatgctcacccacgtggcacggcacggcccaatgtgccatctcatggtggcatcacacaatgaagaaagtgtgcgtcaggcaaccaagcggatgtgggaactgggtatcccgcttgacgggaccgtttgttttgggcagttacttggaatgtgtgatcatgtctccctcgccttggggcaagccggttacgtggtgtacaaatctatcccatatggctccttggaggaggtgattccttacttgattcgacgtgctcaggagaatcgatctgtactccagggagctaggcgcgaacaggagcttctctcacaggagctttggaggcgtttattgcccggttgccggagaatcccgcactag

SEQ ID NO: 236175 - DNA, 762 bp, Artificial Sequence
  Description of Artificial Sequence: Synthetic coding sequence
atgcctgggaggacagagggtgggagctggttgcgtaatgccgcagctgccgacgtcctcaggaatcttcccgaagttgaatggagggagccccagcactgttgcccacctaccccgcgtaagcggaaacagaacccacgcgtgcctctgccccattacccccctaacccagcggcagcaatcgccgcagataccatgcctaagaggaaaaaacagaaccaccatcaacccccaactcaacaacaacccccactgcctgagcgggaagaaactggagacgaggaagatgggtcccccattggaccgccttcgctgctggggcctccacccatggccaacggtaagcccggagatcccaagagcgctctacatcggggtccaccgggatcccgcggacctcttataccgcctctgctcagccttccaccaccgccatggggcagagggccaattcggcgaggcttagggccaaggtcctcaccctatggtcggggttggtggggggtaaacgctgagccaccctttcccggacctggtcatggcggaccaacccgaggatcatttcataaggaacagcgaaatccaagaagactgaagagctggtccctaatcaaaaatacgtgtccgccaaaggacgacccacaggtgatggaagacaagtccgatagaccggtgtgtaggcatttcgctaagaaaggccactgtagatacgaggacctgtgcgcattttaccacccaggggtaaatggcccacccttatag

SEQ ID NO: 236176 - DNA, 504 bp, Artificial Sequence
  Description of Artificial Sequence: Synthetic coding sequence
atgcccaagagaaaaaaacaaaatcatcaccagccccctactcaacagcaaccacccttaccagagcgcgaggagaccggagacgaggaggatggatcccccatcgcccttcatcgcggacccccaggcagtaggggccctctgattcctcctttgctttccttgccgcctcctccatggggcagagggccaatcagacgcggattgggtcccaggtcatccccctacggcagagggtggtggggtgtgaatgccgagccccctttcccgggaccgggacacggaggccctactcggggaagctttcacaaggagcagcggaatcctcgccgtcttaagtcttggagtctgatcaaaaatacatgtccgccaaaagacgatccccaggtgatggaggacaagagtgaccgccctgtatgcagacacttcgccaagaagggccactgccgttacgaggacctttgcgccttctatcatcccggtgtaaatgggcctccgctctag

SEQ ID NO: 236177 - DNA, 567 bp, Artificial Sequence
  Description of Artificial Sequence: Synthetic coding sequence
atgcccaaaaggaagaaacaaaatcatcatcagccacccacccagcagcagccccctctgcccgagagggaggagaccggcgatgaagaagacgggagtccaatcggccctccttctctgctcggcccacccccaatggctaacggcaagccaggtgaccccaagagcgccctgcataggggccctccaggttcacgtggaccactgatcccgcctctgctgtccctgcctcccccaccatgggggcgagggcctattcggaggggcctggggcctcgcagctctccttatggcaggggttggtggggcgtgaatgcagagcccccttttcccggaccagggcatggcggacccactcgtgggtcttttcacaaggaacagaggaatccacggaggctgaagtcctggtcattgatcaagaacacctgtcctcccaaagatgacccacaggtcatggaggacaagtctgatcggcctgtctgccgccacttcgcaaaaaaaggtcactgcaggtatgaggatctttgtgcattctaccaccctggcgtgaacggccctcccctatag

SEQ ID NO: 236178 - DNA, 567 bp, Artificial Sequence
  Description of Artificial Sequence: Synthetic coding sequence
atgcctaaaaggaaaaaacaaaatcaccaccagcctcctacacaacagcagcctcccttgccagagagagaggaaactggggacgaagaagacggcagtccaatcggacctccatctttactgggcccaccacccatggccaatggaaagccaggcgacccaaaatctgcgttacatagaggtcctcccggatcacggggacctctcattcctcctctgctgagtctgcctccaccaccatggggtcggggaccaatcaggagagggctgggacctcgatctagcccctatggacgtggatggtggggcgtgaatgcagaacctccctttcccggtccgggtcacggcggtccgactagaggttcattccataaggagcagagaaacccccgaaggctaaaatcatggtccctcataaagaatacgtgtccacccaaggatgatcctcaggtcatggaagacaaatcggaccgcccagtgtgtaggcactttgcaaagaagggtcactgcaggtacgaggacctctgtgccttttaccatccaggcgtgaacggaccgcctttgtag

SEQ ID NO: 236179 - DNA, 504 bp, Artificial Sequence
  Description of Artificial Sequence: Synthetic coding sequence
atgcctaaacggaaaaagcagaatcaccatcagccgccaacacaacagcagcccccactgcctgaaagggaggaaaccggggacgaggaagacggctctcctatcgcactgcaccggggaccaccaggatcgagggggccattaatccccccacttctatcccttccccctcctccatgggggagggggccaatccggagaggcttaggtcctaggagtagcccatacggtagaggttggtggggagtcaatgccgagcctcctttccctggcccaggacatggagggcctacacgcggatcctttcacaaggaacagcgtaacccccgtcgattgaaaagttggtccctgatcaagaatacttgccctccaaaagacgatcctcaagtgatggaagacaaatctgacagaccagtctgtcgacacttcgcaaagaaaggccactgtaggtatgaagatctctgtgcattctaccaccccggtgtgaacggtcctccactgtag

SEQ ID NO: 236180 - DNA, 504 bp, Artificial Sequence
  Description of Artificial Sequence: Synthetic coding sequence
atgccaaagcggaagaagcagaatcaccaccaaccaccaacacagcagcagccaccccttcccgaaagagaggaaaccggcgatgaggaagacgggtcccctatcgcactgcacagaggacctcccggtagccggggacccctgattccgccacttcttagtttgccccctcccccttggggtagaggcccaatacgccgaggtctgggccctcggtcttctccatacggaagaggctggtggggtgtgaatgcagagcccccattcccgggtcctggtcacgggggacccacgcggggttcattccacaaggaacagcgcaacccacggagactaaagagctggtccctcatcaagaacacttgtccacccaaggatgaccctcaggttatggaggataaatctgacagacctgtgtgtcggcactttgcaaaaaaaggacattgtcgctacgaagacctctgtgccttctaccaccctggcgtgaatgggccaccactctag

SEQ ID NO: 236181 - DNA, 504 bp, Artificial Sequence
  Description of Artificial Sequence: Synthetic coding sequence
atgcccaaacgcaagaaacaaaaccaccaccagcctccgactcaacagcaaccccctctgcctgagcgggaagagaccggggacgaagaggacggaagccctatcgctctgcacagaggaccccctggtagccgcggaccattgattccaccactgctgtcactgcccccacccccatggggcaggggtcctatcagacgtggtctcggcccacgcagcagcccatatggtcgaggctggtggggtgtgaacgctgagcctccattcccagggcctgggcatggtggacctaccaggggcagttttcacaaagagcagaggaatccacgtcggctgaagtcgtggagtctcatcaaaaacacttgcccacccaaagacgacccccaggttatggaggataagagcgacagacctgtgtgcaggcactttgcaaagaaagggcactgcagatacgaggacttatgcgcgttctatcatcctggggtgaacggtccccctctgtag

SEQ ID NO: 236182 - DNA, 567 bp, Artificial Sequence
  Description of Artificial Sequence: Synthetic coding sequence
atgcctaagcgtaagaaacagaatcaccaccagcctcccactcagcagcagccacccctgccagagcgcgaggaaacgggcgacgaagaggatggcagcccaattggccctccctccctccttggccctccacccatggcaaatggaaagcccggagatccgaaatctgctctgcaccggggaccacccggtagccggggaccactaatccctcccctactgtccttaccgcctccaccctgggggagaggccctattcgcagagggctggggcctcgttcctccccctacggccgtggctggtggggagttaacgctgaacctccctttcccggtcctggccatggtggcccaacacgcggatccttccacaaggaacagcggaaccctcgcagacttaaatcatggtccctcataaaaaatacctgtccccctaaggatgaccctcaggtgatggaggataagtcagatagacctgtgtgccgacacttcgccaaaaaaggtcactgtaggtacgaggacctttgtgccttttatcatcccggtgtaaatgggccaccgctgtag

SEQ ID NO: 236183 - DNA, 567 bp, Artificial Sequence
  Description of Artificial Sequence: Synthetic coding sequence
atgccgaagagaaagaaacaaaatcatcatcagccccctactcagcagcaaccccctttacctgagagggaggagaccggagacgaggaagacggatcccccatcggccctccttctctactgggcccaccacctatggctaatggcaagcctggggatcccaaatcagccctccatcgcggacccccaggctcaagaggccctttaattccacctcttctgtccctgcctccacccccatggggtcgtggtcctattaggcgaggcctcggccctcgtagttccccttacggcaggggctggtggggagtgaacgcggagccccctttccccggaccaggccacggcggtcctaccaggggaagctttcacaaagagcaaaggaatccgagacgcctgaagagttggtcccttataaagaacacctgtcctcctaaagatgaccctcaggtgatggaagacaagagcgacaggcccgtatgtagacactttgccaaaaagggccactgtcggtacgaggacctctgtgcattttatcaccccggtgtgaacgggcctccactgtag

SEQ ID NO: 236184 - DNA, 504 bp, Artificial Sequence
  Description of Artificial Sequence: Synthetic coding sequence
atgcccaagcgcaaaaagcaaaatcaccatcagcctccaacgcaacagcaaccccctcttcccgaacgagaggaaactggcgacgaggaagacggctcccctatagctctacacagggggcctccaggttctcgtggccctctcatcccgcctttgcttagcctgccgccacctccatggggccgtggccctatccgtagggggcttggaccaaggtcttcaccgtatggcagggggtggtggggagtgaacgccgaaccacctttccctggccctggccatggagggcctactcggggatcctttcacaaggaacagcggaatccacgtcggttgaaaagttggtctctgattaagaatacgtgcccaccaaaagatgatccccaagtaatggaagacaagtccgatagaccggtctgccggcattttgctaaaaaggggcactgtagatatgaggatctgtgtgccttttaccacccgggagtcaacggcccaccgttatag

SEQ ID NO: 236185 - DNA, 504 bp, Artificial Sequence
  Description of Artificial Sequence: Synthetic coding sequence
atgccgaaacgcaagaagcagaaccatcatcagccaccaacacagcagcagcctccattaccggaaagggaagagacgggggacgaagaggatggatcccctatcgccttacacaggggaccgcctgggtctcggggacccttaataccccctttgctgtctctaccacccccaccttggggtagggggccaatcagacgaggccttgggccaagatccagcccttatggcaggggctggtggggcgtgaatgccgagccgccttttcctggtccgggtcatgggggacccacccggggttcctttcacaaggagcagcggaatcctagacggcttaagtcatggtctctgatcaaaaacacctgcccaccgaaggacgacccccaggtaatggaagataagagcgaccgacccgtgtgccgtcactttgccaaaaagggacattgccgatacgaggatttatgtgcgttctatcacccgggagtgaatggccctccgctttag

SEQ ID NO: 236186 - DNA, 504 bp, Artificial Sequence
  Description of Artificial Sequence: Synthetic coding sequence
atgcccaagaggaagaagcagaatcatcatcagccccctacacagcagcagccaccccttccagaacgcgaagagacaggggatgaggaggacggttccccaatcgccctgcacaggggccctccgggtagccgaggcccactgatcccacctcttcttagcttgccacctcctccatggggtcggggaccaattcggagggggctggggcctcggagtagtccctacgggcgtggatggtggggcgtgaacgcggaaccacccttcccaggccctggacatggcggacccacgagagggtcttttcataaagagcagcgaaacccaagacgtctcaaaagctggagtctcataaagaatacctgtccacccaaggacgatcctcaggtgatggaggataagtctgatcggccagtctgtcgtcattttgccaagaaaggccattgtcgctatgaggacctgtgcgctttttaccacccaggtgtcaacggccctccactgtag

SEQ ID NO: 236187 - DNA, 567 bp, Artificial Sequence
  Description of Artificial Sequence: Synthetic coding sequence
atgcctaaacgtaagaagcagaatcatcaccaacccccaactcagcaacagcccccactacccgaaagagaagagacaggagatgaagaagacggatcccccataggtcctccctctctgctcggccctccccctatggccaatgggaagcctggagatccaaagtccgccctccaccgtggaccaccaggtagccgaggccctctaatacctcctcttctgtctttgcctcctcccccttggggtcgcggacctatccgacgtggactgggtccgcgatcttccccttacgggaggggctggtggggcgtcaatgccgagcccccattcccaggaccagggcatggcggaccgactagagggtccttccacaaggagcagagaaacccacgcaggctgaaaagctggagcctcattaaaaacacctgtcctcccaaggacgacccacaggttatggaggacaagagtgatcggccagtgtgccgtcactttgctaaaaagggacattgccgctacgaagatctttgcgccttttaccatcctggggtcaatggaccgcctctgtag

SEQ ID NO: 236188 - DNA, 567 bp, Artificial Sequence
  Description of Artificial Sequence: Synthetic coding sequence
atgccaaaaaggaaaaagcagaatcatcaccaacctcctacccagcaacagccgccacttccagaaagggaagagacaggggacgaagaggacggaagtcccatagggcctccatcgttgctcggccctccgccaatggcaaatggaaagcccggagaccctaagtctgctctacaccgtgggccaccagggtctaggggcccattgattccaccactgctaagcctccccccacctccctggggacgtggccctatccgacgcggacttggccctcgaagtagcccctacggccgtggctggtggggcgtgaacgccgagcctccgttccccggacctgggcatggcggaccaacacggggatctttccataaagagcaaaggaatccccgacggctgaagagctggagcctgattaagaatacatgccctcctaaagacgacccacaagttatggaagataagtcagatcgcccagtgtgtcggcatttcgccaagaagggtcactgtcgctacgaggacctgtgtgcgttctatcatcctggagtgaacggaccaccattatag

SEQ ID NO: 236189 - DNA, 567 bp, Artificial Sequence
  Description of Artificial Sequence: Synthetic coding sequence
atgcccaagcgaaagaaacagaaccaccatcagcccccaacacagcagcagccaccactgccagaacgagaagagaccggtgacgaagaggacggttcacctattggccctccttccctcctgggaccgccacctatggccaacggcaaaccaggggatcccaagtccgccctgcataggggaccacccggatccagggggccactaatccccccattgctttctctccctcctcctccttggggcagagggcctataagaaggggcctcggcccaagatcttctccatatgggagaggatggtggggtgtgaacgccgagcccccatttcctggtccagggcacggcggacctaccagagggtccttccacaaggaacagcgtaacccaaggaggcttaagagttggagcctgatcaagaatacatgccctccgaaagatgaccctcaggtcatggaggacaagtcagatcgaccggtatgccggcacttcgccaaaaaggggcattgccggtacgaggacctatgtgccttctaccatccgggtgtgaatggccctcccctgtag

SEQ ID NO: 236190 - DNA, 762 bp, Artificial Sequence
  Description of Artificial Sequence: Synthetic coding sequence
atgccagggaggacggagggtggtagctggctccggaatgctgccgctgcagacgttctgcggaaccttccagaagtggaatggagagagccccagcactgctgcccacctacccccaggaagcgcaagcagaacccaagagtaccactgccacactatccacccaatcccgctgctgccatcgccgcagacaccatgcctaaacggaaaaagcagaatcaccaccagccccctacgcaacaacagcccccacttcctgagcgggaggagaccggggacgaagaagatggatcccctatcggtccgccatccttactaggacctcccccaatggcgaatgggaaacccggtgaccccaagtccgccctgcacagaggcccacccggatcccggggtcctctgatccctccattgctctctctccccccacccccatggggcagaggtccaattcggagggggttaggtccacgatccagcccttatggacgcggttggtggggtgtgaacgccgagcccccatttcctggaccaggccacgggggtcctacccgaggctccttccacaaagagcaaaggaacccgagaaggttaaagagctggagcctgatcaagaatacatgccctccaaaagatgatccacaggtgatggaggataaaagtgaccgcccagtctgtaggcattttgcaaagaaagggcattgtcggtacgaggatttatgcgcattctaccacccaggcgtgaatggacccccattgtag

SEQ ID NO: 236191 - DNA, 762 bp, Artificial Sequence
  Description of Artificial Sequence: Synthetic coding sequence
atgccagggaggaccgaaggcggatcctggctgaggaacgctgccgcagccgacgtcctgcgcaatctgcccgaggtggagtggcgggaaccacagcactgctgccctcccacccctaggaaaagaaagcagaatcctcgggtaccccttcctcactatccacccaatccagcagcggcaatcgctgctgacaccatgccaaagcggaagaagcagaaccaccaccaacccccaactcaacagcagccaccactgcctgagcgcgaggagacaggggatgaagaggatggctctcccattgggcctccctcccttctgggccctccccctatggccaacggcaaacctggggatccgaagtcagcgctccatcgcggaccacctgggtcacggggaccactcattccccctctcctgtcgttgccaccccctccatgggggagggggcctatccggagaggccttgggcctcgcagctccccttatggaaggggttggtggggtgtgaacgctgaacccccttttccaggaccgggacacggcggaccgacacgtggtagtttccacaaagagcaacggaacccaagacgactcaaaagctggagccttataaagaatacttgtccccctaaagatgatccacaagttatggaagacaagtctgatcggccagtgtgtcgtcacttcgctaaaaagggacactgcaggtatgaggatctctgtgcattttaccatcctggtgtgaacggaccgccactgtag

SEQ ID NO: 236192 - DNA, 762 bp, Artificial Sequence
  Description of Artificial Sequence: Synthetic coding sequence
atgccgggtcgcactgaaggagggtcttggctgcgcaatgccgctgcagcggacgtattgagaaacctgcccgaagttgaatggcgggaaccccagcactgctgcccaccgaccccgcgaaaacggaaacagaacccgcgagtaccgttgccgcattatcccccaaatccggctgccgcaatcgctgccgacaccatgccaaagcggaagaaacagaaccaccaccagccccctacccagcaacagcctcccttacccgaacgagaggagactggagacgaagaggatggtagcccgatcggacctccttctttgctcgggccacctcctatggctaacggaaagcctggggatcccaagtccgccctgcaccgaggtccacccggttctagaggccctctgatcccgccacttctttctcttccaccacctccgtggggcagaggaccaatcagacgtggcctggggcctagaagctccccatatggccgtgggtggtggggcgtgaatgctgagccgccatttcccggtcccggtcacgggggtcctacaagaggctccttccataaagagcagaggaaccctcggagactcaaaagctggagcctgataaagaacacatgccctcccaaggatgatccacaggtgatggaggataaaagcgatagacccgtctgccgccactttgcaaaaaaagggcactgtcgttatgaggacctgtgcgctttctaccatcctggggttaatggaccacctctctag

SEQ ID NO: 236193 - DNA, 762 bp, Artificial Sequence
  Description of Artificial Sequence: Synthetic coding sequence
atgccaggccgaactgaaggagggtcgtggcttcggaatgccgctgccgcagatgtcttacggaaccttcccgaggtcgagtggcgagagcctcagcactgctgcccaccaactcccaggaagcgtaaacagaatccacgggttcccctgccccattatccaccaaatcccgcagcagccattgccgctgacacgatgcccaaacgtaagaagcagaaccaccaccagcctcccacacagcagcagccacctctcccagagcgggaagaaactggcgatgaagaagacggctcaccgattggacctccctccctgcttggccctcccccaatggcaaacgggaaacctggagatccaaaatccgcactacaccggggacctcctggcagccgcggaccactgattccccctctgctatccctccctcctccaccctggggaagaggaccaatccgcagaggattgggacctaggagctcaccatacggcagagggtggtggggagtgaatgcagagccaccatttcctggacccggacacggcggacccactaggggatcattccacaaggagcagcgtaatcccagacgattgaaaagttggtccttgatcaaaaacacttgcccgcctaaggacgacccccaagtaatggaagataagtccgatcgccctgtctgtcgacactttgccaaaaagggccactgtaggtacgaggatctctgcgccttttatcacccaggtgtgaacggtccaccactatag

SEQ ID NO: 236194 - DNA, 762 bp, Artificial Sequence
  Description of Artificial Sequence: Synthetic coding sequence
atgccaggcaggactgagggaggctcctggctgaggaacgccgctgcagccgacgtgttgcgcaacctgccggaggtggaatggagagagcctcagcactgctgcccccctacaccccgaaagaggaaacagaaccccagagttccgctgccccactatcctccaaaccccgcagctgcaattgccgcagacacgatgccgaagcgcaagaaacagaaccaccaccagcccccaacccagcagcagccacccctcccagagcgcgaggagactggcgatgaagaggacggaagcccaatcggcccaccctccctgctgggtcctccacctatggctaatggcaagcctggtgacccaaagtccgctttgcatcgcggtccccctggaagcagaggtcccctgatcccaccactgctgagtctgccaccgccaccatgggggagaggaccgatacgcagaggcctggggcctcggtcatctccgtacgggcgtggatggtggggggtcaacgctgagccaccatttcctggcccagggcatgggggtccgacaagaggctccttccacaaggagcagaggaaccctaggcgacttaagagctggagcctgattaagaatacatgtccacccaaggacgatcctcaagtgatggaggacaaatccgaccgccctgtttgtaggcacttcgccaagaagggacattgccgctacgaggacctctgtgccttctaccaccccggtgtgaacggtccacctctgtag

SEQ ID NO: 236195 - DNA, 762 bp, Artificial Sequence
  Description of Artificial Sequence: Synthetic coding sequence
atgcctggaagaacggaaggagggagctggctacgtaacgccgctgcagccgatgtgctcaggaatctgccagaggtggaatggagggagcctcaacactgttgcccacccacccccaggaagaggaaacagaaccctagggttccactcccgcactaccctccaaatcctgcagcggctattgcagcagacaccatgccaaaaagaaaaaaacagaaccaccatcagccacccacccagcagcagcctccacttccggagagggaagagacaggtgacgaagaggacgggtcgcccatagggccaccttctctcctcggccctccccctatggccaacggtaaacccggtgaccctaagtctgctttacatcggggaccaccaggatcaagaggaccactcattccacccctgttaagtctcccacctccgccatggggaagagggccaatacgccgtgggctgggccctcggagctcaccatacggtaggggctggtggggggttaatgccgagccaccttttcctggtccaggccatgggggaccgactaggggctcattccataaggagcagaggaaccccagaaggctcaaatcatggagcctgatcaaaaatacttgccctccgaaggatgacccgcaggttatggaagataaaagcgatcggccagtctgccggcatttcgcaaagaaaggccactgtaggtatgaagatctctgtgctttctaccatcctggtgtgaacggccctccactgtag

SEQ ID NO: 236196 - DNA, 1344 bp, Artificial Sequence
  Description of Artificial Sequence: Synthetic coding sequence
atgagatctgtctcttacgtgcagagggtggcgctagaatttagcgggagcctctttcctcacgccatctgcctgggcgatgtcgacaacgacacactaaatgaactggtggtcggagatactagtggtaaggtgagtgtatataagaatgacgattcacgtccctggctgacctgctcatgccagggcatgctgacttgcgttggagtcggagacgtgtgtaacaagggcaagaacctgttggtggcagtcagcgcagaaggctggtttcatctatttgatctgactcctgccaaagttctggacgcttcagggcatcacgagacactaatcggcgaagagcagcgtcctgtatttaagcaacacatcccagcaaatacgaaagtgatgctcatttcggatatagacggggacgggtgtcgcgagttggtggtcggctacaccgacagggtggtgcgagcatttcggtgggaggagttgggtgagggcccagaacacctgaccgggcagcttgtttctctgaaaaaatggatgctcgagggccaggtggacagcctgtctgttacccttggacccctcgggcttcccgaactgatggtgagtcagccagggtgcgcttacgctatcctgctgtgcacgtggaaaaaagacactggttcgccaccagcatccgagggaccaactgatggttccagagaaacaccagcggcacgagacgtagtgcttcatcagacaagcggtcgcatccacaacaaaaatgtgtcgacacacctcatcgggaatattaaacaggggcacggaacagaatcctcagggtccggtctgttcgcactgtgcacccttgatggtacccttaagcttatggaggagatggaagaggcagacaaactgctttggtccgtacaggtggaccaccagctgttcgcattagagaaacttgacgttacagggaacggacacgaggaagtcgtggcctgtgcatgggacggccagacatatatcattgatcacaacagaactgtcgtgcgctttcaggtggacgagaatatccgagccttctgtgctggcctatacgcgtgcaaggaaggtcgtaacagcccatgcctagtgtacgttacgttcaatcagaagatatacgtatactgggaagtgcagctggagagaatggagtctacgaatttagtgaagttacttgagaccaagccagagtaccacagtctgttgcaggagctaggggtagatcctgatgacctccctgttactagagctctccttcatcagaccctctaccatcccgaccagccaccacagtgcgcgccttcaagcctccaggatccaacctag

SEQ ID NO: 236197 - DNA, 381 bp, Artificial Sequence
  Description of Artificial Sequence: Synthetic coding sequence
atgcttcttgtgctactctccgtggttttattagccctgtcaagcgcacagtcgacggacaatgatgtcaattatgaggactttactttcaccatccccgacgtggaggattcctacctggatcccctggtcattgtcgtcaccaagatgatggtgctgagccgggatcaccagaatcaggaggctataactgcaatcttgcctcatctcctgtttaaaatctctaatgaccaccctgatgaagacacggttaatagcttatatccagattttctgctttccgcctgtcgaaaacaccaccattcttcccggggaaccgaccagcaggacataccaaggagtaaccactctggcaacctggagtttagtggaagaaaatag

SEQ ID NO: 236198 - DNA, 198 bp, Artificial Sequence
  Description of Artificial Sequence: Synthetic coding sequence
atgctgctagtgctgctctcagtggtgctgcttgctctttccagtgcccaatcaacagacaacgacgtcaattatgaggatttcaccttcaccatcccagcttgcagaaagcaccaccactcaagccggggtactgatcagcaggatattcccagaagcaaccacagcgggaatctcgaattctcaggacgcaagtag

SEQ ID NO: 236199 - DNA, 696 bp, Artificial Sequence
  Description of Artificial Sequence: Synthetic coding sequence
atggccgtgtttctggaggccaaagatgcacacagcgttctcaagcggtttcctcgcgctaatgaattcttagaagaattgcgtcaggggaccattgagcgcgaatgcatggaagagatttgttcctacgaggaggtgaaggaggtcttcgagaacaaggagaagactatggagttctggaagggctacccgaatgccgtctacagcgtaagagacccctcccagagttcagatgcaatgtacgtcgttgtgcctctgctgggggttgctctcctgatcgtgatcgcccttttcattatctggaggtgtcaacttcagaaggccactagacaccacccaagctacgcccagaaccggtatctggcctcacgggctggccacaccctgcctcgggtgatggtttatagagggacagtacactctcagggagagccaagtggccacagagaagcagccaactcaccccaggttgtgctcggaccaagccgtggcggtcgcacaacagtaagactcgaaagtactctctatctccctgaattaagtctgagccggctgtcgtcaacaacgcctccaccaagctatgaggaggtaaccgcaccgcaggagtctagttccgaggaggcttcggttagctattctgaccctcccccaaagtatgaggagatagttgctgctaaccccggagctgataaatag

SEQ ID NO: 236200 - DNA, 309 bp, Artificial Sequence
  Description of Artificial Sequence: Synthetic coding sequence
atggcagggctgtcccgggcactatcttccgtgtttctcgaagctaaggatgcccatagcgtgttgaagcgctttcctagagccaatgagtttctcgaggagctgaggcaggggactatcgagagagagtgcatggaagagatatgcagctacgaagaggttaaagaagtattcgagaacaaggaaaaaaccgcctgtacaaccctcggtctcgtgcttggcgtgggggtggccagcggtattgccaggacagggccaggtaacgcggatcagagtgaggcacgcaaggatactcagcccaaggcatag

SEQ ID NO: 236201 - DNA, 276 bp, Artificial Sequence
  Description of Artificial Sequence: Synthetic coding sequence
gaccccagccaaagcagcgacgctatgtatgtggtggtccccctcctgggcgttgcgctgttgatagtgatcgcactgtttatcatatggcgctgccaactgcagaaagccactaggcaccatccgtcttatgctcagaatagacgatgctttgcggtgagacttgccgctccttcctttgcgagtaaatattcaaacgtgggagcctttccttttagactgtgggcagcttctttgagcctagcccgtatctatctgaccaacatccccaagtag

SEQ ID NO: 236202 - DNA, 159 bp, Artificial Sequence
  Description of Artificial Sequence: Synthetic coding sequence
atggccgtcttcctagaggcaaaggacgcccactccgtccttaaacgttttccaagagccaatgagtttttagaagaactgcgacagggcacaatcgagcgcgagtgcatggaggagatttgctcttatgaagaggtaaaagaggtcttcgagaactag

SEQ ID NO: 236203 - DNA, 696 bp, Artificial Sequence
  Description of Artificial Sequence: Synthetic coding sequence
atggccgtgtttttggaagcaaaagatgctcactccgtgttaaaaagattccccagggccaatgaattcctcgaggaactgaggcagggcaccattgaaagagaatgcatggaggaaatctgctcttatgaggaggttaaggaggtttttgagaacaaggagaagaccatggaattttggaagggctatcctaatgccgtgtactcagtgagggacccatcccagtctagcgacgccatgtatgttgtcgttccgcttctgggtgtggctttgcttatcgtaattgctctgttcataatctggaggtgccagttgcaaaaagctacaagacatcaccctagttacgcccagaatagatacttggcttccagagcagggcatacactcccgcgagttatggtgtacaggggtaccgtgcatagccagggagagccgtccggacaccgagaggctgccaactccccccaggtcgttcttgggccatcccgtggagggcgtacaacagttcgcctcgagtcaaccctgtacctcccagagcttagcctgtctagacttagtagtactaccccccctcccagctacgaggaggttactgctccacaggagagttcatccgaggaggcctccgtctcctatagcgatcctccgccaaagtatgaggaaattgtggccgcaaatccaggcgctgataagtag

SEQ ID NO: 236204 - DNA, 681 bp, Artificial Sequence
  Description of Artificial Sequence: Synthetic coding sequence
atgttcacccttctggtgttattgtcgcaacttcctactgtgacattagggtttccacactgtgcccgtggccctaaagcaagcaaacacgccggtgaagaagtgtttacctctaaagaggaagccaacttctttatacaccgtcgattgttatacaatcggtttgaccttgaactgttcacccccggaaatctcgaacgagagtgcaatgaggagctgtgtaattatgaagaagccagggaaatcttcgttgatgaggataaaacgatcgcattctggcaggagtattccgccaaggggccaacaaccaagtccgacggaaatcgggaaaagatcgacgtgatggggctactcaccggcctgattgcggcaggggtgttcctggttatattcggattgctcggatattatctgtgtattacgaaatgcaacagactgcagcacccttgttcctcagctgtgtatgaacgtggaaggcataccccatcgatcatcttccgaagacctgaggaggccgctctgagccccttaccaccctctgtggaggatgccggtttaccttcttatgaacaagcggtcgcactcacacgcaagcattcggtgtcgcctccacccccttacccaggccataccaaaggttttcgcgtgttcaagaagtctatgagcctgccctcccactag

SEQ ID NO: 236205 - DNA, 375 bp, Artificial Sequence
  Description of Artificial Sequence: Synthetic coding sequence
atgctccttagagatttagtgctgcggcgaggatgctgctggagcagccttctgttacactgcgccctgcacccactgtggggttttgtgcaggtgactcatggagaaccacagaagagttgctctaaagtgactgacagctgccggcatgtctgtcagtgccggcctcccccaccgctgccaccccctcctccacctccacctcctccccgactactctcagctccagcccctaactccacctcttgccccaccgaggagtcttggtggagcggtttggtcatcattattgccgtgtgttgtgccagcttggttttccttacggttctggtgattatatgctacaaggccataaagcggaatcatgcaatctag

SEQ ID NO: 236206 - DNA, 462 bp, Artificial Sequence
  Description of Artificial Sequence: Synthetic coding sequence
atgcttctcagagaccttgtgttgcgcaggggatgttgctggtcttccttactattacattgtgctctccatccactctggggatttgtgcaggtgactcacggtgagcctcaaaagagttgctctaaggtgacagactcctgtcgccacgtgtgtcagtgccggccaccgcctccgctaccgccacctccaccacccccacctccacctcgcctgctgtctgccccagcccctaattccactagctgtcccacagaggagtcctggtggtcaggccttgtgataatcattgccgtttgttgcgccagtctggtgtttcttactgttctggtgatcatatgttacaaggcaatcaaaaggaaaccgctcagaaaggatgaaaacggaacctctgtggcagagtatccaatgagcgccagtcaaagcaataaaggcgtggatgtgaacaatgccgtcgtatag

SEQ ID NO: 236207 - DNA, 462 bp, Artificial Sequence
  Description of Artificial Sequence: Synthetic coding sequence
atgctgctgagggatctggtactgcgacggggatgttgctggtcaagcctgttgctgcattgcgccctccaccccctgtggggattcgtgcaggtgacacacggggagccgcaaaaatcctgttcaaaagtgaccgactcctgccggcatgtttgccagtgccgaccgccacctccgctgccacctccacctccgcctccaccaccccctcgcctcttaagcgcccctgctccaaacagcacctcctgtcctacagaggagtcctggtggagcggccttgtgatcatcatagcggtgtgttgcgccagtctggtctttctgaccgtgcttgtaatcatctgttataaagctataaagaggaagccgcttaggaaggatgagaatgggaccagcgtcgcagagtatcccatgtctgcaagccaaagcaataagggggttgatgtcaacaatgccgtggtgtag

SEQ ID NO: 236208 - DNA, 828 bp, Artificial Sequence
  Description of Artificial Sequence: Synthetic coding sequence
atgtggcgggctggtagcatgagcgctgagcttggggtcgggtgtgccctgcgagccgttaacgagcgagtgcagcaggctgtcgcccgtagacccagagacctgcccgcaattcagccccgattagtggccgtatcaaagaccaagcctgcagacatggttatagaagcttatggtcatggtcagcgaacatttggagaaaattacgtgcaggagcttctggagaaggcctctaatcccaaaatattaagcctctgtcctgaaatcaagtggcactttatcgggcacttgcagaaacaaaatgttaacaaactaatggccgttccaaatctgtttatgcttgaaaccgtggatagtgtgaagcttgctgacaaagttaattcgtcctggcagaggaagggatcaccagagcgtttgaaagtcatggtgcaaataaatacaagtggggaggaaagtaagcacggcctccccccttccgaaaccatcgcaatcgtggaacacatcaacgctaagtgcccgaacctagaattcgtaggactcatgaccatcgggtcgtttggtcacgatttgagccagggcccaaaccccgacttccagctcctgctatctcttagggaggagctatgcaagaagcttaacatccctgcagatcaggtggaactatccatgggtatgtctgccgacttccagcatgcggtagaagtggggtctactaacgtcaggattggttccacaatctttggtgaacgcgattatagtaaaaagccaacacccgacaagtgtgccgctgatgtcaaagctcccctagaagttgcacaggagcattag

SEQ ID NO: 236209 - DNA, 1149 bp, Artificial Sequence
  Description of Artificial Sequence: Synthetic coding sequence
atgcggtcccctttgtgttggctgctgccgctgctgattctcgcttcagtggcacagggccagccaacccggcgaccacgaccagggacagggccaggcaggcgtccaagacctaggcctcgccctacccccagcttcccccagcccgatgagcctgctgaaccaacagacctgcctccgccattaccgccaggcccacctagtatttttcctgattgtccccgagaatgctattgtcctcccgacttcccgtcagctctctactgcgacagcagaaaccttcgaaaagtgcctgtgattccgcctagaatccattatctctatttacagaacaattttattacagagctgccagtcgagagttttcagaatgccactggactgcgctggattaacctggacaacaatagaatcaggaaaatcgaccagagggttttagagaagctgcccggactggtgtttctgtacatggagaaaaatcaacttgaggaggtgccgtccgccctccctcgcaatctcgagcaactccgcctgagccaaaaccatatctcccggatccctccaggtgttttcagcaagttagaaaatctgctcctcctggatctccaacataacaggctgagcgatggcgtttttaaaccagacacgtttcatgggctaaagaatctgatgcaactgaacctggcgcacaatatcctcaggaagatgccaccgagagtgcccaccgctattcaccagctctacctggattccaataagatagagacgatacccaatggatattttaaatcattccctaacctggcatttattcggcttaattataataaactcaccgatcgaggccttcccaaaaatagtttcaatatctcgaacctgctggtgttacacctgagtcacaatagaatcagtagtgtacccgcaataaacaaccgtctggagcacctctatcttaataacaacagtatagagaaaataaatggaacccaaatttgtccaaatgacctggtcgccttccatgacttcagcagcgacctagagaatgtcccacatcttagatatctgcgcctggacggcaactatttgaaaccaccgattcccctcgacttgatgatgtgcttcaggttattgcaatcggttgtgatttag

SEQ ID NO: 236210 - DNA, 1002 bp, Artificial Sequence
  Description of Artificial Sequence: Synthetic coding sequence
atggaggatctggaggaggacgtgaggttcattgtggatgagaccctcgatttcggcggattaagcccctccgatagccgggaagaggaggacatcacagtcctggtgactccagagaagccactcaggcggggtctgagccataggtccgaccccaatgccgtcgcccctgccccacagggcgtgcggctttctctcggcccattgtctccagaaaaactggaagaaatcctggacgaggcgaaccgcctggctgcacagcttgagcagtgtgccctccaggaccgggagagtgcgggtgaaggcctcgggccacggagagtgaagcccagccctcgccgagagacatttgtcctgaaggactcgcctgtgcgggacctcctccccacagtcaactccttgacccgttccaccccttccccgtccagtctgaccccacggctgcgcagtaacgatagaaaaggcagtgtcagggctctgcgggcaacctccgggaaacgcccatcaaacatgaaaagagaaagcccaacttgtaacctgtttcccgcatcaaaaagcccagcaagcagcccgttaaccaggtcgacaccccctgtgcggggtcgggctggcccttccggacgggctgcggcaagcccacctaccccgatcagaagtgttcttgccccacagccgagtaccagcaacagccaacgtctgcctcgaccccagggagcggctgccaagtctagcagccaactgcccattccaagcgctatcccacggcctgccagccgcatgcctcttacctcacggagcgtgcccccaggcaggggtgcactccccccagactccttgtcaaccaggaagggtcttccacgcccttccacagccggtcatcgcgtgcgggagtcggggcataaggtccccgtatctcaacggttgaacctgcccgtaatgggggcaactcgctccaacctgcaacctccacgcaaggtggcagtcccaggacctacacggtag

SEQ ID NO: 236211 - DNA, 933 bp, Artificial Sequence
  Description of Artificial Sequence: Synthetic coding sequence
atggaagacctggaggaagatgtaagatttatcgtcgatgaaactcttgatttcgggggactgtctccctctgattccagggaggaggaggatatcactgtgctggtgacaccagaaaagccactgcgcagagggttgtcacacaggagcgaccctaatgcagttgccccagcaccccagggcgttcgcctgtccctcgggcctctttccccggagaaactggaagagatcctcgatgaggctaaccgcctggctgctcaattggagcagtgtgcgcttcaggaccgagagtctgcaggtgagggactcggtccaagacgggtgaaaccatctccaagacgcgagacatttgtcctcaaggattcccctgtccgagatctactgcctactgtcaattcgttaacaagatctaccccctctcccagctccctgacaccgaggctgaggagcaatgaccggaaaggctcggttagagccctgcgggctacatccggtaagagaccctcaaatatgaagagggaaagccccacatgcaatttattccctgcttcaaagagtcccgcatcgtcgcccctgacaaggagcacaccaccagtgcggggtcgagccggtccaagcggtagagcggctgcgagcgaggaaacccgtgccgcaaagttgagagcctgccagccgaacgcaacccatcagcccgaatgtgccacttggcagaggtgtcccacgagtggtttttccgtcaactccaaacgggcaagtaaaaccaaacattgtcgcacgcagagcgcaggcaagtggactcagggcagttgctttccggcaacaaagtcctcgtgccatggctgccattctcagcaaagcgctgctccgcaagaaagcggatccccacgcacgtatcaggtgaagcgaagtggacagcaggccagattacaatag

SEQ ID NO: 236212 - DNA, 1002 bp, Artificial Sequence
  Description of Artificial Sequence: Synthetic coding sequence
atggaggatctggaggaagatgttagattcattgtggacgaaaccctcgactttggaggattaagcccgtcagattcccgtgaagaagaagatattacagtccttgtaactccggaaaagcctcttcggagaggcctttctcaccggtctgaccccaatgctgtagcgccagccccacagggtgtgcgcctctccctggggcctttgtctccagagaaactggaagaaatcctggatgaagcaaacaggctggcagctcagctcgagcagtgcgctctccaggaccgggaatccgccggagagggcctcggaccacggagagtcaaaccctccccccgaagagaaactttcgtgctgaaggattcgccagttagagacctgctgccgacagtaaactcccttacaaggtccactccctctcctagctccttgacaccgaggttgaggtctaatgatcggaagggttcggttagggcgctgagggctacatcgggcaaaagacccagcaacatgaagcgcgagtcccctacatgcaatctcttccctgcatcgaagtccccagcctcgtcccctttaacacgatcgacacctcccgtgcggggacgcgcaggacccagtgggagagccgctgcgtcgccacccactcctatccggtccgtattggcgccacagccaagcactagcaattctcaacgcctgccacgtccccagggagccgctgctaagtcgagcagccaactcccgattccttcagctatccctcgtccagcctccaggatgccattaacatcccgcagtgttccaccaggacgcggtgctcttccgcctgactccctctcgactcgcaaaggtcttccgaggcccagtacggccggtcacagagttcgggagtccggtcacaaggtccccgtgagccagaggctgaatttgcctgttatgggggctacaaggtcaaatttacagcctcccaggaaggtggcagtgcctggacctacacgctag

SEQ ID NO: 236213 - DNA, 1002 bp, Artificial Sequence
  Description of Artificial Sequence: Synthetic coding sequence
atggaggacctcgaagaggacgtgaggtttattgtggacgaaacgctggacttcgggggtcttagtcccagcgactcccgtgaagaagaggacattacagttttggtgacaccagaaaaacctctgcgacggggtctcagtcacaggtccgaccccaacgctgtggcacccgctccacagggagtccgactgtcactgggccctctgtccccggagaagttggaggagatcctagatgaagcaaaccgtctggctgcccagcttgagcaatgcgctctgcaggaccgagagtccgccggagaaggcctcggcccaaggagggtgaaaccaagtccccgacgggaaacttttgtcctgaaggacagtccagtgcgggatctattgcccacggtcaactccctgaccagatccactcccagtccctcttctctcacacccagactacgaagcaacgatagaaaaggttccgtacgagctctgcgcgcaaccagcggaaaacggccaagcaacatgaaacgggagagcccaacctgtaacctcttcccagcatcaaagtctccagcctctagtccactcactaggtcaacaccgcctgttcgtggacgtgctggcccttccggccgtgcagccgcaagtccaccaacacccattaggtctgtgctggccccacagccaagcacctctaattcgcagcggttgcctagaccccagggcgcagctgctaaatctagctctcaattgccaattccatctgccatccccagaccagcctcccggatgccgctgacttcacggagcgtccccccaggcaggggggcattgccccctgactccctgtcgacccggaaggggctccccagaccctctactgccggacatagagtgagagagtcaggacataaggtcccggtgagtcagagactcaacttaccagtcatgggagcaactcgttctaacctccagcccccaagaaaggtggctgtgcccggaccgacccgctag

SEQ ID NO: 236214 - DNA, 1002 bp, Artificial Sequence
  Description of Artificial Sequence: Synthetic coding sequence
atggaagacttggaagaggatgttaggtttatcgttgacgagacactggacttcggaggcctatccccgtctgacagccgagaagaagaggacatcactgtgctggtgacccccgagaagcctctacgcagggggttgtcccacaggagtgaccctaacgcagttgcacctgctcctcaaggggtgcggctctctctgggcccactgtctccagagaagttagaagagattctggatgaagccaaccgccttgcggcacagcttgaacaatgcgcacttcaggatcgcgagtcggcaggcgaggggctggggcctcggagggttaaaccgagccctaggcgagagacctttgtattgaaagacagcccggtgcgcgatctgttaccgacagttaactcactgacgcgcagcacacctagtccaagttctttgacaccacggctgcgctcaaacgacagaaaggggtcggtccgggctctgagggcgacctctgggaagcgaccttcaaatatgaaacgcgagtcccccacctgcaacctcttcccagccagcaaatccccggcatcttctccactcacccgctcgaccccgccagtgaggggtcgggctggcccatctggcagagccgcagcttctccccctactcccatcagaagcgtcctggccccacaacccagtacatccaactcacaacggctgccgaggccgcaaggggctgctgccaagagctcctctcagctgcctattccctcagctatccccaggccggctagtagaatgcccctcacatcccgaagcgtgcctccaggcaggggcgcattgcccccagatagtctctcaacccgcaagggactgcccagaccttctaccgcaggccatagagtgcgcgaatccgggcataaagtcccagttagtcaacgcctgaatctccccgtcatgggggctacacgttccaatctgcaaccgcctagaaaagtagcagttccaggccctacacggtag

SEQ ID NO: 236215 - DNA, 666 bp, Artificial Sequence
  Description of Artificial Sequence: Synthetic coding sequence
atggaggatctagaggaggatgtaagatttatagtcgatgaaacacttgatttcggcggacttagtccgtccgactcaagagaagaggaagacatcaccgtcctcgttaccccggagaagcccctgcgccgtggtttaagtcacagatctgatcccaacgctgtcgcacccgctcctcagggcgtgagattgtcacttgggcctctgtctcctgaaaagttggaagaaattctggatgaggccaacagactggcggctcaactcgagcagtgcgccctgcaagatcgcgaatccgctggcgaagggctggggccacgcagagtgaagccgagtcctcgaagggaaaccttcgtcctcaaggacagcccggttcgagatttactgccgacagtgaattccctcacgagatccactccatctccctcgtcactgacaccaagactcagatcaaatgaccgtaaaggctcagtcagagcactgagggctacctccgggaaacgaccaagtaacatgaaaagggaatctcccacctgtaacctatttcccgcatctaaatcccccgcaagctcacccctaacccgatccacccccccagtaaggggccgagcaggtcctagcggcagggctgccgctagcgaggaaactagggcagcaaagctccgatag

SEQ ID NO: 236216 - DNA, 699 bp, Artificial Sequence
  Description of Artificial Sequence: Synthetic coding sequence
atggaggacttggaagaggacgtacggttcatagtcgacgagacactcgacttcggcggactctccccaagcgactctcgggaggaggaagatataacagttctagtgacccctgagaagcctctgaggagaggactgtctcaccgcagcgatccgaacgccgtcgccccagccccacaaggcgttcgcctttccctgggtccactttccccagagaagctcgaggaaatcttggacgaggccaaccggctggccgcacagctggaacagtgcgcacttcaggatcgcgaatccgcaggagaaggcctgggccctagaagggtcaagccttctcctaggagagagacctttgttctgaaagacagtccggtgagagacctgcttcctaccgtaaacagcctgacgagaagtacgcctagtccttcttccttgacacctcgcctccgtagcaacgatagaaaagggagtgtccgggcactgcgtgccaccagcggcaagcgaccatccaatatgaagcgggagtcccctacgtgtaatctgtttcccgctagcaaatctccggctagctccccactaacccgaagcaccccccctgtgagggggcgagctggtccatccggtcgggcagccgcttctccacccactcccatacgcagtgtgttagctccacaacccagcacctccaattctcagagatag

SEQ ID NO: 236217 - DNA, 1092 bp, Artificial Sequence
  Description of Artificial Sequence: Synthetic coding sequence
atggaagaccttgaggaggacgttcgctttattgtggatgaaacactcgattttggaggactctccccatctgacagccgcgaggaggaagacattaccgttttagtgactccagagaagcccttacggagagggttgagtcacagaagcgatcccaacgccgttgctcctgcacctcagggggtaagactcagccttggcccactctccccagagaagctcgaggaaattctagacgaggccaacaggctggcagcacagttggaacaatgcgctctgcaggaccgcgaatccgccggagaaggtttaggcccacgtcgtgtgaaaccatctccaaggagggagaccttcgtcctgaaggattctcccgtgcgcgacctgctgccgaccgtcaacagtctaacaagatccactccgagccccagcagcttgacccctaggctgcgatctaacgatagaaaggggtctgtacgggcactgcgggctacctctgggaaacggccttccaatatgaaaagggaatcccccacctgtaatttgtttcccgctagtaagtcaccagccagttcgccactaactagatccacgcctccggtaaggggccgagccggacctagcgggcgagccgcagcatctgaagagacccgggcagccaaactccgcgtgagtggctccggggaattcgttggattgacgctgaaatttcttcatccctcccctcctggaccgccaacccccattcggtcagtgctggccccacagccctccacgtccaactctcagcggttgccgcgtcctcagggtgctgctgcgaaatcttctagtcaattacccataccaagcgctatcccgagacctgcttcccgaatgcccttgacgagtcgcagcgtcccgccaggccgtggagctctcccaccagacagtctctctactagaaaaggactgcccagaccctcaaccgccggtcatcgggtgagagaatctgggcacaaagttccggtatcacagaggctgaatctgcctgtgatgggcgcaacaaggtcaaatctgcaacccccacgaaaagttgccgtaccaggtcctaccagatag

SEQ ID NO: 236218 - DNA, 273 bp, Artificial Sequence
  Description of Artificial Sequence: Synthetic coding sequence
atgagacgactgctcttggttacgtccctcgtcgtcgtgctcttgtgggaagcaggagccgtgcccgcaccaaaggttcccatcaaaatgcaggttaagcactggcccagcgaacaggacccagaaaaggcgtggggtgcccgtgtcgtggaaccccctgagaaagacgatcagttagttgtactgtttcccgtccagaagcctaagcttctcaccaccgaggaaaaaccacggggaacaaaagcatggatggaatctagagcgagaccttag

SEQ ID NO: 236219 - DNA, 459 bp, Artificial Sequence
  Description of Artificial Sequence: Synthetic coding sequence
atgaggaggctgctcttggtgactagcttagttgtcgtccttctgtgggaggctggcgcagttcctgccccaaaagtccccatcaaaatgcaggtcaaacattggcccagtgagcaggatcccgaaaaccgagcctggggagcaagagtggtggagccccctgagaaggatgaccagttggtagtgctgtttcctgtgcagaagcccaagctgttgacaacagaagagaagccacggggtcaggggaggggtcccattctcccaggcactaaggcgtggatggagacagaggacaccctcggccacgtgctgagcccagaaccagatcatgactcactctatcacccgcctccagaggaagaccaaggggaggagcgccctagactttgggtgatgccaaatcaccaagtgctgttaggccctgaagaggaccaggaccatatatatcatccccaatag

SEQ ID NO: 236220 - DNA, 456 bp, Artificial Sequence
  Description of Artificial Sequence: Synthetic coding sequence
atgcgtaggctcctcctggtcacctctctggtcgtcgtgctgctgtgggaggctggcgctgttccagccccaaaagttccgattaagatgcaggtcaaacactggccttctgagcaggatcccgaaaaagcctggggggcacgggtcgttgaaccgcctgagaaggacgaccaattggtggtgctgtttccagtccagaagccaaaattgctgacaacagaggaaaaaccacgaggtcaaggacggggtccaattcttcctggcaccaaggcgtggatggagaccgaggataccttaggccacgtgctgtccccagagcccgaccatgattcactgtatcacccacctcctgaggaggatcagggggaggaacgccctcgattgtgggtcatgccaaatcatcaggtgctgcttgggcctgaggaagatcaggatcacatctaccatcctcagtag

SEQ ID NO: 236221 - DNA, 429 bp, Artificial Sequence
  Description of Artificial Sequence: Synthetic coding sequence
atgcgcaggctgctccttgttaccagtttggtcgtggtgcttctgtgggaagccggagctgtcccagccccaaaagtgcctatcaagatgcaggtgaagcattggcctagtgagcaggatcccgagaaggcgtggggcgcaagggtggtggagcctcccgagaaggatgaccagctggtggtgcttttccctgtccagaagccaaaactcttaaccactgaggaaaaaccccgagggacgaaagcttggatggagaccgaagatacgctgggtcacgtgctctcccccgaaccagaccacgacagcctctaccatccgccacctgaagaagaccagggagaggagcgaccaagactttgggtaatgcctaaccaccaggtcctcctaggacctgaggaagatcaggaccatatctatcatcctcagtag

SEQ ID NO: 236222 - DNA, 6473 bp, Artificial Sequence
  Description of Artificial Sequence: Synthetic coding sequence
atgtcggatcgcagcggccctacggccaagggaaaggacggtaaaaagtattcatctctcaacttgttcgatacctataagggaaaatccctagaaatacaaaaacccgctgtggctccaaggcacggtctgcagtccctcggtaaggtcgccatcgcaaggaggatgcctccgccagccaatctgccctccctaaaggccgaaaataagggcaatgatcctaacgtttctctcgtgcccaaagatggcacagggtgggctagcaaacaggagcagtccgatcctaagtcttctgatgcctcaacagcgcaacctcctgaaagccagccactgcccgcaagccagacgcctgcctctaaccagcctaagagaccacctgccgctccagagaacacccctttggtgcctagcggtgtaaagtcatgggcccaggcgtcagtcactcacggggcacacggggatggcggaagagcctcctcattgttgagcaggttctcaagagaagaattcccgactttgcaggcagctggcgaccaggataaagccgcaaaggagcgggagtccgccgaacaatcttcaggcccaggcccatctctgcgaccccagaactctacaacatggcgtgacggcggtggacgtggacccgatgaactcgaaggaccagatagcaagcttcatcacggccatgaccctcgcggaggcctgcagcctagcgggcctcctcagtttccaccctatagaggcatgatgccacccttcatgtaccccccttacctgcctttcccccctccatacggacctcaagggccataccggtatccaacacccgacggcccttctcggtttcctagagtagctgggcctagaggatccggcccaccgatgcgccttgttgagccagtgggcagacctagcatactcaaagaagataatctgaaggagtttgaccagctggaccaggagaacgatgatgggtgggccggtgcacacgaagaggtggactacactgagaagctaaaatttagcgatgaagaagacggcagggactcggatgaagaaggcgcagagggccacagagatagtcagtcagcaagtggtgaggaaagaccacctgaggcagatggtaagaagggaaactctccaaattcggaacctcccacccctaagacagcatgggccgaaaccagtcgccctccagagactgagccaggacctcccgctcctaaaccaccactcccaccccctcacaggggtccggcagggaattggggtcccccaggcgactatcccgacagaggcggtcccccttgcaagccaccagcccctgaagacgaagatgaggcatggagacagaggcggaaacagagcagcagcgagatctcacttgctgttgaaagagccaggaggagaagagaagaagaagagcggagaatgcaggaggaaagacgagctgcctgcgctgagaagctgaagagacttgatgaaaagtttggggctcccgataaaaggctgaaagccgaacctgcagctcctcccgctgccccaagcacacccgcacccccacccgcagtgcccaaagaactcccagcaccccctgctccccctcctgccagcgcgcctactcctgaaacagaacctgaggaacccgcacaggcgccacctgctcagagcacccctacccctggcgtcgcagccgctccgacgctggtgtctggcggagggtctacttcctcaacatcttctggatcctttgaggccagtccggtggagccgcagctgccctctaaagagggacccgaacctcctgaggaggttccccctccgaccacccccccagtgcctaaggtagaaccaaagggcgacggcatcggtcctactaggcagccgcctagccagggcctgggataccctaagtaccaaaaaagtctaccacccaggttccagaggcagcaacaggagcagttgctcaaacaacagcagcagcatcagtggcaacaacaccagcaaggcagcgccccaccaacccctgtaccccctagcccgccacagcctgtgaccctgggcgctgttcccgctccccaggcccctccacctcccccaaaagcgctgtatccaggcgctctgggtaggccgcctccaatgcctccaatgaacttcgatccccgatggatgatgatcccaccctacgtagatccaaggctgctgcaggggagaccacctctggacttctacccccctggcgtccacccaagtggactggtgccgcgagagcgtagcgattctgggggatcttccagtgagcctttcgacaggcacgcaccagcaatgctgagggagcgagggacacctcccgtggatcctaaactggcctgggtaggggatgtgtttactgcaacgccagctgaacctagaccactgacttcccctctgagacaagccgcagatgaagatgataagggaatgcgcagtgagaccccacccgtaccacctccaccaccctatctggcctcttatcctggctttccagaaaatggagctcctgggccaccaatcagccggttccccctggaggagcccggacctaggccgctgccttggccccctggctctgacgaggttgccaagatccagaccccccctcctaagaaggagccccctaaggaggaaactgcccagttgaccgggcctgaagctgggagaaaaccggcacggggagtcgggtccggcggacagggccctccacctccccgtcgggaaagtcggaccgaaacccgctggggccctcgacctggaagtagccgcagaggaatccccccagaggagcctggagcacctccgcgaagagccggacccattaaaaagcccccaccaccaactaaagtcgaagaactgccccctaagcctctcgagcaaggggacgagactccgaagccgcctaaacccgatccactcaagatcactaaaggaaagttaggcggaccaaaagagacaccgcctaatggcaatctcagcccggctccaagattgagaagggactactcctatgaacgcgtcgggccaaccagctgtcgcggaaggggcaggggagagtattttgcacgcggtcggggttttcgaggcacctacgggggtcgcggaagaggtgcccgttctcgggagttccgatcctatagggaatttcggggagatgacggtaggggcggaggtacgggaggccctaatcaccctcccgcaccacgcggaagaaccgcctctgaaacgagaagcgagggcagcgagtacgaggaaattcccaagcgccgtaggcaaagagggtccgaaaccgggtccgagactcatgaatccgatctggcgccttcagataaagaggcacccactccaaaagagggaactctgactcaggtgcccctggccccaccaccaccaggagctccgccaagcccggctccggctaggttcacagcacggggaggacgggtattcactcccagaggcgtgccttctagacgcggacggggtggcggacgcccacccccacaggtgtgccccggttggtcgcctcctgcaaaatctctggctcctaagaagcctccaacaggccctttgcctcccagcaaggagccactgaaagaaaaactcattcccggaccgctcagccccgtcgcacgcggtgggagtaatgggggtagcaacgtgggtatggaggacggggagaggcccagacggcgaagacatggtagggcccaacagcaggataaaccaccacgatttcggaggctgaagcaagaaagggagaatgcggcacgcggttcagaaggaaagccaagcctgaccttacccgctagtgctccgggacctgaagaggcccttacgacggtaactgttgcccctgctccgcgtagagccgcagccaaaagcccagatctgagtaatcagaactctgaccaggctaacgaagaatgggaaaccgcatctgagtcctctgacttcactagtgaaaggagaggcgataaggaggctccccctcctgtgttgcttaccccaaaagccgttgggaccccaggaggtgggggagggggtgccgtccccggaatcagcgcaatgtctaggggggatctgagccagagagctaaggatttgtcaaaacgctctttttcttcccagcgacccggtatggaacgacaaaataggcgcccaggacccggtggcaaggcaggttcttccgggagctcgagcggtggtgggggtggcggtccgggaggccgtaccggacccggtcgtggggataaacgcagctggcccagtccgaaaaataggtcaagacctccagaagaaaggcctcccggtctgccactacctccccctcctccaagctcatccgcggtgtttcgactcgaccaggtcattcattcaaaccccgctgggatccagcaggctctcgcacagttgtccagcagacagggatctgtgacagcacccggaggccatcccagacacaagcctgggctgcctcaagcaccacagggaccatccccaagaccccctacacgctacgaaccacagagagtgaactcaggcctgagctccgatccccactttgaagagccaggacctatggtgagaggtgtgggtggtaccccaagagattctgccggtgtcagtccttttccgcctaagcggcgtgagcgccctccaaggaagccagaacttttacaggaagagagtctcccaccccctcattcctctggattcctgggctcaaaaccggaagggccaggccctcaagctgagtcccgggacaccggaactgaagctctgacacctcacatctggaaccggctacacacggcaaccagcagaaagagctaccgccctagctccatggaaccctggatggagccactgtcaccttttgaagatgttgcgggaacagaaatgagccaatctgacagcggagtggatctttcaggggattcccaggtctcttctggaccttgcagccaaaggagcagccctgatgggggtctgaaaggggctgctgagggccctccgaagcgcccaggtgggagctctccactgaatgccgtcccatgtgaggggccaccaggatcagagccaccacgaagaccacccccagcccctcacgacggtgatcggaaagaactacctcgcgagcagccgctaccccctggaccaatcggcactgagagaagccaacggaccgaccgcggaacagagcctggccctatccgaccgagccaccgaccagggccaccggtgcagttcggcacctccgacaaagattctgacttaaggctcgtagtcggcgatagccttaaagccgagaaggagcttaccgcttcagttaccgaggccatccccgtatcccgcgactgggagctcctgccttcagcagctgcttcagctgagccgcagtcgaaaaacttagattccggccactgtgtgcctgagccatcatcatcgggccagaggctgtatccagaagttttctatggttcagcaggtccaagctcttcacagatcagcggtggggctatggactctcaacttcatccgaacagcggagggttccggccagggacaccatccctgcatccttacaggagtcagccactgtatctgcctccaggcccagctccaccgtctgcactgctgtcaggcttagcgctgaaaggtcaattcctggacttcagcactatgcaggccactgagctaggaaagctccctgccggaggagttctgtatccccctccttctttcttgtacagcccggcattctgcccctcccctcttcctgatacatccttgctccaggtgagacaggatcttccgtcacccagcgacttttattccacccccctgcagccaggaggccagagcggattcctcccttcaggggctccggcacagcagatgctcctccccatggtggactctcagctccctgttgtgaatttcggctccctccctccagcacctccaccagcccctccacccctgagccttctgccagtgggacccgcactccaacctccgagccttgcagtgcggccacctccagccccagcaaccagggtcctccctagtccagcaagacctttccccgcttctctcggcagagctgaactccacccggtggaacttaagcccttccaggattatcagaagttaagttctaacttagggggaccgggaagcagtcggacccctcccactggtcgctccttttcaggcctaaacagccggctgaaggccaccccgtccacctacagcggggttttcagaacccaacgagttgacctgtaccaacaggcttcgcctccagacgcattgcgctggattcccaagccctgggagaggaccggaccgccaccaagagagggtccatcccgccgagcagaggagcccggaagtaggggcgacaaagaaccaggcctccctcctccgcgata

SEQ ID NO: 236223 - DNA, 4149 bp, Artificial Sequence
  Description of Artificial Sequence: Synthetic coding sequence
atgctgagggaacgaggcacccctccggtagaccctaaattggcttgggtaggcgacgtcttcactgccacacctgccgagccacgccctttgacgagtccattgaggcaggcggctgatgaggatgacaagggcatgagatcggagacaccgccagtgccacccccaccaccctatttggccagttaccctggatttccggagaatggtgcacccggtcctcctatttctagatttccactggaagaacctggacctcgacccttgccctggccaccaggctctgatgaggtagctaagattcaaaccccacctccaaagaaggagccacccaaggaggaaactgctcagcttacgggaccggaggcaggaaggaaaccagcccgaggagtgggctcggggggacaaggtcctccaccccctcggagggagtctaggaccgagactcgctggggaccgaggccgggttcatccaggagggggatcccaccagaggagccaggtgcacctccaaggcgcgctggtcctataaagaagccaccacctcccacaaaggtagaagagcttcccccaaagcccctggaacagggcgacgagacacctaaacccccaaagccagatccactgaaaattaccaaggggaagttagggggaccaaaggagacacctcccaacggaaatcttagccccgctcccaggctgcggcgagactactcgtatgagcgcgtgggaccaacctcatgtagagggcgaggcagaggcgagtacttcgcgcgtggcagaggattccgcggaacctatggcggtagggggaggggtgccagatctcgggaattccggtcatatagagagttccgtggcgacgacggcaggggaggcggtacaggtggccctaatcacccccctgcaccacggggacgtactgcctccgagacccggtccgaaggtagtgaatatgaggagattccgaaacgccgacggcaacggggaagtgaaacaggcagcgagacccacgagtccgatctagcccctagcgataaggaagcacccacgccaaaagaaggaactctgacacaggtacccctcgctcctcccccaccaggcgcacccccttcacccgctccagccagatttactgctcgcggaggtagagtgttcacaccaagaggcgttccttcacgccgaggcagaggtggcggacgacctccccctcaggtatgcccaggctggtcccctcccgctaaaagtctggcccctaagaagccacccaccggacctctgccaccctccaaggaacctctgaaggaaaagctgataccaggcccactgtctcctgtggccaggggtggctcaaacggcggatcaaacgttgggatggaagatggtgagaggccccgtaggcgcagacacgggagggctcaacagcaagataaaccgccacggttccgacggctgaagcaagagagggaaaacgccgctcgaggctcagagggcaagcctagcctgacactcccagctagcgcacctgggccagaagaggcgctaacgaccgtgaccgttgctcccgctcctcggagagctgctgccaaatccccggatttgtccaatcaaaattccgaccaggccaacgaagagtgggagacagccagcgaaagtagtgattttacgagcgagcgacggggagataaggaagcccctcctcccgtcctgctaacgccaaaggctgttggcactcctggcggtggcggtggaggtgcagtgcccggtatttctgctatgagccggggagatctcagccagcgggctaaggaccttagtaaacgtagctttagttcacagagaccgggtatggagagacagaacaggcgtcccggtccgggaggcaaggctggttctagcgggagttcatcaggcggaggagggggtgggccaggaggcaggactggccctgggcgtggggacaagaggagttggccctctcccaagaatcgtagtaggccacctgaggagcgtccccctggcctccctctgccacccccacccccatctagttccgccgtgttccggctggatcaggtcatccacagcaatcccgctggcatccagcaggctcttgcacagctttcttccagacaggggagcgtcactgcgcctggcggacaccctagacataaaccaggccttccacaggccccacagggaccgtcccctcgccctcccacgcgatacgaaccacagagggttaatagtgggctgagcagcgatccccacttcgaggagcccggaccaatggttcgaggcgttgggggtaccccacgcgactctgcaggagtgagtccattccctccaaaaaggcgagaacgccctcctagaaaacctgagctgctgcaggaagagtccctgccaccgcctcacagcagcggctttttaggctcaaaaccagaggggccaggacctcaggcagaatcccgggacaccgggaccgaagccctaactcctcatatctggaatcgcctgcacacggccacttccaggaagtcataccgcccatcgtccatggagccatggatggagcctctatccccattcgaggatgtggccggaacagaaatgtcacagtccgactctggtgtcgatcttagtggggactcccaggtgtctagcggaccatgcagccaacggagctctcccgacgggggtctcaagggcgctgccgaaggaccgccaaagcggccaggtggttcgagcccactgaatgcggttccatgcgagggacctcctggctcagaacccccacgcaggcctcccccagctcctcacgatggggaccggaaggaactgcctagggagcagcccctgccaccaggcccaatcgggacagagaggtctcaacgcaccgataggggcaccgaacccggtcccattcggcctagccacagacctggccctccagtacagttcggtacatctgacaaggacagtgatctgaggcttgtggtcggcgattccctcaaagctgagaaagagctgactgccagcgttacagaggcgattcccgtttctcgtgactgggagcttttgcccagtgcagccgcatccgccgaaccccagagcaagaatctggactcaggacattgtgtacccgaaccaagctcatccgggcaaaggctctaccctgaagtgttttacggttccgccggaccttcaagctctcaaatctccgggggtgccatggactcccagttgcatcccaatagtgggggattccggcctggcaccccaagcctccacccatacagatctcagcctctctatttacccccaggacctgcacccccatccgcacttcttagcggcttagccctaaaaggtcagtttttggatttttctacaatgcaggcaacagagcttggcaagctgcctgcagggggtgtgttgtatccaccgccttcatttctgtattccccggctttttgtccatccccgcttcctgacacgtcgctcctgcaggtccgacaggacctcccaagcccgagtgatttttacagcacccctctgcagcccggtggccaatccggttttcttccttcaggcgctcccgctcagcagatgctgctcccaatggtcgattcccagctgcccgttgtcaactttggctccttgccccctgctccaccaccagctccccctcccctgtccttattgccggtgggccctgccctgcagccgccaagcttggctgtgcgtccccctccagccccagccacccgggtgctgccttcgcctgccaggccatttcctgccagtctcgggagggccgagttgcatcctgtcgaactgaaaccctttcaggattaccagaagctcagttccaaccttggaggccctggtagctcccggactccacctacagggcgatcattttctgggctgaacagccgcttaaaggctaccccatccacctacagcggcgtgttcaggacccaaagggttgacctttaccagcaggcctccccccctgacgctctgagatggattccaaaaccctgggagaggacagggcctcctccacgcgagggcccttcaaggcgagctgaagagccgggaagccgaggcgacaaggagccaggcttgccccctcctcgctag

SEQ ID NO: 236224 - DNA, 6473 bp, Artificial Sequence
  Description of Artificial Sequence: Synthetic coding sequence
atgtccgacagatccggtcctacagctaagggaaaagacgggaagaagtacagcagtctgaacctgttcgacacatataagggaaagagccttgaaatccaaaaacccgcagtggctccacggcacggcctccagtccctggggaaagtcgctatcgctcgtcgcatgcccccaccagccaacctgccttcactaaaggctgaaaataaagggaacgaccctaatgtctcactcgtgcctaaagatgggactgggtgggccagcaagcaggagcagagcgatccaaagtcctctgatgcaagcactgcacagccacccgaatctcagcccctgcccgcttcccagaccccggcttctaatcagcccaagcgacctcccgctgccccagagaacacacccctggtgcccagtggcgtcaaatcctgggctcaggctagcgttactcacggagcccacggagatggagggagagccagctctctgctgtcgaggttcagtcgggaagagttcccaacattacaggcggctggcgatcaagataaggctgccaaggagcgtgaaagcgccgagcagtcctccggtcccggaccaagcctgagaccgcagaacagcactacatggcgggacggaggaggacgagggcctgacgaactggaagggcctgattctaaactgcaccacggccatgacccgcgaggagggttgcaacctagcggaccacctcaattccccccttaccgcggtatgatgcccccttttatgtatccgccatacctgccattcccaccaccttatggcccacagggcccttacagatatccgacgcctgatgggccatcccgcttccctcgcgtggccggtccgaggggctctggccctcccatgagacttgtggaacccgtcggacgcccttcaatactcaaggaagacaacttgaaggagttcgatcagcttgatcaagagaatgatgatgggtgggcaggtgcacacgaagaggtcgactataccgagaaactgaagttctcggacgaggaagacggcagggactctgacgaggaaggcgcagagggccaccgggactctcaatcagcctctggggaagagaggcctccggaggctgacggtaaaaaaggaaattcacccaattcggagccccctactcctaaaaccgcctgggccgaaacatcgaggccacccgagactgagcctggccctccagctcccaagcctccccttccaccccctcatagaggccctgccggaaactggggccctccaggtgactaccctgatcgcggagggccaccctgtaaaccgcctgctcccgaagatgaagatgaggcttggagacagaggcggaagcaaagctcaagcgaaatttcccttgcggtggaaagggctcgacgtcggagagaggaggaggaaagaagaatgcaagaggagaggagagctgcctgcgctgagaagttgaaacgtttagacgagaaattcggggcacccgacaaacgcctgaaagccgagcctgccgctccacctgccgcaccctccacgccagccccacctcccgcagtgcccaaagagctcccagcccctccggcaccaccccctgcgagcgccccaacccccgaaaccgagcccgaagaacccgcacaggctcccccagcgcagtccacaccaactcccggagtggcggcagcccctactttagtcagcgggggagggtctaccagctcaacaagctctgggagcttcgaggcaagcccggttgagccccagctccccagtaaagagggccctgagccaccagaggaagtcccaccccctacaactccgcctgtgcccaaagtggagcctaagggggacggaatcggcccaactcgtcaaccaccatcccaaggtctggggtatcccaagtaccaaaagtctttaccccctagattccagagacaacagcaggagcaactgctcaagcagcagcagcagcatcagtggcaacagcatcagcagggatctgcaccacccacgcctgtgcccccatccccaccccagccagttaccctgggggcagtcccagcccctcaggcccctcctcccccaccaaaggcgttataccccggtgcacttggacgccctcccccaatgcctcccatgaatttcgatccgcgttggatgatgattccaccgtacgtggatccccgactcctgcagggcagacctccattagacttctatccaccgggtgtacacccttccggcctggttccaagagaaaggtcagacagtggcggatcctctagcgagccgttcgacaggcatgcccctgcaatgttacgggaaaggggcactccacccgttgatccgaagcttgcctgggtgggcgatgtcttcactgccactcccgctgaaccacggcctctgacctctccactgcggcaggccgctgacgaagacgacaagggcatgagatctgagacccctcctgtacctcccccaccaccgtacctcgcatcctaccctggcttcccagagaacggagctccaggtccacctatcagcagattcccactggaggagcccggacccaggccactgccttggcctccaggcagcgatgaagttgctaagatacagaccccaccacctaagaaagaaccaccgaaagaggagacagcccaacttacaggaccagaagccggtagaaagccggcacggggtgtgggttctgggggacagggaccccctcccccacggcgtgaaagcagaaccgagaccaggtggggcccacgccctggaagttctcgccgaggaatcccacccgaggaacctggtgcccctccccgacgggcagggccaatcaaaaaaccacctccgccaactaaagtggaagagcttccccctaaaccactcgaacagggagatgagaccccgaagccccctaagcctgacccactgaaaataacaaagggcaagttaggagggcctaaggaaacccccccaaatgggaatctttcccccgctcccaggttgaggcgcgactactcctatgaaagagtgggaccaaccagctgtcggggtcgtggacgcggagaatacttcgccaggggcagggggtttcgaggtacctacggtggaagggggcgaggagcacgtagtcgagaatttaggagctatcgtgagtttaggggagacgatggaaggggtggcggtaccggaggcccaaatcaccccccagccccacgcggacgaactgcgtccgaaactcgcagtgaaggctccgagtacgaggagatcccgaaacgcaggcgccagaggggctccgagactggaagcgagactcacgagtcagacctggccccatctgacaaggaagccccaactcctaaggagggcacgctgacccaagtaccattggcgccacctccgccaggggctcctccctctcctgctcctgccaggtttacagcaagaggaggtagggtgttcacacctagaggcgtgccaagcaggcgcggtcggggtggcggacgcccaccaccccaagtctgtccaggatggagccctccggcaaagtctcttgcccctaaaaagccccctacaggcccactccctccttcaaaggaacccctaaaggagaaattaattcccggacctctcagcccagtcgcccgtgggggaagtaatggaggatctaacgtgggaatggaagatggcgagcgccctcgacgtagacgccacggtagagcccaacagcaggataagcctccccgatttcgcaggctgaaacaggagagggagaatgccgctagaggtagtgaaggaaagccctctttgacgctgcccgcatctgcgccaggtccagaagaagcccttacgaccgtgacagtggcacctgccccacgcagggcagccgctaaatcaccggacctctccaatcaaaacagtgaccaggctaacgaggaatgggagaccgcctcagaaagtagtgacttcacttctgagcgccgtggtgacaaagaagcccctcctcccgttctcctaactccgaaagctgtaggcactcccggagggggaggagggggagctgttcctggaatttcggccatgtccagaggcgatctatctcagcgagccaaggatttgtccaagcggtcttttagctcccagagaccgggtatggagcgacagaatcggagaccgggaccagggggtaaggcgggtagcagtggctcttcctccggagggggtggtggtgggccaggcggacggactggtcccggtaggggtgataagcgcagctggccatccccgaagaatcggagccgtcctcccgaggaacgcccaccaggccttccgctccccccacctcccccttcctcctctgcagtgtttaggttggatcaggtgattcatagcaaccctgcgggaattcaacaggccttggcccagttgtcttctagacagggctcggtgaccgctcccggtgggcatccaagacataaacctggattgccgcaggcaccgcagggcccttctcccaggccaccgacccgatatgagcctcagagggtgaacagcggactcagctctgacccccactttgaggagcctgggccaatggtcaggggcgtggggggaacaccccgagactccgccggagtttcaccattcccccctaagcgcagagagagaccaccaaggaaaccggaactattgcaggaggaaagccttccaccacctcactcctccggattccttggctcaaagcctgaggggccaggacctcaggccgagtccagagataccgggacagaagctttaacgcctcacatttggaatcgactgcacacagccacctcccgaaagtcctaccgaccttcatctatggaaccatggatggaaccgctgagtcccttcgaggacgtcgcaggtaccgagatgtctcagtcagacagcggcgtagatctgtctggggattcacaggtgagttctggcccatgcagccaacggtcaagtcccgatggaggcctgaaaggagctgccgagggacctcccaaaaggcctggtgggtcaagtccactgaacgccgtcccttgtgaagggcctccagggtctgaaccccctcgcaggccgcctccagccccacatgatggggatagaaaagagctgccacgtgagcagcctctgcccccaggaccaattggaacggagcggtcccagcgaactgataggggcactgaacctgggccaattcggccatctcacagaccaggcccaccagtgcagtttgggacaagtgacaaagatagcgatttacgcttggtggttggagattccctaaaggccgagaaggagctcacagcatccgtgaccgaggctatcccagtctctcgtgattgggagcttttgccgagcgcggcagcatccgccgagccccagtcaaaaaacctggactctggccattgtgttcctgagccatcatcaagtgggcagagactatatcccgaagtgttttacgggagcgcgggtcccagcagctcgcagatatccggtggagcaatggatagtcagttgcatcccaactccggcggttttcggcctggtactccatccctgcatccttatcgcagtcagccactctacctgcccccaggccctgcacctccgagcgccctgctcagcgggctggctctgaagggtcagtttttggacttcagcactatgcaagctacggagctagggaaactccctgccggtggggtgttgtacccaccaccaagcttcctgtattccccagcattttgcccaagccctctgccggacaccagccttttgcaagtcaggcaggacctgcccagcccatcagacttctactcgacacccctccaaccgggtgggcagtccgggtttctgccttcaggagcccctgcccagcagatgctgctccccatggttgattcccaattacccgtggtcaactttggctccctgccacccgctccaccccctgccccacctccactgagtctgctgcccgtcggcccagcactccagcctccatccctggcggtgcgccctccccctgctccagcaacaagagtgcttccctctcctgcccgtcctttcccagccagtttaggcagggcagaactgcaccctgttgagctgaagccttttcaggactatcaaaaattgtcaagcaacctcgggggaccaggatcatccagaaccccgccaacaggcagaagttttagcgggcttaacagcagactcaaagccacgccatctacctacagcggcgtgttcagaacccagagggtggacttatatcagcaagcctcaccacctgacgccctgaggtggatacctaagccgtgggagcgcactggtcctccacccagggagggccctagtcgcagggctgaggaacccggtagcagaggggataaagagccgggactccctcccccaaggta

SEQ ID NO: 236225 - DNA, 6473 bp, Artificial Sequence
  Description of Artificial Sequence: Synthetic coding sequence
atgagcgacaggtctgggccaaccgctaaaggtaaggacggcaagaagtactctagtctgaacctgttcgacacatacaagggtaagagtctggagatacaaaagcctgctgtggctcccagacacggcctccaatccctggggaaggttgctatcgcaaggaggatgccacctcccgctaatcttccctcccttaaagccgagaacaaggggaacgatccgaatgtgagcctggtccctaaagatgggacaggttgggcctctaaacaggagcagagcgaccccaaatcttctgacgcaagcactgcccagcctcctgagtcacagccacttcccgctagtcagacgccagcaagcaatcagcctaaaaggccccctgctgctcctgaaaatacccccttggtgcctagcggagtgaagtcgtgggcccaggcatcagtgacccacggggctcacggcgatggcggacgagcttcctcattgctgtccagattcagtcgggaagaattccccacactgcaggccgctggagaccaggataaggccgctaaggagcgcgaaagcgccgaacagtctagcgggcctgggccttctctcaggccacagaatagcaccacttggagagacggaggcggacgaggcccagatgagctggagggcccagacagcaaactgcaccatggccatgaccctaggggagggctgcagccaagcggaccaccacaattcccaccttacagaggaatgatgccgccttttatgtaccccccttaccttccgttcccaccaccttacggcccacaaggaccctatcgttacccgacgcctgatgggcctagccgctttccacgcgtggccggtccccgaggatcaggcccaccgatgcgcctagtggagccagtggggaggccttcaatcctgaaagaggacaacctgaaagaattcgatcagttagaccaagaaaatgatgacggctgggctggagcacacgaggaggtggattatacggagaaactgaagtttagcgacgaagaggatggcagagatagcgatgaggaaggagccgagggtcaccgggacagccaaagcgcctcgggtgaggagcggccacccgaagctgatgggaaaaaagggaatagccctaatagtgagcccccaaccccgaagactgcttgggccgagacctctcgcccaccagagaccgagcccggacctcctgctcccaagcctccgttgccgccaccacatagaggccctgccggtaattgggggccacctggggattatccggacagaggcggaccaccttgcaagcctccagcacccgaagacgaggatgaagcatggcgccagcgcagaaagcagtcaagcagcgagatcagtctggccgtagagcgggctcgtcggaggagagaagaggaggagcgaaggatgcaggaggagcgccgtgcggcttgtgcagaaaaacttaaaaggctggatgagaagttcggagcccctgataaacgacttaaggccgagccagccgcaccgcctgcagctccaagtactccggcaccaccccctgcagtgcccaaagagctgcccgcaccccctgcaccgccacccgctagcgctccaaccccggagaaggaaccagaggaacctgcacaagctccccctgctcagtccactcccacacctggcgtagccgcagctcccacactggttagtgggggtggatctacgtcctccacttcctcaggatccttcgaggccagtccagtggagccacaattgccctccaaagaaggcccagagccgcctgaggaagtaccaccacccaccactcctccggtgccaaaggttgaaccaaagggggacggtattggccctacccggcagccaccgagtcagggcctggggtacccgaagtatcaaaagagccttcccccacgcttccagagacaacagcaagagcagctccttaagcagcagcaacagcatcagtggcagcagcatcagcagggttcagcaccccctacccctgttccaccctcaccccctcaaccggtaacactgggagcagtaccagccccacaagcaccgccacccccaccaaaagccctgtatcccggtgcactcggccgacctccgccaatgcccccaatgaactttgatccaaggtggatgatgatccccccttatgtcgacccgagattattgcaaggtcggcctccactcgatttttatccgcctggagtgcacccaagcggactggtccccagggaaagatctgacagtggcggatcaagctccgagcccttcgaccgacatgctcctgccatgctgagagagcgcggaaccccgcctgtcgaccctaagctcgcctgggttggtgatgtgttcactgccaccccggcagagcctcggccactgaccagccctcttcgacaggctgcagacgaagatgacaagggaatgaggtccgagaccccacccgttccgcctccaccaccctatctggcctcctacccaggcttcccagagaatggcgctccgggaccccctattagccgctttccacttgaagaacccggtccccgtcccctgccttggccccctgggtctgatgaggttgcaaagattcaaactccccctcccaagaaagagcctccaaaggaggagacggctcagctgaccgggcctgaggctggcaggaagccagctcgcggtgtgggctccgggggacaggggcctcctccacctcggagggagtctagaaccgagactagatggggccctagacccggttctagcagacgcggtatccccccagaggagccaggcgcaccccctaggagggccggtccaataaaaaagcctcctccccctaccaaggtcgaggaattgccaccaaagccactggagcaaggagacgaaacgcccaagccgccaaaacccgatccactcaaaattactaagggtaagctgggcggaccaaaggagacaccacccaatggaaacctctcgcccgctccaagactgcgacgagactacagttacgagagagtgggacctaccagctgtcgcggacggggtcgcggtgaatattttgcacggggtagggggttcagagggacctatggaggtaggggacgaggcgcaagatctcgggaattcaggagctacagagagtttcgcggagatgacggaagaggcggaggcactgggggacctaatcacccacctgcaccacggggaagaaccgcatctgagacgcgatcagaagggagcgagtacgaggagattcccaaacgcaggcgccaaaggggctctgaaactggctctgagacccacgagtcagacctggccccaagcgacaaggaggctccgaccccaaaggagggtacgttgacccaggtgcctctcgcccctccacccccaggcgctcctcctagtcccgctccagcacgctttaccgctcgaggagggcgtgtgttcactccccgaggtgtccctagcaggagggggcgaggcggagggaggccacctccccaggtttgccccggatggagtcctcccgctaaatccctcgcaccgaaaaaacccccaacgggcccattgccgccaagcaaggagcctctcaaggaaaagttgatcccgggtcccctcagcccggtggctagggggggttccaatggcggaagcaatgttggaatggaagacggcgaaaggccacgtcgcaggagacacggcagagcacagcagcaggacaagcctcctcggttcaggcgtctcaaacaagagagggagaatgcagccagggggagcgagggaaaacccagtttgacccttcctgcttccgctcctggccctgaagaggccctcactacggtgaccgttgcccctgccccacgccgagctgccgcaaagagtcccgacctctccaaccaaaactctgaccaggccaacgaggaatgggaaacagctagcgaatcttccgactttacgagtgagcgcaggggagacaaggaagctcccccacctgtactcctgactcccaaggcggttggcacccccggaggcggaggtgggggtgcggtgcccggtataagcgcaatgtcacgcggagacttgtcacagcgggctaaagacctgtctaaaaggtcattctctagccagcggccagggatggaaaggcagaataggcgtccaggtccaggaggcaaggcgggatcgagcggttcatctagcgggggaggaggcggaggtcccggtgggagaacgggacctgggcgaggggacaagaggtcatggccgtcacccaagaacaggtccaggcccccagaggagcggcctccgggacttcctctcccgcctccccctccttcttcttctgcagtctttcgcctcgatcaggtgatccattcaaatcctgcaggaattcagcaggctttggctcagctgtcttccagacaaggaagcgtgaccgcgccaggaggccatccgaggcacaaaccgggtccaccacaggcccctcagggtccaagtccaagaccccctacacgatacgaaccgcagagggtgaacagcggactgagctcagacccgcattttgaggagccaggacctatggtccggggagtgggcggtacgcccagggactctgcaggggtttcccctttcccgcctaagagacgagaaagaccccctcgcaaacctgaactgcttcaggaggaatctctcccaccccctcacagtagtggctttcttggctcaaagcctgaaggtcctgggccacaggcagaaagccgagatactgggactgaggctctgacacctcacatttggaacaggctccataccgccacctcacgaaagtcgtacagaccaagcagcatggagccgtggatggagccactctcaccgtttgaagatgttgcaggtactgagatgagccagtctgatagcggagtggatttgagcggcgatagccaggtgtcaagcgggccttgttcgcagcgcagtagccccgatggaggactgaagggagccgctgaggggcctcctaagcgtccaggcggatcgagcccactgaacgcagttccttgcgaaggacctcctggcagcgagccaccacgcaggcccccacccgctccacatgacggggatcgaaaggagctgcccagggagcagcctctccctccaggccctatcggaaccgagaggtctcagcacacagatagggggacggaaccgggaccgattcggccttcacacagacccggtcccccagtgcagttcgggacatctgacaaggattctgatctgagactggtggtaggagactcacttaaagcagaaaaggagctgacggccagtgtgaccgaagcaatccccgtcagtagagactgggagttgttacccagtgctgccgctagcgccgagccacagagtaaaaacttagactccggacattgtgtccctgaaccaagctcttccgggcagagactgtatccagaagtgttttacggaagcgccggtccttcttcctctcagatctccggaggagccatggacagccaactgcaccccaatagtggaggatttaggcctggcacaccctcgctccacccttatagatctcagcctctgtacctgcctcccggtccggcaccgccatctgcactcctatcaggcgtggctctgaagggccaatttctggacttttctacaatgcaggctacagaacttgggaagttacctgctggaggcgtcctctaccctcccccaagtttcctgtacagccctgccttctgtccatctcccctgccagatacctcacttcttcaggtgcgtcaggatctgcctagtccgtccgatttctattctacacccctgcaaccagggggacagtcagggttcttaccctcaggggcacccgcacaacagatgctgctgcctatggtggattctcagctgccggtggtgaacttcggctccctcccaccagcacctccccctgcacccccttctctgtctctgctgcccgtaggacccgctctgcagcccccaagccttgccgtacgccctccacctgcccctgccacacgcgtgctgccttcacctgcacgacccttcccagccagcctcggacgcgctgagctccatccagtcgaacttaagcccttccaggactatcagaagctgtcaagtaacctaggaggcccaggctcatctcgcacacccccaacaggaaggagtttcagcggcctgaatagccggctcaaagccactcccagtacttactctggagtctttcggacccaaagagtagacctgtatcagcaagcgtcgccacccgacgcactgaggtggatccccaagccatgggaacggactggccctcctcccagagagggccctagccgacgggctgaggagcccggttctaggggcgacaaagaacctggattacctcctccaaggta

SEQ ID NO: 236226 - DNA, 6474 bp, Artificial Sequence
  Description of Artificial Sequence: Synthetic coding sequence
atgagtgaccggtccggtcccaccgcaaagggtaaggacgggaagaagtactcctcactaaatctctttgacacctacaaaggtaaaagtctagagatccaaaagcccgctgtcgcgccaagacacgggttgcaatccttggggaaagtagcaatcgcaagacggatgccgccacccgcaaatctgccaagtctgaaggctgagaacaagggtaacgaccccaacgtgtctctggttcccaaggatgggaccggctgggcaagcaagcaggaacagtctgatcccaaatcttccgatgcgagcaccgcccagcctcccgagtctcaaccgctgcctgcttcccagacacctgccagtaaccagccaaaaaggccaccggctgcacctgagaataccccattagtcccaagtggcgtgaagagttgggcccaagcttccgtgactcacggggcacacggcgatggcggaagagcctcatcactcctgagccggttctccagagaggagttcccgactctgcaagctgccggagaccaggataaggccgcaaaagagcgggagagtgccgagcagtcgtctgggcctggcccaagcttgagaccacagaactctaccacttggcgagatggagggggtcggggtcccgatgagctcgagggcccagatagcaaactgcatcatggtcatgatcctagaggagggcttcagcccagcggaccccctcaatttcccccttaccggggaatgatgccaccattcatgtaccctccctacttgcctttccctcccccatatggaccacagggtccatatcgttatccgacccccgacggaccgagccggttccctcgcgttgccggacccagaggatccggtcctcctatgcgcctggtggaacctgtcggtagaccctctatacttaaggaggacaacttaaaggagttcgatcagctggatcaagagaacgatgatgggtgggccggagcccacgaagaggttgattatacagaaaagctaaagttttccgatgaagaagacggccgagatagtgacgaggagggagctgaggggcacagggacagccagtctgcttctggtgaggagcggcctcccgaggctgatggaaagaaggggaatagtcccaactcagaaccacccacaccaaagaccgcatgggcggaaacctcccggcctccagagacagaaccaggcccacctgctccgaagcccccactcccacctccgcaccgtggcccagctggcaactggggccctccaggagactaccctgacaggggtgggcctccttgtaaaccccctgcccctgaggatgaagacgaggcttggcgacaacgccgaaaacagtcaagctcggaaatttctttagcagtcgagcgggcaagaagacgacgggaagaggaggagcgccgaatgcaggaagagagacgtgctgcctgcgcggaaaaactgaagcggttggatgagaaatttggagccccagataagcgattgaaagcggagccagctgcaccccctgctgcccctagtacgccagcgcctccaccagccgtccctaaggagctcccagcacccccagcccctccgcctgcaagtgctccaacccctgagaaagagccagaagaacccgcacaggcccctcctgcacaatccacgccaactcccggagtggcagcagcccctaccctggtgtccgggggagggagtacttccagcacctcctcgggatcctttgaggcatctcctgttgaaccacagttgccaagtaaggaggggccagaacctcccgaagaagtgccaccacctaccacccctcccgttccaaaggtggagccaaaaggcgatggaatagggccaaccaggcagcccccatctcagggactgggctaccccaagtatcaaaagtcacttcccccaaggtttcaacgacagcaacaggaacagctcctgaaacagcagcagcagcaccagtggcaacaacaccagcagggctcagccccacccacccccgtgccgccatccccccctcaacccgtcacactgggcgctgtacctgcaccgcaagcgccacctcctccacctaaggccttgtatccaggagcgctggggcgtcctccccctatgcctccaatgaactttgatcctagatggatgatgattcccccttacgtggatcctcgtcttctccagggcaggcctcctcttgacttttatcctccaggcgtgcacccctccgggctcgtgccgcgagagcggagtgacagtggcggttcatcatccgagccatttgacagacacgcccctgccatgctgagggaaagggggacgccaccagttgaccctaagcttgcctgggtgggcgatgtcttcacagcaactcccgctgagccacgaccactcacatcccccctcagacaggctgccgatgaggacgacaaggggatgcgctctgagacccctccagtgccaccaccaccaccctatcttgcttcttaccccggtttcccagagaatggagccccaggtcctcccataagtaggtttcccctggaggagcccggtccaaggccactaccctggcccccaggatccgatgaggtggctaaaattcagactccgcctccgaagaaggaacctcctaaggaggagacagctcagttgaccggtccagaggctggcagaaaaccggctagaggcgtcggttcagggggacagggcccacccccaccccgtagggagagtcgtacggaaaccagatggggccctcggcctggtagctcacgaagggggattccccctgaagagccaggagctccccctcgccgtgcgggacctattaagaaaccgcctcccccaaccaaggtggaggaactgccccctaagcccctcgagcagggcgatgaaacacccaaacctccgaagccggacccgttaaagattactaaaggcaagctgggaggacccaaggaaactcctccaaatggaaatctctcaccggctccgcgtctgcgcagggactatagctacgagagggtggggcctacttcttgtcggggacgcggacgcggagagtactttgcaagaggtcgcggtttccggggaacttacgggggaagaggtcggggtgcacgttccagggaatttaggagctacagggagttccgcggtgacgacggccgaggtgggggaaccggcggtccgaaccatcccccagctccccgaggaagaactgcaagtgagacaagatcagagggctccgaatacgaggagatcccaaaacgcaggcggcagcgagggagcgaaactggctctgagacacatgaatctgaccttgcacccagtgacaaagaggcccctacccccaaggaaggtactctaacacaggttccacttgccccaccaccccctggggctccaccctcacccgctcctgcacgatttacagctagagggggtagagtgttcacaccgaggggagtgccatctcgccgagggaggggcggaggccgaccaccccctcaggtgtgccccggttggtcccctcctgctaaaagcctggcccctaaaaaaccccctactgggccattacctccctctaaggagccactaaaggaaaaactgatacctggcccacttagtcccgtagcgagggggggatccaacggcggttccaacgtcggtatggaggatggcgagaggcctcggcgtcgtagacacggccgtgcccaacagcaggacaaaccacccaggttccgccgtctgaagcaggaaagggagaatgctgccagaggcagtgaggggaaaccaagcctgactctgcctgccagcgcccctggcccagaggaggcgctgactaccgtaaccgttgcccctgccccacggagggccgcagccaagtcgcctgatctgtctaatcagaacagcgatcaggccaacgaggagtgggagaccgcctcagagagctctgactttacatccgaaaggcggggtgacaaggaagcaccccctcctgtgctgctcacaccaaaagctgtgggcacaccaggaggtgggggaggtggggctgttcctgggatcagcgctatgtcccggggagacctgtcccagcgggctaaagatctctccaagcggagctttagctctcagaggcctggaatggagcggcagaataggcggccagggccaggagggaaagctggctcaagcgggtccagcagtggcggtggtggaggcggtcccggaggacgaactggccctggcaggggtgacaagcgttcctggccctcaccaaagaacaggtctagacctcctgaggaacggccaccaggcctacccctgccccctcctcccccatcatcctccgctgtcttcaggctggaccaggtaatccattcgaatcctgctggaatccaacaagctctggcacagttgtcatcaaggcagggctctgtcaccgccccaggaggtcatcctcgccataagccaggcccaccccaggcaccccagggccctagtcccaggccgcctacccgttatgaacctcaacgcgtcaactcaggcctgagttcagatccccacttcgaggaaccaggcccaatggtcagaggagtggggggaacccccagggacagtgctggcgtgtcgcccttcccacctaagcgtagggagaggccccctcgtaagccagaacttttgcaagaagagtctctgccccctcctcacagcagcgggttcctgggaagtaaaccagagggtcccggtccccaagcagaaagcagggacactggcacggaggcactgactccacacatctggaatcggctgcataccgctacaagccgaaagagctacagaccctctagcatggagccgtggatggaacccctgagcccattcgaggatgtcgccggaacagaaatgagccaatctgattcgggcgttgatctgagtggtgacagccaagtctcctcagggccttgctctcaacgtagcagccccgatggcggactgaagggtgccgcagagggccctccaaaaaggcccggtggatctagtccgctcaacgccgtcccctgcgagggcccacccggaagcgagcctcctaggcgacccccacccgctcctcatgatggcgatcgcaaagagctccctcgtgaacagccgttaccaccaggcccaattggcactgagagaagccaacacaccgatcgcggaaccgagccgggtcccattagaccaagtcaccgacccggaccaccagtgcagttcggtacgagtgacaaagacagtgacctgaggttggttgtgggagatagcctaaaagccgaaaaagagctcacggcaagcgtgactgaggccatcccagtaagccgagattgggagcttctgccaagcgcagctgcctcggccgagccacagtccaaaaacctagattcaggccactgcgttcctgaaccatcatcatctgggcagcggttgtacccggaggtgttctacggctctgccggtccgagcagttctcagataagcgggggagctatggattctcaactgcatcctaacagcggtgggtttcgcccaggaacacccagcctgcacccctacagatctcaacccctttatctgccccctgggccagcaccaccgtccgcactcctgtcaggagtggccttaaagggccaatttctagattttagcacaatgcaggctaccgagttgggcaaactgcccgcaggtggagtcctgtaccctcccccatcttttctgtacagccccgctttttgcccttctccactccccgatacatccctgctgcaggtacgccaggatctaccttccccgagtgacttctattctaccccactgcagcccggagggcagtccggattcttgccaagtggcgctcctgctcagcaaatgctgctccctatggtggattcccaactgcctgttgtgaactttggttccctgccacccgctcccccacccgcaccaccctccctgagcttgcttccagtgggtcccgctctgcagccccctagtctggctgtgagaccccctccggcacctgcaacccgagtgctcccatctccagcgagaccattcccggcttctctcggcagggccgagttgcacccggtggaactgaaaccattccaggattaccaaaagcttagttccaatctaggaggccctggaagctcaagaacaccgccaaccggcaggagcttcagcggcctcaattcccggttaaaggcaacaccctcgacctatagcggggtctttcgcactcaacgcgtggacctctatcagcaggccagtcctcccgatgctttaaggtggattccaaagccttgggaacgcacgggacccccacctagagaggggccatctcggagagccgaggagcccggtagcaggggggacaaggaacctggcctaccccctcccagatag

SEQ ID NO: 236227 - DNA, 6473 bp, Artificial Sequence
  Description of Artificial Sequence: Synthetic coding sequence
atgtctgacaggtccggccctacagccaagggaaaggatggcaagaagtactccagcctgaatttgttcgacacatacaaaggtaagtccttggagatccaaaagcctgctgttgcccctagacacggattacagtctctgggaaaggtggccatcgcacgcagaatgccccctccagctaatttaccatcattgaaggcagagaataaagggaatgatcccaacgtgtctctcgtgcccaaagacggtactggctgggcctccaagcaggagcagagcgatccgaaatcatctgacgccagcactgcacagccaccagagtctcagcctcttcccgcttctcagacccctgcctctaaccagcctaaaagacctcccgcagctcccgaaaataccccccttgtaccctccggcgtgaaaagctgggctcaggcatccgtgacccacggcgcacatggggacggaggtagagcctcttcacttctttcccgctttagcagggaagaatttcccactttgcaggccgctggggaccaggacaaagccgctaaggaaagagaatccgcggagcaaagttctgggcctggcccatccctgcggccacagaattctactacttggagggacggcggtggcaggggcccagacgaacttgaaggtcccgattctaagctgcaccacggacacgatccgaggggcggtctgcagcctagcggacctccccagttccctccataccggggaatgatgcccccatttatgtacccaccatacctgccattccctcccccatacgggcctcaggggccttaccgataccccacgcccgacggcccttcacggtttccccgtgttgcaggccctcggggatccggtcccccaatgcgattagtggagcccgttgggaggccctcgatactcaaagaggataacctgaaagagttcgatcaactggatcaggagaacgacgatggttgggccggagcacacgaggaggtggactacacagaaaagctgaagttctccgatgaggaggacggtcgggatagcgatgaagaaggggcagagggccacagggatagtcagagtgcgagtggcgaagagcgccctcctgaggccgatggcaagaagggcaacagccccaattctgagccgcctactccgaaaacagcgtgggccgaaacaagccgccctcccgaaaccgaacctggacccccagcacctaagccccctctgcccccaccccataggggccctgccggaaattggggacccccaggagactaccccgataggggcggacctccctgtaaacctcctgcacccgaggacgaagacgaggcctggagacagaggcgtaaacagtccagctcagaaatcagcctcgcagttgaacgcgcaaggcgacgccgtgaagaagaggaacgtaggatgcaggaggaacgcagggccgcatgcgctgaaaagctgaaacgactggatgagaagtttggagcaccagataaaaggttaaaagcagaacccgcagcccctcccgctgcacccagcactcccgcacccccacccgctgtgcctaaggagctgcctgcacccccagccccaccaccagcttccgccccaacacctgaaaccgagcccgaggagcccgcacaggcccctcctgcccaatcaactcctacccctggggtagctgcagcacctacactagtctccggcggaggttccacctcttcaactagcagcggctcgttcgaggctagtcccgtggaaccacagctgccctcaaaggagggcccagaacccccagaagaagttccaccacccaccaccccaccagtcccgaaggttgaacctaaaggcgacggaatcgggccaactcgccagccaccgagtcagggcttaggttaccctaagtatcaaaagagcctgccccctcgatttcaaaggcagcagcaggagcagctactgaagcagcagcagcagcaccaatggcagcagcatcagcaggggagcgccccacccacacccgtgccaccaagccctcctcagcccgtgacactgggcgcagtgcccgctcctcaggcccctccgccaccaccaaaggctttgtatcccggagctctgggaaggcctccccctatgccgcctatgaacttcgacccgcgatggatgatgattcccccatatgtggaccctaggctgttacagggaagaccaccattggatttctacccaccaggtgttcaccccagtgggctcgtcccgagagagaggagcgattctggcggttcatcaagcgagcctttcgatagacacgcacctgcaatgctgagggagcggggaaccccgcctgtcgatcctaaactcgcatgggtgggagacgtgtttacggcgactccagcggagcccagacctctcaccagcccgttaagacaggccgcagatgaggatgataaaggtatgcggagcgagaccccccctgtccctccccctcctccttacctggcaagttatcctggtttccccgagaacggagccccaggacccccaataagcaggtttcctctagaagaaccgggaccacgacccctgccctggcctcccggatccgacgaggtggccaaaattcaaacgccgccacccaaaaaggaaccacctaaggaagagaccgcccagcttaccggcccagaggccggacggaagcctgcccgtggagtcggctctggtggacagggaccaccacccccacggagggaaagtagaacagaaactcgatggggcccacgcccaggctcctctcggcgtggcattcccccagaggagcccggagcaccacctcgcagggccggaccgattaaaaagcctccccctccaaccaaggtggaggagctgccccctaaaccactggagcagggggacgagaccccaaaacccccaaagcccgacccactgaaaattaccaagggcaagcttggcggtcccaaagaaacccctccgaatggcaatctcagtccagcacccagactcaggcgagactattcttacgagcgagttgggccaacaagttgtagaggcaggggaagaggggaatactttgccagaggacggggattcagaggaacatatggcggacgaggcagaggagcaagatccagggaattccgctcttaccgtgaatttaggggggacgatgggagggggggaggcacagggggtccaaaccatcctccggctcccagagggaggacagcatccgaaaccaggtcagagggcagtgagtacgaagagataccaaaacggcgaaggcaacgtggctcagagactggtagcgaaacacatgaatctgaccttgcaccgtccgacaaggaggctccgacaccaaaggagggaacgctaactcaagtgcccctggcgcctccgcctcccggtgcgccaccatcacctgccccagctcgctttactgccaggggcggacgggttttcacccctcggggtgttccatcacgaaggggcagaggtggagggagaccaccccctcaggtgtgtcccggatggtcaccaccggcaaagtcacttgctcccaagaaaccgccaaccggtcccttgccgccatctaaagagcctctcaaggagaagctcattccgggaccactctcacccgttgccaggggcggttctaatgggggtagtaacgtcgggatggaggatggggagcggcctagacgcagaagacatgggagagcacagcagcaagacaaaccccctaggtttcgacgattgaagcaagagcgggaaaatgctgcccgaggctcagaaggaaagccttccttgaccttgcccgcttccgcccctgggcctgaggaagccctcactaccgtgacagtggctcctgcgccacggagagctgccgctaagtcgccagacctgtctaaccaaaattctgaccaggccaacgaagagtgggagacagccagcgagtccagtgactttacatccgagaggaggggggataaggaagctccccctcctgtactgcttacgcctaaagcagtcggaacccccggtggcggaggagggggtgccgtgccaggcatttccgcgatgtccaggggtgacctctcccagcgggcaaaagacttgagtaagaggtccttttccagtcagagaccgggtatggagaggcagaaccgcaggcccggtcctgggggaaaagccggatcctccggaagctcaagcggcggtggaggcggtggacctggcggaagaaccggccctggacggggtgacaagaggtcctggccttccccaaagaaccgaagccggccaccagaagagcgtcccccagggctgcccctccctcctcccccaccatccagcagtgcagtgttccggctggaccaagtaatccactccaacccagccggaatccaacaagcgttggcccaactgtctagtaggcaggggagcgttacagctcctggtgggcatcctcggcataaacccggtctgccgcaggcgccacagggcccttctcccaggcctcctacccgatatgagccacagagggtgaactcaggacttagcagtgatcctcacttcgaagagccaggaccaatggtgcgaggtgtcgggggtactccgagagacagtgctggagtgtctcctttcccccctaagcgacgggaacgcccacccaggaaaccagagctcctgcaggaagagtcactcccaccccctcattcctccggctttctcggctccaaaccagagggaccagggcctcaggcagaaagcagagacaccggcaccgaagccctcacaccacacatttggaacaggcttcacaccgccacctcgaggaaatcctaccgaccatcgtccatggagccttggatggagccactaagccctttcgaagatgtggccggtacggagatgagtcagagtgacagtggagtggacctctccggggactcccaggtatcaagtgggccatgctctcagaggagctcacctgatgggggactaaagggggcagccgaggggccacctaaacgtcccggtggcagtagcccactgaacgccgtcccttgcgagggcccacccggttctgagcctccccgtagacccccaccagcaccacacgacggtgacagaaaggagctgcctcgggagcaaccactcccccctggccctattggaactgagaggtcccagcgtacagacaggggcacagagcccggacctatccgtccttcacatcggccaggccctcccgtccaatttggtacatctgacaaggactctgatttaagactagtggtcggagattctctcaaggccgaaaaagagctcaccgccagcgttactgaagccattcccgtttcccgggactgggaactcctgccatctgctgctgcatcagcagagccacagagcaagaatctcgactccggacactgtgtgcctgaacccagttccagtggccagaggctgtaccccgaggtgttctacggctcagccggaccctctagctcacagataagtggaggggctatggattcccagctgcacccaaattcaggagggttccggccaggcacccccagcctccatccatacagaagccagcctctatacttgccccctggccctgcaccaccttctgccctcctatccggagtggctctcaagggccagtttttggattttagtactatgcaggccaccgagttgggcaaactgcctgccggaggtgtgttgtacccccctcctagtttcctgtattccccagctttttgccccagccccctgcctgacaccagtctcctgcaggttcgccaggacttgccttcaccctctgatttttattcaacaccactgcaacccggaggccagtccgggtttctgccgtcaggggcaccagcacagcagatgcttctgcccatggtagactcccagcttccagtggtgaactttgggtccctgcccccagccccacccccagcaccaccccctctcagcctgcttcctgttggcccagcactccagccgcctagcttagcagtgaggccccctccagcccctgcgacccgggtgctcccttcgccggctcgcccattccccgcaagcttgggacgtgcagagcttcacccagttgaactgaagcccttccaagactaccagaagctttcatctaatcttggaggcccaggctcctcccggaccccacctaccggccgttcttttagcggccttaacagtagactgaaggctaccccctcaacgtacagcggtgtttttaggacgcagagggtcgacctgtaccaacaagctagtccccctgacgccctccgttggatcccaaagccctgggagagaactggccctccgccacgggaaggcccatcccgcagggcagaggaaccaggatcgagaggcgataaggaacccggactgcctccccctcggta

SEQ ID NO: 236228 - DNA, 6473 bp, Artificial Sequence
  Description of Artificial Sequence: Synthetic coding sequence
atgtcagaccggagcggacctactgccaaggggaaggatgggaagaagtatagtagcctgaatctgtttgacacatataagggaaaatcgctggagattcagaaacccgctgttgcccctcgccacggtctacagtccctcgggaaagtggccattgcgaggcgcatgccaccacctgccaatcttccgtctctaaaggctgagaacaaaggcaatgatcccaatgttagtttggttccaaaggatggaaccggctgggcatccaaacaggaacaatccgatcccaaaagctcggatgctagtacagctcagcctctcgagagtcaacccttacctgcttcccagactcctgcctcaaatcagcccaaaagacctcccgcagcccctgagaacacccctttggttccttctggggtaaaatcttgggcacaagcttccgtaacacacggcgctcacggggatgggggaagagcgagctctctgctgtcacgcttttcccgggaagaatttcccacactgcaggctgcaggggaccaggacaaggcggcaaaggagcgagagtctgcagaacagtcaagcgggcctggccctagcctgcgtcctcaaaacagcacaacttggagggacggcggtggacggggacctgatgaactcgagggtccagactcaaagttgcatcatggacacgatccaagggggggactccagccaagcgggccacctcaatttcccccatatcgcggtatgatgcccccttttatgtaccctccgtacctcccttttccccctccttacgggcctcagggaccatatcgatatcccactcccgacggtcccagcaggtttccgagggttgctggcccaagagggagcggaccacccatgagattggtggaacccgtggggagaccctcaattctaaaagaagataatttaaaagagttcgatcaacttgaccaggaaaatgacgacggttgggccggagcccacgaggaggttgactacaccgaaaagcttaaattttcagatgaagaagacggacgggactcggatgaagagggagccgagggccaccgggattctcaatctgcctcaggggaagagcgcccaccagaagccgatggtaagaaaggcaacagcccaaattccgagccaccaacacctaagacggcttgggccgaaacctcccgtccacccgagacagaaccaggcccaccagcccctaagcctccattaccgcctccacataggggtcccgctgggaactggggcccacctggtgattatccagatagaggcggtcctccctgcaaacctccagcgccagaggatgaggacgaggcctggcgccagcgacgtaaacaaagctcttctgagattagcctggcagtggaacgggcaagaagaaggcgcgaggaggaggaacgcagaatgcaagaagagcgacgcgctgcctgcgccgagaaactgaaacgtcttgacgagaagtttggggctcctgataaacgcctaaaagcggaacctgccgcaccccctgcggcaccctctactccggcacctcccccagccgtccctaaggaacttcctgctcccccagccccacctccggctagtgcccctacacctgagaaggaacccgaggaacctgcacaagctccgccagcccagagcactcccacccctggcgtggcagccgctcccacacttgtgagcggtggaggatctacgtcttccaccagcagtgggtcattcgaggctagcccagtggagccccagctgccctccaaagaaggccctgagcccccagaggaggtaccaccccctaccactccgcctgtgcctaaagtcgagcccaagggcgatggaattggccctaccagacagcctcccagccaggggttaggctaccctaaataccagaagtctcttcccccacgattccagaggcagcagcaggaacagcttttaaagcagcagcagcagcaccagtggcaacagcaccagcaggggagtgcccctcccacgcctgtccctccctctccgccacagccagtgactctcggagctgtgcccgctccacaggcaccacctcctccacctaaggccctctaccctggcgcactgggcaggccacctccaatgccaccgatgaactttgaccccaggtggatgatgatcccgccatacgttgatccgaggctgttacaaggacgcccacccctggacttttaccccccaggcgtgcaccccagcggtcttgtgccacgggaacgcagtgatagcgggggtagcagcagtgagcccttcgaccgccatgcgccagctatgctgcgggaaagaggcactcctccagtggaccccaagctcgcttgggtgggggacgtattcaccgccacacccgctgaacctcgccctctgactagtccactccggcaagccgcagacgaggacgacaaaggcatgagatcagaaacgcctccggtgcctccaccaccgccttacctcgcttcgtaccctgggttcccggaaaacggagcgccagggcctcccataagccggtttcctctggaggaacctgggccacggcctctgccctggccgcctggctcggacgaggttgcaaaaatacagaccccccctcctaagaaggaaccccctaaggaggaaacagcacagctcactgggccagaagcgggaaggaaaccggcacggggtgtgggcagcggaggccaggggcctccaccacctcgacgcgagagtagaacagaaacccgctgggggccacgcccagggagttctaggagaggtatcccaccggaggaacctggagccccacccaggcgcgctggcccaatcaagaagcctccaccaccaacgaaggtggaggagctgccccctaaacccttggagcagggtgatgagactcctaagccccctaagcccgacccactgaagattacaaaaggcaaattgggcggtcccaaggaaacgcctccaaatgggaatttgtcgccagccccacgcctgaggagagattattcatacgagcgagtgggtccaaccagctgccggggtagaggcaggggagagtattttgctcgagggcgtggcttccgcggaacctacggcggaagagggcgaggtgcccgaagccgcgaattccggagttatcgagaatttagaggcgatgacggtcgaggagggggaacagggggtcccaatcacccgccagcccctaggggaaggacagcttcagaaacgagatctgagggcagtgaatatgaggaaataccaaaaaggcgcagacaaaggggatctgagactggatctgagactcatgaatcagaccttgctccaagcgacaaagaggccccaacccccaaagagggcaccctaacgcaagttcctctggcccctcccccaccaggcgcaccccctagtcctgctcccgctcgttttactgcacgaggaggccgtgtgtttactccaaggggagtgccgtcaaggaggggcagggggggagggcgacccccaccccaggtatgcccgggatggagccccccagcaaaaagcttagcccctaagaagccgcctacaggacccctgcccccaagcaaagagccccttaaggagaaactcattccagggccattatcacctgttgctcggggaggttccaacggaggctctaacgtaggtatggaagatggagaacgacctcgtaggcgtagacatggaagagctcaacagcaggacaagccgcctaggtttaggaggctaaagcaggagcgggagaacgccgctcgcggatcagagggaaaaccttctctgactctccccgcaagcgctcccggacctgaagaggctctcacaacagtgacagtagcccctgcacccagacgggcagccgctaaaagtcccgatcttagtaatcagaatagcgaccaagccaacgaggagtgggagaccgcctctgaatcatccgatttcactagcgaacgcagaggagacaaagaggccccaccccctgtcctgctaactcccaaggcggttgggacaccaggaggcggaggaggcggagccgtacccggtattagcgcaatgtcacggggagaccttagccaaagggcaaaagatctaagcaaaagatcattctctagccagcgtcccggaatggagcggcagaaccgaaggccaggccctggagggaaggcagggagcagcggcagttcatccggtggcggtggcggagggccaggtgggcgtacaggcccaggaagaggggacaagcgttcctggcccagtcccaagaatcggtccagaccaccagaagaaaggccacccggattgcctctgccccctcccccaccgtcttcatctgctgtctttcgattagaccaggtgattcacagtaaccccgcaggcattcagcaggctctggcccagttgtcttctcggcagggtagtgttaccgcccctgggggacatccccgacacaagcctggaccgccacaggcaccgcaggggcctagtccaaggccgcctaccaggtacgaacctcagagggtcaactccggactgtcttcagatccgcacttcgaagagcctggccctatggttagaggcgtgggagggacccccagagattctgctggggtttctcccttcccgccaaagcgcagagaacgcccacctaggaagcctgaattactgcaggaggagtccctgccccctccacacagcagcggcttcctggggagtaaacccgagggacccggtcctcaggccgagtctcgagatacgggcacagaggccctcacaccacacatctggaataggttacacacagccacttctagaaaaagctataggccctcatccatggagccgtggatggagcccctgtcaccttttgaagatgtggccggaaccgaaatgagtcagtccgactccggggtggacctgtccggggatagccaagtaagctctgggccatgttcccagcgctcttcacccgatggcggactcaagggcgcagccgaagggcctcccaagagacctgggggatccagtcccctcaacgcagtcccctgtgaaggccctcccggttctgaacctccaaggcgcccaccacctgcgcctcacgacggggaccggaaggagctcccccgagagcagcctcttccacctgggccaatcggtaccgaacgatctcagaggaccgataggggcacagaaccagggccaatacgcccatcccaccggcctggccctccagtgcaattcggtactagtgacaaggacagcgacctccggttggtagtgggtgactctctgaaggctgagaaggagctcactgcctccgttactgaggcaatacctgtgagtagggattgggagcttctccccagcgcagccgctagcgccgagccccagagtaagaatctcgacagcggccactgcgtccccgagccaagcagctcaggacaaaggttgtatccggaggtgttctatggatcagccggacccagttcctcgcagatttctgggggagcaatggactcccagctacatccaaattctgggggatttcggccaggcacccctagcctccacccttatcgctctcagcctttatatctccctcccggacccgctccgccaagcgctctgctgagcggagtggctctgaagggccagtttctggactttagcactatgcaagcaactgaactgggaaagctccctgccggtggcgtgctgtatcctcctccaagctttttgtattcccctgccttctgcccgtcccctttgccagacacctctctgctgcaggtgcggcaggacctgccttctccgtccgacttctacagtacacccctgcagccaggtggacaatccggattcctgcctagtggagcacctgctcagcaaatgttactccccatggttgattcccagctccccgtcgtcaacttcggtagcctgccccctgctccacctcctgcccctcctcctctgtccctgctgcctgtcggccctgccctgcaacccccttcactcgccgttagaccacccccagcacccgctacccgagttttgccctctcctgctaggccattcccggcatctctggggagggcggagctccacccagtggagctaaaacctttccaggactatcaaaaactttccagcaatttaggcggacccggaagctcacgtacaccccctactggacgttcattctccggtctgaattcaagactgaaggccaccccctctacatattccggagtcttccggacacagagagtcgacctttatcagcaagcctcaccaccagacgctctccggtggattccaaaaccgtgggagcggacaggtccacctcccagagaaggcccaagcagaagggccgaggaacctggctctaggggggataaggagcctggcttaccaccacccaggta

SEQ ID NO: 236229 - DNA, 6473 bp, Artificial Sequence
  Description of Artificial Sequence: Synthetic coding sequence
atgtccgatcgcagcggccctacagctaagggtaaggatggcaagaagtactccagcctcaatctctttgatacatacaagggcaagagtctcgaaattcagaagccagccgtggcccctcgtcacggcctgcagtctctgggcaaagtagccattgctagacggatgccgcctcctgccaacctgccttctctgaaagcagaaaataaaggcaatgaccccaacgtatctctcgttccaaaggacggtaccggctgggcttctaaacaggagcaatccgatccaaagtccagcgacgctagcactgcccagcctcccgaaagtcaacccttgccggcttctcaaacccctgccagtaaccagccaaagcggccaccggctgcccctgagaatacgcctctagtgccatcaggtgtgaagtcctgggcgcaagcttctgtcactcatggcgcacacggagatggcggacgcgcttcgtcactgctgtcaaggttttcacgcgaagagtttccgacactgcaggccgctggagatcaggacaaggctgctaaagaacgggagtctgcggaacagagctccggacctggtccatccctgcgcccacagaattccactacttggagagacggtggcggacgcggacctgacgagttggagggacccgatagcaagctgcatcacggccacgatccaaggggcggactccaaccctcaggcccaccccaattccccccatatcgcggaatgatgccaccgtttatgtatccgccatacctcccgttcccaccgccatatggccctcaggggccttatcgctatccaacaccagacggtccaagccgattcccacgagtggcagggcctcgcggaagcggtcctccaatgaggctggtggaacccgttggcagacccagtattttgaaagaagacaatttgaaagagttcgatcaactggaccaagagaatgacgacggctgggctggcgcacacgaagaagtcgattacacagaaaaactcaagtttagcgatgaagaagatggcagagattcagatgaggagggggctgaagggcaccgggattcccagtccgcatcaggagaagaacgcccacccgaggcagatggtaagaagggtaatagccccaattccgagccccctaccccgaagacagcttgggccgaaaccagtagacccccagaaacggagccaggcccacctgctccgaagccgccacttcctccgccacacagaggccctgccggtaactggggtccaccgggtgactacccagacagaggcggaccgccatgcaaaccaccagccccagaagacgaggacgaggcttggcgtcaacgcagaaagcagtctagctccgaaatcagcctggcagtcgaacgggcaaggcggcgacgagaggaagaggaaagacggatgcaagaggaacggagggcagcatgcgcagagaagctcaaaagactggatgagaagtttggcgcacctgacaaaaggctgaaagcagagccagctgctccaccggctgcccctagtacacccgctccccctcctgcggttcccaaggaacttccagctccccctgccccaccacccgctagtgcccctacacccgaaaaggagcctgaagaacccgctcaagcacccccagctcagagcacgccaactcccggagtggctgcagcccctactctggtgagcggcggaggcagcacctctagcacatccagcgggtccttcgaagcctctccggttgaacctcaactgcccagcaaggaggggcctgaaccgcctgaagaggtgccaccacctactacccccccagtgccaaaagtagaacccaaaggggacggcattggtccgacacggcagcccccatcgcaaggactcggctatcctaagtaccaaaagtcattgccacccaggtttcagcggcagcagcaggagcagctgctgaaacagcagcaacagcatcaatggcagcaacaccagcagggctcagccccacccactccagttcccccttctcctcctcagcctgtcaccctcggtgccgtcccagctccgcaggcgcctccccctcctcccaaggctctttacccaggtgccctgggaagacctcctcctatgcccccaatgaacttcgacccgagatggatgatgattcctccgtacgtggatccaagactgctacagggtcgacctcccctagatttctatcctccgggagtccacccctctgggctagtgcctagggaaagaagtgattccggcggttcgtcttccgagccattcgatcggcatgctcctgccatgctgcgggagcgagggactccgcctgttgacccaaagctggcctgggtgggggatgtgttcacagctacgcctgctgagccccgaccccttacctcgcctctgcggcaagccgctgatgaggatgacaaggggatgcgatccgaaacccctcccgttccaccaccgcctccgtatttggcgtcttatcctggcttccccgaaaatggcgctccgggacctcctatcagcagattccccctggaggagccgggacccaggccactcccatggcctcctgggagcgacgaagttgcaaagatccagactccccctccaaaaaaagagccacctaaggaggagactgctcaactgacggggccagaggccggtcgaaaacctgccaggggagtggggtccggcggacaagggccaccgccacctagacgggagagccgcaccgaaaccagatgggggccaagaccgggtagcagtcgtaggggaatcccacccgaggagcccggtgccccacctcggagggccggacccattaaaaagccaccccctcccacaaaggtggaggaactgcctcctaaaccccttgaacaaggagatgagacacccaagcccccaaagcccgatccgcttaagatcactaaaggcaagttgggcggaccaaaggaaacaccacccaatgggaatctttctccagcccctcggctgagacgtgattactcctatgaaagagtgggacccacctcgtgtcgcggaagagggcgtggtgaatacttcgctagagggaggggatttagggggacatacggtggcagaggaaggggggctcggagtagagaatttcggtcttaccgagaattccgaggagacgacggaagaggaggcggaactggcggtcctaatcaccctcctgctcctagaggcaggaccgccagcgaaacaaggtcagagggctctgagtatgaagaaattcccaagaggaggaggcagagggggtcagagaccgggtcggagacacacgaaagtgacctagctccttccgacaaagaggctccaacgccaaaggaggggacactgacccaagtgccactggcacccccaccaccgggagcccctcccagtccagcaccggctcgcttcacagccagaggcggtcgagtgtttacgcccaggggtgtgccttcccgcagggggagaggtggagggcgtcctcccccacaagtgtgcccagggtggtcgcctcccgcaaaatccttggcccctaaaaagccaccaacaggcccactgccacctagcaaggaacctctcaaggaaaaattaatccctggccctctgtcccctgtggcacgagggggatctaatgggggatccaacgtagggatggaggatggtgaaagacccaggaggcgccgtcatggcagagcccagcagcaggacaagccgcctcgctttagaagattgaagcaggaaagggagaacgccgcaagaggttcggaaggcaaaccaagccttactctacctgcgtcagctcccggaccagaggaggcgctcaccacagtaacggtggccccagcccctcggagagccgcagccaagagccccgatctctctaaccaaaattctgatcaggcgaacgaagaatgggaaacagctagcgaaagcagcgatttcacctcagaacggaggggagataaggaggctccacccccagtgctgttgaccccaaaggctgtcggaacccccggaggtgggggagggggagcggtgccagggatttccgctatgagccgcggagacctgagccaacgggctaaagatctgtccaaacgctccttctcaagtcagagaccaggcatggaaagacaaaacaggcggccaggccctggaggtaaagccggatcctcaggcagctcttctgggggaggcggaggagggccaggtggaaggacaggaccgggtcgcggagataaacggagctggccaagccctaaaaacagatcacgccctccagaagagcgtccccctggacttcctctgccccctccacctccgagcagctccgctgtgtttcgactcgaccaggttattcactcgaatccggctgggatccagcaggctctggcccagctcagcagtaggcaggggtcagtgaccgcaccaggcggtcatccgaggcacaagcctgggccaccccaggctcctcaagggccatctcccaggccgccaactcgttacgaacctcagagggtaaattctggcttgagctctgatcctcacttcgaagaacctggcccaatggtgcgaggagttggcggaactcccagggactcagctggggtctctccattcccacctaaacgtcgggaacggcctcccagaaaacccgaactcttacaggaagagagcctccctcctcctcacagttcgggatttctcggttcgaagccagaagggcctggaccacaggccgaatcccgtgacactgggacggaggcactaaccccccacatctggaacaggcttcacactgcaacaagccgaaagtcgtatcggcctagttccatggagccctggatggaacctctttctccatttgaagatgtggcgggtacagagatgtcccagagcgatagcggcgttgatctctccggggattctcaggtcagttccgggccttgttctcagcggtccagtccagacgggggattaaaaggagctgccgaaggccctcccaaacgacctggaggttctagcccactgaacgctgtaccgtgtgaaggccctcctggttctgaacctccaagacgtccaccacccgctccccatgacggcgatcggaaggagctccctcgagaacaaccactccctcccggacctatcggcactgagaggtcccagcatacagaccgcggtacagaacctggaccaatccgaccaagtcaccggccaggtccccctgtgcagttcggtacctccgacaaagacagcgacctcaggctggtggtcggggacagcctaaaggctgaaaaggagctgaccgccagcgtgaccgaggccatccctgtttctagggactgggagttgctgcctagcgctgccgctagcgccgaaccccaaagcaagaacctggattctggccattgcgttcccgagccaagctcctccggccagagactttaccctgaggttttctacggcagcgccggacctagtagcagccaaatctccggtggcgctatggacagccaactgcacccgaatagcgggggattcagacccggtacaccctctctgcatccataccgttcccaacctttatatctgcctcccggtcctgctccaccctcagctctgcttagtggcgttgccctgaagggacaatttctcgatttttccacgatgcaggcaaccgaattaggaaaattgcctgcaggaggcgtattgtaccccccaccatctttcctttattctcccgctttctgcccgtcaccgctgccagatactagtttgttacaggtcagacaggatttaccctcacctagcgatttctactccacaccacttcagcctggtgggcagtcgggcttcctgcccagcggggctccagcacagcagatgctgctgcccatggtcgattcacagcttcctgtggttaatttcgggtcgctgccgccagcccctccacctgcacctccttccttgtccctgctgccagtgggccctgctctccagcccccaagcctggcagtgcgacccccaccagcaccagccacgagagtactccccagtcctgccaggccatttccagccagcctgggtagagcagaactgcaccctgttgaattaaaacccttccaagactaccagaagttgagctccaatctcggcggacccggtagttcacgcactcctcccacggggaggagctttagcgggctcaatagcagactgaaagctacgcccagtacatatagcggggtgtttagaactcagagggtggacctttatcagcaggccagccctcccgatgcactacgctggattcccaaaccctgggaacgaactgggccaccgcctagagaggggccatcacgcagagccgaggaaccaggcagtcgcggagataaggaacctggactcccacccccaagata

SEQ ID NO: 236230 - DNA, 6449 bp, Artificial Sequence
  Description of Artificial Sequence: Synthetic coding sequence
atgtccgatcggagtggaccaactgctaagggtaaagatggaaaaaaatacagtagcctaaatctcttcgacacctacaagggaaaatcacttgagattcagaagccagccgttgctcccagacacggcttgcaaagtctggggaaggtggcaatcgcacggaggatgcccccacccgcaaatttaccgagtttgaaggctgaaaacaaaggcaatgacccaaacgtgtcactggtgccaaaggacggaacaggctgggctagtaaacaggagcagagcgatcccaagagcagcgatgcatctacagcccaaccacctgagagtcagccactccctgcgtctcagacacctgcatcaaaccagccaaaacgaccgccagcggctccagagaatacccccctggtgccttctggcgtgaaaagctgggcccaggcgagcgttacacatggagctcatggggatggtggcagggctagctcccttctgtctaggtttagtcgcgaagagtttccaactctgcaggccgcaggagaccaagataaggcagctaaggagcgcgaaagcgcagagcagtccagtggaccgggaccttccttacgtccccaaaacagtaccacttggcgggacggagggggacgcggaccagacgagctagagggccctgactcaaaactgcatcacggtcacgatccacgcggtggacttcagccatccggaccccctcagtttccaccgtacagagggatgatgcctccttttatgtatccaccttacttgcccttcccgccaccctatgggccacagggcccttaccggtatcctactcctgatggaccaagccggttccctagggtcgccggaccgagaggtagcggcccaccaatgcgcttagtcgaaccggtggggcgtcctagtatcctaaaggaagacaacctcaaggagtttgatcagctggaccaggaaaacgacgacggctgggcaggcgcacatgaggaggtcgattacactgaaaagctgaagttctccgatgaggaggatggcagagatagcgatgaagagggggcagagggacaccgtgatagtcagtctgcttccggagaggaaaggccacctgaggcagacgggaagaaagggaactccccaaacagtgagcctcctactcccaagaccgcttgggccgagacgagcagacccccagagaccgagccaggaccacctgcccctaagccacccctgccgcctccccaccgcggacccgctggcaattggggaccccctggcgactacccagatcgaggagggcctccctgcaagcctccggcacccgaggatgaagatgaggcctggcgacagaggaggaagcagtctagttcagaaatcagcctggctgtagagcgcgcacgtcgcagaagagaggaggaggagcgacgtatgcaggaggaaaggcgggctgcgtgtgccgagaagctaaagagattagacgagaagttcggtgctcctgataagcggctgaaagctgaaccggctgcccctcccgcagcccctagtacgccagcaccacctcctgccgtgccgaaggaactgcctgccccaccagcccctccaccagccagtgctcctactccggagaccgaaccggaagaacccgctcaggcccctcctgcacagagcactcccacccctggagtagcagcagctccaaccctggttagcgggggtgggtccacatcgagcaccagcagcgggagctttgaggcttccccagtggaacctcagctgccctctaaggagggccctgaacccccagaggaggtgccacccccaacgacccctccagtgcctaaagtggaaccaaagggggatggtataggaccaacaagacagccgccatcccagggactgggataccccaagtaccagaagtccctgccgcctcgtttccagcgacagcagcaagaacagctgctgaaacagcagcagcagcaccagtggcagcagcaccagcaggggagcgcgccaccaacacctgtacctccttccccgccacagccagtcacgctgggggcagttcctgcccctcaggcacccccacccccacctaaggctctataccccggagccctcggtcgtccaccaccgatgccccctatgaattttgacccgagatggatgatgatccccccttacgttgaccctcggttactccagggcaggcctcccctggatttttaccctccaggtgtgcatccgagtggtctggtgcccagagaaagatccgattccggcggtagttcaagtgaaccattcgatcgtcacgcacccgcaatgttgcgagagcgcggtacgcccccagtggatccaaagctcgcctgggtgggagatgtatttaccgctacaccagcagagcctaggcccctcactagcccccttcggcaggcagccgatgaggacgacaagggtatgcggagcgagacccctccagtacccccaccacccccatatctggcaagctatccaggcttcccagaaaacggagcccctggcccacccatttccaggttccccctcgaagaacccggaccaagacctctaccctggcccccaggttctgacgaggtggccaaaatacagacacctccaccgaaaaaagagccccctaaagaggagactgcacagctaaccgggccagaggccggaaggaaacccgcaagaggcgttgggtctggtggacaaggtccacctcctcccaggcgcgagtcccgcacagagacgaggtggggaccaaggcctggctctagtcgacggggaataccaccagaggagcccggagctccgcctcgcagagctggacccataaaaaaacctccaccccctactaaggttgaggagctccctccaaaacccctggaacagggagatgagactcctaagccgcctaagcccgaccctcttaagatcacgaaagggaaattgggagggcctaaggaaactcctccaaacggcaatctgtcccctgccccaaggttgcgaagggactacagttatgagagagtcggtcccacatcatgcagagggaggggcagaggcgaatactttgcgagaggccgaggcttccgaggcacatatggtggccgtgggcgtggagccgcagggaacagcgccgtgactgaaagctttgaagagatgatgggcgtcgaggtagggcagggcgatcagaccacccttcttctgcctgaggcagcccttccagctcgacatggagctagggtccagagcatgcgcaagagcccatcaggggcaggatctggcgctcagaagcaggccgctcggcctatgcgcgttatctggctcctgcagacgagaagactgccacacccaaggagggagcactccccaaggtcgaggtcccccaccactaggtcacccacattcccagcgccagcgagatttaccccaggcgtgggagagtccagcttgcccgaaggcatctctcccggtccccgtcggcgtgagcccccacaggtgtgccctgggtggtcacctccagcaaaatcacttgcacctaaaaagcccccaacgggacccttgccaccctctaaggagccactgaaggagaaactgatcccgggtccgctgtctcctgtggcacgagggggatccaatgggggtagcaatgtgggaatggaggacggagagaggccccgtcgcaggcggcacgggagggcccagcagcaagataagcctccaagattcagacgtctcaaacaagaacgtgaaaatgctgctcgcggttctgagggtaagcccagcttaacgctgcccgcaagcgctccaggtccagaagaggccctaaccacagtgacagtcgcccctgccccacggagagcagccgcaaagtcacctgatctatctaaccagaactccgaccaagctaatgaagaatgggaaactgcctctgagagctccgatttcacaagcgagcgcaggggcgacaaagaggcacccccaccagtcctgctgactcccaaagcggtgggcacccccggtggcggaggtggaggggctgtgccaggaatttcggctatgagccgaggcgacctcagtcagcgcgctaaggatctctccaaacgctccttcagcagccagcgaccgggaatggagcgacagaatcggaggcccggtcccggaggaaaggccggtagttctgggtcatcatccggcggtggtggaggcggaccagggggtcggaccggccctggcaggggcgataaaaggagttggccaagccctaagaaccgaagcaggcctcccgaggagagacctccaggcttaccgctgccaccacctccgccatccagctccgccgtatttcggttagaccaggtgatacacagcaaccccgctgggattcagcaagcactggctcagctgtccagtcgacaggggtctgtcacggcaccaggaggccacccgcgtcataaaccaggcttacctcaggcgcctcagggtcccagccctagacctccaacgcgatatgagcctcagagagtgaacagcgggctgtcctctgaccctcacttcgaggaaccaggcccaatggttagaggcgttggcggtacacctcgtgactccgcgggtgtttctcccttcccccctaagagacgcgaaaggcctccgcgaaaacctgagcttcttcaggaggagagtctcccacctcctcatagctccggcttcctgggcagcaaaccggaagggcctggaccacaggccgaatcacgagacactggaactgaggcactgacgccccatatctggaaccgtctacacacggcaacaagccggaagagttaccgcccatcttcaatggaaccgtggatggaacctttgagccctttcgaagatgtagccggtacagaaatgagccagagcgattcaggcgttgacctgtctggagactcccaagtctcttctgggccatgctctcagcgatcttccccagatggaggccttaagggcgctgcagagggacccccaaagcgcccaggcggaagcagcccattgaacgctgttccatgtgaaggaccaccaggaagtgagccaccgcgaagacctcctccagccccacacgacggtgatcgcaaagaacttccaagagagcagccgctgccgcctggcccaatcgggaccgagagatcccaacggaccgacagaggtactgagccaggccctatccgcccttcccatcgccctggccctccagtacagttcggcacatcagacaaagacagcgacttacgactcgtggtgggcgacagcctgaaggccgagaaggagttgacggcttcagttacggaagccatccctgtgagtagggactgggagctgctgccaagtgcggctgccagtgccgaaccacagtctaaaaacctcgatagtggtcactgtgtgcccgagcccagctcatcaggccagaggttatacccagaggtgttttacggcagcgccggaccaagttccagtcagattagcggcggtcatggcttgtcgattacttccaagcagtggcgcaggcctgggaccccatcccttcacccctatcggtcacagccactgtatttgccccctgggccagcgcctcccagtgccctattatctgggctggccctcaagggccagtttctcgactttagtactatgcaagcaaccgagctgggtaagctgcccgctggtggtgttctctatcctccgcctagctttttatattctcccgctttctgcccttcccccctccccgatacatcactcctgcaagttcggcaggacctgccctcaccttcggatttctactcaacacccctccagcccggtgggcagagcggcttcctgccctctggtgccccagcccagcaaatgctgcttcctatggtcgacagccagctgccagtggtaaactttggctcgctccctccagccccacccccagccccaccgccactgtcactgctccctgtcggtcctgcactgcagcctccctctcttgccgttaggccccctccggctccagccacgagggtgttgccaagccccgcacggccattcccagcaagcctgggccgtgcagaactgcacccagtcgagcttaagccttttcaggactaccagaagctttcatcaaatctcgggggacccggtagctctaggacaccccctaccggacgatcctttagcggactgaactcacggctgaaggctactccttcaacatattctggcgtcttccggacccagcgtgtggacctctaccagcaggcctcaccccctgatgcgttgcgctggatcccaaagccctgggaaaggactggaccaccacctagagagggcccatctcggagggcagaggagccgggttcccgcggtgataaggagcccggtttacctcccccacggta

SEQ ID NO: 236231 - DNA, 6473 bp, Artificial Sequence
  Description of Artificial Sequence: Synthetic coding sequence
atgtctgaccggtccggccctactgccaaaggaaaagatggaaagaaatacagttctctaaacctgtttgacacttataagggaaaatcattagagatccaaaagccggctgtagccccacgtcatggcttgcagtccctggggaaggtggccatcgccagacgaatgcctccccctgccaatctgcctagcctgaaggcggaaaataagggaaatgaccccaatgttagtctggtgcccaaagatgggacaggctgggcctccaagcaggaacaatctgaccctaagagcagtgacgcatccacagcgcaaccccctgagtcgcagccattgccagcgtctcagaccccagcttccaaccagcctaagaggcctcctgctgccccagagaacacgccgctggtaccatcaggggttaagtcctgggcccaggccagcgtgactcacggagctcacggggacggcggacgggcatccagcctcctgtcccggttctctcgcgaggagtttcccactttacaagcggcaggtgaccaagataaagccgctaaggagcgggagtccgcggaacagtcttctggacccggtccctcgctcagacctcagaatagcactacatggagagacggaggcggacgcggtcctgatgaactggaaggccctgactcgaaactgcatcacgggcatgatccaaggggcggtctgcagccatctggaccccctcagtttcccccataccggggaatgatgcccccatttatgtatcctccatatcttccattccccccaccatatggaccacagggcccatatagataccctacaccagacggcccttcccgcttccccagggtggcaggccctcgcggttctgggcctcctatgcgcctcgtcgagcccgtgggaaggccgtcaattctcaaagaagacaaccttaaagagttcgaccagctggaccaggagaacgatgacggatgggccggtgcacacgaggaagtcgactacacggagaagctcaagttcagtgatgaggaggatgggcgagactcagatgaggaaggtgccgaagggcatcgcgactcccaatccgcctctggcgaggagcggcctccagaagcagacggcaagaaaggtaattcacccaactctgaaccccctacacccaagacggcctgggcggagaccagtcgtccgcctgagaccgaacccggtcccccagccccaaagccgcctttgcctcctccacacaggggcccagcagggaattggggaccccctggcgactacccggatagaggcggtcctccatgcaagccccctgcccctgaagatgaagacgaggcttggagacaacggagaaaacaatccagtagcgaaatctcattagctgttgagcgagcaaggcgccgtcgagaggaagaggaacgcagaatgcaggaagaacggagagcagcatgcgctgagaaactcaagcggctggacgaaaaatttggcgctccagacaagaggcttaaggcagagcccgcagcgccaccagccgcaccctcaacaccagctccaccccctgctgtgcccaaggaactgcccgcacctcccgcacccccaccagccagcgcacctacacctgaaaaggaaccggaagaacctgcgcaggcaccccctgctcagtccacccccacaccgggagtcgccgcagcaccaaccctggtgtcaggcggaggcagcactagctccactagttccggaagcttcgaggcatctccggtggagccacagctcccctctaaggagggacctgaacctccagaggaagtgccacctccaacgactccaccggtgccgaaggttgaaccgaaaggggacggaatcggcccaactcgtcaaccaccaagccaggggctggggtatcctaaataccagaagagtttaccccctcgatttcaacgtcagcagcaggagcagttgctcaaacagcagcagcaacatcaatggcagcagcatcaacaggggtccgcccctcctacccctgtaccgccatcgcctccgcagccagtcactctcggggctgttcctgccccacaggcccctcctccacctccaaaggccttatatccaggagctctgggtagacctccgccaatgcctccgatgaactttgacccccgatggatgatgattccaccatatgttgacccacgcctgctgcagggtagaccaccacttgacttctacccacccggtgtgcaccccagtggcttagtgccaagagaaaggtccgattctggaggatcttcatcagaacccttcgacagacacgcacctgccatgctgcgcgagagaggcacccctcctgtcgatcccaaattggcctgggtcggagatgtttttaccgccactcccgcagagccccgaccactgacttcccctctgcgccaagctgctgacgaggatgacaagggtatgcgctcagagactccccctgttcctccacctcctccttacctggcaagttatccgggatttcctgaaaacggcgctccaggacccccaatctcccgcttccccctggaagaaccaggcccacgcccactcccatggccaccaggctctgatgaagtggctaagatccagacacccccaccaaagaaagagcctcccaaggaggagaccgcccagttaaccggccctgaggcgggaagaaaacccgcacgtggcgtcggctccggcggacaaggaccacctcctccacggagggaaagcaggactgaaaccaggtgggggcctagaccaggaagctcccgcaggggaattccacccgaggagcctggcgctccccctcggagggctggccctataaagaaaccccctcctccaaccaaggtggaagagcttcccccaaaacccctggaacagggtgatgagactccaaaacctccaaaaccagacccccttaagatcaccaaaggcaagttaggcggacccaaggaaacgcctcctaatggcaacctgtcacccgcacctcgcttaaggagggactattcgtacgagagggttggccctacctcgtgccgcggacggggtagaggagaatactttgccagggggcgaggattcagaggtacttacggaggcagagggagaggagcgagatcgagagagttccgaagctatagagagtttaggggtgatgatggcaggggtggaggtaccggagggccaaaccatccacccgctcctagagggcgtacagcttcggagaccagaagcgaaggcagcgaatatgaggagatcccgaagcgtcggcgtcagagggggagcgaaactggctcagaaacgcatgagtctgacctggcccctagcgataaggaagctcctacgccaaaggaaggcacgctgactcaggtgcccctggccccaccaccacctggtgctcctccctcccctgcccctgctcggtttactgcgaggggaggaagagtgtttactccacgaggtgttccctcccggaggggtaggggcggtggccgtcctccccctcaggtctgtccagggtggagcccacccgcaaaaagtttggcgcctaagaagccaccaaccgggcctctcccgccttctaaagagcccctgaaggagaagctaattcccggaccactcagcccggttgcccgaggcggatccaacggcggatccaatgtcgggatggaggacggagagcggccacggaggaggcgtcacggcagagcccagcagcaagacaagccaccacggtttaggcggctaaagcaagaacgggaaaacgcggctcgaggaagcgaagggaaaccatcacttactctaccagccagtgcaccaggaccggaagaggccctgaccactgtcactgtagcgcctgcacctcgtcgcgcagcagccaagtcccccgatctgagcaaccagaatagtgaccaagccaatgaagaatgggaaacggctagcgagtccagcgacttcacttctgagagacggggagataaagaagctccgccacctgtgttgttgacccctaaggccgtcggaactcccggaggcggaggcggtggagctgtgcccggtattagtgccatgtcccgcggagatcttagtcagcgcgctaaagacttaagtaaacggtcattttcaagccagcgccctgggatggagcggcagaacaggaggcccggaccaggaggtaaggcaggatcctctggctctagctcggggggtgggggaggaggcccaggcggtaggactggtccgggtagaggcgacaaacgctcctggccctcaccaaagaaccgcagcagacctcccgaagaaagaccaccaggattgcccctacccccacccccacctagttccagtgctgtgttccggctggaccaggtgattcacagcaatccggcagggatccagcaggctctggcccaactgagttctcgccagggcagtgtgactgcgccaggtgggcatccgagacataagccaggaccacctcaggcacctcagggaccttctccacgaccccctacacgttatgaacctcagcgcgtcaacagcggcctgtctagtgatccgcatttcgaagagcctgggcctatggtacgcggagttgggggaactccgagggatagcgcgggagtgtctcctttccccccaaaaagaagggagaggcctccgagaaaacctgagcttctgcaggaggagagcctgccccctccgcacagcagcggattccttggcagtaagccggagggacccggtcctcaggctgagtcacgggacaccggaacagaagctctaactccccacatttggaacagactccacactgccacatcccggaagtcgtatcgcccatcaagcatggagccttggatggaaccgctctctcccttcgaggacgttgccggtaccgagatgagtcagtccgattcgggagttgacttaagtggtgactcccaggttagcagcgggccttgctcgcagagaagctcaccagatggaggcctgaagggtgcagctgaaggacccccaaagaggcctgggggtagtagtcctctgaacgccgtgccctgtgagggaccacctggctccgagcctccccgacgtcctccccctgcaccccatgacggtgaccggaaagaattgccaagagagcagcctttacctccaggaccaataggtactgaacgaagtcaacatacagatcgcggtactgagcccggacccatccggccaagccaccggccaggacctcccgtgcagtttgggaccagtgataaggacagcgacctccggctcgtggtgggcgactcactaaaagcagaaaaggagttgacagctagtgtcaccgaagccattccggtctcacgtgattgggagctcttacccagcgctgccgcaagcgctgaaccccagagtaaaaatcttgactctgggcactgtgtaccagagccctccagctccgggcagcggctttacccagaagtgttttatggttctgccggaccctcaagctcccagatctctgggggagcaatggattcccagctgcatccaaattcaggagggtttcgcccagggactccaagcctccatccctacaggtcccaacccctgtacctaccacccggtcccgcaccacctagtgctttgttaagcggcgtggctcttaagggccagttcctggacttttcaacaatgcaagcgacagaacttggtaagttacccgctggcggagttctctacccccctccatcttttctctactcccccgcattctgtccgagtcctttaccagatacgagcctgctgcaagtgaggcaagacctcccaagcccatcagacttctattcaaccccccttcagccagggggtcaatctggctttttgcctagcggtgcccctgcacaacaaatgttgttacctatggtcgacagccagctgccagtcgtgaactttggctcgctgcctccggctcctcctcccgcaccgccttccctctctcttctgcctgtgggtccggcactgcagccacctagcttagcggtcaggccaccgccagctcctgctacaagagtgcttccttcaccagccagaccttttccagcatcccttgggagagctgagctccaccctgtggagcttaaaccctttcaggactatcagaagctttcttcgaatctcggaggccctggaagttcacgcactcctcccacagggaggagctttagcggtctcaactcaagacttaaggctactccttccacctatagcggcgtttttcgcacccagagggtggatttgtaccaacaggcctctcctcctgacgcgctgcgctggataccgaagccttgggaaagaaccggccctccccctcgtgaggggccatctagacgtgccgaggagccaggttctcgcggtgacaaagagcccggattaccaccaccacggta

SEQ ID NO: 236232 - DNA, 6473 bp, Artificial Sequence
  Description of Artificial Sequence: Synthetic coding sequence
atgtctgatagatcggggccaacagccaaaggcaaggacggaaagaaatacagctccctaaatctgtttgatacatacaaggggaagtccctcgaaattcagaagcccgcagtggcaccacgccacgggctgcagtctctcggcaaagtagccatcgctcggagaatgcccccacctgcaaacctccccagcctcaaagccgagaataagggcaacgatcctaatgtgtcactagtgccaaaagatggcactggctgggcgtcaaagcaggaacaatccgatcctaaaagctcggacgcatcaacagcacagccccctgaatcacagcctttgcccgcatcacagacgccagcttccaatcaaccaaagcggcctccagccgctcctgagaatactccgctggttccgagcggagtgaaatcatgggctcaggcttccgtgacccacggggctcacggagatgggggtagggcatcatccttactgagccggttttcacgagaagagttccccacattacaggcagccggagaccaagacaaagctgctaaagagcgggagtccgccgagcagtcttcgggcccaggcccaagcctccggccacaaaactctacaacctggcgagacggcggaggtcggggtcccgacgaacttgaggggcctgactccaagctccaccacggacacgacccaaggggcggtctccagcccagcgggcctccacagtttcctccatacaggggaatgatgccaccattcatgtatcctccatacctccccttcccacctccttacggccctcagggaccatataggtacccaacccctgacgggccttcacgtttcccaagagttgccggaccccgtgggtccgggcctccgatgagactggttgagccagtgggcaggccctctatattgaaagaggataatctcaaagaatttgaccagttggaccaggagaacgatgatggctgggctggcgctcatgaggaggtcgattatactgaaaaattaaagtttagcgacgaagaagacggtcgcgattctgacgaagaaggggctgaaggccaccgagattcccagagtgccagcggagaagagaggccccctgaagccgatggaaagaaagggaactccccaaacagcgagcctcctacaccgaagaccgcctgggccgagacaagtaggccccctgagactgaaccagggccaccggcacccaagcccccattgccaccgcctcatagaggcccagccggaaactggggccctcccggagattatccggatcgcggaggccctccctgcaaaccacccgcacccgaagatgaggacgaggcctggcgtcagcgcagaaagcagagctctagcgagatctccctggccgtggagagggccaggaggagaagggaggaagaggaacgccgtatgcaggaggagcgtagagccgcttgcgccgaaaagttgaagagactagacgagaagtttggagctcctgataaaaggctaaaggctgaacccgcagcaccccctgcggcaccatctacgcctgcccctcccccagccgtccctaaagaattacctgctcccccagctcccccacccgcttccgctcctacgccagaaaaggagcctgaggagcccgctcaagcccctccagctcaaagtacaccaaccccaggggttgcggctgcccctaccctggtcagcggcggaggatccacatcatccactagctccggctctttcgaggcctcccccgtagagccacagttaccgagcaaggaaggacccgagcctccagaggaggttccccctccgaccacaccccctgtgccaaaagtcgaaccaaaaggcgatgggatagggccaacccggcaacctcctagccaggggttagggtaccctaagtatcagaaaagccttccaccaagatttcagcggcaacagcaagagcagctactgaagcaacagcaacaacatcagtggcagcagcatcagcagggatcggctccacctacaccagtcccgcctagccccccacagcctgtgaccctgggcgctgtgccagcccctcaggcccctccccctccacctaaagctctgtatcccggtgccctggggaggcccccaccgatgcccccaatgaacttcgaccctcgctggatgatgattcccccttatgtcgacccgagactgctgcaaggcaggccgcctttggacttttaccctccaggcgtccacccttctggcctcgttcccagggaacgctctgatagcggtggaagttcctctgagccattcgaccgtcacgcgcctgccatgctcagggaacgcggaactcctccggtcgatcccaaattagcctgggtaggcgacgtattcaccgctacaccagccgaaccaaggcctctgactagccctctcaggcaagctgctgacgaagacgacaaaggcatgcggtccgaaacacccccagtgccacctcccccaccgtacttagcttcttacccaggctttcctgagaacggcgctcccggacctccaattagtagatttcccctcgaggaaccgggtccacggcctcttccctggccgcctggctcagatgaggtggccaagatccagacaccgcctccgaaaaaggaaccacctaaggaggagacagctcagctcaccggtccagaggccggtaggaaacccgctagaggggtgggttcaggcggtcagggtcctcctcccccacgcagagaaagtcgtacggagaccagatggggcccaaggcccggatcgtcacgtaggggaatccccccagaagagcctggcgctcctcctcggagggcaggccctatcaaaaaaccacctccccctaccaaggtggaagaattaccccctaaacctctggagcaaggtgacgaaaccccgaaacctcccaaacccgacccgctgaaaattacaaagggaaaactgggaggacctaaagagacccctccaaacggcaatctgtctcctgcccctcgtttacgacgggactattcatacgagcgcgtaggaccaacatcttgtaggggcagaggtcgaggtgagtacttcgcccgaggcaggggcttcaggggaacgtatggagggaggggaaggggcgcacgatctagagaattccgctcctatagagagtttcggggtgatgatggcaggggcggaggcactggtggacctaaccacccacccgctccacggggtcgaaccgcttccgagactcgcagcgaagggtcagaatacgaagaaatccccaagaggcgcagacagcgaggcagcgagactgggagcgagactcatgagtcggatcttgcaccttcagataaggaagcgcctacacctaaagaagggacactgacacaggtccccctggctccaccccctcccggagcgcctcctagccctgcccctgcccgttttaccgccaggggaggaagggtgttcacaccacggggtgtgcctagtcggaggggcagaggaggcggaagaccccctccacaggtctgccctgggtggtcacctcccgctaagagtctcgcacccaaaaaaccgcctacaggccctctgcctccatcaaaggagcccttaaaggagaagctaatccctggaccactctcccccgtggctagggggggaagcaacgggggttctaacgtagggatggaggacggagagagaccccgacgcagacggcacgggcgtgcccagcaacaagacaaaccacccaggtttcgtcggctcaagcaggaacgagagaatgcagctcgtggatctgagggcaagccatctctgaccctaccagcttctgcgcctggcccagaagaggccttaactacagtaacagtggcacctgcccctagaagggcagccgcaaaaagccctgatctttcgaaccagaactctgatcaggccaacgaggagtgggagacagcttcagagtcttcggattttacttcagaacgtcggggtgacaaagaggctccccctcccgtcttattaacgcctaaagcagttggaactccgggtggaggcggaggaggagctgtgcccggaatcagtgcgatgtcaagaggggacctgagccagagagctaaggacctgtctaaaaggagcttctcctcccaacgacctggcatggaacggcagaaccgaaggcccggtcccggtggcaaagcagggtcctccggatcctccagcggcggtgggggtggcggaccgggaggtcggacaggccctggtcgaggtgacaagcgtagctggcccagcccaaaaaataggagtcgtccacctgaagaaaggcctcccggtctgccactgccccctcctcccccatcatccagtgctgtttttcgcctggaccaagttatacattctaatcctgctggcatccagcaagccctggcccagttgtcttcccgacagggatccgttaccgctcccggaggacacccacgacacaagcctggacctccacaggctcctcaaggcccttctcctcggccacctactcggtatgaacctcagagagtgaactccggtttaagttcggaccctcactttgaggagcctggcccaatggtgagaggggtgggagggacccccagagactccgcaggcgttagcccctttccacccaagcggagagaaagaccacctcggaagcctgaactgttgcaagaggagagtctgccccctcctcatagtagcgggttcctgggctcaaaacctgagggcccaggcccacaggccgaaagccgtgataccggaacagaagctctgactccccacatctggaatcggctgcatacagccaccagcaggaaatcatatcgtccatcatcaatggaaccgtggatggagcccctctctccgtttgaagatgtggccggaaccgagatgtcccaatctgattcgggggtggatctgtcgggcgacagtcaggtatcctcgggaccctgctctcagaggtcttcgcctgacggaggactgaaaggggcagctgagggcccacctaagcggcctggtggttcctctcctttaaacgctgtcccttgtgagggcccacctggctctgaaccacctaggcgacctcctcccgctccacacgacggagaccgcaaggaactgcctagggaacagcccctgcctccgggacccattggcactgaacggtcccagcataccgatcgcggaacagagcctgggcctatccggccaagccaccgcccaggccctcccgtgcaatttggaacctcagataaggactctgacctgcggttggttgtcggagacagccttaaggccgagaaagaactgaccgcgagcgtcacagaggcaatcccggtgtccagggactgggagctgctaccctctgctgcagcatcggcggagcctcagtccaagaatctcgactccgggcattgtgtacccgagcctagcagctctggccaaaggctctatccggaagtcttttatggatccgccggaccgtcttccagccagatttccggaggggcaatggattctcagttgcaccctaactccgggggatttcgaccgggaactccttccctgcacccatacaggagccaaccgctgtatttaccccctggacctgcacctccaagcgccctgctatctggagtggccttaaaaggccaatttctggattttagcacaatgcaggccaccgaattgggcaagctcccagcgggaggggtgctgtatcctcccccatcctttctgtactctccagcgttctgcccatcccctctgcctgacacctctttgctacaggtgaggcaggatctccccagcccaagcgacttctactccaccccccttcagccaggcggacagtctggatttctgccaagtggggctcctgcccagcaaatgctgctaccaatggtcgattcacagctgcctgtggtgaactttggttccctgcctcccgctcctcctcctgcacctcccagtctctctctgctcccagttgggcctgccctccagccaccctctttagccgtccgtccgcctcctgctcccgctacaagggtcttgcccagcccagctagacccttccccgctagcttgggaagagccgagctgcacccagttgaactgaagccatttcaggattaccagaaactgtcctctaatctgggcggacctggaagcagcaggacccccccaacagggagatcttttagcgggctgaatagccgcctcaaggccacaccgtccacctactcaggagtctttcgcactcagcgagtcgacctttaccagcaggcttctccgcctgatgccttacgatggattcctaaaccgtgggagcgcacaggccctcctcctcgggaagggcctagcagacgagccgaggaacctggcagcagaggtgacaaggagcccggtcttcctccaccacgata

SEQ ID NO: 236233 - DNA, 6473 bp, Artificial Sequence
  Description of Artificial Sequence: Synthetic coding sequence
atgagcgaccggagcgggcctacagcaaagggaaaggatggaaagaagtatagctccctcaaccttttcgacacatataaggggaaatccttagaaatacaaaaaccggcagtggcaccaaggcatggcctccagagcctcgggaaggtcgcgatcgccagacggatgccaccccctgcaaatctgccaagtttaaaggccgagaacaaagggaacgatcccaatgtctctctcgttcccaaggacggtacaggctgggctagtaagcaagagcagtccgacccaaagagtagtgatgcttctaccgcgcagcctccagagtcccagccactgcccgcttcgcagacccctgcaagcaaccagcccaagcgaccgcctgctgccccagaaaataccccacttgtgccgagcggggtgaaatcctgggcacaggcaagcgtaacacacggtgctcatggtgacgggggtagggcctcaagtctgctttcgcggttttctagggaggaatttcccaccttgcaggccgcaggagaccaggacaaggccgctaaggaaagggagtcggctgaacagagctcaggacctggtccttctctgcggccacagaattccacgacatggagggacgggggaggcagaggccctgacgagctcgaggggcctgattcaaaactgcaccacggacacgaccctagggggggtctccagccttctggccctcctcagtttcccccatatagggggatgatgcccccttttatgtacccgccttatctcccctttcctcccccatacgggccacagggaccataccgctacccaacacccgacggcccaagccgcttccccagggtggctggacccagagggagtggaccacctatgcgcttggtggagcccgttggccgaccaagcatcctcaaggaagacaatttgaaagagtttgatcagctggatcaagagaacgatgacggctgggctggtgcccacgaggaagtggattacaccgagaagcttaagttcagcgacgaagaggacggcagagactcagatgaggaaggagccgaaggacacagagactcccagagtgcaagcggggaggaaagacctcctgaagccgacggtaaaaagggaaactctccaaatagcgagcccccaaccccaaagacagcttgggctgagacctctaggcctccagagacagaacctggccctccagcccctaaacctccccttccgccaccacaccggggacctgccggaaactgggggcctcccggagactacccagacagaggaggccctccctgcaagcccccagccccagaggacgaagatgaagcctggagacaacgtcgcaagcaaagttcatccgaaattagtttggcagtagagagggccaggcggcgtagggaagaagaggaaagaagaatgcaggaggaaagacgggcagcttgtgctgagaaactcaaaagactcgatgagaaattcggcgctccggataaacgtctgaaagccgaaccggctgcaccgccagcggctccgtctacgcctgcccctccaccagccgtcccaaaggagcttcctgcccctccagcaccaccacccgcaagtgccccaacgcctgagaaggaacctgaggagcctgcccaagcccctcccgcacagagcacacccactccaggggtcgccgctgcacccactttggttagtgggggaggctccacgagctctacatcatccggctcgttcgaggcttcacccgtggagccccagctgccaagcaaggaggggcctgagccccctgaggaggtgccaccaccgactacacccccagtaccaaaagttgagcccaagggagatggcatcggccctacacgccaacccccatctcaaggtctcggctaccctaagtaccagaagtcgctgccgcctcggttccaacgtcaacagcaggagcagctcctcaagcagcagcagcagcaccagtggcagcaacaccagcaggggagcgcccctcctacaccagtgcctccaagcccaccccaaccagtgacccttggagctgtgccagcgccacaggcacctccgccacctcctaaggcactgtaccccggtgctcttgggagaccccctcccatgcctcctatgaacttcgacccccgttggatgatgatacctccttatgtcgatcctaggcttctccagggcaggccgcctctggatttctatcccccaggggtgcacccttccggactggtaccaagggaacgatccgactctggtggcagtagctctgagccttttgatcggcatgccccagccatgctgcgggaaagaggaacccctccagtggaccccaagcttgcttgggttggcgacgtgtttaccgccacaccagcagaaccgcgacccctgaccagcccactaaggcaagccgcagatgaggacgacaagggcatgagaagcgaaactcccccagtccccccaccccctccttatctggcatcataccccggatttcccgaaaatggggctcccggtcctccaatcagccggtttcctttggaggagcccggtccccgtccgctcccttggcctccaggctccgatgaggtcgcgaaaatccagacaccaccacctaagaaggaaccccctaaggaggagacagcacaattaactggtccagaggcgggacgcaagcccgcaaggggagtaggctccggtggacaaggtccaccccctccgagacgcgagtccagaacggaaacacgctgggggcctcggccaggatcaagcaggcggggaatccctccagaagagcctggcgctccgccaagacgggcaggacctatcaagaaacctcctccacccacaaaggtggaggagctgcccccaaagcctcttgagcagggcgatgagacccctaaacctcccaaaccggacccgctcaagattactaagggtaaactcgggggtccaaaggagaccccacccaacggcaacctctcccccgcacccaggctgaggcgtgactactcatacgagcgagtgggccctaccagctgcagaggcaggggtagaggggagtatttcgccagaggacgcggttttaggggcacatacggcggaagaggtcgtggggctcggtcaagggagttcaggagttaccgagaattccggggagatgacggcaggggcggagggaccgggggacccaatcatccccctgccccacgcggtaggaccgcctccgaaactcgctctgaaggaagcgagtatgaggaaatcccaaagaggagacgccaaagagggagtgagactggctctgaaacacacgagtctgacctggcgccatcagacaaggaggcccctacgccgaaggaggggacactgacccaggtgccattggccccacccccaccgggtgccccaccaagtcctgctcccgctcggttcacggcaaggggtggccgtgtctttactcccaggggcgtgccgagccggcgagggaggggaggaggtcggcctccccctcaggtttgcccaggctggtcccctccagccaaaagtctagcccctaagaaacccccaacaggcccactacccccaagcaaagagccgctaaaggagaaactaattccgggacctctctccccagtggcccgtggaggaagcaatgggggatccaacgtgggcatggaggacggagagcgcccacggcgaaggcgacacggccgagctcagcagcaagacaaaccccctcggtttcgcaggcttaaacaagagcgcgaaaacgccgcaaggggttcagagggtaagccatccttaaccctccctgcaagcgctcccggacctgaagaagcgctcactacggtaacagtcgccccagccccaagacgtgccgcagccaagagcccggatctcagcaaccagaacagtgatcaggctaacgaagagtgggagacagcgtccgagtccagcgatttcacatcagagaggcggggagataaagaggccccaccacctgttctgttaacacccaaggctgtcggaacacctggaggtggcggtggaggtgccgtccccggaatctcagctatgtcgcggggagatttatcccagcgggcaaaagacttatccaaaagaagtttcagttctcagcggccaggcatggaacgccagaaccggagaccaggcccagggggaaaggctggttcttcaggatcgagttccggaggcggaggcggtggtcctggcggacgaaccggtcctgggaggggagacaagcgaagctggccctcccctaagaacaggtctcgtccccctgaggagcgcccacccggactaccacttccccctccgcctcccagttctagtgcggtgtttcgcttggatcaggtgattcactctaacccggctggaatccagcaggccctggcccagctttcatccagacagggtagtgtcacagcccctggagggcatcccaggcataagcctgggcctccacaggctccacagggtccttctccacgcccacctactagatacgagccacagcgtgtcaacagcggtttgagcagcgacccccactttgaggaaccagggccaatggtccgcggagtcggtgggaccccgagggatagcgcgggtgtgtctccatttccacccaagagacgtgaacgaccacctaggaagccagaattacttcaagaggagagcctaccccctccacattcttccggttttctcggctccaagcccgaggggcctgggccacaggccgagagtagagacacaggaaccgaggctcttacgccccatatctggaataggctgcacacagccacgtcaagaaaatcctaccgaccttcaagtatggagccctggatggagcccctaagcccattcgaagacgttgccggtacagagatgtcccagtccgatagcggggtagacttgtctggcgacagtcaggtatcgagcggaccttgtagccagaggtctagtccagacggcggactgaaaggagccgctgagggacctcccaagcgccctggcggttcatctcccttgaatgccgtcccctgcgagggtcctcctgggagcgagccacctcgaagacctccacccgctccccacgacggcgatcggaaagagctacccagagagcaacccctcccacctgggccaattggcactgagcgatctcagcgcacggatcggggaaccgagcccggaccgattagaccctcccaccggccaggccctccggtgcaatttggaacatccgacaaggattcggatctcaggttggtagttggcgacagcctgaaggcagaaaaggagttaaccgcctccgttactgaggcaatcccagtgtcaagagactgggagttgctgccctcagctgccgctagcgccgagcctcagagcaaaaatctcgacagtgggcattgcgtgccagagcccagttcctccggccaacgtctttatccagaggtgttctacggttctgctggacccagtagctcccagattagtggaggcgctatggactcacagttgcaccccaactcgggagggttcagacccggaaccccatctctccacccatataggtcacagcccctgtacctccctccgggaccagcaccaccatctgcattgctcagcggggtcgcattgaagggacagttcctagacttctccactatgcaagcaacagagctgggtaagctgcccgcaggaggcgttctctacccaccccctagctttctgtattctcctgccttctgcccctcacccctgccagacaccagcctcttgcaggtacggcaggaccttccctcgccaagcgatttttacagcaccccgttgcaacctggtggacagagcggattcctgcctagtggagctcctgcacagcagatgcttctgcccatggttgactcccaactaccagtggttaatttcggttctctgcccccagctccccctcccgctcctccaccgctaagccttctccccgttggcccagccctccagcctccatccctcgccgtgcgccctccaccagctccagcaacccgtgtattaccctctcccgcacgcccattccccgcaagcctcgggcgagcagagctgcatcctgtcgagttgaaacctttccaagactaccagaagctcagtagtaatctgggcggacctgggagcagccgtacgcctcccactggaaggagcttcagtgggcttaatagtcgcctgaaagctacaccctctacttacagcggggtcttcagaacccagagggtcgatctgtatcagcaagcttccccccctgatgccctccgctggatccctaagccctgggagaggactgggccaccgcctcgagaagggcctagcaggagagctgaggagcctggctccagaggagataaagaacccggtctgccccctcctcgcta

SEQ ID NO: 236234 - DNA, 6416 bp, Artificial Sequence
  Description of Artificial Sequence: Synthetic coding sequence
atgtcagatcggtccggccctaccgcaaagggaaaggatggaaaaaaatatagctccttaaatctattcgatacctacaaaggtaaatccctggagattcagaagccggcagttgccccaaggcacggattacagtccttgggaaaagtggctatcgcaaggcggatgccacccccagccaatttgccatcgctgaaagctgagaataaggggaatgatcccaatgtctctttagtgcccaaagacggtactggttgggcatcaaagcaggagcaatctgatccaaagtcttccgacgcaagcactgcccaacccccagagtcacagccccttcccgcttcccagacacccgcatccaaccagcccaagaggccgcctgccgctccagaaaataccccccttgtgccttccggggtgaagtcatgggcccaggcttccgtgacacatggcgcacatggtgatggcggtcgggcttcatctctcctgagccgatttagccgggaggagttcccaacacttcaggcggcaggtgatcaagataaagctgcgaaggagagagagagtgcagaacaaagctctggacccggtccctctctaagaccacaaaatagcactacttggagggacggcggtggacgcggacctgatgagctcgagggcccagactctaagttgcaccatggccacgatcccagggggggactacagccctccggacccccacagttcccaccctacaggggaatgatgccaccgtttatgtatccaccctacctcccctttcctcctccttatggccctcaaggcccatatcggtaccccacacctgacggtcccagccggtttccaagggtggctggccctagagggagcgggcctccgatgaggctggtggaaccagtaggccgtccatcaattctgaaagaagacaatctgaaggagtttgaccagcttgatcaggagaacgacgatgggtgggcaggcgcacatgaagaggtcgattacacagagaaactgaaatttagcgacgaggaagacgggagggattccgacgaggaaggggcagagggtcatcgagactcccagtcggcttccggtgaagagcggcctcccgaagccgatggcaagaagggcaattccccaaattctgagccgccaacccctaagacagcctgggccgagacctcgcgcccacctgaaactgagcccggtccacccgctccaaagcccccactgccccctcccggagactatcctgataggggagggccaccatgtaaaccacccgcacctgaggacgaggatgaagcctggcgccaaaggaggaagcagagttcctccgagattagtctggccgtcgagagggcccgtcgtcggagggaggaggaggagcgaagaatgcaggaggaaagaagggccgcatgtgcggagaagttgaagcggctggatgagaaattcggcgctcccgacaaaagactaaaggccgaaccagcagcgcctcccgcagctcccagtacgccggctccgccacccgctgtgcctaaagagctgccagcccctcccgcacctcccccagcgtctgcccctacgcctgaaaccgaacccgaggaacctgcacaagcacctccagcacagagcacccctactcccggtgttgctgccgcacctacactagtgtcaggaggagggagtactagtagcacctccagtggctcattcgaagcatcccccgtcgagcctcagctgcctagcaaggaaggacctgagccaccagaagaagtgcccccacccaccaccccgcctgttccaaaggtggagcctaaaggcgacggaatagggcctaccaggcagccaccatctcagggcctgggatacccgaagtaccagaagagcctcccgccacgctttcaaaggcagcagcaggaacagctcctgaagcaacagcaacagcatcagtggcagcagcaccaacaaggcagcgcccctccaacccccgtcccaccgtcacctccacagccagttaccttgggggcagttcccgctcctcaggcacctccacctcctcctaaggccctctacccgggagcccttggacgccctccccctatgcccccaatgaattttgatcctaggtggatgatgatcccaccctatgttgacccgcgactcttgcagggacgccctcctcttgacttctatcctccaggcgtccaccctagcggcctggtgccccgagagaggagtgatagcggcggaagctcatcggaacctttcgacaggcatgcccctgccatgttacgagagcggggtacaccaccagtcgatccaaaactggcatgggttggcgacgtcttcaccgctacacccgcagagccaagaccactaaccagtcctttgaggcaggcagccgacgaggatgataaagggatgagatcggagacacctcctgtgcctcctcctccaccttatctggcctcttatccagggttccctgaaaatggggctccaggacctcctatcagccgcttccccctggaggagccagggcctcgtccactcccatggccacctggaagcgacgaggtagccaagatccaaacaccacctcctaagaaagaacccccaaaggaggaaacagcccagttgacagggcctgaggcaggaagaaagcctgccagaggagtaggtagcggtggacagggcccacctccaccaaggcgcgaatcgagaactgagaccagatgggggccaagacccggttccagtagacggggtatccctccagaagagcccggagcaccacctcgtagagccggtcccataaaaaagccacctccacctaccaaagtggaggagctgccacctaaaccgttggagcagggagatgagactcccaaacctccgaaacctgacccactgaaaatcaccaagggaaagttaggaggacccaaagagacgcccccaaatggcaacctgtctcccgcaccccgtctccgtagagattactcttacgaacgcgtgggcccaacttcctgtcgcggacggggacggggagagtacttcgccagggggagggggtttcgcggtacctatggcggtaggggacgaggagctgcaggtaactcagccgtaaccgagtctttcgaagagatgatgggcgtggaagtcgggcagggagaccagacgactctcctactgcctgaggctgcccttcctgccaggcacggggctcgggtgcaatcgatgcggaaaagtccgtccggcgcaggcagtggcgctcagaaacaggccgcacggcctatgagagtgatatggctgcttcagacgagacggctcccacacccgagaagagagcacagcccgagatctaggtcccctacgacaagatctccaacgtttccggcaccggcacgattcacccctggggtgggggaatctagccttcctgagggaatatctccaggtccacggcgtcgggaaccacctcaggtttgtccaggatggtcgccgcctgccaagtcactggcccctaagaagcctcccactggacccctgcccccttcgaaggaaccgttgaaggaaaaactcatcccgggaccgctgtctcccgtcgcccgagggggtagcaacggtgggtcaaacgtggggatggaggacggggaaagaccccgtagacggagacatggcagggctcagcaacaggacaagccacccagattccgtcggcttaagcaggagcgagaaaacgctgcgagaggtagtgaagggaaaccctccctgacactccccgcttccgccccaggacccgaagaggctttgaccacagtgacagtggcgccagcacctcgtagggctgcggctaaatctccagacctaagtaaccagaatagcgaccaagcgaatgaggagtgggagacagccagtgagagttctgattttaccagcgagcgccgtggggataaggaggctccaccaccagtcttactcacacctaaggcggttggaacgccaggaggcggaggcggaggcgcagtgccagggattagcgcaatgtctcgcggagacctgagccagagggcgaaagacctcagcaaaaggagcttttccagtcaacgccctgggatggaacgtcagaaccgcagacctggacctgggggtaaagccggttcatcaggttcaagtagtggaggcggaggtgggggacccggaggcaggacggggccagggcgtggagataagcggtcttggccttccccaaaaaacaggagcagaccccctgaggagaggcctcccggactccccctgcccccaccacctccaagcagtagtgcagtgtttcgacttgaccaggtcattcacagtaatccagcgggtattcagcaagcattggcccagttgagctccaggcagggcagcgtgaccgcccctgggggacaccccagacacaagcccggacttcctcaagctcctcagggcccatctcccaggcctcccacgaggtatgaaccccaacgggtgaatagcggtctttcatctgatccccacttcgaggagcccggaccgatggtgagaggtgtcggcggaacgcctcgagactccgccggagtctcaccctttcctcctaagcgacgggagaggccgcctcgtaagcctgaattgctgcaggaagagtcactgcctccaccccattcctccggcttcctgggctcgaaacctgaggggcctggcccacaggcggaaagccgcgatactggaacggaggccttgactccacatatttggaaccgactccatacagctacttcgcgtaagagctatcggccatcatccatggagccctggatggagcctctctccccgttcgaggacgtggccggaactgagatgtctcaatcagattctggggtggatttatcgggtgactctcaagtgtccagcggtccgtgctctcaacgatcatcccctgatggcggattgaagggtgctgcagaaggacctcctaaaaggccaggtgggtccagtcccttgaacgccgttccttgtgaaggcccacctggcagcgaaccccctcgcagacctcctcccgcaccacatgacggcgatagaaaagagcttcctagagagcagcctctgcccccagggccaataggtactgaaaggagccagagaacagaccggggaaccgaacccggtcccatcaggcccagccaccggcctggcccaccagtccaattcggaacatccgacaaggatagtgatcttaggttagtggtgggggattctttgaaggccgagaaggagctcaccgcaagcgttacagaggcaatccccgtcagccgggattgggagttgcttccctcagccgcagcctccgccgagccacaatcaaagaacctggactccggacactgtgtgccagaacccagcagctccggacagagattataccctgaagtattttacggaagcgctggaccgagtagttctcagatttcaggcggacatggcctgagcatcacttccaagcagtggcggaggccgggaactccgtcattgcacccatacagaagccagccactatacttaccgcctggccctgcacctcccagcgctctgttatccgggctggcactgaaggggcagttcctcgacttctcaacgatgcaggccaccgagctgggaaagctacccgctggaggcgtcctctacccaccgccatctttcctttacagccctgccttttgcccctcacctctgcccgacacatctctgctccaggttcgtcaagatctcccatccccttccgacttctattctactccactgcagcctggcggacagtcaggctttctgccctcgggagctccagcccagcagatgcttctccctatggtcgactcccaactgcctgtggttaactttggcagtctccctcctgcccctccccctgcccctcccccactgagtctgcttccagttggaccagctctccagccaccaagcctggcagtccggccaccccctgccccagccacgcgggttcttccctctccagccaggccattccctgcctctctgggacgggcagaattacaccccgttgagctaaaacctttccaggactaccagaagttgtcgagcaaccttggaggtcccggatctagtcggactcccccaactggaagatctttcagtggacttaatagcagactgaaggccactccctccacctactcgggagtgtttaggactcagcgggtcgacttgtaccagcaggcgtctcccccagacgcgcttagatggattcccaagccctgggagaggacaggcccaccaccgcgtgaaggacctagtcgtagggctgaggagcctggatcccgaggggataaagagcccggactgcctccccctcgtta

SEQ ID NO: 236235 - DNA, 6473 bp, Artificial Sequence
  Description of Artificial Sequence: Synthetic coding sequence
atgtctgaccgaagtggcccaacagccaagggcaaggacggcaaaaaatactcctcattgaatctattcgacacttacaaaggaaagagcctcgaaattcaaaaacctgcagtggcccctcggcacggactccagagcctaggcaaggttgccatcgctcggagaatgcctccaccggctaatttgccttccctgaaagcagagaacaaggggaatgacccaaacgttagtctggtgcccaaagacggaaccggatgggcgagcaagcaggagcagtcagacccaaagagctctgatgcctctacggcacagccccctgagtctcagccgctgccagcctctcaaacacctgcctccaatcagccgaagcgaccaccagctgctccagaaaacacacccctcgttccatcaggggtgaaaagttgggctcaggcctccgtcacacatggggcacatggcgacggaggtagggcaagctccctgctctctagatttagtagggaggaatttccaactctacaagctgctggcgatcaggataaagccgcaaaggaaagggagtcagccgagcagagctctggtcccggtccttcccttcgcccacaaaactctaccacctggcgagacgggggtgggcgtgggccagacgagctggaggggccagattctaaactgcatcatggtcatgaccccagaggcggacttcagccttccggcccaccccaatttccaccttaccggggtatgatgccacccttcatgtatccaccttacttgcctttcccacccccttatggtccacaaggcccttaccggtaccctaccccagacggaccctctcggttcccacgggtagctggccctcgcggaagcggtccacccatgaggctggtggaaccggtcggacgcccatcgatcctcaaagaggacaacctgaaggagttcgaccagctggaccaggagaacgacgacgggtgggcaggggcacacgaggaagtagattacacagagaaactgaagttctcggatgaggaggacggccgagattcagatgaagaaggagccgagggacacagagattctcaatccgcgtcgggcgaggaacggccacctgaggcagatggaaaaaaaggcaattctccaaactctgagcccccaactcctaagacagcctgggccgagaccagcagaccaccagagactgaacccggtccccctgcacccaagccccctctgcccccaccccatagggggccagctggcaactggggaccccctggcgattacccagacaggggtgggcctccctgtaagccccctgcacctgaagacgaagatgaggcctggcgccagagacgcaaacagagttcaagcgagataagcttggccgtcgaaagggctcgcaggcgaagagaggaggaagagcgcaggatgcaggaagaacgcagggcagcctgtgctgagaagctcaaacgcctcgatgaaaagttcggggctccagacaaaagactcaaggccgagcccgctgccccaccggcagcaccttctacgccagctccccctcctgccgtgccaaaagagctccccgcacctccagctccccctccagcttccgcacccaccccagaaaaagaacctgaggaacctgcccaggcccctccagctcagtccaccccaacacccggtgtggcagctgcaccaactctggtttctggcggaggatccactagtagcacatcatcgggaagtttcgaggcaagccccgtggagccgcagttaccctcaaaggaaggcccagaacccccagaagaggtccctccccctactaccccccctgttcccaaggtggaacctaagggggacggaattggtccaaccagacagcctccgtctcaagggctgggctatccaaagtatcagaagtcactcccccctcgattccaaagacagcagcaggagcagctgctgaaacaacagcaacaacatcaatggcaacaacaccaacagggatctgcacccccaacccccgtacccccatctccgcctcagccggtgacccttggagctgtgcctgccccacaggcccctccaccgcctcccaaggcattgtacccaggagcgctggggagacccccacctatgcccccaatgaacttcgacccgaggtggatgatgattcccccttacgtggacccccgtctcctgcagggccgtccccctttagatttctaccctcctggcgttcacccttccggtctggtaccccgtgaacgctccgactcgggcggatcgagctctgagcctttcgaccgccacgccccagccatgcttcgggagagagggacaccccctgtggacccgaagctggcgtgggtcggggatgtcttcaccgccacacctgccgagcctcggcctttgactagtcccctgaggcaagcagccgatgaagatgataagggaatgcgttcggagacaccacccgtgcctccccctcctccatatctagcatcataccccggattcccagagaatggggcacccggaccccctatttcaagatttccgctggaggagccaggtccacgaccattaccctggccaccaggatccgacgaggtggccaagattcagactccaccacccaaaaaagaacctcccaaagaagaaacagcgcaattaacgggccctgaagcgggaagaaaacccgcaaggggcgtagggagtggcggtcaggggccaccaccacccaggcgcgagtctagaactgagactagatggggccctcggccaggctcatcgcgcagagggattccccctgaagaaccgggagctccccctaggcgcgcaggaccaataaagaagcctcctccgccaacgaaagtcgaggaattgccacctaagccactggagcagggtgacgagaccccaaaacctcccaaaccagatcccctcaagatcaccaaggggaagctgggcggaccgaaggaaacgcctcctaatggaaacttatctccggcaccaaggctgcgtagggactacagctatgagcgcgtaggtcccacgagctgccgtgggagagggagaggtgagtacttcgccaggggtcggggatttcggggtacttacgggggacgcggtcggggagccaggagccgggaattcaggtcctatcgggaattcaggggagacgatggccgagggggaggaactggtggtcccaaccacccacccgctcctagagggcgtaccgcatctgaaaccagatcggaggggtccgagtatgaagagattccaaaacgccgtaggcagaggggctctgagacaggctccgagacccacgagagtgatctggcgccttccgataaggaagctcctacacccaaagagggtactctgacgcaggttcctctcgcccctccccctccaggcgctcctcccagtccggctcccgctcgttttacagctcgcggaggtagggttttcacccctaggggcgtaccgagtcggcgtgggcgtggagggggaagacccccaccgcaagtgtgccccggttggtcaccacctgccaagtcccttgcacccaaaaagcctcccaccggtccactaccaccttccaaggagccattgaaagaaaagcttattcctggacccctgagcccagtcgccaggggagggtcaaacggcggatccaatgtgggcatggaagatggcgaaagacctaggcgcagacggcacggtcgcgcacagcagcaagataaaccccctagattcagaagattaaaacaggaacgtgaaaacgctgcccgtggaagcgaagggaagccttctcttacgttgcctgcttcagctcctggccctgaagaagcgctaaccaccgtaaccgtggccccagcccctcggagagccgcagctaaaagtcccgatttgtcaaaccagaactccgaccaggcaaacgaggagtgggagactgcatccgagagttcagacttcacctccgagcggaggggcgacaaagaggccccaccgcctgtattgcttactcctaaggcagtcggaacgcctggtgggggaggaggaggtgcggtgcccggtatatctgccatgtctaggggtgacctatcccagcgggctaaagatctctccaaaaggtcctttagctcacaacggccagggatggagagacagaatagaaggcccggaccgggtggtaaggcgggtagttcgggaagctcatctggagggggaggcggaggacccggaggtaggacgggacccggacgaggagacaaaaggagctggccatccccaaagaatcgatctagacctcccgaagagagacctcctgggctgcccctgcctccaccgcctccaagcagcagcgccgtgtttcgcctggaccaggtgatccactctaatccggctggcatacagcaggctctagctcaactgtcatctagacaaggctccgtcaccgcgcctggaggccatccgaggcataaaccaggccctccacaggcacctcaggggccatctcctcgtccacctacacggtacgagccacagagggttaatagtggcctgtcctccgatcctcacttcgaggagccaggaccgatggtgagaggagttggcggtaccccgagagactccgccggagtttcaccttttcccccaaaacgacgcgaacgtcctccacgcaagcccgaactgctgcaggaggagagtctcccacctccccactcgagcggtttcttagggagcaagccggaaggtcctggaccccaggctgagtctagagacaccgggacagaggcactgacgccccacatttggaaccgcctccacaccgctacctcccggaaatcctacagaccctcaagcatggagccatggatggagccactaagtcccttcgaggacgtagcgggtacagagatgagccagagtgacagcggcgtcgatctctccggggatagccaagtgtcttctggcccatgtagtcagcgctcctctcccgacggcggactgaagggcgctgctgagggcccacctaagcggccaggcggatccagcccactaaatgcagttccatgtgagggcccacctgggagcgagcccccacgcagacctccaccagctccacatgacggggataggaaagaactgcctcgagaacagccacttcccccagggcctattgggacagaacgctcacagcatacggacagggggacagaacccggtcccatcagaccttcacatcggccaggccctccagtacaatttggaacatcagataaagactcagatctgcgactagttgtaggagacagcctaaaagccgagaaggagctgactgcaagtgtaacagaggctatccctgtttctcgcgattgggaactgctgccgagcgccgcagcctcggctgaacctcagagcaagaatttagattcggggcattgtgtccccgagccctccagctccgggcagcggctgtaccctgaggtgttttatggctctgccggaccttcatcatctcagattagcgggggagccatggattcgcagctccacccgaactccgggggatttaggcctggtactccatctcttcatccttaccgaagccagccactttatttgccaccagggcctgcgcctccaagtgccctcctgagtggggtggctctgaagggacagtttctcgatttctctaccatgcaggctacagaactgggaaagctgcctgctgggggtgtcctgtacccacccccttcatttttatacagcccggctttttgtccatcaccactgcctgacacgagcctgctccaggtgcgtcaggacctgccatctccgagtgatttttactccacccccctgcagccaggaggacagtcgggttttttacccagtggagcccctgcacagcagatgctgctgccgatggtagacagtcagctgcctgtggtgaatttcggaagcctgcctcctgccccaccccctgcccctcccagcctgtcattgcttccggtggggcctgcgcttcagcccccttcacttgcggttcgtcctcccccagccccagcaacaagggtactgccaagtcccgctcgacctttccctgcctcactgggaagagctgagcttcatccggtggaactgaaacctttccaggattatcaaaaactctcatctaacctgggcggaccaggcagctcccgcacacctcctaccggcaggagcttcagcggcttaaattcacgactgaaggctacccctagcacctatagcggcgtcttcaggacacaacgggtggacctgtaccagcaagccagcccccctgatgccctccgctggataccgaaaccatgggaacgcactggtccaccccctagagagggaccatcccggagggccgaggagcccggtagccgcggagacaaggaaccagggctgcctccacctcgata

SEQ ID NO: 236236 - DNA, 6473 bp, Artificial Sequence
  Description of Artificial Sequence: Synthetic coding sequence
atgagcgatcggagtggcccaacagccaaggggaaagacggtaagaaatactcatctctgaacttattcgatacctataagggaaagagcttggaaatccagaagcctgcagtggcaccacggcacggcttgcagtctctggggaaagtggccatcgctagaagaatgccaccgccagctaacctaccttcactgaaggccgaaaacaagggcaatgatcccaacgtttcccttgttcccaaggacgggacaggatgggccagcaagcaagaacaaagcgatccaaagtctagcgacgcttccaccgcccagcccttggagtctcagcccctgcccgctagccagaccccggcatctaaccagcctaaaagacccccagctgccccagagaataccccactcgttccctccggagttaaaagctgggcccaggcctctgtgacccacggggcacacggggatggaggccgtgccagtagtctcctttcgaggttctctcgggaagagttcccgaccttacaggccgcaggagaccaggataaagcggctaaagaacgagagtctgccgaacagtctagcggccctggaccctcacttcggccacagaattccaccacatggcgcgatggaggtggaaggggccctgacgaacttgagggacctgacagcaagctccaccatggacacgatcctcggggtggactgcaaccttcaggccctcctcagtttcctccctaccggggaatgatgcctcccttcatgtacccaccgtacctgccattcccccctccttatgggccacagggcccttacagatacccaacccccgacggtccgagcaggttcccaagagtagcaggaccgcgaggttcaggtccacccatgcggttggtggaacctgtcgggcgaccatctattttaaaagaagacaacttgaaagaattcgaccagttggaccaggagaatgatgatgggtgggcgggagcacacgaggaggttgactacaccgaaaaacttaaattcagcgacgaagaggatggtagagacagcgacgaagagggtgctgagggccaccgcgactcacaatctgccagcggtgaggagaggccacctgaagcagacggtaaaaaaggtaactcaccaaacagcgagccgcctaccccaaagacagcttgggcggagactagccgtcctccagagactgagccagggcctcccgcacccaagcctcccctgccgccacctcaccgcggtcccgcaggcaactgggggcctcctggcgattaccccgaccgaggcggaccgccatgtaagcctcccgctcccgaggacgaagacgaagcctggcggcaacgaagaaagcaatcctcatcagaaatctccctggcagtagaacgcgctcggagaagacgcgaagaggaggagcgacgaatgcaggaggagcggagagctgcttgtgctgaaaagctgaagaggctcgacgagaaatttggggcacctgacaagcgactgaaagcagaacccgctgcgccaccggctgcgccaagtaccccggcaccccctcctgcggtacccaaagaactccctgctccacccgctccacctcccgcttcagcacccactcctgagaaggaacctgaggagccagcccaggcgccaccagcccagagcactcctaccccaggtgtggcggcagcaccaaccctggtgtccggcggaggttctactagttccaccagtagcgggtctttcgaggctagccccgttgagccccaactgccatccaaagaggggccagagcctccggaggaagtaccaccccctacaactccacctgtcccgaaggtggaaccaaaaggggacggcattgggcctacccggcagccgccttcacaaggcctggggtaccctaagtaccagaagagccttccgccacgcttccagagacagcagcaggaacagcttctgaaacagcagcagcaacaccagtggcagcaacaccagcagggcagtgcaccacccactcctgtgcctccgagtcctcctcagcccgtgaccctcggcgcagtacccgctcctcaagcccctccccctccgccaaaagccctatatccaggggctctgggtcgcccaccccctatgcctccaatgaatttcgacccacgctggatgatgatacccccatatgttgacccacgactgctccagggccgtccacctttggacttctacccgccaggcgtgcatccatccgggttagttccacgggaaaggagcgattcaggaggctccagcagcgaaccgtttgaccgccatgctcctgcaatgctccgggagagaggtacacctcccgtggacccaaagctcgcgtgggttggagacgtcttcactgccactcccgcagaaccccgtccgttgacatcccccttaagacaggctgccgatgaggacgataaggggatgcggtccgagacccccccagtgccgccaccaccgccttacctagccagctaccctggattccccgaaaacggtgcccctggccctcctatctcaaggttcccactcgaagagcctggtcccaggccactgccttggccacccggatccgacgaggtcgcaaagattcagaccccccctcctaaaaaggagccccctaaagaagagaccgcccagctcacaggacccgaggccggacgaaagcctgcaagaggagttggcagcggaggccagggtccccctccacccagacgagagagccgcacagagacacggtggggaccacgacccggtagttccaggaggggaattcccccagaggagcccggagccccaccgagacgcgctggcccaattaagaagcccccacccccaacaaaagtggaagagctcccaccaaagcctctggaacagggagatgagacgcccaaacctccaaaacccgaccccctcaaaatcacaaagggcaaattgggtggccctaaagagacccccccaaatgggaacctcagccctgcccctaggctgagaagagattattcttacgagagagtgggcccaacatcttgccgcggaaggggtcggggagagtacttcgccagggggagggggtttagggggacatacggcggaagggggaggggcgctcgctcaagagaattccgatcttatagggaatttaggggcgacgatggcaggggagggggaacaggcggtcccaaccatccacccgctcctcggggacgtaccgcctcagagacacgcagtgagggctcagagtacgaggaaatcccgaaaaggcggagacagaggggctctgaaacaggctccgaaacacacgaaagcgatctggcaccgagcgacaaagaggccccaaccccaaaggaaggaaccctcacacaggtgcctttagccccaccgcctcccggagcccctccgtctcctgccccagcacgctttacggccagaggcggtcgggtgttcactccgagaggagtgcccagtcgccgtggcaggggcggtggcaggccacccccacaggtgtgtcctggctggtctccccctgcaaaatctctggctcctaaaaagcctcccaccggacctcttccaccaagcaaggagcctttgaaggagaagcttattcctggccctctttcccccgtggccagggggggtagcaacgggggaagcaacgtgggaatggaggatggcgagaggccacggaggaggcggcatggacgggctcagcagcaggacaaaccccctcgcttccgacgactgaagcaagaacgggagaacgctgccagaggatccgagggtaagccaagcctcaccctgccagcttccgcccctgggccagaggaagcgctgactacagtgaccgtggctccggctccacgcagagccgctgcgaaaagtccagatctgtccaaccagaactcggaccaggcaaatgaggagtgggagaccgcctccgaaagctccgacttcacttctgaaagaaggggagacaaggaagccccaccaccggtgcttttgacccctaaggcggttggcactcccggtgggggagggggaggagccgtccccggaatttccgctatgagccgtggcgacctgagccagcgggctaaagacctctccaaaagatccttcagctctcagcggccaggtatggagcggcagaatagacgacctggcccaggaggtaaagctggatcctccgggtcgagctcaggtggaggaggagggggaccaggtggtcgaacaggaccgggacggggtgacaagaggtcttggccgagccccaaaaatcgatctcggccacctgaagagcgtccgcctgggctccctctgcctccccctcccccaagttccagtgccgtcttcagattagatcaggttattcactctaacccggctggcatacaacaggccctggcccagctgagttctcgccaggggagtgtgactgcccctggcggacacccacggcacaagcctggacccccacaggcccctcaggggccttctcctcgcccacccacccggtacgagcctcagcgtgtgaacagcgggctaagtagcgatccacattttgaggaaccaggacctatggttaggggtgtggggggaaccccccgtgattctgcaggggtatccccatttccaccaaagcgcagagaacgtcccccacggaaacccgaattactgcaggaggaaagtcttcccccaccccacagctctgggttcttgggatccaaacctgaaggacctggaccacaggctgagtccagagataccggcaccgaggctctcacaccccatatttggaatcgcctccacactgcgacttcccgtaagtcctatcggcctagttccatggagccctggatggagcctctgagtcctttcgaggacgtggccggaactgagatgagccaatctgacagtggcgtcgatttaagcggggatagccaggtaagtagtggaccatgttcacagagaagcagccccgatggcggtctgaaaggtgctgctgagggacctcccaaacggccagggggtagttcgccactcaatgcggttccttgcgaaggccctccaggaagcgagcctccgagaaggcctccgcctgcccctcacgatggggatcggaaagaactccctcgcgaacagccgttaccgccaggcccaatcggtacagagaggtctcagaggacagacaggggtaccgagccgggaccgatccggccatcccacaggcccggtcccccagtccagttcgggacctctgacaaggattctgatctccgcctggtagtaggcgactctctcaaggctgagaaggagttgacggcctcggtgacggaagcgatacccgtgagcagggactgggaactgctacctagtgccgctgctagcgccgagcctcagtctaagaaccttgatagtggccattgcgttcccgagccaagctccagtgggcaacggctttatccagaggtattttacggctcagcgggacccagctcctcccagatcagcggcggagcaatggattcacagcttcaccctaactctggtggattccggccaggcactccaagtctgcatccttacagatcacagcctctgtaccttccgccaggacctgcaccgccatcagcgttattgtctggcgtcgcactcaagggccagttcctcgacttcagtaccatgcaggcaaccgaactcggcaagctgccagccggtggagtgctctacccaccgccaagctttctatattcaccagctttttgtccctcacctcttccagacacatcactgcttcaggtcaggcaggacctccccagcccgagcgatttttacagtactccgctccagcctggcggacagtccggattcctccccagtggcgcacctgcacagcagatgcttctgccgatggtggattcacagctgccagtcgttaacttcgggtcgctcccccctgcgccacctccagcacccccaccactttcactcctcccagtgggtcctgcacttcagccccctagtctcgctgttcgaccacctcccgctccagctacccgcgtcctgcctagccccgcacggcctttcccagcctccctgggaagggctgagctgcatcccgtggaactaaagcccttccaagattatcaaaagttgagcagcaatctgggaggcccaggttcgtcacgcacccctcctaccggtagatcattcagcgggttgaatagtcggctaaaggcaaccccctcgacctattctggggtctttcgcacccaacgggtcgacttgtaccagcaagcctccccgccagatgccttgcgctggatccctaagccatgggagaggacaggaccaccacccagggagggaccgtccaggcgggcagaagagcccggtagtcgtggggataaagaaccaggtctgcctcctccacggta

SEQ ID NO: 236237 - DNA, 6473 bp, Artificial Sequence
  Description of Artificial Sequence: Synthetic coding sequence
atgagcgaccggtccggacccaccgcaaagggaaaggacgggaaaaaatactcttcgctgaatttattcgatacctacaagggcaagagtctggaaattcagaagcctgctgttgcccctcgccacgggctgcagtctctgggcaaggtggcaattgctcggaggatgcccccacccgcaaatcttcctagtctgaaggcagagaacaagggtaatgacccgaatgtttccctggtccctaaggatggaactgggtgggcatcaaaacaggaacaatctgaccccaaaagtagtgatgcctcaaccgcccaacccccagagagtcagcctctgcccgcatcgcagacacctgccagtaatcaaccaaagagacctccagctgcccctgaaaatacgccacttgtcccgtccggtgtgaaaagctgggcacaggcttctgtgacccatggggcacacggcgacgggggaagagcgtctagccttctttctaggttctcacgtgaagagttcccaacgctgcaggccgctggggatcaggacaaagccgctaaggaacgcgaatccgccgagcaatccagtggccctggacctagccttcgcccacagaatagcacaacttggcgagacgggggaggcagagggccagatgaactggagggacccgactccaagctccaccacggacatgatcctcgtggcggtttgcaaccttctggtccgccacaatttcctccgtaccggggaatgatgccgccttttatgtaccccccatacctgcccttccccccaccatatggtccacagggtccctaccgctacccaactccggatggcccttcacggtttcctagagttgctggtcctcgagggtctggccctcccatgaggctggtggaacccgtgggaaggccttcaattctcaaagaggataacctgaaggaattcgaccaacttgatcaggagaatgacgacggatgggcaggagctcatgaggaggtagactacaccgagaagctaaagttctcggacgaagaagatgggagggatagcgatgaagagggagcagaggggcatagggactctcagtctgcttccggggaggaaaggccacccgaagccgacgggaaaaaggggaatagtccaaactccgaaccacccacgcctaagactgcctgggcagagaccagccggcctcccgaaaccgaacccggacccccagcgcctaaacctccactgccaccaccacaccggggtcccgcaggaaactggggtcccccaggtgactatcctgacagaggcggtcccccttgcaaaccacccgctcccgaagatgaagacgaagcctggcggcaacgtcgcaagcagtctagcagcgagatctcgttggccgtggaacgcgcacgtcgcagaagagaagaagaagagagaagaatgcaagaggagagaagagcagcctgcgctgaaaaactcaagcggctggatgagaaattcggcgcacccgataaaagactcaaagctgagcctgcagctcctccagccgctccctctacccctgcacccccacccgctgtgcccaaggagctccctgcgcctcctgcaccgcctcccgctagtgctcctacacctgagaaggagcccgaggaacctgcccaggctccaccagcgcaatcgacccccacccccggagtggcagcagcccctacgttggtatcaggcggaggttcaacttcctctacttcttccgggagttttgaggcaagccccgtggaaccacagttgcctagcaaggagggtccggagccccctgaagaggtcccccctcctacaacacctccagtgcctaaagtcgaacctaagggggacggaatcggccctactcgccagcctccttcacagggtttgggttaccctaaataccagaagagcctcccacccagatttcaacggcagcaacaggagcagctgttaaaacagcaacagcagcatcaatggcagcaacatcagcagggtagtgcccctccaacacccgtgcccccttctccccctcagcccgtaactcttggtgctgtcccagcccctcaggctccaccacccccacctaaggctctgtatcctggtgcactcggcaggcctccgccaatgccacccatgaactttgaccccaggtggatgatgattcctccctatgttgatcctcggctgttgcagggacggccacccctggatttctatccacctggggtccatccctccgggctcgttccgagggagagaagcgacagcggaggttcctcgtcagagccattcgatcgccatgccccagcaatgctccgcgaacgcggtacgccacctgttgatccaaagctcgcttgggtgggagacgtgtttaccgcaacccccgctgaacccaggcccctgacctctcccctgcggcaggcggctgacgaagacgacaagggtatgcgcagtgaaactccccctgtccctccaccacccccttacctggcttcttatccgggattcccagagaatggagcaccaggtcctcctatttcccggtttccactggaggagcccggtcctagacctctgccctggccgccaggatccgatgaagtggctaaaatccaaactcctcccccaaagaaagagcccccaaaggaggaaacggcacagctcactggccctgaggccggaaggaagcccgctcgcggagtgggttctggtggccaagggcctcccccacctcgtagggagagcagaaccgagacccggtgggggccacgtccgggatcgagtcggagagggattcctcccgaggagccaggagcaccacccagaagggccggtcctattaagaaacctcctcccccaactaaggttgaggagttgccccctaaaccgctggagcaaggcgacgaaacccccaaacctcccaagcctgacccacttaagattacaaaaggaaaactgggcggacccaaggaaacaccgcctaatgggaatttaagtcctgcacctagactgcgccgtgattactcgtatgaacgcgtgggaccgacatcatgccgcggacgcggaagaggcgagtattttgccagagggaggggcttcagagggacttatgggggacggggacgcggagcacgcagccgggaattcagaagttacagggaatttaggggggatgatggacggggtggtggcaccggcggacccaaccaccctcccgctccacgcggtcgaactgcttcggaaacccgaagcgagggatcagaatacgaagaaatacccaagagacgcaggcagaggggatctgaaaccggatccgagacccatgagtccgatctcgctccttcagacaaagaagccccaacacccaaggaggggaccctcacacaggtgccccttgcccctcctccaccgggagctcctccaagtccagcacccgctaggtttaccgccaggggcggaagggtgtttacaccaagaggagttccctctcggagaggcagaggcggtgggcgaccaccaccgcaggtgtgtcccggatggtcaccgcctgccaagtctctggctcccaaaaaaccaccaaccgggcctttaccgccatctaaggagccactgaaggagaaactaattccgggacccctctcgccagtggcgcgaggaggttctaacggaggcagtaacgtggggatggaagatggtgagcgccctcgacggcgaaggcacggacgggcacagcagcaggataaaccaccccgtttccgacgcctgaaacaggagcgtgagaatgcagcaaggggcagtgagggaaagcctagcttaaccctccctgcgtcagcacctggccctgaagaggccctgactacagtgaccgtggcacccgctcctagaagagctgctgccaagtcgccagatctcagtaatcagaattccgatcaggccaatgaggaatgggagacagcttccgagagctcggatttcaccagcgagcggaggggtgacaaagaagcacctcctccagtactgcttacaccaaaagctgtgggtacgccgggaggcggagggggaggggctgtgcccggaatcagcgccatgtcgcgtggggatctcagtcaacgcgcaaaggatctgagtaagaggagcttcagtagccagagacctggcatggagcggcagaaccgtagacctgggccaggcggaaaggctggatcttccggctcgtcatccggaggtggcggaggcggtcccggtggcaggaccggaccgggaagaggagataagaggagttggccgagcccaaagaatcggagccggccaccagaggaaaggccccctgggctgccactgcccccacctccgccttcctcgtccgcagtcttccgcctcgatcaagtgatccattccaatccagccggaatacaacaggccctggcccagctgtcctcgcgccagggaagcgtgaccgctcccggaggacatcctcggcacaagcctggcccaccacaggcaccccaagggccatctccaagaccccctacccgatatgaaccacagagggttaactccgggttatcaagtgaccctcatttcgaggaacctgggcctatggtcaggggggtgggcggtactcctagggactccgcaggagtctctccattcccacctaagagaagagaaaggccaccccgaaaacccgaattgctgcaagaagagtctcttccccctccccattcaagcggctttttgggtagcaaacccgagggtccgggaccccaagctgagagtcgggacacggggacggaggccttaaccccccacatctggaaccggctgcacacagccacctccaggaagtcttaccggccttcatccatggaaccatggatggagccgctttccccattcgaggatgtagcgggaactgaaatgagccagtctgactctggagtggacctcagcggtgacagccaggtctcatctggaccctgctctcagcgcagctcgcccgacggcggtctcaagggggcagccgaaggaccgccaaaacgccctgggggaagctcaccactgaacgccgtgccctgtgaagggccacctgggagcgaacctccacgcaggccacctccagcaccacacgacggggaccggaaggaactgccgagggagcagccactgcctcctgggccaatcggcactgaacggagtcagcgcacagacaggggaaccgagcccggaccaatcagaccttcacacagaccaggccctccagtgcagttcggtacctcagataaggacagcgatctgcgtctcgttgtaggcgacagtctcaaagccgagaaagaacttaccgcaagcgtgaccgaggctatccctgtctctagagattgggagctattgccaagcgccgcagccagcgctgagccccaatccaagaatctggattctggacactgtgtccccgagccatcctctagcggacagagactctacccagaggtgttctacggctcagcagggccttcttccagtcagatctccggaggcgcaatggactcacagctgcatcccaacagcgggggattccgtcctggaactccatcactccacccctaccgatcacagcccctctatttgccaccaggacctgcaccccctagtgctctgctgagcggcgtagcgctcaaaggtcagtttcttgacttttcaacaatgcaggccactgagttggggaaactgccagcaggcggagtgctgtacccacctccgtcttttctgtactcccccgctttctgtccctcgcctcttccggacacgtcacttttgcaggttaggcaggatttaccaagcccgtccgacttttactctacaccactgcagccaggaggacagtccggattcctgcctagcggcgcaccagcccaacagatgctgctgccgatggtcgacagccagctgcctgttgttaatttcggttctctacctccagctccccctcccgcacccccacccctttccttactgcccgtcggccctgctctgcagccacctagcctggctgtcaggccacccccagcgcctgccacaagggtgcttccatccccagcccgaccttttcctgcctctctggggcgagctgaactgcaccccgtggaactgaaaccattccaagattatcagaaactgtctagtaaccttggtggacctggatcaagtaggacaccacccactggccgatcgttcagcggcctgaatagccgactaaaggctacccccagcacttattcgggcgtattcaggacgcaacgagtcgatctgtaccagcaggctagcccacccgacgctcttcggtggatccctaaaccatgggaacgaactggccctcccccacgtgaaggtccttcccgcagagcagaagaacccggtagtcgaggcgataaagaaccgggactccctcccccacggta

SEQ ID NO: 236238 - DNA, 6473 bp, Artificial Sequence
  Description of Artificial Sequence: Synthetic coding sequence
atgtcagatcgctctggaccgactgccaagggcaaggatggtaagaaatattcatcgttgaatctctttgatacatacaagggcaagagtcttgaaatccagaaacccgctgtagccccacgacatgggttacagtcgttagggaaggtcgctatcgccaggcgaatgcctccacctgctaatctgcctagcctgaaggccgaaaacaaaggcaacgatccaaatgtgagcttggttcctaaagatggaactggctgggctagcaaacaggaacagagtgatccaaagtcctccgacgcctccaccgctcaaccccctgaatctcagcctctcccggctagccagacgcccgcatcaaaccagcccaagcgccctccagccgctcccgagaataccccactggttccgtccggcgtcaaaagctgggcacaggcttccgtgacgcatggcgcacacggcgatggtggtagagcaagttccctcctatcccgcttctctcgagaggaattcccaactctgcaggccgcaggggatcaggataaggcagccaaagagcgggaatcagccgagcagtccagcgggcctggccctagcctgagaccgcagaattccacaacctggcgggatgggggtggccgagggcctgacgaactggagggccctgattcaaaacttcaccacgggcatgaccccaggggcggactgcagcccagtggtccccctcagttcccaccatatcgaggcatgatgccgccatttatgtaccctccatacttgccttttccccctccatacggaccccaggggccttataggtacccaactcctgacggaccttcgaggtttccgagagtggctggtccaagaggaagtgggcctccgatgcggctggtggagcctgtgggcagaccttctatcctgaaagaggataacctgaaagaattcgaccagcttgatcaggagaatgatgacgggtgggctggggcacatgaggaagtagattatactgagaaactcaagttctctgacgaagaggatgggagggatagcgatgaagagggtgctgaagggcaccgggatagtcaatctgccagcggcgaagagcgtcccccagaggccgacggcaaaaagggtaattcgccaaacagcgagccccctaccccaaagactgcatgggctgagaccagtcgccctcccgagacagaacctggacccccagctccgaaacctcctcttccgcctccccaccgcggtcccgctggcaactggggtcctccgggagattacccagatcgaggcggtcctccatgtaaacccccagcacccgaggatgaggatgaagcctggcggcagaggcggaaacagtctagctccgagatatccttggccgtggaaagagcgaggcgccgacgcgaagaggaggaacggaggatgcaggaagagcgtagagccgcatgcgccgagaaactgaaaaggttagatgagaagttcggcgcaccggacaagaggttaaaagcggaaccagcagcaccccctgcagcccctagcaccccagcgcctcccccagccgtccctaaagagcttccagctcccccagcccctcctccagcctcagcccctacaccagagaccgaacctgaagaaccagcccaggctccacctgcacaaagcactcccacacctggtgtggcagctgcccctacgctggtgagtggaggcggaagcacctctagtacctccagtggaagcttcgaagcatctcccgtggagccacagctcccaagtaaggaaggcccagaaccgccagaagaggtcccaccccctaccactccccctgttccaaaggtagagcccaagggcgatggcattggcccaacccggcaacccccaagccagggactgggatatccaaagtaccagaaatccctcccaccaagatttcaacgccagcaacaggagcagcttcttaagcaacaacagcagcatcagtggcagcagcaccagcagggaagtgcaccacccacccccgtgcccccttctcctccacagcccgtgacactcggtgccgtgcctgctcctcaagcccctcctcctccgcctaaggccctgtacccaggtgctctgggcaggcctccccctatgcctccaatgaattttgacccgaggtggatgatgattcctccttacgttgatcccaggttgcttcaaggcaggccaccactggacttctaccctcctggcgtacatccttctggactggtgccacgagaacggagcgattcagggggttcgtcatctgaaccctttgaccgacatgccccagctatgctgcgagagcggggaacccccccagtcgatcctaagttagcctgggtcggcgatgtttttactgccacacctgccgagccacgtccactgactagtccccttaggcaggccgctgatgaagacgacaaaggaatgagatccgagactccacctgtgcctcccccaccaccatatctcgcgagttatcccggttttccagagaatggcgctcccggaccacctatcagccgatttccattggaggaaccgggacctagaccactcccctggccgccagggtccgacgaggtagccaagatccaaacgccccctcctaaaaaggaaccccctaaggaggagaccgcccagttgacaggcccagaggccggtaggaaacccgcacggggagtcggatcgggaggccagggcccacctcctcccagacgggagagccggacagagacaaggtggggcccacgcccaggcagctcgcgccgtggcatacccccagaagagcccggagctcctccgagaagagccggaccaataaagaaaccaccccctcctaccaaggttgaggagctaccgccaaaaccacttgagcaaggggacgagacccctaaacctcccaagccagacccactgaagataactaaaggaaaactcgggggtcctaaggaaactcctcctaacggcaatctgagccctgccccaagacttaggagagattactcttacgagcgcgtggggccaacaagctgccgtggtcggggtcggggtgagtacttcgccagagggcgtggatttcggggaacttacgggggtcgtggacggggagccaggagccgggagttcaggagctatcgggaatttcgaggagacgacggcagggggggagggactgggggaccgaaccacccaccagcccctcgtgggcgaaccgctagtgaaactaggagcgaaggatcagaatacgaagagatcccgaagaggcgccgacagcgtggcagcgaaacaggatcagaaacccacgaaagcgatctcgcccctagcgacaaagaggctccaacacccaaagagggtaccctgacccaggttccactcgccccacccccacctggcgcacctccgagtccggcaccggctaggttcacagcgagagggggaagagtttttacccccagaggagtgccttctagacgcggtagaggcggtggacggcctcctccccaagtgtgtccaggctggtccccacctgccaaaagccttgctccaaagaagcctccaaccggaccccttccgcctagcaaagaacctttgaaagagaaactcatccccggtccactgagccccgttgcgaggggcggttcaaacggaggatccaatgtggggatggaagacggcgagagaccccgacgcaggcgccatggcagagcgcagcagcaagataaacccccacgcttcagacgcttgaaacaagaacgggagaacgctgcacgaggaagcgagggaaagccttctctcaccctgcccgcaagcgctcctggtcccgaggaggccctcactaccgtgacagtggccccagcaccccgacgggctgctgctaagagccccgatctcagcaaccaaaactccgaccaggccaatgaggaatgggagaccgccagtgagagtagcgatttcacctctgaaagacggggtgacaaggaagctcccccacctgtcctgcttactcctaaggctgttggaacccctggcggaggcggaggcggtgccgtcccgggaatatccgcaatgagcaggggagatcttagccagagagccaaggatctgtctaaacgcagttttagttcgcaacgcccaggcatggagcggcagaacagacggcctggcccagggggtaaagcaggatcatcaggttccagctctgggggtggcggaggcggtcctgggggaagaactgggccaggtagaggagacaagagaagctggccaagccccaagaacaggtcacgccctcctgaagagcgccctcctggtctccctttaccaccaccaccaccttctagtagtgccgtgttccgccttgaccaagtgatccactctaaccctgctggcatccaacaggcacttgctcaactctcgagtagacaaggatcagtgactgctccaggtggccaccctaggcacaagcccggtctccctcaagctcctcaggggccatcccccagaccacccacccgctatgaacctcagcgcgtgaatagtggattgtccagtgacccccacttcgaagaacctggtcctatggttcgcggtgtgggagggactccaagggactccgctggagtgtctcccttccctcctaaacgcagagagagaccccctaggaagcctgagctcctccaagaggagtcattaccaccccctcactctagcggcttcctgggcagcaaaccagagggtcccggaccgcaagctgaatctagggacacagggacagaggccctgacccctcacatctggaaccgtctgcatacagccactagtaggaaatcatatcggccttcatccatggagccctggatggagcccctttctccttttgaagacgtggcagggaccgagatgtcccagtcggattccggtgtggaccttagcggagacagccaggtctcctcgggcccttgtagccagcgctcaagcccagatggcggtctaaaaggtgcggcagagggacctccaaagcggcctggtgggagcagtcctctgaacgcagtaccttgtgagggcccacctggctctgaaccaccacggcgaccccctcctgcccctcatgacggggacaggaaggagttacctcgcgaacagcctctccctcctggcccaatcggtactgagaggagtcagcgtaccgaccggggtacggagcccggtcctattcgaccatcacatcggccaggccctcctgtccaatttggcacatccgataaagactcagatctccgcctggttgtgggcgacagtctcaaagccgaaaaagagctgacggcgagtgtgaccgaagcaataccagtgagccgtgactgggagctccttcccagtgctgcagctagtgccgaaccacagtctaaaaacctcgacagcgggcactgtgtgcctgaaccgagctcgagtggccagaggttgtaccccgaggtgttttatgggtcggctggaccctcttcatctcagatctctggaggtgccatggattcgcagctccaccccaacagtggcggttttcgccctggcaccccttcacttcacccttaccgctcgcagcccctgtatttgcccccaggaccggcaccacccagcgccttgctgtcaggggtggctctaaaggggcagtttctcgatttttccactatgcaggccacagaacttgggaagctgcctgcaggaggtgtcttatacccgccaccaagctttttgtacagccccgctttttgtcctagccctcttcctgatacatctctgctccaagtccggcaggatcttccctccccaagcgatttctacagtacccccctgcagcctgggggtcagtccggctttctgccatctggagcacccgcacagcagatgctcctgcccatggtggacagccagttacccgttgttaactttggaagccttccgccagcccctccaccagctccccctcctctaagtctgcttccagtcggtccggcactccaacccccatccctggcagttcgtccacctcccgctcccgcaacccgtgttctccctagccccgcaagaccctttccagcctccttgggcagagccgagctgcaccctgttgaactgaaaccgtttcaggactaccagaaactctcatctaatctcggcggaccgggttcctcccgaacgccacccaccggtcgcagtttctcaggactgaattcccgactgaaagctaccccttcaacctacagcggagttttcagaacccaacgtgtcgatctataccagcaggcctcacctcctgatgccctacggtggattcctaagccatgggagcgcaccggacctccaccgcgagaagggcctagccgcagagccgaggagcccggaagtagaggggataaggaaccaggcttgccccctcccaggta

SEQ ID NO: 236239 - DNA, 6449 bp, Artificial Sequence
  Description of Artificial Sequence: Synthetic coding sequence
atgtcggaccgctccgggccaactgcaaaaggcaaggacgggaagaaatacagctccctcaatctctttgacacctacaagggaaaatctttggaaatccagaaaccagcagtcgctccccgacatggtctccaaagcttagggaaggtggcgatcgcaagaaggatgccacctcccgctaaccttccttcccttaaggccgaaaataaggggaacgatccaaatgtatcgttggtgcctaaagatggaactggatgggccagcaagcaagaacagagcgacccaaaaagtagcgatgcatccaccgcacagcctccagaatctcagcctctccctgccagtcaaacgcccgcatccaatcagcctaaacgccctccggctgccccagagaacacacctttggtgccctccggcgtaaagtcctgggcccaggcctcagtaacccacggggctcacggcgacgggggtagagcctctagtctcctgtcgcgcttttcgcgcgaggagttcccaactctgcaggcagcaggagatcaagacaaggcagcaaaggagcgggagtctgccgaacaatctagtggccctggaccaagtcttaggccccaaaattccaccacctggcgcgacggaggcggtagggggccagatgaactggagggaccagattccaaactccaccacggccacgatccacggggtgggctgcagccttctggcccaccgcagttcccaccctatcggggtatgatgccaccatttatgtacccaccctacctgccgtttcccccaccgtacgggccacaaggcccttaccggtatcccacacctgacgggcctagccgctttcccagggtagcgggacccaggggcagcggccctcctatgagacttgtagaacccgtgggacgcccttctatcctgaaggaggataatttgaaggagtttgaccagttggatcaagaaaatgacgatgggtgggctggcgcacatgaggaagtagactatactgaaaagctcaagttctctgatgaggaagacggacgcgacagcgacgaagaaggtgccgaggggcatcgagattcccagagcgcctccggagaggagcgccctcccgaagccgatggcaagaagggcaactcccctaactctgagcccccaacgccgaaaacagcatgggcagagacgtccagacctccagagaccgagccaggaccgcctgccccaaagccaccattaccccctccccatcggggtccagcagggaactggggcccacctggggactatcctgatcgcggagggcctccatgtaagccacccgcacccgaggatgaggatgaagcttggcggcaacggagaaaacaaagttccagtgagatttccctagccgtcgagcgggctagacgcaggagagaggaggaggagcgcaggatgcaggaagagcgccgagctgcatgcgcggaaaaactgaagcggctggatgagaagtttggagcccctgacaagaggctgaaagctgagcctgcagccccaccggcagccccatcaacccccgcacctccacccgctgtgcccaaggagcttccggctccccctgccccaccccctgcatctgcacccaccccagaaactgagcccgaagagccagctcaagccccaccggctcagagtactccaacaccaggcgttgcagccgctcctacccttgtgtctgggggtggcagcactagtagcacttccagcggaagctttgaagcgagccctgtggaaccccagctgccatcaaaggaaggcccagagcccccagaagaagttcccccacctacgactccaccagtgccaaaagttgaaccaaaaggggacggcattggtccgaccaggcagccaccatcacagggacttggctaccccaaataccagaaatctttaccccctagattccagcgacaacagcaagaacagctgctaaagcaacagcagcagcatcagtggcaacagcatcagcagggttctgccccaccaactccagtcccaccgtctccaccccagcccgttacacttggcgctgtgcccgctcctcaagctcctcctcctcccccaaaagcattatacccaggagccctgggtcgcccacccccaatgcctccaatgaacttcgaccccagatggatgatgattcccccttacgttgatccgagactcctgcagggacggcctcctctcgatttttatcctcctggcgtgcatccctccggcctggtcccacgcgaacggtccgattccggtggctcatcgagcgagcctttcgaccggcacgcacccgctatgctacgtgagcggggaactcctcccgtggacccaaaactggcctgggttggcgacgttttcacagccaccccggctgagccaaggccccttaccagccccctgaggcaagccgctgatgaagacgacaaggggatgagatcagaaacacccccagtgcctccaccccctccctacttggcttcttaccccggttttcctgagaatggagcaccgggacctccaatatcccggttccccctcgaggagccaggccctcggccacttccatggccgccaggatccgatgaagtcgcaaagatacagactccgcctcccaagaaggaaccaccaaaggaggaaaccgcacaattgaccgggcctgaggcaggcagaaaacctgctcggggtgtggggtctggtggccaggggcctccccctccccgtagggagtccagaaccgaaacccgctggggacctcgccctggatcttcacgtcgaggcatcccgcctgaggagcctggtgcacctcccaggcgagcaggaccaattaaaaaacctcccccacctaccaaggtcgaagaactgccgcctaagcctctggagcagggagacgaaacccccaagcctccaaagcctgatccactcaagattacaaagggaaagctcggaggcccaaaggagacaccccctaacggcaatctgagccccgcaccaaggctcagacgcgattactcatacgaacgggttgggcctacctcttgcaggggcagggggaggggagagtattttgccagaggtcggggatttcgtggtacatatggcggacgcggaagaggcgcagcgggaaattccgctgtaacagaatcatttgaggagatgatgggtgtggaggtgggtcagggcgatcagactacccttctattgcccgaggctgctctgcctgctcgccacggggcacgagttcagagtatgcgtaaaagccctagtggcgctggcagcggggctcagaaacaggctgctagaccaatgagggtgatctggttgctacagacccgcagactgccacatcccagacgtgagcatagtccgagatctagatcaccaaccactcggtctccaacatttcccgcaccagccaggtttacccccggagtgggggagtcgagtcttcctgaaggaatctcacccggacccaggcgaagagaaccaccacaggtttgtcccggttggtcccctcctgctaagagtctggccccaaaaaagcctccaacaggaccactgcccccatctaaggagcccctgaaggagaagctgatccctggaccgctgtctcctgttgccaggggcggatcaaatggcggtagcaacgtgggcatggaggatggagaacgccctaggcgacggaggcacggcagagcccaacaacaggataagccaccaagatttcggagactcaagcaggagcgggagaatgctgcacgtgggtctgagggcaagccgagtctgacattacctgcctctgcacctggccctgaggaggcattaaccaccgtgaccgtcgctccagcaccacgcagggccgctgcaaagtcaccggatctctccaaccagaactcggatcaggccaacgaggaatgggaaaccgctagcgaaagcagtgattttacttctgagcgaaggggggacaaggaagcaccgcctcctgtactcctgacacccaaggcggtgggaacaccgggtggcggagggggaggagccgtacctggaatttccgccatgtccagaggagatctttcccagagggcaaaggatttgtctaagcgttcttttagctcccagcgccctggcatggagagacagaacagaagacccggacccggtggtaaagccggaagttctggtagcagctctggtggaggcggaggcggtcccggtggacggacgggtcccggtcgcggagataaacggtcctggcctagtcctaagaatcggtcaaggcctcccgaggagcgtcctcccggtctgcctctgcccccaccccctccatcctccagtgccgtgttcagacttgaccaggtgattcacagcaatcccgcaggaattcaacaggcgctcgcccagttaagctctagacaggggtctgtcaccgcaccagggggacatcctagacacaaaccaggcctaccgcaggcacctcagggcccttcaccaaggcctcccacaaggtatgaaccacaacgcgtcaacagcggattaagctccgatcctcatttcgaggagccaggccctatggtacgtggcgtaggcggtacacctagagactctgcaggcgtgtcaccttttcctcccaagagacgggagaggccaccccgaaagccggagctacttcaagaagaatcactgccccctccccattcatctggatttttgggcagcaaaccagaggggcctggcccacaggctgagtcaagagacacggggacagaggctctgaccccacacatttggaaccggctgcacacagccacttcgcgcaagtcctatagaccttcttctatggaaccatggatggaaccgctctcccctttcgaagacgtagctggcactgaaatgtctcaaagcgacagcggcgtggatttaagcggcgattctcaagtaagctctggaccttgctcccaaagaagcagtccagacggcggactcaaaggtgcagctgaggggccacctaagcgccctggcggatctagcccccttaatgctgtcccgtgtgagggtccgcctggctccgaaccgcctcgcagaccacctcctgctccacatgacggggataggaaagagctgccgagagagcagcctctaccgccaggccctatcggcaccgaacggagccaaaggacagaccgaggaaccgagccgggtcccatcagaccaagccaccgaccaggtcccccagtgcagtttggcacttccgataaggatagtgacctgcgtctcgttgtcggcgatagcctgaaggctgagaaggagcttaccgcctctgtaacggaagccatccctgtgtcccgcgactgggagctgctccctagcgccgcagcctctgctgaacctcagtccaaaaacctggacagtgggcactgcgtacctgagccgagtagttcaggccagcgactgtatcccgaggttttttatggaagtgccggaccctccagctcgcaaatttcaggtggccatggcttaagcataacatcaaagcagtggaggcggccaggcactccatctttacacccctaccgctctcagcctctgtacctcccacccggtcccgcaccgccatccgcgctgctgtccggcgtggccctcaagggccagttcctagattttagcacaatgcaagctaccgaactcgggaaactgccagccggtggtgttctgtatcccccaccgagttttctgtactcccccgctttctgcccatcccccctgccggatacatccctgctgcaggtgcggcaagatcttcccagcccctccgacttctattctactccactgcagccgggagggcagtcaggattcctgccgtccggcgcacccgctcagcagatgcttctacccatggtcgattctcagctgcccgtggttaacttcggctcactgccacctgcacctcccccagctccccctcccctcagcctgctccctgtcggcccagcacttcaaccgccaagcctggctgtgagaccaccgccagcccctgccactagggtgttgccaagcccagcgaggccatttccggctagcctgggtcgcgctgagctgcatcctgtagagcttaaaccatttcaagattaccagaaactcagcagcaatctcggaggaccagggtcatctcgaacaccgcctacggggaggtcattttcgggcttgaattctcgactgaaagctacaccttctacctacagtggcgtttttcggactcaaagagtggacctgtaccagcaggccagccctccagacgctctccgctggattccaaaaccttgggagcgtacaggacctcccccaagagaagggccttctcggcgagccgaggagcccggaagtcggggtgacaaggagcccggactccccccacctcgcta

SEQ ID NO: 236240 - DNA, 1650 bp, Artificial Sequence
  Description of Artificial Sequence: Synthetic coding sequence
atgagcgatcggtctgggcctactgcgaaaggaaaagatggaaagaagtactcatcattgaatctcttcgatacatataaaggaaagtcattagagatccagaagcctgcggtggcacctagacatggcctccagtcactgggaaaggtggccatagccagacgaatgccaccaccggctaatctcccctcattaaaagcagagaataaaggaaacgacccaaatgtgtcactggttcctaaagacgggactgggtgggcaagtaagcaagaacagagtgatccgaagtcaagcgacgcctccaccgcccaacctccggagtctcaaccactcccagctagtcagactccagcctcgaatcagcccaagcgacctccggctgcacccgagaatacaccactcgttccttctggagttaagagttgggctcaagctagcgttacacatggggctcacggtgacggtggcagggcctcttctctcctgtcccgcttttctcgagaagaattccccaccctgcaggccgcaggggaccaggacaaagcggctaaggaacgagaaagtgctgaacagtcttccgggccagggcctagtttaagaccgcaaaatagcacaacttggagggacggtgggggacggggacctgacgaactggaaggtccagattctaaactgcatcatgggcatgacccgagaggtggtctccaaccctctggccctccacaattcccaccatataggggcatgatgccacctttcatgtacccaccatacttgcccttccccccaccatacggccctcaagggccataccgctacccgaccccagatggaccctccagattccctcgggtggcaggcccaaggggaagcgggcctcccatgcgtctggtagaaccggtcgggcgtccgtccatccttaaagaggataaccttaaagagttcgatcagctggaccaggaaaatgatgacggctgggccggagctcacgaagaagttgattataccgagaaactgaaatttagtgacgaggaggatgggagggactccgatgaagaaggcgcagagggacaccgcgacagccagtccgccagcggggaggagcgccctcctgaagccgatggtaagaagggcaactctcccaatagtgaaccccctacacccaagactgcttgggctgagaccagcagaccacccgagaccgaacctggaccacccgctcccaaaccccctctccccccaccccacaggggacccgctggcaactggggcccaccaggcgattacccggatagaggtggaccgccatgtaaacccccagcgccagaagatgaggacgaagcctggagacagaggcggaaacagagcagttctgagatttctctcgccgtagaacgggctcgaagacggagggaggaagaggaacgccgtatgcaggaagagcgacgggctgcttgcgcagaaaagcttaaacgcttggacgagaaattcggggctcctgataagcggctaaaggcggagcccgctgctccaccggcagcccctagtacccccgctccccctcccgctgctagcgaggtacctctgatggaagatagtagggggcagcagagggaccctccaagagggttggaggcccctcatccgtag

SEQ ID NO: 236241 - DNA, 6416 bp, Artificial Sequence
  Description of Artificial Sequence: Synthetic coding sequence
atgagcgacagatctgggcctactgcaaagggcaaagatggtaagaaatacagttctttaaatctgttcgacacttacaaggggaaatcgctggagattcagaagcccgctgtcgctccacggcatggactccagtctctcggcaaagttgcaatagccagacggatgcctcccccagcaaacctgcccagcctgaaggcagaaaataagggcaacgaccccaacgtcagtcttgtgcccaaagacggaactgggtgggcctctaaacaggagcagagcgatcccaaaagtagtgacgcgagtacggcccaaccgccagagtcccagccattgccagccagccagacacccgcttctaaccagccaaagagacccccagccgctccggagaataccccgttggtgcccagcggtgttaaaagttgggcccaagcatcggttacacacggagctcacggagatggcggacgcgcatcttctttgttgagccggttttcccgagaggagtttcctacactgcaagccgcaggtgatcaagataaggctgcaaaagaaagagagtctgccgaacaaagttcaggcccaggaccatcactgcgaccacagaacagtactacctggcgcgatggcggagggcgaggtcctgacgagctggagggccctgatagcaaattgcatcatggccacgacccccgagggggattgcagccttcaggtccacctcagttcccgccttaccgaggcatgatgcccccatttatgtatcccccttacctgccattcccccctccctacggaccccaagggccatacagatatccgactcccgacggtccctctagattcccacgggtggcaggtcctcggggatccggcccacccatgagactggtggagcctgtcgggcgtccaagtattctgaaagaagataacctgaaagagtttgatcagctggatcaggagaacgatgatggatgggccggtgctcatgaggaagtggactatactgaaaagctgaagttctctgacgaagaagacggccgtgatagcgacgaagagggcgcagaagggcatagagattcccaatcagcttccggtgaagagagacctcccgaagcagacggaaaaaagggcaattctcctaattcggagcctcccacaccgaaaacagcatgggcagaaaccagtcgccctcctgagacggagcctgggcctcccgctcccaaacctccgcttcctcctcctggcgattatcctgacagagggggtccaccatgcaagccacctgctccagaggacgaggacgaagcttggcggcagcggaggaaacagtcctcttctgagatttcactcgcagtggagcgggcacgcaggagaagagaggaagaggagagacgtatgcaagaggagcgacgggctgcttgcgctgagaaactgaaaaggcttgacgagaaattcggcgcacccgataagagactgaaggccgagccagctgcgcctccggcagctccttccaccccggctcctccaccggctgtgccgaaagagctgcctgcacccccagcccctccccctgcttcggcccctacccctgaaaaagagcctgaagaaccagcccaagctccccctgcccaaagcacacccacccctggcgttgctgctgcccctacactcgtgtccggcggtggaagcacaagttccacttcgtccgggtcctttgaagcctcacctgttgaaccccagttgccctctaaggagggccctgagcctcctgaggaggtccctccgccaactacaccccctgtaccaaaggttgaacctaagggtgatggaataggtcccacccgtcagcccccaagccagggtctggggtatcccaagtaccagaaaagtttgccccctagattccaacgccagcagcaggagcagctcctaaaacaacagcaacaacaccagtggcaacagcaccaacaggggtctgcccctcccacccccgtccctccttcaccccctcaaccagtgaccttgggcgctgtccccgcacctcaagcaccccctccgccacccaaagccctgtatcccggtgcactagggcgtccccctccgatgccacctatgaacttcgacccccgttggatgatgataccaccatacgtggatcctcgactgcttcaggggcgtcctccactggatttctacccacctggcgtccacccttctggactggtgcctcgagagcgctccgattctgggggatccagcagcgaaccattcgaccggcacgcccctgcgatgctgcgcgagcgcggtacccctccagtcgaccctaaattagcttgggtcggagatgttttcacagccacccctgctgagcccagacccttaacatcacctctacgtcaggcagctgacgaggacgataagggtatgagaagcgaaactcccccagtccctccccctcccccatacttagcctcgtatcccggattccccgagaatggggcacccggaccacctatatctaggttcccattagaggaaccagggccaaggccactgccttggcctcccggttccgacgaggtagctaaaattcaaacccccccacccaagaaggaacctccgaaagaagagacagcccagctcacaggcccagaagccggtaggaaacctgccagaggtgtgggctccggtggccaaggcccacccccacccaggagagaatcccggaccgagactcgatggggacctaggcctggatcttcccgccgaggcatcccacctgaagaacctggggcaccccctagacgcgctggcccaataaagaaacctcctcccccaacgaaggtcgaggagctgcctcccaagcccctggagcagggcgacgaaaccccaaagccacctaagccagatcctctcaaaatcactaaggggaaactggggggacccaaggagacacccccaaatggaaatctttcaccagccccaaggctaagaagagactattcttatgagcgtgttggcccaacctcttgtcggggtagaggaagaggggagtattttgccaggggtagggggttcagaggcacctatggtggcagaggcagaggggcagctggaaatagtgctgtgacagagtctttcgaagaaatgatgggcgtggaggtaggtcagggtgatcaaaccaccctcttgttacctgaagccgcactccccgctagacacggcgcaagagtgcagagtatgaggaaatcaccatccggggctgggtctggcgctcagaaacaggctgccaggcccatgcgggttatctggctgctgcagaccagacgcctcccacaccccaggagagaacacagccctagaagccgcagccctacgacaagatcccctacctttccagcacccgcaagattcacgccgggtgtcggcgaatcttctttacccgagggaatcagtcccggacccagacggagagaaccacctcaagtgtgtcctgggtggtcgcctccagctaaatccctggctcctaagaagccacctactggaccgctgcccccttcaaaagaacccctgaaagaaaagttgattcccggaccacttagccctgtcgcgcgtggcggatcaaatggcggttcaaacgttggtatggaagatggggagcgaccacgaagacgtcgccatggccgagcacagcagcaggataagcccccacgcttccgcaggctcaaacaagagcgggaaaatgctgccagaggctctgagggcaaaccttctctgaccctgccggcatcagctcctggacccgaagaagctctaaccaccgtcaccgtcgcccctgctccacggagggccgcagctaagagccccgacctgtctaatcagaattccgaccaggcaaatgaggagtgggagaccgcttccgaaagttctgatttcacaagcgagcgacggggagacaaggaagccccacctccagttctactgacccccaaggccgtcggcacccccggaggcggaggaggtggagccgtgcccggaatatccgcaatgtccaggggagacctgtcccagagggccaaagacctgtccaaaaggagtttctctagccaaaggcctggaatggaacgccaaaatcgccgaccgggaccaggcggaaaggccggaagttctgggagctcatccgggggagggggaggtggccctggaggaagaacaggtcccggtagaggtgataaacgcagctggccaagccctaaaaaccggagcaggcctcccgaggaaaggccgccaggacttccactcccccctccccctccatccagttcagccgtatttcgtcttgaccaggtgatccactccaacccagctggaatccaacaggccctggcccagttgtcgagccgtcagggaagcgtcacagcacccggtgggcatcctagacacaaacctggccctcctcaggcgccacaggggcctagcccacgaccccctacacggtacgagcctcagagagtgaactccggattgtcatccgacccacattttgaggagcctggcccaatggtgcgaggtgtgggaggaacccctcgcgattccgctggggtatctccatttccccctaaacggagagaaagaccgccacgtaagcctgaattgctccaggaggaaagtctgccaccaccgcactcatccggcttcctcgggtctaaacccgaggggccaggtccgcaggcagagtccagagacacaggaacagaggccctcacaccccatatttggaaccgcttgcacacagctacgtccaggaagtcatataggccctcatcaatggaaccctggatggagccgctgtctccattcgaagacgtggcaggcacagaaatgagccaatctgacagcggggtagatctgagtggagattctcaagtctcctctggcccttgttcacaacgctcaagcccggatggcggtcttaagggggcagccgagggaccccctaagcgcccagggggttcttcacccctcaatgctgttccatgtgagggtcctccgggatccgaacccccaagacgccctccgccagctcctcatgatggcgacagaaaggagcttcctcgggagcagcctctgcctcccggaccaatcggcaccgagcggagtcagcacactgatcgcggaaccgaacctggccctatccgcccatctcatcggcctggacctcccgtccaatttggtacctcagataaggacagcgacctccggctggtagtgggcgactccctgaaggcagagaaggagttgactgcaagtgtcactgaggcgatccctgttagcagggactgggaactgctgccctccgccgctgcctctgcagaaccccaaagcaagaacctggatagtgggcattgcgtcccagagcccagctccagtggccagagactttaccctgaagtgttttatggatctgctggtcccagtagctcccagatatcggggggacacggcctgtccgtgacatcgaaacagtggcgaagacccggaacaccctcactgcacccataccggtcacagccactctatctccctcccggacccgctccacctagcgcgctgctgagtggcgtcgcgcttaaaggacagttcctggatttctcaactatgcaagcaaccgagctgggcaagctgccggctggtggggttctgtaccctcctccatcttttctgtattcccccgcattctgcccaagtcctctgcctgacaccagcctgctgcaggtgcggcaagatctccctagcccatccgatttttactctacccctctccagcccggaggccaatccggctttctcccttcaggcgcacccgcacagcagatgctgcttcctatggtggactcccagctcccagtggttaatttcggaagtctgccgcctgctccacctcctgcacccccttcgctgagcctgctgcctgtcggcccagcattacaacctccttcattggccgtgaggccccctcccgcacccgcaactagggtgctgccctctccggctcgtccgtttcccgcttcgctaggaagagccgagttacatcccgtcgaactaaaacccttccaggattaccaaaagctgagctccaatctagggggacccggatcgtctagaacgccgcctacaggacgatcattcagtgggttaaactcacgactgaaggcaacccctagtacctactccggggtctttcgtacacagagagttgatctgtatcagcaggcgtcacctccagacgctctccgctggatcccaaagccatgggagcggactggacccccacctagagagggtccaagccggagggccgaagagccaggttctcgaggtgataaagagcctggcctgccccctcccaggta

SEQ ID NO: 236242 - DNA, 6449 bp, Artificial Sequence
  Description of Artificial Sequence: Synthetic coding sequence
atgtcagacagaagcgggccaacagccaaaggcaaagacggcaaaaagtacagctcattaaatctgttcgatacatacaaaggcaaaagcctggaaatccagaaacccgctgtcgctccgcgacacgggctgcagtcattagggaaggtggcaattgccagacgcatgcctcccccagccaacctcccttcactgaaggcagaaaataaaggaaacgaccccaatgtttctctggtacctaaagacggcacagggtgggcatctaaacaagagcaatcagacccgaaaagctccgacgccagcactgcacagccccctgaatctcaacctctgcccgcatcacagacccccgcatcaaaccaacccaagcgccctcctgctgcgcctgagaatacacccctggtcccatcaggcgtcaaaagctgggcccaggccagcgtgactcatggcgcacacggtgatggaggcagagcttcaagcctgctgtctcgttttagccgggaagagtttccgacactccaggctgctggcgaccaagacaaggctgccaaagagagggaatcggccgaacagtcttctggcccagggccatccctgagaccgcagaactctaccacctggcgtgatggcggaggacgtggccctgacgagttggaaggacccgattcaaagctgcatcacggacatgacccccgaggaggcttgcaaccatccggcccaccacaatttcccccttatcgtggcatgatgccgcctttcatgtatcccccttacctgccttttccccctccatacggaccgcagggaccataccgctatccaacccccgatggaccctctcgattcccaagggtggcagggcctcgcggaagtggccctcctatgcgactcgtggagcccgttggacggcctagcattctgaaagaagacaacctcaaggagtttgatcaactggatcaagaaaatgacgacggatgggcgggtgcacacgaggaagtcgactacactgagaagctgaaattttcagatgaggaagacgggagagactccgacgaggagggggcagagggccaccgcgatagccaatctgctagtggcgaagagaggcctcccgaggctgatggcaagaagggtaatagcccaaacagtgaaccccctacacctaagactgcatgggcagaaacatcaagaccacccgaaactgaaccgggacccccagctcccaaaccgcctttaccacctccacaccggggtccagcaggcaattgggggccacctggtgactacccggatcggggtggacctccatgtaagccacccgcacccgaggatgaagacgaggcatggcggcagaggagaaaacagagcagctcagagatcagcctggctgtggaacgcgctaggaggagacgtgaggaggaggaacgcagaatgcaggaggaacgacgtgctgcttgcgctgaaaagcttaaaaggctggatgaaaagttcggcgctccggacaagcgtctgaaggccgaaccggcagctcctcctgctgctccgtctacaccagcccctccacccgcagtgcccaaggagctgcctgcgccacccgcacctccccctgcttccgctccaaccccagaaaaggagcccgaagagccagcccaggctcccccagctcagagcacaccaacaccaggggtggccgctgcaccaaccctggtctctgggggaggctcgacatcgtctacttcctcaggctctttcgaggcctccccagtagagccgcagctcccttctaaggagggccctgagcccccagaggaggtgcccccacccacaactcccccagtccctaaggtcgaacccaagggcgatggaatcggccctacccggcagcccccttcccagggactcggttatcctaagtaccagaaatcattgcctcctagatttcagcggcagcagcaagagcagctccttaaacagcagcagcagcatcagtggcagcaacaccaacagggatctgcacctcccaccccagttcctccatctccaccccagcccgtaaccctgggtgccgtgccggctcctcaggcccctcctccccctccgaaagctctgtatcctggggcattgggcagaccacctcccatgcccccaatgaattttgaccctaggtggatgatgatcccgccatatgtggatcctcgtttacttcagggacgacctccgcttgacttttatcctccgggagtgcacccttcaggactcgtacccagagaaaggagtgattctggcggttcttcatcagagccgttcgataggcacgctcctgccatgttgagagagagaggaaccccccctgtcgacccaaagctggcatgggtgggagacgtcttcaccgcgactcccgcagagcctaggcctctcacctctcccctgaggcaagccgcagacgaggatgacaaggggatgcgatctgagacaccacccgtgccaccacccccaccttatttagcttcatatccaggcttcccagagaatggagctcctgggccaccgatctcccgctttccactggaagagcccggacccaggcccctgccttggccccctggttccgatgaggttgctaaaatacagacccctccaccgaaaaaagagcctcccaaagaagagactgcacagctgactgggccagaggctggtaggaagcctgcacgaggtgtggggtctggtggccagggcccaccccctcctagaagggagagtaggaccgaaactcggtgggggccaagacctgggtcgtcacggagggggatcccacccgaagaacccggagcacccccaagacgagcgggaccaattaagaaaccccctccccctacaaaggttgaagagctgcccccaaaacccctggaacagggagacgagacgcccaaacccccaaaacctgatcccctgaaaatcacaaagggcaagcttgggggacccaaagagacgccaccaaatggaaacttgagccccgctccgagactgcgcagagattattcctacgaacgggtcggccctacctcatgtagggggagaggtagaggcgagtatttcgcacggggaaggggtttccgcggaacctatggcggacggggtcggggtgctgccggtaattccgcagtgaccgagagctttgaagagatgatgggggtcgaagtcggtcagggcgaccagactacactgctcctgccagaagccgcactgccagcaaggcatggggctcgcgttcagagtatgagaaagagcccctcaggtgccggaagtggagctcagaagcaggccgctaggcctatgagagttatctggctgctgcagacccgcaggctcccccacccgcgacgcgaacattctccgaggtcaaggagtccaaccacccgttcgcccacttttcccgcaccagccagatttactcccggtgtcggtgaaagctccctgccagaaggcatcagtcctggtccaagaaggagagagccgcctcaggtgtgccccggatggtcccccccagcgaagagcctggccccaaagaaaccacccacaggcccacttcctccctcaaaggaacctctgaaggaaaagctgattcctggccctctcagtccagtcgctagaggagggtctaacggtgggagtaacgtggggatggaggatggagagagacctcgtaggcggaggcatggtagggcgcaacagcaggacaaaccccctaggttcagacggctgaaacaggagcgggaaaatgccgctcggggatctgagggcaagccttcattgaccctgccggcttcggcccctggaccagaagaggctcttaccaccgtcactgtggctccagcacccagaagggccgctgctaaatccccagacttgtctaatcagaactctgaccaagccaacgaagaatgggagactgctagcgagagcagcgactttacatctgagcggaggggcgataaagaggccccacctccagtcctgctgaccccaaaagcagtgggcacccctggaggcggaggcggtggagctgtccccggaatatccgcaatgtccaggggagacttgtcacagcgcgctaaggacctctccaaacgttccttctccagccagcggccaggaatggaacgccagaaccgcaggcctggcccaggtggcaaggccggtagctccggctcctcatcaggcggaggagggggaggacccggagggcgtactggccctggcaggggcgacaagcgcagctggccaagccctaagaacagaagccggccacccgaggaacggcctccaggcctgccactgcctccaccccctccttccagttccgccgtgtttcgcttagatcaggtgatccatagcaatccagcgggaattcagcaagcacttgcccagctctcatcacgccaaggatcagttaccgccccaggaggccacccacggcataagcccggaccacctcaagccccacagggtcccagccccaggcctccaactaggtacgaacctcaacgcgtgaattcaggccttagtagcgacccccatttcgaagagccaggacccatggttagaggcgtgggagggacccctcgggacagtgcaggcgtctccccttttccaccaaagcggagggaaaggccgcctcgcaagcccgagctcctgcaagaagaatctctgcctcctccccatagctccggattcctcggctctaagcccgaaggccctgggcctcaagcagaaagtcgggacaccggcacagaagcgcttacccctcacatctggaatagattacatactgctaccagtcgaaaaagttatcggccttcgtcgatggaaccctggatggagcctctctcccccttcgaggacgtggcaggcaccgaaatgtcacagtcagattcgggagtggatctgtcgggggatagtcaggtcagttcaggaccctgctcccagcggagctccccagacggcggactcaagggcgcagcagaggggccaccaaagcgccctggcggaagctctccccttaatgctgttccttgtgaggggcctcccggatccgagccacctcgccgacctcctcccgcaccccacgacggcgacagaaaggagttgccgagggaacagcctttaccccctggcccaataggaaccgagcgttcacaacacaccgaccgcggaaccgaaccaggccctatcagaccttcgcatcgtccaggacctccagttcagttcggcacgagcgacaaggacagcgatttacgcctggttgtgggcgacagtttgaaagctgaaaaggaactgacagcgagcgtcacggaagcaatccccgtcagccgcgactgggagttacttcctagcgccgcagcctctgccgagccccagagcaaaaacctcgactcgggccactgtgtgcctgaaccaagtagcagcggacagaggttgtatcccgaagtcttctatggaagtgccggtcctagctcatcccagatctcggggggacacgggctctcggttacctctaagcagtggcgcagaccaggaacaccctccctgcacccctacaggtctcagccactctatcttcccccaggccctgcaccacctagtgccctgctttccggagtcgcgcttaaggggcagttcctagactttagtaccatgcaggcgaccgagctcggaaaactacctgctgggggtgtattgtatcctcccccaagctttctctacagccccgcattctgcccatccccgctgcccgacacctctctgttgcaggtgcgtcaggatcttccgtcccccagtgacttttattctacacccctccagcccggaggccagagtggtttcttaccttccggagcccctgctcagcagatgctgcttcctatggtcgactctcagctgccagtagtaaattttgggtccctgccccctgcccctccaccagctccacccagtctgagcttactgcccgtcggccctgccctccaaccgcctagtctcgcagttagaccccctcccgcaccagctacaagggtactccccagccctgcccgtccattccccgcttcgctcggaagagccgagctgcaccccgtggaactcaaacccttccaagactatcagaaattgtcctccaacttggggggaccgggaagcagtcgaacgccgccaacagggaggtccttttctggactcaactcaaggctaaaagcaaccccatcaacgtactctggggtgttcaggacacaaagggtcgatttataccagcaggcgtcccccccagatgcactccgctggattcctaagccctgggagcggaccggccctcccccacgcgaagggccatcacggagagccgaggaacctggcagccgaggggataaggagcctggactgccacctcccaggta

SEQ ID NO: 236243 - DNA, 1650 bp, Artificial Sequence
  Description of Artificial Sequence: Synthetic coding sequence
atgagtgacagatccgggccaaccgctaaggggaaggacgggaagaagtatagctccttaaatttatttgacacatacaagggaaaatccctggaaattcaaaaaccggcagttgcgccaagacacgggttgcaatcattgggcaaggtggcgatcgccagaaggatgccgcctccagcaaatctgccctcactgaaagccgaaaacaagggcaatgatcccaacgtgtctctggtgcccaaggacggtacaggctgggcttctaagcaggagcaaagcgatcctaagtcctcagacgcatccacggctcagcctcccgaatcacaacccctgcctgccagccagactccagcttctaatcagcctaaacgaccgcctgccgcacccgagaatactcccctggtcccttcgggggtgaaatcctgggcccaagctagcgtgacgcacggtgcccatggagacggcggacgggcttcttctctgttgagccggttcagccgcgaggaattccctacactgcaggctgccggagaccaggataaggctgccaaggagagggagtctgcagaacagagcagcggaccgggaccgagcttgcggcctcaaaattctacaacctggagggatgggggaggacgcggtccggatgaactagaaggcccagacagcaagcttcatcacgggcatgatcctagggggggacttcagccgtccgggcctccccagtttcctccttaccgcggaatgatgccccctttcatgtatcccccttacctgccatttccgcctccatacggccctcaggggccatatcggtaccccacacccgacgggccttcccgcttccctcgagttgccggacctcgaggcagcggccctcccatgcgtctggtggagcctgttggtcggcctagcatcctcaaggaggacaacctgaaggagttcgatcagctggaccaagaaaacgacgacgggtgggcaggcgcacacgaagaagtggactacaccgagaagctaaagttcagtgacgaagaggatgggagggattccgatgaggaaggggcagaaggacaccgtgatagccaaagtgcctctggggaagaaaggccacctgaggcggatggtaagaaaggcaattcccctaattcagaaccccctacacccaaaactgcttgggctgagacctcaagacccccagaaaccgaacctggccctccagcgccaaaaccacccctgcccccacctcaccgcggaccggcaggtaactgggggccacccggagattatccagaccggggagggcctccctgcaaacctcctgctccggaggatgaggacgaggcatggcggcagcggcgtaagcaatcttcctcagagatctctctggcagtggagagggcacggaggagacgtgaggaggaggagcgacgtatgcaagaagaaagacgcgctgcatgcgctgaaaaactcaaaagactggatgagaaatttggtgctccagacaagcgtcttaaggcagaacccgcagctcccccagctgctccctctacccccgcacctcctcctgccgctagcgaagtgccccttatggaggatagtcgtggacagcaacgggaccctccacgcggtcttgaggcccctcacccctag

SEQ ID NO: 236244 - DNA, 1650 bp, Artificial Sequence
  Description of Artificial Sequence: Synthetic coding sequence
atgtcagataggtcaggccctacagcaaaaggaaaagacggcaaaaagtactctagcctaaatctgtttgacacctacaagggaaaaagtcttgaaattcagaaaccggcagttgcccctcgccatggactgcaaagtcttggaaaagttgcgattgctcgcagaatgccaccccctgccaatctgccttctctcaaagcagagaacaagggaaacgacccaaatgtcagcttagtccctaaagacggcactggctgggcttcaaagcaggagcaatctgacccaaaatctagcgacgcctctactgcccaacctccagagagccaacctctgcctgcgagtcagacccccgcatccaaccaacctaagcggccacccgctgcccctgaaaacacccctcttgtgcccagtggcgtcaagtcttgggcccaagcctcagttacccacggggctcacggagatggaggccgtgcttcctccctgctgtctcgtttcagccgcgaagagttccctactctgcaagccgctggcgatcaagacaaggcagccaaggaaagagagagcgctgaacaatcctctggaccaggcccttctcttcgcccacagaattctactacctggcgagatggcggaggcagaggcccagatgagctcgaagggccagactcaaagcttcaccacggccatgaccctcggggtggtcttcaaccctccggaccaccacagtttcctccctataggggaatgatgcccccatttatgtaccctccttatttacctttcccacccccttacggaccccaaggcccttacagatacccgaccccagatgggcctagtcgctttccccgagtagcaggacctcgaggatctggcccacccatgagacttgtcgaacccgtgggcagaccttcaattctcaaagaggataacctgaaggagttcgaccagctggaccaagaaaacgacgacggttgggcgggtgcgcatgaagaggtggattataccgagaagctgaagttttccgatgaagaagacggccgagactcagacgaggagggcgcagaaggacacagggactcccagtcagcttcaggggaggagcgcccacctgaggccgatggaaagaaggggaattcacctaatagtgagcccccaactcctaagaccgcctgggctgaaacatcccggccaccagaaactgagccagggcctccagcacccaagccacccctccctccccctcatcggggacccgcagggaattggggaccccctggagattaccctgatcgaggtggaccgccatgcaagccccctgctccagaggacgaggacgaggcctggaggcagcgaagaaaacagtcttcttccgagatttcactggccgttgagcgcgctcgccgacgtagggaggaggaagagagacgcatgcaggaagagaggagagctgcatgcgctgaaaaactgaaaagacttgacgaaaagtttggagcccctgacaaacgattaaaagcagagcccgcagctcccccagccgcacctagcacaccagctcccccacccgctgcctccgaagttccgctgatggaagatagtagaggccagcaacgtgaccccccaagggggctggaagcacctcacccctag

SEQ ID NO: 236245 - DNA, 4149 bp, Artificial Sequence
  Description of Artificial Sequence: Synthetic coding sequence
atgctgcgggaaaggggcactccacccgtggatcctaagctcgcttgggttggcgatgtgttcaccgctactccggcagaacccagacctctgactagccctctgaggcaggccgctgacgaggacgacaaaggtatgcggagcgagaccccaccggtcccgcctccacccccttatcttgcgtcataccccggttttccagagaatggcgctccaggtcccccaattagcaggttcccccttgaagagcctggacctcgccctctgccttggcctcccggtagcgatgaagtggctaaaatccagacaccgcctcctaaaaaggaaccacctaaggaagaaaccgcacaactgacaggacctgaggctgggaggaaacccgcacgtggtgtcggttctgggggacagggaccccctccccctagacgcgagagccgtacagaaacccgctggggcccaagaccagggtcaagcaggcgtggcattccaccggaggaacccggtgcacccccacgtcgcgctggtcccatcaagaaaccgcctccccctacgaaggtggaagagctgccgccaaaacccttagagcagggtgatgaaacgccaaagccgcctaagcccgaccctctaaagattacaaaaggcaaattgggaggaccaaaagaaacccccccaaatggcaacttgtcgcccgctccgaggctacgcagggattattcgtatgagcgcgtgggacccacctcctgcaggggcaggggaagaggcgagtacttcgcacgtggtcgcggattccgtggaacctacggcggtcggggtcggggagcgagatctcgcgagttccggtcctacagagagtttcgcggtgacgacgggagagggggaggcactggagggcctaaccatcccccagctccaagaggcagaacagcttccgagacacgcagcgaagggtccgagtatgaggaaatacccaagcggagacggcagagaggcagtgaaactgggagtgagactcacgaatcagatctggcgccttccgataaggaagccccaaccccaaaggaaggcacacttacacaggttcctctggcaccgcctccgcctggggcaccacccagcccagccccagcgcgtttcacagctcggggaggcagggtcttcacgcccagaggggtgccatccaggcgcggtcgaggcggagggaggccgccaccccaggtttgccccggttggagccccccagctaaaagcctggctccaaagaagcccccaactggccctctcccaccgagcaaggaacccctgaaggaaaagctgattccaggaccactgtcccctgtggctcggggtggcagtaatggaggcagcaacgttgggatggaggatggcgaacggccaagacgtcggagacacgggagagcgcagcaacaggacaaaccacctaggtttaggagacttaagcaggagcgggagaacgccgcaagggggtccgaaggtaagccttcgctcactctgcctgcatccgcgcctggcccagaggaggctctgacaacggtcaccgtcgcgcctgccccacggagagccgctgcaaagtcccccgacctgagcaaccagaactctgaccaggctaacgaggaatgggaaaccgcttccgagtcaagcgactttacatccgaacggagaggagacaaggaggcccctcccccagtactcctgacacctaaggctgtcggtacacctggaggcggtggcggaggagccgtcccaggcatttcggcaatgtctaggggggacctcagccaacgcgctaaggatctgtcaaaaagatctttttcctcacagagacctggcatggaaagacagaaccggcgacccggaccagggggtaaagcgggttccagtggctcatctagcggaggcggtggaggcggacccggtgggagaaccggaccaggcagaggcgataagcggagttggcccagtcctaagaatagatcacgacctcctgaagagcggcctcctggccttccgttaccacccccacctccatctagctcagccgtgtttcgactggaccaggtgattcacagtaatccagcgggaatccagcaggcactagcccagttaagctcaagacaagggtcagtcactgcccctggagggcatcctcggcacaaaccgggaccgccacaagcccctcagggcccttcaccgagaccccctaccaggtatgagccacaaagagtcaatagcggcctgagctccgatccacattttgaagaaccaggccctatggtccgcggagtcggcggaacgcctcgcgacagcgctggagtctctccctttcctccaaagcggagagagagaccccctcggaaacctgagcttctccaagaggagtctctgccacctccccattcctctggctttctcggctcaaagccagaaggtccaggcccacaggctgagtcacgcgataccggaactgaggcgttgactccccacatttggaatcggctgcacactgccacatccagaaagtcataccgcccatcaagtatggaaccctggatggaacctctgtccccctttgaagatgtcgcaggcaccgagatgtcacaaagcgactccggggtggacctgagcggggactcccaggtgtcctctgggccttgctcccagcggtctagcccggatggcggattgaaaggagcagccgagggacctccaaaaaggcccggaggctcgagtcctctgaacgcagttccatgcgagggtcctcctggttcagagccacctcgccgaccaccccctgcacctcatgacggcgatagaaaggaattgccgagagagcagcccctgccacctggcccaataggcactgagagaagccagcacaccgatcgcggtacggaaccaggtcccattaggccatctcaccgccctggcccacctgtgcagttcgggacatccgacaaagactcagacctccggctggtcgtaggagatagtttgaaggccgagaaggagctgacagcatccgtaaccgaagccatcccggtgagcagggattgggaactgctcccaagtgccgcagcatctgccgagccccagtcgaagaatctggatagtggacattgcgtgcccgagccctctagcagcggccagcggctatatcctgaagtattctatggctccgccggaccaagcagctcacagattagtggcggagcaatggacagccagctccatcctaactcaggcggattccgacccggaacccccagcttgcatccataccgatctcaacccttatatctgcctcctggaccggcaccgccaagcgcacttctaagcggcgtggctctaaagggtcagttccttgactttagcacaatgcaggccacagaactgggcaagcttcctgcaggaggcgtgttgtatccaccgccatcctttttgtattcaccggctttctgtccttctccactaccagacacgtccctgctacaggtcaggcaagacttgccatctccgtcagatttttattcaacccccctacagcctgggggacagtctggatttctgccatctggtgcacccgcacaacaaatgctgctgccaatggtggatagccaactgcccgtcgtgaactttggctctttgccgcctgcccctcctcccgcaccaccctctctgtccctcctgcccgtggggccagctcttcagccaccttcactggcagtgaggcctccacctgccccagctacccgagtgctacccagtcccgctcgcccttttcccgcttcactgggccgagccgaacttcacccagtggagctgaagcctttccaggactatcaaaagctgtccagcaacctcggaggacccggatcctcacggacccccccaacgggtagaagcttttctggcctgaactcccggctcaaggccactccctctacatactctggcgtgtttcggacccagagagtcgatctataccagcaggccagcccccctgacgccctacgatggatcccaaaaccttgggagaggacaggtcctcccccacgggaaggcccttctcgccgagcagaagagcccggatcccgaggcgacaaagagcccggactgccgccaccaaggtag

SEQ ID NO: 236246 - DNA, 6416 bp, Artificial Sequence
  Description of Artificial Sequence: Synthetic coding sequence
atgagtgaccgcagtggcccaactgctaaagggaaagatggtaaaaagtactcctcgctcaacttgttcgacacatacaagggtaagtccctggagatacaaaagccagcggtggcccctagacacggcctgcaatcactggggaaggttgccattgctaggcgaatgccacctcctgcgaacctgccttctctgaaagcagaaaacaagggaaacgatcccaacgtctctctggtgccaaaggacgggaccggatgggcgagtaaacaggaacagagcgaccccaaatcatctgatgctagtaccgcacagccccttgagagtcagccgctaccggctagccagacacctgcttccaaccaaccaaaacgccctcccgctgcgccagagaacacgccacttgtcccatccggtgtgaagtcatgggctcaggcctctgtgacccacggcgctcacggtgacggcggaagggccagttcgttgttaagcagatttagccgggaagagtttccgacgctgcaagctgctggggaccaagataaagcggctaaggaacgcgaatccgctgagcagagtagtgggcctgggccaagcctgagacctcagaatagcacaacgtggcgtgacggcggaggccgtgggccagacgagctagagggcccagactccaagctgcatcacggccatgacccacgcggtggactgcagcccagcggaccccctcagttccccccttaccgcggtatgatgccaccgttcatgtacccaccatacctgcccttcccacccccatacggaccgcaggggccttatagataccctacaccggacggcccatcccggttccccagagtcgctgggcctcggggaagcggccctccaatgcggttggtggagccagtggggcgaccgagcatcctaaaggaggacaatctcaaagaatttgatcagttggaccaggaaaatgacgatggttgggccggtgcccacgaggaggtcgattataccgagaagttgaaatttagtgacgaggaggacgggcgtgactctgatgaagagggcgcagagggacaccgcgattcccagtccgctagcggcgaggagcgacctccagaagctgatggaaaaaagggtaactccccgaacagtgaaccccctacaccaaaaaccgcttgggcagaaacttctcgcccacccgaaactgagccagggccacctgcacctaagccccctttgccccctcccggtgattatcctgacaggggaggcccaccctgcaagcccccagcccctgaagatgaagatgaagcttggcggcagagacgtaaacagagcagttccgaaatcagcttagccgtcgagcgcgcacgcaggcggagagaagaggaagagcgcagaatgcaggaggaacggcgagccgcttgcgccgagaaactgaagaggctggatgaaaagtttggcgcaccggataaacggctcaaagcagagccagctgcccctcctgctgccccttccactcctgctccgcctcccgctgtccctaaagaattaccagcccctccagcaccgcctcccgcatccgctccaacacctgaaaaagaacccgaagaaccagcgcaggccccaccagcacagagtacaccgacgccaggggtggccgctgcaccgacattggtgagcggcggtggatctaccagtagtacaagtagcgggagtttcgaggcgagccccgtcgaacctcagctcccctcaaaggagggccctgaaccgccagaggaggttccgccacctacgactcctcccgtgcccaaggtcgagcccaaaggggatggaattggccctacgcgacagcccccaagccagggcctaggctatcccaagtatcagaagtcactcccgcctaggttccagagacagcagcaggaacaactcctgaagcagcagcaacaacatcagtggcaacagcaccaacagggctctgccccacccacccctgtccctcccagcccaccacagcctgtgactctgggcgcagtgcctgcaccccaggcaccacctccaccccctaaggccctgtatcctggcgcactgggacgtccaccaccgatgcccccaatgaacttcgaccccaggtggatgatgatcccaccctatgtcgatccgcgactgctgcaaggtcgccctccgctcgacttctacccacccggagttcatccttcaggactggttccgagggagcgctcagattcagggggaagttcctcagagccattcgaccggcacgccccagctatgctgagagagcggggaactcccccagtcgacccgaaactcgcctgggtgggggatgttttcacggccacacccgctgagcctcgacccttgaccagtcccttgcgacaagccgctgacgaggatgacaaaggcatgagatccgagacgccacctgtgccacccccacctccatacctggcgagctatcccggatttccagaaaatggagcccctgggcctcccatttcgcgcttcccactcgaggaacccggacctcgccctctaccatggcccccagggtctgatgaggtggccaaaatacaaacacccccaccgaagaaagagccaccaaaagaggaaacagctcagttgactggccctgaagcaggtaggaaaccagcgcgtggcgtcgggtcgggaggacagggcccaccaccccctcggcgagagagtagaactgagacacgatggggcccacggccaggctcttcccgtagagggattcctccagaagagccaggagcaccaccccgaagagccggacccattaaaaagccacccccaccaactaaagtggaagagctgccccctaagccattggaacagggcgatgagactcccaagccgcctaagcctgacccactgaaaataacaaagggcaaattgggtggacctaaggagactcccccaaacgggaacctttccccagccccacggcttaggcgcgactattcatacgaaagggtggggccaacaagctgcagaggcaggggtcgaggggagtatttcgccaggggacggggattccggggaacgtatggtgggaggggcaggggcgcagccggtaattccgccgtgacagagagttttgaggaaatgatgggcgttgaggtgggccagggggaccagaccactctgctgctcccggaagctgctctacctgcacggcatggagcccgagtgcagtcaatgcgcaagagcccctcaggagcgggaagcggggctcagaaacaggccgctcggcctatgagggtgatttggcttctccagaccagaagactcccacatccgagacgcgagcactcaccacgaagtcgctccccaacaacacggtcccctacttttcccgctcctgctcgtttcactcccggagtgggggaaagtagtcttcccgaaggcatttcccccggaccaaggaggagggagcctccacaggtgtgtcccggttggtccccccctgctaagtcactcgctcctaagaaaccgccaacaggacctttgcccccttccaaagaacccttgaaagaaaagctcatccccggtcccctgtcccccgtggctcggggtggctccaatgggggaagcaacgtcggcatggaagatggcgaaaggccccgacgcagacggcatggcagagcccaacagcaggacaaacctcctaggttccggaggctcaaacaggagagagaaaatgccgctagaggctcggaaggcaagccttccctgactctgcccgcttccgcccctggtccggaggaggctcttaccaccgtgaccgtcgcgcctgcaccccgtagggctgcagcgaagagcccagatctctccaaccagaactcagaccaggccaatgaggagtgggagactgctagtgagagcagtgacttcacaagcgaaagacgcggagataaggaagcaccccctcctgtgctgcttactcccaaggccgtgggaacaccaggaggcggaggcggaggggcagtccccggaatctccgctatgtctagaggtgacctgtctcagagagctaaagatttgtctaagaggtcgttttctagtcaacgccctggcatggagagacagaaccggcgtccgggaccagggggtaaagctggcagctctggctctagtagtggcggaggtggaggaggaccaggcggtcgtacaggacctggccgaggcgacaagcggtcctggccttcgccaaaaaatagatcaaggccgccagaggagaggccacctggcttgccgctgccacctcctcctccgtcctcctccgcggtttttaggctggaccaggtgatccacagtaatccggctggaatccaacaggccctcgctcagctgagcagcaggcaagggtccgtgacagccccaggcggacacccaaggcacaaacctgggcctccgcaggccccacaggggcctagtcccaggcctcccactcgttacgagccacagagggtgaactctgggctctcatcagatccgcacttcgaagaacccggtcccatggtgagaggcgttggcggaacaccaagggattccgcaggagtctctccttttcctcccaagcgtcgggagaggcccccacgtaagcctgaactgctgcaggaggaaagcctccccccaccacattcttcggggtttttaggctccaaacctgaagggccaggccctcaggccgaatctcgggacaccgggacagaagcactgaccccacatatttggaacaggctgcatactgctacaagtaggaaatcataccggccttcttctatggaaccttggatggaacctctgtcccccttcgaagacgttgcgggtacagagatgtcccagagcgattctggagtggacctctccggtgatagtcaagtgtcttcaggaccatgttcacagcggtccagccctgatggaggtctgaagggcgctgccgagggccctccgaagaggccaggaggatccagtcccttaaacgcggtcccttgtgaggggccaccaggatctgaacccccacggagaccacccccagcccctcacgacggcgaccgcaaagaactccccagggagcagcctcttccccctggtcccatcggaaccgaaaggtcccagagaaccgatagaggcacagagccaggacccatcagaccctctcatcgtccaggtccaccagtgcagtttggcacttctgataaggactctgacctgcgtctcgtcgttggagacagcttgaaggcagaaaaagaacttacggccagtgttactgaggctatccccgtgagtagggactgggagttacttcccagcgccgctgcttccgctgaaccacagtccaagaatttagatagtggtcattgtgtaccggagccctctagctccggacagagactctaccccgaggttttttacggctccgccggtccttcgtcttcgcagatcagcggcggacatgggctctccatcacaagtaagcaatggcgcaggcccggaacacccagcttgcatccttataggagccagccactgtatcttcctccagggccagcgccaccgtctgccctgctgtctggagtagccctgaaggggcagttcttggatttcagtacaatgcaggccaccgaactaggcaagctgcctgcgggtggcgtgctgtatcctccaccgagctttctgtatagcccagcgttctgtccgtcaccgcttccagacacctccttgttgcaggtgcggcaggacttgccaagtccctcagacttctactccacgccgcttcagcccggtggccagagtgggtttctgccctccggagctccagcccagcaaatgttacttcccatggttgacagccaactccccgtggtgaacttcggctccctgccgcctgcgcctcccccagccccaccacctctcagcttgctgccggtggggccagctttgcagcccccatctctggctgtgaggcccccacccgctccggcaacacgtgttctcccaagccctgcaaggccattcccagcttctctgggccgtgcagagctgcacccagtagaactaaagcctttccaggactatcagaagttgagttctaacctcggcggtcctggatccagccgcacccccccaaccggaagaagctttagcgggctgaactctcgccttaaggccactccaagcacatactccggtgtcttcagaacccaacgcgttgatttataccaacaggcctcaccccctgatgccttgagatggattcctaagccgtgggagaggaccggccctccaccaagggaggggccatcacgacgggctgaggagccagggtctaggggggataaggagcccggactcccacctcctcgcta

SEQ ID NO: 236247 - DNA, 6416 bp, Artificial Sequence
  Description of Artificial Sequence: Synthetic coding sequence
atgagcgatagatccggcccaaccgccaagggcaaagacggtaaaaagtattcctcactgaatctgttcgatacttacaagggtaagagcttggaaatccagaagccagccgtcgctcccaggcacggactgcagagcctgggcaaagtggctatcgctcgaaggatgccacctccggctaatctgccttctttaaaggccgaaaataaggggaatgatccaaatgtctctctcgttcctaaggacggcaccgggtgggcctcgaaacaggagcaaagtgatccaaaatctagcgacgccagcaccgctcagccccctgaatcacagcccttaccggcttcacagacccccgctagtaaccagcccaagaggccccctgctgctcccgagaacactccacttgtgccctccggcgtcaagtcctgggcccaggccagcgtgacacacggagctcacggagatggtgggagagcatcttcactgctgtcacgtttcagcagggaggagttccctaccctgcaggccgcaggggatcaggataaagcagccaaggagcgggagtcagcggaacagtcatccggccctggacctagtcttagaccacaaaatagcactacttggagagacgggggaggaagaggacctgacgagcttgagggacccgacagcaaactgcaccacggccacgatcccagggggggactgcagccctcagggccaccacagtttcctccatatagggggatgatgccaccgtttatgtaccctccctatctgcccttcccacccccatacgggcctcagggtccatatagatacccgacacctgacggtccttctcgctttccaagggtggcagggcctagaggcagcggaccccctatgaggttggtcgaacctgtcggaagaccctcgattctgaaagaagataatcttaaggagtttgaccaactcgaccaagagaacgacgacgggtgggccggagcccacgaggaggtagattacactgaaaaattaaaattcagtgatgaggaagatggacgcgattcggatgaggaaggggcagaagggcaccgcgattcccagtccgcttcaggggaggaacgtccgccagaggcagatggcaaaaagggcaattcaccaaacagtgaacctccaacaccaaagactgcttgggctgaaacaagccggcctcctgagaccgagccgggaccgcctgctcccaaaccgccactccccccaccgggtgattatccagaccgcggtggaccaccctgcaaaccccctgctccagaagatgaggatgaagcctggaggcagcggaggaaacagtcttcttccgagattagtctcgccgttgagcgtgcacgcaggcggagggaagaggaagagcgacgtatgcaggaggaaagaagggcggcttgcgcagagaaactcaagcgattagacgaaaaatttggtgccccagataaaagattaaaagcggagcccgctgcaccaccagccgctcctagcactcctgccccaccacctgcagttccaaaggagctccccgcaccccctgcccctcccccagccagcgcaccaacaccagagaaggagcctgaagaaccagcacaggcccctcctgcccagtctacccctactcctggcgtcgcggctgcacccacgctggtctctggcggtgggagcactagcagtacttcctccggctcctttgaggccagcccggtcgagcctcaattgccatcaaaggagggaccagagccaccggaagaggtgccccctcctacgacaccacctgtacccaaggtcgagccaaaaggtgatggtattggaccaactaggcagcctccatctcaggggctgggctatcccaaataccagaagtcactgcccccaagatttcagagacagcagcaggaacaactccttaaacagcagcaacagcaccagtggcaacagcatcagcagggctctgctccccctacccccgtgccccctagtccccctcagcccgtgacgctgggagccgtgcccgcaccacaggcacccccacctcccccaaaggctctttaccccggagccttaggacggcctcccccaatgccacctatgaacttcgatcctcggtggatgatgattccgccttatgtggatcccagactcctgcaaggcaggccacccctagacttctaccctcccggagtccacccatccggtctcgtccctagggagcgaagtgacagtggagggagctcttccgaaccttttgataggcacgctcccgctatgttgagggagagaggtacaccgccagtggatcccaaactcgcatgggtgggtgacgtatttactgcaaccccagccgaacctcgtcctctgacctccccccttaggcaggccgctgatgaggacgacaaaggaatgagaagtgagacaccacccgtgccacccccacccccatatcttgcttcatatcccggatttcccgagaacggcgcaccaggaccgccaattagccggttccccctggaggaaccaggccctaggccgctgccctggccacctgggtccgatgaggtggccaagatccagaccccaccacccaaaaaggaacctcctaaggaggagacagcacagctgaccggcccagaagccggtcggaagccagccagaggcgtggggtcaggaggtcaaggtcctcccccaccccgtcgtgaatcccggacagaaactaggtgggggcctcggccaggttcctctaggcgcggaatcccacctgaggagccgggagccccacccaggagagctggacccattaaaaagcccccacccccaacaaaggtagaggagctgcctcccaagcccctggagcagggcgatgagacgcctaaaccccctaagccggacccattaaaaattacaaaagggaagctgggaggcccaaaggaaacaccacccaatggcaacctcagccccgctccccgtttgcgtagagattacagctacgagagggtcggacccaccagctgtagagggcgtgggcgaggtgaatatttcgctcgaggacggggattcagggggacatacgggggaaggggcaggggcgctgcaggcaatagtgcagtgacagaaagctttgaggaaatgatgggcgtcgaggtcggccagggagatcagacaacactgttgctgcctgaggctgcgctgcccgctcgacatggagccagggtgcagagcatgagaaaatcaccttcaggtgcagggtccggagcacaaaaacaagcggctcgcccaatgcgcgttatatggctcctgcaaacccgaagactacctcatccacgccgtgagcattccccaagatcacggagtcctacaacccgaagtccgaccttccccgcaccagccaggtttaccccaggggtgggagagtctagcttgccggaaggcatttccccaggcccaaggaggcgcgaaccccctcaagtctgtcctggctggagcccaccggctaagagcttagccccaaaaaagccacccacggggccactaccgcctagtaaagagcccctgaaagagaaactgattcctggccctctaagcccagtcgcacgcggaggctccaacggcggatcaaacgtggggatggaggatggagagcgaccaagacgacggcgacatgggcgagctcaacagcaggacaaacctcctcgatttcgccgtctaaagcaggaaagggaaaacgcagcacgcggttctgaagggaagccctcccttaccctgcccgcttcagcccctggccctgaggaggccttgaccacggtgaccgtggcccctgccccacgacgagcagcagcgaaatcccctgatctcagcaaccagaattcggaccaggctaacgaagaatgggagacagcgtctgagtcctcagattttacgagtgagcgacggggtgacaaggaggcaccaccccctgtccttctcaccccaaaagccgtggggacacctggaggaggcggaggtggcgctgtcccaggcatcagcgctatgagtcggggtgacctgtcccagcgcgcaaaggacctgagcaaaaggagttttagctcacagcggcctgggatggagcggcagaatcggagacccggacctggagggaaagcaggctcgtctgggtcttcttctggcggaggcggagggggacctgggggacggaccgggccaggacgtggagataagagaagctggccatccccaaagaataggtcacggcctcccgaagagagaccccctgggctccctctgccaccgcctcccccatcctcctctgctgttttccgattagaccaagtcattcacagcaatccggctggaatccagcaggccctggcccagttgagcagccgtcagggttctgtcaccgccccaggcggacaccccaggcacaaacccggtcccccacaggctccacaggggccatcaccccgacccccaaccaggtacgagccacagagagtgaacagcggactctcgtccgacccacactttgaggaaccagggcctatggtgcgcggagtgggtggcacacctcgggattcagccggagttagcccatttccacccaagaggagggaacgcccaccaagaaaacctgagctgcttcaggaggagtccttgccccctcctcattcctcgggtttcctggggtccaaaccagaggggccaggtccacaagcagagtcccgggataccggcactgaagctttgacacctcatatttggaataggctacatactgctacgtcgcgcaaaagttataggccaagcagcatggagccctggatggaacccctgtccccctttgaggatgtcgctgggactgagatgtctcagtctgacagtggagttgacctgagcggggacagccaggttagtagcggcccttgcagccaacgcagttcgcctgacggcggactgaaaggggcagctgaaggacctcctaagcgcccagggggttctagccccttgaatgcagttccatgcgaaggaccacctggtagtgagccacctagacgcccacccccagctccacatgacggggatcgaaaagagctgcccagagagcaacctctgccacccggacctatcgggacagaacgaagtcaacacactgatcgcggtactgaaccgggtccgattcgtccaagtcaccgacctggcccaccagtgcagttcggaacatcagacaaagacagtgaccttagactcgtcgttggtgactccttgaaagcagaaaaggaattaactgcatcagtgacggaggccataccagtgtctagggattgggaattgttaccttcagccgcagcctctgcagaaccgcagtctaagaacctggattctggccactgtgtcccggagccgagtagctccgggcaacggctctaccctgaggtcttttacgggagcgccggaccttctagcagtcagatatcagggggacacggcctgtctgtgacatcaaagcagtggagaaggcctgggaccccttccctccatccatatcgaagccaacccctttacctgccacccggaccagctccaccatcagccctgctttccggagtggcattgaaaggacagttcctcgatttctcaacaatgcaggccacggaactcggcaaacttccggcagggggagtcctgtatccccctccatcgtttctgtactcgcccgcattctgccctagccccctgccggacaccagcctgttacaagtgagacaagacctgccctctccatctgacttttatagcaccccgctccagcctgggggtcagtcaggatttttgccaagcggtgctccagcgcagcagatgctccttccaatggtagatagccaactccctgtggtgaacttcgggtcacttcctcctgcacctcccccagcacccccttcgctctcgcttctgcccgtggggccagctctccagccaccttccctagccgtgcggccaccacccgctcccgctactcgtgttctaccctctccagcacggccttttcccgcttctctgggcagagcagaactccaccctgttgagctcaaacccttccaggattatcagaaattgagctcaaaccttgggggtcccggatccagcaggactcctcccacagggagatcattttcaggtttgaactctcggctcaaggcaaccccatccacctactctggcgtgtttcgcacacagcgtgtggatctttaccaacaggcctccccgcctgacgccctgaggtggattcccaagccatgggagagaactggtccaccacccagagagggcccaagtcgtcgcgctgaggaacctggatccaggggtgataaagaacctggcctgcctccccctcggta

SEQ ID NO: 236248 - DNA, 6416 bp, Artificial Sequence
  Description of Artificial Sequence: Synthetic coding sequence
atgtcagaccggtcaggcccaaccgcaaagggaaaagacggtaaaaagtattcatccttgaacttgtttgacacatacaagggcaagtccctcgaaattcagaaaccagccgttgcccctagacacggccttcagagtctcgggaaagtagcgatagctagaagaatgcccccacctgcaaatcttcccagcctgaaagctgagaacaagggcaatgaccctaatgtatcgctggtgcctaaagatggtactggctgggcaagtaaacaagagcagtccgaccctaagtcgtctgacgccagcaccgcgcaacctccggagagccaacccttgcctgcatctcagacacctgccagtaaccagccgaagagacctcccgctgctccggagaatacacccttggtgccctccggcgtgaaatcctgggctcaggcaagcgtaacccacggggctcatggcgatggaggaagagcaagtagcttactgtcacgattctcgcgtgaagagttcccaactctccaagcagccggagaccaagacaaagccgcaaaggagagagagtctgctgaacagtcttcaggtcctggccctagtttaagaccccagaacagcacaacgtggcgcgacggcggtggtcgaggcccagacgagctggaaggccctgacagtaagctgcatcacgggcatgatcctaggggaggcctccagcctagcggccctccgcaattccctccctatcggggaatgatgcccccattcatgtatccaccctacctgccgttcccccctccgtatggaccccagggcccatatcgctaccctaccccagatgggccttcccggtttcctagggtggctggtccgcgaggctccggaccccctatgaggctggttgagcccgtgggaagaccgagcattttaaaggaggacaaccttaaagaattcgatcagctggaccaggaaaatgacgacggatgggctggcgcacacgaagaggttgattacacggagaaactcaaattctccgacgaggaggatggtcgcgattcggatgaggagggagctgagggtcaccgagattcccagtccgcctctggcgaagaacgccctcccgaggctgacggcaagaagggaaatagtcccaatagtgagcccccaacgccaaaaactgcttgggcggagacgtctaggccacctgagaccgagcctggcccaccagccccaaaacctcccctgccccctccaggcgactacccggatcggggaggccctccatgcaagccacccgctcccgaggacgaggacgaggcatggaggcagcggagaaagcaatccagctccgagatttcgctggctgtggagagggccagaaggagacgcgaagaggaagaacgacggatgcaggaggagcgtcgagccgcatgtgctgagaagctcaagcggctggatgagaaattcggagctcctgataaaagactcaaagccgagccggcagcaccacccgctgcaccctcgacacccgctcctccacccgcagtcccaaaggaactacccgcaccacccgcacctccaccggctagtgcccctactccagagacagagccggaggaacccgcacaggcccctcccgctcagtcaacaccaaccccgggtgtggcagccgcacctacactcgtgagcgggggagggagcacgagctccacttcaagcggttcttttgaggccagtcctgtggagccgcaactgccatctaaagagggccctgagccccctgaagaggtgccgccaccgactacccctcctgtgcctaaagtcgagcctaaaggggatgggataggaccaacaaggcaaccaccatcccaggggctgggataccctaagtaccagaagagcctgcctccgaggttccagcggcagcagcaggagcagctgctcaaacagcagcagcagcaccaatggcagcagcaccagcaggggtcagcccctcctacgccagtgccacccagccctccgcagcccgtcacgctcggagcagtgcccgctccacaggctccccctcctcccccaaaggcgctgtacccaggcgctctgggacgtcctcctcctatgcccccaatgaatttcgacccgcgttggatgatgatcccgccatatgtagaccccaggctgcttcaaggtcgacctcccctcgatttctaccctccaggagttcatccttcgggtctggtccctagggagcgcagcgacagtggaggatcgagcagcgaaccatttgaccggcacgcacccgcaatgcttagagaaagagggactccccctgttgaccctaagctggcctgggtgggcgacgtgtttactgctacacctgctgagcctcgcccattaactagcccgctgcggcaggcagccgacgaagacgacaaaggcatgcgttctgagacccccccagtgccaccgcctcccccttacttagcctcgtatccagggtttcctgaaaatggggcacccggacccccaattagccgttttcctctggaggagcccggaccgcgacccctaccctggccccctggttctgacgaggtggcaaagatccagactccgccacctaaaaaagagccgccaaaagaagagacagctcagctgacagggccagaagccggacgcaaaccggcacgaggggtcggttccggaggccagggcccaccccctcccagaagagagagtaggaccgagactagatggggccctcgccctggaagttctcggcgaggcatcccaccggaggagccaggcgcacccccaaggcgagcagggccaatcaaaaagccaccaccacccacgaaggttgaggagctcccccctaagccactcgagcagggtgatgagactccaaaacctcctaagcccgatccactgaagattactaaaggtaaattggggggacctaaagagacacccccaaacggtaatctgtctcctgcccctcgcctccgacgtgactattcctacgagcgggtaggtcccaccagctgtagaggcagaggcagaggcgagtactttgcacgcggacgaggctttaggggcacgtatggcggacggggaaggggggcagccggtaattctgccgtgactgagtcctttgaggaaatgatgggggtagaggttggacagggagatcagaccactcttcttttgcccgaggctgccctgcccgctaggcatggtgcgagggttcagtccatgcgcaagtccccttcaggagcgggttctggagcacagaagcaggccgctaggcctatgagggtgatttggctgctacagacccgaagattgccacacccacggagggagcacagcccaaggtcgcgcagtcctactacacggagtcccacttttcctgcgcctgccagatttacccccggtgtgggagagtcaagcttgcctgaaggcatcagccctggacctcgccgacgcgagcctcctcaagtctgcccgggatggagcccccctgccaagtctctcgccccaaaaaaaccccctactggtccactgcctccctccaaagaacctctgaaggaaaagcttatcccgggtccactgagtcccgtagccaggggcggttccaatggcggatccaacgtgggaatggaggacggggagagacccagacgaagacgtcacggcagagcccagcagcaggacaagccacctaggttccgaaggttgaagcaggagcgggaaaatgcagctcggggtagcgagggtaaaccttccttgacattgcctgcaagcgcgcctggcccagaggaagctctgaccacagtaaccgtcgcgcctgcccctaggagagctgccgctaagtcacccgacctcagtaaccaaaattctgaccaggctaacgaggagtgggaaaccgccagcgaaagttcagacttcactagtgagagacgaggggacaaagaggctccaccaccagtgctgttgactcccaaggccgtgggcaccccaggcggtggagggggaggagcagtgcccggaatttcagccatgtctagaggggacctgtcgcagcgagctaaggatctaagcaagcgttccttctcttcgcagaggccgggaatggaacgccagaataggcggccagggcctggcggtaaagcgggaagttccggaagtagttcaggtgggggaggcggaggcccaggaggaagaaccggcccaggacgaggggacaaacgatcgtggcccagcccaaaaaacaggagccgcccacccgaggagcgtcctcccggtttgcctctgcccccacctcctccgtctagcagtgccgtgtttcggctcgatcaggtcatacactccaaccctgctggtattcagcaagccttggcacagctgtcctcccggcaagggagcgtgaccgctcccggaggccacccaagacataaacctgggcttccacaggcaccgcagggcccttcgcccagaccaccgactagatatgagccccagagggtgaatagtggcctctcaagtgacccccattttgaggagccaggccctatggtgcgcggtgtgggtggtaccccacgtgactctgccggtgtctccccattccctccgaagcgccgagagcgcccacctcggaagcccgagctgttacaagaggagtcactcccgcctccccacagctccgggtttctgggaagcaaacccgagggacctgggcctcaagcggagtcaagagacacaggtaccgaggctctcactccacatatctggaacaggttacacactgccacctcacgaaagtcttacagaccttcttccatggaaccctggatggagccactctctcccttcgaagacgtcgcaggcacggaaatgagccaatctgatagcggggtcgatctatccggcgacagccaggtatctagtggcccatgttcacagaggagcagccctgatggtgggctgaagggtgctgcagaaggacctcctaagcggccaggtggaagctcccctttgaacgccgtaccctgtgaaggcccaccagggtccgaacctcctagaaggcctccacccgctcctcacgacggggatcgtaaagagctccccagggaacagcctctgcctccgggaccaatcggtaccgaacgatctcagcgaacggacagaggcacagaacctggtcccatcaggcccagccatcggcctggccctccagtgcagtttggcacgagcgataaggatagcgacctgcgcctggtggtaggtgacagtctcaaagccgaaaaagagctgacagcctcagtcaccgaggcaatccccgtatccagggactgggaactgctgccctctgcagccgcaagcgccgagcctcagagcaagaatttggactccggacactgtgtccccgagccctccagcagcggccagcgcctgtaccccgaggtattttatggttctgccggtcctagcagctctcagatctcaggagggcatggactctcaatcaccagcaaacagtggcgaaggccaggtacccctagccttcatccatatagatcacaacctttatacctgcctcccggaccagcgccaccctcagcactcttatctggagttgcccttaagggccagtttctggatttttctaccatgcaggccaccgaactgggcaagttacccgcaggcggtgtcctatacccgccaccctcattcctctactcacctgccttttgtccctcccctctgcccgacaccagtcttcttcaagtacgacaagatctccctagcccttccgatttctatagcactccactgcagcctggcggacagagtgggttcctcccatccggagcaccagcccaacagatgctactgccaatggtggattcccagctgcccgtggtcaattttgggtctctgccccctgcaccaccgccagcccctccacccctatctctgctgcctgtaggtccagcacttcagccaccttcactcgccgtcagacccccacctgcaccagcaactcgcgtacttccatctcctgccaggccctttcccgcttctctaggcagggccgagcttcaccctgtggagctcaagccctttcaggattaccaaaagttatccagtaatcttggaggccctggaagcagtcgcacaccacccactggacggtctttctccggactcaactctaggttgaaagcaactccttcgacatatagcggagtgtttaggactcagcgcgttgatctgtatcaacaagcgtctccacccgatgctctccggtggatccctaagccttgggagagaacaggcccaccccctcgggaaggcccttcacgacgagccgaggaaccaggatcaaggggagataaggaaccagggctgccgccaccgagata

SEQ ID NO: 236249 - DNA, 6416 bp, Artificial Sequence
  Description of Artificial Sequence: Synthetic coding sequence
atgtcagacagaagcggccctacagccaaaggcaaagatggcaaaaaatatagctcgctcaatctctttgatacctataagggtaagagcttggaaatccaaaaaccagcagttgcccctcgtcacggactgcagtctctcggaaaggtggcgattgcccgacggatgcccccacccgctaaccttcccagcctgaaagctgagaacaaaggtaacgatccaaacgtgtcgctagttcctaaagacgggacagggtgggctagtaagcaagaacagtctgaccctaagagctcggatgcttccaccgcccagccaccagagagtcagcccctccctgcctctcaaacaccagcctctaaccaacctaaacgccctccagcagcgccagagaacactccactagtaccatccggggtcaaatcctgggctcaggcttcagtcacccatggggcacacggggacggtggaagggcttcctctctgctgtctagattcagccgcgaagaattcccaacgctccaggcagcaggcgaccaggataaggccgctaaagaaagggaatcagccgaacaatcttccggaccgggtccttctctaaggccccagaattccacgacttggagagatggcggagggagagggcctgatgaactggagggtcccgatagcaagctgcatcacgggcatgacccgaggggagggctccaaccatccggaccgcctcagtttccaccttaccggggtatgatgcctcccttcatgtatcctccatacttgcccttccccccaccatacggccctcagggcccttatcgttatcctactccagacggcccatcccggtttccacgtgtggctggacctagaggaagcggaccacctatgcgtctagtggaacccgttggtcgcccatccatcctgaaagaggataatctcaaagagttcgaccaactcgaccaggagaatgacgatggatgggccggtgcacacgaggaagttgattacacagagaaactgaagttttccgacgaagaggatggtcgggactccgatgaagaaggcgctgaaggccatcgggacagtcagagtgcctctggggaagagaggccgcctgaagcggacggcaaaaaagggaactctccgaactcggaacctcctacaccgaagacagcctgggcagagacttcaaggccccctgagaccgagccagggccaccagcacctaagcccccactgcctcctccaggcgattaccctgaccgcggagggcctccttgcaagccccctgcgccagaggatgaggacgaggcatggcgtcagaggcggaagcagtccagctcagaaatctccctggccgtggaaagagccagacgcaggagagaggaggaggaacgacgcatgcaggaggaaaggcgcgctgcgtgcgctgagaagttgaaacgactggatgagaagttcggtgccccagataaaagactgaaggccgaacccgctgctccgccagccgctccctcaacaccggcaccccctcccgctgtgcctaaggagttgcctgcccctcctgccccacccccagcttcggccccaaccccagagaaggagcctgaagaaccagctcaagccccaccagcacaatccacacctacccccggagtggccgcagcccctaccctggtctctggcggagggtccacctcatctacctcaagtggctcttttgaagcctctcccgttgaaccacagttaccttcaaaggaaggccctgaacctccagaggaggtacctcctcccacaacgccacccgtcccaaaagtcgagcctaaaggcgacgggataggaccgacacgacagccaccctcccaaggactcggttacccgaagtaccagaagtccttgcctcccagatttcaacggcagcagcaggagcagctcttgaaacagcagcaacagcaccagtggcagcagcaccagcaggggtcggcgccaccaaccccagtgccaccaagtccccctcaacctgtgaccttgggggctgtgcctgcacctcaagcccctcccccaccacccaaagccctctaccccggagcactgggcagacctccccctatgccccctatgaattttgatccacgatggatgatgatcccgccatacgtagaccctagactcttacagggaaggcctcctttggacttttaccctccaggcgtgcacccttcgggtctcgtgccacgggagaggagcgatagtgggggatccagcagcgaacccttcgacaggcacgcccctgcaatgctgagagaaagaggcactcccccagtggaccctaaactcgcttgggtgggtgatgttttcactgctacgcccgctgaacccagacctctgacaagcccactgcgccaggcagccgatgaggatgacaagggtatgaggtctgagacgccaccggtccccccaccccctccctatctcgcaagctatcccggtttccccgaaaatggcgctccaggacctccgatttctcgctttcccttggaggaaccaggacctaggcccctgccctggcctccaggatctgatgaggtcgcgaagatccagacacctccaccaaaaaaagaaccccctaaagaagaaacagcccagctgactgggcctgaagcaggacgcaaaccggctcgtggtgttgggagcgggggacaggggccaccaccgcctcggcgtgagagtaggacagaaacacggtgggggcctagacccggatcctcacgaagagggatccctcctgaagaacctggagcccctccaaggcgagccggaccaataaaaaagcctcctccacctaccaaagtggaagaattgccccctaaacccttggaacagggggatgagacgcccaagccacccaagcctgaccctctcaaaatcactaaggggaaactaggcggtcctaaagaaacacccccaaacgggaacctctcccctgctccacggctgagaagggattatagttacgagcgagtaggacctaccagctgccggggacgtgggagaggggaatacttcgcccgtggaagagggttccgcggtacctacggaggcagaggcaggggcgctgccggtaacagcgctgttaccgagagttttgaggagatgatgggtgttgaggtaggccagggggaccagaccacactgcttctgcctgaggcagcattaccagcgagacatggcgctagagtgcagagtatgcgcaaaagtccctccggggctggatcaggcgctcaaaaacaggcagcacggccaatgagggtgatatggttactacagactcgacgcctgccccatccgcgaagagaacacagccccaggagccgttctcctaccactcgctccccgaccttccctgcgcctgcacggttcacgccaggcgtaggcgaatcctccctgcctgagggcatctctcctggccctcgcagaagggaacctccccaggtgtgtcccggttggtcccccccagcgaagtctctggcaccaaagaaacctccgactgggccactgccaccaagcaaagaacctctgaaagaaaaactaattccgggacctctctctcccgtggctcgtgggggtagtaacggcggaagcaatgtgggtatggaagatggggagagaccgagaagacgcagacatggcagagcacagcaacaggataaacctcccaggtttcgacgactgaagcaggagagagagaatgccgctcgcggaagcgagggaaagccatcccttacgctcccagcatccgcacccggtcccgaggaggccttgaccacagtaactgtcgcccctgccccacgcagggccgctgctaagtcccccgatctttcaaaccagaacagcgatcaggctaacgaagaatgggagaccgcctccgaatcatctgacttcacatccgaacgcaggggtgataaggaggcacccccacccgtgctgctgacgcctaaagccgtcgggacgcccggaggaggaggcggaggcgcagttcccggaatcagcgctatgtccaggggggatctgtcacagcgagctaaggatctcagcaaaaggtctttctccagtcagagaccaggcatggaacggcagaaccggagacccggtccaggcggtaaagcaggatcgagcggatcctcttcaggcggaggaggcggaggcccagggggtcggaccggaccgggtaggggtgacaaacggagttggccctccccaaaaaataggtcccgcccacccgaagaacgcccaccaggactacctctcccccctccacctcctagcagtagcgcagtttttcgcctggatcaggtaatccactcgaatcctgccggtatccagcaagcactggctcagctttcaagccgccagggttcagtcaccgctccaggcggacaccccaggcacaaaccaggaccacctcaagccccacagggccctagccccagacccccaacaagatacgagccccagagagtgaatagtggcctgagctccgacccccatttcgaggaacccggtcctatggtccgaggcgtgggcggaacacccagggactcggctggagtgtctcccttccccccaaaaagacgggaaaggcccccaagaaagcctgaactcttgcaagaggaatccttgcccccacctcattcctcagggtttctaggttcaaaacccgagggcccaggaccgcaggcagaaagccgcgacacgggcaccgaagctctgacaccccacatctggaacaggcttcacacagccacaagcagaaagagttaccgtccgtcctccatggagccatggatggagcctttgtctccttttgaagatgtcgcgggtaccgagatgtctcagagcgatagtggagtggacctgagcggtgacagccaagtgtcttccggcccttgttcacagcgatcctcccccgacggtgggctcaagggagccgcagaagggccaccgaaacggcctggcggttccagccccttaaacgctgtgccctgcgaaggcccacctggctctgaacctcccaggcgaccgccacccgctccccacgatggtgaccggaaagagttgcctagagaacagccgctgcctccgggacctatcgggaccgagaggtcccagcatacagacaggggcacggagccaggaccaattcgacctagtcaccgcccaggcccaccggtccaatttggcacatcagacaaagactccgatcttcggctcgtagttggtgattcgctgaaggccgagaaggaactcacggccagcgtgacggaggctatcccggtgagccgcgactgggaattactcccctccgcagcagcgtccgctgagcctcaatccaagaacctagattccggccactgtgttccagagccgagtagctcaggccagcgcttgtacccagaggtgttttacggaagtgctggccctagcagcagccagatttcgggaggccacggcctcagtgttacaagcaagcagtggcggagaccgggaacccccagcctgcacccatatcggagccaacctctctatttgccaccgggacccgcacccccttcggccctcttgagcggagtagctctcaaggggcagtttctggatttcagcacaatgcaggccacggaactgggcaagctccctgccggtggtgtgctctatccaccaccaagtttcctatacagcccagcgttctgcccgtcgccactgccagacacctccctccttcaagtgagacaggatctgcctagtccctcggatttctattcgaccccgctgcagcctgggggacaatctggcttcttgccttctggtgcccctgcccagcagatgctcctcccaatggttgattcccagcttcctgtggtgaatttcggaagccttcctccagctccgcctcctgctccccctagccttagccttctgcccgtgggaccagcattgcagcccccttccctcgctgtccgtcccccaccggcacccgcaacccgcgtcctgcccagccctgctaggcctttccccgcttcactggggagggctgaactgcacccagtggaactcaaacctttccaggattatcaaaaactgtcaagcaatctagggggacctgggagttcaaggacaccccctaccggcaggtcattctccggcctgaattctcgcctaaaagcgactcccagcacgtactcaggagtattccggacccagcgcgtcgatctctaccagcaggccagtcctcccgacgcactccggtggatccccaagccttgggagcgcacaggacccccaccccgtgaggggccaagtcgcagagctgaggagcctggatctcggggagataaagagcccggactgccaccccctagata

SEQ ID NO: 236250 - DNA, 6416 bp, Artificial Sequence
  Description of Artificial Sequence: Synthetic coding sequence
atgtcagaccgcagcggccctacagctaaaggcaaggacggcaagaagtactcatcattaaatttattcgatacttacaaaggcaaaagcctggagatccaaaaaccagctgtagccccaaggcatgggctgcagagcctcgggaaagtagccatcgctcggcgtatgccccctccagctaatctgccctccctgaaggcggagaacaaagggaatgaccctaacgtgtctcttgttcctaaggacggcactggatgggcctccaagcaggagcaatctgatccgaaatcatccgacgcctcgactgcccagcctcccgagagtcaacctctcccagcttcccaaacacctgctagcaaccagcccaagaggccacccgctgcaccagagaacactcccctcgtaccgagtggggtcaagtcttgggcccaagctagtgtgacccacggcgcacacggagatgggggtagagcatcctctctgctatcccgcttttctagggaggagttcccgacactacaggcggctggcgaccaggacaaagccgcaaaagagagggaatcagccgagcagtctagcgggcctggccctagtctccgtccacagaacagcacgacctggcgggatggcggaggtagaggacccgacgagcttgagggcccagactccaaactgcaccacggccacgacccaagaggaggcctccagccctcagggccacctcagtttcctccataccgcggtatgatgccacccttcatgtatcccccttacctgcccttcccacccccatatggaccacaaggcccatataggtacccaactcctgacggaccgtcaagattccccagagtggctgggcctcgcggtagcgggcctcctatgaggctcgtcgagcctgttgggcgtcccagcattctcaaagaagacaatctcaaggagtttgatcagctggatcaggagaacgatgacggctgggcaggtgctcatgaagaggtggattatacagagaagttaaagttctcagatgaggaagacggaagagatagtgacgaggagggcgctgagggccatagagatagccaatctgccagcggagaagagagaccaccggaggcagatggaaagaagggcaatagtcctaactcggaaccaccgacacccaaaactgcttgggctgaaacatctcgcccacctgagacagagcctggacctccagcccctaagccaccgctgccaccacccggagattacccagatcgaggtggtcctccctgcaagccgccagcgcctgaggatgaggacgaggcctggaggcagcgaagaaagcagtccagcagtgaaatctctttagccgtggaaagagcccgacggcgacgtgaggaggaagagaggaggatgcaggaagagcggagagcagcctgtgcagagaagctgaaacgccttgacgagaagtttggagcacctgataaacggttgaaagccgagcccgcagccccaccggcagcacccagcacacccgcaccccctccagctgtgcccaaggaactgcccgcaccgccagctcctccgccagcatccgctcccacgccagagaaagagcctgaagagcccgcacaggcccctccggctcagtcgacaccaacccccggtgtggcagctgcccctactttggtatctggcggaggcagcacgtcctccacgtccagcggaagcttcgaagctagccccgttgaaccccagctacccagtaaggaaggccctgagccccctgaagaggtccccccaccgactaccccgccagtgcccaaggtcgaacctaaaggcgacggcattggcccaacacggcagccgccttcccagggcctgggctacccaaagtatcaaaaatccctccctccacggttccagcgacaacagcaggaacaactcctaaaacaacagcagcaacatcagtggcagcagcatcagcaagggtctgcccctccaacaccggtccccccttctcccccacagcctgtgactctcggcgcagtgccagcgcctcaagcccctcctcctcccccaaaggctctgtacccaggcgctctaggacgtccgcctcctatgccccctatgaatttcgacccccgatggatgatgatccctccatatgtcgacccacgactcttacagggtaggccacctctagacttttaccctcccggtgtgcatccaagcggacttgtccctagagaacgcagcgattccgggggtagttcctcagagcctttcgacagacacgcgcctgcgatgctgcgggaacgtggaaccccaccggtagatcctaagctagcctgggtgggggatgtattcaccgcaactcccgctgagcctaggccactgacctcacccctgagacaagccgcagacgaagacgacaaggggatgcggtcagagactcctcctgtgcctcctcctccgccttatcttgcaagctacccaggattccctgaaaacggcgcacctggcccacccataagtcggttccccctagaagagcccggaccgcgacccctgccctggcccccaggcagtgacgaagtggctaagatacagacccccccacccaagaaagagccaccaaaagaggaaaccgcccagctgacaggccctgaagctgggaggaagcctgccaggggggttgggtccggagggcagggacccccaccccctcgacgcgagtccagaactgagacgaggtggggaccccgacctgggtcatccaggcgagggatcccaccagaagagcctggcgctccccctcgtagagcaggacctatcaagaaacccccaccaccgactaaagtggaagaactccctcccaagcctttggagcagggggacgaaaccccgaagccacccaaacctgacccgctgaagatcactaagggtaagctgggtgggccaaaagagaccccccctaacggcaacttaagcccagcacctagactgagacgagactattcctacgaaagggtgggccctacctcctgccggggaagaggtcgcggagaatatttcgccaggggtcgcggtttccgcggaacctacgggggaagagggcgaggcgcagccggtaactctgccgtaaccgaaagttttgaagagatgatgggtgtggaagttgggcagggagatcagaccaccctgcttctcccagaagcagctttgcctgcgagacacggggcacgtgtccagagcatgagaaaatcgcccagtggcgctggatctggcgctcagaagcaggccgctagacccatgcgggtaatatggctcctccagacaaggcgcctgccacatccacgtcgagagcactcaccacggagccggtctcccaccacgcgctccccgacctttcccgcacccgctcgtttcacccctggggttggcgagtcctctctccctgaaggcattagcccgggtccgcgaaggcgggaaccccctcaggtgtgtccaggctggtcaccacccgctaagagcctggccccaaagaagccccctacaggcccactgcctccttctaaagaacctctgaaagagaagctgatacctggccctctgagccctgtggcaagagggggtagtaatggtggtagtaacgtcgggatggaggatggtgagaggcctagaaggaggaggcatgggagagcacaacaacaggacaaaccgccaagattccggcgtctgaagcaggaacgcgagaatgcagctcggggatctgaggggaaacctagcctgaccctcccagcttcagcgccaggcccagaagaggctctcacaactgtcaccgtggcccctgcccctcgcagggccgctgcaaagtctcctgatctgtcgaatcaaaactcagatcaggccaatgaggagtgggaaacagcttctgagtcttccgactttacctcggagagaaggggagataaagaagcgccaccgcctgtgcttctaactccgaaagccgtcggcacgcccggtggtggaggagggggagcagtgccgggtatttccgcaatgtcaaggggagacctgtcccaacgggcaaaggacctctccaagagatcatttagtagtcagagaccgggaatggagcgacagaacaggcgtcccggtcctggtgggaaagcgggatcaagcggctcctcttccggaggtgggggtgggggtcctgggggtcgcacaggccctggaaggggtgacaaaaggagttggcccagccccaaaaatcgttcccggccacctgaggaacggccacctggtctcccgcttccccctccccctcctagttccagcgctgtatttcgcttagatcaggtgattcatagtaatccggcaggaattcagcaggctctggctcaactgagcagccgtcaaggcagtgtgacagcgccaggaggacaccctagacacaagccgggtcctccccaggctccccaagggccaagcccccgtccccctactcggtatgagccacagagagtaaatagcgggctcagttctgatccacacttcgaagagcctggcccaatggtgcgcggagtaggcggaacacccagagactcagccggagtcagtccctttcctccaaagcgccgagagcgtccaccaaggaaaccggagcttctgcaagaggaatctctcccacctccacactcttctgggttcctgggttccaaaccagaaggtcccggaccgcaggcagaatctcgtgacacaggcaccgaagctctgactccccacatttggaatcgtctccacactgccaccagccggaagtcgtatcgcccttcgagcatggaaccatggatggagccactgtcacccttcgaagatgtggccggaaccgaaatgtctcagagtgacagcggtgtggacctgagtggtgattctcaggtgagctcgggaccttgcagtcagcgctcaagccctgacggcggtctgaagggggcagctgaaggccctcccaagaggccaggagggagctctccattaaatgccgtgccctgcgaaggtccacccggttccgagccccctcggagaccccctccagcccctcatgatggggatcgcaaggaactgcctcgcgagcaacccttgccacctggccctatcggaactgagcggagtcagaggacagaccggggtactgaacctggtcctatccggccttcacatcggcctggccctcccgtccaattcggaacatctgataaagactctgacctgcgcctggtggtgggggattccctaaaggcggagaaagagcttacagcttcagtgaccgaggccatccctgtgtcccgggactgggagctgctgccaagcgccgcagcctcggctgagccacaatctaaaaatctcgattctggacactgtgtccccgagccatccagctccggccagagattatacccggaagtgttctatggctctgctggtccttcaagctctcagatctccggcggacacggcctgagcataacatcgaaacagtggcgacgcccaggaacccccagccttcatccgtaccggtcacagccactctacttgcccccaggtcctgcaccaccttccgctctgctatcaggcgtggctctgaaagggcaatttctggacttctctaccatgcaggccactgagctgggcaaacttccagctgggggagtgctatacccccctcccagcttcctctattctccagcgttctgtcctagtcctctgccagataccagtctgctgcaagtccgccaggatctgcctagtccctcagatttctactcaactcctttacagcctgggggacagtcaggattcctgccaagcggcgcacccgcacaacaaatgctgctccctatggtggatagccagcttcctgtggttaacttcggcagcttgcctcccgcaccccctcctgccccaccccctctgtctctgctgcctgtggggccagcactgcagcccccatcactcgccgtgagaccgcctcctgccccagctactcgtgtcctgccttcgccagccagacctttcccagcctcactggggcgagccgaactgcacccggttgagcttaagcctttccaggactatcagaagctgagctccaatcttggcggtccgggatcttctcgcacaccacccacagggaggagtttttcagggttgaactcccgactgaaagccactccttccacttattccggcgtttttcgcacgcagcgcgtggatctgtatcagcaggctagccccccagatgcacttcgatggatacccaaaccatgggagcgcaccgggcctccccctagagagggaccatctaggcgggctgaggagcccggttccaggggagataaagaacccggattaccccctcccaggta

SEQ ID NO: 236251 - DNA, 4149 bp, Artificial Sequence
  Description of Artificial Sequence: Synthetic coding sequence
atgctgagggaacggggtacccctcccgtggacccaaaattggcttgggttggagacgttttcactgccaccccagctgagccaaggcctctgacctctccgctgcgacaagccgctgatgaagacgacaaaggtatgcggagcgagacccccccagtgcctccaccaccgccttatctggcctcttacccgggattcccggagaatggcgctcccggaccgcctatcagcagatttcctcttgaggagccaggcccacgaccactcccgtggccccctggttctgatgaagtagccaaaatacaaacgccgcctccaaagaaagagcctcctaaggaagaaaccgcccagttaaccggcccagaggcaggtaggaagcctgccaggggtgtaggctctgggggacaaggtccccctcccccacgcagggagagcaggaccgaaactagatggggccctaggccaggctcttcacgacgcggtatccctccagaagaaccaggggctcccccacgacgcgctgggcctataaagaaaccccctccacccactaaggtcgaggagcttccccctaaaccactggaacagggagacgaaaccccaaagccgcctaaaccggatcccctgaaaatcacgaaaggtaaactgggtggacctaaagaaacaccacctaatggtaacctgtcccctgctcctcgtctcaggcgcgactacagctatgagcgcgtgggcccaactagttgtaggggcagaggcaggggggaatatttcgcgaggggcaggggcttccgaggcacatatggaggaagaggaaggggtgctaggagccgagaatttagatcctatagagaattccgcggagacgacggacgtggcggaggtacagggggacccaatcacccacctgctccacgcggacgaacagcttccgaaacacggagcgagggttcggaatatgaggagatcccaaagagacgtcggcagagaggaagtgagactggatcagaaacccacgaatccgaccttgctccgtcagataaggaggcccctacccccaaagaggggaccctgactcaggtgcccctggcacccccaccacccggtgctcccccaagccccgcaccagcccgatttactgcaagggggggtcgtgtgtttacccctcgtggggtgccttctagacggggacggggtggcggaagaccaccgccacaagtgtgccccggttggtcgccgccagccaagagcttagcacccaagaagccgcctactggccctcttccaccctcaaaagaaccactgaaggagaaactgatccctgggcctctgtctccagtggcacggggtggctctaacgggggaagcaacgtcggcatggaagacggagagcgcccacggaggcgacgtcacggacgcgctcaacagcaagacaaacccccaagattcagaaggctgaagcaagagagagaaaatgccgctcgcggaagtgaaggtaaaccaagtctaactcttccagcctctgcccctggtccagaagaggcactgactaccgtgacagtggctcctgctcccaggcgtgctgccgctaaaagccctgatctgagcaaccagaactccgaccaggccaatgaggagtgggagaccgcttctgagtcatctgacttcaccagcgagcgcaggggcgacaaagaggcccctcctccagtccttttgacccccaaggccgtaggcactcccggtggagggggaggtggagctgtccctggcatcagcgctatgagcaggggcgacctttcccagcgtgctaaggatctgtctaaacgctccttttcaagccagcggccaggaatggagcgacaaaatcgcagacccggacccggaggcaaagcgggatcatcaggaagctccagcggaggcggagggggtggtcccggaggcaggacgggtccaggtaggggtgacaagcggtcctggccatcacctaaaaatcggtcacgacccccagaggaacgcccaccgggtctacctctccccccaccaccaccctctagttccgccgttttccggctcgaccaggtgatccactccaaccctgccggaattcagcaggccctggcccagttgtccagccgccaggggtctgtcactgcacccggaggccaccccaggcataaacccggactgccccaggcaccacagggaccctcaccaaggcctccgactcgttatgagccccagagagtcaattctggactgtctagtgatccccacttcgaagaacctggccctatggtgcgtggggtcgggggaactccaagggattccgctggagtgagcccattcccccctaaacgacgtgagcgccctccccgtaagcccgagctgcttcaggaggagtccctcccgccacctcactcaagtggcttcctaggatcaaagccagagggcccagggccacaagccgagtccagagacacgggcaccgaagcccttactccgcatatttggaatcgtttgcacacagcaacttcccggaagagctaccgtccaagctcaatggagccctggatggagccattaagcccattcgaagacgtcgcaggaaccgagatgagccagtccgactccggggttgatctgagcggggattcgcaggtatcaagcggtccttgttctcagcggtcctcaccagacgggggactcaaaggcgcagccgagggacctcctaaacggccagggggatcctcgccacttaatgcagtgccatgcgaaggtccgcctgggtcagagcctcctcgaaggcctccgcctgcacctcacgatggcgacaggaaagaactccctagggagcagcctctgcctcccggacctatagggaccgagcgctctcaacgaacagatagaggtacagagcctggcccaattcgtccatcacacagaccagggccacccgtccaattcgggacttccgataaggacagcgacctacgcttagtggtaggggactctctgaaggccgaaaaggaactcactgcaagcgtcactgaggccattccggtctcacgcgattgggagctccttcctagtgccgctgcgagcgcagagccacagtcaaaaaacctggacagtggacactgcgttcctgagccttcatcgagcgggcaaaggctctacccagaggttttttatggaagcgccggacctagtagttcacaaatttccggtggggctatggattcccaacttcaccccaattccggcggatttagacctggaaccccttctcttcacccataccgctcccagccactgtatctgccccctgggcctgctcctcccagtgccctgctgtccggtgtcgctctgaagggtcagttcttagatttttcaaccatgcaggcaaccgaattgggtaagctccccgctggcggagtcctatatccgccaccttcatttctctattccccagctttctgtccctccccccttcctgatacaagtttactgcaggtacgccaagacctaccgtcaccaagcgacttttacagtaccccgctgcagccagggggacagtctggattcctcccttctggcgctcccgcacagcaaatgctgctccctatggtcgactcgcagttgcctgtagtgaacttcgggtcattacctcctgcccctcctccagcaccacctccacttagtctgctgccggtgggaccagctttacagcccccatccttagccgtaagaccccctcctgctcctgccactcgggtattaccctcacctgcccgaccttttcccgcttcgttgggcagggccgagttacatccggtggagctcaaacctttccaggattatcagaagctatcttcaaacctcggtggcccaggcagctcccggaccccacccacaggacgctcattctctgggctaaactcccgacttaaagcgacacctagcacttatagtggcgtcttccgaacacagcgcgttgatctataccagcaggcctcaccaccagacgccttgcgctggatccctaaaccgtgggagaggactggaccccctccacgggagggtccttcaaggagggcagaagaaccaggatctcgcggagacaaggagcctggactgccgccacccagatag

SEQ ID NO: 236252 - DNA, 6449 bp, Artificial Sequence
  Description of Artificial Sequence: Synthetic coding sequence
atgtccgataggagtgggccaaccgccaaaggcaaagacggaaagaaatattcaagtctgaatcttttcgacacatacaaaggaaagagcttggagatccagaagccagctgtggccccacgacatggattgcagtccctcggcaaggttgctatcgcacgcaggatgcctcctccggctaatcttccatccctgaaggctgagaataagggtaatgatccgaatgtcagccttgtgcccaaggatgggactgggtgggcttctaagcaggagcagtcagatccaaagtccagcgacgcttcaactgcacagcctccagaatcgcaaccgctgcctgcatctcagacccccgctagcaaccagcccaagaggccaccagccgcaccggagaacacaccactggtaccaagtggggttaaaagctgggcccaggcgtcagtcacacacggcgctcatggtgacgggggtagggcgtctagcctgttgtcaaggttcagcagggaagagttccccacactgcaagcggctggtgatcaggacaaagctgccaaagagagagagagtgcagagcagagttcaggccctggcccttcactgagaccccagaacagcaccacctggcgcgatggcggtggacgcggacctgacgaattggaaggcccagattctaaactgcaccacggacatgatccaagaggaggacttcagccatcagggccaccccaatttcctccgtacagggggatgatgccaccattcatgtaccccccttacctgcccttcccccctccgtacggcccacaggggccttatagatatcccacacctgatggcccttccaggtttcctcgggtggctggccctcggggaagtggcccaccgatgcgccttgtggagcccgtcggtcgaccttccatcctcaaggaggataacctgaaagaattcgatcagctcgatcaggagaacgacgacggatgggccggtgcacacgaggaagtggattataccgaaaaacttaagttcagtgacgaagaagacgggcgtgattccgacgaagagggcgcagaagggcaccgcgattctcagtccgctagtggcgaagagcggccaccagaggccgatgggaagaagggcaattctccgaattcagagcctcctacccccaagacagcttgggccgagacttccagaccccctgaaacggagcccggacccccagcccctaagcctccattacctccacctcatagaggcccagccggaaactggggccctccgggtgactacccagaccgcggtggccctccatgcaagccccctgcaccagaggatgaggatgaggcctggcgacagagaaggaagcagtcctccagcgaaatctccctggcggtagagagagcgagaaggagacgcgaggaggaggagagacggatgcaggaggaacggagggctgcgtgcgcagaaaagttaaagaggcttgacgaaaaatttggtgctcccgataaacgattgaaggctgagcctgccgctccaccggctgctcccagcacccctgctccacctcccgcagtgcccaaggaactaccggcaccccctgcaccacctcctgccagcgcacctactccagaaaaagagccagaagagccagcgcaggctcccccagctcaaagtaccccgactcccggagtggcagcagccccaactctggtgtcagggggtggcagcacttctagtacgtcatccgggtccttcgaagcgtctccagttgagccccaattgccttccaaggagggcccagagccaccggaggaggtgcctccaccaaccactccccctgtgcctaaagtggagcctaaaggggatggtatcggtcccactaggcagccacctagccagggcctgggctacccgaagtatcagaaatccctgcccccaagattccagcgtcagcaacaggagcaactgctgaaacagcagcaacagcatcagtggcagcaacaccagcagggtagtgctccccctacacccgttcctccaagcccccctcaaccagtgaccctcggcgcagttcctgctccccaagccccacctccacccccaaaggccctgtatcctggcgctttaggcaggccaccccctatgccacctatgaacttcgaccctcgctggatgatgataccaccgtatgtggatcctaggttgctccaaggtaggcctcccctggatttctaccctcctggggtgcaccctagtgggcttgtcccaagagaaagaagcgactccggaggctccagttccgagccgtttgatagacacgcccctgctatgttacgggagagaggcaccccacctgtggaccctaaacttgcgtgggtcggggacgtgtttacggcaaccccagcagagcccaggcctctgacaagtccgttacgacaggctgccgatgaggacgacaaaggtatgcgctctgagacacctcccgtgcctccccctcctccatacctagcgtcatacccaggatttcctgagaacggggcacctggtccacccatcagccggttccccctggaagagccgggaccaaggccattgccgtggcccccaggcagtgacgaagtggcgaaaatccagacaccaccacccaagaaggaacctcctaaagaagagactgcacagctgacaggccctgaagcaggccgaaagcctgcgcgtggagtggggagtggcggacagggccctccccctcctaggcgggaatcccgtacagagacccgctgggggcctagacccggtagctccagacgcggtataccaccggaggagcccggagcaccccctcggagagcaggccctatcaaaaagcctccgcctcctactaaagtcgaagagctgccgcctaagccattagagcagggcgatgagacccccaaaccccctaagcccgatcctctcaagataactaaaggaaagctgggaggacccaaggagacacctcctaatgggaatctgagccctgccccacggctgagaagggattactcttacgaaagagtcggccctactagttgccgagggagaggaagaggcgagtattttgccaggggtagggggtttcggggaacgtacgggggaagaggaagaggtgcagccggtaactctgctgtgaccgagtctttcgaagaaatgatgggcgtagaggtggggcagggagatcagaccaccctgctactcccggaggccgctctgcccgcacgtcatggcgcaagagtccaaagtatgcgtaaaagtccttccggtgccggttctggcgctcaaaaacaggccgctcggccaatgcgggtgatctggctgcttcagaccaggcggctgcctcacccgaggcgcgaacatagtccccgatcccgaagccctacaactcgatcacctacgttccctgctccagcacgctttacccccggagtaggagaaagctcactccctgagggtatttctccgggacccaggcggagggaaccccctcaggtgtgtcccggttggagtccccctgccaaatccctcgcacctaagaagccacctacaggaccactacccccaagtaaggagccactgaaggaaaagttgatcccgggtccactgtctcctgtggctcgaggagggagtaatggaggttcgaacgttggaatggaggacggcgagcgcccacgacggcgacgccacggacgggctcagcagcaagacaagcctcctcgctttcgtcggctaaagcaggaacgcgagaacgccgctcgtggctccgagggaaaaccatctctgaccctgcctgcatccgctccagggccagaagaggcgctgactactgtgacagtggccccagctccacgtcgagctgcagctaaatcaccagacctgtccaaccaaaactcagatcaagcaaacgaggaatgggaaaccgcctcagagagctccgacttcaccagcgaacgcaggggagataaggaagcccctccacccgtgttgctgaccccgaaagcagtgggcacaccagggggaggaggcggaggagccgtgccaggaattagcgcaatgagcagaggggacctatctcaaagggctaaggacctgtccaagagatcattttctagccaacggccagggatggagcgacaaaaccggaggcctgggccaggagggaaagctggaagctcagggtcatcctcaggtgggggagggggtggtcctggaggcagaaccgggcctggcagaggagataagcgctcttggccgtcaccgaaaaatagatcacgcccaccagaagaaagacctccaggcctcccactaccacctccaccaccttcatcttccgccgtcttccgcctggaccaggtcatccattcgaatcccgctggtattcagcaggccttggctcagctgtcgagtaggcaaggatctgtgactgcccctggcggacaccctcggcacaagcccggacctccccaggctccccagggcccatcacccagaccaccaactaggtacgagccccagcgggtgaattcagggctgtcttctgacccccacttcgaggagccaggccctatggtcagaggagtgggtgggactccgcgagattcagctggtgttagccctttcccaccgaagcggcgagagcgccctcccaggaaaccagaactgctccaggaggagagcttgcctccccctcattccagtggtttcctgggctctaaaccagaaggaccagggccacaggctgagagccgcgatactgggaccgaggccttaacaccacatatttggaatcgactgcataccgccacctccaggaagagctacaggcccagttccatggaaccttggatggagccactgtcaccattcgaggacgttgctggcaccgagatgtcccagagtgattctggcgtggatcttagcggcgatagtcaggtcagcagcggaccctgcagccagagatcctcccccgatggcggactcaaaggtgccgctgagggtcctcccaagcgtccgggtggcagcagccccttgaatgccgttccctgcgaaggcccacctggtagtgagccgccaaggaggccccctcccgcaccccacgatggcgacagaaaggaacttcccagggagcaacctctcccccctggacccattggcaccgaacgctctcaacgtaccgatagagggaccgaaccaggcccaatccgaccaagccaccgcccagggccacctgtgcagttcggcacttctgataaggacagtgaccttaggctcgtcgtgggagatagtcttaaggctgaaaaggaactcacagccagcgtgaccgaggctattccggtcagccgggactgggagctgctaccatccgccgctgccagtgccgaacctcagtcaaaaaacctcgatagcggccactgtgtacccgagcccagtagctctggccagcgcttgtaccctgaagtgttttatggcagcgctgggccaagcagctctcagatctccgggggtcacggactctctatcacttccaaacagtggcgccgacctggcacacctagtctgcacccataccggtctcaacccctttatctgccgcctggccctgctcccccatcagcccttttgtcaggggtcgccctcaagggccaattcctcgatttttcaacaatgcaggcaactgagctcgggaagcttcccgctggtggagtgctgtatccgccaccttcctttctctacagcccagcgttttgcccctcaccacttcctgacacttcactgctccaggtacggcaggacctgccaagcccatccgatttctatagcacgcccctgcagcctggagggcagtccggctttctgcctagcggcgctccggctcagcagatgctgctcccaatggttgacagtcaactcccggtcgtgaattttggttctctcccgccagcccctccccctgctcccccacccttatccttactgcccgtcgggccagccctgcagccgccatcactggctgtgaggccccctccggcacctgccactcgggtactgcctagcccggcaagacctttccccgcatcgctgggcagggctgaactccatcccgtggagttgaagcccttccaggattatcagaagctgtcatctaacctggggggtccaggcagctctaggactcctcccactggcagaagttttagtggtctcaacagccggctgaaagctacaccaagtacgtacagcggggtgtttaggacgcagcgcgtggatctgtaccagcaagcaagtccacccgatgctttgcgttggatccccaagccttgggaacgcacagggccacctccccgagagggcccttcccgcagggctgaagagcccggttcccgcggtgacaaggagccgggactgcctccaccccgtta

SEQ ID NO: 236253 - DNA, 6449 bp, Artificial Sequence
  Description of Artificial Sequence: Synthetic coding sequence
atgagcgaccgtagcgggcctactgccaaaggcaaggacggtaaaaaatactccagtcttaatctgtttgatacttacaaaggaaagtcactggaaatacagaaaccagcagtggccccacgccatggactgcagtcactgggcaaagtggccatagcgaggcgcatgcctccaccggcaaatcttccatcgctgaaagcagaaaacaaaggcaacgaccctaacgttagtctggtacccaaggacggtacaggatgggcaagcaaacaagagcagtcggatccaaagagctccgacgcctcaacagcacaacccctggagagccagccactgcctgcttcacaaacccccgcttctaatcagcctaaacgcccaccagccgcacctgagaacacacctctggtgccctctggagtcaagtcctgggcccaagcttcagtcacccacggggctcacggcgacgggggacgagctagcagcttgctcagccgcttctccagggaggagttccccacactccaggccgcaggagaccaggataaggcagctaaagagagagagtccgcagagcagagcagcggacccggaccttcactccgcccacagaactccaccacatggagagatgggggtggaagaggcccagacgagttagagggccctgactccaagctgcaccatggccatgaccctagggggggactgcaaccatccggcccaccccagttccccccatacagaggaatgatgccacccttcatgtatcctccatacctgcctttcccgccaccgtatggaccccaagggccttacaggtaccccacacctgatggaccctccaggtttccaagagtggcaggccctcggggatctggtccaccgatgcggctggtggaaccggtgggcagaccatcaatattaaaagaggataatctgaaagaatttgaccagcttgatcaggaaaacgacgacgggtgggctggcgctcacgaggaggtagattacactgagaaactgaagttctctgatgaagaggacggtagagatagtgatgaggaaggagctgaggggcaccgagattctcaatccgccagcggtgaggagcggccacctgaggccgacgggaaaaagggcaattcccctaattcagaacctccaactcccaaaacggcttgggccgaaacaagccggcctcccgagaccgagcccggaccaccagctccgaagccccctctgccccctccccaccgtgggcctgccggtaactggggccctcctggagactatccagacagaggcggtcccccatgcaagccgcctgcccctgaggacgaagacgaggcatggcgccagcggaggaagcaatctagctccgagatcagtctggccgtggaacgagccagacgccgacgggaggaggaagaaaggcgaatgcaggaagaacgcagggccgcttgcgctgagaagctcaagcggctcgatgaaaaatttggggctccagataagcggttgaaagccgagcccgcagcaccccctgctgcgcctagtactcctgcgccaccacccgcagtgccaaaggagctgcctgctccaccggcaccaccacctgcctccgctccaactcccgagaaggagccagaggagccagcacaggcccctcctgcccagagcactcctactcccggagtcgcagccgctcccaccctggtctcgggtggcggatctacgtctagtacatcttcaggctccttcgaagctagtcccgtggagcctcagttaccttctaaggaagggcctgagccacccgaagaagtgcctccccctactacccccccagtccccaaggtggagcctaagggagacggaatcggtccgacgcgccagccaccaagccagggattaggctacccaaaataccagaagtccctgccaccacgcttccagcgtcagcaacaggagcagctgttgaagcaacagcagcaacatcagtggcaacagcaccagcaggggagtgcacccccaacacctgtcccacccagcccaccacaacctgtaaccctcggagccgtgcccgctccgcaggcgcctcccccacctccgaaagccctataccctggagcccttggacggcctccaccaatgcccccaatgaatttcgatcccagatggatgatgattcccccatacgtggatccacgcttgttgcagggacggccaccccttgacttttatccgcctggagtgcatccttctggactcgtccccagggaacgttctgactccgggggaagcagcagtgagccctttgaccggcacgctccagctatgttgcgggagagaggcactccacccgtggaccctaagctggcctgggttggggacgtgttcacagccaccccagctgagcccagaccacttacgtcccctcttcgccaggctgccgacgaagacgataaaggcatgagatccgaaacgccaccagtcccgccaccgccaccatatctagcctcttaccccggtttccccgagaatggcgcacccggtccgcctatttcaagattccccctagaggagcctgggccacgccctctgccctggccccctgggagcgatgaggttgccaagatacagactccacctcccaagaaggagccacctaaggaagagaccgcacaactcactggtccagaggctggccgaaaacccgctcggggtgtcggctccggcggtcagggtccgccacccccaaggcgagaatctcgcacagaaacgagatggggacccaggccaggcagttcacgccgtggcatcccccctgaagaacccggagccccaccaaggagggccggacctatcaagaagcccccaccgccaacaaaggtcgaggaactgccccctaaaccccttgagcagggcgatgagacccctaagccccctaaacccgatcccctgaaaattacaaaaggaaagttgggcggacccaaggagacacccccaaacggcaatctgagccctgcaccacgcctgagaagggactattcttatgaaagagtaggccctacctcctgtagagggaggggtcgcggagaatattttgccaggggacggggatttcgcggaacttacgggggacggggtaggggagctgctggcaactcagctgtgactgagtccttcgaagagatgatgggtgttgaggtgggccagggcgaccaaacaacattgctcttgcccgaagctgctctgcctgcaaggcatggcgcaagggtccagtccatgagaaagagtccgtctggagctggttctggagctcagaagcaggcagcccgtcctatgcgtgtgatctggcttctgcagactaggcgcctcccacacccacgtcgcgaacactccccacggtctcggtctccaaccacacggtcacctacctttcctgctccagccaggttcaccccaggcgttggcgaaagctccctgccagaggggatcagccccggtcccagacgtagagagccaccccaagtctgccccggttggtcaccaccagccaagtcgttggctccaaagaaaccgcctaccggaccattgccgccaagcaaggagcccctcaaggagaagcttattcccggaccgttgtctccagttgctcgcggtggatccaatggcggaagcaatgtggggatggaggacggagaaagaccaaggcgcagaaggcacggcagggcacagcaacaggataaacctcctagatttagacggctgaaacaggaacgggagaacgcagcgcgtggttccgagggtaagccatccctaaccctccctgcaagcgcccctggacctgaagaggcactgactactgttacagttgctccagctccacgaagagcggcagccaagtctccagatcttagcaatcagaacagcgatcaggccaacgaggaatgggagaccgcttctgaatcctccgatttcaccagtgagcgcagaggggataaagaggcgccaccacccgttcttcttaccccaaaggcagtgggaactccagggggaggagggggaggcgctgtgccaggaatttcggccatgtctcgcggagatctgtcccagcgggctaaagacttatctaaaagaagcttttcctcccaacgccctgggatggagagacaaaaccgcaggcctggtcccggaggtaaggcagggagctcagggagctcttctggaggcggaggaggcggaccaggaggtcgcactggccctggaagaggggacaagagaagttggccatctcccaagaatcgctctcgtcctcctgaggagaggcccccaggcctgcctctcccaccaccccctccttcatcatcagccgtattccggctggatcaggtcatccatagcaaccctgcagggatccagcaagctctcgcgcagctctccagcaggcagggatcagtgactgccccagggggacatccaaggcataaacctgggcctccacaagctcctcagggaccttcccctcgccctccaacgaggtacgagccccagcgcgttaactcaggcttgtcctcagacccccacttcgaagagccaggccctatggttcggggtgtgggaggaacccccagggacagcgctggggtttccccttttcctccgaaacggagagaacgcccacccagaaagcccgagctattacaggaagagagtctgcccccaccacattcatccggattcttggggtccaagccagaaggacctggacctcaagcggagtcccgcgacaccgggaccgaggcacttacccctcatatttggaaccggttacacaccgcgacaagcaggaagagttataggccttccagtatggaaccttggatggagcctctgtccccttttgaagatgtcgctggaaccgaaatgtcacagtcagatagtggggttgacctgagtggagattcgcaagtgtcaagcgggccatgttctcagcgcagctctcccgatggcggactcaagggcgctgccgaggggccacccaagcgtcctgggggatcttcccctctcaacgctgtgccatgcgaaggtccgccaggctctgaaccgccaaggcgcccaccccctgcccctcacgacggagaccgaaaggagctaccacgcgagcagcctcttcctcccggtcccattggcacagaaaggtcccagcgcactgatcgaggtaccgaacctggaccaattaggccctcacaccgaccgggtccaccagtccagttcggtacctcagataaagacagcgacctccgacttgttgttggtgatagcttgaaagccgagaaagaactaaccgcaagtgtgacagaagccatccctgtctctcgcgactgggagctcctccccagtgccgctgcatcagccgagccacagagcaagaacctggattcagggcattgcgttcctgaaccatcaagtagtgggcagcgtctctatcctgaagtcttctacggcagcgcaggcccttcaagtagccagatatctggaggacacggactgtccatcaccagcaagcagtggagacggccagggactcctagtttacatccttacagatctcagcctctgtatctcccacctggcccagcacctcctagcgctctcctcagtggcgtagcgctgaaaggacaatttctggacttctccaccatgcaggcaacggagctgggcaagctcccagccggaggagtgctgtaccctcctccgagtttcttgtactctcctgctttttgccccagtcctctgcctgacacctctctcttgcaggttaggcaggatcttccgagtcccagcgatttctacagcacccccctgcagcctgggggtcagtcgggctttttaccaagtggagctccagctcagcagatgttacttcccatggtcgactcgcagctgcctgtagtgaatttcggatcgctacctcctgcaccaccccctgctcccccacctctttctctcctcccggtcggccctgctctacagcccccaagcctggccgttcgcccacctccagctccagctacacgtgtcctgccttctcccgctaggccgttccccgctagtcttggcagagccgagcttcatcctgtcgagctgaaaccattccaggactaccaaaaactttcctctaacctgggaggccctgggagctctcgcacccctcccaccgggagatctttttccgggttgaatagcaggctgaaggctacccccagcacctactctggggtctttcggacacagagagtggacttgtaccagcaggcttctccacccgatgcgctgaggtggatccccaagccctgggaacgaacagggccaccaccccgtgagggtcctagccgccgtgccgaagagcctgggtctcgaggggacaaggagcctgggctacctccacctcggta

SEQ ID NO: 236254 - DNA, 4149 bp, Artificial Sequence
  Description of Artificial Sequence: Synthetic coding sequence
atgctccgcgagaggggaacacctcctgttgatcccaaattggcctgggttggagatgtgttcaccgccacgccagccgagccgcgtcccttgactagccccctgcggcaggctgcagatgaggacgacaaaggaatgagatctgagacccccccagtgccacctccacctccttatctagctagctaccccggattcccagaaaacggggcaccgggaccgcctatatcccgtttcccattggaagagcccggtcccaggcctctgccatggcccccagggtctgatgaagtggccaaaatccagacaccgccaccgaagaaagagcctcctaaagaggaaaccgctcagctcaccggccctgaagccggacgaaagcctgctagaggtgttggcagcggagggcaaggtccccctcctccgcgaagagaatcccgcacggaaacaagatgggggcctaggcccggatcgagtcggagaggcatacccccagaggaaccgggtgctcccccacgcagagccggtccgatcaaaaagccaccccctcccacaaaggtcgaggaactgcccccaaagccactcgagcagggagacgagactccgaaacctccgaagccggaccctttgaagattacaaaaggaaagctcggtggccctaaggagacccctcctaatggcaatctttcccctgcccctcgcctgcggagagattattcctatgagcgcgtcgggccaacttcttgccggggtcgtggccgaggtgaatacttcgctcgaggcaggggcttccgcggaacctacggcggaagaggcagaggggcacgttctagagagtttaggtcctaccgtgagtttagaggcgatgacggtcggggaggtggcacgggaggccctaatcatccccctgctccgagggggcgtacggccagcgagactcgaagtgagggcagcgagtatgaggaaataccaaagcgaagacggcagcgaggctctgaaaccggaagtgagacccatgagagcgatctggccccatccgataaagaggccccaaccccgaaggagggcaccttgacacaggtgcccctggcaccaccccctcccggagctccccctagtccagcccctgcacgattcaccgccaggggcggaagggtgtttactcctaggggagtcccttcccggagggggcgtggcggaggcagaccaccaccacaagtgtgccccggttggtcaccgcctgcaaaatcacttgcgccaaagaagcctcccacaggccctcttccccctagtaaagagcccttgaaggaaaagctaataccgggacctctctctcccgtggctagaggagggtccaacggcggatctaacgtgggcatggaggatggggaacgcccacgcaggagacggcatggccgagcgcaacagcaagacaagcctccaaggtttcggaggctgaaacaggaacgcgagaatgctgctcgcggaagtgaaggtaagccaagcctgaccctgccggctagtgcccctggccctgaagaggccctgaccacggtgacagtcgcccctgctccacggcgagctgcagccaagtcccctgacctgtctaaccaaaattccgaccaagccaatgaagagtgggagaccgcctctgaatcttcagatttcacaagtgagcggcgaggcgacaaggaggctccccctccagtgctcctgacccccaaggctgtcgggaccccagggggtggaggcggaggcgctgtgccaggaatctccgctatgtctcgtggtgacctttcccaaagggcgaaagatctgagcaagcgttcgttctcctctcagcgccctgggatggaaaggcaaaatcggaggccaggacccggtggaaaagcgggatccagtggatctagctctggcggagggggaggtggcccaggcggacggacaggaccaggcagaggagacaagcggagctggccaagcccaaaaaatagaagccggcctcccgaggagagaccccctggtctgcccttgccccctcctccaccctctagcagcgcggtctttaggctggatcaggttattcacagtaaccctgcgggtattcagcaagctctggctcagctgtcatccaggcagggctcggtaaccgccccagggggtcatcctcgccacaagccaggcccacctcaggccccacagggtcccagtcccaggccacctactcgctatgaaccccaacgggtgaactccggactgagcagcgatccacattttgaagagccgggacctatggtcaggggcgtgggcggaacacccagggattctgccggtgtcagcccgttccctccaaagaggagagagagacctccgagaaagccagagcttctgcaggaggagagccttccccctccacactccagcggtttcctcggttctaagccagaaggcccagggcctcaggctgaatctagggataccgggaccgaagcacttactccgcacatctggaatcggcttcataccgcaaccagtcggaagagttacagaccatctagcatggagccatggatggaacctctatctccctttgaagatgtcgcaggcactgaaatgagtcagagcgacagcggggtcgacctgtctggtgactcacaggtgtcgtccggcccttgctcacagaggagtagtcccgacggagggctcaagggcgcagctgagggccctccaaaaaggccaggcggtagctcccccctcaatgctgtgccttgtgaaggccctccaggctcagaaccgccacggcgtcctcctccagcccctcatgatggggaccgtaaagagctcccaagggaacaacccctgccacccggtcccatcggcactgagcggtcccaacgcacagaccgagggaccgagcctggccctatcagaccttcccacagacccggacccccagtgcaattcggtactagtgataaagacagcgacttgcggttagtggttggcgactctcttaaagcagagaaagagctgaccgccagcgtcacggaagctattcctgtgagtcgagactgggagttacttcccagtgcagctgcctctgccgagccacagtctaagaatctagattctggtcattgtgtgcccgagccgtcttcttctggccaacgcttgtaccctgaagtgttttatggcagcgccggtcccagttcgagtcagatcagcggaggggctatggattcccagctccatcccaactccggcggattccggccaggcaccccatctctgcacccctaccgatcccagccactctacctgcccccaggccctgcaccccctagcgctctgttgtctggtgtcgctttaaagggccagttcctcgacttctccaccatgcaggccacagagctcggaaaactcccagccggaggcgtgctctaccctccgccatcctttctctactctcctgctttttgcccttcacctctccccgacacaagtctactgcaggtgaggcaggacttgcctagtccatccgatttctacagtactcctctacaaccagggggtcagagcggattcctgcctagcggcgcacctgcccagcagatgctcctgcctatggtggactcgcagctcccggtagtcaactttggctccctgccccctgcgcctccccctgcccctcctcctctgagtctgctcccagttgggcctgcactgcaaccaccaagccttgccgtcagaccgcctccggcaccagctactcgcgttctgccttccccagctcgcccatttcccgcttcgttggggcgtgcagaacttcaccctgtggagttaaaacccttccaggattatcagaagctttccagtaacttgggagggcctgggagcagccggacccccccaaccggcagaagtttttcaggcctgaactcaagactgaaggccacgccaagtacttactccggtgtcttccgtacccagcgtgtcgatctctatcagcaagcttccccgcctgacgccctgaggtggattccgaaaccttgggaaaggacaggcccacctcccagggagggccctagccggagagccgaagaaccaggaagccgaggagacaaagaaccagggctgcccccacccagatag

SEQ ID NO: 236255 - DNA, 4149 bp, Artificial Sequence
  Description of Artificial Sequence: Synthetic coding sequence
atgctgagggaacgcggaacgcctcctgtcgatccaaaattggcatgggtgggagatgtgttcactgctaccccagcggagcccagaccattaacttctcccttacgccaagcagctgacgaggatgataaggggatgcgatctgagactccacccgtgccgccaccaccaccttacttagcttcctatccaggattccccgaaaacggcgcaccgggtcccccaatcagccggtttcctctcgaagagcctggcccacggccacttccatggccacccggtagtgacgaagttgcaaaaattcagacgcctccccctaagaaggaaccgccaaaggaggagactgcccaattgacaggaccagaggctgggcgaaaaccggcacgaggggtcggatctggtggccaggggcctccgcctccccgtagggagtctagaaccgagacccgatggggcccacggcctgggagctcaaggagagggattccaccagaagaaccgggagcccctcccagaagagccggacctataaaaaagccaccaccccctaccaaagtggaggagctcccgcctaaaccattagagcaaggtgatgagacacccaagccacccaaaccggatcctctaaaaatcactaagggtaagctggggggacccaaggagactccaccaaatggcaacctgtccccagcacccaggctgagaagggattactcctatgaaagagtgggaccaacttcctgtaggggtcgaggccgaggtgaatactttgcacgtggtaggggattcagaggtacctatggcggtcgagggagaggcgctaggtccagagaatttagatcttacagagaattccgtggagacgacggcagagggggaggaaccggcggtcctaaccaccccccagccccacgcggacgcacagcctccgagaccagatcagaaggttcagagtatgaggagattccaaagagaaggagacagagaggtagcgaaacgggatcagagacccacgagtccgaccttgccccatctgataaggaggcaccaaccccaaaggaaggaaccctgacccaggtgcccctagctccccctcctcccggagcaccacccagtcccgctccagcacggttcacagctagaggaggtcgagtgttcacacccaggggagtgcctagcaggcgcggtaggggaggcggaagacctccaccccaggtttgtcctggatggagcccacctgcgaagagtcttgcccctaaaaagcccccaactggcccactcccgccaagcaaggagccgctaaaggagaaactcatccccggacccctgtcccccgttgccagaggcggatctaatggaggcagcaacgtgggtatggaagacggcgagcggcctaggaggagacggcacggccgagcgcaacaacaggataagccaccaagatttcggaggttaaagcaggagagggagaacgccgcacggggatctgaaggaaaacctagccttaccctcccagctagcgcacccggacctgaagaggctttgaccactgtgaccgtcgcaccagcccctcgcagggctgctgccaagagcccagatctgagcaatcagaattcagaccaggccaacgaggaatgggagaccgcatccgagtcaagtgacttcaccagcgaacgcaggggcgacaaagaagctcctccacctgtcctgctaacccccaaggcggttggcacaccagggggaggcggtggcggagctgtccctgggatatcagccatgagcagaggggatttgagtcagagggctaaagatctatcaaagaggagtttttcgtcccaacggcctgggatggaacggcaaaataggcgccctggaccagggggtaaagcaggctctagcggatctagttccggcggagggggaggaggccctggtggcaggaccggcccagggaggggagacaagcgatcatggcctagcccgaaaaatcgatcgcgccctcccgaagaaagaccacccggactgcccctcccaccccctccaccctcgagcagcgctgttttcaggcttgaccaagtaattcattcgaatccagccggaatacagcaggcgctcgcacagttgtcgtcacggcagggatcagtgaccgcaccagggggtcatcctagacataagccgggtcctcctcaggctcctcagggcccttcaccaaggccacctacacggtatgaaccacagcgcgtcaacagcggcctctctagcgatcctcacttcgaggagccagggcctatggttcgtggggtaggcggaacccccagagatagcgccggtgtgagcccctttccaccaaaacgtagggagaggcctccgaggaagcctgagttgctccaggaggagtcgttgcccccaccacactcttctggcttcctggggtcgaaacctgaagggcctggccctcaggctgagagccgagacacgggcaccgaggctctgaccccccatatttggaataggctccatactgcaacctcgagaaagtcatataggccaagttccatggagccatggatggagccactgagtcccttcgaagatgttgccggaactgagatgtcccaaagcgatagcggcgtagacttgagtggcgactcccaggtgtcatccgggccatgctcacaacggtcatcacctgatggcggacttaaaggtgcagcagaaggccctcccaaaagaccaggtggttctagtccattgaatgctgtcccctgtgagggccctccgggtagtgaacccccaaggaggcccccacctgcccctcacgacggcgatcgcaaggaacttccccgtgagcaacccttgccacctggcccaatcggcacggaacgcagccagcgcaccgatagggggaccgagccaggtcctatccgtccatcacaccgacccggacccccagtacaatttggtaccagtgataaggactcagacttgcgactggtcgtgggtgatagtctcaaggcagagaaggagctcaccgcatctgttaccgaggcgatacccgtgagtcgagactgggaactgctgccaagtgccgcagcctctgccgaaccacaatccaaaaatctggactccggccattgcgtgccagaaccttcatcatccgggcagagactttaccccgaagtgttctacgggtccgcaggccctagcagctcacagataagcggcggtgccatggattcccagctccatcccaacagtgggggttttcgccctggaacaccaagtctccacccttaccgctcccagccgctatatcttccaccgggaccagctccaccttcagcactgctctctggtgtcgcactgaagggacagttcctggactttagtaccatgcaggcgacagagcttggcaagttgccagcaggcggtgtgctgtatcctcccccaagttttctgtactcacctgccttttgtccatctcccttgccagacacatcactcttgcaggtgcggcaggatctgccatccccatccgatttttacagtacccctcttcagcccggaggccagtcaggattcctgccttctggagcccctgcacagcaaatgcttctccctatggtggatagtcagcttccggtggttaatttcgggtctttaccccctgcgccaccccctgcccctcctcccctgtcgcttctgcccgtggggccagcattgcaaccaccttctctggccgtgcgaccaccccctgctccagctacaagggtgcttccttcccccgcaagaccttttcctgctagcctcggccgagcagagctccatcctgtggaactcaagccctttcaggattatcagaaactttcaagcaacctgggagggccaggaagcagcagaaccccccctacgggcaggtcctttagcggtctgaatagtcgcctgaaagcgactccatctacctacagcggtgtcttccgcacacagagggtggatttgtatcagcaggcaagccctcccgacgccctgaggtggattcctaagccttgggaacggactggcccaccacctcgggagggacctagccgacgggctgaagagcctggtagtaggggagataaagaaccagggctccccccaccaagatag

SEQ ID NO: 236256 - DNA, 6449 bp, Artificial Sequence
  Description of Artificial Sequence: Synthetic coding sequence
atgagcgataggtccgggccaaccgcaaaaggtaaggacgggaagaagtattcctctttgaatctttttgatacctacaagggtaagtccctggagatccagaagccagcagtggctccccgtcacggccttcagtccttgggtaaagtggccatagcacgtcggatgcccccacccgctaacctgccctcactaaaagccgagaataaaggaaacgatcccaatgtttccctcgtacctaaagacgggacggggtgggctagcaaacaggaacaatctgatcctaaaagcagcgacgccagcacggcacagccacctgagtcccagcccttgcccgcttcacagacacccgcaagcaaccaaccaaaaaggccccctgcagccccagaaaataccccactcgtgccttcaggtgtgaaatcatgggcccaggcctcggtcacccacggagcccatggagacggagggagggccagcagcctgctttccagattcagccgcgaagaatttccgactttacaggcagccggtgaccaggacaaggccgcaaaggagagggaatctgccgaacaatcctccggtcccggacctagtctgcgccctcagaacagtaccacatggagggacggcggaggacggggtcctgacgaactcgagggccctgactcgaaactgcaccatggccacgacccccgagggggactgcagccaagtggcccacctcaatttcccccttatagaggaatgatgccaccattcatgtatcccccttacctaccttttccccctccgtacggaccacagggaccatatcgctatcctactcccgacggcccttcaagattccccagggtcgccggacccagggggagcggccctcctatgcgcctggtggagccagtgggacgtcctagcattctaaaagaggataacctaaaagagtttgatcagctggaccaagagaacgacgacggctgggcaggcgctcacgaggaagtggattatacagagaaacttaaattttctgacgaagaggatggcagagattccgacgaagagggagccgaagggcatcgggacagccagtccgcaagtggtgaagagcggccaccagaagccgacgggaagaaaggtaactctcctaattcagaaccacccacaccaaagaccgcgtgggcagagacttctaggcccccagaaacagagcctggtcctcccgctcccaaacccccactgcctccgccacaccgcggacccgcaggtaattggggccctcctggcgattacccagaccgaggcggtcccccatgcaagcccccagcacccgaggacgaagacgaggcatggcggcagcgtcgaaaacaatcctcgtcagaaatctcactcgccgtggaacgtgccaggagacgcagagaagaggaggagcgccgtatgcaggaggagcggcgagctgcatgcgcagaaaaactgaagaggctggacgagaagttcggcgctcccgataagagactcaaggccgagcctgccgctcccccagctgcaccatccactcccgctccacccccagccgtgcccaaagaactgcccgctcctccagcaccaccgcctgcgtcagcacccaccccagaaaaagagcccgaagaacccgcacaagcccctccagcgcagagtactcctactccaggcgtggctgccgcacctactcttgtaagtggcggtggttcgacgagctctaccagcagcggctcttttgaggcatctcctgtggagccacagctgccatcaaaggaagggccagaaccacccgaggaggtccctcctccaacaacacccccagtgccaaaagtggagccaaaaggagatggtatcggtccaacacgacagcctccatcccagggtctaggctacccaaaataccagaagtcgttacctccgagattccagagacagcagcaggagcagctacttaaacaacagcaacagcaccaatggcagcaacatcaacagggaagcgcccctcctactccagtccctccaagtccaccccagcctgtcacgctgggcgcagtgccagccccacaggctcccccaccacctccaaaggctctgtacccgggagccctgggtaggcctcccccaatgccccctatgaactttgatccccgatggatgatgatacccccttatgtcgaccctcggctgttgcaggggagaccacctctggacttttacccgccaggggtgcacccaagtggccttgttccccgagagcgctccgactcggggggatccagctccgagcctttcgatcgtcacgcccctgctatgctaagggagcgcggtacacccccagtggaccccaaacttgcttgggttggagacgtgttcaccgctacgccagccgagcccagacctctgacaagtcccctccgccaggcagccgatgaggacgacaagggtatgcgctctgagacacctccggtccctcctccccctccctacctggcttcttatcccggattccctgagaacggggctcctggtcctcctatttcaaggttcccactggaagaacctggcccacgaccattaccgtggccacctggcagcgatgaagtggctaagatccaaactcctccaccaaaaaaggagccccctaaagaggaaaccgcccagttaactggtccagaagctggacgaaagccagccagaggggtgggatccggaggtcaaggaccgccacctcctcgaagggaaagtcgcaccgagactcggtggggtcctagaccgggttcctcccgtcggggtattccgccagaagagcccggtgcacccccaagaagggcagggccaattaaaaagcctcctcctcctacgaaagttgaagagctgcccccaaagcccctggagcaaggggacgaaacccctaaaccccctaaacctgaccctctaaaaatcaccaagggaaagctggggggaccaaaagaaaccccacctaacggcaacctgtccccggctccccgtttgagacgagactacagttatgagagagtggggcctacctcatgccgcggaaggggccgtggagagtatttcgcgagaggcagagggtttcggggtacttacggtggcagagggcgtggtgcagcaggtaactcagccgtcacagagagtttcgaggaaatgatgggggtcgaagtgggccagggtgaccagacaaccctccttctcccggaagctgctttgccagccaggcatggcgctagagttcagtcaatgaggaagagcccaagcggtgctggctcaggtgctcagaaacaagcagctcgacccatgcgcgtgatctggctcctgcagactcggagactacctcatcctcgccgtgaacactcccctaggtctagatcccccaccacccggagtcccacttttcccgctcccgctcggttcactccgggagtgggggaaagcagtttgcctgagggaatctctccgggtcctcgtcggcgtgagcctccgcaggtttgccctggttggagtcctcctgcgaaatcacttgccccaaaaaaaccacctacagggccactcccccctagcaaagagcctctaaaagagaagcttattccaggccctctatctccagtagctcggggtggcagcaatgggggtagcaacgtcgggatggaagacggggaacggcctcgtagacggagacatggacgagcacagcaacaggacaaacccccaaggtttagaaggcttaaacaggagagggagaatgcggctcgcggaagtgagggtaaaccaagtcttactctgcccgctagcgctcccggacccgaagaggctctaacgacggtgaccgtagctcccgcaccaagacgggcagctgcaaaaagcccggatctgtcaaaccagaatagcgaccaggctaacgaagaatgggagaccgccagtgaatcctcagactttacatctgaaagacggggtgacaaagaagccccacccccagtgctattaacccctaaagcagtcggcactcccggaggaggtggtggcggagccgtccccggtatatctgccatgtcccgcggtgatctttcccagcgcgcaaaggatctctccaagcggtcattcagcagccaacgacccggtatggagcgacagaacagacgcccaggtcctggtgggaaggcgggtagctcagggagctcatcgggcggtggtggcggaggtcccggaggaagaaccgggcctgggagaggcgataagagaagttggccgagcccgaaaaaccgctccaggccaccggaggaaagaccgcctggcctgcctctgcctccgcctccaccctcatcaagcgccgtgtttcggctggaccaagttatccacagcaaccctgctggcattcagcaagctctggcccagttgtcatctaggcagggaagcgtgaccgcccctgggggtcaccccagacacaaacctggtccccctcaggcaccccagggccctagtccacgaccacccaccaggtacgagccacagcgtgtcaactcgggtctaagctccgatccacactttgaggaacccggaccgatggtgcgaggcgtcggcggtactccgagggactcagcaggcgtaagtccgtttccccctaagagacgagagcgcccacctaggaagcccgaactgcttcaagaagagtcactgccaccaccccacagcagcgggttcctcggctctaagccggagggtcctggcccacaagcagaatccagggatacaggaacggaggcacttacaccccacatctggaaccgactgcacactgccacaagccgtaagtcttataggccttccagcatggaaccatggatggagcctttatccccgtttgaggacgttgcaggcacagaaatgtcacagtccgacagtggcgttgatctctctggcgacagtcaggtgagcagcggtccttgttcccagcgtagctcccctgacgggggactaaagggcgcagccgagggaccccctaaaaggccaggaggctcatctccactgaatgcagtgccctgtgaaggtcctcccggatcagagccgccacggaggccaccacctgctccccacgacggagacagaaaggaattgcctagggaacagccattgccacctggccctatcgggactgagagatctcagcacacagacagggggacggagcctggacccatacggccaagtcatagaccgggtcccccagtacagttcggaacatcagacaaggattctgacctgcggctggtcgttggtgattccctgaaggccgagaaggaactcaccgcaagcgttacagaggctatccctgtgtcaagagactgggagctactgccctctgctgcagcgtcagctgaaccccagagcaagaatctcgatagtggacactgtgtgcctgaaccatcgtcttcaggccagcgcctttaccccgaggtgttctatggatctgctggacccagcagcagccagatttccggcggacacggactgtctgtgacctctaagcagtggcgcaggccgggtactccatccctccacccctatcgatcgcaacccctgtacctgccaccaggcccagctccaccatccgctctactctctggcgtggccttgaaaggccaattcctcgacttcagtaccatgcaggctaccgagctgggtaaactgcccgcaggtggcgtgctttatccaccaccatcctttttgtactctccagcattctgcccttcccccctccctgataccagcctgcttcaagtgaggcaggacctgccttcgccatctgatttctatagcactccactgcagccagggggtcagtcaggctttttgccttccggggctcctgcccagcaaatgcttttaccaatggttgactctcagctccccgttgtaaactttggttccctgcccccagcccctccacctgctcctcctagcctctcgctactaccagttgggcctgccttgcagcctcccagtctggcggtcagacccccacctgccccagctacccgggtgttgccttccccggctcgcccttttcctgcaagccttggtcgagccgagctgcaccctgtggagctgaagccttttcaggactatcaaaaactcagctcgaacctgggcggacctggatccagccgaacccctcctactgggcgatctttcagcggccttaacagcagactcaaggctaccccatcgacatattctggcgtcttcaggacacagagagttgacctctaccagcaggcctccccccctgacgcgctgcggtggattcctaagccatgggaacgcaccgggcctcccccacgagaagggccaagccgtagggctgaggaaccgggttcaagaggcgataaagagcccggactgccaccccctaggta

SEQ ID NO: 236257 - DNA, 4149 bp, Artificial Sequence
  Description of Artificial Sequence: Synthetic coding sequence
atgctccgagagaggggaacacctcccgtggacccaaaattagcatgggtgggcgatgtctttaccgccacaccagccgagcccagaccattgactagccctctgagacaggcagccgatgaggacgataaagggatgaggtctgaaacccccccagttcctccccctcctccgtacctcgcgagttatcccggatttcccgaaaatggcgctccgggtccgcctatttcccggttccctctggaagaacccggtccaaggccccttccatggccccctggaagtgatgaagttgccaaaatacagactccccctcctaagaaggaaccaccaaaggaggagaccgcccaattgacaggtcctgaggctggaagaaagcctgctcgaggggtgggcagcgggggacaaggacctccgcctccacggagggagagcagaacagagacccggtggggacctcggcctgggtctagcagacgaggaatcccccctgaggagcccggagcaccccctaggagagcgggacctatcaaaaaaccccctccaccgaccaaggtggaagaattgcctcctaaaccgcttgaacagggcgacgagacaccgaaaccaccaaagccagatccactgaagattaccaagggaaaacttggtggacccaaagagacccctccgaacgggaatttaagtcccgcacctcgcctccgccgtgattactcatacgagcgcgtgggacctacgtcctgccggggtcgtggaagaggcgagtacttcgcacggggtcgcggatttcggggaacgtatgggggtagaggcaggggagccagatctcgggagttccgctcataccgagaattcagaggtgacgatggcagaggaggtggcactggcggtccaaaccatccccctgcacccagggggagaactgcttccgagaccagaagtgagggcagcgagtacgaagagatccctaagagaaggcgacaacgcggtagtgagacagggtccgaaactcacgaatccgatctggctccctctgacaaagaggcacctacccccaaagaaggcaccttgacacaagtgccattggctccgccaccacctggggctcctccctcgcccgcaccggcaaggttcacagccagaggcggaagagtgttcacgcctcggggtgtgccttccaggcggggacggggtggcggaagacccccaccgcaggtgtgccctggttggtcaccaccagccaagagcctcgccccaaagaagccccctacaggccctctcccgcctagcaaggagcctctaaaggaaaaactgatacctggaccgctcagtcctgtcgccagggggggttccaacggagggagcaacgttggcatggaggacggggaaaggcctaggagacggaggcatggcagggctcagcagcaggacaagcctccccgattcagacgcctaaagcaggaacgcgagaacgccgctcggggatctgaaggcaagcccagccttactctgccggcaagtgcacctggcccagaagaggcacttaccacagtcactgtggcacccgctcctagacgcgctgcagccaagtcacccgacctgtctaaccagaattcggaccaggcgaatgaggaatgggaaacggcttcagaatcctcagattttacaagcgaacgcagaggagacaaagaggctcctccaccagtactgttaactcccaaggctgtgggcactcctggcggtggcggaggtggcgcagtccctgggatttccgctatgagtcggggagacctctcacagcgcgcaaaagatctcagcaaaagatcttttagttcccagcggcctggcatggagcggcagaacagacgccctggccctgggggaaaggctgggtcgtccggttcatcgtccggaggagggggtggaggacctggtgggaggacagggccaggaaggggagataaacggagctggccgtccccaaaaaaccggtctcgcccaccagaggagaggcccccaggtctcccgctgcctcccccaccgccaagcagcagcgcagtattccgacttgaccaggtgattcactctaaccccgctggaatccaacaagccctggcccagctcagtagtcgccaggggagcgtaactgctcctggaggtcatccccgacataagcccggacctccacaggctccacagggacctagcccgaggcccccaacgcgctacgagccgcaaagagtgaactccggcctcagtagcgatccccactttgaagagccgggtcctatggtccgaggggtgggcggaacccctagggactcagccggagtttctccattcccccctaaaagaagagaacgtccacctcgtaagccagagcttctgcaggaagaatcactcccacctccccacagttccggcttcctgggctccaaacctgaaggccctgggccacaggctgagagccgcgacactggtaccgaagctctgactccacatatctggaaccgccttcataccgcaacctcacgtaaatcctaccgtcccagtagcatggagccctggatggagccgctaagcccctttgaagatgtggccggtacagaaatgtctcagtctgacagcggggtggacctgtcaggagactcccaggtgtcttcaggcccatgttctcagaggagtagtccagatgggggactgaaaggagcggcagaaggtcctcccaagagaccagggggaagcagtccgctgaatgccgttccttgtgaagggcctccaggcagcgaacctcccagacgccctcctccagcccctcatgatggcgatcgaaaggaactgccacgggagcagcctctgcctcctggccctatcggcaccgaacgcagccagcacactgaccgtgggaccgagcctggcccaatacggccatcgcatcgcccagggcctccagtgcagttcggtacgagcgataaagattctgacctcagacttgtcgtgggcgacagtctgaaagccgagaaggaactcacggcctccgtgacggaagccattccggtaagccgcgactgggagctgctgccctcagcggcagcatccgcggagcctcagtcaaagaatttagatagtggacactgtgtgcctgaaccctcttccagcggccaaaggctgtaccccgaagtgttttacgggtctgctggcccttcatcctcacagattagtggtggagccatggacagccagctacaccccaacagtggtggtttcagaccaggtaccccctcccttcacccctatcggtcccaacctctgtatctacctccgggtccagctcccccttcagctctcttatccggggtggctctgaaggggcaattcctcgatttttcaactatgcaggctaccgaattaggaaaattaccagctggtggagtactgtatcccccaccaagttttctctattcccctgctttttgcccatccccgttaccagatacgtcattactgcaagtccgccaagacctaccatccccgtccgatttctacagcacgccactgcagccgggagggcaaagtggcttcctgccgagcggcgcacccgctcagcagatgctgctgccaatggtcgattcacaactgccagtcgttaactttggttccctcccgccagccccacctcccgcacccccttcactcagcttgctccccgtgggcccagccctccagcccccttcactggcagtgcgcccaccaccagcaccagccacccgcgtgctgccttcacctgcgcgaccctttcctgccagtcttggcagggcagagttgcaccccgttgaattgaagcctttccaggactaccaaaaactgtcctcaaaccttggagggccaggttcgagcagaacacctcccacggggagaagtttctcaggacttaattcgaggcttaaggccactccctcaacctactccggcgtattcaggactcagcgggtggatctgtatcagcaggccagcccgcctgatgcactgcggtggatccccaagccctgggagagaacaggccctcctcccagagaggggccatcccgtcgggctgaagaacccggtagcaggggtgacaaagaacccggtctaccacctccaagatag

SEQ ID NO: 236258 - DNA, 6449 bp, Artificial Sequence
  Description of Artificial Sequence: Synthetic coding sequence
atgagtgacaggtctggcccaaccgctaagggaaaggacggaaagaagtactcctccctgaacttatttgatacatacaagggaaagtccctagagatccagaaaccagcagtggctccacgccatggcctccagtcgctgggaaaagtcgccatcgcacgtcggatgccccctcctgccaaccttccctcactgaaggcagagaacaaaggtaatgatccaaacgtgtccttggtgcctaaggacggaaccggatgggcaagcaagcaggagcagagcgacccaaaaagtagcgacgcttcaactgcgcagccacccgagtcgcagccactccctgctagccagacaccagcctccaatcagccgaagcggcctccagccgctcccgagaacacgccccttgtacctagcggcgttaagtcgtgggcccaggcatcagtgacacacggcgctcatggagatggcggtcgagcatccagtcttctttctaggttctctcgagaagagttccctacccttcaggcagcaggtgatcaggacaaggctgctaaggagagagaatccgccgagcaaagctccggtccaggtcccagcttacggccacaaaatagcaccacctggagggatggcggaggtagaggaccagatgaactcgagggaccagacagtaaattacatcacggccacgacccaagaggcggactgcagccgtccgggcctcctcagttcccgccttaccgcggaatgatgcccccttttatgtatcccccttacttgcccttcccaccaccatacgggcctcagggcccataccgctaccctacgcccgatgggccaagccgttttccaagagtggctggaccaagagggtctgggcctccaatgcggctggtagaacctgtcggtcgcccaagcatactgaaagaggataacctcaaagaatttgatcagcttgaccaagagaacgatgacggatgggccggagctcatgaggaggtcgattacaccgaaaaactgaagttttccgacgaagaggatggccgagattctgacgaggagggcgctgaagggcatagagacagccagtctgcttccggcgaagagcggccacctgaagcagacggaaagaaggggaatagccctaactcagaacccccaacccccaagacagcttgggccgagacttcaaggccacccgaaacagaacctgggcctccagcaccaaagcctcctctccctcctccacatagaggcccagctggcaattggggtcccccaggcgattatccggatcgaggcggtcccccttgtaagcccccagctccggaagatgaggatgaagcctggcgccagaggaggaaacagtcctcttcagaaatctccctggcagtggagagggcaaggagacgacgggaggaagaggagcggagaatgcaggaggagagacgagccgcatgcgcggagaagttaaaaaggctggacgagaagttcggagcccctgacaaaaggcttaaggcggaacccgcagctcccccagctgcgccaagcaccccggcaccccctcctgctgttccgaaagagttgcctgcgcctccggcaccccctcccgctagcgctccgacacctgagaaggaacccgaagagccagcacaggctcccccagcgcagtcaacgcctacacccggtgtggctgcagcaccgacccttgtaagcggcggtgggtctacgagttcgacctcctctggatcgtttgaggcatcaccggtcgagccccaactgccatctaaagaaggtccggagcctcctgaggaggttccccctccaacgactcccccagtgccgaaggtggagccgaaaggcgatgggatcgggccaacaagacagcccccatctcagggcctcggataccccaagtaccagaaatcactgcctcccaggttccagcgccaacaacaagagcaactactcaaacagcaacaacaacatcagtggcaacagcaccagcagggctcagccccaccaacccctgtaccaccgtcaccaccccagccagtaaccctgggcgcagtccctgccccacaggcacccccacctccccctaaagccctatatcccggagcccttggtcgcccaccacctatgcctcctatgaattttgatccccgttggatgatgatccctccatacgtggaccccagactgttacagggccgtccccctcttgatttttatcctcctggcgtgcatccttcaggcctcgtacccagggaaaggtcggactctggaggatcctcttcagagccgtttgaccgtcatgcccctgccatgctgcgcgagagagggactccgccagtggatccaaaattggcctgggtgggtgacgtgtttactgctacaccggctgaaccacgacccttaacaagtccactgaggcaggcggcagacgaagacgataagggcatgagatcagaaacaccgcctgtgccgcctccccctccctacctcgcaagttacccgggttttcccgagaatggggcacctggccctccgataagccgtttccccctggaagagccagggccaagacccctcccttggccacccggtagcgatgaggtggccaagatccaaacccctccacctaagaaagaaccgcctaaagaggagacagcacagctcaccggccctgaagccggtaggaagccggcaagaggggtcggaagtggaggtcagggccctccgcctcctcgcagggagagtcggaccgaaaccagatgggggcctaggcccggatccagcagacggggtattccaccggaagagcccggagcaccccctagacgtgctgggccaattaagaaaccaccacccccaacaaaagtggaggagcttccccctaaacctctggaacagggggatgagacacccaaaccccctaaaccagaccccctgaagatcacaaaaggaaagttgggaggccctaaagagacacctcctaacggcaatttgtcccccgctcccagactgcggagagattattcctacgaacgcgtgggccctactagctgccgcggtcgcggaagaggcgagtattttgctcggggtcggggtttccgaggaacgtatggcggacgcggacggggagcagctggcaatagtgccgtgacagagtcttttgaagaaatgatgggcgtggaggtgggccagggcgatcagaccaccctgctcctgcctgaggccgctcttcctgccagacacggcgcacgggtgcaatccatgcgcaaatcaccgtctggcgctggaagtggggcacaaaagcaggctgctagacccatgagagttatctggctgcttcaaacacggaggttaccacatcccagacgcgaacattccccacgcagcagaagtccaaccactcggtctcccactttcccagcgccagccaggtttacccccggagtgggcgagagcagcctgccagaaggcatctctcctggccctaggcggagagagccccctcaggtgtgtccaggctggtcccccccagccaaatccctggctcccaagaaacccccaacgggtccactgcccccttccaaagaacccctcaaagagaagcttatccccggtcccctttccccagtggcccgtggaggaagtaatggaggatcaaacgtggggatggaggacggggagcgcccaagacgcaggcggcacgggcgtgctcagcagcaagataagccacctagattcaggaggctgaagcaggagagggagaacgccgcacgaggctcagaggggaagccaagcctgaccctgcccgcatccgcccctggacctgaggaagccctgaccactgtaaccgtggcgccagctcctcgaagggcagctgcaaaatcacccgatttgagcaaccagaactcagaccaggccaacgaagagtgggagaccgcttctgagagctcagactttacaagcgagcggaggggggacaaggaggcccctcctccagtgttgctcacacctaaggccgtgggcactccaggcggaggagggggtggcgcagttcctggcatctccgcaatgtctaggggagatctgtctcagcgggcaaaggatctgtctaaaaggtccttctcgtcacaacgaccagggatggagcggcagaatagacggccaggcccagggggaaaggctggcagctcaggtagcagctccggcggtggtggaggcggacccggtggcagaaccggtcccggacgaggagataagcgcagctggccttccccaaaaaacagaagccgaccaccagaagaacggccacctggtcttcccttgcctccacctcccccttctagctctgctgtgtttaggctggatcaggtgatccactccaaccccgcaggcatccagcaggctctggctcagctcagttcgagacagggtagcgtgaccgcccctggcggacatcccagacataaacctggaccgcctcaggccccacagggccctagcccaagacctccgacaaggtatgaaccgcaacgggtgaattctggtctgtcttctgacccacatttcgaagagcctggccctatggtccgtggcgtcggcggaactcccagagatagcgctggcgtgagtccattccctcctaagaggcgcgaaaggccgcctcgcaagccagaacttttgcaggaagagagcctgccccctccgcactcctccgggtttttgggaagcaagccagagggacctggcccacaggccgagagccgggatacaggcaccgaggcattaaccccccatatttggaatcgactgcatactgccacgagccggaagtcgtatcgcccaagcagtatggaaccttggatggaaccgttaagcccctttgaagatgttgccggaacagagatgagccagtcggattcgggcgttgacctttccggagattcccaagtaagctcaggtccttgctcccagcggtcttctcccgacggcggtcttaaaggcgctgccgagggcccaccaaaaaggcctggcggatcttccccactgaacgccgtaccttgtgagggccctcctggttcagagccccctcgcaggcccccacccgctccccatgacggggaccgcaaggaactgcctagagaacaaccattgccccctgggccaattggtactgaacggagccagcatacggaccggggaacagaacccggtcccatccggccttctcaccggcctggaccccctgtacaattcggcacttctgataaagacagcgacctccgtctcgtggtaggcgactcccttaaggccgaaaaggaattgactgcctcggtgaccgaggccattcccgtgagtcgggactgggaactgttaccgtccgccgctgcttccgcagagcctcaatctaaaaacttagattcagggcattgtgtgccagaaccaagctctagtgggcaacgtttgtatccagaagttttctatggcagtgctggcccttcaagcagtcagattagcgggggacacgggctgagtgtgacgagtaaacaatggcgccgtcccggaacaccttctctacatccctacagatcacaaccgctgtacctgccccctggccctgctcctccttccgcactcctttctggcgtggccttaaagggacaattcctagatttttctactatgcaagctactgaacttgggaagctgcctgccggaggtgtgttataccctccaccctcatttctctactctcccgctttttgtccttcgcctttgccagacactagtctgcttcaagtcagacaggacctgccttctccaagcgacttctactctactccactgcagccgggtggccagtcagggttcttaccaagcggggctcccgcacagcagatgcttctcccaatggtggactcccagctgcctgttgtgaatttcggcagcttgccgcctgcccctcctcccgcaccccctagcttgagtttactccccgttgggccagccctccaacccccttcactcgcggtcaggccaccacccgcaccagcaacaagagtcctgccttcccccgcaaggccattcccagcctccctaggacgggcagagctacaccccgttgagctcaaaccttttcaggattaccaaaaactatctagcaacctcgggggaccgggttcatcccgaactccgcctacgggcaggtccttttcaggcctgaatagtcgtctgaaggctaccccatcaacatatagtggcgtatttcgaacacagagagtagacctgtaccagcaggccagtccacctgacgctctgagatggatccctaaaccctgggagcggactggacctcccccaagagaaggcccttcaagacgggctgaagagcccggtagtcggggtgataaagaacctggactaccgccaccgcgtta

SEQ ID NO: 236259 - DNA, 1650 bp, Artificial Sequence
  Description of Artificial Sequence: Synthetic coding sequence
atgtcagacagaagcgggcctactgcaaagggaaaggacggtaagaaatattcctcactcaatctattcgacacatacaagggcaaaagcctggagattcagaagcccgcagtcgccccaagacatggcctgcagagcttggggaaagtcgccattgctcgacggatgccaccccctgccaaccttccctccctgaaagctgagaataaggggaatgacccaaacgtgtcccttgtgcctaaggacgggaccggatgggcctccaagcaagaacagtccgatcctaaatcatcagacgcctccacggcgcagcctcctgagtctcagcccctccccgctagccagactcctgcgtccaatcaacccaagaggccccctgccgctccagaaaacactcctctggtaccctctggggtcaagtcctgggcccaggcctccgttacccacggtgcgcacggagatggtggtcgcgcttcatccttgctgtcaaggttcagcagagaagaattccctacactccaggctgccggtgatcaggacaaagcagccaaggaaagagagtctgcagagcagagctcaggccctggcccaagcctccgtccccagaacagcaccacctggcgggacggagggggtaggggcccagatgaactggagggtccagattccaagctacatcacggacatgatccgaggggagggctacagcccagtggccctccacagtttccgccatataggggtatgatgcctccattcatgtaccccccttatcttcccttcccgccaccttatggtccacagggaccttataggtaccctacacccgatggacccagcagatttccaagggtggccggaccaaggggtagcggtccccctatgaggcttgtggaacccgttgggagaccctcaatcctgaaggaggacaatctaaaagaattcgaccaactggaccaggaaaacgacgatggatgggcaggcgctcacgaggaagttgactacactgagaagcttaagttttccgacgaggaggatgggagagactccgatgaggagggtgcggaggggcaccgcgacagtcagtctgcctccggcgaggagcgccctcctgaagccgacggcaagaaaggtaatagcccgaactccgaacctccgactcctaagacggcttgggccgagacttctcggcctccagaaaccgaaccagggccaccggctccgaaaccacccctcccgcctccccatcggggacctgcaggtaactgggggccaccaggggactaccctgaccgagggggtcctccgtgtaagcctcctgctcctgaagacgaggatgaagcctggcggcagcgacgaaagcagtcttcctctgaaatctctcttgctgtggagcgggcacggagacgtagggaggaagaagaaaggcgcatgcaggaggaaaggcgggctgcctgtgcagaaaagttaaaaaggctggacgagaagtttggcgctcctgacaaacgactcaaggcagagcccgcagcaccacctgctgcaccatccactccagccccaccaccagccgctagcgaggtgccattgatggaagactcccggggacaacaacgagatcctccgcgagggctcgaagcgccacacccatag

SEQ ID NO: 236260 - DNA, 1650 bp, Artificial Sequence
  Description of Artificial Sequence: Synthetic coding sequence
atgtccgaccgctccggccctacagcaaaaggcaaggacggaaagaagtattctagcctgaacctgtttgatacatacaaggggaaatccctggagatccagaagccagctgtagctccacgtcacgggctgcagtcactcggtaaagtcgcaatagcgcgacgaatgcccccacctgctaacctgcctagtctcaaggctgagaacaagggcaacgatcccaatgtgtccctggtccccaaggacgggaccggctgggcaagtaagcaagaacagtcggacccaaagtccagtgatgccagcacagctcagcctcccgagtcccagcctctccctgcaagtcaaaccccagcctcaaaccagcccaagaggcctccagccgcaccagaaaataccccattggtgccatctggcgtcaaatcatgggctcaggcctcggtgacccacggcgcacatggtgatggtggcagagcatctagcctcctctctcgattctccagagaagagttccctaccctccaggcggctggcgatcaggacaaagccgctaaagagcgggaatcagctgagcagtcaagcggacctggcccatccttgcggccacagaacagtactacttggcgtgacggaggcggacgcggaccagacgagctggaaggacctgactccaagttacaccatggccatgatcctcgcggaggcctccagccctcagggcctccacagtttccaccctacagagggatgatgcctccatttatgtatcctccttacctgccattcccccctccatacggccctcagggtccctaccgctatcccaccccagatggtccatcacgctttcctcgcgttgcgggaccgaggggaagcggccctcccatgcgacttgttgagccagtgggtaggccttccatcttaaaggaggacaacctgaaggagttcgatcagttagaccaagagaacgacgacggatgggccggagcccatgaggaggtagactataccgagaagctgaagttttccgatgaggaagacggaagggacagcgatgaagagggtgctgaggggcaccgcgactctcagtccgcaagtggagaggagcggcctcctgaagctgacggtaaaaagggcaatagtccaaactcagagcctccaactcccaagactgcatgggctgagacctctaggcctcccgaaactgagccgggtcccccagctcccaaacccccactgcccccaccacaccggggaccagcagggaattgggggcctccaggcgattacccagaccgcggaggccctccttgtaagcccccagcccctgaggacgaagacgaagcctggcgacaacggaggaaacagagttcctctgaaatatctcttgctgtggagcgagcacgaaggaggagggaggaagaggaaaggcggatgcaagaggaaagaagggctgcttgcgcagaaaagttgaaaagactggatgaaaagttcggcgctcctgataaaagactaaaagccgaaccagccgctccccctgccgcacccagcacccctgctcctccccctgctgccagcgaggtgcccctgatggaggacagcaggggtcagcagagagaccctcccagaggactggaggccccacacccctag

SEQ ID NO: 236261 - DNA, 4149 bp, Artificial Sequence
  Description of Artificial Sequence: Synthetic coding sequence
atgctgagggagcgcggaaccccaccagtggatcccaagctagcttgggttggggatgtttttaccgctacgcccgctgaacctcgcccactgaccagcccgctgagacaagcggcagatgaggatgacaaggggatgcggtcagaaacaccaccggtcccaccccctcctccttacttggcctcttatcctggtttccccgaaaatggggcacctgggccacccatatcgagattccccctagaagaaccaggccctcgcccactaccctggccacctggaagcgatgaagtggcaaagatccagacgccacccccaaagaaggaaccgccaaaagaggaaactgcacaactgactgggccagaggctggcagaaagccggctcggggtgtcggatcaggaggacagggtccacctcctccaagacgggagtcaaggactgagacacggtggggtccaaggccaggcagtagcagacggggtatccctcctgaggaacccggagcgcctccccgtcgggcagggcctatcaagaagcctccgcctccaactaaagtcgaggagctgcctccaaagcctctggagcagggcgatgagacaccgaagccaccaaagccagatcccctcaagattaccaaaggcaagctgggagggcctaaggagactcccccaaatggaaatctgagccccgcacctcgcttgaggagagactacagctatgaacgagtgggccctacaagctgtaggggcaggggcaggggggagtactttgcacgcggaaggggatttagaggaacttacggaggcagaggcaggggggcaaggtcccgagagtttcgctcctaccgggaatttagaggcgacgacggacgcggaggtggcacaggcggaccgaaccacccacctgccccaaggggtcgtacagcctctgaaacccgatctgaggggtctgagtacgaagagatccccaagcggagaaggcagagaggctcagagactggctcagaaactcacgagtcagacttggcacctagtgacaaggaagctcccactccgaaggaaggtaccctgacccaggttcctctggctcccccacccccaggggctccaccatctcccgcaccagcacgctttaccgctcgcggagggagagtgtttacccctaggggggtgccttcacgaaggggcagaggaggaggaagacctcctcctcaagtgtgtccagggtggtcgcctcctgccaaatcactggcccctaagaagcccccaacaggtcctctgcccccaagcaaggagccactcaaagaaaaactgatccccggacctctttcccctgtggcgcgaggtgggtcaaacggtggtagtaacgttggaatggaggacggcgaacggcctcgacgcaggagacacgggcgtgctcagcagcaggataagccacccagatttagaagattgaagcaagagcgtgagaatgcagcccgagggtctgagggcaagccatcactgacactccctgcatcagctccaggacccgaagaggcactgaccacggtgacagttgcccctgcacctagacgggcagccgctaaaagcccagatttgtcaaaccagaattcagaccaggcaaacgaagaatgggaaacagcctccgaaagttccgactttacctctgagaggcggggtgataaggaagcacctccccctgtgttactgacgcctaaggcagtcggtacccctggagggggaggcggtggagcggtgccgggaattagcgcaatgtcccgtggagacttgagtcagcgcgctaaagacctttccaagaggtcattcagctcacagcggccaggtatggagcggcagaacagacgaccaggccctgggggtaaagcaggtagctcaggaagctcctccggcggagggggaggcggtccaggaggtcgcaccggcccaggcagaggcgataagaggtcttggccctctcctaaaaatcgtagtcgtcccccagaagaacgccctccagggctgccgctgcccccaccacctccgtcttcaagtgccgttttccgcttagaccaagttatccattcaaaccctgcaggaattcagcaggcactggcgcagttgtcttccagacagggatccgtgacggccccagggggacatccacgtcacaaaccaggaccaccgcaagcaccgcagggcccatcaccacgaccccctacacgctatgaacctcagagagttaattctggtctgagctccgatcctcatttcgaggaacccggacctatggtgcgcggagtgggaggtactccaagagactcggccggagtttcccctttccctcccaaacgcagggagcgccctccccgaaagccggaacttttacaagaagagagcctacctccgcctcactccagcggattcttgggatctaagccggagggccctgggcctcaagctgaatcacgcgacacaggcaccgaggctctgacaccccacatttggaatcggctccatactgccacttctcggaagagctacagaccaagctctatggagccctggatggagcctctgtcccctttcgaggatgtggccggaacggaaatgtctcagtcagactcaggcgtagaccttagtggtgacagccaggtttcctctggaccatgtagtcagaggtcttccccagatggagggttgaaaggggctgctgagggaccaccaaagagaccgggaggctcctcaccattgaacgcagtgccatgcgagggaccccctggctctgaaccacctcgcaggcctcccccagcacctcacgatggcgacaggaaggaactgccacgagagcaacctttaccacctgggcctattggaacagagaggagccagcacacagatcgcggaacagagcctggccctattcggccttctcaccggccaggccctccagtacaatttgggacttcggacaaggactccgatctgagactcgtcgtgggcgacagtctcaaggccgagaaggaactcaccgcgtcagtgacagaagcgataccagtctctagggactgggagctgctcccatcagccgcagctagtgcggaaccgcagtctaaaaatctggactcagggcattgtgttccggaaccttcgtcctccggacagcgactgtacccagaagtcttctacgggtctgccggtccatcctcaagccagataagcgggggagcaatggatagccagctgcaccccaattccggcggtttcaggcctgggacaccttccttgcacccatatagatcacagcccctctacttgccgccaggacctgccccacccagtgccctgctgagcggtgtagcacttaagggccagttcttggatttttccacaatgcaggccacggaactgggaaagctgccggctggaggtgtcctgtacccgcctccgtccttcctgtactcacctgcattttgcccaagtcccctgccggacacttcgctgcttcaagtgcgacaggatcttccctccccttctgacttttattctaccccactgcagcccggtggacagagcggctttcttccgtcaggcgcacctgcccagcagatgctgctgcccatggtggattcccagctccccgttgtgaattttggctccttgcctcctgcacctccacctgcaccccctagccttagtctcctgcccgtgggccctgctctgcagccacccagcctggcagttaggccccctccagcccctgctaccagagtcctgccatctccggctcgcccattccccgcttctcttggccgagccgaactacatccagtcgaattaaagccttttcaggattaccaaaaacttagtagcaatttaggcggaccaggatcctccaggaccccccctactggcaggagcttcagtggcctgaactccagacttaaagctactccctccacctactcaggtgtgttccggactcagcgtgttgatttatatcagcaggcctctccacccgatgccctgcggtggatccccaaaccgtgggaaaggaccggtccaccccctcgggagggacccagcagacgggctgaggaacccggatcccgaggggataaggagcccggattgccaccaccgcgttag

SEQ ID NO: 236262 - DNA, 984 bp, Artificial Sequence
  Description of Artificial Sequence: Synthetic coding sequence
atgaccgtcgtttccgtgccacagcgtgagcccttagtcctgggagggagactcgcgccactgggtttttccagcaggggatacttcggggcactgcctatggtcactacagcacctccaccattgccacgcatccccgatcctcgagcactaccccctactttatttttgccacacttccttggcggagacgggccatgtttgactccccaaccgagagcacctgctgccttgccaaacagatcactggctgtcgcagggggtacccccagggccgctcccaaaaaaagacgaaaaaaaaaagtgcgcgcttcgccagccggacaactcccttctcggttccatcagtatcaacagcacagaccatcactcgaaggcggacgttccccagctacaggcccatccggtgctcaggaagtccccggtcccgcagctgctctggcacctagtcctgctgcggcagccggaactgaaggagcctccccagaccttgcacctctgaggcctgctgcccctgggcagacccctctcagaaaggaagtgctgaaaagtaagatggggaagtcagaaaagatagctttaccccatggacagctagtgcatggaatccacctttatgagcagcctaaaattaacagacagaagagcaagtataatctgcctttgacgaagatcactagtgccaaacgtaacgaaaacaatttttggcaggacagtgttagcagcgaccgaattcagaagcaagagaaaaagcccttcaagaacactgaaaacattaaaaattctcatctcaaaaaatcagcattcctgactgaagttagtcaaaaggagaactacgccggtgctaagttctccgatccaccatccccgagcgttctgcctaaaccaccttctcactggatggggtcaaccgtggaaaattctaatcagaatcgcgagttaatggctgtccacttaaaaactctgctcaaggtacagacttag

SEQ ID NO: 236263 - DNA, 429 bp, Artificial Sequence
  Description of Artificial Sequence: Synthetic coding sequence
atgggtaaaagtgaaaagatcgcactgccacacggacagcttgtccatggcattcatctctatgagcagcctaagatcaacaggcagaaaagtaagtataatctccctctaactaagataaccagtgctaagagaaatgagaataacttttggcaggatagcgtgtcatccgacagaattcagaaacaggaaaaaaagccctttaaaaataccgagaacataaagaactctcatcttaaaaagagcgcttttttgaccgaggtcagtcaaaaggaaaactatgccggagccaagttctccgatcctccaagccccagcgtgcttccaaaacctccgtctcattggatgggctccactgtcgagaattcaaatcagaaccgcgaattgatggccgttcatttgaagacactcctcaaggtgcagacttag

SEQ ID NO: 236264 - DNA, 429 bp, Artificial Sequence
  Description of Artificial Sequence: Synthetic coding sequence
atgggcaagtccgagaagatcgccctcccgcacggccagctggttcacggaatccacctttacgaacagcccaagataaatagacagaagtctaaatataacctgccacttactaagattacttcggccaagcgaaatgagaacaacttctggcaggactctgtctcgtccgaccgaatacagaagcaggagaaaaagccctttaagaatacagagaatattaagaatagtcatcttaaaaagtcagcgttcctgacagaggtgagccagaaggaaaattatgctggcgcaaagtttagtgaccctccttcaccctctgtcctgccgaagccgccatctcactggatgggatctacggtggaaaacagcaatcagaaccgggagcttatggcagtgcacctaaagacactgttgaaggtgcagacatag

SEQ ID NO: 236265 - DNA, 420 bp, Artificial Sequence
  Description of Artificial Sequence: Synthetic coding sequence
atgggcggtggcgagcggtacaatatacccgctccccagagcagaaacgtctcaaagaaccaacagcaattgaaccggcagaagaccaaggagcagaactctcagatgaaaattgtgcacaagaaaaaggaacggggacacggttataattcgtctgcggcagcttggcaggctatgcagaacggcggtaaaaacaaaaacttccctaataatcagtcttggaattcaagcctcagtgggcctagactgctgtttaaaagtcaggcaaatcaaaactacgctggggctaagtttagcgaaccaccctctccttcagtgctcccaaagcctccgagtcattgggtgccggtctcctttaaccccagtgataaggagattatgaccttccagctgaaaactctcttaaaggtgcaggtctag

SEQ ID NO: 236266 - DNA, 420 bp, Artificial Sequence
  Description of Artificial Sequence: Synthetic coding sequence
atgggtggcggagaacgctacaacattccggcaccccaatctcggaatgtcagcaagaaccagcagcagttaaaccgccagaaaacgaaagagcagaactcacagatgaagatcgtacacaaaaagaaggaaagagggcatggctataattcgtcagcggcagcatggcaagccatgcagaatggaggcaaaaacaagaactttcccaacaatcagagctggaacagctccctgtcaggccctcgattactcttcaagtctcaagctaatcagaactatgctggcgcaaaattctcagaacctcccagccctagtgtgctccctaaaccaccaagtcattgggtacccgttagcttcaatccctccgataaagaaattatgacatttcagcttaagaccttgctcaaggttcaggtctag

SEQ ID NO: 236267 - DNA, 597 bp, Artificial Sequence
  Description of Artificial Sequence: Synthetic coding sequence
atgcttctgatcctcctcagtgtggctctgctcgccctgtcttctgcccagaatttgaatgaggacgtgagccaggaagagagcccctccctgatcgctggtaaccctcagggacctagcccacagggcggaaacaaaccacagggaccccctcctcctcctgggaagccacagggaccaccccctcaggggggaaataagcctcagggaccacccccaccaggcaaaccacagggccctccacctcagggagataaatcccgttcaccacggagtccccctgggaaacctcagggccctccacctcagggcggtaagccacaggggccacccccacagggtggtaacaaaccccagggccctcctcctcccggtaaacctcaggggcctccagcgcagggcggaagcaagagtcagtcggctcggagtcccccaggcaaaccacagggaccacctcagcaagagggtaacaacccccaaggcccaccccctcccgctggtgggaatccccagcaaccacaggcaccgccagctggacagccacaaggtccgccaagaccccctcagggtggacgcccatctcgaccgcctcaatag

SEQ ID NO: 236268 - DNA, 537 bp, Artificial Sequence
  Description of Artificial Sequence: Synthetic coding sequence
atgctgctgatcttattgtctgtagccctgttggcgctgagctccgctcagaaccttaatgaggacgtgtctcaagaagagtcaccctcacttattgcgggaaacccccagggcccatccccccagggaggcaataaacctcagggtcccccaccccctccaggcaagccgcagggccctcccccacagggtggaaataagcctcagggcccaccccctccgggaaaaccccagggccctccccctcagggcgacaagtctcgatcacccaggtccccccctggaaagccgcaggggccacctcctcagggcggtaagccacagggtcctcccgcacaaggagggagcaagagtcagagtgcaagaagccctccaggtaagccccagggaccgccacaacaggagggcaacaatcctcagggtccacctccaccagctggagggaatccacagcagcctcaagctccccctgccggacaaccacaggggcctcctcgccctccccagggcggaaggccaagccgccctcctcagtag

SEQ ID NO: 236269 - DNA, 597 bp, Artificial Sequence
  Description of Artificial Sequence: Synthetic coding sequence
atgctgttgatcctgctgagcgtcgcgttactggcactgtcttccgcacaaaatcttaacgaagacgtctcacaagaggaatctcccagtctcattgccggaaatccccaaggtccatctccccaggggggtaacaaaccgcagggcccacccccaccacctggcaaaccacagggaccgccaccacaaggaggcaataagccccagggtccgccacctcctggtaaacctcaggggccacctcctcagggagacaagtcaagatccccgcgttccccacctgggaagccacaaggaccgccacctcagggcggtaagccacaaggaccccctccacagggtggtaataagcctcagggacctccacctcccggaaagccccaagggccaccagcgcaaggaggctccaaaagccagtcagccaggtccccaccaggaaagccacagggcccacctcagcaggaaggtaacaatccgcaagggccacctcctcccgcaggtggtaacccgcagcagccacaggcccctcccgcaggtcagccacaaggcccacctcgcccacctcagggtggccgtcccagcaggccaccccagtag

SEQ ID NO: 236270 - DNA, 1251 bp, Artificial Sequence
  Description of Artificial Sequence: Synthetic coding sequence
atgttacttattcttctttctgtagcactgcttgcactgagcagtgctcaaaatctgaacgaagacgtgtcccaggaagagagtccttctctcatcgctgggaatccccagggggcacctccccagggtgggaacaagcctcaaggccctcccagtccccctgggaaaccccagggtccacctccccagggcggtaaccagccgcagggccctcctcccccacccggtaagccccaaggaccccctcctcagggcggaaacaagccccaggggcctccacctcccggaaaaccacagggcccaccccctcagggcgataagtctaggagcccccgaagcccaccagggaagccacaggggccaccccctcaaggtggcaaccagccacagggacccccacctcctcccggaaaaccccagggccctccccctcagggaggaaataaaccgcagggcccaccacctcctggcaagccacagggacctccaccacaaggcgataataaatcaagatcttcacgcagtcctccagggaaaccccagggacctccccctcaggggggtaatcagccccaggggccaccgcctccacctggaaagccacagggacctccgccacaaggaggcaacaagccccagggcccaccaccgcctgggaagccacagggcccacctccacagggcgataacaagagtcaatccgcgcgttctccccctggaaagccccagggccctccccctcaaggaggaaaccaaccacagggtcctccccctccgcctggcaagccccaggggcctccccctcagggcggaaataaaccccaaggcccaccacccccaggcaagcctcaaggcccaccccctcaggggggaagcaaatcccgctcttctcggtccccccctggcaagccgcaggggccaccgccacagggcggaaatcagcctcaaggaccaccacctcccccaggaaaaccccagggtcctcctccccaggggggaaataagccgcagggcccaccacccccagggaagccacaaggacctcctccccagggcggttctaagagtcgaagcgctaggtctcctcctgggaaacctcagggcccacctcagcaggaggggaataacccacagggcccaccacctccagccggtggaaacccacagcagccacaggccccaccggctgggcaaccacagggccctccgaggccaccccaagggggaaggccttcgagaccaccacaatag

SEQ ID NO: 236271 - DNA, 744 bp, Artificial Sequence
  Description of Artificial Sequence: Synthetic coding sequence
atgctgctgattctcctctccgtcgccctgctcgctctgtcctcagcggagagtagtagcgaggacgtaagccaagaggagtccctgttcctaatttctggaaagcctgagggcaggcggccacagggaggaaaccagccacagagacctcctccgccaccaggcaagccacagggacctcctccccagggcggaaatcaaagtcaggggcctcccccacctccaggcaaacccgagggtaggcccccacagggaggcaaccagagccaaggccctccaccacacccaggcaaacccgaacgtccaccgcctcaggggggtaaccaaagtcagggcaccccgcctcctccaggcaagcccgaacgccctccaccacaggggggaaaccagagccaccgcccaccgccaccaccaggaaaacccgagagaccccctccccaagggggaaatcagtcacagggacccccaccccacccaggaaaacctgagggcccaccacctcaggaggggaacaaatccagatcagcgagatctccccctggaaagccacagggccctccacagcaggagggaaacaaacctcagggccctcccccaccagggaagccacaaggaccccctccagctgggggaaacccccagcagcctcaggctcccccagctgggaaaccacagggtccccctccgccaccacagggaggcaggcctcctagaccggctcagggtcagcagccaccacagtag

SEQ ID NO: 236272 - DNA, 744 bp, Artificial Sequence
  Description of Artificial Sequence: Synthetic coding sequence
atgctgttgattctcctgagcgtggccctgctggccttgagctccgccgagtccagcagcgaagacgtgtctcaggaggagtccttatttttgatctcaggaaagccagaaggtcgcagaccccaaggcggaaaccagcctcagagaccccctcctcctccgggaaagcctcaaggcccacccccacagggcggaaaccagtcgcagggccctccaccaccacctggcaaacccgagggcaggccaccacaggggggaaaccaaagccagggtccacctccacaccctggtaagccagaacgcccaccaccccaggggggaaaccaatcccaggggacacccccaccccctggaaaacctgagcgccctccccctcaaggcggtaatcaatctcacaggccacctcctcccccagggaaacccgaacgccctcccccacagggaggcaatcaaagccagggtccccctccacatccgggaaaaccagaaggccctccccctcaggagggaaataagagtcgctctgctaggtcacctcccggtaagccacaaggccctcctcagcaggagggcaacaaaccccagggtcctccacctccgggaaagcctcaggggccacctccagccggaggcaatcctcagcagccacaggctcccccagcaggaaaacctcaaggcccaccaccacccccacagggtgggagacctcctcgacccgcacaaggccagcagccacctcagtag

SEQ ID NO: 236273 - DNA, 537 bp, Artificial Sequence
  Description of Artificial Sequence: Synthetic coding sequence
atgctcctgatcctactgtccgtagcacttctggccctgagctcagcagaatcctcgtccgaggatgtgtcccaggaagaatcactgttcctgatcagcgggaagcctgagggaaggcggcctcagggtggcaaccaaccccagaggcctccacctcctcctgggaagcctcagggaccgccaccccagggaggaaatcagagccaggggccaccccctcctcctggtaagcctgaggggcgacctccccagggaggcaaccagagccagggacccccaccacaccccggaaaacccgagagacctccacctcagggaggtaaccagtctcagggtaagccccaaggcccaccgcagcaagagggcaataagccccaagggccaccgccaccaggcaaaccgcagggtccaccacctgcgggagggaatccacagcagccacaagcccctccggcagggaagccccagggacctcctcccccacctcaagggggaaggccacccaggcctgctcaggggcagcagccaccgcagtag

SEQ ID NO: 236274 - DNA, 501 bp, Artificial Sequence
  Description of Artificial Sequence: Synthetic coding sequence
atgttactgattctgctctcggtggccctgctggcgttttccagtgcccaggatctaaacgaggatgtcagccaagaggatgttccgctagtgatttcagacggcggtgacagtgagcagttcctagatgaagagcggcagggccctccgcttggtgggcagcagagtcagccctccgcgggtgacgggaaccaggacgacggcccacagcaggggccaccccaacaggggggacagcagcaacaggggccacctcccccacaaggcaagcctcagggacccccacaacaggggggacatccaccccctccccaaggtagaccgcagggaccgccacagcagggtggtcacccacgaccccctagagggcgtccccaggggccaccgcagcaaggcggtcatcaacagggcccaccaccgcctccacctggaaagccgcagggccctcctcctcagggaggtcgtcctcaggggccacctcaagggcagagccctcaatag

SEQ ID NO: 236275 - DNA, 291 bp, Artificial Sequence
  Description of Artificial Sequence: Synthetic coding sequence
atgctgttgatcctactatccgttgcactactggccttctcctctgctcaggacttggatgaggacgtatcccaggaggacgtccccctggtgatatcggatggcggagacagcgagcagttcatagacgaggaggggcacaaggaccacccaaatagagaggccattagtaaagtgcttcctcacctcctcctggagtcccctcgagaccatttgccgaaaggggctgcccacaaagaccttcaccgaggctccctgctgtctaatctcggcttcaatgaccggaagtag

SEQ ID NO: 236276 - DNA, 501 bp, Artificial Sequence
  Description of Artificial Sequence: Synthetic coding sequence
atgctccttattctattatcagtcgcccttctcgcgttctcaagcgcccaggaccttgacgaagatgtatcacaggaggatgtccccctggtcattagcgacggcggtgactccgaacagtttattgacgaagaacgacagggaccgcctcttggcggacagcagagccagcccagcgcgggtgacgggaaccaaaacgacggccctcaacaggggcctcctcaacagggcggacagcagcagcaaggtcctccccctcctcagggcaaacctcaggggcctccacagcagggcggtcaccccccacctcctcagggcagaccccaagggccacctcagcagggcggacatcctaggccacctcgcggtcgacctcagggtcctccacaacaggggggacaccagcaggggccaccacctccacctccgggaaagccacagggacctcctccccagggcggtagaccacaggggcctccccaggggcagagccctcagtag

SEQ ID NO: 236277 - DNA, 501 bp, Artificial Sequence
  Description of Artificial Sequence: Synthetic coding sequence
atgctgctgatcctcctgtctgttgcactgttggcattttcttccgcccaggacctggatgaggatgtttctcaagaagatgtgccccttgtgatttctgacgggggtgacagcgagcaattcattgatgaggaacggcagggacctccgctggggggacagcagtctcagccttccgcaggcgacggtaaccagaacgacggtccacagcagggaccacctcagcagggaggacagcagcagcaggggcctcctcctccacaaggtaagccgcagggaccaccccaacagggcggacacccacctccccctcaaggacgcccacagggaccccctcagcagggcggacaccccagaccacctagaggaaggccccagggaccccctcaacaaggaggtcatcagcagggccctccaccacctccaccaggaaagccgcaggggccacctccgcaggggggacgccctcagggaccccctcaagggcagagtccacagtag

SEQ ID NO: 236278 - DNA, 900 bp, Artificial Sequence
  Description of Artificial Sequence: Synthetic coding sequence
atggctgccagtagctccgagatctcagaaatgaaaggagtcgaggagagtccgaaagtgcctggggaaggccctggacatagtgaagctgaaacagggcctccgcaggtgctggcaggcgtcccagaccagccggaggctccgcagcctgggccaaacacgacggccgcacctgtcgattctggcccaaaggcaggcctggccccagagacaaccgagacgcccgctggcgcttccgagaccgcacaggccaccgacctatctctctcacctggcggagagtccaaagcgaactgtagcccagaagacccctgccaggagacagtaagcaaacctgaagtctcgaaggaggccactgccgatcaaggtagccggctggaaagtgctgcccctccagagccagcaccagagcctgctccacagcccgaccccaggccagactctcagcccaccccgaagccagcgctgcagcccgaactgcctacccaggaagaccccaccccagagatacttagcgaaagtgtgggagaaaagcaggaaaatggagccgttgttccactgcaggctggggatggggaggaaggccctgcccctgagccccatagtcctccatcaaaaaagagtccacccgcaaacggcgcaccacctcgggtactacagcagttggttgaggaggaccggatgcgtcgggctcatagcggtcaccctggttcgcctcgcggatcattgagcagacatccctccagccagctagccggtcctggggttgagggcggagagggcacacagaagccacgcgactacattattcttgctatcctgtcttgcttttgtcctatgtggcctgtgaacattgttgcgtttgcttacgcggtgatggtttcacccatggggccttag

SEQ ID NO: 236279 - DNA, 1023 bp, Artificial Sequence
  Description of Artificial Sequence: Synthetic coding sequence
atggccgctagttcaagcgagatcagtgagatgaaaggggttgaggaatcaccaaaggtgccgggagaaggaccagggcatagcgaggccgaaactgggcctcctcaggttctcgctggggtcccggaccaaccagaagcacctcaaccaggccctaacactacggccgctcctgtcgattcaggccctaaagcaggcctggctcccgagactacagagacacctgccggagcatctgaaaccgcacaggcaaccgatctctctctgagtccaggtggcgaatccaaggcaaactgctcccccgaggacccttgccaggaaaccgtttctaagccagaagtatccaaggaggctactgccgaccagggatcacggctcgagtctgccgctccccctgaaccggcacctgaacctgctccccagcctgatccccgacctgattcccaaccaaccccaaaaccagccctccagcctgagcttcccacgcaggaggaccccacccctgagatactgtctgagagcgtgggtgagaagcaagaaaacggcgcagtggtgccgctgcaagccggagacggtgaggagggtccagcacctgaacctcactccccaccatctaaaaaaagccccccagcaaatggtgcccctccgcgtgtcctgcagcagctagtggaggaagaccggatgcgacgagcacactctggccaccccggaagtccacgaggaagtctgtcgcggcacccaagctcccagctggccggacccggagtggagggcggtgagggtacacagaagcccagagactatatcatcttggccatactctcttgtttctgtcccatgtggccagtcaacatcgtggcttttgcttacgccgtaatgagcaggaattcgcttcagcagggcgatgtcgacggggcacagcgactggggcgagtggcaaagctgctgtccattgttgccctcgtgggcggagtcttgatcattattgctagctgtgttattaacctaggagtgtacaaatag

SEQ ID NO: 236280 - DNA, 1191 bp, Artificial Sequence
  Description of Artificial Sequence: Synthetic coding sequence
atgcctcagctgcagttcaaggatgcgttctggtgccgcgattttactgcccatactggttatgaagtcctgctgcaacgcctgctagacggcagaaaaatgtgtaaagatatggaggagctcctgcggcagcgagcgcaggctgaagaacgctatgggaaggaacttgtccagatcgcacgtaaggccggtgggcagacagagatcaactccctgcgagccagctttgattcgctgaagcagcagatggagaacgtaggtagcagccacatccagctggctctgacattacgggaggaactccgtagtttagaagagtttcgtgaaaggcaaaaggaacagcggaaaaagtatgaagctgttatggatagagtacagaaatccaaactgtccttgtataaaaaggcgatggagtcaaagaagacgtatgaacagaagtgccgggatgcagacgacgctgagcaggcatttgaacgaatttccgccaatgggcatcagaagcaggtggagaagagccagaacaaggctcggcagtgcaaggattcagctacagaggctgagcgcgtgtatcgccagtccatagcccagctagagaaagtccgagctgaatgggagcaagaacataggacgacctgtgaggccttccagctccaggagtttgaccgactcactatcctacgcaatgcgctttgggtgcattctaaccaactgtctatgcagtgcgtcaaggatgacgagctgtacgaggaagtgcggttaacgctggaaggatgcagtatcgatgctgacatcgactccttcatccaggctaaatcaaccggtaccgagccacctggcgaggtgagactggcagactctgcagcgtcacggttttccgggctccttcacggcagcccaaaaacaacatctcttgcagccagcgctgctagcaccgaaactctaactcccactcctgagcgcaatgagggtgtctataccgccatcgctgtgcaggagatacaggggaaccccgctagtcctgcgcaagaatacagagccctttacgactatacggcccagaaccccgatgagttagacctctcagccggagatatcctggaggtcatcctggaaggagaggacggctggtggacagttgagcgtaacggccagcgtggcttcgtcccaggttcttacctggaaaaattatag

SEQ ID NO: 236281 - DNA, 1251 bp, Artificial Sequence
  Description of Artificial Sequence: Synthetic coding sequence
atgatgcctcaattacagtttaaggatgctttttggtgtcgcgacttcacagcccacactggttatgaggttctgctacagagacttctcgacggtaggaagatgtgcaaagatatggaagaactgctgagacagagggcacaggcagaagaacgctacggtaaggagttggttcagatagccagaaaggcaggagggcagaccgagattaattcacttcgcgcatccttcgatagcctgaagcaacagatggaaaacgtgggatcctctcatatccagctggcactgacccttagggaggagctgaggagcctggaagagttcagagaaagacagaaggagcagaggaaaaaatacgaggcagtcatggatagggtccagaaatccaagttgagcctgtataaaaaagctatggagagtaaaaagacatacgagcagaagtgtcgagacgccgacgacgctgagcaagctttcgagcgtatttctgccaacggacaccagaagcaagtcgaaaaatcacagaataaggctcgtcagtgtaaagatagtgccactgaggctgaaagggtttaccgccagagcatagcacagctggagaaagtgcgagccgagtgggaacaggagcatcggactacctgcgaggcctttcagctccaggagttcgaccgcctaacaatcttgaggaatgctttgtgggttcacagcaatcagttgtccatgcagtgcgtgaaggacgacgagttgtacgaagaagtgcgcctgaccttggaagggtgttccattgacgccgatatcgactcattcatccaggcgaaatccaccggcacagagcctcctgcacccgtgccataccagaactattatgaccgagaagtgacgcctctcacgtcttctcctggcatccagcccagttgtggaatgataaagcgcttctcgggtcttcttcacggcagcccaaaaactacgagcctcgctgcctctgcggcatcaacagagacactgacccctactccggagcgcaacgagggagtgtacactgctattgctgtgcaggagatccagggcaatcctgcttcaccggctcaagagtatagagcactgtatgactacactgcacaaaatccagatgagctggatctgtccgcgggtgatatcctcgaggtgatcctggagggtgaggatgggtggtggaccgtggagcgtaacggccaacgcggttttgtgcccggatcgtatttagagaaattgtag

SEQ ID NO: 236282 - DNA, 1605 bp, Artificial Sequence
  Description of Artificial Sequence: Synthetic coding sequence
atgatctggtatatccttataatcggcatactcctgccgcaatcacttgcccaccctggcttcttcacatctatcggccagatgaccgacctgatacatactgaaaaagacctagtgacatctctgaaagattacattaaagccgaagaagataaattggagcagatcaagaagtgggctgagaaactcgatcgtcttacatcgaccgcaacgaaggatcccgagggttttgtgggacatcctgtcaacgcattcaagctgatgaaaaggctcaatactgaatggtcggagctagaaaacttggtcctgaaggacatgagtgatggtttcatatccaatctgactattcagcggcagtacttccctaatgacgaggaccaggtaggagccgcaaaggccctgctgaggcttcaggacacgtacaaccttgacactgataccatcagtaaaggcaatctgcctggggtgaagcacaaatcctttctaaccgctgaagattgttttgagcttggcaaagtggcatacaccgaggcagactattaccacaccgagctgtggatggagcaggccctcagacagctcgatgaaggggagatctccacaatcgataaggtttcggtcctagattatctgagctacgccgtttatcagcaaggcgacctcgataaagcactgctgctcacgaagaagctccttgagctcgaccccgagcaccagcgcgcaaatggcaaccttaaatacttcgagtacattatggctaaggaaaaggatgtgaataagagtgcatcagacgatcagagcgatcaaaagaccacacccaaaaagaagggggttgcagtggactacttgccagagaggcagaaatacgaaatgctgtgtaggggtgagggcataaaaatgacaccaagacgccagaaaaagctgttctgcaggtaccatgacggcaatcgaaaccctaaatttatattagctcccgcaaagcaggaggacgaatgggacaaaccgaggatcatccggtttcatgacatcatctctgatgcagagattgaaatagtcaaggacttagctaagcccagactgtctagggctacagtccacgatcccgagactggcaagttgactaccgcgcagtaccgagtgagtaagtctgcctggttgtctggctacgagaatccagtggtttctcgcatcaatatgcgcatccaggacctcaccgggttggacgtgagtaccgccgaggaactgcaggtggctaattatggcgtgggcggacagtatgagccacactttgattttgctagaaaggatgagcccgatgccttcaaggaactgggcacaggcaaccgaatcgccacctggttgttctatatgtcggatgtgagtgcaggcggtgccacagttttcccagaggtgggcgcatctgtttggccgaagaaaggtaccgctgtgttctggtacaatcttttcgcttcgggagaaggagactatagcacacggcacgctgcatgcccggtgctggtggggaataaatgggtgtctaacaagtggctccacgaaaggggccaggaattcagacgcccttgcaccctgtcggaactagaatag

SEQ ID NO: 236283 - DNA, 1605 bp, Artificial Sequence
  Description of Artificial Sequence: Synthetic coding sequence
atgatctggtatatactgattataggcattttgctgccacagtcactcgctcacccaggcttcttcacctccatcggccagatgacagatcttattcataccgagaaggatcttgtaacatccttaaaagattacattaaagcggaagaggacaaactggagcaaattaaaaaatgggctgagaaattagatcggttaacttctacagcaacgaaagacccagagggcttcgtgggacaccccgtcaatgctttcaagttaatgaagcgactgaacactgagtggtctgagcttgagaatctggtcttaaaggatatgagtgatggcttcatctccaacctcaccatacaacgacagtattttcctaacgacgaagaccaggtgggggctgccaaagccctgctaagacttcaggatacctataaccttgacacggacactatctctaaaggcaacttaccaggtgtgaaacataaatccttcctcactgccgaggactgctttgaattaggaaaagtggcctataccgaggcggattattatcacaccgagttgtggatggagcaggctctgagacaactggacgaaggcgagatctctacaattgacaaggtgtctgtgttggattatttgtcatatgccgtgtatcaacagggcgacctagacaaggctctgctgcttaccaaaaagcttctggaacttgaccctgagcatcagagggcgaatggaaatctcaagtatttcgagtacatcatggccaaagagaaggatgtgaataagtctgcatctgatgatcagtctgatcagaagacgactcccaagaaaaagggcgtcgccgtcgactacctcccagaacgccagaaatatgaaatgctttgcagaggagagggaattaaaatgacgcctcggaggcaaaaaaagctcttttgccgataccacgatggcaacagaaatcccaagttcatcctggcccctgccaagcaggaggatgaatgggataagccaagaatcatacgctttcacgatattatcagcgacgccgagatcgaaatcgtgaaggacttggccaagccccgtctccgcagggccacaattagtaaccctatcaccggcgacctagagactgtgcactatagaatttccaaatccgcctggttatcaggctacgagaatccagttgtttcccgaatcaatatgcgaattcaggatctaactggtctggacgtgagcactgccgaagaattgcaagttgcaaattacggggtggggggacagtacgaaccacatttcgactttgcccgaaaagacgaacctgacgccttcaaagagctgggcaccggaaaccgaatagctacttggctgttctatatgtcagatgtgtccgcagggggagcaacagtctttcctgaagtcggcgctagtgtgtggccaaagaagggcacagctgttttttggtacaacctgtttgcatctggagagggtgattattctacacggcacgccgcttgtccagtgctcgtgggcaacaagtgggtaagtaacaaatggctccacgaaagaggccaggagtttcgcaggccttgcacgctgtcagagcttgagtag

SEQ ID NO: 236284 - DNA, 1605 bp, Artificial Sequence
  Description of Artificial Sequence: Synthetic coding sequence
atgatttggtacatcctgattatcggcattctactcccacagagtcttgctcatcccggattttttacttccattgggcagatgaccgacctgatccacacagaaaaggatttagtaacctcgctgaaggactacataaaggctgaggaagataagctggagcagataaaaaaatgggccgagaagctagatcgcctgacaagcacggcaacgaaggacccggaggggttcgtgggccatcctgttaacgcttttaagctcatgaagaggttaaacactgaatggtccgagctggagaatcttgtgctgaaggacatgtctgatggcttcattagcaacctcaccatacagagacagtatttccccaacgacgaggatcaagtgggcgcagctaaggccctgctgagactgcaggacacatacaacctggacacagatactatttccaagggtaatctgcccggagtgaaacacaagtcatttttgaccgcagaagattgtttcgaactggggaaagtcgcatacactgaggctgattattaccacacagaactgtggatggagcaggcgctgcgacagctggacgagggagaaatcagtacgatcgataaggtgagcgtgctcgactacctgtcttatgcagtttatcaacagggtgatctggataaagctctattgcttaccaagaagttactcgagctggatcccgagcatcagcgagccaatggaaacctgaaatatttcgagtatataatggctaaggagaaggatgttaataagagcgcgagtgacgatcagtccgatcagaagactacaccaaagaagaaaggggtggctgtggactacctcccggaacggcaaaagtacgaaatgctctgtcgcggagaaggtatcaaaatgacaccgcgacgccagaaaaagttattctgccgctaccacgacggaaataggaaccccaagtttattctcgcacctgcgaaacaggaggacgagtgggataaacccagaattatcaggttccacgatattatcagtgatgcggagattgagatcgtgaaagatctcgccaagcccagactgagccgggctacagtccacgatcctgagaccgggaaactcaccactgcacaatacagagtgtcaaaaagcgcatggctgtcagggtacgagaatccagtggtgagccgcatcaatatgcgtatccaggacttaacaggtctggatgtgagtaccgcggaggagctccaggtagcaaactatggcgtgggcggacagtacgagccccatttcgacttcgcacgcaaggatgagccagacgctttcaaggaactgggaactggcaatcgtatcgccacatggctcttttatatgtctgacgtgagcgctggtggagccaccgtttttccggaagttggggcaagtgtgtggccgaagaaaggtaccgctgtcttctggtacaacctgtttgcctcaggtgaaggagattattcaaccagacacgctgcatgtccagtgcttgtgggaaataaatgggtttctaacaaatggctgcacgaaaggggccaggaatttcgtcggccttgcaccttatctgagctggagtag

SEQ ID NO: 236285 - DNA, 1605 bp, Artificial Sequence
  Description of Artificial Sequence: Synthetic coding sequence
atgatttggtatattttgattattggcattctactgccccagtccctggcgcacccaggatttttcaccagcatcggacagatgactgatctcattcatacagaaaaggacctggtcacctccctgaaggactatattaaagcagaggaggacaagttagagcagatcaagaagtgggccgagaagttggaccgtctgactagtacagctacaaaagaccccgaaggctttgtgggacaccctgtgaacgctttcaaactcatgaaaaggctgaacaccgaatggagtgagctggagaacctggtcttaaaagatatgtctgacggatttataagtaacctcacaatccagcgccaatacttccctaacgacgaagatcaggtgggtgccgctaaagcgctattgcggcttcaggacacctacaatctcgacaccgacaccatctcaaaagggaacctgccaggcgtgaagcataagtcctttctcaccgccgaggactgcttcgagctgggtaaggtggcctatacagaagccgattactaccataccgaactctggatggagcaagctctgaggcagctggacgagggagagatttctactatcgataaggtgagcgtgctggactatctgagctatgcggtctaccagcagggagatctggacaaagccctcctgctgaccaagaaacttctcgaactcgacccagaacaccagcgggctaacggcaatctgaaatatttcgaatacataatggcgaaggaaaaggacgttaataagtctgcaagcgacgaccagtccgaccaaaagacgacccccaagaagaagggggtggccgttgactatctgcccgagcgacagaagtatgagatgttatgcaggggcgaggggatcaaaatgacccccagaagacaaaagaaattgttctgtaggtaccatgatggcaataggaaccccaaatttattctcgctcccgctaagcaagaagacgagtgggacaaaccacggattattcgtttccatgacattattagtgatgcggagattgagatcgtgaaagacctcgccaagccaagacttaggcgagccacgatttccaatccgattactggggatttggaaaccgtgcattataggatttctaagagtgcttggctgagtggttacgagaatccagtggtgtcgcgcattaacatgcgtatccaggacctgaccggccttgatgttagcacagcagaagaacttcaggtggccaactacggggttggaggccagtacgagcctcattttgactttgcgagaaaagacgaacccgatgcatttaaggagttggggactggaaataggattgcaacttggctgttctatatgagcgatgtgtccgccggtggagccacagtattcccagaagtgggtgcaagtgtatggcctaagaaggggactgcagtgttttggtacaacctcttcgccagtggcgagggcgattacagcaccaggcatgccgcatgccccgtcctggtcggcaacaagtgggtgtcaaacaagtggctgcacgagagggggcaggagttccgaaggccctgcactctctctgaactggaatag

SEQ ID NO: 236286 - DNA, 1605 bp, Artificial Sequence
  Description of Artificial Sequence: Synthetic coding sequence
atgatttggtacatactgattatcggcattcttttaccacaaagcttggctcatcccggattctttactagcattggccaaatgaccgacctcatacatacagagaaagacctcgtgactagcttgaaggactacatcaaggccgaagaggataagctggaacaaattaaaaagtgggccgaaaagctggacaggctcacaagcacagccacaaaggaccctgaggggtttgtgggacatccagtaaacgcctttaaactgatgaagaggctgaacaccgagtggtcagagctcgaaaatttagttcttaaggacatgagtgatggcttcattagcaatctcacaattcagcgccagtactttccgaatgatgaggaccaggtgggggctgctaaggcactgctccgcctgcaggatacctataacctcgataccgataccattagtaaaggcaacctgcccggtgttaagcataagtctttcctcactgccgaggattgtttcgagctcggaaaggtcgcctatacggaggcggattattaccatactgagttgtggatggagcaagccctccggcagctcgacgagggggagatttccactatcgacaaggtgtcagtcctggactacttgagttatgctgtctaccagcaaggcgacctggacaaggctctgctgttgactaagaagctccttgaactcgatccggagcatcagagagctaacggaaacctgaaatattttgaatacattatggctaaggagaaggacgtcaataaatccgctagtgatgaccagtctgaccagaagaccactcccaaaaaaaaaggggtggctgtggattatctgcctgagagacagaaatacgagatgctctgccgaggggaaggaatcaagatgactccaagaagacagaagaaactgttttgtcgataccatgatggtaacaggaaccccaagtttatcctggccccagctaaacaggaggatgagtgggataaacccaggatcattcggttccacgacatcatctcagacgcagagatcgagatcgtaaaagatcttgctaaacctcgcttacgacgtgccactatctccaatcccataacaggggatttggaaaccgttcattatcggatcagcaagtcagcttggttgagtggatatgagaatcccgtagtgagtaggattaatatgcgcatccaggacttaacagggctcgatgtgtctacagccgaggaactgcaggtggccaactatggagtgggcggacagtacgaaccccatttcgacttcgcaagaaaggatgagcccgacgccttcaaggagctgggaaccggaaaccgcatcgccacatggctcttttatatgagcgacgtgagcgccggaggagccacagttttccccgaagtgggggcatctgtgtggccaaaaaagggtactgctgtattctggtacaaccttttcgcttcaggcgagggagattactctacacggcacgcagcgtgtccagtgctggtagggaataagtgggtgagcaacaagtggttgcacgagcgagggcaagaatttcggagaccttgtacgctttctgagctggaatag

SEQ ID NO: 236287 - DNA, 1551 bp, Artificial Sequence
  Description of Artificial Sequence: Synthetic coding sequence
atgatttggtacattctgattattggcattttactgcctcagagtctggcacatcctggtttctttaccagtattggtcaaatgacggacctgatccatacagaaaaggacctcgtcacttccttaaaggattatattaaagccgaagaagacaaactggaacagatcaagaaatgggcagaaaagctcgacagactgacaagcacagcaactaaagatccagagggcttcgtgggtcacccggtcaacgcctttaaattgatgaagaggcttaataccgagtggagcgagttggagaatctcgtgctgaaggacatgagcgatgggtttatctccaatctgaccatccaaaggcagtacttccccaacgatgaggaccaggtcggcgcagctaaggccctcctgagactacaggacacttacaacctggatacagacacaatttctaagggcaacctcccaggcgtaaagcataagagcttcctgacggccgaggactgtttcgagctggggaaggtcgcatataccgaggccgactattatcacacggagctttggatggagcaagctctcagacaactagatgagggggagatctcaaccatagataaagttagtgtgctagattacctaagctacgcggtttaccagcagggagatttggataaagccctgctccttacaaagaagctgttggagttggatcctgaacaccagcgggcaaacggtaacctgaaatattttgaatacatcatggccaaagagaaggacgtcaataaaagtgcaagcgacgaccagagtgatcagaaaacgactcccaagaaaaaaggcgtggctgtcgactatttacctgagcggcaaaagtatgagatgctgtgcaggggtgagggcattaagatgactcccagacgccagaagaagctgttttgcagataccatgacggaaaccgcaaccccaagttcatattagcccctgctaagcaggaggacgagtgggacaagccgagaattatccgtttccacgatatcatcagcgatgcagagattgaaatcgtgaaggaccttgccaagccacggctctcacgcgctaccgtgcatgatccagagaccggaaaattaactaccgctcagtatcgcgtgtccaaaagcgcatggttatctggctacgagaatcccgtggttagtcgaattaatatgagaatccaagacctgactgggctggatgtgagtaccgccgaggagctgcagaaggacgagccagacgccttcaaggaactgggaaccggtaatcgcatcgcaacctggctgttctacatgagcgatgtgagcgcaggcggtgccactgtctttccagaggtaggcgctagcgtgtggcctaagaagggcacagctgtgttttggtataacctgttcgcgagcggtgagggggactatagtactcgacatgctgcctgccccgttttggttggtaataaatgggtaagcaacaaatggctgcatgagcgtggacaggagttccgtcgaccctgtactctaagcgagctcgagtag

SEQ ID NO: 236288 - DNA, 1608 bp, Artificial Sequence
  Description of Artificial Sequence: Synthetic coding sequence
atgaaactgtgggtcagtgccttactgatggcttggttcggagtgctatcatgcgtccaagcagaatttttcactagcatcgggcatatgaccgatcttatctatgcagagaaggaactggttcaaagtctgaaggagtacatcctggtcgaggaggccaagctgtctaagattaaatcttgggccaataaaatggaggctctgacatctaagtcagctgcagacgccgagggttacctcgcccacccagtgaacgcctacaagctggtcaaacgtttaaataccgattggccagccctggaagatctagttctgcaggactctgccgcaggtttcatcgccaacctgtcagttcagcgccagttttttcctacagacgaagacgaaatcggggcagcaaaggcacttatgcggctccaggacacctaccgactcgaccctggaacaatttcgcggggagaattgccgggaaccaagtaccaggccatgctgtccgttgatgactgctttggtatggggagatcagcgtacaacgagggtgattactatcacaccgtgctgtggatggaacaggtactcaagcagctagacgccggagaggaagcgaccaccacgaaatcccaggtcttagactatctgagctacgcggtctttcaactcggagatttgcatcgggcactggagctgacccggaggctacttagcctggaccccagccatgagcgtgccggagggaatctccggtatttcgagcagctgctagaggaggaacgggaaaagacactcactaaccagaccgaagctgagctggctacccctgaggggatctatgagaggccagtcgactatctgccggagcgcgatgtgtatgaatcgctgtgcagaggggagggagtgaaactgactcccagaaggcagaagaggctgttctgcagatatcaccacggaaaccgcgctcctcagttgctgatcgcgcctttcaaggaggaagacgagtgggatagtccacacatcgtgagatactacgacgtcatgtcagatgaagaaatagagagaatcaaagagatcgcgaaaccaaagctggccagggctacggtccgggaccccaagacgggcgtgctgacagtggcctcttatcgtgttagcaagtcaagctggcttgaagaagacgatgatcccgtcgttgctcgggtaaatcgtcgcatgcagcatatcaccggcttgacagtgaaaaccgccgagttgctgcaagttgcaaactatggtgtggggggtcaatacgagccccactttgacttctccaggaatgacgaacgtgatactttcaaacacctggggacaggaaacagggtggctacattcctgaactacatgagtgatgtggaggccggaggcgcaacggtgttcccagatctaggcgcagctatttggcctaagaaagggaccgctgtgttctggtataacctcttgagaagtggagagggggattatcgaacgagacacgccgcttgccccgttctcgttggttgtaaatgggtgagtaataaatggttccatgaaagggggcaggagtttcttcgcccttgtggctccacagaggttgattag

SEQ ID NO: 236289 - DNA, 1602 bp, Artificial Sequence
  Description of Artificial Sequence: Synthetic coding sequence
atgaaattgtgggtgagcgcactcttgatggcttggtttggagtgctaagttgtgtccaagcggagttttttacatccattggacacatgaccgatctgatttacgcagaaaaggaattagtgcaaagcctaaaggagtatatccttgtagaggaagctaagttaagcaaaatcaaatcttgggccaataagatggaagctttgactagtaagagcgcagctgacgccgaggggtacttggcgcatcccgtcaatgcctataagctcgtgaaaagactgaatactgactggccggctttagaggatctggttcttcaggactcagccgctggcttcattgccaacctctctgtgcagcgtcagtttttcccaacggacgaagacgagatcggcgctgccaaagccttgatgagactccaggatacctaccggctggatccaggaacaattagcagaggggagcttccaggcacgaaatatcaagccatgctgtccgttgatgattgtttcggaatgggcaggagcgcctacaacgagggtgattattaccataccgtgttgtggatggaacaagttctaaaacaacttgatgctggggaggaggccaccacgacaaaaagccaagtccttgactatctaagctatgcggtgttccagttaggcgatctgcatagggctctggagctcaccagaagactgttgtcgttagatcccagtcatgaaagggcaggagggaaccttcgctacttcgaacagctgttggaagaagagagggagaagactttaaccaatcagaccgaagctgaactggctacacccgagggcatatacgaaaggcccgtggactacttgcccgagcgcgacgtgtatgagagcctgtgcagaggggaaggagtaaagcttacaccccgtcggcagaagaggcttttttgccgctaccatcacggaaaccgggctccacagcttttgatcgcaccgttcaaagaagaggatgaatgggactcgcctcatatcgttagatattatgatgtcatgtccgacgaagaaatcgaaaggatcaaggagatcgctaagcccaagctcgcacgagccaccgtcagagaccctaaaactggcgtccttacagtggcttcttacagagtgagcaagagtagctggctggaggaggatgatgatcctgtggttgcgcgagtgaaccgccgtatgcaacatattaccggacttaccgtaaagaccgcagaacttttgcaggtggcaaattatggggttggaggacagtacgagcctcactttgacttttcacgacgccctttcgatagcggcttgaagacagaagggaacagactcgccacgtttctgaactatatgtccgacgtggaagccggtggtgccacagtcttccctgatctaggagccgctatctggccaaaaaagggtactgctgtgttctggtataatcttctcaggagtggcgagggggattatcgcacccggcacgccgcttgtcctgtgcttgtaggatgcaaatgggtatcaaacaagtggtttcatgaacggggacaagagtttctgaggccttgcgggtccacagaggttgactag

SEQ ID NO: 236290 - DNA, 1602 bp, Artificial Sequence
  Description of Artificial Sequence: Synthetic coding sequence
atgaaactgtgggtgagcgccctcctgatggcctggttcggggtattgtcctgcgtccaggcggaattttttacctccataggacatatgaccgatttgatatatgccgaaaaggaactcgttcagagcctgaaggagtacatcctggtggaggaggcgaaactgtccaagatcaagagttgggcgaacaaaatggaagccttgacatccaaaagtgccgcagacgctgaaggctacctcgctcaccccgtcaatgcttacaagcttgtcaagcggttgaataccgactggccagcgcttgaagacctggtcctgcaggactccgcagcgggatttattgccaacctgagcgtgcagcgccagttcttccccaccgatgaggatgagattggcgcagctaaagcgctgatgcgactacaggacacgtatcgactcgacccaggcacaatcagccggggtgagctccccggaacgaaatatcaagccatgttgagcgtcgacgattgttttgggatgggtcgatctgcctacaacgagggagactactaccacaccgtgctttggatggagcaggtcctgaagcagttagatgcgggtgaggaggccacaaccactaagagccaggtccttgactatctaagctacgccgtttttcaactgggagatctccatagagccctggagctgacacggagactgttaagtctggacccctcacacgagcgggcaggaggtaacctgcgttatttcgagcagcttttggaagaggaacgggagaagactctgaccaatcaaacagaggcagagctggccactccagaggggatctacgagcggccagtcgattacctcccagagcgcgacgtctacgagtctctgtgccggggagagggcgtgaaactgaccccccgaaggcagaaaaggctattttgtagatatcatcacggtaatagagcgccacagttacttattgcgccttttaaagaagaagacgaatgggatagtccccacatagtccggtactatgacgtcatgtctgacgaggaaattgaaaggataaaggaaatcgccaagccaaagctggcccgtgccaccgtgagggatcccaagactggtgtgctgaccgtcgcgtcatacagagtgtctaagtccagttggttagaagaagatgacgatcccgtggtggcgagggttaatcgacggatgcagcacatcacaggactgaccgtgaagacagcagagctgctgcaggtggcaaactatggtgtgggtggccagtacgagccccactttgatttcagccgcagacctttcgacagcgggttgaagacagaaggtaatcggctggccacattcctcaattatatgagcgacgtggaggccggaggtgctacggttttcccggacctcggagcggctatctggcctaagaaggggactgccgtcttttggtataacctgttgcggtccggagaaggtgactacaggacccggcatgcagcatgccccgtactggtggggtgcaagtgggtgtccaataaatggtttcatgaacgtggccaggagttcctgagaccatgcggaagcacagaggttgactag

SEQ ID NO: 236291 - DNA, 1602 bp, Artificial Sequence
  Description of Artificial Sequence: Synthetic coding sequence
atgaagctgtgggtgtcagctctgcttatggcatggttcggagtgttatcatgcgtccaagccgagttttttaccagcatcggacacatgacagatctcatttacgcagaaaaggaattagtccagtccctgaaagaatacattttggtggaagaggccaaactttcaaagataaagtcctgggcaaacaagatggaggccctaacatcgaagtccgcggcagacgctgaagggtatctggcccatcctgtgaacgcttacaaacttgtgaagcgactgaatactgactggccggcactggaagacctcgtgcttcaggactcggccgcagggtttatcgccaaccttagcgtgcagcgacaattcttccccactgacgaggatgagatcggcgctgccaaagctttgatgaggctgcaagacacttatagactggatccaggcaccattagccgcggagaactgccgggaactaagtatcaggccatgctgagcgttgacgattgctttggcatgggaaggtcagcctataacgagggcgattattaccacacagttctatggatggaacaggtcttgaaacagctggatgcaggcgaagaggctacaaccaccaaatcccaggtgctcgactatctttcctacgccgtattccagctcggcgacctgcatcgggctctggaactcacacggaggctactgagcctcgatccaagtcatgagcgagccggtgggaacctgcgatattttgagcaactcctggaagaagaacgggagaagacccttactaatcagaccgaagcggaactggctacccccgaaggaatctacgagcggccagtggattacttacccgaaagagacgtatatgaaagcctgtgtaggggagaaggagttaaattgacccccaggaggcagaaacgcctgttttgcaggtaccaccatggaaacagagcaccacagctcctgatcgccccatttaaggaagaggacgaatgggactctccacacattgtgaggtactatgatgttatgagtgatgaggagattgaaaggatcaaggaaatagcaaaacctaagctagcacgggcaactgtgcgcgaccccaagactggcgtgctcaccgtcgcatcttaccgcgtgagcaagagctcttggctggaagaggacgacgatcccgtagtcgcaagggtaaacaggcgaatgcagcacatcaccggcctgacagtgaaaacagccgaactcttacaggtcgcaaactacggcgttgggggtcagtatgaaccacatttcgacttcagccgtcggccattcgattccgggctaaaaaccgagggcaatcggttggccacttttctgaactatatgagtgatgtggaagcaggcggtgccactgtatttcctgacctcggagccgcaatctggccaaagaaaggcaccgccgtcttctggtataacctactccgctccggtgaaggagattaccggacccgtcacgccgcttgccccgttctcgtggggtgcaaatgggtttctaataagtggttccacgaaagaggccaggagtttcttagaccctgcggatccacagaagtagattag

SEQ ID NO: 236292 - DNA, 1608 bp, Artificial Sequence
  Description of Artificial Sequence: Synthetic coding sequence
atgaaactgtgggtgtctgccttgttgatggcttggtttggtgtgctgagttgcgtgcaggctgagtttttcacctctataggtcatatgaccgatctcatttatgccgagaaggaattagtgcagtccttgaaggaatacatccttgtggaggaggccaaactaagcaagattaaaagctgggcaaacaagatggaagcactaacatccaagtcagccgctgacgccgagggttaccttgctcaccctgtcaacgcatacaagttagtcaagcgccttaacacagactggccagccctggaggaccttgtgctccaagattccgccgctgggtttattgccaatttaagcgttcagcgccagttttttcctaccgacgaggacgaaattggcgctgcgaaggcacttatgagactgcaagatacctatcgtttagaccccggaaccattagcagaggggaactgcctggcacaaagtatcaggcaatgcttagcgtggatgattgcttcggtatggggaggagcgcttacaatgagggcgattactaccataccgtgttgtggatggaacaagtgctgaagcagctggatgccggagaagaggccacaaccactaagagccaagtacttgactacttaagttacgcggtgttccaactcggtgacctgcatagagccctcgagctgacaagaagattgctgtcactggatccgagtcatgagcgcgctggcggtaatcttagatactttgaacagctgctggaagaggaaagggagaaaacactcactaaccaaactgaggccgagctcgccaccccagaaggtatctatgagcggcctgttgactaccttccggagagagatgtctatgaatctttgtgccggggtgagggcgtgaagctgaccccacgccgtcagaaaagactcttttgcaggtaccatcatggaaacagagccccacagctgctgatcgcgcctttcaaggaggaagacgagtgggactcaccgcatatcgtgcgctactacgacgtgatgtctgatgaggagatcgaaaggatcaaggaaattgcaaagcccaaactcgccagagctaccgtgcgcgaccccaagacgggcgtgttgaccgtggcctcttatcgcgtgtccaaatcttcctggttggaggaggacgacgatccagtcgtagcacgcgtaaaccgccgaatgcagcatatcactgggttaactgtgaagacggctgagttactgcaggtcgccaattatggggtcggaggacagtacgagcctcacttcgatttctctagaaatgacgagagggatactttcaagcatttgggaaccgggaacagagtcgcaacctttctgaactatatgtcggatgtcgaagccggtggagccactgtgttccctgatctgggggctgctatttggccgaagaaaggtacagcggtattctggtataacttattaagatcgggagaaggagactacagaacaagacatgcagcctgccctgttctagttgggtgtaagtgggtttcgaataagtggttccacgagcgaggccaggagttcctacgcccatgtggcagcaccgaagtggactag

SEQ ID NO: 236293 - DNA, 504 bp, Artificial Sequence
  Description of Artificial Sequence: Synthetic coding sequence
atgaagctgtgggtgtccgctctgctgatggcctggttcggcgtactcagctgcgttcaggccgaattctttaccagcattggacacatgacagatctgatctatgccgaaaaagagctagtgcaaagtctgaaggagtatatacttgtcgaagaggccaagctgagcaagatcaagtcgtgggccaacaagatggaggcactgacttcgaaatccgccgctgatgctgaaggatacctggctcaccctgtcaatgcttataagctagtgaagcggttgaataccgattggccagctctcgaggatttggtgctgcaggattcagctgcagggtttatcgccaacctaagtgtccagcgacagttctttcccacagacgaagacgaaataggcgcagctaaggccctgatgagactgcaggatacatatcggttggatcctggtaccatatcacgcggagaattgccgggaactaaataccaggccatgctgtctgttgactag

SEQ ID NO: 236294 - DNA, 1608 bp, Artificial Sequence
  Description of Artificial Sequence: Synthetic coding sequence
atgaaactgtgggtgtctgccctacttatggcgtggtttggagtgctctcttgtgtccaggcagaattcttcacatccatcggacatatgaccgacctcatctacgctgaaaaggaactggtgcagagtctgaaggagtatatactggtggaagaagccaagctgtccaagataaagtcttgggccaacaagatggaggctctgaccagtaaaagcgctgcagatgcagagggatacttagctcatcctgtgaacgcctacaagcttgttaaacgtctgaataccgactggcccgcactggaggatttagtgctccaggacagcgctgccggattcatcgccaatctttctgttcaacggcagttcttccccaccgacgaagatgagatcggtgccgcaaaggcattgatgaggctgcaggatacatacaggctcgaccccggaaccatatcaagaggtgaactgcccggaaccaaataccaagccatgttgtccgtggatgactgctttggcatgggcaggtcagcttataacgagggggattactaccacacagtgctttggatggagcaagtgcttaagcaactggacgctggtgaagaagccacgactacaaagtctcaagtcctcgactatctctcctacgccgtgtttcagcttggggacctgcatcgggctttagagttgaccagacgtttgctctctctcgacccgagtcatgagcgagccggtggcaacctgcggtactttgagcaactgctggaagaggaacgcgagaaaaccctgactaaccagactgaggctgagctggccactcctgagggaatttacgagcgccctgtcgactatttgcccgaacgcgacgtgtacgagagtttgtgccgaggtgagggcgtaaaactcaccccgaggcgccagaaacggctgttctgtcgctaccaccacggcaacagagcgcctcaactgctcattgcaccctttaaagaggaggacgaatgggacagtcctcacatagtgcgttattatgatgtgatgtccgacgaggaaattgagcgcatcaaggagatcgccaagccaaaattggctagagctacagttcgtgatcctaagactggagtgttgacagtcgcctcatatagggtgagcaagtcaagttggctggaggaagacgacgaccctgtagttgcccgtgtgaatcgcagaatgcagcacattacaggactcactgttaaaactgctgagctgctacaggtggccaattacggggtgggaggccagtatgagcctcattttgattttagccgcaatgacgagagagacacgtttaaacatttaggtacaggcaaccgcgtggctacatttctgaattacatgtccgacgtagaagcaggaggagctacagtgtttcccgaccttggcgctgctatctggcccaagaaagggactgcggtgttctggtacaaccttttgcgctctggcgaaggcgattaccggacaaggcacgcggcttgcccggtgctcgtgggttgcaaatgggttagcaacaagtggttccacgagaggggccaggagtttcttcggccatgcgggtctaccgaggtggattag

SEQ ID NO: 236295 - DNA, 306 bp, Artificial Sequence
  Description of Artificial Sequence: Synthetic coding sequence
atgaagttatgggtgtccgccttgctgatggcgtggttcggggtactttcatgcgtacaggccgagttttttacttccattgggcatatgaccgacctgatctatgcagaaaaagagctcgtccaaagcctgaaggaatacatccttgtcgaagaagctaagctaagtaaaataaagagttgggcgaacaaaatggaggcattgaccagcaaaagtgcagccgacgccgagggctatctggcacatcctgtgaacgcttataagctggtgaaacgactcaatacagactggcctgctttggaatag

SEQ ID NO: 236296 - DNA, 615 bp, Artificial Sequence
  Description of Artificial Sequence: Synthetic coding sequence
atgaagctgtgggtctcagcccttctaatggcttggttcggggtcttgtcttgcgttcaggctgagttctttacctcaatcggacatatgaccgatttgatttatgccgaaaaagaacttgtccagtctctgaaggaatatatcctggtcgaggaagcaaagctgtccaaaataaagtcatgggctaacaagatggaggcgctcacctccaaatccgcagcagatgcagagggatacctggctcatccggtgaatgcctataagctcgtgaagaggctgaacacagactggcccgctctggaggatcttgtgctgcaggactcggccgcaggtttcatagccaacctgtccgtgcagcgccagttctttcccaccgatgaagacgagataggtgctgcaaaggctttgatgcggctccaagacacatatcgccttgaccccggaaccattagcagaggtgagttacccggtactaaataccaagctatgctgtcagtggacgattgcttcggcatgggtcgctcagcgtacaacgaaggagattactatcacactgtcctctggatggagcaagtgctaaaacagttagacgccggtgaagaggctactacctag

SEQ ID NO: 236297 - DNA, 345 bp, Artificial Sequence
  Description of Artificial Sequence: Synthetic coding sequence
atgaagctgtgggtgtccgcgctgttaatggcatggtttggggttctgagttgtgtgcaagcggaattttttacgagcattggccacatgaccgacctcatatacgcagaaaaagagctggtccagagcttaaaagaatacatcttagtggaggaggcaaaactctctaaaattaaatcttgggcaaataaaatggaggccctgacctccaagtccgcagcagatgctgaaggctacctggcacaccctgtgaacgcctataaactggttaagagactaaacacagattggccagcccttgaggatttggttctccaagattccgctgccggattcatagcctag

SEQ ID NO: 236298 - DNA, 444 bp, Artificial Sequence
  Description of Artificial Sequence: Synthetic coding sequence
atgaagctgtgggtcagtgccctactgatggcctggttcggggtattgagctgtgtccaggccgagttcttcaccagcatcggccatatgacagatctgatatacgccgaaaaggagcttgtccagtcactgaaggagtatattctggtggaagaagccaagctatcgaagatcaaaagctgggccaacaaaatggaggcgcttaccagcaagtcggccgcagatgccgagggctacttggctcaccctgttaacgcctacaagttagttaaaaggctaaacaccgattggccagcattagaggacctggtgctgcaggacagtgctgcaggattcattgccaacctatcagtgcagagacagtttttcccaactgatgaggatgagatcggcgcagccaaggcactgatgcgtcttcaggacacataccggctagacccctag

SEQ ID NO: 236299 - DNA, 153 bp, Artificial Sequence
  Description of Artificial Sequence: Synthetic coding sequence
atgaaactgtgggtatcagccctactgatggcgtggttcggagtgctgagttgtgtgcaagctgagtttttcacaagcattggccacatgacagacctgatctacgcggaaaaggaactcgttcagtctctcaaagaatatatcttggtttag

SEQ ID NO: 236300 - DNA, 555 bp, Artificial Sequence
  Description of Artificial Sequence: Synthetic coding sequence
atgaagctgtgggttagcgcactgctgatggcctggttcggagtactctcgtgtgtccaagcagagttcttcacctccataggacacatgacagatctgatttatgcggagaaggagctggtccaatccctcaaggaatacatcctggtagaagaagcgaagttgagtaagatcaagtcctgggcaaacaaaatggaggccttgacatctaagtctgcagccgacgccgaaggctacttggctcacccagtgaatgcatataaattggtgaagaggttgaatacagattggcccgctctcgaggacctggttctgcaggattctgctgccggatttatcgccaacttgtcagtccagcgacagttctttcccacagatgaagatgaaattggggcagctaaggctctgatgaggctgcaggatacctaccggctggatcccggtactatctccagaggagaactgcccggaacaaagtatcaggccatgctgtccgtggacgactgtttcggaatgggcagatccgcctataatgagggagactattaccattag

SEQ ID NO: 236301 - DNA, 462 bp, Artificial Sequence
  Description of Artificial Sequence: Synthetic coding sequence
atgaaactgtgggttagcgcccttctcatggcatggtttggggtcctcagctgtgtgcaagcggaattctttacaagcataggacatatgacggatctaatctatgccgagaaagaattagtacagagcttgaaggaatatatcctcgtcgaagaagccaagctttcaaaaatcaagtcctgggctaataaaatggaggccctgacctccaagagtgccgctgacgctgagggataccttgctcatccagtcaacgcttacaaactggtgaaaaggctgaacaccgactggcctgcattagaggatctcgtgctacaagattccgccgcagggttcattgccaatctgagcgtgcagaggcagtttttcccaacagatgaggacgagataggcgcagccaaggccctaatgaggctgcaagacacgtacagactggacccaggcacaatttctcgcggttag

SEQ ID NO: 236302 - DNA, 1635 bp, Artificial Sequence
  Description of Artificial Sequence: Synthetic coding sequence
atgggtcccggagctaggctagcggctttgctggctgtgctcgccctggggaccggcgaccctgaaagagccgctgccagaggtgacacttttagcgctttgacctcagtcgccagagccctggctcctgaacgcagactactcggtcttctgcgcaggtatctgcgcggtgaggaagccaggctgcgggacctcactcggttctatgataaggtgctgtctctgcacgaagactcaacaacgcctgttgctaatccactcctggctttcaccctaattaagagactgcagtcagattggaggaatgtggtgcactctctggaggccagtgaaaacattagggctttgaaggatgggtacgaaaaagtagaacaggacttacccgcttttgaagatcttgaaggggcagccagagccctgatgagattacaggacgtttatatgctcaacgttaaaggtctggcccgaggcgtctttcagagggtcacaggttccgcgatcactgacctctactcccctaagcgcctgttcagtctgactggagatgattgctttcaggtcggaaaagtcgcgtatgacatgggcgattactaccacgccatcccatggctggaggaggccgtatcactgtttcggggatcatatggtgaatggaaaacagaagacgaagctagccttgaagatgctttagaccacttggcatttgcatactttagggcaggtaacgtgagttgtgctctgagcttatctcgggaatttctcctgtattcacccgataacaagagaatggccaggaatgtgttaaagtacgagcgcctcctggccgaatctcctaatcacgtggttgcggaggccgtgatacagagacccaatatccctcacctgcaaactagagatacatacgagggactgtgccaaaccctggggagccagccaacactctatcagattccttctctgtattgttcatacgagaccaattctaatgcatatctgctcctccagcccatccgcaaggaagtcatacatctggagccctacatcgcgctgtaccacgactttgttagtgacagtgaagcacagaagatccgcgagttggctgaaccctggctccagcgaagtgtggtggcaagtggggaaaagcaactgcaggtcgagtaccgcataagtaagtctgcctggctgaaggataccgtggacccaaaactggttacactgaaccatagaatcgccgcactgacagggctggatgtaaggcctccttacgcggaataccttcaggtggtcaactacggcatcggaggacactatgaaccccacttcgatcatgccacctctccttcatctccactttaccgaatgaagagcggaaaccgggtggcgactttcatgatctatctctcctccgtagaggctggcggagcgactgcctttatttatgccaatttaagcgtgcccgttgtgcgaaacgctgcccttttctggtggaatcttcatcggagcggtgaaggagatagcgatacgctccatgcgggatgccccgttctggtcggtgacaaatgggtggcgaacaagtggatccacgaatacgggcaggagtttcggagaccttgcagcagctcacctgaggactag

SEQ ID NO: 236303 - DNA, 1815 bp, Artificial Sequence
  Description of Artificial Sequence: Synthetic coding sequence
atgggacctggcgctcgcctagcagccctgctcgctgtcctcgcacttggtactggagacccggaaagggccgctgcaaggggcgacacatttagtgctcttactagcgtcgctcgtgcactagcgccagaaagaagattgttggggctgttaaggaggtatttgcgtggtgaggaagcccgtttaagagacttgacccgattctacgacaaagtcctcagcttgcacgaagactcgaccactccagtcgcaaaccccctgctggcgttcacacttatcaagcgtttgcagagcgactggcgcaatgttgtgcatagtctggaagcaagcgagaacatccgagccttaaaagatggatacgagaaagttgaacaagacctgccagccttcgaggacctggagggggctgctagagctttgatgcgattgcaggacgtctacatgttgaacgtgaaagggctcgcccgaggcgtgtttcagcgcgtcaccggatccgccatcactgatctgtacagccctaagagacttttcagcttgacaggcgacgactgttttcaggtgggtaaagtcgcctatgacatgggcgattactaccatgctattccctggctcgaggaggcggtatccctattccggggaagttacggggagtggaaaaccgaagacgaggccagtctggaggacgcacttgaccatctggctttcgcctattttcgagctgggaatgttagctgtgctctgagcttgtctcgagagttcctgctttattcaccggataacaagaggatggccaggaatgtgctcaagtatgagcgccttctggctgagagcccaaatcatgtggttgcggaggcggtgattcagaggcccaacattccgcacctgcagaccagagacacctatgagggactctgtcagaccttaggcagccagcccactctttaccagatcccgtctctctactgctcttatgaaactaactctaacgcatacctgttattgcagccaatccggaaagaggtgatacacctggagccgtatatcgcattgtatcatgattttgtgagtgattccgaagctcaaaagatccgggaactcgcagaaccttggctgcagcgttccgtcgtggcgtccggagaaaaacagcttcaggttgaatatagaatttctaagagtgcatggcttaaggacacagttgaccccaagctagtaactctgaatcaccggatcgcggcactaaccggattggatgtcaggccgccatacgcagaatatctgcaggtggtaaactacgggatcggcggacattatgaaccccactttgatcacgctactagcccatctagcccattgtaccggatgaaatcaggaaaccgcgtggctacattcatgatttacctgtctagtgtcgaagcgggaggcgcaaccgcatttatttatgccaacctcagcgtgcccgttgttcgccattgctttggcggtacatgtacaggggtggtaaaaggcaccgtcactcatttcatgctagccgtgttgtcatggtgggaaatatccggatggcccacatccgggtatatgagcatggatcgaaacagtgcagaccccgcagccccagctctgaagacggaactcctcgctgagagatcgtggtggtcaccagtggcctttcagagaagtcaagaacccaaagctggagtcggtgaagagaaggcagagcagccgcctggtcgtcgtccgtgccagttatgtttgtgcctggcaaaccagagacagggcaggggatgctaccagggtacactgcggatgtatatctag

SEQ ID NO: 236304 - DNA, 1527 bp, Artificial Sequence
  Description of Artificial Sequence: Synthetic coding sequence
atgctgcgccgtgcactgttgtgtctcgccgtggctgctcttgtgcgcgcagatgctccagaggaggaagaccacgtgctggtgctgcgcaaaagcaacttcgcagaagcgttggccgctcataagtatcttctcgtcgaattttatgccccttggtgcggccactgcaaagctctggctccagagtacgcaaaggccgctggcaagctgaaggctgagggctccgagatccggctggcaaaggttgatgccacagaagagtctgatctggcacaacagtatggagtgagaggttacccgacgattaagtttttccgcaacggggacactgcctcacccaaagaatatacagccggtagagaagcagatgacattgtgaactggctaaagaaacggaccggtccagctgcaactacacttcctgacggggcagccgcagagagtctggtggagagttctgaggtggccgttattggattttttaaggacgtggaaagcgactccgctaagcagttcctgcaggcagcagaggcgatcgacgatattccatttggcattacttctaacagtgatgtattttctaagtaccaattagacaaagatggggtggtcctgttcaagaagttcgacgaaggacgcaacaactttgagggcgaggtgacaaaggagaatctactggattttatcaaacacaaccaactgcctctggtcattgaattcacagagcagaccgccccaaagatatttggcggtgagattaagacccacatactgctctttctgcccaaaagtgtttcagactatgacgggaagttgtcgaacttcaagacagccgcagaatcattcaaaggcaagatcctgtttatattcattgactcagatcataccgacaaccagcgtatcctcgagttttttggactcaaaaaagaagagtgccctgctgttaggctgattacattggaagaggagatgacaaagtacaaaccggagagcgaggagctgactgccgagcggattaccgaattctgccacagattcctcgaaggtaagatcaagccccaccttatgtcacaagagctaccagaggactgggacaaacagccggtgaaggtgctcgtcgggaagaacttcgaagatgtggcctttgatgagaagaagaacgtgtttgtggagttctacgctccatggtgtggacactgcaaacagttggcccctatttgggataaattgggcgaaacctataaggatcatgaaaatattgtgatagctaagatggacagcaccgcgaatgaagtagaggctgtaaaggtgcatagttttccaactctgaaattcttccccgcaagtgcagatcggacagtcattgattacaacggagagcggaccttggatggatttaagaaattccttgaaagcggtggtcaggatggcgcaggagacgacgacgatctggaggatctcgaagaagcagaggagcccgatatggaagaagatgatgaccagaaggcggtaaaggacgagctctag

SEQ ID NO: 236305 - DNA, 1479 bp, Artificial Sequence
  Description of Artificial Sequence: Synthetic coding sequence
atgctgaggcgggcactcctctgcctggcggtggctgcactggttcgagccgatgccccagaggaagaggaccacaaatatctgcttgtcgagttctatgccccttggtgcggccattgcaaggcactggctcctgaatatgcaaaggccgctggaaagctgaaggctgaaggcagtgaaattagactagccaaagtcgacgccactgaggagtctgatttagcacaacagtatggcgtcaggggctaccccacaatcaaattctttcggaacggagacactgctagccctaaagagtatacagccggaagagaggctgatgacattgttaactggctcaaaaaacgaaccggccctgcggctacaacgctgcccgatggagcggcagctgagtccctggtcgagagttctgaagtagccgtgataggttttttcaaagacgttgaatctgactcagcaaaacagttccttcaggctgctgaggcgatcgatgatatcccatttggaataacttcaaactcggacgttttttccaaataccaactggacaaggatggagtcgtcctctttaagaagttcgacgagggcagaaataatttcgagggggaggtaaccaaggaaaatctcctcgacttcattaaacacaaccaactgcctctggtgattgaatttaccgaacagacagctccaaaaatctttggtggagagattaagacccacattctactgttcctgccgaagtcagtcagtgactatgatgggaagctgtcaaactttaagaccgctgccgagagcttcaagggaaaaatattgttcatcttcatcgattctgatcacacagataaccagcgaatcttggagttctttggcctgaaaaaggaggaatgccctgcagtgcggttgatcacgttggaggaagagatgactaaatataaacctgaaagcgaagagctgacagccgaacgcattactgagttttgccaccgctttcttgagggtaaaattaaacctcaccttatgtcgcaggagctgcccgaggattgggacaagcagcccgtgaaggtcctcgtcggcaagaacttcgaagatgtggcttttgacgagaagaaaaacgtgttcgtcgagttctacgctccgtggtgtggacactgcaaacaactggccccaatatgggacaagctgggagagacttataaggatcacgagaacatcgtgattgcaaaaatggattctaccgcaaatgaagtggaggcggtaaaagtgcacagtttccctaccctcaaattctttccagcctcagccgaccgtacggtcattgactacaatggggaacgaacgctcgacgggttcaagaagtttctagaaagcggcggacaagatggcgcaggggatgatgatgacctggaggatctggaagaagctgaggaacctgatatggaggaggacgacgaccagaaggctgtgaaagatgagctgtag

SEQ ID NO: 236306 - DNA, 1356 bp, Artificial Sequence
  Description of Artificial Sequence: Synthetic coding sequence
atgttacgccgagccctgttgtgcctcgcagtggctgccctggtgcgcgcagatgctccggaagaagaggaccacgtgctggtgctccgcaaatcgaatttcgctgaggccctcgccgcacacaagtacctgcttgttgagttttatgccccatggtgtggtcattgtaaagcgctggctccagagtatgcgaaggccgctgggaagttgaaagcagagggctctgaaattcgcctggctaaagtcgacgccacagaagagtcagacctggctcagcaatacggggtaaggggctatcctacaatcaaattcttccgcaacggcgacacagcttcccccaaggaatataccgctggaagggaagccgacgatatcccatttggtatcaccagcaacagcgatgtcttctcaaagtaccaactggataaagatggtgtggtgctatttaagaagtttgacgagggcaggaacaactttgaaggcgaagtaactaaggaaaacctgctggatttcattaaacataatcagctacccctggtgatagaatttaccgagcagaccgccccaaagatcttcggtggggagatcaagacccatatacttctgttcctgcctaagtctgtctctgactacgacgggaaacttagtaactttaagactgccgctgagtcctttaagggcaagatcttgtttatattcatagacagcgatcacaccgataatcagcggatactggagttcttcgggttaaaaaaagaggaatgtcctgccgtcagattaattacgcttgaagaggagatgaccaaatacaagcctgagagtgaggaattaaccgctgaaaggatcacagagttctgtcatcggtttcttgaagggaaaatcaaaccacatctgatgagtcaggaacttcccgaggattgggacaagcaaccagtgaaggttctggtcggtaaaaatttcgaggacgtggctttcgatgagaaaaagaatgttttcgtagaattctacgccccatggtgcggacactgcaaacaacttgctcccatctgggacaagctgggggaaacttacaaggaccatgagaacattgtcattgcgaagatggactccaccgccaacgaggtggaagctgtcaaggttcacagttttcctactctgaagttcttcccagcctcagccgacaggactgttattgactacaatggcgaaagaaccctcgatgggttcaaaaagtttttagagtcaggagggcaggatggcgcaggggacgatgacgacttggaggatctcgaagaggctgaggagccagatatggaggaagatgatgatcagaaagccgtgaaggatgagctctag

SEQ ID NO: 236307 - DNA, 2133 bp, Artificial Sequence
  Description of Artificial Sequence: Synthetic coding sequence
atgctttcactccagtatccagacgtctaccgggacgagacagctgtccaggactatcatggccacaagatctgcgacccatacgcttggttggaggacccagattcagagcagaccaaagcattcgtcgaagcccagaacaagatcaccgttccttttcttgagcagtgccctattagagggttgtataaggagcggatgacagagctgtacgactatcctaagtatagctgccatttcaagaaggggaagaggtatttctacttctacaacactgggttgcagaaccagcgcgtcttatatgtacaggactcacttgagggtgaagcccgtgtctttctggatccaaacattctgtctgatgacggcacagtcgccctcagagggtacgctttttcggaggatggcgagtattttgcctatggcctcagcgccagtggttcggattgggtgaccatcaagttcatgaaggtggatggagccaaggagctgcctgacgtcctagaacgagttaaattctcatgcatggcatggacccacgacggaaaaggcatgttctacaatagctaccctcagcaagatggcaaatcagatggaacagagacttctacaaatctgcatcagaagctgtactatcacgtcctcggaaccgatcaaagcgaagatatcctgtgtgctgagttcccagatgagccaaagtggatggggggagccgagttatctgacgacgggagatatgtccttctgtcgattcgcgaggggtgtgacccggtcaataggttgtggtactgcgatctgcagcaggagagctcgggaatcgcaggtatcctgaaatgggtgaaactgatcgataatttcgaaggcgaatatgattacgtcacaaatgaggggactgtgttcacgtttaagactaataggcagtcgcctaactaccgagtgatcaatattgacttcagagatcccgaggaatctaagtggaaggtgttggtccccgaacatgagaaagacgtgctcgaatggatcgcctgtgttaggtcaaatttcctagtcttgtgctatctgcacgatgtgaagaatatcctgcagcttcacgatttgaccaccggcgctctgttaaaaacatttcctctggacgtcggctctatcgtaggatacagcgggcagaagaaagacacagaaattttctatcaattcacctctttcctgtcccccggaattatctatcattgcgacctgacgaaagaggagctcgagccaagagtgtttcgcgaagtcacagttaaagggatcgacgcttctgactaccagaccgttcagatattttacccctctaaggatgggaccaaaatacctatgttcatcgtacacaaaaagggtatcaaactggatggatcccatcctgcctttctgtatggatatggaggctttaacatctctattacgcccaactactctgtcagcagactgatcttcgtcagacatatgggcggaatccttgcggtggccaatattaggggtggcggtgaatatggggagacctggcacaaaggtgggatcctggccaacaaacagaattgcttcgacgacttccagtgcgcggcagagtatttaattaaggaaggctacacaagccctaagcgtctgacaattaatggcggtagcaacggcggactgctagtggccgcttgtgcaaatcaaaggccagaccttttcggctgtgtgatcgcacaggtcggtgtgatggacatgctcaagtttcataaatacacaattgggcatgcatggaccaccgactatggatgctctgattccaaacagcactttgagtggctggtaaaatactccccactgcacaatgtcaaacttcctgaggcagacgacatccagtacccttctatgctgctgctcaccgccgatcacgacgatagggtggttcctctgcatagcctcaagttcattgccacactgcagtacattgtggggagatctcgtaagcagagtaatcctctcttaatccatgttgacaccaaagccggacatggcgcaggaaaaccaaccgcaaaagtgattgaagaggtttccgatatgtttgccttcatcgcacgctgcctgaatgtggactggatcccctag

SEQ ID NO: 236308 - DNA, 138 bp, Artificial Sequence
  Description of Artificial Sequence: Synthetic coding sequence
taaatcatctaccactgcgacctcacaaaggaagagttggaacctagagtgtttagggaggttacagttaaggggattgatgcttctgactatcaaacggttcagctccccaaaggaaccgagtcatctcggaattag

SEQ ID NO: 236309 - DNA, 135 bp, Artificial Sequence
  Description of Artificial Sequence: Synthetic coding sequence
atcatttaccattgtgacctgactaaggaggagctagaaccaagagtgttcagagaggtgacagtcaaagggattgacgcctccgactatcaaacggtgcagctgcccaaaggcaccgagagctccagaaactag

SEQ ID NO: 236310 - DNA, 2184 bp, Artificial Sequence
  Description of Artificial Sequence: Synthetic coding sequence
atgcagcaaaaaacaaagcttttcctacaagccttgaagtattccatcccgcatctcggcaagtgcatgcagaaacagcatctgaaccactataacttcgccgaccactgctataatcggatcaaactgaagaagtaccatttaaccaaatgtctgcagaataaaccaaagattagcgagctggctagaaacattcccagtaggtcattctcgtgtaaggatttgcagcctgtaaagcaggaaaatgaaaaacccttgcctgagaacatggacgcctttgagaaggtccgcaccaagcttgagacacagccacaggaagaatacgaaatcattaacgtggaggtaaagcacggaggatttgtctattatcaggagggctgctgcctcgttcgttccaaggatgaggaggccgataatgacaactatgaagtgcttttcaatctggaagagctgaagctggaccaacccttcattgactgcatacgagtggccccagatgagaaatatgtggcagccaaaatcagaaccgaggacagcgaagcttccacttgcgtgataattaaacttagcgaccagcctgtgatggaggcctcattccccaacgtctcctcatttgaatgggtgaaggacgaggaggacgaagacgttttattctacacctttcagaggaacctcagatgtcacgatgtatatcgggctactttcggcgacaataagcgcaatgaacgcttttacaccgaaaaggatccttcctactttgtctttctgtatcttactaaagatagtcggtttctgaccattaacattatgaacaaaactacctcagaggtttggctcattgacggcttatccccctgggatccccctgtcctgattcaaaaacgaattcatggagtcttatattacgtggaacacagagatgatgagctgtacatcctgaccaacgttggtgagccaactgaatttaagttgatgcggaccgcggcagacacccctgctatcatgaattgggaccttttctttactatgaagcggaacactaaagttatagatttggacatgttcaaggatcattgtgtccttttcttgaagcacagtaacctcctgtatgtcaacgtcatcgggctcgctgatgactctgtgcgctcactgaaactgcccccttgggcctgtggctttatcatggataccaattccgacccaaaaaactgtccatttcagctgtgttcgccaatccgtcccccaaaatattatacgtataagttcgctgagggcaagctgtttgaagaaacagggcacgaagaccctattacaaaaacgtctagagtgctgagacttgaagccaaatccaaggacgggaaactcgtgcccatgaccgtcttccacaaaacggacagcgaagacttgcagaagaaacccctgctggtgcacgtgtacggagcctacggcatggatctcaagatgaattttcggcctgaacgacgcgtgcttgtggacgacggttggatccttgcctactgccacgttcgcggaggcggagaactgggccttcagtggcacgctgacggtcgtttaaccaagaagttgaatggtctagccgatctcgaagcctgcatcaaaaccctgcacggacagggattctctcagccctcgctaacaaccctgacagctttctcggccggaggggtgctggccggagccttgtgcaacagcaatcctgagcttgtccgcgcagtgactctggaggcccctttcctagatgttctgaatactatgatggatacaactctgccactcaccctggaagagctggaggagtggggaaacccctctagtgatgaaaagcataagaattacattaagagatactgtccatatcagaatattaaacctcagcactatccttccatccatattaccgcctacgagaacgacgaacgggtgccccttaagggcattgtgagctacactgaaaaactgaaggaggcgattgcggaacatgcaaaggatacaggagaggggtatcaaacgccaaatataatactcgacatccagcccggaggtaaccatgtaatcgaggactcgcacaaaaagataacagctcagatcaagtttctgtatgaagagttaggtctggattctacgtccgtgtttgaagatctgaaaaagtatctgaagttttag

SEQ ID NO: 236311 - DNA, 1998 bp, Artificial Sequence
  Description of Artificial Sequence: Synthetic coding sequence
atgcagcagaagactaagctgtttctccaggctctgaagtattccatacctcacctcgggaagtgtatgcaaaagcaacacctcaaccattacaactttgccgaccattgctacaatagaatcaaactgaagaaatatcatctaaccaagtgtttacagaacaagcccaaaattagcgaactggcccgaaacattcctagtcggtctttctcttgtaaggacctacagcctgtcaagcaggaaaatgaaaagccactgccggagaacatggatgccttcgaaaaggtgcggacaaaactcgaaactcagccccaagaggaatatgagatcataaatgttgaagtaaaacacggcggatttgtatactaccaggagggatgctgcctggttcgaagtaaggatgaagaggcggacaacgacaactatgaggtactgtttaacctcgaggagctaaagctggaccaaccctttatagattgcattcgggtggctcccgacgaaaagtacgtggcggctaagatcagaacagaagattctgaggctagtacttgcgtgataataaaactgagcgaccagccagttatggaggcatcttttccgaacgtcagcagtttcgagtgggttaaggatgaggaggatgaggatgtcttgttctacaccttccagagaaacttgcgttgtcatgacgtttaccgcgcaacgtttggtgataacaagcggaacgaacgcttttatactgaaaaagacccttcatacttcgtgttcctctaccttaccaaggattcaaggttcctcacgatcaacataatgaacaagacaacatctgaggtctggttgattgacggcctcagcccctgggacccacccgtgctgatccagaagaggatacatggcgtcttgtactacgtcgaacatagggacgatgaactttatatcctgaccaacgtgggcgaacccaccgagtttaagctgccgccatgggcctgcggattcatcatggatactaatagtgatccgaaaaattgtccattccaactgtgcagtcccattaggcccccaaagtactatacttataagtttgctgaaggaaaacttttcgaggagactgggcacgaggatccgattaccaagacctctagggtgctgcggctagaagcgaagagtaaagacggcaagcttgtgcctatgaccgtgtttcataagacagatagtgaggacctccaaaagaaacccctcttggtgcacgtgtacggtgcgtacggtatggacttgaaaatgaactttagacccgagcgacgggttctggtggacgacggatggattctagcttattgccatgtacgcggtggcggagagctggggctgcagtggcacgctgacggccgtttaacaaagaagctgaatgggctcgctgacttagaggcatgcatcaagacactgcacggacagggtttttctcaaccttccctgaccaccctcactgcattttccgcaggcggagttttggccggagcactttgtaacagcaaccccgagttggtgcgcgctgtgactctcgaggcacccttcttggacgtgctgaatacaatgatggacaccaccctccctctcacactcgaagagctggaggaatggggaaatccgtcctctgacgagaagcacaagaattacatcaaaagatactgtccttatcagaatatcaaacctcagcactacccttcgatccacattactgcatacgagaacgatgagcgggtgcctcttaagggaattgtctcctacacagagaagttgaaggaagcaatcgcggagcacgccaaggatacaggagaaggctatcagactcctaacatcattctcgatatccagcccggtggcaatcacgttattgaagactcccacaagaaaattaccgctcagatcaagttcctctatgaagagcttggactcgattccacgagtgtgtttgaggacctgaagaaatacctcaagttctag

SEQ ID NO: 236312 - DNA, 1986 bp, Artificial Sequence
  Description of Artificial Sequence: Synthetic coding sequence
atgcagcagaaaacaaagctgtttctgcaagcccttaaatatagtatcccccatcttggaaagtgcatgcagaagcagcacctgaaccattataattttgcagatcactgttacaatcgcattaaactgaaaaagtaccacttaactaagtgtctgcaaaataagcccaaaatcagcgaactagctcgaaatatccctagtcgaagctttagttgtaaagacctacagcctgttaaacaagagaatgagaagcccttgcccgagaacatggatgcgttcgagaaggttcgaactaaactcgagacgcagccacaggaagagtatgagatcatcaatgtcgaggtgaagcatggaggtttcgtgtactatcaagaagggtgctgcctcgtgaggagcaaggatgaagaggcagacaatgataattacgaagtactctttaatttggaagagctcaagttggaccaaccttttatcgattgtattcgcgtggcccctgatgaaaaatacgtggccgctaagatcagaaccgaggatagcgaggcatctacctgtgtgatcattaagctgagcgatcagcctgtgatggaagcgtcttttcccaacgtgagctcattcgagtgggtcaaagatgaggaagatgaagatgtgctcttttacacctttcagaggaacctccggtgccatgatgtctatcgtgccacattcggagacaataagcggaacgaacgattttacactgaaaaagacccttcatacttcgtgtttctgtatcttacgaaagatagtagattcctgacgattaacatcatgaataagacaacaagcgaggtgtggctgatcgatgggctgtccccatgggatccccctgttctgatccagaagaggatccacggcgtgctttactatgttgaacatcgagatgatgagctgtacatactcacgaacgtgggagaaccaacagaatttaagctgatgcgtacggctgctgatactccagcgataatgaattgggatttgttttttacaatgaaacgaaacacaaaggtgatcgacctggacatgtttaaggaccactgtgtcctgtttttaaagcatagcaatctgttatacgtgaatgtgatcggtctcgcagatgactctgtcaggagtcttaaggatggaaaactcgtgccgatgactgtttttcacaagaccgacagcgaggatctccagaagaaacctttgctggtgcacgtctacggagcatacggaatggatttgaaaatgaacttccgccctgaacggagagtgctcgttgacgacggctggatcctggcctactgtcatgtccgtggagggggagaactgggcctgcagtggcacgcggacgggcgactgacaaaaaagctgaatggactggcagacctggaggcatgcattaagacacttcacggacaaggtttttcccagccgtccctaacaaccctcactgcattttctgccggaggcgtcctggccggagcactgtgcaacagtaacccagaattggtgcgtgctgtcacgttagaggcaccttttctcgacgtcctcaacactatgatggataccacgttgcccctcacactagaggaactggaggaatggggaaatccatccagcgacgagaagcataaaaattacattaagcgatattgcccctatcagaacataaaacctcagcactacccatcaatccatattacagcgtacgaaaacgacgaaagagtacctttgaaaggtatcgtttcatacaccgagaaactgaaggaggccattgcagagcacgcaaaagacactggtgagggttatcaaacgccaaatatcatcttggatatccagccaggagggaatcatgtgattgaagattcccacaagaaaattacagcccagatcaagttcctatatgaagagttaggactggatagcacgtcagtttttgaggatttaaaaaaatatctgaaattttag

SEQ ID NO: 236313 - DNA, 2184 bp, Artificial Sequence
  Description of Artificial Sequence: Synthetic coding sequence
atgcagcagaaaactaaactgtttctccaagctctgaagtactccataccacatctaggcaaatgcatgcagaagcagcaccttaatcattacaatttcgcagaccactgctataaccgcattaaactgaaaaagtaccatctgactaaatgtttgcagaataagcccaagatctctgaattggcacggaacatcccctcaagaagtttctcctgcaaggaccttcaacccgtaaagcaggaaaacgagaaacccctgcccgagaatatggatgcctttgagaaagtaaggaccaagctggaaacgcaaccacaggaagagtacgagatcataaatgttgaagtaaaacatggaggattcgtttattaccaggaaggttgctgtctggtcaggtcaaaggatgaagaagcagacaacgacaactacgaggttctatttaatctggaggagctgaagctggatcagccctttattgactgtatcagagtggccccagatgagaagtacgtagctgctaaaatccgcacggaggactccgaagctagtacatgtgtgattatcaagctgagtgatcagccagttatggaggctagctttcctaacgtgtcttcttttgagtgggtgaaagacgaagaagacgaggacgttctcttctacacattccagaggaatctcagatgccatgacgtgtaccgcgctaccttcggcgacaacaagagaaacgagcgtttttacactgaaaaggatccgagctactttgtgttcttatatctgacgaaggattccagattccttactatcaacattatgaacaaaaccacgtctgaggtgtggctcattgacggcctgagcccctgggatccccctgtgctcatccaaaaaagaatacacggcgtgttatattacgtggagcaccgggacgacgagctgtatatactgactaacgtcggtgaaccgaccgaattcaagttgatgcgtaccgctgccgacacacccgcaataatgaactgggacctcttctttaccatgaagaggaacacaaaggtgatagacctggacatgttcaaagatcattgtgtcctcttcctaaaacactcgaatctcctgtacgtcaacgtgatcggtctcgcagatgatagcgttcgctcactcaagctccccccatgggcgtgcggatttatcatggatacaaattctgatccaaagaattgtcctttccagctgtgttccccaattcggccaccgaaatactatacttataagttcgccgagggcaagctctttgaggagacgggccacgaggatcccattaccaaaacgagccgcgtgctgcgtctggaagccaaaagcaaggatggtaagttggttcctatgacagtgtttcacaagaccgacagtgaagacctccagaagaagccactgttggtgcacgtgtatggagcgtatggcatggacttgaagatgaacttccgaccagagaggcgcgtactggtggacgacggctggatactggcatactgccatgtaagaggcggaggtgagcttggccttcagtggcacgctgatgggcgtttgaccaaaaagctgaatggtctggcagatctggaagcatgtattaaaactctgcacgggcaggggttctctcaaccatctctgaccaccttaaccgccttcagcgcgggaggggtccttgcaggagccttgtgcaactccaatccggagttagtgagagccgtaactcttgaagcaccttttctcgacgtgttgaacactatgatggataccacactgccgctaaccctcgaggaactcgaggagtggggcaaccccagcagtgacgaaaagcataaaaattacattaagcgatattgcccctaccaaaatataaaacctcaacactacccatctattcacattactgcctacgagaatgacgaacgtgtgcctcttaaggggattgtgagctacactgaaaagttaaaagaagcaatcgccgaacatgccaaggatacgggtgaggggtaccaaaccccaaatatcattctggatattcagcctggcggtaaccatgttattgaggattcccacaagaaaattaccgctcaaataaaattcctgtacgaagaactgggtttagattccacaagcgtgttcgaggatttaaagaagtatctcaaattctag

SEQ ID NO: 236314 - DNA, 2184 bp, Artificial Sequence
  Description of Artificial Sequence: Synthetic coding sequence
atgcaacagaagacaaagctgttcctacaggctctgaaatacagcatcccgcacctgggcaaatgtatgcagaagcagcatctgaatcactataactttgccgaccactgctacaaccgtattaaactgaaaaaatatcacctgaccaagtgcttgcagaataaaccaaaaataagcgaactggcccgtaacattccttctcgctcattttcctgtaaggatctgcagccagtcaaacaggaaaatgagaagcctctgcctgagaatatggatgcctttgaaaaagtgcggacaaagctggagactcagcctcaggaagaatacgagattattaacgtcgaggtgaaacatggcggatttgtgtactaccaagagggttgctgccttgtaaggagtaaggacgaggaggcagataatgacaactacgaagtcttgttcaacctggaagagctgaagttggatcagccctttattgattgcatacgtgtggctcccgacgaaaagtatgtagctgctaaaatccggacagaggactccgaggcttcgacgtgcgtaattatcaaactgagtgaccagcctgtcatggaggcgtccttccccaacgtgtcttcctttgagtgggtaaaagatgaggaggacgaggatgtgctgttctacacctttcaacgtaatctccgatgtcacgatgtgtatagagctacttttggggacaataagcggaatgagaggttttacacagaaaaagacccctcttacttcgtctttttgtatttgacaaaggacagtcggttccttaccattaatatcatgaataaaactacaagcgaggtttggttgatcgacgggctcagcccgtgggacccacctgtcctgatccagaaacggatccatggtgtcctctactacgtcgagcatcgggatgatgagctctacattcttactaatgtcggcgagcctaccgagtttaagctaatgcgcacggcagccgatactcccgctataatgaactgggatctgttctttaccatgaagaggaatactaaggttatcgacctggacatgtttaaagatcattgtgtacttttcctgaaacactctaatctcctgtacgtcaacgtaatcggtctggctgatgactcagtccgaagcctgaaattgcctccctgggcttgcggtttcatcatggatactaacagcgaccctaaaaactgcccatttcagctctgttcaccaattaggcctccaaaatactacacctataaattcgccgagggcaagcttttcgaggaaacaggacatgaggacccaattacaaagacatctcgcgttctgcggctcgaagcaaagagcaaagacggtaagctcgttcctatgaccgtgttccacaaaaccgacagcgaggacttacagaaaaagcctctcttggttcatgtttacggcgcttacgggatggaccttaaaatgaactttcgaccagagaggcgagtcctcgttgacgacggttggattctcgcatattgccacgttcgcggaggaggcgagctgggcctccagtggcacgctgacgggagactcacgaagaagcttaacgggctggcagacttggaggcgtgtattaagaccttgcacgggcaggggtttagccaaccctctctgacgaccctgacagccttcagcgctggcggtgtgttggcaggcgcactctgtaactctaaccctgaactcgtgagggccgtcaccctggaggctccattcctggacgtactcaatactatgatggataccacattaccactaacgctggaagaacttgaagagtggggcaacccctcatccgacgagaagcacaagaattacattaagcgctactgcccataccaaaacatcaaaccccagcactatcccagcatccacataacagcctatgaaaacgatgaaagagtgcctcttaaaggtatcgtgagttacacagagaaactcaaagaagctattgcagagcacgcaaaggacacaggagaagggtaccagacccctaatataattcttgacatccaaccgggagggaaccatgtgatcgaagattcgcacaagaaaattaccgcccagatcaagtttctttatgaagaacttggtctggactccacttccgtttttgaggacttgaaaaaatatttgaagttttag

SEQ ID NO: 236315 - DNA, 2184 bp, Artificial Sequence
  Description of Artificial Sequence: Synthetic coding sequence
atgcagcagaagaccaaactgttcctacaggctctgaagtacagcatcccacatctgggcaagtgtatgcagaaacagcacctcaatcactacaacttcgcagatcactgttacaaccgaattaagctaaagaagtaccacctcactaaatgcctgcagaacaagcctaaaataagcgagctcgcgcgaaacataccatctaggtccttctcctgtaaagacctgcagcccgtgaagcaggagaacgaaaaacctcttccagaaaatatggatgcttttgaaaaggtcaggactaagctggagacacagccacaagaagaatatgagataatcaatgtcgaggtgaagcacggcggattcgtgtattaccaggagggctgctgtctagtgcggtccaaggatgaggaggccgataacgataactacgaagttctttttaatctggaggagctaaagctcgaccaacccttcattgattgtatcagggtggcaccggatgaaaaatatgtggccgcaaagatccggaccgaggattcggaggcatcgacatgcgtgattatcaagttaagcgatcagcctgttatggaggcatccttccccaatgtgtccagcttcgaatgggtgaaagatgaagaggatgaggatgttctgttctacactttccagcggaatctccggtgccacgatgtctaccgagccacttttggggacaacaaacgtaatgaacggttttatacagaaaaggacccatcctatttcgtattcctgtacttgactaaggacagcagattcctgacaatcaatattatgaataagactacctctgaagtgtggctaattgacggactgtcaccctgggaccctccggtcctgatacaaaagcgtattcacggggtgctgtactacgtggaacaccgcgatgatgagctgtacattctgacaaacgtcggggagcccacagaatttaagttaatgcggacagccgctgacacacccgcaattatgaattgggatctgttcttcacgatgaagcgtaatacaaaggtgatagatctggatatgttcaaggatcattgtgtactcttcctcaagcactccaatttgctgtatgtaaatgtgatcggcctagctgacgacagtgtgcgatccctcaagcttcccccttgggcttgtggttttatcatggataccaatagtgatccaaaaaactgccccttccagctgtgctctcctatccggcctcctaaatactacacctacaagtttgccgagggcaagctgttcgaagagacaggtcacgaggatccaataactaaaacctccagagtgctccgtctcgaggcgaaaagtaaagatgggaaactagtgcctatgacggtatttcacaaaacagatagcgaggatctacagaaaaagcctcttctggtccatgtgtacggagcatatggcatggacttaaagatgaactttcggccagagcgtagggtgcttgtggatgatggctggatactcgcatattgtcatgttcgaggcggtggggaactagggcttcagtggcatgcagacggacgactcacgaagaagctgaacgggctggcggatcttgaggcctgtattaagacccttcatggccagggtttctctcagcctagtttaaccacactcacagcattctcagccggtggcgtactggccggagccctttgcaacagtaaccccgagctggtacgggctgtaacactggaggccccttttctggatgtgttgaatacaatgatggacactacactgccacttactcttgaggaattggaagagtggggaaacccaagttccgatgagaagcataagaattatatcaaacgctattgcccctatcaaaatataaaaccccagcactacccctccatacacatcactgcatacgagaacgatgagcgagtcccattgaagggcatagttagttatacagagaaactgaaagaggctatcgccgagcacgcaaaagataccggtgagggctatcagactccaaacataatccttgatatccagcctggcggaaaccacgtgattgaagacagccataagaagattaccgcccagatcaaatttctttacgaggagcttgggttggatagcacatccgtgtttgaggacctaaagaagtacctgaagttttag

SEQ ID NO: 236316 - DNA, 2184 bp, Artificial Sequence
  Description of Artificial Sequence: Synthetic coding sequence
atgcagcagaaaaccaaactttttctgcaggccctgaaatactctatcccgcacctgggcaagtgtatgcaaaagcagcatctgaatcattacaacttcgctgatcactgctacaatagaatcaagctcaagaagtaccacctgactaaatgtctgcagaacaaacccaagatttccgagctcgcaagaaatattccgtcacggtcctttagctgcaaagatctgcagcctgtgaaacaagaaaacgaaaagcccttgcccgaaaacatggatgcctttgagaaggtccggaccaagttagaaacacagccgcaggaagaatatgagattatcaatgtggaagtgaagcacggcggattcgtgtattaccaagagggatgctgcctcgtgcgatctaaggacgaagaagctgataacgacaattacgaggtcctgtttaacctggaagaacttaagttggatcaaccttttatagactgcatcagagtagccccagatgagaagtacgtggccgcaaaaatccggactgaagactcagaggcctctacctgcgttattattaagctcagcgaccagccagtgatggaggcctcattcccgaatgtatctagttttgagtgggtgaaagacgaggaggacgaggacgttctgttttacaccttccagcggaacctgaggtgccacgacgtgtaccgagctacctttggcgataacaagagaaatgagcggttttataccgaaaaagacccttcctattttgtttttttatacctcaccaaggacagtcggtttttaaccattaacatcatgaataaaacaacatcggaggtctggctgattgacgggctgtccccttgggaccctcccgtgctcatacagaaacgaatccatggtgtcctgtattatgtggaacatcgggatgatgagctgtacatcttgacaaacgtcggcgagccaaccgagtttaaactgatgcgcacagcagcggacacaccagcaattatgaactgggatctcttcttcactatgaagagaaacactaaagtgatagacctcgacatgttcaaagaccattgcgtgctttttctcaagcattctaacctcttgtatgttaacgtcattgggctggctgacgacagcgttcgcagcctgaaactgcccccatgggcatgtggctttattatggacactaatagcgatcctaaaaattgcccgttccaattatgcagccctatacggcctccaaaatattacacttacaaatttgcggagggcaaactcttcgaagaaactggacatgaggacccaattacaaagacatcaagggtattgaggctcgaggctaaatctaaagatggcaaactcgtgccaatgacagtgtttcacaagaccgattctgaagatctgcagaagaagccactcctggtccatgtttatggcgcatacggcatggatcttaagatgaatttcaggcccgaaaggagggtgcttgtggatgatggctggattctcgcatattgccatgtgcgtggcggaggagagctgggcttgcaatggcatgctgacggcaggctcacaaaaaagcttaatggcttggccgatctggaggcgtgcattaaaaccttgcacggtcaagggttttcacaaccaagtctcacgacattaacagcctttagtgcaggcggagtgctagcaggggctctttgtaactcaaacccagaattagtccgcgctgttaccctcgaggccccatttctagacgtgttgaatacaatgatggacacgactctgcctctaaccttagaagaactcgaggagtggggcaacccatccagtgacgagaagcataaaaactatatcaagcgttactgcccatatcagaatatcaaaccccagcactatccttcaattcacatcaccgcatatgagaatgatgagcgggttccactgaaaggtattgtgtcctacactgagaaactgaaagaagcaattgctgagcacgctaaggatactggcgaggggtaccaaacacctaatatcatactggatatccaaccaggcggaaatcacgtgatcgaggatagccacaagaagatcaccgctcaaattaagttcctctacgaagaattgggcttggatagtacctccgtcttcgaagatctaaagaagtatctgaaattttag

SEQ ID NO: 236317 - DNA, 2184 bp, Artificial Sequence
  Description of Artificial Sequence: Synthetic coding sequence
atgcagcaaaagaccaagctctttctgcaggcattgaaatatagtatcccacatcttggcaagtgcatgcagaagcagcacctgaatcactataacttcgcagaccattgttacaaccgaattaaactgaagaagtatcacttaaccaagtgcctgcagaataagccgaagatcagcgaactcgcgagaaatataccaagccgtagcttctcctgtaaagaccttcagcccgtgaagcaagaaaatgaaaagccactgcctgaaaacatggacgcctttgagaaggtgcggaccaaactagaaacgcagccccaagaggagtatgaaataattaacgtggaggtgaaacatggtggattcgtctactaccaggaaggatgttgcctggtgcgatcaaaggacgaagaggccgataacgataactacgaagtcctcttcaatctcgaagagctcaagctggaccagccctttatagactgcatccgcgtcgcccctgatgaaaagtacgtcgccgctaagattagaacggaggactctgaggctagcacatgcgtaattatcaaattgtccgatcagccagtgatggaagcttcttttccaaacgtatctagctttgagtgggttaaggacgaagaagatgaggacgtgctcttttacactttccagagaaatcttaggtgtcacgacgtttaccgtgcaacatttggtgataacaagagaaatgagcgcttctataccgagaaagatccttcatacttcgtttttttatacctgaccaaggacagtcgatttctaacaataaacatcatgaacaagaccacaagcgaagtctggttaatcgacggtctctcaccttgggaccccccagttctcattcaaaagagaatccatggcgtgctctattacgtggagcatagagacgatgagctgtacatcttgaccaacgtgggtgaacccactgagttcaaactgatgagaaccgcagccgacacacctgccattatgaattgggacttgttcttcacaatgaagagaaataccaaagtcattgacctcgacatgttcaaggaccattgcgtcttatttctgaaacacagcaacttactttatgttaacgtaattgggctggcagatgactccgttagatccttaaagctgccaccttgggcttgcgggtttatcatggataccaattccgatccgaaaaattgcccattccaactgtgttccccgatccgacctcccaaatattacacctacaagttcgccgaggggaaactgtttgaggaaactgggcatgaagaccctatcactaagacctcccgggtcctgcgtcttgaagcgaagtcaaaagatggaaaactggtccccatgacggtgttccataagactgactcggaggacttgcagaagaagcccctgctcgtccacgtctatggtgcctacggcatggaccttaaaatgaatttcagaccggaacgccgagttctcgtggacgacggctggatcctggcatactgtcacgtgcgcggaggcggagagctcggcctgcaatggcacgccgatggaaggttgaccaagaagttgaacggcctcgcagacctggaggcctgcatcaagactctgcatggtcagggcttttcccagcctagcttaacaactctcaccgcgttctctgccggaggggtgttggcaggcgctctttgcaactcgaatccagaacttgtcagagcggtaacgctggaggctcccttcctcgatgtcctgaacaccatgatggacaccacactcccattgacactggaggagctggaagagtggggaaacccttcatccgacgaaaaacacaaaaattacattaaaaggtactgtccttatcaaaatatcaaaccacagcactacccctctatccatattacagcctacgaaaacgatgagcgggtccctttaaagggcatagtgtcttatactgaaaaactgaaagaagctattgccgaacatgctaaggatactggcgaaggatatcagaccccaaacatcatcttggatattcagccaggtggaaaccacgtgattgaggactctcacaagaagattaccgcgcagatcaaatttctctatgaggagctgggactcgactccacttccgttttcgaggacctgaaaaagtatctgaaattttag

SEQ ID NO: 236318 - DNA, 456 bp, Artificial Sequence
  Description of Artificial Sequence: Synthetic coding sequence
atgcaacagaagacaaagttgtttctgcaggcactgaagtattcgattccacatcttgggaaatgtatgcaaaaacagcatctcaaccactacaacttcgctgaccactgttataatcgaatcaaactgaaaaagtaccacttgacaaaatgtcttcagaataagccaaagatctccgaactagctcgaaatatcccctcgaggagtttctcctgcaaggacttgcagcctgttaaacaggaaaatgaaaaacccctgcccgagaacatggacgcattcgagaaggtacgtactaaactggaaacccagccacaggaagagtatgagattatcaacgtggaagttaaacacggcggattcgtatattaccaggaagggtgctgtctggtgcggtctaaagacgaggaagctgacaacgacaactacgaagtgctgtttaacctggaagaactgtag

SEQ ID NO: 236319 - DNA, 1917 bp, Artificial Sequence
  Description of Artificial Sequence: Synthetic coding sequence
atggatgcctttgagaaggtgcgaactaagctcgaaacccagcctcaagaggaatatgaaataattaatgtggaagtgaagcacggagggtttgtatattaccaagaaggttgttgtctggtgcgaagtaaagacgaggaggccgataacgacaactatgaggtcctgtttaatcttgaggagcttaaactggatcaacctttcattgactgtatacgggtcgcccctgacgagaagtacgtggctgctaagataagaacagaagattctgaggcctcaacctgcgtcatcattaagctctcagaccagcccgtgatggaggcttctttcccgaatgtgtcctccttcgaatgggtgaaggatgaggaggacgaggatgtactgttctacacattccagcggaatttgcggtgtcacgatgtttacagggctaccttcggtgacaacaaaagaaacgagagattttacacagagaaagacccctcctacttcgtgttcctatacctgacaaaggattcccgcttcttgacaatcaacatcatgaacaaaacaacctctgaagtgtggctgattgacgggttatctccatgggacccgcctgtgctcatacagaagcgtattcatggcgtgctctactatgttgagcacagagacgatgagctgtacatcctcaccaacgtgggggaaccaaccgaatttaaattaatgaggacggccgctgacacacctgcaatcatgaattgggacctgttctttactatgaagagaaatacgaaggtcatcgacctcgacatgtttaaggatcactgcgtcttgttcttgaaacactcaaatttgctctatgttaacgtgattggcctggctgacgactccgttagatcccttaagttgccaccctgggcatgtggttttatcatggataccaacagcgaccccaaaaattgcccgtttcagctgtgttcacctattcgcccaccgaaatattatacgtataaattcgccgaaggaaaattgtttgaggagactggtcacgaggatcctattactaagacgagtagagtcctgcggcttgaggctaaatctaaggatggcaagctggtccccatgaccgtgttccacaagacagactctgaagacctccaaaagaagcccctcctcgtccatgtgtacggggcatacggaatggacttaaagatgaactttagaccagagcgcagagtgctggtcgacgacggttggatcctggcttattgtcatgtcaggggtgggggagagctgggtttgcagtggcatgcagatggacgcctcaccaaaaagttgaacggtctggctgatcttgaggcatgtatcaagactttgcacggccaaggtttctcccagccttcacttactaccctgacagctttctcagccggtggggttttggcaggagctttgtgtaatagcaaccctgagctggttcgcgctgttactctggaagcaccattcctcgatgttctcaatactatgatggacaccacactcccactgactctagaggaactcgaagagtggggcaacccctcttctgatgaaaagcacaaaaattacatcaagagatactgcccgtatcagaacatcaagccccagcattaccccagcatccacatcaccgcatacgaaaatgacgaaagggtgccgctgaagggcatcgtttcttacactgaaaagttgaaggaagccatagccgaacatgcgaaagatactggggagggctaccaaacaccgaacattatactggacattcagccagggggtaatcatgtgatcgaagattcccacaagaagattaccgcccagataaagttcctgtacgaggagcttggcctggattcaacctctgtgttcgaggatctaaaaaaatatctgaaattctag

SEQ ID NO: 236320 - DNA, 1491 bp, Artificial Sequence
  Description of Artificial Sequence: Synthetic coding sequence
atgggcagaagggccctactgttactcctactgagttttctcgcaccctgggctactattgcacttcgcccagccctgcgcgctctcgggagtttgcacctaccgacgaaccctacctctctcccggctgttgccaaaaactatagcgtgctatacttccaacaaaaggtggatcactttgggtttaatacagtaaagaccttcaaccagcgctaccttgtagctgacaagtattggaagaagaacggcggatcaatactcttctacacagggaacgagggcgacatcatttggttctgcaacaacacaggcttcatgtgggatgttgcggaagagctaaaggcgatgctggtgtttgccgaacatcgatattacggagaatccttaccctttggcgacaactcgtttaaagattcacggcacctcaatttcttgacgtctgagcaggcattagcagatttcgccgaacttattaagcatcttaaacgcacaatccccggagcggaaaaccagcctgtcatcgcaataggagggtcgtatgggggtatgctcgccgcttggttcagaatgaagtacccccacatggtagttggggctctggcagcatccgcccctatctggcagtttgaggatctagtgccttgtggagttttcatgaagatagtgactacggacttccggaaaagcgggccacattgcagcgagtctattcacaggagctgggacgccataaacaggctcagcaacactggttctggcctacagtggctcactggggcattgcacctgtgtagccccctgacctctcaggacattcagcacctcaaggattggatatctgagacctgggtgaatctcgccatggttgattacccctacgctagtaattttctccagccactacctgcatggcccataaaggtggtctgtcagtatctgaagaacccaaatgtgagcgacagcctgttactgcagaacatttttcaggcactgaacgtttactacaactattcagggcaagttaaatgtctgaacatctctgaaacagctacttcttccctcggcacactaggctggtcctaccaggcttgcaccgaagtggtaatgcccttctgcaccaatggggttgacgatatgttcgaaccgcacagttggaacttaaaggaactgagtgacgattgcttccagcaatggggtgtgcgacctcgcccatcctggataaccacaatgtacggcggaaaaaacattagttcccatactaacatagtgttttccaatggcgagctagatccctggagtggcggtggcgtcacaaaggatatcacggacaccctggtggctgtcacaatcagcgaaggagcccaccaccttgatctgaggaccaagaatgctctagaccccatgagcgtgttactggctcgcagcttagaggtccgccacatgaaaaactggatccgcgatttctacgacagcgctggaaagcagcactag

SEQ ID NO: 236321 - DNA, 1554 bp, Artificial Sequence
  Description of Artificial Sequence: Synthetic coding sequence
atgggtaggagagcactgcttttgctgctgctgagcttcctcgccccatgggctaccatcgccctaaggcccgctctcagagcgctgggctcgttgcacctgcctacaaacccaactagccttcctgctgttgcgaagaattatagcgtgctgtacttccagcagaaagccctagccgctggccagctgcatatctgtattatccaattgaaccattataaaactccccttgtagatcatttcggctttaacaccgtgaagaccttcaatcagcgttacctagtggctgacaagtattggaagaaaaatggtggatccattcttttctataccggtaatgagggggatattatttggttttgcaacaatacaggattcatgtgggacgtagcggaagagctgaaggcaatgctggtcttcgctgaacaccggtattacggagaaagtttaccatttggcgataactcttttaaggatagccgccacctgaacttcctaacatccgaacaggctctagctgatttcgctgagttgattaaacacctgaagcgaaccatcccaggcgcagagaatcagccagtaatcgctattggaggatcatacggcggtatgctggctgcctggttccgaatgaaatatcctcacatggtggtgggcgcactggcggctagtgcgccaatatggcagtttgaagacctcgtgccctgcggtgtgttcatgaaaatcgtaaccactgacttcaggaagagcggcccacactgtagcgagagcatccacagaagctgggatgccataaacagactctctaataccgggagtggcttgcagtggctcacaggggctttacacttatgttctccactcacttcacaggatattcagcatctgaaggattggatttctgagacttgggtcaacctagctatggtggactatccttacgctagtaacttcctccagccactaccagcctggccaatcaaagttgtgtgtcagtatctcaaaaaccccaacgtgagtgactccctcctgttacaaaacatatttcaggcattaaatgtgtactataactactcagggcaggtgaagtgcctgaatatctcggagacagctacaagttcactggggacactgggttggtcgtatcaggcttgtacagaagtggtcatgcccttctgtaccaacggggtcgacgatatgttcgagcctcacagctggaaccttaaggaactgtcagacgattgcttccagcagtggggggtgcgacctcgaccatcatggatcactaccatgtacggaggaaaaaacatctcttcgcacaccaacattgtgttttcaaatggcgagctggatccttggagtggaggaggcgtgactaaggacataaccgatacgctcgtggctgtgaccatcagcgaaggggctcaccaccttgacctccgaactaaaaacgctctggatccaatgtcggtgctactcgcacgcagcctggaggttcgccacatgaagaattggattcgggacttttatgactctgctggaaagcagcactag

SEQ ID NO: 236322 - DNA, 1176 bp, Artificial Sequence
  Description of Artificial Sequence: Synthetic coding sequence
atgtgggacgtggccgaagaattaaaggcaatgcttgtcttcgctgaacacaggtactatggggagagtctcccttttggcgacaacagttttaaggactcccggcacctgaatttcttgactagcgaacaggcacttgcagattttgcagagttgataaagcatcttaaacggacgatccctggcgctgagaaccagccagtgattgcgattgggggtagctacgggggaatgctggccgcttggtttcggatgaagtacccccatatggttgttggcgcactggcagcttccgctcccatctggcaattcgaagacctcgtaccatgcggcgtgttcatgaagatcgttaccactgattttcggaaatctggaccccattgctccgagagcatacatcgcagttgggatgctatcaacaggttatctaataccggttccggactccagtggctaactggagcactccacctgtgcagtccactaacctcccaggatatacaacatctaaaggattggattagcgaaacgtgggtgaacctggcaatggtggattacccatacgctagtaacttcctacagcccctcccagcctggcccataaaagtagtttgtcagtaccttaaaaaccccaacgtaagcgattctctgctgttgcagaatattttccaggctcttaatgtctactacaactactccggccaagtaaagtgcttgaatatttccgaaacggcaacttcttcccttggcacattgggttggtcctaccaggcctgcacagaagtggtgatgcccttctgtaccaatggagtcgatgacatgttcgagcctcacagctggaacctaaaagagctgagcgatgactgtttccaacagtggggagtgcgaccaaggccttcctggattacaaccatgtacggcggaaaaaatattagctcgcacacaaacatagtgttcagtaacggcgagttagatccttggtctgggggtggggtgacaaaggatattaccgacactctggttgcagttacgatctctgaaggcgctcaccacctcgacctgcgaacaaaaaacgccctggatccaatgtccgtgcttctggcccgtagccttgaagtcagacacatgaaaaattggattagagacttttacgatagcgcaggaaagcaacattag

SEQ ID NO: 236323 - DNA, 1428 bp, Artificial Sequence
  Description of Artificial Sequence: Synthetic coding sequence
atggaaggtttgctcacacgctgccgcgctttgccagccttagctacctgttccaggcagctcagcggttacgtgccgtgccggtttcatcactgcgcaccacgtcgcggtagaaggctactgctatcccgggtattccagccacaaaacctgcgagaagacagagtattgtcacttcaggacaagtctgatgatctgacttgcaaatcccagcgactgatgctgcaggtggggcttatataccctgcatctccaggttgttaccaccttctgccctacaccgtgagagcaatggaaaagcttgtaagggtgattgatcaagaaatgcaggccatcgggggacaaaaggttaacatgccctccctttctcccgctgagctgtggcaagctacaaaccgctgggacttgatgggaaaggaactccttagattgcgcgatagacacggaaaggaatactgtcttggacccacccatgaggaggcaattaccgcgctgatcgccagccaaaagaagctaagctacaagcagctaccatttctcctttaccaggttactcgcaagttccgcgatgaacctagacctaggttcggtctgctgcgcggaagggagttctacatgaaagatatgtacacctttgactcttccccagaggcagcccaacaaacatatagcttggtgtgcgatgcctactgttccctctttaacaaactcgggctgccatttgtgaaggttcaagccgatgtgggtacaataggcggaacggtgtcgcacgagtttcagctgccagtggacataggagaagatagactcgcgatatgtcccagatgcagttttagtgccaacatggagaccctggacctgagccaaatgaactgtcccgcttgtcagggacccttaacaaagacaaagggcattgaggttggccataccttttacctgggtacaaagtactctagcattttcaatgcccaatttaccaatgtgtgtggtaaacctaccttggcagaaatgggatgctatgggctgggcgtcacacgcattctcgcagccgctatagaggtgctttctaccgaggattgcgtgagatggcccagcctgctggccccataccaggcatgcctgatcccacctaagaagggctccaaagaacaagctgccagcgagctgataggtcaactgtatgaccatatcacggaggctgtgcctcagctccacggcgaggtcctattagatgacagaacccacttaacaattggaaaccgtctcaaggacgcaaacaaatttggctacccatttgttattatcgcaggcaaacgagctctggaggatccagctcattttgaggtatggtgccaaaataccggcgaagtggcatttctgactaaggatggtgtcatggacttactgaccccggtgcaaacagtctag

SEQ ID NO: 236324 - DNA, 498 bp, Artificial Sequence
  Description of Artificial Sequence: Synthetic coding sequence
atggccaaaatgaacctgtctagctacatcctgattttgaccttttccctttttagccagggcatcctgctcagcgcttccaaatcaatcaggaacctggatgatgacatggtcttcaacaccttcaggttaggaaagggcttccagaaggaggataccgctgaaaagtccgtaatcgctccctcacttgagcaatacaagaatgatgagtcttcgttcatgaatgaggaggagaacaaggttagcaagaacacgggctccaagcacaacttcctcaatcatgggctacctctgaatttggctatcaagccttatctagccttgaaaggttcagtcgctttcccggctgagaatggagttcaaaataccgagtcaacccaggagaagagagagattggagatgaggagaacagtgccaagtttccaatcggacgcagggattttgatatgcttaggtgtatgctgggcagagtctaccggccatgctggcaggtgtag

SEQ ID NO: 236325 - DNA, 2598 bp, Artificial Sequence
  Description of Artificial Sequence: Synthetic coding sequence
atggctctggtcctcggctctctcctgctccttggcctgtgtggcaacagttttagtggaggacaaccaagttccacagacgcaccaaaggcatggaattacgaactgccagcaaccaattatgaaacacaggactctcacaaggccggaccaatcgggattctcttcgaactggtgcacatttttctttacgtggtgcaaccaagagatttccccgaggatactctgagaaaattcttgcaaaaagcctacgaatccaagattgattacgacaagcctgaaacagtgatcctcgggctcaaaatcgtctattatgaggctggaataattctgtgttgtgtcctcgggctactattcataatattaatgccgctggttggatacttcttctgtatgtgtcggtgttgtaataaatgtggaggagaaatgcatcagaggcagaaagagaacggcccttttttgagaaagtgttttgccatctccctcttggtgatttgcataatcattagcatcggaattttctatggatttgtggcaaatcatcaggtgcggactcgcatcaaaagatcccgtaaactggccgactctaactttaaggacttacgaaccctcctcaatgaaacccctgaacagattaaatacattctagcacagtacaacaccactaaggataaggcattcaccgatttgaacagcataaactctgtgctggggggagggattctggaccgcctgaggccaaacattattccagtgctcgatgagatcaagtctatggccaccgccatcaaagaaaccaaagaggcgctggagaatatgaatagcacactgaagtcacttcaccaacagtccactcagcttagctcgtctctgacctcagttaagacctctctgagatcatctctcaacgacccactttgtctggtacatccttctagtgagacctgcaactccatccggctatccctgtctcaattaaattccaatcccgagctacggcagctgccccctgttgacgcggaactcgacaacgtgaacaacgtgctcagaacagatctcgacggcctggtccagcaggggtatcagagcctgaatgacatcccagacagagtccagcgccaaaccactaccgtggtggctggcatcaagagagtgcttaattccataggaagtgatattgacaatgtaacccagcggctgcctatccaagacatcctgtctgcctttagcgtctacgtcaataacacagaatcttacatacaccgcaatctgcctacgttagaagaatatgacagttactggtggttgggtgggctcgttatatgttctctcctgactctgatcgtgattttctactacctgggattattatgtggcgtttgtggttacgaccggcacgccaccccgaccactagaggctgtgtgagcaataccgggggtgtgttcctgatggtaggagtcggcctaagttttttattttgttggatcttgatgatcattgtagtcctgacattcgtgttcggggctaatgtagaaaaactgatctgcgaaccctacactagcaaagaactctttcgagtgctagacacaccttaccttctgaatgaagactgggagtattacctgtcaggtaagctcttcaataaatccaaaatgaagctcacattcgagcaggtctactcggattgcaaaaaaaataggggtacatatgggacactgcaccttcagaattcattcaacatatctgagcatctcaacataaacgagcacaccggcagtatatcgagcgaattggagagcttgaaggtcaacttgaacatcttcttgctgggcgcagccggacgaaaaaacctccaggacttcgcagcatgtgggattgatcggatgaactacgacagttatctcgcacagactggaaaaagtcccgctggtgtgaatctgctgagtttcgcgtacgatttggaggccaaagccaattcattacctccaggaaaccttcggaattcactcaagcgggatgcgcagaccataaagacaattcaccagcagagggtcttgcccatcgagcaatctctgtctaccctgtatcagtccgttaaaatcttacaaaggaccgggaatggtctgctagagcgtgtgaccagaattcttgcatcattggatttcgctcaaaattttatcactaacaatacgtcctctgtcattatcgaagagacgaaaaaatacgggcgaactatcattggatacttcgagcactacctacaatggatagagttcagtatctcagagaaggtcgccagctgtaagcccgtcgctacagctctcgacacagccgtcgatgtgtttctctgtagctacatcattgacccattgaatctgttttggttcgggattggaaaagccaccgttttcctcctcccagcactgatcttcgctgttaaattagcaaaatactaccgcaggatggattcagaggacgtgtatgacgatgttgagaccatccctatgaagaacatggaaaacgggaataatggctatcataaggatcacgtgtatgggattcacaaccccgtcatgacctcacctagccagcattag

SEQ ID NO: 236326 - DNA, 2571 bp, Artificial Sequence
  Description of Artificial Sequence: Synthetic coding sequence
atggccttggtcctgggtagtctgctccttttgggactatgtgggaacagtttttccggcggacaaccatcatccactgatgcccctaaagcctggaattatgaacttcccgcaaccaactatgaaacacaggatagccacaaagctggaccgataggcatcctgtttgagctggtgcacatattcttgtacgtagtccaaccgagagattttcctgaagacactctccgaaaatttctccagaaagcctacgagtctaaaatcgactatgacaagattgtgtactatgaggccggaataattttatgctgcgtgctgggtctgcttttcatcatcctcatgcctctggtgggttactttttctgcatgtgtcgatgctgcaataaatgcgggggagagatgcatcagagacagaaagaaaatggaccatttttgcgcaagtgtttcgcgatcagcctgcttgtgatatgcataatcatttctataggtattttctatggatttgttgccaatcaccaagtccggacacgcatcaaacgctcacgtaaactggctgattcaaattttaaagacctgcgcacattgctcaacgagacccccgagcagattaagtatatcctggcccagtacaacaccacaaaagataaagcctttacagacctgaattctatcaattccgttctaggaggcggaatactggacaggcttcgtcccaacattattccagtcctcgacgaaatcaagtctatggccacggctataaaagagactaaggaggccctggaaaatatgaactcaaccctgaagagccttcatcagcaaagcacccagctttcaagtagcctgaccagcgtaaagacatccctgcggtcttccctgaatgatccactgtgtctcgtccacccctctagcgaaacctgtaactctatccgcctatcactgagccagttgaactctaatcctgagttgcgtcagctccctcccgtcgatgctgagctcgataatgttaataatgttctgcgcactgatctggatggcctggtgcagcaaggataccagagtctaaatgacatcccagatcgagttcagaggcagaccaccacggtggtggctgggatcaagcgcgtgcttaatagtataggcagcgacatcgacaacgtgacccagaggcttcctattcaagatatattgtccgctttttcggtgtacgttaacaataccgaatcctacatacacagaaacctgccaaccctcgaagagtacgactcttattggtggctcggcggactcgtgatctgctccctccttacgctaatcgtgattttctactatctagggcttctttgcggggtgtgtggttacgataggcatgctacccccaccacccgcggatgtgtgagcaacacgggcggagtgttcctgatggttggtgtgggcctgtcattcctgttctgctggatcctcatgataatcgtcgtactcacgtttgtgtttggtgcgaatgtggagaaacttatctgcgaaccctatactagtaaagagctattcagagtgctggacacaccttaccttctgaatgaggattgggagtattatctgtccggaaagctgttcaacaaaagcaaaatgaaattgactttcgaacaggtgtatagcgactgcaaaaaaaaccggggaacctacgggaccctgcatctgcagaattctttcaacataagtgaacacttgaatatcaacgagcatacgggttctattagcagcgagctcgagagcctgaaggtgaatttgaatatcttcttgctcggggctgctggtaggaaaaacttgcaggattttgctgcttgcggtatagatcgcatgaactacgatagctacttggcacagaccggcaaaagtccggctggtgtcaaccttttgagcttcgcttacgacctggaggccaaggctaactctctccctccaggaaacctgaggaactcgctcaagagagacgcccagacgataaagaccatccatcaacagcgggtcttgccaattgagcagagcctgagtactctctatcagtctgtgaaaattctgcaacggactggcaacggcctcctggagcgcgttactcgcattctggcctccttagacttcgcgcagaatttcattaccaacaacacttctagcgtcatcatcgaggaaacaaagaaatacggaaggactatcatcggctattttgaacattacctgcaatggatcgagttctcaatatcagagaaggtcgcttcctgtaaaccagtggccacggctctggataccgccgtggatgtctttctttgcagctatatcattgacccccttaacttgttttggtttggtattggcaaagctaccgtgttcctcctcccagctctgatattcgcagttaagctggcaaagtactatagacggatggatagtgaagacgtctacgacgacgttgagacgattcccatgaaaaatatggaaaatggtaacaatgggtatcacaaggaccacgtatacggcattcataacccggtgatgacaagcccaagtcagcattag

SEQ ID NO: 236327 - DNA, 2571 bp, Artificial Sequence
  Description of Artificial Sequence: Synthetic coding sequence
atggccttggtcttgggctctctactgctcctgggactgtgcggaaatagtttctctggtggccaaccctcttccactgacgccccaaaagcatggaactatgagctgcctgctaccaactatgagacacaagattcacacaaggcaggcccaatagggatactgttcgaacttgtacacatattcctgtacgttgtgcaaccacgggactttcccgaggacactctccggaagttcctgcaaaaggcatacgagagtaagatagactatgataagattgtgtactatgaggccggaatcatcctatgttgtgtgcttgggcttctgttcattatcctgatgcccctcgtcggctacttcttttgcatgtgtcgttgctgtaataaatgcggaggagagatgcatcagcggcagaaagaaaacgggcctttcctcagaaagtgttttgccatttccctcctggttatctgcatcattatcagtatcggcatcttttatggcttcgtcgccaaccaccaagtgaggacccgcattaagcgatcccggaaactagcagatagtaactttaaggatttgagaacgctcctaaacgaaacacccgagcagatcaaatacatactcgcccagtataacacaactaaggacaaagctttcaccgacctcaattcgataaactccgtgctcggtgggggaatactcgatagactgaggcctaatattatccccgtgcttgacgagattaaatccatggccactgccatcaaggaaacaaaggaggcactcgaaaacatgaacagcaccctgaaatcattacatcagcagtctacgcagctctcaagctcccttacctctgttaagacctctttgagaagctctctcaatgacccactgtgcttggttcacccgagttccgagacctgtaatagtataagactgagcctctcccaattgaatagcaacccggaactgaggcagctgcctccggtcgatgcagaactcgacaacgttaacaatgtgctaaggaccgatttggacggcctggtacagcaggggtatcaaagcttaaacgatatccccgatagggtgcaacggcagactacaactgttgtggcaggtatcaagagggtgctcaatagtatcggctctgatatcgataacgtgacacaaaggctgcccatacaagacattctgagtgctttttctgtgtatgtgaacaacactgaatcatatatacatcgcaatctgccaacacttgaggagtatgattcatattggtggctgggcggactcgtaatctgttccctcctaaccctgatcgttatattttactatcttgggctactctgcggcgtttgtggatatgatcggcacgctacccccacaactcgcggttgtgtctctaatactgggggagtcttcctcatggtgggggtgggccttagcttcctgttctgttggatcttgatgattatcgttgttttgacctttgtgttcggcgcaaacgtggaaaagctgatctgcgaaccctacacaagtaaggagttatttcgggtactggacactccctacctcctgaacgaggactgggagtactatctgtctggaaagctgttcaacaagtctaagatgaagctgaccttcgagcaggtgtacagcgactgcaaaaagaacaggggcacatatggcactctccatttgcagaactcatttaatataagtgagcacttgaacataaatgaacataccggctccatcagtagcgagctagagagcctcaaggttaacctcaacattttcttgctgggagctgcaggcagaaagaatctgcaggatttcgcagcgtgtggcattgaccgaatgaattacgactcctatttagctcaaaccggaaaatcaccagccggtgtgaatctgctgagttttgcatatgatctggaagctaaagcaaatagtctcccccctggaaacttgcgaaattcgctgaagcgggacgcccagaccatcaagacaatccatcagcagcgtgtgctaccaatagagcagtcgttatctactttgtaccagtcagtcaagattctacagaggaccgggaatggcctgttagaacgggtcacccgcatcctggcaagtcttgacttcgcacagaactttatcacaaataacacaagctcagtgattatagaggaaaccaagaagtacggtcggacaataataggatatttcgagcattacttgcagtggattgagttctcgatctccgagaaggtggcgagttgtaagcctgtcgccacggccctggacactgctgttgacgtattcctgtgtagttacatcatagatccactcaacctcttttggttcggcattggcaaagcaacagtgttcttactgcccgcactgatcttcgccgtcaagctggccaaatattacagaagaatggactcggaggacgtgtatgatgatgtggagacaattcctatgaaaaatatggaaaatggaaacaacggttatcacaaggaccacgtatatggcatccataatcctgtcatgacaagccctagccagcactag

SEQ ID NO: 236328 - DNA, 177 bp, Artificial Sequence
  Description of Artificial Sequence: Synthetic coding sequence
atggcgctggtcctgggttctctgctgctgttgggtctctgcggcaatagctttagcggtggtcagccctcgtctacagatgccccaaaggcgtggaactatgagttacctgctactaactatgagactcaggactctcataaggctggtcccattggcattctatttgaactgtag

SEQ ID NO: 236329 - DNA, 123 bp, Artificial Sequence
  Description of Artificial Sequence: Synthetic coding sequence
atggccctcgtactgggtagcctgttactgctggggctctgcggtaatagtttttcaggcggacaaccatcttctaccgacgcccctaaagcctggaattatgaacttcctgcgacaaactag

SEQ ID NO: 236330 - DNA, 2598 bp, Artificial Sequence
  Description of Artificial Sequence: Synthetic coding sequence
atggcccttgtgttgggctctctgttattgctaggattgtgcggtaacagctttagcgggggtcagccttcctcaactgatgcccctaaagcatggaactatgaactgcccgctaccaattacgagacccaggactcccataaagcgggaccgattggaatattattcgaactcgtgcatatttttctgtatgtggttcagccacgtgattttcctgaggacacgcttaggaaatttctgcagaaagcctatgaaagtaagattgactatgacaaaccagagacagtgattctgggtttgaagatcgtttactatgaagctggtattatcctctgttgcgttcttggactcctgtttataatattgatgcctctggtcgggtatttcttctgcatgtgcaggtgctgcaataagtgcgggggagagatgcatcagcgtcagaaggagaatggcccattcctgagaaaatgctttgccatcagtctactggttatatgtattatcatcagtattggaattttctacgggtttgtagccaatcatcaggtgagaactcgcattaaaagaagccggaagttggccgattccaatttcaaagatctgcgcacattattgaacgagactccagaacagatcaagtacattttggcccagtacaataccacgaaagacaaagcattcaccgatctaaactccattaatagtgttctgggagggggaattctggatagacttcgcccaaacattatccctgtgctggacgaaatcaagtcgatggccacagccatcaaggagactaaggaagcccttgaaaacatgaatagcactctgaaatccttgcaccagcagagcactcagctctctagctccctgactagtgtcaaaacttccttgaggtccagcctaaatgacccactctgcttggtacacccttcctccgagacatgtaattccattcgcctctctctgtcccaactcaactctaaccctgaactccgtcagctgcccccagtggatgcagaacttgacaatgtcaacaacgtgctcaggactgacctggatgggctggtgcagcagggctaccagtcactgaatgacatccctgacagagtgcaaaggcagaccactaccgtggttgctggcatcaagagagtgctaaattctataggctctgatatagataacgtgactcagcggctccctattcaagacatcctgagtgcgttctcagtctacgtgaataatacagagagttacatccacagaaacctccccaccctggaagagtacgactcctactggtggttaggcggactggttatatgtagcctgcttacccttattgttatattctattatcttggcctgctgtgcggggtgtgtggctatgatcgccatgctacacccaccacaagaggctgcgtatcaaacactggcggagtgttcctgatggtgggggtgggattaagctttctcttctgttggatcctaatgattattgttgtattgacattcgtatttggagccaacgtagagaagctgatctgcgaaccctacactagtaaagaactattcagagtccttgacacaccttatctccttaatgaggactgggaatattatctcagcggcaaactttttaataagtccaaaatgaaattgactttcgaacaggtttacagcgactgtaaaaaaaacagagggacttacggcaccctccacctgcagaattcattcaacatttccgaacacttaaatatcaacgagcacacgggctccatcagtagcgagctcgaatccctcaaggtgaatctgaatatcttcctgctgggggctgccggtcgcaaaaatttacaggacttcgctgcatgcggtatagacaggatgaactatgattcgtatctggcgcagacgggaaaaagcccagcaggggtgaatttacttagtttcgcctatgacctggaagccaaagccaacagcctgcctcccggaaatctcagaaacagcctgaaaagagatgcacagaccattaagacgattcatcagcagcgggtcctgccaatcgagcaatcattatccactctttaccagagcgtcaagattctgcagaggactggtaacggcctcctggagcgggtcacgaggatcctggcatcccttgactttgcacagaactttatcaccaataatacaagctccgtcatcattgaggaaaccaaaaaatatgggcgaacaatcattggctacttcgaacactacctgcagtggatcgagtttagcatatcagaaaaggtggccagttgcaaaccagtggcaaccgcactggacacagccgtagacgtcttcctgtgctcttacattatcgatcctctgaacctgttttggtttggaatcggcaaggcaaccgtgttcctactgcctgctctgatttttgctgttaagcttgctaaatactatcgccgtatggactcagaagacgtgtacgacgatgtagagaccattccaatgaaaaacatggagaatggcaataacggttatcataaggatcatgtctatgggattcacaaccctgtcatgacgagccccagccagcattag

SEQ ID NO: 236331 - DNA, 45 bp, Artificial Sequence
  Description of Artificial Sequence: Synthetic coding sequence
atggctctggtacttggcagtctgttgttgttgggtctgtgctag

SEQ ID NO: 236332 - DNA, 2505 bp, Artificial Sequence
  Description of Artificial Sequence: Synthetic coding sequence
atggccctggtcctcggatcgctcctcctgctgggcctatgtgggaattctttcagtgggggacagcctagctctactgacgctcccaaggcttggaactacgagctgcccgcaaccaactatgaaacacaggattcacacaaggctgggccaatcgggattctatttgagctggtgcatattttcctgtatgtggtgcagccacgggattttcccgaggacacgcttagaaagttcctgcagaaggcctacgaatcgaaaattgactatgataagcctgagaccgtcatcctaggattaaagatcgtgtactatgaggctggaatcatactgtgttgcgtccttggactgctgtttatcattctgatgccccttgtcggttattttttttgcatgtgccgatgctgtaataagtgtggcggagaaatgcatcagcgacagaaggagaacggacctttcttgcgcaagtgctttgccatcagcctgcttgttatttgtattatcatttccatcggaatattctacgggtttgtggccaatcaccaggttcgtacacgaattaagcgtagccgcaaattagctgattccaattttaaggatctgaggacactgctcaacgagacacctgaacagattaaatacatactggctcagtataacaccacgaaggacaaagctttcaccgatcttaatagcatcaattctgtgctaggaggcggtattttggataggctgcgcccaaatattatccccgtccttgacgaaatcaagagtatggccaccgcaattaaagagacaaaggaggcactcgagaacatgaactcaacccttaagtctctccaccagcagtccacacagctctcgagctctcttacatccgttaagacttctctcagatcatccttgaatgacccattatgtctggtgcatcctagctcggagacttgcaattccattaggctctcactgtcccagctcaactccaaccccgagctcagacagctgcccccagtcgatgctgagttggacaacgtgaacaacgtcttgcgcactgatctggatggcctggtccagcagggatatcagtcgctgaatgacattcctgatcgggtgcagaggcagacaactaccgtggtcgccggtatcaagagggtcctcaactcaatcggaagcgatatcgacaatgtgacacaaaggctgcccatccaggacattctgagtgcattctctgtctatgtcaacaacacagaaagctacatacacaggaatctgcccacactggaggagtatgacagttactggtggctcgggggtcttgtgatttgctccttgctcacactgatcgtgatattctattatttgggtctgctttgcggagtatgcggatacgacagacacgccaccccaaccacacggggatgcgtaagcaacaccggaggcgtttttctgatggttggcgtgggactttccttcctcttctgctggattctcatgataatagtggtccttacttttgtattcggagccaatgtcgagaagcttatctgtgagccctatacttcaaaagaactattccgcgtcttggacaccccatatcttctgaatgaagattgggagtattatttgtctggcaaactcttcaacaaatctaagatgaagctgaccttcgagcaggtgtactcagattgcaaaaagaatcggggaacctatggaacactgcatctacagaactcatttaatataagtgagcacctgaacattaatgagcacacaggttccatttcctctgagttagaaagcctcaaggtgaacttgaatatttttctgctgggggctgcgggtcgcaagaaccttcaggacttcgctgcttgcgggattgatagaatgaattacgattcctacttggcccagaccggaaaaagcccagctggcgtgaaccttctgagttttgcctacgaccttgaagcaaaagccaactcacttccccctggtaacctgcgcaatagtctgaaacgggacgcgcagacaatcaagacaattcatcagcaacgcgtgcttcccatcgagcagagcctttctaccctgtatcagtccgtgaagattctgcaaagaacaggcaacggactgcttgaacgcgtcacacggattctcgcgagtctggacttcgcccagaattttattacgaacaacacatcctctgtaataatcgaggaaaccaagaaatatggacggaccataatcggctacttcgagcactatctgcagtggatcgaatttagtatcagcgagaaagtggccagctgcaaacctgtcgccactgccctggacacagcggttgacgtgtttctgtgctcatatatcattgatcctctcaatctgttttggttcggcatcggtaaggccactgtattcttgctgcccgctctgatttttgccgtaaagctcgccaagtattaccgtcgcatggattcagaggatgtctatgatgatcctagtcaacactag

SEQ ID NO: 236333 - DNA, 2529 bp, Artificial Sequence
  Description of Artificial Sequence: Synthetic coding sequence
atggccctggtgctcggctccttgctactgctaggactatgtggcaattccttcagcggcggacaaccctcctccacagacgcaccgaaggcctggaattatgagttgcctgcaacaaactacgagacccaggatagtcacaaggcaggacctattggcatattgttcgaactcgtgcacattttcctgtacgtggtccagccacgggatttccctgaagatacactgcgtaagttcctccagaaggcttacgaatcgaagattgattacgacaagccagagacggtaatcttgggcctaaagattgtttactatgaggctggaataattctctgctgtgtgcttggactgctattcatcatcctaatgccactggtcggatactttttctgtatgtgccgatgttgtaacaagtgcggcggagaaatgcatcagcgccagaaggagaatggtccgttcttgcggaaatgttttgccatctcgctcctggtgatatgcattattatctccatcggcatattctatggattcgtcgccaaccatcaggtgcgcactcgaatcaagagatctcgaaaattagcagattccaacttcaaggatctccggacgctcctcaatgaaacgccggagcaaataaaatatattctggcccagtataataccaccaaggacaaggcctttactgatcttaatagcataaatagcgttctaggcggtgggatcctggataggcttagaccgaatattattccggtcctcgacgagattaaaagcatggctactgccatcaaggagaccaaggaagctctggaaaatatgaatagcaccctgaaaagtttgcatcagcagagtacccagctttcatcttctctgacgagtgtcaagacatctttgaggagttcactcaatgaccctctctgtctggtccatcccagctcggagacctgtaactctattagactctcactgtcgcagctgaactcgaacccggaactgcgccagctacctcctgttgatgcagagcttgataacgtgaacaacgtgctgaggactgatttagacggcttggtccagcaaggataccagagtctgaacgacatccctgacagggtgcaaaggcagacgaccacggtcgtggctggcatcaaaagggtcttgaacagtattggcagcgacatcgataatgttacccagaggttacctatacaggatattttatcggccttttcagtgtacgtcaataataccgagagttacatccaccggaacctccctaccttagaggagtacgacagctattggtggttaggaggattggtgatctgctccctgttgacattgattgtgattttttactatttaggcttactatgtggggtttgtggatacgatcggcatgctacacctaccacgcgaggctgtgtcagtaacactggcggtgtcttccttatggttggcgtgggcctctctttcctgttttgttggatcctgatgattatcgttgtcctaaccttcgtgtttggcgcaaacgtggaaaaactgatatgcgagccctatacctccaaggagttattcagagtgctggataccccttacttgctgaatgaagactgggagtattatttgtctggtaagctctttaacaaatcgaagatgaagttgacatttgaacaagtatattctgattgtaagaagaaccggggaacctacggcaccctgcatcttcagaacagctttaacatcagcgagcacctgaacattaacgagcacaccggatcaatctcgagcgagctcgaaagtttaaaagtaaacctgaacattttcctgctgggagctgccggtagaaagaatcttcaggactttgcagcttgtggaatagaccgtatgaactacgattcatacctcgcccagacaggtaaaagtcccgctggagtgaatttgctgagttttgcttacgatctcgaagccaaagcaaactcactccccccaggcaacctgcgtaattcccttaagcgcgatgctcagactataaagactattcaccagcagcgggtgctgcctatagagcagagcctctctaccctttaccagtctgtgaagatattacagaggactggcaacggactgttggaaagagtcactagaatcctagctagtctggacttcgcccagaacttcatcacaaacaacacttcatcggtaattatcgaagaaaccaagaagtacggaagaactattatcgggtacttcgagcactatctccaatggatagagttcagcattagcgaaaaagtcgctagctgcaagcccgtcgcaacagccctcgacactgctgtggacgtttttctttgctcttatataattgatcctcttaatctgttctggttcgggatcggtaaagccactgtcttcttactgccagcactgatctttgcggtcaagctcgccaagtactacaggcgcatggatagcgaggatgtctacgacgatgtcgagactatacctatgaagaatccatcacagcactag

SEQ ID NO: 236334 - DNA, 2493 bp, Artificial Sequence
  Description of Artificial Sequence: Synthetic coding sequence
atggccctcgttctaggctccttgctccttttggggctgtgtggcaattcctttagtggcggacagccctcctctaccgatgccccaaaggcatggaattacgagctgccagctactaactacgaaacccaggatagccataaagcgggacccatcggcatactatttgagttggtgcacatcttcctttacgtggtgcagccccgagacttccccgaggacacactacggaagttcctgcaaaaggcctatgagtccaagatcgactatgataaaatagtgtactacgaagcgggtattattctctgttgcgtcctaggtttactgtttatcattctgatgcctctggtgggctacttcttttgcatgtgtaggtgttgtaataaatgtgggggagagatgcaccaaaggcagaaagagaacggcccattcctgcgaaagtgcttcgccatctccctcttggtgatctgcatcattatcagtattggtatcttctacgggtttgtggctaatcatcaggttaggaccagaatcaaacgatcccgcaaacttgccgatagtaacttcaaagatctcaggacactcctcaacgagaccccagagcagatcaaatacattctggctcagtataatacgactaaggacaaggctttcactgatctgaattcgatcaactccgtgctcggtggcggaattctggatcggctcagaccaaatattatccctgtcctggacgagataaaatccatggctactgcaatcaaggagaccaaggaggccctggagaatatgaactccaccctcaagagtctgcaccagcagtctactcagctcagcagcagcctgacttctgtcaaaacaagtttgagaagctctctgaacgatcccttatgtctggtccacccaagttctgagacctgtaattctataaggctcagtttaagtcagctaaactctaaccctgaattgagacaactacctcctgtggacgccgaactggataacgtgaacaacgtcttgcgaacagatctcgacggcctcgttcaacaggggtaccagtcacttaatgacatacctgaccgcgtccaaagacagactaccaccgtcgtcgccggtattaagagggtgctcaactctatcggctccgacatcgataacgttacacagaggttacctattcaggacatcttaagcgccttcagcgtgtacgtgaataataccgagagctatatccaccggaatctgcctaccttagaagagtatgactcatattggtggttgggtggtcttgttatctgctctttgctgactctcatcgtgattttttattatctcgggctgctgtgtggagtttgcggctatgacaggcacgctacaccaactaccagagggtgcgtgagcaacacaggaggagtcttcttgatggttggcgtgggcctgtcgttcctattttgttggatcctgatgatcatagttgtgctcaccttcgtgtttggtgcgaatgttgagaagctaatctgcgaaccttataccagtaaggaactcttccgggtgctggataccccctacctgctgaacgaagactgggagtattacctgagtgggaagctgtttaataagagtaaaatgaagctgacatttgagcaggtttacagtgactgcaagaagaacagaggaacctacggcaccctgcacttgcagaactccttcaacattagcgaacatctgaatataaatgaacacaccgggagtatctcgtcagaactagaatccttgaaggtgaacctgaacatctttctcctgggggctgccggaagaaagaatctgcaagattttgctgcatgcggcatagacagaatgaattatgactcctacctggctcagacaggcaagagcccagcaggggtcaacctcctttcattcgcttacgatctggaggcaaaggcaaactctttaccaccgggaaaccttaggaactcactgaagcgtgacgctcaaaccatcaagaccatccaccagcagcgtgtgctcccaattgagcaaagcttaagcactctttaccaatcagtaaaaattctgcaacgcactggaaacggcctgcttgagcgggtaacgcggatcttggcgtccctggactttgcccagaactttatcacaaataatacatcttctgtaatcatagaagaaaccaaaaagtatggcagaaccataatcgggtacttcgagcactatctgcagtggattgaattcagcatctcggaaaaagttgccagttgtaaacctgtcgccactgctctcgacaccgccgtagatgtatttctatgtagctatataattgaccctttgaacctgttctggttcgggattggcaaggcaacagtcttcctgctccctgctttgatttttgccgtgaagctggctaagtactatcgtcgcatggacagtgaggatgtctacgacgactccagctgggtgacatccgtgcagtgctag

SEQ ID NO: 236335 - DNA, 681 bp, Artificial Sequence
  Description of Artificial Sequence: Synthetic coding sequence
atggaagctgagaggcgccgtcaggccgagaaacccaaaaagggacgggtggggtccaatttgcttcctgagaggcaccctgccaccggaactccaacaacgactgtagactctagtgccccaccctgcaggcgtctgccaggtgccggtgggggtcggtcccgcttcagcccgcaggggggacagcggggacggccacacagtaggaggcgccaccgaactactttctcccccgtgcagctggaacagctggaatccgccttcgggcgtaaccaataccccgacatctgggccagggagtccctcgccagggacactggactgtccgaagccagaatacaagtatggttccaaaatagacgggctaagcagcgtaaacaggagcgttccttattgcagcccttagctcacctgagcccggctgcattcagttcgtttctgcccgaaagcactgcctgcccttatagttacgcggcaccaccaccccctgtgacttgtttcccacacccctattcacacgccctcccatctcaacccagcaccggcggagccttcgccttgtctcaccagtccgaggattggtatccaacactgcatccggctcccgctgggcacctcccatgcccacctcccccaccgatgctgccgctgtctctcgagccaagtaagagttggaattag

SEQ ID NO: 236336 - DNA, 417 bp, Artificial Sequence
  Description of Artificial Sequence: Synthetic coding sequence
aacattagtctctgccctgaaatttgcttccagaaaattgaaagtcaggtgtactttgtgagagttgactccgggatccaacctggtagcgatatatcaatatactatgatcccatgataagcaaattaataacatatggcagcgatcgtaccgaagcgctgaagcgcatggccgacgccctcgacaattacgtcatccgtggagtgacacacaatatagccctcctgcgcgaggtcattatcaacagccgtttcgtcaagggcgacatatcaaccaagttcctgtccgatgtctatccggacgggttcaaaggacacatgctcacaaaatcagaaaaaaatcaattgctggccattgcttccagccttttcgtcgcattccagctgagagcacaacactttcaggaaaattcatag

SEQ ID NO: 236337 - DNA, 363 bp, Artificial Sequence
  Description of Artificial Sequence: Synthetic coding sequence
atgagtatccaattcctcggcaccgtttataaagtcaacattctaacccgcctggcagcagaattaaacaagtttatgctcgagaaggtgacagaagatacttctagtgtgctgcggtctccgatgcccggtgtagttgtggccgtatcagtgaagcctggggatgccgcaacatcatctctttctgtcgaaatttgcctgttctggactttccaggttgcagaaggacaagaaatatgcgttatcgaggctatgaaaatgcagaactcaatgaccgcaggaaaaaccggaactgtcaaaagtgtgcattgtcaagcaggagataccgtcggcgagggagatctgctggtagaactcgagtag

SEQ ID NO: 236338 - DNA, 2046 bp, Artificial Sequence
  Description of Artificial Sequence: Synthetic coding sequence
atggccggtttttgggtaggaacagcccctctcgtggccgctggcaggcgtggtcgctggcctccacaacagctgatgttgagcgcagctctacggaccctgaagcatgtgctgtactacagtcgccagtgcctgatggtaagccggaacctggggtcggtgggttatgaccctaatgaaaaaacgtttgataagattcttgtcgccaacaggggcgaaatcgcctgccgcgtcataaggacctgcaaaaagatgggcataaagactgtagccatccacagtgacgtggacgcttcctccgtgcatgtgaagatggccgatgaagccgtgtgcgtcggtcccgctcctacctctaaaagttatctcaatatggatgcaatcatggaagcaattaaaaaaactagggctcaggcagtgcaccctggctatggcttcctgagcgagaacaaagagtttgctagatgcctcgccgctgaggatgtggtgttcatcggcccagacactcacgccatccaggccatgggggacaagatcgaatcgaagcttctggccaagaaagcagaagtgaacaccatcccaggctttgatggggtagtgaaggacgcagaagaagcagtccgaattgctcgggaaatcggatatcctgtgatgatcaaagcttccgcgggaggagggggtaaaggcatgcgcattgcctgggacgacgaggagacgcgggatggatttcgactgtcctctcaggaggcagcgtcttccttcggagatgacaggctccttatcgagaagttcatcgataatcccagacacatagaaatacaggtactgggggataagcatgggaatgccctttggttaaatgagagggaatgcagcattcagaggcggaatcagaaggtggttgaggaggctccatctatcttcctggacgctgaaacccgccgtgccatgggcgaacaggctgttgccctggctcgtgccgtgaaatatagttcagctggtacggtagaattcctggtggactctaaaaagaacttttactttcttgaaatgaacacaaggctgcaggtggagcatcccgtcaccgaatgtataactggtttagacctcgtgcaggaaatgattagagtcgcgaaagggtatccgttgagacacaaacaagcagatattaggataaacggatgggccgtggaatgcagagtctatgctgaagacccctataagagcttcgggcttccaagcattggcagactgtcacagtaccaggaacccttgcatctgcctggggtacgggtagattcagggatccagcctggctctgatatctctatttattatgaccccatgattagcaaactgatcacttatggctcggacagaaccgaagcgttgaaaagaatggcagatgccctcgataactatgtcatccgcggtgttacccacaacatagcactactgcgtgaggtgataattaattctcgcttcgtcaaaggcgacatctcgactaagttcctgtccgatgtctatcctgacggattcaagggacacatgttaaccaaaagcgaaaagaatcaacttctggccatcgcctcctctttgtttgtggccttccagttgcgtgcacagcacttccaggagaattcccgcatgcccgttatcaagcctgatattgctaattgggagttgtccgtcaaactgcatgacaaagttcatacagtggtagcctcaaacaacggtagtgtgttcagtgtagaagtggacgggtcgaagcttaatgtcacatctacttggaatctggctagcccccttctcagcgttagtgtggatgggacgcaacgcacggtgcaatgcctcagccgcgaagcaggcggaaatatgtccatacagttcttaggaactgtggtggctgaggggcaggaaatttgcgttatcgaggccatgaagatgcagaactccatgaccgcagggaagacagggactgtcaaatccgtccattgccaagccggagataccgtaggtgagggcgacctgcttgtggagctggagtag

SEQ ID NO: 236339 - DNA, 2187 bp, Artificial Sequence
  Description of Artificial Sequence: Synthetic coding sequence
atggccggtttctgggtaggcactgcccctctcgtggcagcaggtagacggggacgctggccacctcagcagttaatgctctctgctgccctgagaacattaaagcacgtgctatattactccagacagtgcttgatggtgtcacgcaatctgggaagtgtgggctatgatccaaatgagaaaactttcgacaagattctggtggcaaatagaggcgaaatcgcttgtcgggtcatccggacctgtaaaaaaatgggtatcaaaaccgtagccattcattctgacgttgatgcttcctccgtgcacgtgaagatggccgatgaggctgtctgcgtaggccctgcgcctacatctaagagctacctcaatatggacgccattatggaggccataaaaaagacgagagcccaggcagtgcatcctgggtacgggttcctaagtgaaaacaaggagtttgcacggtgtttggccgctgaagacgttgttttcatcggacctgacacgcacgctatccaggccatgggcgacaagattgagagcaagctcctggcaaagaaagcagaagtgaatacaatccctgggttcgacggagtggtgaaggatgctgaggaagctgttaggattgcgagagagataggctacccggttatgattaaggcttctgccggtggtggaggcaaaggaatgcgcatcgcctgggatgacgaagagacgcgggacggcttccggctgtcctctcaggaggcggcatcgagcttcggcgatgacaggctgctgatagaaaagtttattgataacccaagacacattgagattcaggtcctcggtgacaaacatgggaacgcactatggctgaatgaacgagagtgttctatccaaagacgcaaccagaaggtggtggaagaggctccctcgatctttttagacgccgagacacgtcgagccatgggggagcaggccgtggccctggccagagcggtgaagtattcttctgcaggcaccgtggagtttctcgttgactccaagaagaatttctactttctcgagatgaacactagactgcaggtggaacacccagtgactgaatgcataactggtctggatctcgtgcaagaaatgattagggtggcaaagggctacccattacggcataagcaggccgatattaggatcaacgggtgggccgtagaatgccgtgtgtacgccgaggatccttacaagtcatttggactgccctccattgggcgtctgagccagtatcaggagccgcttcacttacctggggtgcgcgtggactccggcatccagcccggtagcgatatctctatttactatgaccctatgatctccaagttaattacatacggatctgaccggactgaggctttgaagcgtatggccgacgctctggacaactacgtaatcaggggagtgacccacaatatagccctcctgcgtgaagtaattattaatagtaggtttgtgaagggtgatatttcaactaaatttctcagtgatgtgtacccagatggttttaaggggcacatgttaacgaagagcgagaagaatcagctgttggccatcgccagtagtctgtttgtggcgttccagctgagagcacagcacttccaggagaactctaggatgcccgtgatcaaacccgacattgcaaactgggaactcagcgtgaagctgcatgacaaagtgcacaccgttgtggcctcaaacaacggttctgtattttctgtcgaggtggatggttccaaattgaacgtgactagtacctggaacctcgccagtcctctcttatcagtcagcgtggatggaactcaaaggaccgtgcagtgtctaagccgcgaagcaggtggaaacatgtctatacaattcctgggaaccgtgtacaaggtgaacatcctcactcgactagccgcagagctgaataagtttatgctcgaaaaggtcacagaagacaccagctccgtgctgcggagtccaatgcctggggtggtggtggctgtgtcagtgaagccgggagacgccgtcgccgagggccaggaaatttgcgtgatcgaggcgatgaagatgcagaattccatgactgctggtaaaaccgggacagtgaagtccgtccattgccaggccggagataccgtgggagaaggcgatctgctggtagagttagagtag

SEQ ID NO: 236340 - DNA, 2109 bp, Artificial Sequence
  Description of Artificial Sequence: Synthetic coding sequence
atggctgggttctgggtgggaaccgcgcctctggtcgctgctgggaggaggggtcgttggccgccacagcagttgatgctgtcagcggcactacggactttgaagacattcgataaaatcctggtagccaatcggggagaaatcgcctgcagagttatccgcacttgtaaaaaaatgggcataaaaacagtggcaatccattctgatgttgatgcttcctccgtgcatgtgaaaatggccgacgaagctgtttgcgtgggcccagcccctacctcaaagtcatacctgaacatggacgcaattatggaagccatcaaaaagacaagggcgcaggcagttcaccctgggtatggattcctgagcgaaaataaggaatttgcacgttgcctggctgctgaggacgtggtgttcataggaccagatacccatgccattcaggccatgggcgacaagatcgagtcaaaactcctggcaaaaaaagccgaggtgaatactatccctggattcgatggagttgtgaaggacgccgaggaggcagtaaggatcgccagagaaataggctacccagtaatgatcaaagcctctgctgggggaggcggtaaggggatgagaatcgcatgggatgacgaggagacaagagacggttttcgactgagtagccaggaggcagcatccagctttggagatgaccgactcctgatagagaagttcatcgataaccccagacacattgaaatccaagtgcttggagacaagcatgggaatgcactctggcttaacgaaagagagtgctccatacagcgcagaaatcagaaagtggtagaggaggcacccagtatttttctggacgccgagacccggagagctatgggcgagcaagccgtagcccttgcacgcgcagtgaaatattcatcggcaggcactgtcgagttcctcgtggactcaaagaaaaatttctacttcttggaaatgaacacgcgcctgcaggtagaacatcccgttactgagtgtatcaccgggctggacctcgtgcaggaaatgatccgcgttgccaagggctaccccctccgtcataaacaagctgacatcagaatcaatggctgggccgtggaatgtcgcgtatacgccgaagatccctataagagctttggtttaccatctattggacgactgtctcagtatcaagagccccttcatctccctggcgtaagagtcgattccggcatccaacctggctccgacatcagcatctattacgaccctatgattagcaagttgatcacctacggctcagatcgcaccgaggccctgaagagaatggcagatgcattggacaattatgtgattagaggtgttactcataatatcgctctgttgcgcgaagtaattatcaactcgcgctttgtaaagggggacatctccaccaaattcttgagtgatgtctacccggatgggttcaaaggccacatgcttaccaaatccgaaaagaatcagctgctggcaattgcatcttcactgttcgtcgcttttcagcttcgagcccagcatttccaagagaatagccgtatgcccgtcataaagcctgatattgcgaactgggaactgagcgtcaaactgcacgacaaggttcacaccgtggtggcatctaataatggcagcgtgttttcagtggaagttgacggcagcaagctgaacgtcacgtcaacctggaacctggcgagtccactcttgagtgtctcggtcgatggtacccagcgcactgtgcagtgtctgtcccgcgaagcagggggaaacatgtccattcagttccttggaacggtatataaagtcaatatcttgactcggctcgccgcagaactgaacaaattcatgctggaaaaagtgaccgaggacacaagctccgtgctgagaagcccaatgccgggtgttgtcgtcgctgtttccgtgaagccaggtgatgctgtcgccgaaggccaggagatctgtgtcattgaagcaatgaaaatgcagaacagcatgaccgccggtaaaacaggtactgtcaagtccgttcactgtcaagctggcgacaccgtgggcgaaggagatctgctcgtcgagttggagtag

SEQ ID NO: 236341 - DNA, 255 bp, Artificial Sequence
  Description of Artificial Sequence: Synthetic coding sequence
taaaattgggagctaagcgtgaagctacatgacaaggtgcacacagtcgtagctagtaacaacgggtctgtgttcagcgttgaggtggacggatcgaaactgaatgtgacttcaacttggaaccttgcttccccactcctttctgtgagcgttgacggcacacagagaaccgtgcagtgcctcagccgagaagctggcggaaatatgtccattcaattcctggggacagtcccatggcgaaaattgcttgactag

SEQ ID NO: 236342 - DNA, 336 bp, Artificial Sequence
  Description of Artificial Sequence: Synthetic coding sequence
tacaaagttaacatccttacccgcctcgctgcagaactgaacaaattcatgctagaaaaagttacggaagatacaagttcagtgctgaggtcacccatgcctggggtggtcgtggccgtgtcggtcaagcccggagatgccgcaacatctagcctcagcgtcgaaatttgtctgttctggacattccaagtggctgagggacaggagatctgtgttatcgaggccatgaaaatgcagaactcaatgacggccggtaaaaccggaacggttaagagcgtgcactgtcaggccggtgatacagtgggcgagggcgacctgctcgtcgaattagagtag

SEQ ID NO: 236343 - DNA, 405 bp, Artificial Sequence
  Description of Artificial Sequence: Synthetic coding sequence
tagatgcccgtcattaagcctgatattgccaactgggagctttctgtgaaactgcatgataaggttcacacagttgttgcctccaataacggctccgtgttttctgtggaagttgatggttctaagcttaacgtcacttcaacctggaatttggcatctcccctcctcagcgtctccgtggacggcacacagagaacggtgcagtgtctgtcacgggaggccggagggaatatgtccatccagttcctaggaacagtggtggctgagggacaggagatttgcgtgattgaagctatgaagatgcagaatagtatgacagctgggaaaaccggaaccgtcaaaagcgtgcactgccaagcaggggacacagtgggagaaggcgatctcctggtggagctggaatag

SEQ ID NO: 236344 - DNA, 309 bp, Artificial Sequence
  Description of Artificial Sequence: Synthetic coding sequence
tctgacgtgtaccccgacgggtttaaaggacacatgttaactaagtcagagaagaaccagttattggccatcgctagcagcctgttcgttgcctttcagcttagggctcagcacttccaagagaacagcaggatgcctgtgatcaaacctgatatagccaactgggaactgagtgtgaaactccatgacaaagttcacaccgtggtggctagtaataatggcagtgtcttcagcgttgaggtcgacgggagtaagttgaacgttacctccacatggaatttattcgccttgatcgtgtgtcagcggtag

SEQ ID NO: 236345 - DNA, 1620 bp, Artificial Sequence
  Description of Artificial Sequence: Synthetic coding sequence
atggcggctgcactgagggtggcagcagtaggtgcgagactttctgtcctagcctctggtctacgggcagcagtccgctctctgtgttctcaggcaactagcgttaacgagcggatagaaaataagcgcagaacagccctactgggcggaggacagcgcagaatcgatgctcagcacaagagagggaagctcactgcacgggagcgtatctcactactccttgatcctggctctttcgtggagtccgatatgttcgtcgaacaccgctgtgccgactttggcatggccgctgataagaacaaattccctggagacagcgtggtcaccgggagggggcgaatcaacggaagactggtgtacgtcttcagccaagacttcactgtgttcggaggttcactaagcggggctcatgcccaaaaaatatgtaagatcatggatcaggctatcaccgtgggcgcacctgttattggtctcaatgatagtggaggcgctcggattcaggaaggtgtggagagtctggctggatacgccgacatatttctgagaaacgtcactgcgagcggggtaattcctcaaattagtctaatcatggggccatgtgctggcggagcagtttattcccccgctctaacggattttacattcatggtgaaggatacctcctatctgttcattacaggcccagacgtggtgaagagcgttaccaatgaagatgtcacgcaggaagagctggggggtgccaaaacacatacgactatgagcggcgtggcgcacagagctttcgagaatgacgtggatgcactgtgcaacttgcgcgacttctttaattacctgccactgagctctcaggatcctgctcctgtgagagaatgccatgacccatccgatcgcctggttccagagcttgacaccattgtccccctcgaatcgaccaaagcctataatatggtggacattatccactcagtggtcgatgaacgcgaattttttgaaatcatgcccaactatgcaaaaaacatcattgtggggtttgcacgcatgaatggccgtacggtggggattgtaggcaaccagccgaaggtcgcatccggctgcctggacatcaactcatctgtcaaaggggctcgtttcgtgcggttttgcgacgcctttaatatccctctcattactttcgtggacgtacccggtttccttccgggaacggcgcaggaatacggagggatcattcggcacggagcgaagttactttatgcatttgccgaagccaccgtgcccaaagtgacagtgatcacacgcaaagcatatgggggtgcctacgacgttatgtcctcaaaacacctgtgtggcgacacaaactacgcttggccaactgctgagatagcagtcatgggagctaaaggggcagtagagattatctttaagggacatgaaaacgtagaggccgctcaggctgagtatatcgaaaagttcgcaaatccattcccggcagctgttcgtgggttcgttgatgacatcatccagcctagctcgaccagagccagaatttgctgcgacttggatgtgctggctagtaagaaagtacaacggccttggcgaaaacacgcaaacatccctctgtag

SEQ ID NO: 236346 - DNA, 1680 bp, Artificial Sequence
  Description of Artificial Sequence: Synthetic coding sequence
atggcggcagccctgagagttgccgcagtcggagccaggttatcagtgttagcatctggcctgcgcgctgcagtgcggtctctttgtagtcaggctacttcggtgaatgaaaggatagaaaataaacgaaggaccgctctgcttggtggaggacagagacgcatcgatgcccagcacaaacgtggaaagctgacagctcgcgagagaataagcctgctcctcgaccctgggagttttgtggagagcgacatgtttgtagagcatcgttgcgcagattttggaatggccgctgacaagaacaagtttccgggagatagcgtcgtaaccggcaggggtcggattaacggcagactcgtgtatgtgttctcccagcagattattgggtgggctcagtggttacccctggtaatatcggcactttgggaggccgaagacttcaccgtttttggcggaagtctgagcggcgctcacgcccagaagatttgcaagattatggatcaagcaataactgtcggggctcccgtgataggtctgaatgatagcggtggcgcacggatccaagaaggagtcgagtcactcgcaggatatgccgacattttcctgagaaacgtgacagcgtccggcgtaataccgcagatctcactcatcatgggcccatgcgccggaggagcagtctatagtcctgcgttaacagacttcaccttcatggtcaaggataccagctacttgtttataacgggaccggacgtagtgaagagcgtgaccaacgaagacgtgactcaggaggagctggggggagcaaaaactcatactacaatgagcggcgtggcgcacagggcctttgaaaacgacgttgatgcactttgcaacctacgggatttctttaactatttacccttgagttctcaggaccccgctcccgtgcgagaatgtcacgatccatctgatcgtttggtgcctgaactggataccatcgtgcccctggagagcaccaaggcatacaatatggtggatattatccactctgtggttgacgagagggaattctttgaaattatgcccaattatgcaaagaacattattgtcgggtttgcacgtatgaatggacgcactgtgggaatcgtcggtaaccaacctaaagtggcctccggctgcttggacattaattccagtgtaaagggcgctcgatttgtacgcttttgcgatgcttttaatatcccgctgatcacatttgtggatgtacctggcttccttccgggaaccgctcaagagtatgggggtattatcagacatggagcaaaactgctgtacgcatttgctgaggccactgtaccaaaggtcaccgttattacgcggaaagcctacggaggagcctacgacgttatgagcagcaaacacctttgtggggatacgaattatgcttggccgaccgcagagatcgctgtgatgggcgctaagggtgccgtcgagatcatttttaaaggccatgagaacgtcgaagccgctcaagcggagtacattgagaagttcgccaatccctttcctgcagccgtgagaggattcgttgacgacatcatccagccgtctagtaccagggcccgtatctgctgcgatctggacgtgctggcaagtaagaaggtacagcgcccatggcgaaaacacgctaatattccactctag

SEQ ID NO: 236347 - DNA, 1653 bp, Artificial Sequence
  Description of Artificial Sequence: Synthetic coding sequence
atggctgcggcactgcgcgtcgctgcagtgggcgcacgcctctcagtattagcatccggcttgagggccgctgtgcggtccctctgttcccaagccacatccgttaatgaacgcatcgagaataagcgcaggaccgcactgttgggtggtggccagaggaggattgatgcccaacacaagcggggtaagctaaccgctcgggagaggatcagtcttctcctggatccagggtctttcgtggagtctgacatgtttgtcgagcaccgatgcgctgatttcggtatggccgcagataaaaacaagtttcccggagatagcgtggtgacaggcaggggaagaatcaacggtcgacttgtgtatgtgttttcccaggatttcacagtgtttggaggcagtcttagcggcgcacacgctcagaagatctgcaaaattatggatcaagccatcacagtgggagctcccgtgataggactgaacgattccggaggtgcgagaatacaagagggagtggaatcactcgcaggatatgccgacatctttttacgaaatgtgaccgcatccggcgttattcctcaaatctcattgatcatgggaccctgtgctggaggcgctgtgtattcacctgcccttacagatttcacttttatggtcaaagatacaagctatttgtttattactggaccggatgttgtgaagagtgttaccaatgaagatgtaactcaggaggagttggggggtgctaagacccatactaccatgagcggcgtggcccaccgtgctttcgagaacgacgtggacgctctctgtaacctccgggactttttcaactatctgccactgtcttctcaagacccagctcctgttcgagagtgtcatgacccatccgaccggcttgttcctgagctcgatacaatcgttcccttggagagcacgaaggcctataacatggtggatatcattcacagtgtggtagacgaaagggagttctttgagattatgcctaactatgccaaaaacatcattgtgggatttgctcgaatgaacgggaggactgtgggcatcgtgggcaaccaacccaaagttgcctccggttgccttgatatcaactcatctgttaagggggctaggttcgtccggttttgtgacgcatttaatattcctctgatcactttcgtggatgtcccgggatttttacccggaacggctcaggaatacggcggtataattagacatggggctaaactgctctacgcctttgctgaagccacagtacccaaggtgacagttattacccgcaaagcttatggaggcgcttacgatgtgatgtcatcaaaacacttgtgcggagacaccaattacgcttggcccactgctgagatcgccgtgatgggggcaaagggagccgttgaaataatctttaagggtcacgagaatgtggaagccgctcaggctgaatatatagaaaaattcgccaacccttttccggcagctgtcagaggctttgttgatgacattatccagccgtcctcgacaagagcaaggatctgttgtgacctggatgtgctcgcttccaagaaagtaagggttcaagaggtctttcaccaggtggtgcagagtggacatagggatggcagaggtgcagtgagatggtag

SEQ ID NO: 236348 - DNA, 387 bp, Artificial Sequence
  Description of Artificial Sequence: Synthetic coding sequence
atgtccctaaggttagataccacaccctcctgcaattctgctaggcctctgcacgcattgcaggtgctcttactcctatccctgctgcttacagccctggcttctagtaccaaggggcagacaaaacgcaacctggctaagggaaaggaagagtctctcgattctgacctgtatgcagaactgagatgtatgtgcatcaagacgacaagtggcattcaccccaagaacatccagtctttagaggtgattggtaagggaactcactgcaaccaggtcgaggttatcgccacgctaaaggacgggcgaaagatttgtctggacccggacgcaccacgcatcaagaagattgtgcaaaaaaaattggcaggcgatgaatctgcagactag

SEQ ID NO: 236349 - DNA, 2262 bp, Artificial Sequence
  Description of Artificial Sequence: Synthetic coding sequence
atggagaggcgggcttggtcgctccagtgtactgcctttgtgcttttttgcgcctggtgcgctcttaacagcgcgaaagccaagcgccagttcgtgaatgagtgggccgcagaaatccctggcggacccgaggctgctagcgccatcgccgaagaattgggatacgacctgctgggccagataggttccctcgaaaaccactacttgtttaagcacaaaaatcatccgagaaggagccgcaggtctgcttttcacatcactaaacgtttgtcagatgacgatcgggtcatctgggccgaacagcagtatgaaaaggagaggtcgaaacggtcagccttaagagatagcgcgctcaatctgtttaatgaccccatgtggaaccagcagtggtatctccaggacacgcgcatgaccgccgctctgccaaagttggacctacatgtcattcctgtctggcagaaaggtatcaccggcaaaggtgtagtgattacagtactcgacgacggtcttgaatggaaccataccgatatttatgctaactacgatcccgaagcaagctacgactttaacgataacgaccacgatccttttcctcgctatgaccccacaaacgaaaacaaacacggcacgagatgtgctggggagatcgcaatgcaggcaaataaccacaaatgtggggttggagtggcttataatagcaaagtcggaggcatccggatgctggatggcatcgtcactgacgcgatcgaggcgtcatctattgggttcaatcctggccatgttgatatctattcagcatcctggggcccaaacgacgatgggaagaccgtcgaagggccagggagactggcgcagaaggcctttgaatatggagtcaaacagggcagacagggcaaaggcagcatatttgtttgggccagtggcaacggtgggcgacagggcgataattgcgattgcgacggatataccgacagcatatacaccatttccatttcctcggcctctcaacagggcttatccccatggtacgccgagaagtgtagtagcactctggcaacatcttactcaagcggcgactataccgatcagagaatcacatcagccgatcttcataatgactgcacggagacccatacaggtacaagcgcatcagccccactcgcagcgggtatcttcgctctggcactggaagccaatcctaacctgacctggcgcgacatgcagcatctggtggtttggaccagtgaatacgacccactcgctaataatcccggttggaaaaagaacggcgcagggctgatggtgaattcccgcttcggcttcggacttcttaacgccaaggccctggtcgacttggccgaccccagaacttggcggtctgtgccagagaaaaaggaatgtgtggtcaaggataacgacttcgagccacgggcactgaaagcaaatggtgaggttataatcgaaataccgacccgagcatgcgaaggccaggagaacgccattaagtctctcgagcacgttcaattcgaggccactatcgagtactctcggagaggcgatctacacgtcaccctgacttccgccgctggcacctccacagtgcttctagcggagagggagcgagatacctcaccaaatggctttaagaattgggattttatgagcgtgcacacttggggggagaatcccatcgggacttggacactacgaattactgatatgagcgggcgtatccagaatgagggacgaattgtcaactggaaattgatactgcatggcacctcatcccagcctgagcacatgaagcagccaagagtctacacatcctataataccgtgcagaacgacaggcgcggtgtagagaagatggtggaccctggggaggagcagcctacacaggagaatccaaaggagaacaccttggtgtcgaaatctcccagttcctcctctgtgggcggtagaagagacgagctggaggaaggcgcaccatcccaggccatgctgaggttgctgcagagcgccttctctaaaaatagcccacccaaacagtcgcccaagaagtccccttccgccaaactcaacattccttacgaaaatttctacgaagctctggaaaaactcaataaaccaagccagttgaaggacagcgaggactcactatataacgattatgtagacgtgttttacaacacaaagccctacaagcaccgagatgaccgattactgcaggctttggtggatatccttaacgaggaaaactag

SEQ ID NO: 236350 - DNA, 477 bp, Artificial Sequence
  Description of Artificial Sequence: Synthetic coding sequence
atggagcgccgtgcatggagcctccaatgtactgcattcgttctgttctgtgcttggtgtgcgctgaatagtgccaaagcgaagcgccagttcgtcaacgagtgggccgctgaaatccctggaggaccggaagcagcatccgctatcgctgaggaactggggtacgatctcctgggccaaattggatcactggagaaccactacctgtttaagcataagaaccaccccaggcgatcccgacgcagcgcctttcacatcaccaaacgtctgtcagacgatgaccgcgtgatctgggctgagcagcagtatgaaaaagagagatccaaacgttcggccttaagggattccgcactgaacctgtttaacgacccaatgtggaaccagcagtggtatctgcaggacacacgcatgacagcagccctgcccaaattggacctgcatgtgatcccggtttggcagaaaggcattactggatag

SEQ ID NO: 236351 - DNA, 2121 bp, Artificial Sequence
  Description of Artificial Sequence: Synthetic coding sequence
atgggtaagggaagcattagctttcttttcttctcccaaattgggtcactggagaaccactacctgttcaaacataagaaccaccctaggagaagtaggcgctcagcatttcatataaccaaacggttaagcgatgacgatcgtgtcatttgggctgaacagcagtatgagaaagagcgcagcaaacgttctgccttgagagatagcgcactgaatttattcaatgaccctatgtggaaccaacagtggtacttgcaggatacacgtatgacagcagccttgccaaaactagacctccatgtgatcccagtttggcaaaagggaattaccggcaaaggtgtggtgatcaccgtccttgacgatggactggaatggaaccatactgatatctacgccaactacgacccagaggccagctatgactttaatgataatgaccacgatccctttcccaggtatgatcccaccaatgaaaacaagcacggtactaggtgcgccggagagattgccatgcaggctaacaaccataaatgcggcgtcggtgtcgcttacaactcaaaagtgggcggtatccggatgctggacggaatcgttacagatgcaattgaagccagctctatcgggttcaaccccggacacgtcgatatctattccgcctcatgggggcctaacgatgacggcaagactgtggagggtccagggaggttggcccagaaggcattcgaatacggggtaaagcagggtaggcagggaaaaggtagcatcttcgtctgggcctctggaaacggaggcaggcaaggcgacaattgtgattgtgacggttataccgacagcatctatacgatctctatatcgagtgcctctcagcaggggctgtctccttggtacgccgagaaatgcagttccacattggctacgtcctactcatccggggactatacggatcagcgcattacatcagctgaccttcacaacgattgtacagagacacatactgggacttcggcctctgcgccacttgctgctggcatctttgctttggctctggaggcgaatcccaatctgacttggagagacatgcagcacttggtcgtgtggacctctgaatacgatcccctcgccaacaatcccggttggaagaagaacggggcaggactgatggtgaactcaaggtttggatttggcctcctaaatgctaaggccctggtagatttggctgacccacgcacctggagatcggtacccgaaaagaaggagtgcgtggtgaaggacaacgactttgaaccccgagccttgaaggcgaacggcgaagttatcattgagatccccacgagggcttgtgaggggcaggaaaatgcaataaagagtctcgagcacgtgcagttcgaagctaccatagaatactctaggcggggagacctgcatgtaacactcacttctgcggctggaacaagcaccgtcctcttggcagagcgggaacgcgatacaagcccaaacggattcaagaactgggactttatgtccgttcatacttggggtgaaaatcccataggtacgtggacactgcggatcaccgacatgtctggccgaatacagaatgaggggcgtattgtcaactggaagctgatcctgcatggtacttcgtcacagccagagcacatgaaacagcctcgggtttacacaagttacaatacagttcaaaatgatagaagaggcgttgagaaaatggtcgatccaggcgaagagcaacctactcaggagaaccccaaggagaatactctggtgagtaaatcaccatcttcttcttctgtgggcggaaggagagacgaactggaggagggagctccctcacaggccatgttgaggctcctccagagcgctttttctaaaaattcgcctcccaagcaaagccctaaaaaatcaccttctgcgaaactgaacataccttacgagaacttctatgaggccctggagaaattgaacaaaccaagtcaactcaaagattcagaagacagtttatataatgactatgtcgatgtgttctacaacaccaagccatacaaacaccgagacgacagactgcttcaggccctggttgacatcctgaatgaggaaaactag

SEQ ID NO: 236352 - DNA, 798 bp, Artificial Sequence
  Description of Artificial Sequence: Synthetic coding sequence
atgccactgcccgtggcactgcaaactcgcttggcgaaacgtgggatcctaaagcatttagaacccgaaccagaggaagagattattgctgaggactatgacgacgaccccgtggactacgaggccacgagactggaaggtctgccaccaagttggtataaggtttttgacccctcttgcggtcttccctactactggaatgcagatactgacctcgtatcctggttaagcccccatgatccaaattcggtggtaactaaatctgccaaaaaactcagatctagtaacgccgacgctgaagagaagctggatagatctcatgacaaatcagatagaggtcacgacaaaagcgaccgtagtcatgagaagctcgatcgagggcacgacaagagcgaccgtgggcacgacaagagtgatagggacagagaaaggggatacgacaaggttgatcgtgaacgggagcgggaccgcgagagagacagagacaggggctacgataaggcggaccgtgaagaagggaaggagcgcagacaccatcggagggaggagttggccccatatccaaaatcgaagaaggctgtcagccgcaaagacgaggagctggacccaatggaccccagctcttactcagacgcgcctaggggaacttggagcactgggcttccgaaacggaatgaggccaagactggcgctgataccacagctgccggacctttgtttcaacagcgaccctatccatcccccggagcggtgctcagagctaatgcagaggccagccgcacaaaacagcaggattag

SEQ ID NO: 236353 - DNA, 1917 bp, Artificial Sequence
  Description of Artificial Sequence: Synthetic coding sequence
atgaaagggggatgtgtgtcacagtggaaggctgccgctggttttctgttttgtgttatggtctttgcttcagcagaaaggcccgtatttactaatcatttcctggtggagctgcacaaaggcggtgaggacaaggccagacaggtggccgctgaacacggattcggggtcaggaagttaccgttcgcagaaggcctttatcatttctatcataacgggctggctaaagctaaacggaggcgctctctgcaccataagcagcaactggagagagaccccagggtgaagatggccttacagcaggaagggttcgatcgcaagaagagggggtaccgggacatcaacgagatcgacattaacatgaatgaccctctcttcaccaagcagtggtacttaattaataccggccaggcagacggcacacccggacttgatctgaacgtcgctgaagcctgggagctcgggtacacaggtaaaggagtgacgataggcattatggatgacggaatcgattatctgcatcctgacctggcatcaaactacaatgcagaggcgtcgtatgatttcagcagtaacgatccttacccctatccccgatataccgatgactggtttaactcacatgggacccgctgcgctggcgaggtttccgcggctgcaaacaacaatatctgtggcgtgggggtcgcttacaatagcaaggtggccggtatcaggatgctggaccagccgtttatgacagatataattgaagcctcgtccattagtcacatgccccagttaattgacatttattcggcttcctggggtccaacggataatgggaaaacagtggacggcccacgtgagctcacacttcaggccatggcggacggcgtgaataagggcagagggggaaaaggctccatatacgtgtgggccagtggggacggcggaagttacgatgattgtaattgcgatgggtatgcctcctctatgtggaccataagcattaatagtgctatcaatgatggacgcacggccctctatgacgaaagctgcagctcaaccctggccagcacattttctaatggaagaaagaggaaccctgaagctggggtggcgacaacagatttatacggaaattgcacactgcggcattctggcacctccgccgcagctccagaggccgctggggtctttgctctggctcttgaggccaatcttggccttacctggagggacatgcaacatctgactgttctcacgtctaagaggaaccaactacacgatgaagtacaccaatggagacgcaatggcgtcggtcttgagtttaatcatctcttcggctacggagtactggatgccggagccatggtcaaaatggctaaggattggaaaactgttcccgagagatttcactgcgttggtggcagcgtccaggaccctgagaagatcccaagcacagggaaactggttctgaccctgactacagacgcatgtgagggcaaggaaaatttcgtgagatatctggaacacgtgcaggctgtgatcaccgttaacgccacccggcgaggcgatctcaacataaacatgaccagccctatggggacaaaatcaatcttgctgagccggaggcccagggatgatgatagtaaagtagggttcgacaaatggccttttatgactacacacacttggggcgaggacgcaaggggaacttggaccctggagctcgggtttgttggcagcgctccgcagaaaggtgttcttaaggagtggactttgatgctgcacggtacgcagtcagcgccttatatagaccaggtagtcagagactaccaatccaaactggcaatgtctaagaaagaggaactagaggaagaattagatgaggcagtggagagaagcttgaaatccattctgaataagaactag

SEQ ID NO: 236354 - DNA, 1860 bp, Artificial Sequence
  Description of Artificial Sequence: Synthetic coding sequence
atggtttttgcttccgccgagcgtccggtgtttacgaaccattttcttgtggagcttcataaggggggagaggacaaagctaggcaggtggcagccgaacatgggttcggtgtgcgtaaactccccttcgccgaaggtctgtaccatttctatcacaatgggctagctaaggccaaaagaaggaggtcgttgcatcacaaacagcagcttgagagagatcccagggtgaagatggcccttcagcaagaggggttcgatcgcaagaagcgaggttaccgggacatcaacgagattgatattaatatgaatgatcctctgttcacgaagcaatggtacttgataaataccggacaggcagacgggacccccggacttgaccttaacgtggccgaggcctgggaactcggctacaccggaaaaggtgtgacaattggtatcatggacgacgggatcgattatttacatccggacctggcttcaaactataatgccgaggcttcttacgacttcagtagcaatgatccttacccatatccaagatacactgatgactggttcaatagtcatgggaccagatgcgccggagaggtctctgcggctgccaataataacatctgtggggtcggagtggcttataacagcaaagtggcaggcatacggatgctggatcagccattcatgaccgacattatagaggctagcagcatttcccacatgcctcagctaattgatatttactctgctagctgggggcctactgacaatgggaagacagttgacggtcctcgggagctgaccctgcaggccatggctgacggcgtgaacaagggcaggggcggtaagggcagtatatacgtctgggccagtggggacgggggaagttatgacgactgcaactgtgacggctatgcaagcagtatgtggactatcagcatcaattcagcgatcaacgacgggagaactgccttgtatgatgagtcatgcagcagtacgctggctagtacgttcagtaatggcagaaagagaaacccagaggcaggcgtggcaaccactgacctttatgggaactgtacccttaggcatagcgggactagcgcagcagctccagaggcagcaggggtttttgccctggctttggaagctaacctaggcctaacctggcgcgatatgcagcacctgaccgtgttgacgtccaaacgcaatcaactacatgacgaggtccaccagtggagaagaaatggcgtgggtctggaatttaatcacctctttggctacggcgtgcttgacgcgggagcaatggtcaagatggctaaggattggaaaaccgtgccagaaagatttcattgcgtcggtggaagcgtccaagatccagagaaaatcccctcaacgggcaagttggtgttgacactgaccacagacgcatgcgagggaaaggaaaattttgtcagatacttggaacatgtgcaggcagtgattactgtgaatgccacccgcaggggcgatctgaatataaacatgaccagtcctatgggaacaaagtccatcctgctgagtaggaggccgagagatgatgatagcaaagttggctttgacaaatggccatttatgaccacgcatacatggggagaagatgcgagggggacctggactctagaactaggctttgtggggtccgccccacaaaaaggtgtactgaaggagtggaccttgatgcttcacgggactcagagcgctccttacattgaccaagttgtacgcgactaccaaagtaagctcgcaatgtccaagaaggaagaactcgaggaagagttagacgaggctgtcgaaagatctttgaagtcaattctaaataagaattag

SEQ ID NO: 236355 - DNA, 1812 bp, Artificial Sequence
  Description of Artificial Sequence: Synthetic coding sequence
atgaaggggggttgcgtgtcacagtggaaagccgcagctgggtttctgttctgtgtaatggtgtttgcttctgccgagagaccggttttcactaaccactttttggtggagttacacaagggaggtgaagacaaagctcgccaggtggccgctgagcacggatttggagtaagaaaagttaaaatggccctgcagcaggagggcttcgaccggaagaagagggggtaccgtgacatcaatgaaattgacatcaacatgaacgacccgctctttacaaaacagtggtatctcatcaacactgggcaggccgatgggactcctgggcttgatctgaatgtggccgaagcttgggaactgggctacactggtaagggagttaccatcggcatcatggatgacggaatagattatctccaccctgatctggcaagtaactacaacgcagaagcgagctatgatttcagctctaatgacccatacccatacccccgatataccgatgactggtttaatagccacggaacacggtgcgccggtgaggttagtgcagctgcaaacaacaatatatgtggcgtgggtgttgcttacaattccaaagtggcaggtataaggatgcttgaccaaccgtttatgactgatattatcgaggcttcaagcatcagtcatatgccccagctgatcgacatttacagcgccagctggggtcccactgacaacggcaagacagttgacgggccacgggagttgacactgcaagctatggcggacggagttaacaaaggcaggggcggaaagggctcaatttatgtctgggcaagcggggacggtggaagctacgatgactgcaattgcgacggatacgcatcttcaatgtggaccatctccattaactccgctattaatgatggcaggaccgcgttgtacgatgagtcttgctcgagcactctagcctccacattctcaaatggcaggaagaggaacccagaagctggggtggcaacaacggacctctacgggaattgtacactccggcattcagggacttccgctgcagcccctgaagcagctggagtgttcgcactggctcttgaagccaatctggggctgacctggcgcgacatgcagcacctcaccgtgctcaccagcaagagaaatcagctgcacgatgaggttcatcaatggaggcgcaatggagtgggactcgaatttaatcacctcttcggatacggcgtattagacgctggtgcgatggtcaagatggctaaagactggaagaccgtgcccgaaagatttcactgtgtcggcggttccgtccaggacccagaaaagatcccttcaactggtaagctggtactcacactgacaacagacgcgtgcgaagggaaagaaaatttcgtgcggtacctcgagcatgtgcaggctgtgattacagtaaacgccacacgccgtggcgacctcaatattaacatgacttccccaatgggcacgaagtcaatacttctgagcagacggcctcgggatgatgattcaaaagtcggctttgataaatggccctttatgaccacccacacttggggagaggatgcgcgtggcacctggaccctcgagctgggctttgtcggctctgcgcctcagaaaggtgtgctgaaggagtggaccctcatgcttcacgggacccagtctgcgccttacatagaccaggtggttcgggattatcagtctaagctcgccatgtcaaagaaggaggagctggaagaagaactggatgaggctgtggagagatcgcttaagtctatactgaacaaaaactag

SEQ ID NO: 236356 - DNA, 2268 bp, Artificial Sequence
  Description of Artificial Sequence: Synthetic coding sequence
atgcggcctgccccaattgctctgtggctgaggctggtgcttgctctggctctagtgaggcccagggccgtagggtgggctcctgtcagggcacccatttacgtgagctcttgggctgtgcaagtaagtcagggcaaccgagaagtggagaggctggcccgaaaattcggatttgtcaatctgggcccaatctttccagatggccaatacttccacttacggcacagaggcgtggtccaacagagcctcacaccacactggggccacaggctgcatctgaaaaagaatccgaaggtccagtggtttcagcagcagaccttgcagaggcgagtgaagcgcagcgttgtcgtgcctaccgatccctggttctctaaacaatggtatatgaattctgaagctcagcctgacctctccatactgcaggcttggtcccagggtctatcgggacagggtatcgttgtgtcagttctggacgatgggatagaaaaggaccaccctgatctgtgggctaactatgatcccttggcttcatatgacttcaacgattatgaccccgacccccagccgaggtatacccccagtaaagagaaccgtcatgggacaaggtgcgccggagaggtggcagctatggccaacaacggattctgtggtgtgggcgtcgctttcaatgcaaggattgggggagtgcgcatgctagatggtacaataacagacgtgattgaggcccagagtctgagtctccagccgcagcatattcacatatactccgcgtcatggggccctgaggacgatgggaggactgtggatggtcccggtattctgactagggaggcctttcgtcgcggagtcactaagggacgtgggggactggggacactgtttatttgggctagcgggaatggtggtctccattacgacaactgcaactgcgatggatacaccaactctatacacaccctgtctgtgggcagtaccacccagcaaggtcgagtcccctggtattcggaggcatgtgctagcacactgactacaacatattcaagcggggttgctaccgatccgcagatagtgaccactgacctgcaccatggatgcaccgatcagcacacaggaacatccgccagtgccccactcgcggctgggatgattgctctcgcgctggaagcaaatcctttcctgacgtggagagatatgcagcacctggttgtaagggcgagtaaaccagcccatctgcaagcagaggattggcggacaaatggggttgggcgacaggtaagtcatcattacggttatggtctccttgatgccggattgttggtcgataccgctaggacgtggttaccaacccagccacagcggaagtgcgccgtcagagtgcagagccggcctacaccgatccttcccctgatctatatcagggagaatgtcagtgcctgcgccggtttacacaacagcatacggagtctcgaacacgtccaggcgcagcttaccctttcatacagtagacgcggagatttggagattagcctcacgtcacctatgggaactcggtctacgttggttgcaatccggcctctagacgtgagtacagagggctataataattgggtcttcatgtctacccacttctgggatgagaacccccagggcgtatggacgctcggcctggagaacaaggggtattacttcaacacagggactctgtatcgatacacactcctgctgtacggtacagctgaagacatgacagcacgtcccacaggccctcaggttaccagctccgcctgtgtgcagcgggacacagagggactgtgccaagcttgcgacggccctgcgtatatactgggacagctctgcctagcatattgccctcctagattcttcaaccacacgcgcctcgtgaccgctgggccaggccataccgcggctcctgccctaagagtttgctcaagctgccacgctagttgttacacatgccgcggaggcagccctagggactgtacctcctgtccccctagctcaacccttgatcagcagcaaggaagttgtatgggcccaaccacgcccgatagtcgacccagactgagggccgcagcctgcccacaccatcgatgtccggctagcgccatggtgctgtcgctcctggccgttacactgggaggacctgtcctatgtggcatgtctatggatctcccactgtacgcctggttgtctagggctcgcgcaactcccaccaagccccaagtatggttaccggcaggtacctag

SEQ ID NO: 236357 - DNA, 1137 bp, Artificial Sequence
  Description of Artificial Sequence: Synthetic coding sequence
atggctagcagacggacaacaagaacctctggacccacaacaacaccttggcctgcgatgaccagcatgaccactacccggacaccaagccccgcaacacctcccgctaaacgcactggggtgcggatgctggacgggacaattaccgatgtaattgaggctcaatctctctcgctgcaacctcagcacattcatatctactccgcctcgtggggtcctgaggacgacggacgaacggtggacggtccaggaatcctgaccagagaagctttccgccgtggcgtcactaagggacgtggcggactgggtactcttttcatctgggcatcggggaatgggggtctgcattacgataattgtaactgtgatgggtacaccaatagcatccacaccctttctgtcggctcgacgacacagcagggcagagttccttggtactctgaggcctgcgcaagcacccttactaccacctacagctccggggtggcgactgacccccagatcgtaacaactgacctgcaccacggatgcactgatcagcatactggtacatctgcatctgcccctctggcagctgggatgatcgccctggcactggaagcaaatccattcctgacctggcgcgatatgcaacacttggtggtcagagcctcaaagcctgctcacctacaagctgaagattggcgcactaacggcgttggcaggcaggttagtcatcattatgggtacggacttctggacgctggacttctggtcgacaccgccaggacatggttacctacacagccgcagcgaaaatgcgctgtcagagtgcagagcaggcccacgcccattctgcccctgatctacatcagagagaatgtatccgcgtgtgccggactgcataacagtattcgcagtttagaacacgtccaggcacagctgacgctgagctactcccgcaggggggacctggagattagtctgacgtccccgatgggcacacggagcaccctggtggccattcgggatgtcgtcccactgcacgctgcggctttatgggacgggagagggcacgactcagcggcttatcgcccacctggggaccaacagcgagtgtgcgccgcaggacataggggcgcagttccaggagtgtag

SEQ ID NO: 236358 - DNA, 2742 bp, Artificial Sequence
  Description of Artificial Sequence: Synthetic coding sequence
atgggctggggcagcaggtgctgttgccctgggagactcgatctgctgtgtgttcttgctctgttgggcggatgccttctgcccgtgtgccgtacccgcgtttatactaaccattgggccgtgaaaattgctggaggctttcccgaagcgaacaggatagcaagtaaatatgggttcattaacattggacagatcggagctctgaaggactactatcatttttaccattcaagaaccatcaagaggtccgttatcagctctcgaggaactcattcttttataagtatggagccgaaggtggagtggatacagcagcaggtggtgaagaaacgcaccaaacgggattacgatttttctagggcccagagcacctattttaatgaccccaaatggccaagtatgtggtacatgcattgtagcgacaacacccacccctgccagagtgacatgaatattgagggcgcttggaaacggggttataccggcaaaaatatcgtcgtcactatactggatgatggtatcgagcgcacgcatcccgacctcatgcagaactacgatgctttggcttcctgcgacgtgaatggaaacgatcttgacccgatgcctaggtacgacgcttcaaacgagaataagcatggcactagatgcgccggagaagttgccgctgccgctaacaacagtcactgcacagttggaattgcttttaacgccaagatcggcggagtccgaatgctcgatggggatgttacagacatggtagaggctaagtcggtgtcctttaacccccagcatgtgcatatttattctgcaagctggggtccagacgacgacgggaagacagtcgacggtccggctccacttacccgccaggccttcgagaatggcgtgaggatgggccgacggggactaggatctgtctttgtttgggcaagcgggaatgggggaagaagcaaggaccattgttcatgcgacggatataccaacagcatatacacgatttctatctcaagtaccgctgagagcggtaagaaaccttggtacctggaagagtgtagcagcaccctggctacaacctatagtagcggggaatcatatgacaaaaagataattactacggacttgcgacagcggtgcactgacaatcatacagggacatcagcctccgccccaatggcagcaggcatcatcgccctagcactcgaggccaacccattcctcacctggcgcgatgtacagcacgtgattgtacggacctcacgcgctggacacttgaacgctaacgattggaagacaaatgctgctgggttcaaggtatcacacctatacggcttcggcctaatggatgccgaagcaatggtaatggaagcagaaaaatggaccactgtgccccgacaacatgtctgcgtggagtcaacagaccgacaaatcaagacaatcaggcctaattccgcagtgaggagtatctacaaagcctccgggtgtagcgacaacccgaacaggcatgtcaactatcttgagcatgtagtggtgcggatcactatcacccatccccgacggggtgacctcgccatctacctaacgtctccgtctggcacgcgcagccagctccttgccaacagacttttcgatcacagcatggaaggcttcaagaattgggaatttatgactatccattgttggggcgagcgtgccgctggcgattgggttctggaagtgtacgacactccaagccaattacgaaatttcaaaacgccgggaaaactaaaggaatggagtctggtgctttacgggacatccgtgcagccctacagccccaccaatgagtttcctaaagtggaacggttccggtactctcgagttgaggatcccaccgatgattacggaactgaggactacgcgggtccttgcgaccccgagtgtagcgaggtcggatgtgatgggccaggtccagatcattgtaatgattgtctacactattattacaagcttaagaataacacaaggatctgcgtttcctcctgcccccctggtcactatcacgcagataagaaaagatgtagaaaatgcgcgcctaattgtgaatcgtgctttggatctcacggcgatcagtgtatgtcatgcaagtacggttatttcctaaatgaggaaaccaattcctgcgtgacacactgcccagacgggagctatcaggacacgaaaaagaatctgtgccggaagtgcagtgagaattgcaagacttgtactgagtttcacaactgtaccgagtgtcgcgacggcttatcacttcaggggtcacgttgctctgtctcctgtgaggacggtcgctatttcaacggtcaggactgtcagccatgccatagattctgcgctacttgtgccggtgccggagccgatggatgcataaattgcacagaaggctattttatggaagacgggaggtgtgttcagagctgttctatttcctattacttcgaccatagctcagagaacgggtataaaagctgtaaaaagtgtgacatctcatgcctgacctgtaacggcccaggttttaagaactgtactagttgcccctctgggtatttgctggatcttggcatgtgccaaatgggagcgatttgcaaggacgcgaccgaagagtcatgggccgagggtgggttctgcatgctggtgaaaaagaataacctatgtcagcgcaaagtactgcagcagctgtgctgtaaaacctgcactttccaggggtag

SEQ ID NO: 236359 - DNA, 4773 bp, Artificial Sequence
  Description of Artificial Sequence: Synthetic coding sequence
atgggcagacggggattggggtcggtcttcgtgtgggcttcaggaaacggaggacgctcaaaagatcactgttcctgcgatggctatacgaacagcatttacacaatctctatttcctctactgctgagagtgggaagaaaccctggtacctggaggagtgctcatcaaccttggctacaacttactccagtggagaatcttacgataaaaagattataaccactgacctccgccagagatgtacagacaaccacactggcaccagcgcctccgcccctatggctgctgggattatcgccctggctctggaagcgaatcccttccttacctggcgtgatgttcagcatgtaattgtcagaacctctcgcgctggacatctcaatgctaatgactggaagactaacgccgcagggtttaaggtgtctcatctctacggcttcggcctgatggatgcagaagccatggtgatggaggctgagaagtggaccaccgtgccgagacaacatgtgtgcgtggagtcaacggaccgccagatcaaaacaattcggccaaacagtgctgttagatcaatctataaagcctctgggtgcagtgacaaccctaaccggcacgtgaactacttagaacacgtggtggttcgcatcactattacgcatccacgtcgaggcgacctcgccatctacctcacaagtccttctggaactcgcagccagctgcttgctaatcggctgtttgatcactctatggaagggttcaagaactgggagtttatgacgatacactgttggggtgagagggccgctggggactgggttctcgaggtgtacgacaccccaagtcagctgcgaaatttcaagacaccaggaaaactcaaggagtggagtttggtcttgtatggcacttctgtccaaccctattctccaacgaatgagttccctaaggtggagagattcagatactcccgggttgaggatccaacggacgactatgggactgaagattacgccggtccttgtgatcctgagtgcagcgaggtggggtgtgatggccctggcccagatcattgtaacgattgtttgcactattactacaagctgaagaataatacccggatatgcgtcagttcctgcccacccggacactatcacgctgacaagaaaaggtgccgtaaatgcgctccgaactgtgaaagttgctttggatcccacggagaccagtgcatgtcctgtaagtacggctactttctgaatgaagagaccaatagttgcgttacccattgtcctgatggctcatatcaggataccaaaaagaatctgtgtcgaaagtgctctgagaattgcaaaacatgcacagaatttcacaattgcacagaatgtagggatggtttgtcacttcaggggtcaaggtgcagtgtctcctgtgaggacgggcgatattttaatggacaagattgccagccctgccaccggttctgtgcaacttgtgcaggagccggtgcagatggctgcattaattgtaccgagggatattttatggaagacgggaggtgtgtccagtcctgtagcatctcttactatttcgaccactctagtgaaaacggatacaaatcttgtaagaaatgcgatatcagttgcctgacgtgcaatggacccggtttcaagaactgcactagttgtccttccggctacctgttagacttgggcatgtgccagatgggcgctatttgcaaagacggagagtatgtggatgagcacggtcactgtcagacatgcgaggctagttgcgcaaagtgtcagggtccaactcaggaagattgtacgacctgcccaatgaccagaatctttgatgatggaagatgcgtttccaactgcccttcgtggaagttcgaattcgagaaccagtgtcacccctgtcaccatacctgccaaaggtgtcagggcagtggaccaacacactgtactagttgcggagccgacaattatggcagggagcactttctttatcagggcgagtgtggggactcgtgccccgagggacactacgcgacagaggggaacacctgtttgccctgtccagacaattgcgaactttgccattccgtgcatgtatgtaccaggtgcatgaaggggtattttatcgcacccacgaaccatacctgccagaaactggagtgtgggcaaggtgaggtgcaggatcctgattacgaggagtgcgttccgtgtgaggagggctgcctcgggtgttcactggatgaccctggcacgtgtacatcttgcgctatgggatactatcgttttgaccatcattgttacaagacctgcccagagaagacatatagcgaagaagtggaatgtaaagcttgcgactctaactgtggaagttgcgatcagaatgggtgctattggtgcgaggagggcttcttcttactgggtgggtcctgcgtacgcaagtgcggtcccggattttacggcgatcaggaaatgggagagtgtgaatcctgtcacagggcctgtgaaacttgtactggtcctggtcacgatgaatgttcgagctgtcaggagggattgcaactgttacgtgggatgtgcgtgcacgctaccaaaacgcaggaagaagggaaattttggaacgaggctgtcagtactgctaacctgagcgtcgttaagtccctgctgcaggaacgcaggcggtggaaggtccagattaaaagggatatcttgcgtaagcttcagccgtgtcacagtagttgcaagacctgcaatggctctgcaacactgtgtacctcctgtcctaagggagcttatctgctggctcaagcatgcgtgtctagctgcccccaggggacctggccttccgtgagatctgggagctgcgagaactgtactgaagcgtgcgcaatctgctctggcgcagacttatgcaaaaaatgccaaatgcagccagggcaccccttgttcctccacgagggtcgttgctatagcaagtgcccagaaggctcatacgcggaggacggtatatgtgaaaggtgctctagcccatgccggacctgtgaagggaacgctacgaactgccacagttgtgagggaggacatgtgctgcaccacggcgtgtgtcaggaaaactgtcctgaacggcatgtcgcagtgaaaggagtttgcaaacattgccctgaaatgtgtcaggattgtattcacgaaaagacctgcaaggagtgtacccctgaattcttcctccatgatgatatgtgccaccaatcttgtccacgaggtttttacgccgatagcagacactgcgttccctgccacaaagattgcctggaatgtagcggtccaaaggccgacgactgtgagctgtgcctcgagagtagctgggttttgtatgatggcctctgtctggaagagtgccctgccggtacatattacgagaaggagacaaaagagtgtcgggactgtcataagtcctgcctgacctgcagttcctccggcacctgcactacatgccagaagggcctgatcatgaacccacgtggatcctgcatggccaatgaaaaatgctcccctagtgaatattgggacgaggacgcacccggatgtaaaccttgccacgtgaagtgtttccactgtatggggcctgccgaagaccagtgccaaacctgccctatgaactccctgctgttgaatacaacatgtgtgaaagattgccctgagggttattatgccgatgaggacagtaacagatgcgcacactgccactcttcctgtcggacatgtgagggcagacatagccggcagtgccacagttgtcgtccaggttggttccagctcggcaaggaatgtctgctgcagtgtcgagaaggctattacgccgacaactccaccggacgctgcgagagatgcaatcgttcttgcaagggctgccaagggcctcggcctaccgactgtctctcctgcgatcgcttctttttcctgctaagaagtaagggggagtgtcataggagctgtccggaccattattatgtggagcagagtactcagacctgcgaaagatgccatcccacatgtgaccagtgtaagggcaagggcgcactcaattgccttagctgtgtgtggagctaccacctgatgggcggaatctgcacctctgactgtttggtgggcgagtatagagttggcgagggcgagaaattcaattgtgagaaatgccatgaatcatgcatggagtgcaaagggccaggagcaaagaactgcacactgtgcccagccaatctcgttttgcacatggatgattcccattgcctccactgttgtaatactagtgatcctccaagcgcgcaggagtgctgtgattgccaggacacgaccgacgaatgcattctgagaacaagtaaagtccgcccagccaccgagcacttcaaaacggcactttttatcacatccagcatgatgctggtgctgttgctgggggcagctgtggtggtctggaaaaagtctagaggacgtgtgcaaccagccgctaaagccggatatgagaaactggcggatccaaacaaatcctactccagctacaagagttcctacagagagtcaacttcctttgaggaagaccaagtcatcgagtacagagacagggactacgacgaagacgacgatgacgacatcgtgtacatgggccaggatgggactgtgtacagaaaattcaaatacgggctgctggacgacgatgacatcgacgaactagagtacgacgacgagagttactcttattaccagtag

SEQ ID NO: 236360 - DNA, 2073 bp, Artificial Sequence
  Description of Artificial Sequence: Synthetic coding sequence
atgggctgggggtcaaggtgctgttgcccaggaagacttgatttactctgtgtacttgccctgctgggcggttgtctgttgcccgtgtgccgaactagggtgtacacaaaccactgggctgtaaaaatcgctggaggatttcctgaggcaaaccggattgcctcaaagtacgggtttatcaatatcggacaaatcggcgctctcaaggactactaccacttttaccactctagaacaatcaagcgatccgtgataagcagccgcggaactcacagttttataagcatggaaccaaaagttgaatggattcagcagcaggtggtgaaaaagcggacgaagcgggactacgacttctcgagagcgcagagcacctactttaacgaccccaagtggccatctatgtggtatatgcactgcagtgacaatacacatccatgccagagcgacatgaatattgagggtgcttggaagaggggctatacgggcaagaatatcgttgtgaccattctcgacgacgggattgagaggacccatccagatcttatgcagaattacgacgccctggcaagctgcgatgtgaatggcaacgatctggacccgatgcccaggtatgatgcatcaaacgagaacaaacatggtactcgttgcgccggagaggtggctgcagcagcaaacaattcccactgtactgtcggtattgcgttcaatgcaaaaatcggcggtgtgcgaatgctcgacggtgatgtgacagatatggtagaagccaaatctgtcagctttaatccacagcacgtccacatatatagcgcctcgtgggggcctgatgatgatggaaagaccgtggacggacccgctccgcttactcgacaggcatttgagaacggggtgaggatgggaagaagaggtcttgggagtgtcttcgtgtgggcaagcggtaacggaggtcgctctaaggatcactgctcttgtgacgggtataccaattcaatctatactatcagcattagctcaactgccgaaagcggtaaaaaaccttggtatcttgaggaatgttcaagcacactagccactacttattctagtggcgagtcctacgacaagaaaattatcaccactgatctgcgacagagatgcaccgacaaccatacagggacaagtgcaagcgctccaatggccgcaggcatcatcgccctcgcgctggaggccaatccatttctgacctggcgcgacgtgcagcacgtaatcgtcaggacaagccgcgcagggcaccttaatgccaatgattggaaaaccaacgcggctggctttaaggtgtcccatctatatgggttcggtcttatggacgccgaggccatggtgatggaggctgagaaatggacaaccgtgcctcggcaacatgtctgcgtcgagtccaccgatcgtcagataaagactataaggccaaacagcgcggtgcgctccatctataaggcctccgggtgctctgacaatccaaaccgacatgttaactacctcgaacacgttgtggtgcgaatcactattacccaccccagaaggggtgatcttgctatctaccttacaagcccgtccggaacccggagccagcttctggccaaccgccttttcgaccactctatggaggggttcaaaaattgggaattcatgacaatacactgttggggggagcgcgctgcaggcgattgggtcctggaggtgtacgacacaccctcccagctccggaacttcaaaactcccggtaaactaaaggagtggtccctggtgttatacggcacatccgtccagccttactcaccgaccaatgagttccctaaggtggaacgtttcaggtactcccgggtggaagatcctaccgacgactacggcacagaggactacgccggtgagctggccagctcaggcacccaagcgaagaagcgacagctgatgcatcaccctactacttgggagaatcgcatggagtggaacgggatgaagtggaatggcatgaagtggaatggcatggaatggaacggcatggagtggaaccggatcgagtctaatcgcatcgaatag

SEQ ID NO: 236361 - DNA, 2073 bp, Artificial Sequence
  Description of Artificial Sequence: Synthetic coding sequence
atgggttggggcagcaggtgctgctgccccggaaggctagatctgctatgcgtcctggctctgctcggaggctgcctccttcctgtgtgccggacacgcgtgtataccaaccactgggcagtgaagatcgcagggggtttccccgaggcaaatcgtattgcatctaagtatgggtttattaatatcggccagattggcgcactgaaggactattaccacttctaccactccagaaccatcaagaggtcagtgatctcgagccggggaactcattcgttcatcagcatggaacccaaggtggagtggattcaacagcaagtggttaagaagcgtacaaagagggattatgacttctcaagggctcaaagcacatacttcaacgatcccaaatggccatcgatgtggtacatgcactgttccgacaacacacacccatgccaaagcgacatgaatatcgaaggggcttggaagcgcggatatacaggcaaaaacatagtcgtaactatacttgatgatgggatcgagcggacacacccagacctgatgcaaaattatgacgccttagctagctgtgatgtgaacgggaatgatctggacccaatgccacgctatgacgcgagcaatgaaaataagcatggcacaagatgcgccggagaggtggctgcggctgctaacaattcacattgtaccgtgggcattgccttcaatgcaaaaatcggcggagtgcgcatgttagacggggacgtcacagacatggtggaggctaagtcggtgtcctttaatccacagcatgtccacatctatagtgcatcttgggggcctgatgatgacggaaaaaccgtggacggccctgcacctttgacaaggcaagctttcgaaaacggagtgcgcatgggcagacgagggctgggcagcgtattcgtctgggcttctgggaacgggggaagaagcaaggatcattgttcctgcgatggctacacaaactctatttacacgatatccatttcgtcaacagcagagtccggtaagaagccttggtacctggaggagtgctccagtactctggctaccacctattcatctggcgagtcctatgataaaaagataattacaacagatcttaggcaacgttgtaccgacaatcacaccggtacttcggcttcagctcctatggccgctggcattatagccctcgccctggaagccaatcctttcctcacctggagggacgtccagcacgtcatcgttaggactagccgtgccggacacctgaatgccaacgactggaagacaaatgccgctgggtttaaagtttcgcacctctatggcttcggcttaatggatgctgaagccatggtaatggaggccgagaagtggacaacggtgccacggcaacatgtgtgtgtcgagtcaacggaccggcagataaagacgatccgtcccaatagtgctgtgaggtccatttacaaggcctctggttgtagcgacaatcccaatagacatgtcaactatctcgaacatgttgtagtcaggatcaccatcactcacccacgcaggggggaccttgcgatctatctgacttcacctagtggcactcgatcccaattgctagctaaccgtctcttcgaccatagcatggaaggctttaaaaactgggaatttatgactattcactgctggggtgaaagggctgccggagattgggtactggaggtctacgatactccctctcagctgaggaatttcaagacgcctggtaaactgaaagagtggtctttggttctgtacggcacaagcgtccaaccttattcgcccactaatgagttccccaaggtcgaacgatttcgatattccagggtcgaggatcccaccgatgattatggtaccgaggattacgccggagaactggccagctccggcacccaggctaaaaagaggcaactcatgcaccatccgaccacgtgggagaaccggatggagtggaatggaatgaagtggaatggcatggagtggaatgggatggaatggaatggaatggaatccaacagaatcgaatctaatcggattgaatag

SEQ ID NO: 236362 - DNA, 4683 bp, Artificial Sequence
  Description of Artificial Sequence: Synthetic coding sequence
aacagcatttacaccatcagcatcagttcaactgcagagtcaggtaagaaaccatggtacctggaagagtgctccagtacgctcgcaacgacatactcctcgggggagtcctatgacaaaaagatcattactactgacctgcgacagcgctgtaccgataatcacacaggaacaagcgccagcgcccctatggcagcagggattatcgccctcgccctagaggcaaatcctttcctcacatggcgggatgttcagcacgtgatcgtgcggacgagccgtgctggccatcttaatgcaaatgattggaaaacaaatgccgctggcttcaaggtcagccatttgtatggcttcggccttatggatgcagaggccatggtcatggaggcagaaaaatggaccactgtccctcgtcaacacgtgtgtgtagagtccaccgaccggcagattaagactatccgacccaactctgccgtgcggagcatctacaaagccagcggatgtagtgataatcctaatagacacgtcaactacctcgaacatgtggtcgtccgaataactattacacatcctcgcagaggggatctcgctatctatctgactagtccatctggaacacggagtcagctgttagccaacagactcttcgatcactccatggaaggattcaaaaattgggaatttatgaccattcattgttggggggagagggctgccggagactgggtcctggaggtgtacgacacaccctcacaactacggaacttcaaaaccccaggaaagctcaaagagtggtccttagtcctttacggcactagtgtccagccatatagccccacgaacgagttccccaaagtagagcgctttagatacagtcgagtagaagaccctacagacgattacggcaccgaagattacgccggtccttgtgaccccgaatgctctgaggtaggttgcgacggccctggacctgaccattgcaatgactgtctgcactattactataagctaaagaacaataccaggatctgcgtgtcctcatgcccccctggtcattaccacgcagacaagaagcgttgcagaaaatgtgctcccaactgcgagagctgtttcggctcgcatggcgatcagtgcatgtcttgtaagtacggttatttcctgaatgaagaaaccaattcgtgcgtcacgcattgcccagacgggagttaccaggacactaagaagaacctgtgccgtaagtgtagcgagaactgtaaaacttgtactgaatttcacaattgcactgagtgccgcgacgggctcagcctgcagggttcaaggtgctccgtctcctgtgaggacggtcgctatttcaatggccaggactgccagccctgccaccgattttgcgcaacatgtgcaggggcaggagctgacgggtgcatcaattgcactgaagggtattttatggaggacggcagatgcgttcagtcatgttcgatttcctattattttgaccattcaagtgaaaacggatacaaatcatgtaaaaagtgtgatatctcctgtctgacctgcaatggacctggctttaagaattgtacctcttgcccgtctggctaccttctggacctaggcatgtgccagatgggggctatctgcaaagacggtgaatacgttgatgagcatggccattgccagacatgcgaagcctcatgtgccaagtgccagggacccactcaggaagattgcacaacttgtcctatgacacggatcttcgatgacggaagatgtgtgtcgaattgcccaagctggaagttcgagtttgaaaatcagtgtcacccatgccatcacacctgtcagcggtgccagggttccggcccaacccattgtaccagctgcggcgcagataactacggccgagagcacttcctgtatcaaggcgagtgtggcgactcgtgccccgagggccattatgccaccgaggggaacacgtgtcttccctgcccagacaactgtgagttgtgtcactctgtacatgtctgtacccggtgtatgaaggggtacttcattgctccgacgaaccacacatgtcagaaactcgaatgtggtcagggggaggtacaggatcccgactatgaggagtgcgtcccatgcgaggagggatgcttaggatgtagtctggatgatcccggaacgtgcacaagttgcgctatgggttattacaggttcgaccatcattgctacaaaacatgtccggagaagacctattccgaggaggtcgagtgcaaagcatgtgattcaaactgcggctcttgcgaccagaacgggtgctactggtgcgaagaggggttctttctactgggtggaagctgtgtccgcaaatgcggacccggattttatggcgaccaggaaatgggagagtgcgaaagctgtcatcgggcatgcgagacctgcacaggccctggtcatgatgaatgctcctcttgtcaagaaggcctgcagttgcttcggggtatgtgtgttcatgcaaccaaaacccaagaggaaggaaagttctggaacgaggccgtcagcacagcaaacctgtcagttgtcaagtcccttctgcaggagcggcgtcgctggaaggtgcaaattaagcgtgatatcctgcgcaaattgcagccgtgccactctagctgtaagacttgcaatgggtccgctacactctgcacaagttgccccaagggcgcttatcttctagcccaggcatgtgtgtcatcttgccctcagggaacttggccaagcgtgcgctcaggatcctgcgagaattgtaccgaagcttgcgcgatctgtagcggggctgatctctgtaagaaatgtcagatgcagcccggacatcctctgtttctgcatgagggcaggtgttatagcaaatgtccggaaggctcatacgcagaagacggcatttgtgagaggtgttcctctccttgccgcacatgtgagggtaatgccaccaactgtcactcttgcgaaggtggtcacgtgttacaccatggggtttgtcaagagaattgtccggaacgccatgtcgccgttaagggagtgtgcaagcattgtcctgagatgtgccaggactgcatccacgagaagacgtgtaaagagtgtacacccgagtttttcctccacgacgacatgtgccaccaaagctgccccagaggattttatgccgactctaggcattgtgtgccatgtcacaaagactgtctggagtgttccggaccgaaagcggatgactgcgagctctgcttggaatctagctgggttctgtatgatggattatgcctcgaggagtgcccagctggcacttattacgaaaaggaaaccaaagagtgcagggactgtcacaagtcctgcctgacatgtagcagctctggtacctgcacaacgtgccaaaagggcctcatcatgaacccccgtggctcatgcatggctaatgaaaagtgctctccatctgagtactgggacgaggacgcacctggctgcaagccttgtcacgtgaagtgtttccattgcatgggcccagctgaagaccagtgccagacttgcccaatgaattccttattgctgaacaccacttgcgttaaggactgcccagaggggtattatgccgacgaagattccaacaggtgtgcacattgccatagctcatgcagaacctgcgagggcagacacagcaggcagtgtcactcttgtcgcccaggatggtttcagctaggaaaagaatgcctgcttcagtgtcgagaaggttactatgcagacaattctacgggccgttgcgaacgctgcaaccgcagctgtaaaggttgccaagggccacgccctactgattgcctctcatgtgataggttcttcttcctgctgcggtcaaaaggcgagtgccataggtcttgccccgaccattactatgtcgaacagagcactcagacgtgtgaaaggtgccaccctacatgtgatcagtgcaaagggaagggggctttgaactgtttgagctgcgtgtggagctaccacttgatgggaggaatttgcactagtgattgcctggtaggggagtaccgggtgggcgagggcgaaaaatttaactgtgagaagtgtcacgagtcctgcatggagtgtaagggcccaggggcaaagaactgtacactgtgtcccgctaacttagttctgcacatggatgattcacattgtctgcattgctgtaatacttccgacccgccttcagcccaggagtgctgcgattgtcaagataccactgatgaatgtatactgaggacttcgaaggtgagacccgctactgaacactttaagaccgcactcttcataacttcatctatgatgttggtgcttcttctcggagcagcggtcgtcgtatggaagaaatctagaggtcgcgtacagcccgcagccaaagcaggttacgagaaactggctgacccaaataaatcgtatagcagctacaaatcctcatacagggagtcaacatcttttgaggaagatcaagtaatcgagtatcgcgacagagactacgacgaggacgatgatgatgacatcgtatacatgggacaagatggcacagtttatcgcaagtttaaatacggcctgctggacgacgatgatatcgacgagcttgagtatgatgatgagagctactcctactatcagtag

SEQ ID NO: 236363 - DNA, 306 bp, Artificial Sequence
  Description of Artificial Sequence: Synthetic coding sequence
tgccagccgtgtcaccgattctgcgccacttgcgcaggtgcaggcgcagacgggtgcattaattgtaccgaaggctacttcatggaagacggtaggtgtgtccagtcttgcagtatttcctactacttcgatcatagcagcgaaaacgggtacaaaagttgtaagaaatgtgacatcagttgcttaacctgcaatggacctggcttcaaaaattgtacttcctgtccgtctgggtacctgctagaccttggaatgtgccagatgggtgctatttgcaaggacgtctcactattcaggggagcttag

SEQ ID NO: 236364 - DNA, 5582 bp, Artificial Sequence
  Description of Artificial Sequence: Synthetic coding sequence
atgggatggggcagtcggtgctgctgtccaggcagactcgatctgctgtgcgtactcgcgctcctcggaggttgcctgcttcctgtgtgcagaactagagtgtataccaatcattgggccgttaagatcgccggagggttcccagaggcgaataggattgcatcaaagtatggcttcattaacatcgggcagatcggagcactgaaggattactaccacttttaccacagcagaaccattaagcgatctgtgatctcatcaaggggcacccactcctttataagcatggaacctaaagtcgaatggattcagcagcaggttgtgaagaaacggaccaagagagactacgatttctcacgcgctcaaagcacgtattttaatgatccgaagtggccctccatgtggtacatgcactgctccgataatacccacccatgccagagcgacatgaatatcgagggcgcatggaaacgaggatataccggtaagaatatcgtcgtaactatcctggatgacggaatcgagcgaacacatccagacctgatgcaaaactatgatgctctagcaagttgcgacgttaacggcaacgatctcgatcccatgcctcgctacgatgccagtaacgagaacaagcatggaaccaggtgcgccggagaagtggctgcagccgcaaacaatagccactgcacagtgggaatagcctttaacgccaagatcggcggtgtgagaatgctcgacggggacgttaccgacatggttgaagccaaaagcgtctcttttaacccccagcacgtgcatatctactcggcctcctggggtcccgacgatgacgggaagacggtcgacgggccagccccactcacaagacaggcttttgaaaacggcgtacgtatggggaggagaggtctcggttcagtcttcgtctgggcctctggcaatggcggaagatctaaagaccactgcagttgcgatggttacacgaattcgatttacactatctccatctcgagtactgccgaatcagggaagaagccctggtatctggaggaatgcagtagcacactggctaccacttactccagtggagaatcgtacgacaaaaaaatcatcactaccgatctgagacagagatgcacggacaatcacacgggaactagcgccagtgcaccgatggccgcaggaattatcgcactcgccctcgaggcgaaccctttcctgacgtggagggatgtgcagcacgtgatcgtgagaacatcacgcgctgggcacctgaatgcaaacgactggaaaacaaatgcggctggctttaaagtgtcccacctgtatgggtttggcctgatggatgcagaggctatggtcatggaggccgaaaagtggactaccgtccctagacaacatgtatgcgtggagtcaacagacagacagataaaaactatcagacctaattccgctgtgcggagcatctataaggccagcgggtgtagtgataacccaaacagacacgtcaattatctcgaacacgtcgtggtcagaatcaccatcactcatccacggcgaggagatctggcaatctatttaactagtccttcaggtactcggagccaactactcgcaaacagactttttgatcattctatggaaggctttaaaaattgggaattcatgactatacactgctggggtgagcgagccgctggagactgggtgctggaggtatacgatacccctagtcaactgcgcaactttaaaacacccggtaagttgaaagaatggagtcttgtgctgtacggtacgtctgtacaaccatactcacccaccaatgagttccccaaagttgaaaggttcaggtattcacgggttgaggaccctacagatgactatggaacagaagattacgccggtccgtgtgaccccgagtgttctgaagtgggatgtgacggcccagggcctgaccactgtaatgactgcctacactactattataagctgaagaataatacaaggatctgtgtgtccagctgcccaccaggacattaccatgcagacaaaaagcggtgcaggaagtgcgcccctaactgtgagagctgtttcgggtctcatggggaccagtgtatgtcttgcaagtatggatactttctgaatgaagaaaccaacagttgtgtaacacattgtcccgacggaagctaccaggataccaaaaagaatctctgtagaaagtgttcagagaactgcaagacctgtaccgagtttcacaattgcacagaatgcagggacggtttgtcccttcagggaagtaggtgctccgtgtcttgtgaagacggccgttactttaatggccaggattgtcagccctgccatcggttctgcgctacttgcgccggagcaggtgccgatgggtgtatcaattgcactgagggctacttcatggaggatggcagatgtgttcagtcttgcagcatatcttactattttgaccacagcagcgagaacggatataaatcgtgtaagaagtgcgatatttcctgcctgacgtgcaatggacccggattcaaaaattgtaccagttgcccgtcgggttatctgctggatcttggtatgtgccaaatgggggcaatctgtaaagatggagagtacgtggatgagcacggtcactgccagacttgtgaggcctcctgcgcaaagtgtcaaggccctactcaagaggactgtacgacatgtccgatgacccgaattttcgacgacggacgatgtgtttctaattgccctagctggaagttcgaattcgaaaaccagtgtcacccttgtcaccacacctgtcagcgctgccagggatctgggcctactcattgcacttcatgcggcgcagacaattatggtcgagaacatttcctgtatcagggcgagtgcggggattcatgcccagaaggccactatgccacagaaggcaacacctgcttgccttgccctgacaattgtgaattgtgccatagcgtgcacgtgtgcactcggtgcatgaagggctatttcatcgcccctacgaaccacacctgtcagaaattggagtgcggacagggcgaggtccaagatcctgactacgaggaatgcgtgccttgtgaagaggggtgtttagggtgtagtttggacgatccaggtacttgtacaagctgtgctatgggctactacagatttgaccaccattgctacaaaacctgtccggaaaaaacatacagtgaagaggttgaatgtaaagcctgcgactcaaattgtggctcatgtgatcagaatggctgctattggtgtgaggaaggcttttttcttctcggcggtagctgtgttcgcaaatgcggtccgggattctatggggatcaggagatgggcgagtgcgagtcctgccacagagcctgcgagacgtgcactggaccgggacacgatgagtgttctagctgccaggaggggctccagttattgaggggtatgtgcgtgcacgcaacgaagacgcaggaggaaggcaaattttggaatgatatcctgagaaagctgcaaccatgccacagttcttgtaagacgtgtaacgggtccgctacgctgtgcacaagctgcccgaaaggagcgtatctgctggcccaggcatgtgtttcctcctgtccacaagggacctggcccagtgtccgctcaggctcctgcgaaaactgtacagaggcttgcgcaatttgttccggtgccgacctgtgcaagaagtgccagatgcaacctgggcatcctctgtttctgcatgaaggaagatgttattcgaaatgcccagaaggctcctacgctgaggacgggatatgtgagaggtgttcctcaccctgccgcacttgcgagggtaatgccaccaactgtcatagctgtgagggtgggcatgtactacaccatggtgtgtgccaagagaactgccctgagcgacacgtcgcggtcaaaggtgtctgtaaacactgtcctgaaatgtgccaggactgcatccacgagaagacttgcaaagaatgtacacccgaattctttctgcatgacgacatgtgccatcaaagttgtccgagggggttttacgccgattccaggcactgtgtgccttgccataaggactgcctggagtgcagtggacctaaagccgatgattgtgagttgtgtcttgaatccagctgggtgctgtacgatggactgtgcctggaggagtgcccagcaggaacctactatgaaaaagaaactaaggagtgccgggactgtcataagtcatgcctgacctgcagcagcagtgggacatgcaccacctgtcaaaaaggcctgatcatgaacccgaggggtagctgcatggctaatgaaaagtgttccccctctgagtattgggatgaagacgccccaggctgtaagccttgccacgtcaaatgtttccactgcatgggcccagccgaggatcagtgtcagacttgtcccatgaactccctgctgctgaatacaacctgcgtgaaggattgcccagagggatactacgccgacgaagactctaatcgatgtgcccactgtcattctagctgcagaacatgtgagggcagacattcccggcagtgccatagctgtaggccgggttggttccaattggggaaggagtgtctcctgcagtgccgagagggttactatgccgacaactctacaggacggtgcgagcgctgcaaccgaagttgtaaaggctgccagggaccacgtcccacggattgtcttagctgcgaccgcttttttttcttactccggagcaagggagaatgtcacaggtcctgccccgatcattattatgtcgagcagagcacccagacctgcgagaggtgccatccaacatgtgaccagtgtaagggaaagggagctcttaattgtctgtcatgcgtgtggagctatcacctgatgggaggaatttgtaccagtgactgtctggtaggcgaataccgtgtgggcgagggcgagaagtttaattgtgaaaaatgccatgagagctgtatggagtgcaaaggccctggggcaaaaaattgcacactctgccctgcaaatttggtgcttcacatggatgattctcactgtctgcattgctgcaacactagtgatccccctagtgctcaagaatgctgtgattgtcaggacaccactgatgaatgtatcctgaggacgtccaaggtccgacctgccactgagcacttcaaaacagcactgttcatcacttccagcatgatgctggtcctcctcctgggggctgctgtggtggtgtggaagaaatccaggggaagggtccaacccgctgctaaggccggttacgaaaaactggcagatcccaataaatcttactccagctacaaatccagctatagagagtccacctcttttgaggaagaccaggtgatagagtatagagaccgggattacgatgaagatgatgacgatgacatcgtttacatggggcaagacggaaccgtgtacagaaagttcaaatatggcctcctagacgacgatgatatagacgaactggagtacgatgacgagtcatattcctactatcagta

SEQ ID NO: 236365 - DNA, 1497 bp, Artificial Sequence
  Description of Artificial Sequence: Synthetic coding sequence
atctggaatgtacaccactgtggcgataaaaacagtaggtgccggagcgagatgaacgtacaggcagcctggaagaggggttacactggaaaaaatgttgtagtcacgatccttgacgacggaatcgagcggaaccaccccgacctagcccctaactacgactcctatgccagctacgatgttaatggcaatgactatgatccctcacccagatatgacgcatccaatgaaaacaagcacggaacccgatgcgccggtgaagtcgcagcttccgccaacaattcctactgcatcgtcggaatcgcttacaatgctaagataggagggattcggatgctggacggtgacgtaaccgatgtcgtggaagctaaatctctgggcatacgccctaactacattgatatctatagcgcgtcctggggacccgacgatgatggaaagaccgtcgacggacctggcagactggccaagcaggccttcgaatacggtattaaaaaaggcaggcaaggcctgggatctatatttgtgtgggcttctgggaacgggggacgcgagggagactactgtagttgtgatggctacaccaactctatctacaccatatccgtctccagcgccaccgagaatggctacaaaccctggtacctggaggaatgcgcgtctaccctggctacgacttattcttctggcgcattttacgagcgaaaaatcgtgaccaccgacctacgacagagatgtaccgatggccatacaggcacttctgtgagcgctcccatggtcgctggaatcatcgccctggccctggaggcaaactcgcaattaacctggcgtgatgttcagcacctgctagttaagacatcccggccagcccacctgaaggcctctgactggaaagtcaacggggctggccataaggtttcccacttttacgggttcggccttgtagacgcagaggctctcgtggtcgaggcaaaaaagtggacagcggtcccttcgcaacacatgtgcgtggccgcatccgataagcgcccacggtccatacctttggtccaggtgttgcggacaaccgcgcttacatctgcctgtgccgagcactccgaccagagagttgtgtacctggagcatgtggttgttcgaacctccatctcacacccccgacgtggcgatctgcagatctacttagtgtcgccaagcgggacaaaatcacagctactcgccaagcgactcttggacttgagcaacgaaggatttactaattgggaattcatgactgtgcactgttggggtgaaaaagcagagggtcagtggactctggagatccaggacctgcctagccaggtgaggaacccagagaagcagggggacctggagacaccagtggccaatcaactgactacagaggagagattcgtgtcaacgctgtcaatactattccactggtccgtgtacttgtcgtggtcacagtatcatatcgtgctcatcactgtcgctctttag

SEQ ID NO: 236366 - DNA, 1956 bp, Artificial Sequence
  Description of Artificial Sequence: Synthetic coding sequence
atgccgcctagggctcccccagcaccgggacctcggccaccacccagagccgcagctgccacagatacggctgcaggcgctggtggcgcaggcggagcaggcggagctggaggaccgggattccgacctttggctcccaggccctggcgctggctgctgttgctcgcgttacccgcagcctgcagcccccctcctcggccagtgtataccaatcactgggctgtgcaagtgctcggcggtcctgcagaggccgatagagtcgctgccgctcatggatatctgaacctcggccagatcggcaacttggaggactattatcatttctatcattcaaaaacctttaaaaggagcacgctctcaagccgcggaccccatacgttccttcgaatggatcctcaggtcaaatggttgcagcaacaggaggtcaagcgcagggtcaaacgccaggtaagatcggatccgcaggccttatactttaatgacccaatatggtcaaacatgtggtatctgcattgcggcgacaagaacagtaggtgccggtccgagatgaacgttcaggcggcttggaaaagagggtatacgggcaagaacgtcgttgtcactatcctggacgacggcattgagcgcaaccatcctgacctcgcccctaattatgactcctatgcatcatatgatgtgaacggaaacgattatgatccgagccctagatatgacgcttcaaacgagaataaacacggaactcgatgcgccggtgaggtggctgcttctgccaataatagttattgtatcgtaggcatcgcctataatgcaaagatcggtggtatccgaatgctggacggagatgtgaccgatgttgtggaggccaaaagcctcgggattcggccaaactatatcgatatatatagcgcatcgtggggacccgatgacgacgggaagacagtggacggacccggaaggctagcaaaacaggccttcgagtatggaatcaagaagggtcgtcagggcctggggtctatctttgtgtgggcctctgggaacgggggacgagaaggagattattgcagctgcgacggatacaccaactccatctacacaatctccgttagttctgccacagagaacggatacaagccatggtatctcgaagagtgcgcctccaccctcgcaacaacctatagcagtggcgctttttatgagagaaaaattgtgacaactgatttacgccaaaggtgcactgatggtcacacaggcacttccgtgagtgcccctatggtggcgggtataatcgccttagctctggaggcaaactcccaacttacatggcgagatgtacagcacttgctggtgaagacctccaggccagcccacctcaaggcatctgattggaaggtgaacggtgcaggacataaagtttcccatttctatggcttcggccttgtggatgcggaggccctggtcgtagaggccaagaagtggacggccgtgccatctcagcatatgtgtgtcgctgccagcgataagcggccacgaagtattcctttagtccaggtgttgagaaccacagctctcacatccgcttgcgctgagcacagtgatcagagggtagtatatctggagcatgtggttgtgaggacctccatcagtcatccgaggcgaggggacctgcaaatttacctggtgtccccgtcaggaacgaagtcgcagctgctggcgaaacggctgctcgatttgtccaatgaggggttcaccaattgggagttcatgacagtccattgttggggagaaaaggccgaaggccaatggactctcgaaattcaggaccttccttctcaggtgagaaaccccgaaaagcaaggggatttagaaactccagttgctaaccagctaacaacagaggagagggagcccggtctgaagcacgtttttagatggcaaattgaacaggaactctggtag

SEQ ID NO: 236367 - DNA, 2907 bp, Artificial Sequence
  Description of Artificial Sequence: Synthetic coding sequence
atgccaccaagagcccctcccgctccaggtcctcgtccgccacctcgtgccgcagcagctactgataccgctgccggagccggaggagctggaggcgctggaggcgctgggggacccggttttcgtccactggcacccagaccctggagatggctgctgctcctggcgctgcctgcagcttgctcacctcctcccaggccagtatacacgaatcattgggctgtgcaggtgttaggaggccctgcagaggccgatagggtggctgctgctcatggctacctcaacctcggacagataggaaatttggaagactactaccacttctaccattcaaagactttcaagcggagtaccctttcttcaaggggcccacatacgttcttgcgaatggatcctcaagtaaaatggctgcaacaacaggaagtgaagcgacgagtgaaaagacaggtacgctctgatccccaggccctttatttcaatgacccaatttggagcaacatgtggtacctgcactgcggggacaagaactcaagatgtcgtagtgaaatgaacgtccaggccgcttggaaaagagggtatactggcaaaaatgtggtggtgactatattagatgacggaatcgagcgaaatcaccccgatctcgcgccaaactacgactcatacgccagttatgatgtgaatggcaatgactatgatccgagcccgaggtacgatgcttccaacgaaaataagcacgggacaaggtgtgcgggtgaagtagctgcaagtgctaataacagctattgcatcgtcggcattgcttataacgccaagattggagggatccgaatgctcgatggagacgttacagacgtggtggaggccaagagtctgggcattcggccaaactatatagacatatattccgcatcgtgggggcctgatgatgatggcaagacagtggatggcccaggcaggctagccaaacaggcatttgaatacggaatcaaaaagggccgtcagggcctgggaagcatttttgtctgggccagcggaaatggaggtcgtgagggcgactattgcagctgcgacggctacacaaactccatttataccatcagcgtttcatcggctaccgagaacggttacaagccttggtacctggaagaatgcgctagcaccctggccaccacatattccagtggcgctttctatgagagaaaaattgtgaccacagatctgcgccagagatgcacagacggtcacaccggaacatctgttagcgcccctatggtggccggtatcattgccctggctctggaggcgaactcccaattaacttggcgggacgttcagcatctgttagtcaaaacgtcaagaccggcacatttaaaagcttcagattggaaagtgaatggcgctgggcataaagtgtcacacttttatggattcggccttgttgatgccgaggccttggttgtcgaggccaagaaatggaccgccgtgccaagtcagcatatgtgcgtggcagcaagcgacaagagacctcgttcaatcccattggttcaggtactgcgaactacagctctgactagcgcttgtgcggagcatagcgatcaacgggtcgtgtacctggagcacgtggttgtgcggacaagtattagccacccgagaagaggcgatctgcagatttacctggtaagcccttccgggaccaagtcacagcttctggcgaaaagactccttgatttgtctaacgagggtttcacgaactgggagtttatgaccgttcattgctggggggagaaggcagagggtcagtggacgctggagatccaagacctcccgtcacaagtacgaaatccagaaaaacagggtaaacttaaggaatggtcactcatactatatgggaccgccgaacacccatatcacacattttccgctcaccagtctaggtctagaatgctggagctctctgccccagagttagagccacctaaggcagctttgagtccatctcaggtggaggtgcccgaagatgaggaggactatacagcacaatccacgcccggatcagcaaatattttgcaaactagcgtctgccatccggagtgcggggataaaggttgcgacggccctaacgcagatcagtgcctgaactgcgtccatttcagccttggaagtgtgaaaacttccagaaagtgcgtctctgtttgtccccttgggtacttcggcgatactgctgcccgtaggtgccggcgttgccataaaggctgcgaaacatgttcatcgagggccgctactcagtgcctgtcatgccgacgagggttctaccaccaccaggagatgaacacatgcgttaccctctgccccgcaggcttctatgctgacgagtctcagaaaaactgtttgaagtgccacccctcatgcaagaagtgcgtcgatgagccggagaaatgtaccgtctgcaaagaggggttttcgttggcgaggggctcttgcatcccagattgcgaacccggtacttactttgacagtgagctgattagatgcggcgaatgccaccatacatgcgggacctgcgttggcccaggtagggaggagtgtatccactgcgcaaaaaatttccactttcacgattggaagtgcgtgccagcgtgtggagagggcttctatccagaggaaatgcccggtctgccacacaaagtctgccgccgatgtgatgagaattgcctttcatgtgcgggttcttcacgcaattgttcccgttgcaagacaggctttacgcagcttggcacatcatgcatcacaaatcacacatgctctaatgctgacgagactttctgcgagatggttaagtccaaccggctctgtgaacgaaagctttttattcagttctgctgtcgcacctgcttgttggccggatag

SEQ ID NO: 236368 - DNA, 2868 bp, Artificial Sequence
  Description of Artificial Sequence: Synthetic coding sequence
atgcctccacgcgcacctcctgccccaggcccacgccctccacctagagcagcggctgccaccgacactgctgctggggctggaggagccggtggagcaggtggggctggaggtcccggattccgcccactagctccccgaccttggcgctggcttctgctccttgccctaccagctgcatgcagcccgcctccgaggccggtttatacaaatcattgggcggtgcaggtcctcgggggtcccgctgaagcggacagggtagccgcagctcacggatatcttaatctggggcaaatcggcaacctggaggattactaccacttttatcactccaagaccttcaagcggtccactctgtctagccgcggtccccacacctttttgaggatggacccccaggtgaagtggctgcagcagcaggaagtaaagagaagagtcaagagacaggtgagatccgacccacaggccctgtacttcaacgaccccatctggtctaatatgtggtatctgcactgcggtgacaagaattcaaggtgccgatctgaaatgaatgtgcaggctgcttggaagagaggctacactggaaaaaatgtagtcgttaccatcctggatgatggaatcgagcgcaaccatcctgacttagctcccaactacgatagttacgctagctatgatgtcaacggaaacgactatgatccgtccccgaggtacgacgccagtaacgagaataagcacggcactagatgtgcaggcgaggtcgccgcttctgcaaacaattcgtattgcatcgtggggatagcgtacaacgccaaaattgggggaatacggatgctggatggggacgtaacagacgtggtagaagccaaaagcttgggtattcggccaaactacatcgatatttactccgcctcctggggacccgatgacgacggcaagaccgtggacgggccaggaagattggctaaacaagctttcgagtatggtatcaaaaaaggcagacaaggactcggaagcatcttcgtgtgggccagtgggaatggcggaagggaaggagattactgttcatgcgacggctatactaattccatctataccataagcgtgtcatcagcgactgaaaatggctacaagccgtggtatttggaggaatgcgcatcaactctggctactacatactcctcaggtgccttttatgaacgcaagatagtcaccacagatctgcgtcagcggtgtaccgatgggcatacaggcacaagtgtgtcagcacctatggtggccggtattatcgccctggccctggaggccaattcccagctgacttggagagatgtccaacacttgttagtcaaaacttcaaggcccgctcatctgaaggcctcagattggaaggtgaacggcgctggccacaaagtcagccatttttacggcttcggcctggtggacgccgaagctctggttgtcgaggccaaaaagtggacggccgtgcccagccagcacatgtgtgtggcggcttcagacaaaaggcctaggtcaatccccttagtccaagtccttaggactacggcacttaccagcgcctgtgctgaacatagcgaccagagagtggtgtacctggaacacgtggtggtgcgcacaagtatttcacatcctagacggggagatttacagatctacctggtgtcaccatccgggaccaaatcccagttgttagctaagaggttacttgacctgagtaacgagggcttcacaaactgggaatttatgaccgtgcattgctggggggagaaagctgagggccagtggactctcgagatccaagacctcccttcgcaggtgcgcaaccctgaaaagcaaggcaagttgaaggaatggtctctgatcctttacgggactgcagagcacccttatcacactttcagcgcccatcagagccgctccagaatgcttgaactgtctgcccctgagctcgagccccctaaagccgctctgtctccttcgcaggttgaagtgcctgaagatgaagaggactacacaggggtgtgccacccagagtgtggcgacaagggttgcgacggaccgaacgcggaccagtgcctaaactgtgttcactttagtcttggatccgtcaaaacttccaggaaatgtgtgagtgtttgccctctggggtacttcggtgatacggcagccagacgctgccgaagatgtcacaaaggttgtgagacctgcagcagccgtgcagctacacagtgcttatcttgcagacggggattctatcaccaccaggagatgaatacatgcgtcacgctgtgtcccgctggattctatgccgatgagagtcagaagaattgcctgaaatgtcatccatcttgcaagaagtgcgtagacgagccagaaaagtgcaccgtctgcaaggaagggttctccttggcccgagggtcttgcatcccggattgcgagccaggcacgtacttcgattcagagctcataagatgcggagagtgccatcatacgtgtggaacatgtgtgggaccgggacgagaagaatgcattcactgcgccaagaacttccattttcacgactggaaatgcgttccagcgtgtggggaggggttttaccctgaagagatgccgggactcccccacaaggtgtgcaggcgatgtgatgagaattgcctcagctgcgccggttcctctcgcaactgctcaaggtgtaaaaccggatttacccagcttgggaccagttgcattaccaatcatacatgctccaatgccgatgagacattctgcgaaatggtaaaatcgaaccgcctgtgcgagagaaaattgttcatccagttttgctgccgaacctgtctgctagctggatag

SEQ ID NO: 236369 - DNA, 1869 bp, Artificial Sequence
  Description of Artificial Sequence: Synthetic coding sequence
atgccccctcgggcaccacctgcacccggacccagacctccccctagagccgcagctgccaccgataccgccgcaggtgctgggggagccggaggggctggcggtgctggcggaccgggatttcggccactggcacctaggccatggcgatggctgcttcttctcgctttacccgcagcctgctccgcaccaccacgacccgtctataccaaccattgggctgtacaggtcctgggagggccagcagaggccgatagagtggccgcagcccatggctatctgaacctgggtcaaatcgggaacctcgaggattactatcatttttatcactccaaaacctttaagcgatctacactgtctagccggggaccacacacctttctgcgcatggaccctcaggtgaaatggttgcaacagcaggaggtgaagaggagagttaaaaggcaggtgcggtctgatccacaggcactctatttcaacgatcctatctggtcaaatatgtggtacctgcactgcggagacaaaaattcccgttgtaggtctgagatgaatgttcaagccgcttggaagagagggtataccggaaagaatgtggtcgtaacgattttggatgacggtatcgagcgtaatcacccggacctcgctccaaattacgactcttacgccagttacgacgtcaatgggaatgattatgaccctagccctcgttatgatgccagcaatgaaaacaagcatggcacaaggtgtgcaggcgaggttgccgcatcagccaataattcctattgtatcgtaggcattgcttacaacgcgaagattggaggcatccgaatgttggacggtgatgtaaccgatgtggtcgaggcaaagagcctgggcatcagacctaactatatcgacatttactcagcctcttggggaccggatgatgatggcaagactgtcgatggtcccggaagactggcaaagcaggcattcgaatatggaatcaaaaagggcagacagggcctcggctcaatctttgtgtgggcctctggcaatgggggacgagagggggactactgcagctgcgacggctatacgaactctatttatacgataagcgtttcatcggcaacagaaaacggttacaaaccttggtatctggaagaatgcgccagtactctagccacaacatacagttctggcgctttttacgagaggaagatcgtgaccactgacctgcgccagcggtgtactgatggccataccggtacctcagtgtccgctcctatggtagcgggaatcatcgccctggccctcgaagctaatagtcaacttacatggcgggatgtacagcacctcctggtgaaaacctctcgccctgcacatctcaaggcctctgattggaaggtcaacggagccggacataaggttagccacttctacggcttcggactggtcgacgccgaggccctggtcgtagaagccaaaaagtggactgccgttccctctcaacacatgtgtgttgcagccagcgacaaacggccacggagcatccccctggttcaggtactcagaaccactgcattaacatctgcatgtgccgagcacagcgatcagagggtggtgtacctggaacacgtggtggtgcgcacatcaatctcacacccccgacgcggagacctgcagatatacctggtgagtccttccgggactaagtctcaactcctggccaagagattgctggatctgtccaacgagggtttcacaaattgggagtttatgactgtacattgctggggggagaaggccgaagggcaatggaccctggaaattcaggaccttcccagtcaagtcaggaacccagagaaacaaggcaacctggactag

SEQ ID NO: 236370 - DNA, 1584 bp, Artificial Sequence
  Description of Artificial Sequence: Synthetic coding sequence
atgtacgctctgttcctgctagcgagcttgctgggggcagcgctcgcaggacctgtgctggggcttaaagagtgcacacgcggaagcgccgtgtggtgtcaaaatgtcaagactgcctccgactgcggcgctgtgaagcactgccttcagaccgtctggaacaaaccaactgtgaagtccctgccatgcgatatctgtaaagatgtagtcacagcggctggcgatatgctaaaggataatgccacggaagaggaaattcttgtttatttggagaagacttgcgactggctgccgaaacccaatatgtcagcctcctgcaaagagattgtggattcctatttgccagtaatactcgatatcataaagggcgagatgtcccggccaggagaggtgtgctctgcactcaatttgtgcgagtccctgcaaaagcatttagccgagctgaatcatcagaagcagctggagagtaacaagataccggaactcgatatgaccgaagtggtcgccccatttatggctaatatcccactcctcctctacccacaggatggacccagaagcaagccccaacccaaagataatggagacgtctgtcaagattgcatacaaatggtgactgatattcagacggcagtgcgcacgaactctaccttcgtgcaagcacttgtcgaacacgtgaaggaagaatgtgacagactcggtcctggcatggcagacatttgcaagaattatattagtcagtacagcgagatcgcaatccagatgatgatgcacatgagcgcggagcagccgaaggaaatctgtgctctggtggggttctgcgacgaggtcaaggaaatgccaatgcaaacccttgtccctgctaaggtggcctctaagaatgtgatacctgctctagagcttgttgaacctatcaaaaagcacgaggtacctgccaaaagcgacgtgtactgcgaagtctgcgaattcttggtcaaagaggtgactaaattgatagataacaacaagaccgagaaggagattctggatgccttcgataaaatgtgtagtaaattgccgaaatccctttcagaggaatgtcaggaagtggtggacacctatggctccagcatattgagcatcctactcgaggaagttagcccagagctcgtttgctccatgctgcacctctgttctgggaccaggttacccgctcttaccgtgcacgtgacccagccaaaagatggtggcttctgcgaggtctgcaaaaagctggttggctatcttgaccgcaaccttgagaagaattcgacaaaacaggaaattctcgcagcattggagaaggggtgctcctttctgccagacccttaccagaaacaatgcgatcagtttgtggcggaatatgaacctgtgttaatcgagattctggtcgaggtcatggatcccagtttcgtgtgcctgaaaatcggcgcttgtccaagcgcacacaagccattgttgggcacagaaaagtgcatatggggaccatcatattggtgccagaacaccgagacagctgcccagtgtaacgctgttgagcactgcaaacggcacgtgtggaattag

SEQ ID NO: 236371 - DNA, 1680 bp, Artificial Sequence
  Description of Artificial Sequence: Synthetic coding sequence
atgtatgccctctttttattagcatccctgttaggtgcagcactggctgggccagtcctgggcctgaaggagtgtactcgcggatcagctgtgtggtgccaaaacgtaaaaaccgcttctgactgtggtgcagtgaagcattgcttgcagactgtctggaacaagcccactgtcaagtcccttccttgcgatatctgcaaagatgtggtgactgctgccggtgatatgctaaaagacaatgctactgaagaagaaatcctggtgtatcttgagaaaacgtgtgactggttgccaaaacctaacatgagtgcatcgtgtaaagaaatcgtggactcatatctacccgttatactggacattatcaaaggagaaatgagcagacccggagaggtttgttccgccttaaacctgtgcgagtcacttcaaaagcatctcgcagagttaaaccaccagaaacagctggaaagcaacaagatccccgagctggatatgactgaagtcgtagcacctttcatggctaacatccccctgttgctgtaccctcaggacggacccagatccaagccgcagcctaaggataatggagacgtctgtcaagattgcatccagatggttacggatatccagaccgctgtacgtaccaatagcactttcgtacaggccctggttgagcacgtcaaagaggaatgcgatcggctgggccctggtatggccgacatttgcaaaaactacatcagccaatacagtgagatcgcgattcaaatgatgatgcatatgcagcctaaggagatatgcgcgctggtgggattttgcgacgaagtgaaggaaatgccgatgcaaactcttgtccccgcaaaagttgctagcaagaatgtcatcccagccctggaactggtggagcccatcaagaaacacgaagtcccagcaaaatcggatgtctactgcgaggtatgtgaattcctcgtaaaagaggtgacaaaactgatcgacaacaataaaaccgagaaggagatcctcgatgctttcgacaaaatgtgtagcaaattgccaaagagtttgagtgaggaatgccaggaagtggttgatacgtatggatcctctatactcagtatcctgctggaggaagtgtcacctgaactggtctgtagcatgctgcacctgtgctccgggacccggcttccagcactcacagtgcacgtaacacagcccaaggatggtggattctgcgaggtgtgcaaaaaactggtgggttatctggacagaaacctggaaaagaattctaccaagcaagagatcctggctgccctcgagaagggctgctcattccttccagacccatatcagaagcagtgtgatcagtttgtagctgaatacgagcctgtgctgatcgaaatacttgtggaagtgatggacccttcttttgtgtgcctgaaaatcggagcctgtccttcagctcacaaaccactgctgggtaccgaaaagtgcatatggggtccatcatactggtgccagaatacggaaactgcggcacaatgtaatgccgtggagcattgcaaacggcacgtgtggatcgggtgttggggtgtaggggtcgggagctgcctgtggcctacctgggccccaacgctcttgtctaccagtggatgccaggagaccgccagcaaggcatctcggacatag

SEQ ID NO: 236372 - DNA, 723 bp, Artificial Sequence
  Description of Artificial Sequence: Synthetic coding sequence
atgtacgctctctttttgctagcttctctcttaggcgctgccctggccggacccgtactgggtctaaaagagtgtacacggggaagcgccgtctggtgccagaacgtgaaaacagcttcggactgcggcgctgtgaaacactgtttacagacggtatggaataaacccaccgtgaaatcattaccatgtgacatatgtaaagatgttgtgacagctgctggggacatgcttaaggacaatgcgactgaggaggagatccttgtctatctggaggttagtccggagttggtctgttcgatgctccatctctgctccggaacaagactccctgctcttaccgtgcatgtgacccagccaaaagacgggggattttgtgaagtgtgcaagaagctggtggggtaccttgatcgtaacctagaaaagaactctacaaagcaggagattctcgcagctctggagaagggctgctccttcctgcctgacccgtatcagaaacagtgcgatcagttcgttgcagagtatgaacctgtgctgattgagatcctggtcgaggtgatggaccccagttttgtgtgtctcaaaataggagcctgcccctccgctcacaaacccctcctcgggactgaaaaatgcatatggggcccttcatattggtgtcagaataccgagacagccgcacagtgcaacgccgtggaacactgcaaacgtcacgtgtggaactag

SEQ ID NO: 236373 - DNA, 1581 bp, Artificial Sequence
  Description of Artificial Sequence: Synthetic coding sequence
atgtacgcactgttcctgttggcgtcgctgctcggggctgccctggcgggacccgtgttagggctcaaagagtgtactcgaggcagcgccgtatggtgtcagaatgtcaagaccgcttcagattgtggagcggtgaagcattgcctgcagactgtttggaataagcccaccgttaagagcctgccctgcgacatttgcaaagacgtggtcacagcggcaggagacatgctgaaggacaacgctaccgaggaggaaattttagtgtacctggaaaagacctgcgactggctgcccaaacctaatatgtcggctagctgcaaggagattgtggactcatacttgcccgtgatcctggacatcattaaaggggagatgagcaggcctggcgaggtctgctcagcccttaacctgtgcgaaagtctccaaaaacatctggcggaattgaatcaccagaaacagctcgaaagcaacaaaatacccgaactggacatgaccgaggtcgtggccccatttatggcaaacatcccactgctgctttatccacaggatggtccacgcagtaagccacagcccaaagataatggagacgtttgtcaggactgcatacagatggtcaccgacattcagaccgcagtccgtacgaactccactttcgtccaggctctcgttgagcacgttaaggaagagtgtgatcggctcgggcctgggatggccgatatctgcaaaaattacatttcgcagtactctgagattgccattcaaatgatgatgcatatgttacaacagcctaaagagatttgcgctctcgtaggtttctgtgacgaggtaaaagagatgccaatgcagaccctggttcctgctaaagtagcctccaaaaacgtgattcctgccttggaactggtcgagcctattaagaagcatgaagtgcccgcaaagtctgatgtttactgcgaggtctgcgagttcctggtgaaggaggtgaccaagcttatagacaataataaaaccgaaaaagaaatactggatgcattcgataagatgtgctcaaaattacctaaatcccttagcgaagagtgtcaggaggttgttgacacatacggatctagcatcctgtcgattctgctcgaggaggtatctcctgaactggtttgttcaatgttacacttatgttcaggcactaggctgcccgcactgacagtccacgtgacccagccaaaggatggagggttttgtgaggtgtgtaagaagctggtggggtatctcgataggaatcttgagaaaaactcaaccaaacaggaaattctggccgcacttgagaagggatgctcattcctgccagacccctaccagaagcaatgtgaccagttcgtcgcggagtatgagccagtgctgattgagatattagtggaggttatggatccatctttcgtttgcctcaagatcggcgcttgtccttctgcccataagcccctcttgggaactgaaaagtgcatctggggcccatcttattggtgtcagaacaccgagacggctgctcaatgtaatgccgtggaacactgcaaaagacacgtctggaactag

SEQ ID NO: 236374 - DNA, 1575 bp, Artificial Sequence
  Description of Artificial Sequence: Synthetic coding sequence
atgtatgccctattccttttggcaagcctcctcggggcagcactcgctggacccgtcctcggattgaaagaatgtacccgcggatctgctgtctggtgtcagaacgtgaagaccgcttcagactgcggggctgtgaagcactgtctccaaacagtgtggaacaagcccacagtaaaaagtctgccttgtgacatatgtaaagatgtggttacagccgctggggatatgctgaaggataacgcaaccgaagaagaaattttagtgtaccttgagaaaacctgtgattggttgcctaaacctaatatgagtgcaagctgtaaggaaattgttgatagttacctccctgtgattctggacataattaagggcgaaatgtcccgcccaggcgaggtgtgctccgcactgaacttatgtgaatccttgcagaaacatttggctgagctcaatcaccagaagcagcttgagtccaacaagattccagaattggacatgactgaagttgtcgcaccattcatggccaacatacctcttctgctgtaccctcaggatggccctcgctcaaaaccgcagccgaaagataatggcgatgtgtgtcaggattgtatccagatggtcactgatatccagaccgcagtcaggaccaactctacgttcgtccaggctttggtggagcacgtaaaggaggagtgcgatcggttgggcccaggaatggctgacatctgcaagaactatatctcccaatatagcgagattgccatacagatgatgatgcacatgcagcccaaagagatatgcgctctggtggggttctgtgacgaggtcaaagagatgccaatgcagaccctggtgccagcaaaggtggccagcaaaaacgtaatccctgctcttgaactagtggagccaataaaaaaacacgaggtccccgcaaaatctgatgtctactgtgaggtctgcgagttcctcgtgaaggaggtgacaaagctgatcgacaataacaagaccgagaaagagatcctggatgcattcgataagatgtgcagtaagctcccaaagagcctaagtgaagaatgccaggaggtggtggacacttatggtagctccatattgtctattttattggaggaggtgagcccagagctggtatgcagcatgctccacctgtgttctggaacgcggctgcctgcattgacagttcacgtgacccagcccaaagacggtgggttttgtgaggtgtgcaagaaactagtggggtatcttgacagaaatctggagaaaaactctaccaaacaggaaattctcgccgcactcgaaaagggctgttcttttctcccagatccttaccagaaacagtgtgatcaattcgtcgcagagtacgaacccgtcctaattgaaatcttggttgaggtgatggacccatcatttgtttgtctaaagataggtgcttgcccatcggcacacaagcctctcctcgggaccgagaagtgtatatgggggcctagctattggtgccagaacacagagactgcagcacaatgtaatgccgtcgagcattgcaaaaggcatgtttggaattag

SEQ ID NO: 236375 - DNA, 1353 bp, Artificial Sequence
  Description of Artificial Sequence: Synthetic coding sequence
atgcttaaagacaatgccactgaggaagagattctggtctacctggagaaaacatgcgactggctgcctaaacccaatatgagtgcatcttgtaaggagattgttgatagctatctccccgtcatcctggacatcatcaagggcgaaatgtccagacccggtgaggtttgcagtgctttaaatctctgcgaaagcctgcagaaacacctggccgagctcaatcatcagaagcagctggaatctaacaagatcccagagcttgatatgaccgaagtggtcgcaccatttatggccaatattccactgctcctgtatccccaggatgggcctcgctctaagccccagcctaaagacaatggagacgtgtgtcaggactgtatccagatggtgaccgatattcagacggccgttagaacaaattccacattcgtgcaggccttggtggaacacgtcaaggaggagtgtgataggttaggcccaggcatggctgacatttgcaaaaactatataagtcagtatagcgagattgctatacaaatgatgatgcatatgcaacaaccaaaagaaatctgcgccctggttgggttctgtgatgaggtaaaggagatgccaatgcagactctggtgccagccaaggtggcaagcaagaacgtgattcccgctttggagctcgtggagccaatcaagaagcacgaagtccccgctaagtctgatgtgtactgcgaagtgtgtgagtttctggttaaagaagtaacgaaactgatagacaataacaaaacagagaaggaaatcctcgatgcatttgacaaaatgtgctccaagttacccaagtctttgtcagaggaatgtcaggaagtcgttgacacctatggctccagtatcctgagcattctgttggaggaagtcagcccggagttagtctgctctatgctccacctgtgtagcggaactagactgcctgctttaactgtccacgtgacacagccgaaggacggtggcttctgcgaagtctgtaagaagctagtggggtacctggaccggaacttggagaagaattccaccaaacaggagatcttggcagccctggaaaaaggttgcagcttcctgcccgatccttaccagaagcagtgcgaccagtttgtcgccgaatacgaacctgtcttgattgaaattctagtagaggtcatggatccatcttttgtgtgcctgaagattggggcttgtccaagcgcgcacaagcctcttttgggaacagaaaagtgcatctggggaccgagctattggtgtcagaacacagagactgccgcacaatgcaacgccgtcgaacactgcaaaaggcatgtgtggaactag

SEQ ID NO: 236376 - DNA, 1593 bp, Artificial Sequence
  Description of Artificial Sequence: Synthetic coding sequence
gatggcgcaatgtacgcactgtttctcctggcctcgctgctgggcgctgctctagctggcccagtcctcggattaaaggagtgtacccgcggatcagctgtgtggtgccagaacgtgaagacagccagtgactgcggtgctgttaagcattgcctgcagaccgtatggaacaagcccaccgtgaagagtttgccctgcgacatctgtaaagacgtggtgacagcagcaggagatatgctgaaagacaacgccacggaggaggaaatactcgtctacttagagaagacttgcgattggcttcccaaacctaatatgagtgcatcctgcaaggagattgtggactcctatctccctgtgatccttgatatcataaaaggtgaaatgagtaggcccggtgaagtgtgttccgctctcaatctgtgtgagtcgcttcagaagcatttagcagagctgaatcaccaaaagcagctggagagtaacaagatcccagagctggacatgactgaagtggtggcaccttttatggcgaatatccctctgcttctatatcctcaggatggccctcgaagcaaaccacagccaaaagataatggggacgtttgccaggactgtatacagatggtcactgatattcagactgccgtacgaaccaattccactttcgtccaggcgcttgtggagcacgtgaaagaggagtgcgatcggctgggacctggcatggctgacatttgtaaaaattacatttctcaatatagcgaaattgccattcagatgatgatgcatatgtctgccgagcagcctaaggagatctgtgctctcgtggggttttgcgatgaagtgaaggagatgccgatgcaaaccctagtgccggcaaaggtggcttctaagaatgtgatacccgcattggagcttgtggaacccattaaaaaacacgaagtgccggctaaatcagacgtttactgtgaggtgtgcgaatttctggttaaagaagttaccaaactgatcgataacaacaaaaccgagaaagagatcttggatgcttttgataaaatgtgttctaaactgcctaagtctctgagcgaggagtgccaggaggtggtcgacacctatggcagcagcatcttgagcatcctcttggaggaagtttcacctgaactggtctgcagcatgctgcacttatgctccgggacaagattgccagctctcaccgttcacgtaacacaacccaaagatggcggattctgcgaagtctgcaaaaaactggtgggctatctcgacaggaacttggagaaaaacagtacaaaacaggagatcctcgcagcgttggagaaagggtgtagcttcttacctgatccctaccagaagcaatgcgatcaatttgtcgccgagtatgagcccgtgctgatcgagatccttgtggaagtcatggatccctcttttgtgtgtttgaaaataggcgcttgcccgagtgcacataagcctctactggggactgagaaatgcatctggggcccaagctactggtgtcagaatactgagactgcagcacaatgtaatgcagttgagcactgcaaacggcacgtctggaactag

SEQ ID NO: 236377 - DNA, 2214 bp, Artificial Sequence
  Description of Artificial Sequence: Synthetic coding sequence
atgcccgatcacgactcaaccgcactgctcagccgccagaccaagcgaaggagagtcgacatcggcgtcaagagaacagtgggaacagcgtctgccttcttcgcaaaagccagagcgacattcttctcagctatgaaccctcagggttctgagcaggacgtggaatatagtgttgtccaacacgctgatggggagaaatctaatgtgttgcgcaaactgctcaaaagggcaaatagctacgaggacgcaatgatgccgtttccaggggcaacaattatcagtcagctcctaaagaataatatgaacaagaatggcggaacggagccctctttccaggcatcaggtctcagtagcactggatccgaggttcaccaggaagatatctgcagcaatagctctagggattcccctcctgagtgcctgtcacccttcggtcggccaacaatgtcccagtttgatatggatagactttgtgatgaacacctgagggctaaacgtgccagggtcgagaacatcattcgaggaatgagccatagtccatctgtcgctctgcgcggtaacgaaaacgagagagaaatggcaccacagtccgttagccctcgcgagtcatatcgtgagaacaagcgcaaacagaagttgccccagcagcaacaacagagtttccagcagctcgtctccgccaggaaggaacagaagcgggaagaaagacggcaattaaaacagcagctcgaggatatgcaaaagcagctcagacagcttcaggaaaaattctaccagatatatgattcaaccgattccgagaacgacgaagacgggaacctgtctgaggactctatgcgctctgaaatcctcgacgccagggctcaggatagcgtggggaggagcgacaacgagatgtgcgaactagaccctggtcagttcatagaccgggcaagagcactgattagggaacaagaaatggccgaaaacaaacctaaacgcgaagggaacaacaaggagagggatcatggacctaatagcctgcagccagagggcaagcacctggcagaaacgctcaagcaagagctcaacacagcaatgtcacaggtcgtcgacactgtcgtaaaggtctttagcgccaaacccagtaggcaggtcccgcaggtctttcccccactacagatccctcaggccagatttgcagttaatggagagaatcataatttccacaccgctaaccagcgcctccagtgtttcggtgatgttatcattccaaaccctctggatacattcggaaacgtgcagatggctagctcaaccgatcaaactgaggccctgcctctagtagtaagaaaaaacagctctgaccagtcagcatctgggccagcagctggcggacaccatcagcccctgcaccagtcacccctgtctgccaccaccggattcacaacctctacattccgccacccctttcccctacctctgatggcctatccattccaatccccgcttggagcaccctccgggtcatttagtgggaaggatagagcatcaccagagagcctcgatcttactcgggataccacatcattgcgaactaagatgagctctcaccacctgagtcaccacccctgcagccccgctcatcctccaagtacagctgaagggttaagcttgtcactcatcaagagcgaatgtggagacctgcaggacatgtccgagatttctccctacagtgggtcggccatgcaggaggggctatctcccaaccacttgaaaaaggctaagctcatgttcttttacacacggtacccatcatcaaatatgcttaaaacctactttagcgacgtgaagttcaatcgctgcataaccagtcagcttattaagtggttcagcaacttcagagaattttactatattcagatggagaagtacgctagacaggccataaacgatggggtgacgtctactgaagagctgagcattactagagattgtgagctctaccgtgcactgaacatgcattacaacaaggcaaacgactttgaagtccccgaacgcttcctggaggtagctcaaataactctgcgggagttcttcaatgccatcatagccggtaaggatgttgaccctagttggaagaaggcaatctacaaggtgatctgcaaacttgattcagaggttccagaaatattcaagagcccgaattgcctacaggaattgcttcatgagtag

SEQ ID NO: 236378 - DNA, 2031 bp, Artificial Sequence
  Description of Artificial Sequence: Synthetic coding sequence
atgcctgatcatgattcaaccgctctactgtcccggcagacaaagagaagaagggtagacataggtgtcaagcgcacagttggaacagcttcggcgtttttcgctaaagccagagccaccttcttttcggccatgaacccccaaggttccgagcaggacgtggagtattccgtggtgcagcatgctgatggtgagaaaagtaacgttctgcgtaaactgctaaaaagggccaattcctatgaggatgccatgatgcccttccccggtgcgacaataatttcccagctgttaaaaaacaatatgaacaagaatgggggaactgagccctcctttcaggcttctggcctaagcagcacgggctccgaggtacatcaggaagacatctgtagtaattctagcagggatagcccgcctgagtgtctgagcccatttggcagacctacaatgtctcagttcgacatggaccggctctgcgacgaacatctgagggcgaaacgggctcgggtggagaatattattaggggaatgagccactccccgtccgtggcgctgcgcggaaatgagaacgagagggagatggcgccacagtctgtgtcccccagagaaagttaccgggaaaacaagaggaagcaaaaactgccacagcagcagcagcagagctttcagcagctggtaagtgcacgtaaggaacaaaagcgagaggagagacggcagctcaagcagcagctcgaggacatgcagaagcagttgcggcagctccaggaaaagttttaccagatttacgactctacagatagtgaaaatgacgaggacggcaacctttctgaggattccatgaggagcgagatcctcgatgcgcgtgctcaggattcagtgggtagaagtgataacgagatgtgcgagctggatccaggccagttcattgatcgagcccgtgcccttatccgagaacaggaaatggccgaaaataagccaaaaagggagggcaataacaaagagagggatcatgggcctaattctctgcagcctgaagggaagcacctagctgagaccttgaaacaggagctgaataccgcgatgtcacaggtggtcgacactgtggttaaagttttctcagccaaacctagccggcaggtcccccaggttttcccaccattgcaaattcctcaggctcggtttgcagtcaatggagaaaaccataacttccataccgctaatcaacgtcttcagtgcttcggagatgtcatcatcccgaatcccctcgacacgtttgggaatgtccagatggccagctctacagatcagaccgaagccttaccactggtcgttcgcaaaaattccagtgatcagagcgcctctggccctgctgctggcggacaccatcagcctttacaccagtcacctctgtccgccactaccggtttcaccacgtcaacattcaggcacccttttccactgcccctgatggcatatcccttccagtctccccttggggctccttcgggcagctttagtggaaaagaccgggcttcccccgagagcctggatttgactcgtgatactacatccctgcgcaccaagatgtcatcccaccacctgtctcatcatccgtgctccccagcacaccccccttcaactgccgaaggcctcagtctctctttaatcaagtcggaatgtggggacttgcaggacatgagcgagatttcgccctatagtggaagcgccatgcaggaaggactttccccaaaccatttaaaaaaagcgaaactcatgtttttctacaccagatacccaagttccaacatgctgaagacctatttttccgacgtgaagttcaatcgctgcattacctcccaacttattaaatggttcagtaacttccgggagttttattacatccaaatggagaaatatgccaggcaagcaatcaacgatggggtcacctctaccgaagaactgtccatcacgagggactgcgagctgtatagggccctgaacatgcactacaacaaggccaacgatttcgaatag

SEQ ID NO: 236379 - DNA, 2214 bp, Artificial Sequence
  Description of Artificial Sequence: Synthetic coding sequence
atgccagaccacgattcaaccgccctgctgagtcgacagactaagcgcagacgtgtggacatcggcgttaagcgcactgttggcacagcctcagctttttttgctaaggccagagctacatttttttccgcgatgaacccacaggggtccgaacaggacgtggaatactccgtggtgcagcacgcagacggagaaaagagcaacgtcttgcgcaagctgttaaagagagctaactcgtacgaggatgccatgatgcctttcccgggtgctactatcatttctcagcttttgaaaaacaatatgaacaagaacggagggacggagccctctttccaagccagcggtctttcttccaccgggagcgaagtacaccaggaggacatatgcagcaactctagtcgtgacagccccccagagtgcttgtcacctttcgggaggccaaccatgtcccagtttgacatggaccggctctgtgatgaacatctgcgagctaagagagccagagtcgagaacattatcaggggtatgtcccactcacccagcgttgccctcagaggtaacgagaacgagagggaaatggcccctcagagtgtgtcccccagggagtcgtaccgcgaaaataagcgcaaacagaagctcccacagcagcagcagcagtctttccagcagctcgtttcagccagaaaggagcaaaagagggaggaacgtcgtcaactgaagcaacagctcgaggatatgcaaaaacagctccggcagctgcaggagaagttttaccagatctacgactccacggattcagaaaacgacgaagacggcaatttatctgaagattccatgcgttctgagattctcgatgcaagagctcaggactccgtcgggcgaagtgacaatgagatgtgcgagctggatccaggccaatttattgaccgggcaagagcgctgattcgcgagcaagaaatggcagaaaataagcccaagagagaaggtaacaacaaggagcgggaccacgggcctaactctctgcagcccgaaggtaagcacctggcagagacactaaagcaagaactgaacacagcgatgtctcaggttgtcgacaccgtggtgaaagtattctctgctaagccaagcagacaggttccacaagtctttccccctcttcaaatcccccaggcgagatttgctgtcaacggagagaatcataattttcacaccgctaatcagagattacagtgtttcggagatgttataattcctaatcccctggatacctttgggaacgtgcaaatggcttcttctaccgaccagacggaggccctgcctctggtggtacgcaaaaatagttccgaccagagtgcgtccgggccagcagccggtgggcatcaccagcctctgcatcagtcccctctgtccgctaccaccggttttactaccagcaccttccggcacccctttcccctgcctctgatggcatacccctttcagagcccactgggagcccctagtggttcgttctcgggtaaggacagggctagtcccgaatcgctggatttgacaagagacacaacatccctacgtacaaagatgagcagccatcatttaagtcaccacccttgcagccccgcacacccccctagcactgccgaagggttgtcccttagcctgatcaagagcgaatgcggagacctgcaagacatgtccgagatcagcccgtacagcggaagcgctatgcaggaagggctaagtcctaaccatctcaagaaggccaaactcatgtttttctacacacgctacccctcgtctaacatgctgaagacatactttagtgatgttaaatttaaccgctgtatcacaagtcagttaattaagtggtttagcaacttcagggagttctactatatccaaatggaaaaatacgcacgtcaagctatcaacgacggcgtgacgagcacggaagaactttccatcactcgcgattgcgaattgtatcgagccctcaacatgcattacaataaagccaatgacttcgaggtgcctgagagatttctggaggtggctcagatcacgctccgagagttttttaatgccattattgccggtaaagatgttgacccaagctggaaaaaagctatttataaagtgatctgtaaactagattctgaggtgcctgagatatttaagagcccaaactgcctgcaggaattactgcacgagtag

SEQ ID NO: 236380 - DNA, 693 bp, Artificial Sequence
  Description of Artificial Sequence: Synthetic coding sequence
atgcctgatcatgatagcactgcactcctgtccagacagaccaagagaaggagagttgatatcggagtaaagcgcaccgtgggaacagcttctgccttctttgccaaagccagagcgacattctttagcgccatgaatcctcagggatcggaacaagatgtggagtacagcgtcgtgcagcacgctgacggcgagaagtcaaacgttctgaggaagcttctaaagcgggctaactcttacgaagacgcgatgatgcccttcccaggcgctacaatcattagtcagctgctgaaaaataatatgaacaaaaatggcggaactgagccctccttccaggcttccgggctcagtagtacgggcagcgaggtccaccaagaggacatatgttccaacagcagccgagatagcccaccagaatgtctcagcccctttggcagacccaccatgtctcagtttgatatggaccgtctgtgcgatgagcacctgagagcaaagcgcgcaagggtcgaaaatattattcggggtatgtctcactccccatcagtggccttacgcggaaatgaaaacgagcgagagatggctccccaaagcgtgagccctcgcgagtcttatcgggagaataagcgaaaacagaagctgccgcagcaacagcaacaatccttccagcagctggtttctgccagaaaggagtag

SEQ ID NO: 236381 - DNA, 2214 bp, Artificial Sequence
  Description of Artificial Sequence: Synthetic coding sequence
atgcccgatcatgacagcaccgcactgctctctagacagactaaaagacgacgtgtcgatatcggggtgaaaaggacagtcggcacggcatctgccttcttcgcaaaagcccgagccacattcttttctgccatgaacccccagggatctgaacaggacgtggagtattctgttgtgcaacacgctgacggcgagaagtccaacgttctgcgaaaactgcttaaacgggctaattcatacgaggatgcaatgatgccgttccctggcgctaccattatttcacaactgcttaaaaacaatatgaacaaaaatgggggaactgaaccttcctttcaagctagtggcctgtcctcaacagggagcgaagtgcaccaagaagatatatgttccaatagcagtagagacagcccccctgagtgtctgtcaccatttggtcgcccaacgatgtctcaatttgatatggacagactgtgcgatgagcatcttcgagccaagagagcgagagtggagaacattatccggggtatgagccacagccccagcgtggccctgagagggaatgagaacgagcgggaaatggcccctcagtccgtgtcgccgagagaaagctaccgcgagaacaaacgcaagcagaagctgccgcagcagcagcagcagtcatttcaacagctcgtttcagctcgaaaggagcagaagcgtgaggagaggcgccagcttaagcaacaacttgaagatatgcaaaaacagctgcgtcagttacaagagaagttctaccaaatttatgatagcaccgactcagaaaatgatgaggacggtaacttgagtgaggactcaatgcgcagtgagattctggacgcccgtgcccaggattcagtcggccgttccgataacgagatgtgtgaactagatccgggacagtttattgatagggccagagctctgattcgggagcaagaaatggctgagaacaagccaaaaagggaaggaaacaataaggagagagaccatggaccaaattcattgcagcctgaaggtaagcacctggcagagacgcttaagcaagagctcaacacagccatgagccaggtcgtggatactgtcgtcaaagtcttttccgccaagccatccagacaagtgccccaggtgtttccccctctccagataccccaggctaggttcgctgtcaacggggaaaatcataatttccacaccgctaaccagaggttacagtgttttggggacgttattatccctaaccccctggacacatttggcaacgttcagatggcttcttctactgatcagaccgaggccttacccctggtggttcggaaaaatagcagtgatcagtcagcgtcagggccagccgctggcggacaccatcaacctctccaccagtcacctttaagtgcaacaacagggttcactacaagtacattcagacaccctttccctctccctctgatggcatatccattccagtctccactcggggcaccctcagggagtttttctggaaaagaccgcgcaagtccagaaagtctggatctaacacgagacacgacctccctgagaaccaagatgagtagccaccatctgtctcatcacccctgttctccggcacacccgccttccaccgctgaaggcctttcactgagcctgataaagtctgaatgtggcgaccttcaggacatgagcgagatatctccttactcaggtagtgccatgcaggagggcttatccccaaaccatctgaaaaaggccaagctaatgttcttttatacccgttatcctagttctaacatgctcaagacttacttctccgacgtgaagtttaaccgatgtatcacctcacagctgataaagtggtttagcaatttcagggagttttattacatacagatggagaagtacgcaagacaagctatcaatgacggcgtgacatctactgaagagcttagcattacccgcgattgtgaactgtaccgggctctgaacatgcattacaataaagccaatgactttgaggtcccagaacgattcctcgaggtggctcaaatcacactgcgtgaatttttcaacgccatcattgccggtaaagatgtcgatcccagttggaagaaggctatctataaagtgatttgcaagctggactccgaagtgcccgaaattttcaagagccccaattgcttgcaggaactcctacacgaatag

SEQ ID NO: 236382 - DNA, 930 bp, Artificial Sequence
  Description of Artificial Sequence: Synthetic coding sequence
atggccagttccactgatcagactgaggctctgccgctcgtggtgagaaagaattcgtctgatcagtcagcaagcggacctgctgccggagggcatcaccagcccctgcatcagtccccgctgagcgctacaactggctttactacctccacttttcgccatccatttcccctgcctttaatggcatacccttttcaatcgcctcttggagccccttctggaagcttcagcggcaaagacagagccagtcccgagagtctggaccttacacgtgacaccacgtctttacgtaccaagatgagttcccatcacctgagccaccacccttgttcaccagcacatcccccatccaccgccgaaggtctgtcgctgtcactcataaagtcagagtgtggcgacctgcaggacatgtcggaaatcagcccatacagtgggtccgctatgcaggaaggcctctctccaaatcatctaaagaaagctaagctcatgttcttctacaccaggtacccatcttcaaacatgctgaagacctatttttctgacgtgaagttcaaccgctgcatcaccagccagctgatcaaatggttctcaaactttcgcgaattctattacatccaaatggagaaatatgcccgtcaggctattaatgatggggtcacaagtactgaggagctcagcatcacccgggattgcgagctgtatagagcactcaacatgcactacaataaagccaacgatttcgaagtacctgagaggttcctggaagtggcacaaattactctgagggagttctttaacgcaattatagctggaaaggatgtggatccatcttggaaaaaggccatttataaggtgatctgcaaattggactctgaggttcccgaaatctttaaatccccaaattgtctgcaggagctgttacacgaatag

SEQ ID NO: 236383 - DNA, 1080 bp, Artificial Sequence
  Description of Artificial Sequence: Synthetic coding sequence
atgaaaagcccattctatagatgtcagaacacaactagtgttgagaagggaaacagcgccgtgatgggcggtgttctgttctcaaccgggttgctcggcaacttgctggcgctcgggctccttgccagaagcggattggggtggtgttcacggaggccattgagacctctgccaagcgtcttttatatgctggtgtgcggtttaaccgtcacggatctgctggggaagtgcctcttgagtccagtggttctcgcagcttatgcacagaatcgatcccttagggtcttggctccagcactcgataactccttgtgccaagctttcgctttcttcatgagcttcttcggcctctcgagtacactgcagctgctggccatggccctcgagtgttggttgtccctgggtcatccgttcttctatcggaggcatataactctgaggctgggagcactggtagcccctgtcgtctcagcattctctcttgcgttttgcgccctacccttcatggggttcggcaaattcgtacagtactgcccaggcacctggtgctttattcagatggttcacgaggaagggagcctgtctgtgctggggtactctgtgctgtacagttccctcatggcactgctggttctcgcaactgttctgtgcaacttaggggctatgagaaatctgtatgcgatgcatagacgcttacagaggcacccacgtagctgtacccgcgactgcgctgagccacgggcagatggtagggaggcctctcctcagcccctagaggaactggaccacctcttgctgctggcccttatgacagtactgttcacaatgtgcagcctgcccgtaatttatagggcatactacggggcatttaaagatgttaaggagaagaaccgaactagtgaagaggccgaagatctgagggcactgcgttttctttcggtgatttccattgtagatccctggatattcataatctttcgctctccagtcttccgaatcttttttcacaagattttcattcgccctttgcgatatcggtcacgctgctccaattcgacgaacatggagtcctccctgtag

SEQ ID NO: 236384 - DNA, 8034 bp, Artificial Sequence
  Description of Artificial Sequence: Synthetic coding sequence
atgagcacatgttgttggtgtactcccggaggcgcaagtaccatagatttcctgaaacgctacgcttccaataccccctctggggagtttcagacggccgatgaggatctctgttactgcctcgagtgtgtagctgaataccacaaagcacgggacgaactgccttttctccatgaggttctctgggagctcgagactctcaggctcataaaccacttcgagaaatctatgaaagccgagatcggggatgacgacgaactgtatattgtggacaataatggcgagatgcctctctttgacattacgggccaggatttcgaaaataagcttcgggtacccctcctcgaaatcttgaaatacccgtacttattactgcacgagcgcgtcaatgagttgtgcgtggaggctttgtgtcggatggaacaggccaattgcagtttccaggtatttgataagcaccccggaatctatctgtttttagtccatcccaacgaaatggtgcggagatgggcaattctgaccgcgcgaaatttgggcaaggtggatcgcgatgattactacgatctgcaggaggtgttactttgcttattcaaggtgattgagctgggtttattagagagcccagatatttatacgtcctccgtgctggaaaaggggaagcttatcttgcttccctcacacatgtatgacactaccaattacaagtcgtattggttggggatctgtatgctactgactatcttggaagaacaggcgatggattctcttctgctgggctcagacaagcaaaacgatttcatgcaatccattttacacactatggaaagagaggcggacgatgatagtgtcgatcctttctggccagctttgcactgcttcatggttattctagatcggctgggatccaaagtctggggccagctaatggatccgattgtcgcatttcagactataatcaataacgcatcctataatagggagattcgacacattaggaactcatctgtacggaccaagctagaacctgagtcttacttggatgacatggtaacatgctcgcagatcgtgtataattataatcctgaaaaaaccaaaaaggactcgggctggaggacagcgatctgcccagattattgcccgaatatgtacgaggagatggagacactcgctagcgtcctccagagtgacattggccaggatatgagagtacacaattcaacattcctgtggtttatccctttcgtacagagcctgatggacctgaaagaccttggggttgcatatatagcccaggtagtgaatcacctgtactccgaagtgaaagaagtgctcaatcagaccgatgctgtgtgcgataaagtgactgagttttttcttttgatactcgtgtctgtgatcgagctacatagaaacaagaaatgtctgcacttattgtgggtgtccagccagcagtgggtcgaggccgtcgtgaagtgtgcaaagctccccacgaccgccttcaccaggtcaagtgagaagagctctggcaactgctcaaagggtaccgctatgataagttccctttcgttacactcaatgccatccaacagcgtccagctggcctatgtccagctcatcaggtctttgctgaaggaggggtatcagctgggacagcaatctctgtgtaagcgcttctgggataaactcaatctattcctgaggggcaacctttctttgggctggcagctaacatcccaggaaacacacgagcttcagtcgtgccttaagcaaattatcagaaatattaaatttaaagcccctccatgcaatacctttgtggaccttacaagcgcttgcaagatttctcccgcttcctataacaaggaggaatccgagcagatgggaaaaactagcaggaaagatatgcattgcttagaggcaagctcacctacgttttccaaggagcccatgaaagtgcaggacagcgtcctcataaaagcagataataccatagaaggtgacaataacgaacaaaattatattaaggatgtgaagctggaagaccacctgttggcaggttcttgtttaaaacagtcttccaaaaatattttcaccgaacgtgctgaagatcagatcaagatcagcacacgaaaacaaaagtccgtcaaagagatttcctcatacaccccgaaggattgtacctctcgtaacggcccagagaggggatgcgaccggggaattatcgtgtccactaggctactcacagatagtagcacagatgctttggagaaggtcagcacatctaacgaggatttttcccttaaagacgacgcccttgccaaaaccagcaagaggaaaactaaagtgcagaaagatgagatttgcgctaaattgtctcatgtgattaaaaagcagcaccgtaaatcaacattggtcgataacacaatcaacctcgacgagaatctcacagtgtcaaatattgaatcgttctactccaggaaagatacaggagttcagaaaggtgacggatttatccacaatttaagcttagaccctagtggtgttctggacgataagaatggggagcagaaaagccaaaataatgttttgcccaaggagaagcagttgaagaatgaggaactggttatttttagttttcatgaaaacaattgcaagatccaggagttccatgtggatggcaaggagctgataccttttactgaaatgacgaacgcttcagaaaaaaagtcatctcccttcaaagacctgatgactgtccccgaatccagagacgaagaaatgagcaactctacttccgtgatttactccaatttgaccagagaacaagcaccagatataagtcccaagtctgacactcttacggactctcagatcgatagggaccttcataaactttcattgttggctcaggccagcgttatcacattcccctccgactcaccccagaatagcagccagctgcagcgcaaggtcaaggaggacaagagatgcttcacagctaatcagaataacgtgggcgataccagcagagggcaggtaatcatcatttccgatagtgacgacgatgatgatgagcgcatcctttctctagagaaactgacaaagcaagataaaatctgtctggaacgagaacatcctgaacaacatgttagtaccgtgaatagtaaggaggaaaagaatccagtcaaggaagagaaaaccgagacgctcttccagtttgaagagtctgacagccaatgtttcgaatttgagtctagctccgaggtcttcagcgtttggcaggaccatccagacgataataatagcgtgcaggatggagagaagaaatgtctcgcacccatcgcaaatacaacaaacggccaaggttgcactgactatgtcagtgaggtagtgaaaaagggcgcagagggaatagaggaacatactcggccaaggagcatttctgtggaagagttttgcgagatagaagtgaagaaacctaagagaaagcgctcagaaaaaccaatggcggaagatccagtccggccttcgtccagtgtcaggaacgaaggccagtctgacacgaataagcgtgatctggtaggaaatgactttaagagcatcgatcgcagaacctcaacccctaacagccggatacaaagagcaactactgtttcccaaaagaagagcagcaaactttgcacgtgcaccgagcccatcaggaaggtgcctgtctcaaagacgcctaaaaagacccactcggatgccaaaaagggccaaaatcgatcctccaactacttaagctgtagaactaccccagccattgtgccacctaagaaattcagacagtgccccgagccaactagtaccgctgagaaattaggcctaaagaaggggccacgcaaggcctacgaactgtctcagaggtccctagattacgtggcacagctccgggatcacgggaagacagtaggcgtcgtggacacacgcaagaagactaaacttatttcaccccagaacctatccgttcgaaacaataaaaaacttctcacatcccaggaactccagatgcagagacaaattagacccaagtctcagaaaaacaggaggaggctgtccgactgtgagagcacagatgtgaaacgcgctggttctcacactgctcagaactctgacattttcgtgcctgaatccgatcgctccgattataattgcacagggggaactgaagtgctcgccaactcgaatcggaagcagctgataaagtgtatgccgagcgaaccggaaacaatcaaggccaagcacgggtcccctgctacggatgacgcctgtcctctgaatcaatgcgactccgtggtactgaacggtactgtccccaccaatgaggttattgtgagcaccagtgaggacccccttggaggaggggacccaaccgcgcgacacatcgaaatggccgcactcaaggagggggagcccgatagcagctcagacgctgaagaagataacctgtttttaacccagaatgatccagaggatatggacctgtgtagtcagatggagaatgacaattacaagctcattgaacttatacacggaaaggacaccgtggaagtggaggaagactccgtttcccggcctcagcttgaatctctgagcggtacgaaatgtaagtataaggattgcctggagactaccaagaaccagggagaatactgccccaaacattccgaagtaaaggccgctgatgaggatgtttttagaaagcccggattacccccacccgcttcaaagcctcttcgccctacaaccaagatattctcttccaaaagcacctctcgtatcgcaggcctgagcaaaagccttgagaccagtagcgccttgtctccatctctgaagaataagagcaaggggattcaatctattctaaaggttcctcagcctgtccccctaatagcgcagaaaccggtgggcgagatgaagaatagctgcaacgtgttgcatccccagtctcctaacaatagcaataggcaaggctgtaaggttccttttggtgagagcaagtacttcccctccagttccccagttaatatcctcctgagcagccagagcgtcagtgacacttttgttaaggaggtgcttaagtggaaatacgagatgttcctgaatttcggacaatgtgggcctccggcaagcctctgccaatcaatctctaggcccgttcctgtgcgtttccataactatggagattatttcaacgtcttttttccactcatggttttaaacacgttcgaaactgttgcccaggaatggctgaatagccccaatagagagaatttttatcagctgcaggtgcggaagtttcccgctgactatatcaagtactgggaattcgccgtttatctcgaggagtgtgagcttgcaaaacagttgtatcctaaggagaatgatctggtcttcttggcacccgaacgcattaatgaagagaaaaaagatactgagagaaatgatatccaggaccttcacgagtatcattccgggtacgtccacaagtttcgccgaacatcagtgatgaggaatggcaagaccgagtgttatctgtcaattcaaacacaggagaacttccccgcaaacttaaacgagctcgtgaactgcatcgtcattagttccctggtgactacacagcgaaagctgaaggccatgagtcttctaggttctcggaatcaattggctagggcagtgctaaaccctaatcccatggacttctgcacaaaagatctgctgacaacgacaagtgagcggattatcgcctacctgcgggattttaatgaggatcaaaaaaaggctattgaaaccgcctatgcgatggtcaagcactcgccaagcgtcgccaaaatttgtctaatccatggtcctccaggcacaggtaaaagcaagacgatcgtgggactgctatatcgccttctgacagagaatcagagaaaaggacattcagatgagaattcaaacgcaaaaattaaacaaaatcgtgtgttggtttgcgcaccatcaaacgccgctgtcgatgaattaatgaagaaaatcatcctggagtttaaagagaagtgcaaagacaaaaagaaccccttgggcaactgcggagacatcaacctcgtgcggctcggaccggagaaatcaatcaattcagaggtcctgaaatttagtttagactcccaggtgaatcaccgcatgaaaaaagagctgccctcccacgtacaggccatgcataagcgtaaagagtttctggactaccaactcgacgaactgtctagacaaagggccctctgtcgagggggtagggaaattcagaggcaggagctggatgagaatatctctaaggtcagcaaggaacggcaagagctggccagcaagattaaagaggtccaaggacgcccacaaaagacccagagtattatcatcctggagtcgcacattatatgctgtaccctgagcacttcaggcggtcttttactggagagcgcattcagggggcaaggtggagtgcctttttcttgtgtgatagtggatgaagccggacagagctgcgagatcgaaaccctcaccccgctcatacacagatgtaataaactgatcttagttggcgaccccaagcagttgccacctaccgtcatctcaatgaaggctcaagaatatggatacgatcagtctatgatggcccgtttctgcagactcttggaggaaaatgtcgaacataacatgatctctcgcctccccatcctccagctcaccgtacaataccggatgcaccccgatatttgcctgtttccttcgaactatgtatataatagaaatctcaagacaaatcgacaaactgaggctattcgctgctcatccgactggccctttcagccctatttagtgtttgatgtcggagacggatctgagaggagagacaacgactcatatattaatgtgcaagaaataaagctcgtgatggagataattaaactgatcaaggataagagaaaggacgtcagcttcaggaatattgggatcataacccactataaggcccagaagactatgattcagaaggatctggataaggaattcgatcggaaggggcctgccgaagtcgacaccgtcgatgctttccaggggaggcagaaggattgcgtgatcgtcacatgtgtacgcgcaaattcgatacagggatccattggttttctcgcctcattgcagagactgaatgtgaccattaccagggccaagtacagtctgtttatcctggggcacctgaggactctaatggagaatcagcattggaatcagctgatccaggacgcccagaagcgaggagccataatcaagacatgcgacaaaaattatcgccatgatgctgtgaaaatcctaaagttgaagccggtgctgcagcgtagcttgacacatccccctactattgcaccagaagggagccgccctcagggcggactcccatcatcaaagttagacagtggattcgctaagaccagcgtcgccgcatctttatatcatacccccagcgatagcaaggaaatcacacttacggttacctccaaggacccagaacgaccccctgtacatgatcagctgcaggatcctagactgctgaagcgcatgggaatagaggtcaagggtgggatcttcctctgggatccgcaaccctcttctccacaacaccccggtgccacaccaccgacaggcgagcctggatttccagtagtgcatcaggatctgagccacatccagcagcctgcagcagtagtcgccgctttatcatctcacaaaccccctgtgagaggggagcccccagcagcgtcaccggaggcgtccacttgccagagcaaatgtgacgacccggaagaagaactttgccaccgccgtgaggcccgtgccttcagcgaaggtgagcaggaaaaatgcgggagtgagacacaccatacaaggcgcaattcacgctgggacaaaaggacattagagcaggaggactccagcagcaaaaagagaaaattgttgtaa

SEQ ID NO: 236385 - DNA, 483 bp, Artificial Sequence
  Description of Artificial Sequence: Synthetic coding sequence
atggctacacaccatactctgtggatggggctggccttactgggggtgttgggggacctgcaagctgccccagaggctcaagtctctgtccagccaaattttcagcaggataaattcctcgggagatggttcagcgccggtctggcgtccaattccagttggctgcgggaaaagaaggctgcactgtccatgtgcaagtccgtggtagcgccagcaaccgacgggggactaaatctcacttctacctttctgcgcaagaaccagtgtgagacccggacaatgctgctccagccagccggttctttgggatcctattcctatagaagcccaagggagtggggcctccaccggcctccaggccctagcctgggggcaacgctcgctggaactactttgggacaaccacctgctgccgagatccatggggtgggcggtgatggatgtccaaccagtgtaagaggcaagggacaagcctgggcctag

SEQ ID NO: 236386 - DNA, 573 bp, Artificial Sequence
  Description of Artificial Sequence: Synthetic coding sequence
atggcaacccaccataccctgtggatggggttagccctgctgggagtgctcggtgatctccaggcagctcccgaagcacaggtctctgtgcaaccgaattttcaacaggataaatttctaggacgatggttctccgcagggttagcctccaatagcagctggcttcgcgaaaagaaggccgctctgagtatgtgtaagagcgtggtggcaccagcaaccgatggcggactgaacttgacgagtacatttctcaggaagaaccagtgtgaaacgcgaacaatgctcctacagccagctggatcacttgggtcctacagctaccgaagtcctcactggggctcaacgtacagtgtatctgtggttgagacagattacgaccaatacgctcttttgtactcccaagggtccaaagggcctggagaggacttccgaatggctaccctgtattctagaacacagacccctcgagcggagctaaaggaaaagttcaccgcattctgcaaagcccagggatttacagaagatacaatcgtctttctgccacagaccgataagtgtatgaccgagcaatag

SEQ ID NO: 236387 - DNA, 189 bp, Artificial Sequence
  Description of Artificial Sequence: Synthetic coding sequence
tagggttatcattgtctcccagcccctaacagggcacagggagaagtcggaggcgatggaggctccgtccaattcggtggctccgtgaaaacatcatctgccctgcgcgaggaacaggaggcccagtgggaaaactggccaaaaagcggcgtgttgaccaccgccccagggtttttcctgggaaggtag

SEQ ID NO: 236388 - DNA, 642 bp, Artificial Sequence
  Description of Artificial Sequence: Synthetic coding sequence
tagctacgtggagggggtcagttcctgggcaggggcgtccgcggagttgccgcacgtggcatcgggaggggaggcggagcgggtctggagactggaggtgtcgacggtcggggagcacccgctggtagacgccgttgggtccgcagagtcctggcagatgccggtggcggacgctccccgcaattcctgggcaggtggttcagcgcaggtctggcaagtaactcttcttggctgagggagaagaaagctgccctgagcatgtgcaagtctgtggttgcccctgccacagatggtggcctcaacctcaccagcactttcctgcggaaaaatcagtgcgaaacgagaaccatgctcttgcagcctgcaggatctctagggtcctacagctatagatctccccactggggatctacctatagcgtttctgtcgtcgaaaccgactacgaccagtacgctctcctgtattcccaaggctctaaaggccctggagaggacttccgcatggccaccctatactccaggacacagacccctcgtgcagagttgaaagaaaagttcaccgcattttgcaaggcacagggttttacagaggataccattgtgtttttgccccagaccgacaaatgcatgaccgaacagtag

SEQ ID NO: 236389 - DNA, 588 bp, Artificial Sequence
  Description of Artificial Sequence: Synthetic coding sequence
atggccacacatcatactttgtggatgggactggcattgttgggggtgctgggcgacctccaggctgcacctgaagctcaggtctcggtccagcccaattttcagcaggacaaatttcttgggcgttggttttcggctggactagcttctaatagtagctggctaagggagaaaaaggcagcacttagtatgtgcaagagcgttgtggcccctgcgaccgatgggggactgaatctcacctccacgtttttgagaaagaatcagtgtgaaacgcgcacaatgctcctccagcctgccggaagtctcgggtcttactcctatagatcaccgcgtgaatggggtctgcatcgaccccctggacccagcttaggcgcaactctggcaggcaccaccctcggtcagccgcctgccgcagaaattcacggggtcggcgactggggctcaacgtattccgtgtctgtggtagaaacggattacgatcagtacgccctgctgtattctcaagggtccaagggacctggcgaggatttccgcatggccacattgtattctcggacccagacaccccgagctgagctgaaggagtag

SEQ ID NO: 236390 - DNA, 573 bp, Artificial Sequence
  Description of Artificial Sequence: Synthetic coding sequence
atggccacacaccatactttgtggatgggcttggcattgctgggcgttctcggggatctgcaggcagcgcctgaagcccaggtgtccgtccaacccaacttccagcaggataaattcctcggcagatggttctctgccggtctggcaagtaacagttcttggcttcgggaaaaaaaggcggctctttcaatgtgcaagtcagttgttgcacctgccaccgacgggggtctcaatctaacatcaacatttctccggaaaaaccagtgtgaaacaagaaccatgctcctccaaccagcaggatcactgggttcatacagttataggtctccccattggggttctacttactctgtctccgtggtggaaacagactacgaccagtatgccctactttatagccaaggttctaagggcccaggagaagactttagaatggcgacattatattctaggacgcagacaccacgcgcagagctgaaagaaaaattcactgccttttgcaaggcacaaggctttactgaagacactattgtcttcctgcctcaaaccgacaaatgtatgaccgagcagtag

SEQ ID NO: 236391 - DNA, 1209 bp, Artificial Sequence
  Description of Artificial Sequence: Synthetic coding sequence
atgtccccctgtggaccgctcaacttgtctcttgcaggggaggccaccacttgtgctgcaccctgggtccccaatacgtcggcagtgcctcccagcggcgcatcacctgcgttacccatatttagcatgacgttgggtgccgtgtctaatctgctggccctagctctgctggctcaggccgcaggtaggctgcgtcggagaaggtccgctgctacctttctcttattcgtcgcttccctgctagcgactgacttggcgggtcacgtgataccgggagcactagtgctgcgcctgtatacagccggacgtgctcccgctggaggggcttgccatttcctgggtgggtgtatggtgttctttggactgtgtcctctgctcctcggatgtggcatggccgtggagaggtgcgtgggagtcactaggcctctgctgcacgctgccagggtcagtgtcgccagggctagactcgccctggccgctgtggctgctgtggcactggccgtggctctgcttcccttggccagagtgggcagatacgagcttcaatatcccggaacatggtgttttatcggcctgggccctcctgggggatggcgccaggcacttctcgctggcctcttcgcttccctcgggttggtggctctgctcgctgcgcttgtctgtaatacactgagcggtctcgcacttctacgagccaggtggaggcgtcgcagcaggcgccctcctcccgcttccggccctgactctaggcgcagatggggcgctcacggccctcgctccgcctccgcatctagtgcaagcagcatcgcctctgcctcaactttttttggaggatccagatctagcggaagcgctcgcagagccagagcgcatgacgttgaaatggtgggtcagctggtaggtatcatggtggtgagctgcatctgttggtcgcctatgctggttcttgtcgccctggccgtcgggggttggtcctctacttctttgcaacgtccactctttctcgctgtgcggttagcttcatggaaccagatactggacccgtgggtgtacatactccttaggcaagcggtgctgaggcagttgctcagactgctccctccacgggcaggcgcaaaaggcggacccgctggactaggcctgactcccagcgcctgggaggcgagtagtctgcgctcttcccggcacagtggccttagccacttctag

SEQ ID NO: 236392 - DNA, 1077 bp, Artificial Sequence
  Description of Artificial Sequence: Synthetic coding sequence
atgggaaatgcatcaaacgatagtcaatccgaagactgcgaaaccagacagtggttgccaccgggagaatctccggctatttcatccgtaatgttctcagccggagtgctggggaatctaatcgcattggccctcctggcccgaaggtggagaggcgatgtcggctgctccgctggtcggagatcctcgctttctctgtttcatgtgttggttactgagcttgtctttactgacctgctgggcacctgtcttatttctccagttgtcttggcttcctacgccaggaatcaaacgctggtggccctagcgcctgagagtagggcctgtacgtatttcgccttcgctatgacgttcttcagcttggcaacgatgctgatgctgtttgccatggcactggaacgttacctgtctattgggcacccctatttctatcagaggagggtttctcgctcaggcggattggccgttctgcctgttatttacgctgtttcactgttgttctgtagcttaccactgcttgactacggccagtatgtacagtactgtcccggtacatggtgtttcattaggcatgggaggactgcatacctgcagctgtatgccaccttgctcttactcctaattgtgtcagtgctggcctgtaacttctctgtcattttgaatctgattcggatgcatcgtcgaagccggaggtcccgctgtggtccctccctaggcagcgggagggggggaccaggcgcacgtcgcagaggggagagggtaagtatggcagaagaaaccgatcacctgattctccttgccatcatgaccatcacatttgcggtctgcagcctgccctttaccatctttgcttatatgaacgagacctcttcgcgcaaggagaaatgggacttacaggccctgcggttcctaagcattaactctattattgatccatgggtgtttgctatcctcagaccccctgtgttaagattaatgcggtcagtcctgtgttgtaggattagcctccgaacccaagatgcgacccagactagctgtagcacacaatcagacgcctcaaagcaagctgacctgtag

SEQ ID NO: 236393 - DNA, 1173 bp, Artificial Sequence
  Description of Artificial Sequence: Synthetic coding sequence
atgaaggagacacgagggtacggaggtgatgcgcctttttgtacacggctgaaccattcatacactgggatgtgggccccagagcggagtgcagaagctcgcggaaaccttacacgaccgcctggatctggggaggattgcgggagtgtctcagtcgctttccccatcacaatgttgctcacaggattcgtgggcaatgcattggctatgctgctcgtaagcagatcatatcggagacgggagtccaaacggaaaaaatccttcctcctttgtattggttggctggcgctgacagacctggtaggacagctgctaaccacacctgtggttatcgtagtctacctaagcaaacagcgatgggagcatatcgacccatctggacgactgtgcacattctttggactcacgatgactgtgtttgggttgagctcattgtttatcgccagtgccatggcagtggagcgcgctctggccattagggctccccactggtatgcatcccatatgaagacccgagctactcgggcagtgctcctgggtgtctggctggcggtgctggcgttcgcgctgctccctgtcttaggcgtgggtcagtatacagtccagtggccagggacatggtgttttatcagcacgggacgcggaggaaacggcacaagctccagtcataactggggaaacttatttttcgcatctgcatttgccttcctgggccttctcgcgctcaccgttactttctcctgtaacctggccactataaaggcgctcgtctcacgctgccgcgctaaagcaaccgctagccaatcatccgcgcaatgggggcgtataacaacagagacggcaattcagctgatgggcatcatgtgtgttctgagcgtgtgttggagtccccttctcattatgatgctcaaaatgatcttcaaccaaacctcggtggaacactgtaaaacacacacagagaagcagaaggagtgtaattttttcttaatcgcagtaagattagcgtcactcaatcagattctggatccctgggtctatctgctcctacgcaagatactactgaggaagttttgccagatcagataccatacgaataattatgcttctagttccacaagtctgccgtgccagtgtagttcaacactcatgtggtcagaccacttggaaagatag

SEQ ID NO: 236394 - DNA, 1260 bp, Artificial Sequence
  Description of Artificial Sequence: Synthetic coding sequence
atgaaagagacccggggatacggcggtgacgcccctttttgcacacgactcaatcacagttacaccggtatgtgggcgccagagaggagcgctgaagcacgcggaaacctcacaaggccccctggcagcggggaggactgcggatcagtcagtgtagcgttcccgattactatgctgttaacaggtttcgtgggcaatgcactggcaatgttgcttgtatcaaggtcctaccgaaggcgggagagcaagcgaaaaaaaagttttctgctatgcatcggatggttggcacttactgatctggttggacagcttcttaccacgcctgtggtgatagtggtttacctctctaaacagcgttgggaacatatcgatccctcagggagactatgcaccttcttcggtctgacgatgacggtgtttggattgagtagcctttttattgcctccgctatggctgtcgaacgggcacttgccatccgggctccacactggtatgccagccacatgaaaacgagggcaacccgagcggtcttgttgggcgtctggctggctgtgcttgcttttgcattgctacctgtcctgggggtcggacagtacactgtccagtggcccggtacttggtgttttatttctactgggcgtggtggcaatggaacgagttcctcccataattggggaaatctgttttttgcctccgccttcgcatttttgggactgttggctctgactgtcactttttcctgcaacttggccacaataaaggctctcgtttcgcggtgccgcgctaaagccaccgcaagccagtcctctgcccagtggggcagaatcacaactgaaaccgcgatccaactcatggggattatgtgtgtgttatcagtgtgctggtccccattactgattatgatgctgaagatgatcttcaatcaaacgagcgtggagcactgcaagacacacacggaaaaacagaaagaatgcaacttcttcttgatagctgttcgtttagcatcactcaaccagatactcgatccatgggtatatctcctcctgcgcaagatcctcctgagaaagttttgtcaagtggctaacgccgtctcatcctgtagcaatgatggtcagaaggggcagccaatcagtctcagtaacgaaattatccagaccgaggctatccggtaccacactaacaattatgcatcaagctcaacaagccttccatgccaatgcagcagcactctgatgtggagtgaccatctggaacggtag

SEQ ID NO: 236395 - DNA, 1290 bp, Artificial Sequence
  Description of Artificial Sequence: Synthetic coding sequence
atgaaagaaactcggggatacggcggagatgctcccttctgcacccggctcaatcattcttacactgggatgtgggccccagagcgctcagctgaggccagagggaatctgacaagacctccaggcagtggggaggattgtgggtcagtgagcgtggcctttcctattaccatgctgctgactggcttcgttggcaacgctctggcgatgctgctggtgtcccgcagctatagacggagagaatcgaaacgcaaaaaatcctttctgttgtgcatcggctggctggctttgacagacctggttggccagctcctcaccacgcccgtcgttatcgtagtgtacctctcaaagcagaggtgggaacacatcgacccctcagggagactatgcacttttttcggactgacgatgactgtgtttggcctctccagtttattcatcgccagtgcaatggcagtggaaagagcccttgccattcgggctccccattggtacgcctcacacatgaagaccagggcaactcgagccgtgctattaggggtgtggctggctgtgctggcctttgctttactgccagtgctcggcgtgggccagtacactgtacagtggcctggcacgtggtgtttcattagtacaggcaggggcggaaatggcaccagcagttctcataactggggtaatctctttttcgcttcggcctttgcgtttctcggcctattagcattaaccgttacattcagttgtaacctagccacaatcaaggctctggtcagtaggtgccgcgctaaagctacggcctcacagtcctccgcccaatgggggcgtattaccacagagaccgccatccagttgatgggcattatgtgtgtcctatcggtttgttggtcaccattgctgattatgatgctgaaaatgatctttaaccagacgtctgtagagcattgcaagacacacaccgaaaaacagaaggaatgcaatttcttcttgatcgctgtacggctggcttcactaaaccagattttggatccatgggtctacttgctgctgagaaaaatcttgctccggaaattctgccagatgcggaaaagacgcctgagggagcagttttggcgcccagcgagctccggctccgggtgccagcaaattaggtgtctgatggagagctgttcgttaactcagactggagtgcagtggtcagatttccgctcactgcagccctcacctcctcccctgacagccattttcgcatcctgggtgcaggtcattctgcttccacaaccgcctaagtag

SEQ ID NO: 236396 - DNA, 1257 bp, Artificial Sequence
  Description of Artificial Sequence: Synthetic coding sequence
atgaaggagactcgcggttacggaggagacgcacccttttgcaccagattaaatcactcttacaccggcatgtgggcccctgagcggagtgccgaggctcggggtaatctaaccaggcctccaggatcaggcgaggattgcggtagcgtctctgttgctttcccgatcactatgctgttaactggttttgtgggcaacgctcttgcaatgctgctcgttagcaggtcctacaggcggagagaaagcaagcggaagaaatcatttctcctctgcattggatggctggccctgactgacttggtcggccaactgctgactacgcccgtggtgattgtggtctatctttctaaacaacggtgggaacacatcgacccttcaggcaggctctgcacgtttttcgggctgactatgacagtgtttggactatcctccttgttcatagcctctgccatggcagtcgagcgtgcgctcgcaatccgggctcctcactggtacgcgagccacatgaaaacacgcgctacgagagccgtcttgcttggtgtctggcttgctgtgctggctttcgcactgctgcccgtgctgggcgttggacagtacacagtgcagtggcccggtacctggtgctttatttccacaggccgtggaggaaacggaaccagttcctctcataattggggcaacttgttctttgcaagcgcttttgcctttctgggactgttagctctaaccgtcactttttcgtgtaatcttgcaactattaaagccctggtctcacggtgccgggcaaaggctactgctagtcaaagttccgcccagtggggtagaataactacagaaactgctattcagctcatgggtatcatgtgtgtcctgtccgtgtgctggagtccattgctgataatgatgctgaagatgatctttaatcaaacgtcggtagaacattgcaagacacatacagaaaaacagaaagagtgcaactttttccttatcgcagtgagactggcttccttgaaccaaattctcgatccctgggtgtacctgttactgcgcaaaatcttattaaggaagttttgccagatgcgcaagcgaaggctgcgagagcagctgatatgctcactacagaactctcagatccaacgagcaactgcccattgtggtcaggttcagacttatcgggtactcaatcgcgaggaaatggaagttctcgtgtccagcattaacgtgtatactcggatttctactgtaaaaaccgaatag

SEQ ID NO: 236397 - DNA, 1209 bp, Artificial Sequence
  Description of Artificial Sequence: Synthetic coding sequence
atgaaggaaacccggggatacgggggagatgcacccttctgtactaggctgaatcactcctacaccgggatgtgggccccagaaagatcagccgaagctagggggaatctgaccagaccaccgggtagtggcgaagactgcggctccgtttccgtggcctttcctataaccatgcttctcacaggctttgtcggtaacgcactggccatgttgctggtgtctcgttcgtaccgaaggcgcgaaagcaagcggaagaaatcctttttactctgcatcggctggctagccttaactgacctggtgggtcagctactgaccacacctgtggtgatcgtcgtgtacctgtctaagcagagatgggagcatattgacccatctgggcgactctgcaccttctttggtctcaccatgacggtctttggtttgtcatcgctgtttatagcctcggctatggctgtggagcgcgcactcgccataagagcccctcactggtatgcctctcatatgaagacgcgggcaacacgggctgtgttgctgggagtatggctggccgtgctggccttcgctctcctgccggtgctgggagtggggcagtataccgtgcagtggcctgggacgtggtgtttcattagtactggtagaggcggtaacggcactagcagctcccataactgggggaacttgtttttcgccagtgcattcgcattcctggggctgcttgccctcactgttaccttttcctgcaacctcgccaccatcaaggcactggtcagtcggtgtcgggctaaggccaccgcttcccaatccagtgctcagtggggcagaatcacgacggaaaccgctattcagcttatgggtatcatgtgcgtgctctcagtttgttggtctccactccttattatgatgctgaagatgatcttcaaccagacgagcgtagagcattgtaaaacccatactgagaagcagaaggaatgtaattttttcctgatcgccgtacggcttgcctctctgaatcagattctggacccttgggtctatctgctactgagaaaaatcctactccggaagttctgccagatgagaaagcggcgactccgtgaacaggaaatgggccctgacggcagatgtttttgtcacgcttggaggcaagtgcctcgaacatggtgtagttctcacgaccgggaaccttgttcagtgcagctttcttag

SEQ ID NO: 236398 - DNA, 1167 bp, Artificial Sequence
  Description of Artificial Sequence: Synthetic coding sequence
atgaaagagacaagaggctacggtggggacgccccattctgcacgaggctgaaccactcatataccgggatgtgggccccagaacggtcggccgaggccaggggtaacctgacacgtcctcctggcagtggcgaggattgtggttccgtgagtgtggcgttcccgatcacaatgctcctgacaggctttgtgggtaacgccctagccatgctacttgtgagtcggtcctaccgacgtcgcgaaagcaagcggaagaagagcttcctgctgtgtattggctggctggcactgacggatctggtgggccagctactgactacccctgtggtgattgtggtgtatctgagcaagcagagatgggaacatattgatccctccggacgcctctgcaccttttttggcttaaccatgacggtattcggactctcttctctgtttatcgcctcagccatggcggtcgaacgcgctctggcaatacgggctccacactggtacgcctcgcatatgaagacccgagccactcgtgctgtgctcctgggagtctggctggcagtgctagcattcgccctattgcccgttctgggcgtaggacagtacacagttcagtggcccggaacgtggtgcttcatcagcacagggaggggcggtaacggtacttcttcctctcataattggggaaacctcttcttcgcctccgccttcgccttcctcggtctcctggccttgaccgtcactttctcctgcaacctggccaccatcaaggcccttgtgagccggtgccgggcaaaggccaccgcttctcagtctagcgctcagtggggtaggattactacagagactgccattcagctgatgggcatcatgtgcgtactgagcgtgtgttggtcaccactgctgattatgatgttgaagatgatttttaatcagacctccgtagaacattgcaagacacacacagagaaacaaaaggaatgcaacttcttcctcatcgccgtgaggcttgccagcctcaaccaaatcctggacccttgggtgtatctgttgctccgcaagatcctgctgcgcaaattttgtcaagtggcaaatgctgtgtcctcctgctccaacgacggacaaaaggggcagcctatttccctgtcaaacgagatcatccagaccgaagcttag

SEQ ID NO: 236399 - DNA, 1173 bp, Artificial Sequence
  Description of Artificial Sequence: Synthetic coding sequence
atgaaagaaactagaggctacggcggtgatgcacccttctgtacaagacttaatcatagctacacggggatgtgggctcctgagcgcagcgccgaggcgaggggaaatctgacccgccctcccggatctggcgaggattgcggcagtgtgtcagtggcctttcccatcaccatgttgctgacgggttttgtgggaaatgcactagccatgctcctagtatctaggagttacaggcgtcgtgagagtaaaaggaaaaaatcatttcttctctgcatcgggtggctggctcttactgatctggtggggcaactcctgaccaccccggtcgtgattgtggtttacttgtcaaaacaacggtgggaacacatcgatcccagtgggcgactctgtacattttttggactgaccatgactgtgtttgggctgtcgtcccttttcatcgccagtgctatggccgtggagcgggcactggccattcgcgcaccacattggtatgctagtcacatgaagacacgagcaacccgtgccgtgctgctgggcgtgtggctagccgttctggcctttgctctcctaccggtgctgggagtcgggcagtacaccgtgcaatggcctggcacttggtgcttcatttccactggccgaggcggaaatggcacctccagttcccacaactggggcaatctgttcttcgctagtgctttcgcgttcctgggattgctggctctgactgttactttttcctgtaacctggccacgattaaagctctggtgagccgctgccgggcaaaagctacagcttcacagagttctgctcagtggggcagaattaccacagaaacagccatccaactgatgggcattatgtgtgttctttctgtctgttggagccctctgctcatcatgatgctcaaaatgatttttaaccagacatccgtggagcactgcaaaacacataccgagaaacagaaggaatgcaacttctttttgatcgccgtccgtctggcctccctgaaccaaatactcgatccttgggtatacctgctgcttaggaagatcctgctgcgtaagttttgtcagatccgataccacacgaacaactacgcctcatcgtctacgagcctcccctgccagtgcagctctacgcttatgtggagcgaccacctagaacgctag

SEQ ID NO: 236400 - DNA, 1098 bp, Artificial Sequence
  Description of Artificial Sequence: Synthetic coding sequence
atgaaggaaactcgtgggtacggcggagatgcacctttctgtactaggctgaaccattcgtacaccgggatgtgggcgccagagcgctcggctgaggcaagaggcaatctcacccgccctccagggtcgggcgaagattgcggatccgtgtccgtcgctttcccgataacaatgctgctaactgggtttgtggggaacgccctcgctatgctcctggtatctcgctcatacagacgcagagagagtaagaggaagaagagcttccttctctgtatcggctggttggcccttacggacctggttggacagcttctgactacgccagttgtaatcgtcgtgtatctgtccaagcagcgttgggagcacatcgacccaagcggtcggctgtgcacatttttcggtctgactatgactgttttcggactctccagtctattcattgcctccgccatggccgtagagcgtgctctggcaattagggcaccccactggtatgcgtcccacatgaagaccagggcaactagagccgtgctccttggagtgtggttggcagtgcttgctttcgccctgttgcccgtcctgggggtgggacagtacactgtgcaatggccagggacttggtgtttcatttcaacgggaagggggggaaatggtacttccagcagtcacaactgggggaatctcttcttcgcatcagccttcgcatttctggggctccttgccctcaccgttacattttcttgcaatcttgcaacaatcaaagccttagtttcacgatgccgtgctaaggcaacagcatcgcagtccagtgcccagtggggccgaatcaccacggaaaccgccattcagcttatgggaattatgtgtgtactgtcggtgtgttggtcaccactgcttatcatgatgctgaagatgatctttaaccagaccagcgtggagcattgcaaaacccacaccgagaagcagaaagaatgtaacttttttttgattgcagtgagactcgctagcctcaatcagatcctcgatccctgggtctacttactgctgcggaagatccttctgaggaaattctgtcaggaggagttctgggggaactag

SEQ ID NO: 236401 - DNA, 1365 bp, Artificial Sequence
  Description of Artificial Sequence: Synthetic coding sequence
atgaaggaaacgcgtgggtatggcggagatgcccctttctgcactcgcctaaatcatagttacacgggtatgtgggctcctgagagatccgctgaagcccgagggaatctaacccggcctcccggaagcggggaagattgcggctctgtcagtgttgcgtttcccatcaccatgctactcacaggtttcgtcggaaatgctcttgcaatgctgctcgtctctcgcagttatcggaggagagagagcaagaggaagaagagtttcctgttgtgcatcggatggttagccctgaccgatctagttggccagttgttaaccactcccgttgtgatcgtagtgtacctgagtaaacagcggtgggagcatatagacccatccggtcgcttgtgcacgttttttggactaacaatgacagtatttgggctgtcgagcctctttatagcatcagcaatggcagtcgagagagctctggccattcgggctccccattggtacgcctcccatatgaaaacaagggccaccagggccgtgctgctgggcgtctggctcgccgtccttgcctttgccctgctgccggtgctgggtgttggccagtatacggtgcagtggccaggcacctggtgctttataagcacagggaggggcggaaacggcacaagctcctctcacaactggggtaatcttttcttcgcatcggctttcgcatttttgggacttctggcccttacagtgacatttagctgcaaccttgcgactataaaggcattggtgtcccgctgtagagccaaggcaactgcatcccaaagtagcgcccagtgggggcgaatcacaaccgagacagccatccagctcatgggaatcatgtgcgtgcttagcgtctgttggtctccactgttaattatgatgctgaaaatgatattcaaccagacaagcgtcgagcattgtaaaacgcacaccgaaaaacagaaagagtgtaactttttcctcatcgccgtgcggcttgccagtctaaaccagattctggatccatgggtttatttactcttacgcaagattttgctccgaaaattttgtcaggttgctaatgccgtgagtagctgctccaacgatggccaaaagggacagccaataagcctgtcgaacgagattatccagactgaggcaatgagaaagcgcagattgcgggagcaggcccctctcctccctacttcaaccgtgattgatcctagcaggttttgcgcacagccattccgctggtttctggatcttagttttcctgccatgtcgagtagccatccccagctgccactcaccttggctagctttaagctcctgagggagccttgttcagtgcaactgtcctag

SEQ ID NO: 236402 - DNA, 1173 bp, Artificial Sequence
  Description of Artificial Sequence: Synthetic coding sequence
atgaaagaaacacgcggttatggaggagacgcaccgttctgcactagactcaatcacagctacactggtatgtgggctcctgagcgatccgccgaagctcggggtaacctgacacgaccacccggtagcggggaggattgtggctccgtctctgtggccttccctatcactatgcttctgacgggatttgttggcaatgctcttgcaatgctcttggtctctcgatcgtatcgcagacgggagagtaagcgcaagaagtcctttcttctgtgtataggatggcttgcgctgacggatctcgtggggcagctgctgaccactcccgtcgtaatcgttgtctatctatcaaagcagcgatgggagcacattgaccccagtgggagactatgtaccttcttcggcctgaccatgactgtgttcgggctgagctcactgtttattgcctctgccatggccgtcgagagagccttagccattcgggcaccacactggtatgcgagtcatatgaaaacaagagcaactcgcgcagtcttgctgggggtttggctggcggtgctggcatttgccctgctccctgtcctgggggtagggcagtacacggtgcaatggccaggtacctggtgctttatttctaccggacggggtggcaatggcaccagcagctcccacaactggggtaacttattttttgcttcagcttttgccttcttgggactgcttgccctgacagtgacgttttcatgtaacctggcgacaattaaagctttggtttccagatgccgcgctaaggcaacggcctcgcagtcatccgcacagtgggggcgaatcacaactgagacagcgatccagctgatggggatcatgtgcgtcttgtctgtgtgctggtcaccactgctcatcatgatgctaaagatgatttttaaccagacgtcagtcgagcattgcaaaacccataccgagaaacagaaggaatgcaacttttttctcatcgccgtgaggcttgccagtctgaatcagatcctcgatccgtgggtatacctgctgcttagaaaaatcctgttaaggaagttttgccagattcggtatcacacaaacaactacgcttcctccagtacctctctaccttgccaatgctccagcacccttatgtggagcgaccatctggaaaggtag

SEQ ID NO: 236403 - DNA, 1125 bp, Artificial Sequence
  Description of Artificial Sequence: Synthetic coding sequence
atgaaagaaacccggggttatggaggggatgcgcctttttgcactcgcttaaatcactcctacacagggatgtgggcccctgaaagatctgctgaggcccgaggcaacctcacccgccctcctggctcgggcgaagattgcggctccgtgagtgtggccttcccaattacgatgttactcacaggattcgtcggtaacgctttagcaatgctgttagtttcccgcagctacagacgcagagaatcgaagaggaagaagtcatttctgctgtgcattggatggctggcattgactgacctggtcgggcagcttttgacaacccctgtagttatcgtggtgtatctgtcgaagcagagatgggaacatatcgatccctcaggacgcctatgcaccttttttggactaaccatgacagtgttcggtctgtcttctttattcattgcatctgctatggcagtggaaagggctttggccatccgcgctcctcactggtacgcaagccatatgaaaaccagagcgactagggcggtgttattaggcgtgtggttagctgtcctcgcttttgctctgctccccgtattaggggtcggccagtataccgtgcagtggcctggaacttggtgctttattagcacaggcagagggggtaacggcacatcgagcagccacaattggggcaacttattctttgcctccgccttcgcctttctgggattgctggctctcactgtgacattctcctgcaatctggcaactattaaggcactggtctctcggtgtcgggctaaggccaccgcctcacaaagctcagcccagtgggggagaatcaccaccgagacagccattcagctgatgggtatcatgtgtgtccttagcgtctgttggtcccctctgctgattatgatgctcaaaatgatctttaatcagaccagtgtagagcattgcaagacccacaccgagaaacagaaggaatgtaacttttttctgatcgccgttcggcttgccagtctgaaccagatcttggatccatgggtgtacctgcttctgagaaagatccttctgcgtaagttttgtcagatgcgtaagaggaggctccgggagcaggaggagttctggggaaattag

SEQ ID NO: 236404 - DNA, 1467 bp, Artificial Sequence
  Description of Artificial Sequence: Synthetic coding sequence
atgtccacccccggagtaaattcttcggcaagtctgtcgcccgaccggcttaattccccagttactattcccgctgtgatgtttattttcggagtcgtcggcaacctggtagctattgtggtcctctgcaagtcaaggaaggagcagaaagagaccaccttttatactctggtctgcgggttagcggtcactgatctgctggggaccctcttagttagcccggtgacaatagcaacttacatgaagggacagtggccaggaggacagccgctgtgcgagtattcaacttttatcctcctgttcttctcgcttagtggtctcagtataatctgcgccatgtctgttgagagatacctggcaatcaaccatgcctacttctactcacattatgtcgataaaagactcgctggactaactctttttgctgtatatgcatctaatgtactattctgtgcccttccaaacatgggactcgggagcagccgtctgcagtaccctgatacctggtgcttcatcgactggacgaccaacgtaacggcccacgctgcatactcttacatgtatgctggattttcatcattcctgatcctggcaacagtgctatgcaacgtcctagtgtgtggcgcactccttaggatgcacagacagtttatgcggaggacctccctggggaccgagcagcaccatgctgccgcagccgctagcgttgcctctcggggtcatcctgcagccagtccagccttgccacggttgagcgattttaggagaagacggtccttccgaagaattgctggagcagaaatccagatggtgatattacttatcgcgacaagtctcgttgttcttatatgcagcatccccttagtcgtacgggtgttcgtgaaccagttgtaccagccttctctcgaacgcgaggtctctaagaaccctgacctacaagctattcgtattgcatctgtaaaccctattttggacccctggatttatattctgttaagaaaaaccgtgctatccaaggcgatcgaaaaaatcaaatgcctgttttgtagaattgggggatctcgaagagaaaggtccgggcagcactgttctgactcacagagaaccagtagcgccatgtcgggccactcccgttccttcatcagcagagagctgaaggaaatcagttcaaccagtcagacactgctcccagatctttccctccccgacctaagtgagaatggtctcggcggtcgcaatctgttgccaggcgtgcccggaatgggactggctcaggaagatacaacctcattaaggacactgaggatctccgagacgtccgattcatcccagggccaggatagtgaatcggtcctgttggtggatgaggccggtgggtcgggtagagctgggccagctccaaaaggatctagtctccaggtgactttcccgagtgagacgctcaatctttccgagaagtgcatctag

SEQ ID NO: 236405 - DNA, 459 bp, Artificial Sequence
  Description of Artificial Sequence: Synthetic coding sequence
atgcccgctcatagcctggtcatgagtagtcccgctctgccagcgtttctgctctgtagcacactccttgtgattaagatgtacgtcgtggctattattactggccaggtccgtcttagaaaaaaggcatttgcaaatcccgaggacgccctacggcatggcggaccccaatactgtcgtagtgatcctgatgtggaacgctgtcttagggcgcaccgcaacgatatggaaactatttaccctttcctcttccttgggttcgtgtattctttcctcggccctaaccctttcgtggcatggatgcattttctcgtgtttttagtaggacgggtggctcataccgtcgcatatctcgggaaattaagggcccctattcgcagcgtgacatacacactcgctcaactgccctgtgcctccatggctctgcaaatattatgggaagcagctcgacacctgtag

SEQ ID NO: 236406 - DNA, 561 bp, Artificial Sequence
  Description of Artificial Sequence: Synthetic coding sequence
atgaaagccgtgaatgaacagggaaaggaggtaaccgaattcggaaacaaatattggctcatgctaaacgaaaaggaggcacagcaagtttacgggggaaaggaggcaaggactgaggagatgaagtggcgtcagtgggcggatgactggctcgtgcacttgattagccccaatgtctacaggacccctaccgaagccctggcaagctttgactatattgtccgggaaggtaagttcggtgcagtggaaggagctgtggccaaatacatgggagcagctgccatgtacctgatctcaaagcgccttaaaagcagacatcgcctgcaagacaatgtgcgggaggatctgtacgaggccgctgataagtgggttgccgctgtgggtaaagacaggcctttcatggggggacagaagcccaacctggctgacctcgccgtttatggggtgctgcgggtgatggaaggtctggacgcttttgacgatctgatgcaacatacacacattcagccgtggtacctgcgggtggaacgggctatcaccgaggcttctccagcacattag

SEQ ID NO: 236407 - DNA, 1134 bp, Artificial Sequence
  Description of Artificial Sequence: Synthetic coding sequence
atggatcctgcagctcgggtagtgcgagccctgtggcccggtggatgcgcccttgcctggcgtctcgggggtaggcctcagccgctgctccccacccagtctagggctggcttcgcaggtgctgctggaggtcctagtccagttgcagccgcaagaaaagggagcccaaggctgctgggcgctgcagccctagcgcttggaggggcacttggcctgtatcataccgctcggtggcaccttagagcgcaggacctccatgcagagcgctccgcagcacagttgagcctgtcctcgcggctccaactgactctttaccagtataagacatgcccattttgctcaaaagtgagggcgtttctcgacttccacgccctcccctatcaggtagttgaggtgaaccccgtgcggagagccgagattaagttttctagttacagaaaggtgcccatcttggtcgcgcaggaaggtgagagcagccagcagctgaatgatagcagcgtcatcatctccgctttaaagacgtatctggtatcaggtcagcccttagaagagatcatcacttactaccccgcaatgaaggcagtgaatgagcaaggaaaggaagtgactgagttcggtaacaagtattggttaatgctgaacgagaaagaggctcaacaggtgtatggcggaaaagaggctcggaccgaagaaatgaaatggagacaatgggcggacgattggttggtgcatctgatctctcccaacgtctaccgaacacctacagaggccttggcgtccttcgactatattgtcagagaagggaagttcggagccgtggaaggtgccgtggctaaatacatgggggcagctgcgatgtatctgatctcgaagcgcctgaagtctaggcataggcttcaggacaacgtccgcgaggacctgtacgaggcggcagataagtgggttgcagccgtaggcaaggatcggccttttatgggcggtcagaaacctaacctcgccgacctggcggtgtatggggttctccgggttatggaagggcttgacgcctttgatgatctcatgcagcacacccacattcaaccttggtatctccgcgtagagagggctatcacggaggctagccccgcacactag

SEQ ID NO: 236408 - DNA, 894 bp, Artificial Sequence
  Description of Artificial Sequence: Synthetic coding sequence
atgagcatgaacaacagcaagcagctggtgtctcccgctgctgccctccttagtaatactacttgccagactgaaaatcgactctcagtattcttcagcgtgatcttcatgactgtgggtatcctgagcaatagtttagccatcgctatcctgatgaaagcctatcagcgcttccggcagaaatctaaggcatccttcctcctcctcgcgagcggactggtgataactgacttcttcggccacctcataaacggcgctatcgccgtcttcgtctatgcgtccgataaggagtggatcaggttcgatcaatcaaacgtgctgtgttccatctttgggatctgtatggtctttagcgggctttgtcctcttctgctcgggagcgtgatggccattgagcgctgtatcggcgtgactaaacccatttttcacagtactaagataacgagcaagcacgtaaagatgatgctgtctggcgtgtgcctgtttgccgtgttcatcgcattgctccctatcctgggtcatcgggactacaagatccaggcttcaaggacttggtgcttttataatacagaagatataaaggattgggaggatcggttttacctccttttattttctttcctgggactcttggctcttggagtatctttactgtgtaacgcaattactggcatcactcttctacgcgtcaagttcaagtctcagcagcacaggcagggaaggagccatcacttggaaatggtaattcaactcctggcaattatgtgcgtaagttgcatttgttggtcccccttccttgggtaccggatcatcctgaatgggaaggagaagtacaaggtatacgaagagcagagtgacttcttgcatcgactgcagtggcctaccttggagtag

SEQ ID NO: 236409 - DNA, 1080 bp, Artificial Sequence
  Description of Artificial Sequence: Synthetic coding sequence
atgagtatgaacaacagcaaacagctagtctcaccagctgcagctctcttgtctaacaccacctgccaaactgagaaccgtctgagcgtgttcttcagtgtgatatttatgactgtcgggattctctccaactcccttgctatcgcgatcctgatgaaagcttaccagagattccggcagaagagtaaggcttctttccttttgctcgcaagcggactcgtaatcacagacttttttggacatctcattaacggtgcaatcgccgtctttgtgtatgcatccgataaggagtggattagattcgatcagagtaatgtcttatgctctatcttcgggatatgtatggtcttttccgggttatgtcccctactcctggggagtgtgatggcaatcgaaagatgcataggagtgactaaaccaatcttccactccaccaagatcacctctaagcacgtgaaaatgatgttaagcggcgtgtgcctgttcgcggtattcattgcccttttgcctatactcggccaccgggattataaaatacaggcctccagaacatggtgtttttataacaccgaggacattaaagactgggaggatcgattttacctgctattattcagcttcctgggactattggccctcggtgtgtctctgctctgtaatgctattacaggcattacactgctgagagtaaaatttaagagccagcaacaccgccaggggagatcccatcacttggagatggttatacagttgctggcaatcatgtgcgtaagttgtatttgttggtctcctttcttggtaactatggcgaacatcgggatcaatggtaatcacagcctcgagacttgcgagactactctgtttgctctaaggatggccacctggaaccaaatactggacccgtgggtttatatactgctgcgcaaggcagttctgaagaatctttacaagttggccagccagtgttgtggcgtgcatgttatttctttacatatttgggaattatcaagcattaaaaactcgctcaaagtcgccgcaatctccgaatcccctgtggccgaaaagagcgctagcacttag

SEQ ID NO: 236410 - DNA, 1080 bp, Artificial Sequence
  Description of Artificial Sequence: Synthetic coding sequence
atgtccatgaataattctaaacagttagtcagtcctgccgcagccttactaagtaacactacatgccagaccgagaatcggctgagcgtctttttttccgtgatctttatgacagtggggatcctctccaattcactcgcaatagcgatcttaatgaaagcctaccaacgcttcaggcaaaaatcaaaagcatcttttctactgctggcaagcggattggttattaccgattttttcggccacttgatcaatggcgcaatcgctgtctttgtctacgcctccgacaaagaatggattagattcgaccagtcaaatgtactgtgcagcattttcggcatttgtatggtgttctctggcctgtgtccactgctgctcggctctgtgatggcgattgagcgttgtattggagtaacaaagcccattttccacagtacaaaaattacgagcaaacatgtgaaaatgatgctaagcggcgtgtgcctcttcgccgtattcatcgcgctgctcccaattttggggcaccgggactacaagatccaggcttctagaacttggtgtttctacaataccgaggacatcaaggactgggaggacagattttaccttctcctgttttcattcctggggctgctggccttgggcgtgagcctgctctgtaacgccatcaccggcattacactattacgggtcaagtttaaatcacagcagcacaggcaagggcgttcccaccaccttgaaatggtgatccagctcctagccatcatgtgtgtgagctgtatttgttggtcaccattcctcgtcacaatggctaatataggcatcaacggaaaccatagtcttgaaacctgcgagactacactgttcgcgctgcggatggccacatggaatcagatcttggatccctgggtttacatcctccttcggaaggccgtcctcaaaaatttatataagctcgcatcacagtgttgtggggtgcacgtgattagtctccatatttgggaattgtcaagcatcaaaaatagcctaaaggtcgccgctatcagcgaatcaccagttgccgagaaatccgcgtcaacctag

SEQ ID NO: 236411 - DNA, 2640 bp, Artificial Sequence
  Description of Artificial Sequence: Synthetic coding sequence
atgggcagactggccagccgcccactgcttcttgcactgctttcgctcgccctttgtcgtggccgtgtggtgagggtgccaacagctaccctggttcgagtggtgggaaccgagctggtgatcccttgcaatgtgtcggactatgacggaccatccgagcagaattttgactggagctttagcagccttggctcttcttttgtcgagctcgcttcaacctgggaggtcggattccccgctcagttgtaccaagaacgactacaacgcggtgaaatcctgctcagacgcaccgccaacgacgcagtggagctgcacattaagaacgtccaaccttctgaccagggccactacaagtgctctacaccatctacagacgctaccgtgcaaggtaactacgaggatacagtgcaggtgaaggtgctggcagactctctccacgtggggcctagtgctagaccccctccatccctctcattgagggagggtgagccatttgaactgagatgtacagctgccagcgcctctccactgcacacccacctggcactcctctgggaggtgcacagagggcctgccaggcgttctgttctcgcattgactcacgagggcagattccacccaggccttggctacgagcaacgttatcattcaggagatgtccgcttagataccgtgggctctgatgcctatcgtttgtctgtctctagagcactctccgctgatcaagggtcttaccggtgcattgtcagcgagtggatcgccgagcagggtaattggcaggagattcaggagaaggcagtggaagtcgcaactgtcgtcatccagccctccgtgctgcgagccgctgtgccaaaaaacgtatcagtcgccgaagggaaagagctggaccttacttgcaacattacgacggacagagccgatgacgtccgtcccgaggtgacttggagcttctcgcgcatgcccgactctaccttacccggtagccgtgtgctcgcgagactcgacagggacagcctggtccactcctccccacacgtggccttatctcacgtagacgccagatcctaccacttattggtgagggatgtctccaaggaaaatagtggctactattactgtcacgtgtccctgtgggcaccagggcacaatagatcatggcataaggtcgccgaagccgtttcctctcctgctggcgtcggcgttacatggctggagccagactatcaagtttatcttaacgcgagtaaagtcccaggttttgctgatgacccaaccgagctcgcctgcagagtggtggacacgaagtctggggaggcgaatgtgcggttcaccgtgtcctggtattataggatgaaccgcagaagtgataacgttgtgactagcgaacttctggctgtcatggatggtgactggacgcttaagtacggcgaacggagcaaacagagggcacaggatggcgactttatcttctccaaagagcatactgataccttcaattttaggatacagcggaccacagaggaagaccgcggaaattattattgcgtcgtgagcgcgtggaccaaacagcgaaacaatagctgggtgaaatccaaggacgtcttttctaagccagtaaatattttctgggcacttgaggatagtgtactggtcgtaaaggctagacagcctaagccattttttgcggcaggcaacactttcgagatgacatgtaaagtgtcctctaagaatataaagagcccgaggtacagcgtgctaattatggcggaaaaaccagtaggggacttaagctccccaaacgaaactaagtacattattagcctggatcaggactccgtggttaaactggagaattggacggacgcatcgcgggttgatggtgtggtactggaaaaggttcaggaggatgagtttcgctacaggatgtatcagactcaggtctccgacgccggtttataccgctgcatggttacagcttggtctcctgtgcggggatccctgtggagagaggccgcaacctcattgtctaatccaatagagattgattttcagacctccggcccaattttcaatgcctcagtccattctgatactcctagcgtgatcagaggcgaccttattaagctcttctgcatcatcaccgtggagggtgcagccctagatcctgatgatatggccttcgatgtgtcctggtttgctgtccactcattcggtctggataaggctcctgtgctcctgtccagtctcgaccgaaaggggattgtgacaacctctcgcagagactggaagtctgacctaagcctggaaagagtgtcagttctagaattccttctccaagttcatgggtctgaagatcaagactttgggaattactattgcagcgtcacaccttgggtcaaaagtcccaccggctcgtggcagaaagaagcagagattcactcaaaaccggtgttcataactgttaagatggacgttctgaacgctttcaaatacccacttctgattggcgttgggctgagcaccgtcattggtctcctctcctgtttaattgggtactgcagttcccactggtgttgcaaaaaggaggtccaggaaacaagacgtgaacggaggaggctcatgtctatggaaatggactag

SEQ ID NO: 236412 - DNA, 2217 bp, Artificial Sequence
  Description of Artificial Sequence: Synthetic coding sequence
tccggtgccgctggcgcagggagggggggaggaggcgaggccgctggaaaggaggaggagggggaacccttcgaactgcgctgtactgcagcatctgcttccccacttcatacccacctcgctctcctatgggaagtgcaccgtggtcctgctagaaggagtgtgttagcactcacccatgagggcaggtttcatcccggactcgggtacgaacaacgataccattccggagacgtcaggctcgacaccgtcgggagcgacgcttacagactgtctgtaagccgggctctctccgctgaccaaggatcttaccggtgtatcgtttctgagtggattgctgagcagggtaattggcaggaaatccaggagaaagctgtagaagtggctaccgtggtaatccaaccttctgtgctgagggccgcagttccaaagaacgtttcggtggctgaaggaaaagaactggatctaacatgcaatatcacaactgaccgggcagatgacgtgaggcccgaggtgacatggagctttagccgtatgcccgattcaacattaccagggtctagggtgttggccagactggaccgcgatagtctggtgcatagttctccccatgtggcccttagccacgtggacgcaagaagctatcacttgctggtgagagacgtgagcaaagaaaattctggttactactactgccatgttagtctgtgggccccaggacacaaccggagctggcataaggtggctgaagctgtctcatcacctgctggtgtgggcgtgacttggctcgaacctgactaccaggtatatctgaatgcctccaaagtgccaggcttcgctgatgacccgacagagctcgcctgtcgggttgtggacacaaagagcggggaagcaaatgtgcgattcacggtgtcctggtactaccgaatgaaccggagatcggacaatgtggtaactagcgagcttctcgccgtaatggacggagactggaccctgaaatatggggagcggtccaaacagcgggcacaggacggcgactttatcttttcaaaagagcacacagacactttcaattttcggattcagaggaccaccgaggaagaccgtggtaactactattgtgtggtgagcgcctggacgaaacagcggaataattcttgggtcaagtccaaggacgtgtttagtaagcccgtaaacatcttttgggcgcttgaggacagcgtcttggtggttaaggctagacagcctaaacctttcttcgccgcagggaacacctttgagatgacttgtaaggtgtcctctaagaatataaaatctccgagatatagtgtgctgattatggctgaaaagcctgtcggcgatctgagtagtcctaatgagacgaaatacatcatttccctcgaccaagatagcgtggtgaagttagagaactggactgatgcgtcccgggtggacggcgtggtgttagagaaagtccaggaggacgaatttcgctacagaatgtaccagacccaggtctctgacgccggactgtaccggtgcatggtgaccgcttggtcccctgttagaggatccctttggagggaggccgcaacctcgctgagcaatccaatcgagatcgattttcagaccagtgggccaatctttaacgccagtgtgcactctgacaccccaagcgtgatcaggggcgatctgattaagttgttttgcataatcacggtggagggcgcagctttggacccagacgatatggcttttgacgtctcatggtttgctgtgcacagctttggattagacaaagcccctgtcctgctttcaagcctcgaccgcaaaggaattgtgaccaccagtcggagggactggaagtccgatcttagcctggagagggtgtccgtcctggagttcctgcttcaggttcatgggtctgaggatcaggacttcgggaactactattgctctgtaactccatgggtcaagtcccctactggctcttggcaaaaggaggccgagatccattccaagcctgtgttcatcaccgttaaaatggatgttctcaatgccttcaaatacccactgctgatcggtgtgggcctgtcgacagtgattggtctgctgagctgcttaatcgggtattgctcttcccactggtgctgtaaaaaagaggtgcaagagacgcgtagagagcgacgaagactgatgtcgatggaaatggactag

SEQ ID NO: 236413 - DNA, 1161 bp, Artificial Sequence
  Description of Artificial Sequence: Synthetic coding sequence
atggcagacagttgccgcaatttaacatatgtgagaggatctgtcgggccagccacctcgacactgatgtttgtcgcaggggtcgtgggtaacggcttggccctgggcatcctctcagcacgcaggccggctaggccgagcgcattcgcggtgctggtcactggtttggctgccaccgatttacttgggaccagcttcctttctcccgctgtcttcgtcgcttacgccaggaacagcagtctgcttgggttggccaggggagggcctgctctctgcgacgcttttgctttcgctatgacattcttcgggctcgcatccatgctgattctgttcgccatggccgttgaacgttgcctggctctgagtcacccttatctctacgcccagttggatgggcctcggtgcgcacggctggcattgcctgctatctacgccttttgcgtgctcttctgcgctctcccattgctcgggctgggtcagcaccagcagtattgcccgggtagctggtgcttcttgcgcatgagatgggcgcagccagggggagccgctttcagcctggcgtacgccggtctggtggctctcttagttgcagcaattttcctttgcaatggatccgtgacattgtcactgtgtaggatgtatcggcaacaaaaacgacatcagggctctctggggcctagaccgcgtaccggagaggacgaggtcgaccacctgatattgctcgccttgatgaccgttgtgatggcagtgtgcagcctgccattgacaatccggtgctttacacaggctgtggcgcctgacagctcatccgagatgggagacttgctggcctttcgcttctatgcctttaatcctattctggacccttgggtgtttatactttttaggaaagccgtgttccagagactcaagctgtgggtctgttgcctttgccttggaccggcacacggcgactcacaaacccccctgagtcaactggcttctggacggagagatccgcgtgctccctccgctcctgtgggcaaagaaggttcatgtgtgccgttatctgcctggggagagggacaagtagaaccgctacccccaacccagcagtcctcagggagtgctgtgggcaccagcagcaaggcagaagctagcgtggcttgttccctgtgttag

SEQ ID NO: 236414 - DNA, 1503 bp, Artificial Sequence
  Description of Artificial Sequence: Synthetic coding sequence
atggcatgggccgcactgttagggttgctggccgctcttctcttacttctccttcttagcaggcgcaggacaagacgcccaggagagcctcccttagaccttgggtctattccctggctcggctacgcactggattttggaaaagacgcagcctcctttctgactagaatgaaagagaaacacggagatatcttcactatcctggtcggcggtcgatatgtcaccgtcctactggatccacattcttatgacgcagtcgtgtgggagccaaggactcgattagatttccacgcgtatgccatcttccttatggaaagaatcttcgacgttcagctcccccactatagtcccagcgatgaaaaagcacgcatgaaacttacccttctccaccgggagttgcaggctttgacagaagctatgtacacaaatttgcacgccgtgctgctgggtgacgccacggaggctggatcaggttggcatgagatgggcctgctcgatttttcttactcttttctcctacgcgctggttaccttaccctgtacggaatagaggccctgcctcgaacccacgaaagccaagcacaggacagagtccatagcgccgatgtattccataccttcagacagctggacagactgctgcctaagctggccagaggcagcttgagtgttggggacaaggatcatatgtgctctgtcaaaagtagactttggaaacttctcagccccgcacggctagccaggagggcccatagaagtaagtggttagagtcttacctgctgcatcttgaggaaatgggagtctccgaagaaatgcaggccagagcactggttcttcaactatgggccacacaaggcaacatggggcctgcagcattttggctgctcctgtttctgctgaagaaccctgaggccctagccgctgtgcgtggcgaactggaatcaatcctgtggcaagcggagcaaccagtgtcgcagaccaccacattaccacagaaggtgctggacagcacacccgttcttgactctgtgttatctgaatccctgcggctgaccgccgcacctttcatcacccgcgaagtggtggtggacttggccatgcctatggccgatggcagagagtttaacttgagacgcggagacaggctcctgctgtttccgttccttagccctcagcgtgaccccgagatttataccgatcccgaagtcttcaaatacaatagattccttaaccccgacggcagtgaaaagaaggacttctacaaagacggcaagcggctgaagaactacaacatgccttggggtgctggtcacaatcattgcctagggaggtcatacgccgtgaacagcattaagcagttcgtctttcttgttctggtccatctggacctggaattgatcaacgccgatgttgaaatccctgaattcgacctgtcaagatatgggttcggccttatgcagccggagcacgacgtgcccgttcggtaccggatccgaccatag

SEQ ID NO: 236415 - DNA, 408 bp, Artificial Sequence
  Description of Artificial Sequence: Synthetic coding sequence
atgcgggcatttctcaggaaccagaagtatgaggacatgcataatatcatacacatactccaaattcgaaaactgcgccataggctgtcgaacttccctagactgccagggattctggcacctgagacagttctcctgccattctgctacaaagtgtttagaaagaaagaaaaggtgaagaggagccagaaagcaacagaattcattgactattctatagaacaatctcaccatgcaatcttaactcctttgcagacacacctcacaatgaaaggcagtagtatgaagtgttcctcactcagctcagaggcaattttgtttacactcacactgcagctgacgcagaccctcgggctggagtgttgcctgctttacttgtccaaaaccattcatccacagattatctag

SEQ ID NO: 236416 - DNA, 345 bp, Artificial Sequence
  Description of Artificial Sequence: Synthetic coding sequence
atggcgggattagcccttcagcccggaaccgcgctgctttgttactcttgcaaggcgcaggtgtctaatgaggactgtttgcaggttgaaaactgcacccagctgggggaacagtgttggacagcaagaattcgagctgtgggactgctgactgtgatctcgaaaggatgctcattaaattgtgttgacgacagccaggattactacgttggcaaaaaaaacattacctgttgtgacaccgacttatgtaacgcaagtggcgcacatgctttacagcccgcagctgccatactcgctcttctgccagccctgggcctgctgctgtggggccctgggcagctctag

SEQ ID NO: 236417 - DNA, 714 bp, Artificial Sequence
  Description of Artificial Sequence: Synthetic coding sequence
atgatggtgatggtggtggttattacctgcctgctctcgcattataagctctcggccagaagtttcatatcacggcacagccaaggcagaagacgggaggacgcgctgagctctgagggatgcctgtggccatccgaatccaccgtcagcgggaatggtattcctgaacctcaggtttatgccccaccacgtccgacagatcggctggctgtgcctcctttcgctcaacgagagcggttccatcgattccaacccacctacccatacctgcaacacgagattgacctgccgccaactatctcattgagtgacggggaagagcccccaccttaccagggcccttgtactcttcaattgcgtgaccctgagcaacagcttgagctgaatcgcgaatccgtcagggctcctccgaatcgcaccatctttgattccgatctgatggatagtgccaggcttggtggaccctgcccaccctcgtcgaactctggcatctctgctacttgttacggctcaggaggtcggatggaaggaccacccccaacttacagcgaggttatcggtcattatcctggatcctccttccagcatcagcagtcaagcgggccaccttcacttttggaggggacacgtttgcatcatacacacattgcacctctggagtccgctgccatttggagcaaggaaaaggacaagcagaaagggcaccctctgtag

SEQ ID NO: 236418 - DNA, 864 bp, Artificial Sequence
  Description of Artificial Sequence: Synthetic coding sequence
atgcaccgcttaatgggcgtgaatagcaccgccgcagcagccgctgggcagccaaatgttagctgcacctgtaattgtaagagatctttgttccagtcaatggagattactgagcttgaattcgtccagatcatcatcatcgtggttgttatgatggttatggttgtggtgataacatgccttttgtcccactacaaactgtccgccaggtccttcatttcccggcactcccaggggaggaggcgtgaggatgccctgagtagcgaaggatgtctgtggccctccgagagtacagtctcaggcaatggcatccctgagcctcaggtttacgccccaccaaggcccaccgaccgcctggctgtgcctccttttgcgcagcgggagagatttcacagattccaacctacctacccctatctccaacacgaaattgacctgcctcccaccatctccctgtctgatggagaggaaccgccaccataccaaggcccttgtacactacagctgcgggaccctgaacaacagctggaactgaaccgggaatctgtacgggcaccaccaaatcgaaccatcttcgacagtgacctcatggacagtgctcgactgggtggcccatgcccaccatcttccaattccggtatatctgcaacatgctatggtagtgggggtcggatggaggggcctccccctacctactcagaagtcatcggccactatcccggaagttctttccagcaccagcagtcatccggcccaccttccctcctggaggggacaaggctgcatcacacccatattgcgccactggagtctgcagccatttggagcaaagagaaagataaacaaaaagggcaccccctgtag

SEQ ID NO: 236419 - DNA, 759 bp, Artificial Sequence
  Description of Artificial Sequence: Synthetic coding sequence
atggctgagctcgagtttgtgcagatcattatcattgtggtagtgatgatggtgatggtggtcgtgatcacctgccttctctcacattacaaactgtcagccaggtcatttatctcaaggcactctcagggcaggagaagggaggatgctctgtcctctgaaggctgtttgtggccatccgaaagtacagtttccggaaacggtatccccgagccacaggtgtacgcgccacctagacccactgaccgccttgccgtgccgccattcgcccagcgcgaacgtttccatcggttccagcctacatatccctacctgcagcatgagattgatcttcctccaactattagcctaagcgacggagaagaaccaccgccttatcagggtccctgcacattgcagctgagagatcccgaacagcaactggagctgaatcgagagagtgtcagggcacctccaaacagaaccatttttgattccgatttgatggactcagccaggcttggagggccatgccccccatctagtaatagtgggattagcgccacctgttacggctccggcggacgaatggagggaccgcctcctacctacagcgaggtaatcgggcattatcccggtagcagcttccagcaccagcagtcttccgggccaccttcactgctcgagggaacacggctgcatcacactcacattgctcccctggaaagcgccgctatctggagtaaagaaaaggataaacagaagggacatccattatag

SEQ ID NO: 236420 - DNA, 714 bp, Artificial Sequence
  Description of Artificial Sequence: Synthetic coding sequence
atgatggtgatggtcgtcgtgataacctgcttgctgagtcattacaagctgtcggcgcgaagttttattagtcggcactcccaaggccgtcgaagagaggatgcgttaagctcagaaggatgtctttggcccagtgagtctacggtgagtggtaatggcattcccgaaccccaggtatatgcccctccgcgtcctacagataggctggcggtgcccccattcgcacagcgagagcggttccataggtttcagcctacatatccctaccttcagcatgaaatcgatctcccgcctaccatcagtttatctgacggagaggaacctcccccatatcagggtccgtgtacactccaactgcgagacccagagcaacagctggagctgaatcgagagtccgtgcgcgcacctccaaacagaaccatctttgacagcgacttgatggatagtgcgaggttaggtgggccatgcccgcctagttcaaacagcggcatttctgccacgtgttacggtagtggcggacgtatggagggcccacccccaacatactcagaggttataggtcattacccaggctcatcttttcagcatcaacaaagttcagggccaccaagcctccttgaaggaacacgactgcaccatacccatattgctcctctggaaagtgcggcaatctggtctaaggagaaggataagcagaaaggtcaccctctgtag

SEQ ID NO: 236421 - DNA, 714 bp, Artificial Sequence
  Description of Artificial Sequence: Synthetic coding sequence
atgatggtcatggtggtcgtgatcacctgtctgttgagtcattacaagctgtcggctagatccttcatctccagacatagtcagggtcgtcgcagggaagacgcgctgtcaagcgaaggatgtttgtggccatcagagagtacagtgtctgggaacggtatccccgagccacaggtgtacgcaccccctaggcccaccgatagactagctgtgccaccctttgcccaaagggagcgcttccataggttccagccgacatacccgtatcttcaacacgaaatcgacctgcctccaactataagcctctcagacggagaggaacctcccccataccaaggtccttgcactctccaacttagggaccccgagcagcagctggagctcaacagggaaagcgttcgagccccaccaaaccgcactatatttgactcagatcttatggattcggccagacttggcggaccgtgtcctcctagctcgaactctgggatatctgctacctgttacggttctgggggacggatggaaggacctccaccaacctacagtgaagtgattggtcattaccctggatcctctttccaacaccaacagtccagcggtccacccagcctcttagagggcacgaggctgcatcatactcatatcgcacccctcgagtccgcagctatctggagtaaggagaaagataagcaaaagggtcatcctctttag

SEQ ID NO: 236422 - DNA, 684 bp, Artificial Sequence
  Description of Artificial Sequence: Synthetic coding sequence
atgcaccgcctgatgggcgtaaactctacggcagccgctgcggctggacagcctaatgtcagctgcacttgcaactgcaaacgctctcttttccagtccatggaaatcagttgtcatgggtttccggtgtgtaaaagtcaccagcatcaggagtggaagagcctgtgttggtctctgcgtagccccggaggcgcatcatctatcactgggttcgggagtatgaaggtgaccaacccggcaatgaatttacctgagtgccagtggctgcggatccagaaggccgaactcgaattcgtccagattatcatcatcgtggtcgtcatgatggtgatggtggtagtgataacatgtctattgtcccattacaaactgagtgcccgtagctttattagccgccactcccagggccgaagaagggaagacgcgctcagcagcgaggggtgcctgtggccctccgaatctactgtatcagggaacggaatcccagagcctcaggtgtatgccccacctcggcctaccgatcgcctagccgttccaccgttcgcccagcgtgaaagattccacagattccaacctacgtacccttatctccagcacgaaatcgacttgcccccaacaatcagtctgtctgatggcgaggaacccccaccatatcaaggcccatgcacgctgcaactcagatag

SEQ ID NO: 236423 - DNA, 627 bp, Artificial Sequence
  Description of Artificial Sequence: Synthetic coding sequence
atgccagctattcctgcacacggggctgaactggagttcgtacaaattattatcattgtggtagtcatgatggtaatggttgtcgtgatcacttgcctgcttagccactataaactctccgctagaagcttcatctcgcggcactcgcagggtcggcgacgcgaagacgccttgtcgagcgaaggatgtctgtggccatctgagagcaccgtaagtggcaacggcattccggagccgcaggtttatgcgccaccccgtccgacagataggctggccgtgcctcctttcgcgcagagagagcgttttcaccggtttcaacctacctacccttaccttcaacacgaaatcgatcttcctcctacaatttccctgagcgatggggaggaacctcccccttaccaaggaccatgcactctgcagctgcgggatccagaacagcagctcgaacttaacagggagtctgttcgagcccctccaaataggacgatctttgacagcgacctcatggatagtgctaggttggggggtccttgccccccaagctccaatagtggaatcagtgctacctgttacgggtctggtggccgaatggaggggccaccacctacttattctgaggttatctag

SEQ ID NO: 236424 - DNA, 156 bp, Artificial Sequence
  Description of Artificial Sequence: Synthetic coding sequence
atggctcgttaccgttgttgtcgtagccaaagccgaagcagatattatagacagcggcagcgtagcagacgaagacggcgtagatcatgccaaacccgaagacgagccatgcggtgttgcagaccaaggtatcgacccaggtgccggaggcactag

SEQ ID NO: 236425 - DNA, 309 bp, Artificial Sequence
  Description of Artificial Sequence: Synthetic coding sequence
atggtgcggtacagggtgagatcactgtccgagaggtcccatgaagtgtatagacaacagctgcacggacaagaacagggacatcatgggcaagaggagcagggattatcaccggagcatgttgaagtgtacgaaagaactcatggccaatcacactaccgtagacgccattgttcccggcgacgtctccatcgaatacatcgccgacaacatcgcagctgtcggcgtcgcaaacgacggtcctgccggcacagaagaagacacagaagaggctgtagaacaaggaagcggacctgtcgcagacactag

SEQ ID NO: 236426 - DNA, 423 bp, Artificial Sequence
  Description of Artificial Sequence: Synthetic coding sequence
atggtccgataccgcgttcgatccctgagcgagaggagccatgaagtgtaccggcagcagctccatggacaggagcaggggcatcacgggcaagaagagcaggggttgagccctgagcatgtggaggtatacgagaggacgcacggccagagccattatagaaggcgtcattgttcgagaagacggttgcaccgcattcacaggcgacaacaccgttcctgccgaagaagaaaacggcgaagttgtcgccataggaggagacaccgaagggagagcttgggagatcccttgaaccagaatttcctctcccaaaaagccgcagagcctggcagagaacacgccgagggcaccaagcttccaggccctctcactccttcgtggaagctacgtaagagccgccctaaacatcaggtgcgaccctag

SEQ ID NO: 236427 - DNA, 657 bp, Artificial Sequence
  Description of Artificial Sequence: Synthetic coding sequence
taattggctctcctgcttgccagggcaggtctgcgcaagcccgagagccaggaggctgcgccactgtccgggccttgcggcaggagagtcattaccagtagaattgtcgggggagaagatgccgaactgggccgttggccttggcaggggagtctgcgtctctgggattcccacgtgtgcggcgtgtcactcctgtcccataggtgggccctgacagccgcacattgctttgaaaccgacctgagtgatccaagcggctggatggtgcaattcggccagctcacgtcaatgccatcattttggagcctgcaggcatactacacaagatattttgtgtctaatatatacctgtccccccgatatctcggtaatagcccttacgacatagcattagtaaaactgtctgcccctgtgacctatacgaaacatatacagccaatctgtttgcaggcgtcaacattcgagttcgagaaccggaccgactgctgggtgactgggtggggctacatcaaagaggacgagggaagctccggacgacatcacaaacagctatatgtccaacctcctcttccccaggtccagttcccccagggacacctctggaggcacgggctgtgctggcagtgcccgagacgggagggttgccttctgcgatag

SEQ ID NO: 236428 - DNA, 744 bp, Artificial Sequence
  Description of Artificial Sequence: Synthetic coding sequence
atgaacccattgcttattctcacgttcgttgcggctgctttggcagcacctttcgacgacgatgataagatcgtaggcggatacaactgtgaagaaaattcagtgccgtaccaggtgagtttgaactcaggttatcacttttgcggcggatctcttatcaacgagcagtgggtggtgagcgcaggccattgttacaagtcccgtatacaagtcaggctgggtgaacataatatcgaagtgcttgagggcaacgaacaattcattaatgcagcaaagatcatacggcatccacagtacgatcgaaaaactcttaataacgacattatgctcataaaactgagttccagagccgtgattaatgcccgagtgagcaccatttcactgcccactgcccctcccgcaacgggaaccaagtgcctgatttccggctgggggaacactgcatcttcgggggctgactaccccgacgagcttcagtgcctagacgcccctgtgttaagtcaggccaaatgcgaagccagctaccctggcaagatcacatctaacatgttctgcgtgggatttttagaaggcggaaaggactcctgtcagggcgacagtggcggtcctgttgtgtgcaacgggcagctacagggtgtcgtttcctggggagatggttgtgctcagaaaaataagccaggcgtctataccaaagtctacaactacgttaagtggataaagaataccatcgcagcgaattcttag

SEQ ID NO: 236429 - DNA, 714 bp, Artificial Sequence
  Description of Artificial Sequence: Synthetic coding sequence
atgaatccgctcctaatcttaaccttcgttgcggctgccctggccgcacccttcgatgatgatgacaaaatcgtggggggatataactgtgaagagaactccgttccttatcaagtcagcctgaacagcgggtatcacttctgtggcggaagcctgattaacgaacaatgggtcgtgtctgcaggccactgttacaagtcacggatccaggtgaggctgggcgaacacaacattaacgccgcaaagatcatcagacacccccaatatgacaggaaaacactgaacaatgacatcatgctcatcaaactctccagccgtgccgttatcaacgcgcgagtatccacaattagcttgccaacagcgccaccggctactggaacaaaatgcctgatatctggttgggggaacacagctagctctggtgctgattatcctgacgagctccaatgcctggacgcccctgttctgagccaggccaagtgcgaggcttcctaccctggcaagatcacttctaacatgttctgcgtgggatttcttgagggcggaaaggacagctgccaaggggatagcggaggcccagtcgtgtgcaacgggcagctgcagggagtcgtgtcttggggcgacggttgcgcccaaaagaacaaaccaggagtgtatactaaggtgtataactatgtcaaatggattaagaacacaatcgccgctaattcctag

SEQ ID NO: 236430 - DNA, 2628 bp, Artificial Sequence
  Description of Artificial Sequence: Synthetic coding sequence
atgactctggcgcgtttcgttctcgccctgatgcttggcgctctgccggaagtagttggattcgacagcgttttgaatgattccttacatcattcccaccgacactctcccccagcaggccctcattatccatattacctacccacgcagcagcgcccaccacggacaagaccaccacctcctctgcctcggttcccaagacccccacgcgcactccccgcacagcgccctcacgctctgcaggccggtcacactcctcggccacacccctggggctgccccgctggagagccgtgggttagtgtcacagactttggggctccgtgcttacgttgggccgaggtccccccattcttggagaggtcccccccagcatcctgggcccagctccgaggacaaagacacaatttctgtcggagcccagatggagcaggcagaccctggtgcttttacggcgatgccaggggaaaggtggactggggatactgcgattgcagacacgggagcgtccggctgaggggaggaaagaatgagttcgagggcacagttgaagtatatgcctcaggcgtatgggggacggtgtgctcctcacattgggatgattcagatgcaagcgttatatgccaccaactgcagcttggaggcaaaggcattgctaagcagacgcccttttccggtttgggacttattccaatctattggtcaaatgtccgctgtagaggtgacgaggaaaatattctgctgtgcgagaaagatatctggcagggcggagtctgcccccagaaaatggccgcagccgtgacctgctccttttcccatggacccacattcccaattatcaggctcgctgggggaagctcagtccatgaaggtcgggttgaactataccacgccggacaatggggtactgtgtgcgatgatcagtgggacgacgccgatgctgaggtgatctgccgccagctgggtctctccggtatcgctaaggcctggcatcaagcttacttcggggaaggaagtggcccagtaatgcttgacgaagtccggtgcaccggaaacgaactgtctatcgaacagtgtcccaagtccagttggggcgagcacaactgtgggcacaaagaggatgccggtgtgtcatgcactccgctgaccgatggcgtgatccgactagccggtggtaaaggaagtcatgagggcaggctggaggtatactatcgtggacagtggggaactgtgtgcgatgacggctggaccgaattgaatacatatgttgtatgccgccagctcggctttaagtatgggaagcaggcctctgctaaccacttcgaggaatcaactggccctatttggctggatgatgtgagctgcagtggtaaagaaaccagattcttacagtgcagccggcgacaatgggggagacacgactgctcacatagggaagatgtatcaattgcttgctaccccggtggggaaggacacagattatctcttggattccctgttagactgatggatggggaaaacaagaaagagggcagagtggaagtcttcataaatggccaatggggcactatatgcgatgacggctggaccgacaaggacgcagctgttatttgtagacagttgggatacaaggggccagccagagcaagaaccatggcctattttggtgagggtaaaggccctatccatgtggataacgtcaagtgcaccggcaacgagcgcagtcttgcggactgcatcaagcaggatattggtcggcacaattgtaggcactcagaggacgccggagtcatttgcgattacttcggtaaaaaagcatcaggcaactctaacaaggaatctctgtcctcagtgtgtggactccgtctgctgcaccgacgacagaagaggattatagggggaaagaatagtcttcggggagggtggccttggcaggtctctctaagactgaagagttcacatggagatggcaggctcctgtgtggtgccactttgttgtcctcctgttgggttctgacagcagcacactgcttcaagcgctatggcaactcaaccaggagttacgcagtgagggtcggcgattatcacaccctggtcccagaggagtttgaagaggaaataggagtgcagcaaattgttatccatagagaatataggcccgaccgttctgactatgatattgctctggtccgactccagggccctgaggagcagtgtgctaggttctccagccacgtacttccagcatgcctacccttgtggagagagaggccccagaagacagcaagcaactgttatatcactgggtggggcgacactggcagagcctattcacggacgctacagcaggcagctattccactgttgcctaagcgtttctgcgaagaacgatacaaaggaagatttactggaaggatgttatgtgctggtaatttacacgagcacaaacgggtagactcctgtcagggcgattccggtggtcccctgatgtgtgaaagacccggagaatcctgggtggtatatggcgtcacctcctgggggtatggatgcggcgtaaaggattctccgggtgtgtacaccaaagttagcgctttcgtgccatggattaaaagcgtcaccaaactgtag

SEQ ID NO: 236431 - DNA, 489 bp, Artificial Sequence
  Description of Artificial Sequence: Synthetic coding sequence
atgaagggatttactgcaacgttattcctgtggacactgatcttccccagctgcagcggcggtgggggtggcaaagcctggccaacacacgttgtctgtagcgactcgggcctcgaagtgctgtatcagtcttgtgatccactgcaggatttcggtttttctgtcgagaagtgttccaagcagctaaagtctaacatcaacataaggttcgggatcatactgcgagaagacattaaagaactgttcctcgatttagccctaatgtcccagggatctagcgtccttaacttcagctatcccatatgtgaagctgcattgcctaaatttagcttctgtggcaggaggaaaggggagcagatctactacgccggaccagtcaataatccagagtttactataccgcagggtgaatatcaggtgctgctggagctgtatacggaaaaacggtcgaccgtggcatgcgctaacgctactattatgtgcagctag

SEQ ID NO: 236432 - DNA, 822 bp, Artificial Sequence
  Description of Artificial Sequence: Synthetic coding sequence
atggcagtgtggttagctcagtggcttggcccactgctcctcgtatcactttgggggctgctggcgccagcatccctattgagaaggctcggagaacacattcagcagttccaggaatcttccgcacagggcttggggctgagtctgggacccggagctgccgctttacctaaggtaggctggctggagcagctcttggacccctttaacgtatcggacaggcggagctttctgcagagatactgggttaacgaccagcattgggtggggcaggacgggccaatcttcctccacctgggcggagagggtagtcttggcccaggcagtgtgatgagagggcaccccgcagcactggcccctgcctggggagctctggttatctctttggagcaccggttttatggcctgtcaataccagcaggaggcctggaaatggcccaactccgattcctatcctcacgactggcgctcgccgacgtggtgtccgccagacttgctctgtctcggctatttaacatatccagttcttcgccttggatctgctttggcggatcatacgccggttcactggctgcatgggctagattgaagtttccccacttaattttcgcttccgtggcaagttctgcacccgtgcgggctgtactggacttctctgaatacaatgatatcgtcctgcactcactcgggcagaagtgcctaagcttttcacgggctgagacggtggcccaactgcggagtactgagccacagcttagcggcgtgggtgacagacagtggctgtaccagacttgcacagaatttggattttacattacttag

SEQ ID NO: 236433 - DNA, 501 bp, Artificial Sequence
  Description of Artificial Sequence: Synthetic coding sequence
atggccgtctggctcgcgcagtggctgggtccgctcttgttagtttctctctggggacttctggcaccggcatctcttctaagacgattaggcgagcatatccagcagttccaggagagcagcgcacagggactgggtctgagtctgggccctggggcagctgcactgcccaaggtaggctggctggaacagctgttggatccttttaacgtcagtgatcggagatctttcttgcagcggtattgggtgaacgaccagcattgggttgggcaggatggacctatctttttgcaccttggcggagaggggtctctggggcctgggtctgttatgagaggccatccagcagcactcgccccagcctggggcgctttagttatctcattggagcaccgcttctatggtctctcaatccccgcagggggtcttgagatggctcaactgcggttcctttctagccgccttgcgctgtcatgcactgcttgggctcgctcagtgtag

SEQ ID NO: 236434 - DNA, 498 bp, Artificial Sequence
  Description of Artificial Sequence: Synthetic coding sequence
tgagtgatgagagggcatcctgccgcactcgcccctgcctggggcgcactagttatatcacttgagcatcggttttacggcctatctattccagcaggcggactggaaatggcacagctgcggttcttgtcttccaggcttgcgcttgccgacgtggtaagcgctcggctggccctgtcacgcctgtttaatatcagtagctcctccccttggatctgctttgggggatcctacgctgggagtttggcagcctgggcaagactgaaattcccccacctcatttttgcttccgtggctagttctgcacctgtgcgtgccgtgctggatttctctgagtataacgacatcgtcctgcattctcttggtcaaaaatgcttatcctttagccgagctgaaactgtggcgcaactgaggagcaccgagccacagctctcaggcgtgggcgaccgacagtggctctaccagacctgtaccgaatttggcttttacgtgacctag

SEQ ID NO: 236435 - DNA, 945 bp, Artificial Sequence
  Description of Artificial Sequence: Synthetic coding sequence
atgggagcacgcggagcactgctgctggccctgcttctggccagagctgggctcagaaaacctgaatcccaggaagcagctcccctgagtggaccttgtggcaggagagtgattacatccagaattgttggaggggaggatgcggaactcggccgatggccatggcaaggatctctgagattatgggactcccacgtgtgtggggtcagccttctgagtcaccgctgggccttaactgcagctcattgcttcgagacatattctgatctttctgacccctccggatggatggtgcagtttggacagctgacgtctatgccttcgttttggagcctgcaggcctactatacccggtacttcgtcagcaacatatatctgagcccccgatacctgggcaatagtccatacgatatcgctttggtgaaattgagcgcacctgttacctacacgaagcatatccagccaatctgcttgcaggccagtacatttgagtttgagaataggaccgattgctgggtgactggctggggatacatcaaagaggacgaggcgcttccatccccacacaccttacaggaagttcaggtcgcgatcattaacaactcaatgtgcaatcatctcttcttaaagtactcctttcgtaaggacattttcggagatatggtatgcgccggtaacgcgcagggaggcaaggatgcgtgcttcggggactctggtggaccacttgcgtgcaataagaacgggctgtggtatcagattggggtggtatcctggggggtaggctgtgggaggcctaatagacctggggtgtataccaacattagccaccactttgaatggattcagaagctgatggcccagtctggtatgtcacaacctgaccccagctggcctctgctgttttttcctctactttgggccctcccactattagggccagtttag

SEQ ID NO: 236436 - DNA, 903 bp, Artificial Sequence
  Description of Artificial Sequence: Synthetic coding sequence
atgggtgcccgaggagcattgttgttggccttgttactcgcacgcgctggactgcggaagccagaatcacaagaagccgcaccccttagcggcccatgtggacggcgagttattaccagcaggatcgtgggaggcgaggatgccgaactcggtcgttggccatggcagggctctctaagattatgggatagccatgtgtgtggagtgagcctgctgtcacatagatgggccctaaccgccgctcactgcttcgagacctacagtgacctgtcagatcccagcgggtggatggtccagtttggacagctcacttcaatgcccagcttctggagtctgcaagcatattacacaaggtactttgtgtcgaatatctacctctccccacggtatctggggaacagcccctacgacatcgctcttgtgaaactttccgctccagtgacatataccaagcatatccagcccatttgccttcaggcttccacatttgagtttgaaaaccgaaccgattgctgggtgaccggctggggctacatcaaggaagacgaagctttacccagtccccataccctacaggaggtgcaggtggcaattataaacaatagtatgtgtaatcaccttttcttaaagtactcgttcaggaaagacatcttcggcgatatgggggactccggtggacctttggcatgcaacaagaacggcctgtggtaccagattggtgtcgtgtcctggggagtgggatgcggtcggcctaataggcccggagtctatacgaacatttcccaccacttcgaatggatacagaagttgatggcacaatctggtatgtcccagccagatccctcttggcctcttttgttcttcccccttctttgggcattgccactccttggcccagtctag

SEQ ID NO: 236437 - DNA, 939 bp, Artificial Sequence
  Description of Artificial Sequence: Synthetic coding sequence
atgggggctaggggtgctctcctgttggccctattattggcgagggccggtctgagaaaacctgagtcccaagaagccgcacccttgagtggaccatgtggcagaagggtgatcacctcccggatagtgggcggtgaggacgcagaactggggcgatggccttggcagggcagtttgaggctgtgggacagccatgtatgtggggtctctctgctctcacaccgttgggctctcactgccgcacactgctttgagaccgaccttagcgatccaagtgggtggatggtgcagttcggtcagttaaccagcatgcccagcttctggtctctgcaagcctattacactaggtacttcgtgtctaatatctacctgtcaccgaggtacctcggcaacagtccttacgatatagcactcgtcaagctgagcgcacccgttacatacactaaacatattcagccaatctgtttacaagcctctacctttgaatttgagaatagaaccgactgttgggttactgggtggggttatattaaggaagatgaagccctgccaagcccgcacaccttacaggaagtgcaggtcgccatcattaacaactcgatgtgtaaccatctgttcttaaagtattcttttaggaaggacatatttggcgatatggtttgcgccggaaacgctcaggggggaaaagacgcttgtttcggagacagtggcggaccgcttgcttgcaacaagaatggcctgtggtatcagattggcgtggtcagttggggagtgggatgtgggagacccaacagacctggcgtatacaccaatattagccaccacttcgagtggattcagaagctgatggctcagtccggcatgagccagccggacccctcttggcctctgctattctttcccttgctgtgggcactccctttgctgggtcctgtttag

SEQ ID NO: 236438 - DNA, 954 bp, Artificial Sequence
  Description of Artificial Sequence: Synthetic coding sequence
atggttgtcagtggggctcctcccgcacttggaggtggctgtctgggcacattcacaagtctactgctgttggcctccaccgcaatcttgaatgctgcgcgaattccggtgccacccgcttgtggcaaaccgcagcaactcaacagggtcgtggggggagaggattccaccgactccgaatggccgtggatcgtcagcatccagaagaacggaacacatcactgtgctggatctctattaacgtctcgctgggtcatcaccgctgcccactgttttaaggataatttgaacaagccctacctctttagtgttctacttggagcttggcagttaggaaacccaggatccagatctcagaaggtcggtgtggcctgggtcgaacctcacccggtgtatagctggaaggaaggtgcctgcgccgatatcgcactagtgaggctggagaggtctatccagtttagcgagagagtccttccaatttgcctaccagatgctagcatccacttaccgccaaatacacactgttggatcagtggctggggatcaattcaggacggcgtgccactgcctcatccgcagactctgcaaaaactaaaagtcccgattatcgacagtgaggtttgtagccatctgtattggcgaggcgcaggtcagggccctattactgaggacatgctgtgcgctggatacctggaaggcgagagagatgcttgcctcggtgattctggcggaccactgatgtgccaggtggacggggcttggctgctggccggaatcatatcttggggggagggctgcgccgaacggaatcgccctggggtgtacattagcctctccgcacatcggagctgggtggagaaaatcgtgcagggcgtacaattgcgcggacgagctcagggcggaggcgctcttcgcgctcctagccagggcagtggcgctgccgctcggtcttag

SEQ ID NO: 236439 - DNA, 786 bp, Artificial Sequence
  Description of Artificial Sequence: Synthetic coding sequence
atgcatatgcgggagactagcgggttcactctcaaaaaaggacggtcagcccctttggtgttccatccccctgatgcactcatcgctgtgcctttcgatgacgatgacaagattgtgggtggatacacgtgcgaggagaacagtctgccttatcaggtcagtctgaactccggctcacatttctgcggtggcagtttaatttccgagcagtgggtggtgagtgctgcacattgttacaagacaaggattcaggtgcggctgggcgagcataatattaaggtgctcgagggtaacgaacagtttatcaatgctgcgaaaattatccgccatccgaaatacaatcgcgataccttggacaatgacataatgttgatcaagttgagttctccagcagtcattaatgctagagtatccacaatttccctgcccaccactccacccgctgcaggtactgaatgcctgatttctgggtgggggaatactcttagcttcggggctgactaccccgatgaattgaagtgtctggacgcccctgtcctcacacaggccgaatgtaaggctagctaccctggaaagatcaccaatagcatgttttgtgtgggcttcctggagggtggcaaggactcctgtcaaagggacagcggcggacctgtcgtgtgcaacggccagctccagggcgtggtttcttgggggcacggatgtgcgtggaaaaaccggcctggcgtgtacactaaggtttacaactacgtggactggatcaaagataccatcgcggctaactcctag

SEQ ID NO: 236440 - DNA, 915 bp, Artificial Sequence
  Description of Artificial Sequence: Synthetic coding sequence
atgtgtggcccagatgaccggtgccctgcccgatggccaggccctggcagggccgtaaaatgtggtaaggggctggctgcggcaagacctgggcgagtcgaacgcggaggggcacaacggggaggagccggtttggagttacaccccctgctcggcggtcgcacatggagagctgctagggacgccgatggttgcgaggcattgggtacggtggcggtccctttcgatgacgatgacaaaatcgtaggcggatatacctgtgaagaaaactctctgccgtaccaagtgagcctcaatagtggcagccacttttgtggtgggtccctcatatctgagcagtgggtggtttcagctgcgcactgttataagaccaggatacaagtgcgcctgggcgagcataatatcaaagtactcgagggcaacgaacagtttataaatgcagctaagataataaggcatccaaagtataacagagacacattggataacgacattatgctcattaagctgagttcccccgcagtcataaacgccagggtctcgaccatttcgttgcctactaccccaccagctgccggtaccgagtgtctgattagtggttggggcaataccttgtctttcggcgctgactatccagatgagctaaaatgtctggacgcccctgtactgacccaggctgaatgtaaagcctcttatcccggaaaaattactaatagtatgttttgtgtcggattcctggaaggcggtaaggattcctgtcagcgcgattcaggagggcctgtagtgtgtaacggtcagctccaaggtgttgttagttggggacacgggtgtgcgtggaaaaacagaccaggggtctataccaaggtctacaattatgttgattggatcaaagataccattgctgccaattcttag

SEQ ID NO: 236441 - DNA, 744 bp, Artificial Sequence
  Description of Artificial Sequence: Synthetic coding sequence
atgaacccttttctgattttggccttcgtcggcgcagcagttgccgtgccattcgacgacgacgataagatcgtaggcggttacacttgcgaggaaaacagtcttccgtaccaagtttccctgaattccggtagccatttttgcgggggttctctgatcagtgaacagtgggtggttagcgctgcccattgctacaaaaccagaattcaggtcagactgggcgagcacaatatcaaggtactggagggaaacgagcagttcataaacgccgctaagatcatacgccaccctaaatataaccgagacacactcgataacgacatcatgcttatcaagctgagtagcccggctgtgatcaacgcccgagttagcacgatctctctgcctactaccccgccagccgcagggactgaatgcctgatttcgggatgggggaacactctctcatttggagccgactacccggatgagctgaagtgcttagacgctcctgtcttgacccaggctgaatgcaaggccagctatcctgggaaaataaccaattccatgttctgcgtgggtttcctagagggtgggaaagattcctgtcagcgggacagtggtgggccagtggtgtgtaatggccagctgcaaggcgtggttagctggggccacggctgtgcctggaagaatcgacccggagtatacaccaaagtctacaactatgtcgattggattaaggacaccatcgcggctaattcatag

SEQ ID NO: 236442 - DNA, 723 bp, Artificial Sequence
  Description of Artificial Sequence: Synthetic coding sequence
atgggtcctgcaggtgaggttgctgtgccttttgacgacgacgacaaaatagtcggcggttacacctgcgaagaaaactctctaccctaccaggtgtccttaaactccgggagccacttctgcgggggaagcctcatcagcgagcagtgggtcgtatctgccgctcactgctacaagactagaattcaggtgcgcctgggggagcataatattaaggttttggaaggaaatgagcagttcatcaacgccgctaagatcataaggcacccaaaatacaatcgcgacacactagataacgacatcatgttgattaagttgagcagccctgctgtaatcaatgctagggtgagtacgatctcgctgccaactacaccccctgcagccggaactgagtgtcttataagcgggtggggcaacactttatctttcggggcagactacccagacgagctgaaatgtctcgatgcccctgtactaactcaggcagaatgtaaggcttcctacccgggtaagatcacaaatagtatgttctgtgtgggcttccttgaggggggaaaggattcctgccagagagacagcggcggacctgttgtgtgtaatgggcagctccaaggagtcgtgtcctggggccacggatgtgcctggaagaataggccgggagtgtacactaaggtctacaattatgtggattggatcaaggacaccattgcagcgaattcatag

SEQ ID NO: 236443 - DNA, 537 bp, Artificial Sequence
  Description of Artificial Sequence: Synthetic coding sequence
atgcgggagactagcggctttaccctgaagaaagggaggagcgcaccattggtgttccatccccctgatgcactgatcgcagtgcccttcgacgacgacgacaagattgtgggcggttatacttgtgaggagaactctctcccttatcaagtgagcttaaacagtgggagtcatttctgtggcggaagtctgatctctgagcagtgggtggtaagtgctgcccattgctataaaactaggatacaggtccggctcggcgaacacaacattaaagttctcgaaggcaatgaacaattcattaacgctgccaaaatcataaggcatccaaagtacaatcgcgacacactggataacgacatcatgctgatcaagctctcgtctcccgctgttattaacgccagagttagcactatcagcctgcctaccacacctcccgcagctggcacggagtgcttgatcagcggttggggaaacaccctcagcttcggcgcagactatcccgacgaattgaaatgcctggacgccccagtgctgtag

SEQ ID NO: 236444 - DNA, 843 bp, Artificial Sequence
  Description of Artificial Sequence: Synthetic coding sequence
atgaggggagtttcctgtcttcaagtgttgttacttctggtgttgggcgctgccggaactcagggccgaaagagcgctgcgtgtgggcaacccagaatgtctagcaggatcgtgggtggacgcgacgggagggacggtgagtggccctggcaggcctctatccagcatcgcggtgcacatgtgtgcggtgggtctctcatcgctccgcagtgggtgttgaccgccgctcattgttttccaaggcgcgcactaccagccgaataccgggtcagactcggagcgttgagactcggttcgacatcccctaggacactgtcggtgccagtacgcagagtactgctcccaccagattactcagaagatggcgcaagaggagatctggctttgctgcaactgaggagaccggtacctttgtcagccagggtccagcccgtgtgcctgccagtcccgggagctcggcctcccccaggaacaccctgtcgcgtcactggttgggggagtttgagacctggtgtacctttaccagagtggagacccctccaaggagtgcgtgtaccacttcttgattctcgtacctgcgatgggctgtaccacgttggtgccgatgtcccgcaagccgagaggatagtactgcccggatcactctgcgcaggatacccccagggccataaggacgcctgtcaaggagactcagggggtccactcacatgtttgcagtccggcagttgggtcctggtcggagtcgtaagctgggggaaggggtgtgcgttgccaaacagacccggagtctacacttcagtggctacctacagcccatggatacaggccagggtgtctttctag

SEQ ID NO: 236445 - DNA, 1032 bp, Artificial Sequence
  Description of Artificial Sequence: Synthetic coding sequence
atggctcaaaagggggtcctggggcctggacagctgggagcagtagccattttactttatctgggcctgctgagatccgggactggggcagagggtgccgaagctccttgtggggtggcaccacaggctaggatcaccggagggtcctccgctgtcgcaggccagtggccctggcaggtgtctattacttatgagggcgtgcacgtgtgcgggggttctttggtgtccgaacaatgggtccttagtgccgctcattgcttcccatctgaacaccataaagaagcctacgaagtaaagttgggagcgcaccagttggacagctattctgaggacgctaaagtgagtaccctaaaagatataatacctcacccctcctatcttcaggaggggagccaaggcgatatagcactgctgcaattaagccgccctatcacatttagccggtatatcaggcccatttgccttcccgcagctaatgcaagctttcctaacggactacactgcacagttactgggtggggccatgtggcacctagcgtgagtctgctcactcccaagccactgcagcaactggaagttccattgattagtagggagacctgcaactgtctgtataacatcgatgccaaacccgaagaaccccattttgtgcaggaggacatggtgtgcgcgggatatgtggaggggggaaaagatgcatgtcagggcgactctgggggtccactgtcttgtcccgtcgagggcttatggtatctcacgggtatagtttcttggggcgatgcctgcggggcacggaaccggcctggcgtatacacactggctagctcctatgcatcttggattcaatcgaaagtgacggaactccagccacgcgtcgtcccgcagacgcaagagagtcaaccagattcaaacctgtgcgggtcacatttagcatttagttctgcccctgctcaaggtctcctcagacctatcttgttcctgcccctgggtcttgcactcggccttctgtccccatggctgagtgagcactag

SEQ ID NO: 236446 - DNA, 504 bp, Artificial Sequence
  Description of Artificial Sequence: Synthetic coding sequence
atggcccagaaaggggtgctcggtcccggacagttaggcgcagtcgcaatcctactgtatctgggactgctccgtagcggtacgggcaaagaaggagcagcggctccctgtggcgtcgcccctcaggcacgcattacaggcggtagctccgccgtggccggtcagtggccctggcaagtgtctatcactttctctagatatatcagacctatctgcctcccagcagctaacgcctcatttcctaacgggcttcattgcacagtgaccggctgggggcatgtagctcccagcgtcagtctgcttacacccaaacctctacagcagctcgaagtgcctctgatttcacgggagacgtgtaattgtctctacaacatagatgctaagcccgaggaacctcacttcgtccaagaggatatggtctgtgctggctacgtagagggcgctctgttgcgggtcaccctgggtgctcacagtccagctctgtggcgggtgagtgggacctag

SEQ ID NO: 236447 - DNA, 1197 bp, Artificial Sequence
  Description of Artificial Sequence: Synthetic coding sequence
atggagctggaagagggtaaagcaggctcaggcttaaggcagtactatctgagtaagattgaagagttgcagctcatagttaacgacaaatctcagaatctccggaggctccaggcccagaggaatgaacttaatgccaaagttagactcttgcgggaggaactgcaactgttgcaggagcaaggctcgtacgtcggggaggtcgtgagagccatggacaagaagaaagtgctggtgaaggttcatccggaaggcaagtttgttgtggacgttgataaaaacattgatattaacgatgttaccccaaactgccgcgtcgctctgcgcaacgattcgtacaccctgcataagatcctgcctaataaggtggacccactggtgagtctgatgatggtggaaaaagtgcctgacagtacctacgaaatgattggcggacttgacaagcagattaaggagatcaaggaagtgattgagctgccggtcaaacaccctgaactgttcgaagccctgggaatcgctcaaccgaaaggggtgttgctgtatggaccacctggcacaggcaagacattgttggcaagggcagtagcccatcatactgattgcacattcatccgggtgtccgggagtgagctggtacaaaagttcatcggtgaaggggctagaatggtccgcgaactgtttgtcatggctcgagagcacgccccttcaattatctttatggatgaaattgacagtatcggtagttcacgtctcgaggggggatctggcggagacagtgaagtgcagcggaccatgctcgagttgctcaatcaactggacggattcgaagccacaaaaaacataaaggtgatcatggcaactaacagaatcgatatcctagatagtgcacttctaagacccggtaggattgatcgtaaaattgaatttcccccacccaatgaggaggctagactggatatcctcaagatccactcacgcaaaatgaacctgacaagggggataaacctgcggaagattgccgagttaatgcctggcgctagcggagccgaggttaagggcgtgtgtaccgaggcaggaatgtatgccctccgggaaaggagggtgcacgtgacacaagaggattttgagatggcggtggctaaggtgatgcagaaagatagtgagaaaaacatgtctatcaagaaactatggaagtag

SEQ ID NO: 236448 - DNA, 765 bp, Artificial Sequence
  Description of Artificial Sequence: Synthetic coding sequence
atggcctccctcctgaaagtggatcaggaagttaaactgaaggttgatagttttcgggagagaatcaccagcgaggctgaggacctggtagctaattttttccctaagaaattactggagttagatagtttccttaaggaacccattctcaacattcatgacctgactcagattcactctgatatgaatttgccggtcccggaccctatcctgttgaccaactcacacgacggattggatggccctacatataagaaacgtcgactggatgagtgtgaggaggcattccagggcaccaaagtctttgtgatgcctaacggcatgctgaaaagcaatcagcaactcgtggatataattgagaaggtgaagcctgagatccgtcttctaatcgagaaatgtaatactgtcaaaatgtgggtccagctgctgatcccgagaatcgaagacggcaataacttcggcgtatccattcaggaggaaacagtggccgagctgaggactgtcgaatctgaagccgcaagctatctggatcagatcagccgttactacatcacaagggcaaagttagtgtctaagatagcaaaatacccacacgtggaagattatcgacgaaccgttacagaaatcgacgaaaaggaatacatttctctgcggctcatcatcagtgagttgaggaaccagtatgtcaccctccatgacatgatcctcaaaaacatcgagaaaatcaagcggcctcggtccagcaacgctgaaaccctttactag

SEQ ID NO: 236449 - DNA, 1323 bp, Artificial Sequence
  Description of Artificial Sequence: Synthetic coding sequence
atggggcagagccagtctggtggtcacgggccaggaggcggtaagaaggatgacaaagacaaaaaaaagaagtatgagccccctgtaccaaccagggttggcaaaaaaaagaaaaaaactaaaggacccgatgccgcatccaagctgcctcttgtaaccccgcacacccagtgccgcctgaagctgctcaaactggaacgcattaaagattatcttctgatggaagaagagtttattcgtaaccaggagcaaatgaagcccctggaggagaagcaagaagaagaacgaagcaaagttgacgacttaagggggacgcctatgtcagtgggcaccctcgaggaaatcattgacgacaatcacgcaatagtctcaaccagtgtcggatccgagcactatgtgagcattctgtcctttgttgataaggacctattagagcctgggtgctctgttctgctcaatcataaggtgcacgccgttataggtgtcctcatggatgacaccgatcctctggtgacagtgatgaaggtcgaaaaagccccacaggagacttatgcagatatcggaggacttgacaaccaaatccaggagattaaggagtccgtagagctgcctctgacacatcctgagtactacgaagagatggggatcaaacctccaaagggcgtaatcttgtacggaccgccagggaccggtaaaacgttgctggccaaggctgtagccaaccagacctctgctacatttctcagagttgtgggctctgagctcatccagaaatatctgggggacggtcctaagcttgtcagagaattattcagggtggctgaagagcatgctccaagtatcgtctttatcgacgagatagacgccatcggcactaaaaggtacgactccaattccggaggagaacgagagatccaaaggaccatgttggagctgctgaaccagctcgacggatttgactccaggggggacgtgaaagtgattatggcaactaatcggatcgaaaccctggaccccgctctgatccgccctggtagaatcgataggaagattgaatttcctcttcctgatgagaagacaaaaaagagaatcttccagatccatacgagccggatgacattagccgacgatgtgaccctggatgacctcattatggcaaaagatgatctttccggcgctgacatcaaagccatatgtacagaggcaggcctcatggcgctgagagaacggcgaatgaaggtgaccaatgaggattttaaaaaatccaaggagaacgtgctttataagaaacaggagggaacgcctgaggggctgtacctttag

SEQ ID NO: 236450 - DNA, 1104 bp, Artificial Sequence
  Description of Artificial Sequence: Synthetic coding sequence
atggaggaggaattcatcaggaaccaggagcagatgaagcctctagaggagaagcaggaggaggaaagaagcaaggtcgacgatctccgagggactccaatgagcgtagggaccctggaagagatcatagacgacaaccacgctattgtttccacaagtgtgggaagcgagcactatgtgagcatcttatcctttgtcgataaggatctgttggaacccggttgtagcgtgctattgaaccacaaagtgcatgcggtcatcggtgtgcttatggacgataccgaccctctggtaaccgtgatgaaggtcgagaaggccccacaggaaacgtacgcagatatcgggggactggacaatcagatacaggaaatcaaagagagcgtcgagcttccacttacccatcccgaatattacgaggagatgggcatcaaacctcccaaaggggttatcctctatgggcctcccggaaccgggaagactcttttagctaaggcagtagcaaaccagaccagcgcaacatttttgcgagtggtcggttcggagttgattcagaagtatcttggcgacgggcctaaactggtcagagaactttttcgagtcgctgaggagcatgccccttcaatcgttttcatcgacgagattgatgctatcggaacaaagcgctacgactccaactctgggggagagcgagaaattcagagaactatgctggagttactaaaccagctggatggattcgacagtcgaggggatgtaaaggtcatcatggccacaaaccggatagaaactctggacccggctctcatacgtccaggacgtattgatcgcaagatagaattccccctgccagacgaaaagaccaagaagcgaatcttccagatacataccagccgcatgaccctcgccgatgacgttacattggatgacctgatcatggctaaggatgacttaagtggggcagatataaaagcaatctgcaccgaggcaggcctgatggccctgcgcgagaggcggatgaaagtgaccaatgaagacttcaaaaagagcaaggagaacgttctgtacaaaaagcaggagggcacaccggaaggcctctatctttag

SEQ ID NO: 236451 - DNA, 1302 bp, Artificial Sequence
  Description of Artificial Sequence: Synthetic coding sequence
atgcctgattaccttggcgcagatcagagaaagactaaggaagacgaaaaagatgacaagcctatccgtgccctcgacgagggggacattgcactgttgaagacctatggccagtctacttactcgcgacagatcaagcaggtggaagacgacattcagcaactgctcaagaaaattaacgagctcaccgggatcaaagaatccgacaccggcctggcgcctcctgccctctgggatttggcggcagacaaacagaccctgcaatcagagcaacccctgcaggtcgctcggtgtacaaagattatcaatgcggacagtgaggaccccaagtacattatcaatgtgaaacagttcgcaaaattcgtggtcgacctgtccgatcaagtagcaccaacagacattgaggagggcatgcgcgtaggtgtggataggaacaagtaccagatccacatcccactgcctcctaaaatcgatcccacagttaccatgatgcaggtagaagagaagccggacgtgacttatagtgacgtgggagggtgcaaagagcagatcgagaaacttagggaggtcgtggaaacccccttgctgcatccagagagatttgtgaacctggggatcgaacctcctaaaggcgttctcctattcggccctcccggaactggaaaaacactctgcgccagggccgtcgcgaatagaacagacgcctgtttcattagagtgattggatcagaacttgttcagaaatacgtgggagaaggcgctagaatggtgcgggaactctttgagatggctagaacgaaaaaagcgtgtctcattttcttcgacgagatcgatgctatcggcggtgctagattcgatgacggtgcagggggagataacgaggtacagcgtaccatgctggaattgatcaaccagttagacggctttgacccacgcggaaacattaaggtattaatggccactaatcggcctgatactcttgacccagccctgatgcgacctggcagactagacagaaagatcgagttttcattgcccgacttagaagggagaacacacatctttaagattcatgcacgctccatgtcagttgaaagagacatacgcttcgaactgctcgcccgtctgtgccctaatagcactggcgcagagatccgttcagtgtgcacggaagccggaatgttcgccattagagctcgcaggaagattgcaactgaaaaagactttctggaagctgtgaacaaagtgatcaaatcctacgctaaattcagtgcaacaccgcgttatatgacgtacaattag

SEQ ID NO: 236452 - DNA, 393 bp, Artificial Sequence
  Description of Artificial Sequence: Synthetic coding sequence
atgcctgattacctgggggctgatcagaggaaaactaaggaggacgagaaagatgataaacctatccgcgctctagacgagggcgatattgcgttactcaagacttatggccagtcaacctacagtcggcagattaagcaggttgaagatgacatccagcagcttctcaagaagattaacgaactgactggaataaaagagtccgacacagggcttgcccctcctgccttgtgggacctggccgctgacaaacagacattgcaaagtgagcagccacttcaggtcgccagatgcacgaaaatcatcaatgccgatagtgaggatccaaagtacataatcaacgtgaagcagtttgccaaattcgtagtggaccttagcgatcaggtagcatag

SEQ ID NO: 236453 - DNA, 1302 bp, Artificial Sequence
  Description of Artificial Sequence: Synthetic coding sequence
atgcctgattacttaggagccgatcagcggaagactaaggaagacgagaaagacgacaagccaattcgcgcactcgacgaaggagacatcgcccttctgaaaacatatggtcaatctacttacagccgccagataaaacaggtggaggacgacattcagcagctcctcaaaaagataaatgagctcacaggaatcaaggaatccgacactgggctggctcctcctgccctgtgggaccttgcagccgacaagcaaacccttcaaagtgaacagcctcttcaggtcgcacgctgcactaaaataatcaacgctgattcagaagaccccaagtacatcatcaatgtgaaacagtttgctaaattcgtcgttgatctgtctgaccaggtagcgcctaccgacattgaagaaggaatgcgggtgggggttgatcggaacaagtaccagatccacatccccctcccacccaagatcgatcccacggttactatgatgcaggtggaagaaaaacctgatgtaacgtattccgacgtggggggatgtaaggagcagatcgagaaattgcgagaggtggtcgagacaccgctgctgcatcccgagcggtttgtaaacctcggcatcgaaccccctaagggagtacttctgttcggcccacctggaactggaaaaacattgtgcgctagggcagtggccaacagaacagacgcttgttttatccgcgtgatcggcagcgaactggtgcagaaatacgtcggggagggggctcggatggtaagggaactgtttgagatggcaaggacaaaaaaagcttgtctgatcttttttgacgagatcgacgctatcggcggagcacgctttgacgacggcgcagggggtgacaacgaagtccagagaacaatgttagagctgattaaccaactggatggtttcgatccgcgaggtaacattaaagtattaatggcaacaaatagaccggacactctggaccctgcgctgatgcgaccaggtagactagaccgaaaaatcgaattcagcctacccgacctggaggggcgaacgcatatcttcaagatccacgcacggagtatgtcagttgagagagacattaggttcgagctgctggctcggctgtgtcccaacagtactggcgcagagattaggagtgtctgcacagaggccggtatgtttgcaattcgcgcacgcagaaagattgcaacagaaaaagatttcctcgaggcagtgaacaaagtgataaagtcctacgctaagttcagtgccacccctcggtacatgacctacaattag

SEQ ID NO: 236454 - DNA, 393 bp, Artificial Sequence
  Description of Artificial Sequence: Synthetic coding sequence
atgcctgactacttgggggcagatcagcgcaagacaaaagaagacgagaaagacgacaagccaataagggccctagacgaaggggatatcgcgctgctgaagacatacggacaatccacatactccaggcaaatcaaacaagtggaggatgacatacagcagctgctaaaaaagatcaatgaattaacagggatcaaggagtcagacacagggctagccccacctgcactttgggacttggctgccgacaaacagacacttcagtccgagcagccacttcaggtcgcccgatgtacaaagataatcaatgcagactctgaagaccccaagtatatcatcaacgtcaagcaattcgcaaagttcgtcgtggacctttctgatcaggtggcatag

SEQ ID NO: 236455 - DNA, 891 bp, Artificial Sequence
  Description of Artificial Sequence: Synthetic coding sequence
atgagggtgggtgttgatagaaataagtaccagattcacattcctttgccacccaaaattgaccctactgtgacaatgatgcaggtggaagaaaagccagatgttacatactcagacgttggagggtgcaaagaacagattgagaaactccgcgaagtcgtggaaacaccgctgctgcacccagaacgatttgttaaccttggtatcgaaccacccaagggagtacttttgttcggtccccctgggactggcaaaacactgtgcgccagagctgtggcgaaccggaccgatgcgtgcttcatcagggtaatcggctcagaactcgtgcaaaagtacgttggagagggcgctcggatggtccgcgaactttttgagatggcgcgaaccaagaaagcttgtctgatcttttttgacgaaatcgacgcgataggcggtgcgcgatttgacgacggggctgggggagacaacgaagtgcaaagaaccatgttggagcttattaatcagctggatggcttcgacccgcgaggtaatatcaaagtgctaatggccactaaccggcctgacaccctggacccagctcttatgcggccaggccgactggatcgaaagatcgaatttagtctccctgacctcgaggggaggacacatatatttaaaattcatgccaggagcatgtcagtcgagagagatattaggttcgagctcctagcaagactttgtccgaattccaccggtgccgaaataaggtcagtgtgcacagaggcaggcatgtttgctattagagcgagaaggaagatcgccacggaaaaagacttccttgaggccgtgaacaaggttatcaagagctacgctaaattcagtgccacacctaggtacatgacatataattag

SEQ ID NO: 236456 - DNA, 1320 bp, Artificial Sequence
  Description of Artificial Sequence: Synthetic coding sequence
atgaacttgctcccgaacatcgagagtcctgtaacacggcaggagaaaatggccacggtttgggatgaggccgagcaggatggcattggggaagaagtattgaagatgagtactgaggaaattatccaacgcaccagattgctggacagcgagatcaagatcatgaagagtgaggtgctccgcgtgacacacgaactgcaggctatgaaagataaaattaaagagaactctgagaagattaaggtgaataagactctcccatatttggtgagcaacgtgatagaactgctggacgtggatcccaatgaccaggaggaagacggcgcaaatatagacctggactcgcagcgaaagggaaagtgcgccgtgattaagactagcaccagacagacctattttctgccagtaatcggcctggtggacgcggaaaaactcaaacctggagacctggttggagtcaataaggattcctacttgatactggaaacattacctacagaatatgactcccgcgtaaaggccatggaggtggatgagcggcctactgaacaatacagcgacataggcggactggacaagcagatccaggaactggtggaggcgattgtgctgccaatgaatcacaaggagaaatttgagaacctgggtatacagccccctaagggagtattgatgtatggtccacccggaacaggcaagaccctccttgcaagagcttgcgctgcccaaaccaaggccacgtttctgaaactggcaggcccacagctggttcagatgtttattggggacggggctaagctggtgagagacgcatttgcactcgccaaagaaaaggctccgagtattatctttattgatgaactggatgcaataggcacaaaacggtttgactccgagaaggccggagacagggaagtccagaggacaatgctggaactgctgaatcagctagacgggtttcagccaaacacccaggtgaaggtaatcgccgctactaaccgggtggatattctggatcccgcacttcttagatcgggtagattagaccggaaaatcgagttccccatgccaaatgaggaggcacgtgccaggattatgcagatccacagtcggaaaatgaacgtctcacctgacgtcaactatgaagagttagctcgttgcaccgatgattttaacggtgctcagtgcaaggcggtatgcgtcgaggcaggcatgattgcccttcgaaggggcgcaacagaactaacacatgaggactatatggaaggaatcctggaggtacaggcaaaaaagaaggccaatctgcagtattacgcgtag

SEQ ID NO: 236457 - DNA, 1257 bp, Artificial Sequence
  Description of Artificial Sequence: Synthetic coding sequence
atggaggagatagggattctggttgagaaggcacaggatgagatccccgctttatcggtgagtcggccacagaccggcctgtcattcctgggacctgaacccgaagacttagaagatctgtactccagatataaaaagctccagcaggagctggaattcctcgaagtgcaggaggagtatattaaggacgaacagaaaaatttgaagaaagagttcttgcacgcccaggaggaggtgaagagaatccagtctattcctcttgtgatcgggcaattcttggaggccgtcgatcagaacactgctattgtcgggagtaccactggctcaaattactacgtccgcatcctcagtacgatagatagagaattactgaaaccaaatgcttctgtagccttgcacaagcactcgaacgctctcgttgatgtgttgccccctgaggcggactcttccatcatgatgcttacatctgaccaaaaaccagacgtgatgtatgctgacatcggcggaatggacatacagaaacaagaggtgcgcgaggcagtggaactacctctcacacactttgagctttacaagcagattggaatcgatccacctagaggtgtgttaatgtacggtcctccgggttgtggcaaaaccatgctggctaaagctgtggctcaccataccaccgccgcttttatcagagtcgtgggatctgaatttgttcaaaaatatcttggagaggggcctcgcatggtgagagacgtttttaggttagccaaggaaaacgccccagccataatctttatcgacgagatcgacgctattgccaccaagcgctttgatgctcaaactggggcagacagggaagtgcagcggatcttactggagctgctcaaccagatggatgggtttgatcaaaatgtcaacgtgaaggttatcatggctaccaatagagcggataccctggatccagctcttttgagacctggcagactggaccgcaagattgaattccctctccccgacaggcgacagaagagacttatcttcagtaccattactagtaaaatgaatctgtcggaagaggtcgaccttgaggactacgtcgccaggcctgacaaaatttcaggcgctgatatcaacagcatttgccaggagtccggcatgcttgccgtaagagagaaccgctatatcgtcctggcaaaggattttgaaaaagcctataagacggtaatcaaaaaagacgagcaagaacacgaattttacaaatag

SEQ ID NO: 236458 - DNA, 1164 bp, Artificial Sequence
  Description of Artificial Sequence: Synthetic coding sequence
atggaagaaattggcattctggtggaaaaggcccaggatgagatccccgcactcagcgtgagccggcctcagaccgggcttagcttcctgggacccgagcccgaagatttggaagacctctattctcgatataaagaagaggtgaagcgcattcaatctatcccactggtgatcggccagttcttagaagccgttgaccagaacacggccattgtggggagtacaaccggtagcaactattacgtgagaatcttatctaccattgatcgggagttgctgaagcccaacgcatcagtggcacttcataagcattctaacgcactggtggacgtgctgccccctgaggctgattcatctattatgatgctcactagtgatcaaaagcccgacgtgatgtacgccgacattggtgggatggatattcagaaacaagaggtgagggaagccgtggagctgcctctaacgcattttgaattgtacaaacaaatcggcatcgaccctcccaggggtgtcttgatgtacggccctcccggttgtggaaaaacaatgctggccaaagctgttgcgcaccatacgacagcagctttcatccgagtggtaggcagcgaattcgttcagaagtatctcggagaaggacctcgtatggttagagacgtgtttcggctggccaaagagaacgccccagctataatatttatcgatgagattgatgcaatagccacaaagagattcgacgcccaaacaggcgcagaccgggaggttcaaagaattctcttagagttgcttaatcagatggatggtttcgatcaaaatgttaatgtgaaggtgatcatggccactaatagagcagataccctggaccccgcattgctgagacccggaagactggatcggaagatcgaatttcccctgccagatcggagacagaagagattaatctttagcacgattacttcaaagatgaatctttccgaagaggttgatctggaagattatgtggctcggccagacaaaatttctggcgctgacataaattctatctgccaggagtccggcatgcttgcagtccgggaaaacaggtatattgtgcttgccaaggacttcgaaaaggcttataaaaccgtaattaagaaagacgagcaggagcacgaattttacaaatag

SEQ ID NO: 236459 - DNA, 1221 bp, Artificial Sequence
  Description of Artificial Sequence: Synthetic coding sequence
atggccttggacgggcctgagcagatggagttggaggaggggaaggcagggtcaggtctccgccagtattatctctccaagattgaggaactccagttaatcgtgaatgataagtcccagaacttgagacgattacaggcacagcggaacgagctgaatgcaaaagtcaggttgttacgggaggaattgcagctgttgcaggagcaggggagttatgtgggggaagtggtgagggccatggataagaagaaggtgctcgtgaaagtgcatccggaaggtaaattcgtggtagacgtggacaaaaacatcgacattaacgacgtaactcctaattgccgagtggccctcaggaacgattcttacactctccataagatactgcccaacaaggttgatccactggtgagcttgatgatggtagaaaaagttccagattcgacgtacgagatgattgggggtcttgacaaacaaataaaggagatcaaggaggttattgaactgccagtgaaacacccagaacttttcgaagccctgggaatcgcacagcctaagggcgtgctcctctatgggccacccggtaccggaaagacgctcctggcgagagccgtagcccaccacacagattgcacctttatccgcgttagcggcagcgaactggtgcaaaagttcataggtgagggagcgcgaatggtccgggaattgtttgtaatggccagggagcacgctcctagcattatcttcatggacgagattgactctataggctcttcaaggctagaagggggtagcggtggcgattcagaagtgcagaggactatgcttgagctgctgaatcagctggacggatttgaggccaccaagaatataaaggtaatcatggccaccaatcgcattgacatccttgattctgccctgcttcgcccagggcgtattgatcgcaaaattgagtttccccctcccaatgaggaggcacggctggatatcctcaagattcacagtcgtaagatgaatctgacacgcggtattaacctgcgtaagattgcagagctgatgccaggtgcgtctggagccgaagtcaaaggtgtatgtaccgaggcagggatgtatgcactgcgggaacgccgtgttcatgtgactcaggaggactttgagatggccgtcgcaaaggtgatgcagaaggactctgagaaaaatatgtccatcaagaagctatggaaatag

SEQ ID NO: 236460 - DNA, 1197 bp, Artificial Sequence
  Description of Artificial Sequence: Synthetic coding sequence
atggagttggaggagggtaaggctggttccggcctgcgacagtactatctcagtaagattgaggagcttcagttgattgtgaatgataaatcacagaacctgcggagactgcaggctcagaggaatgaactcaatgctaaagtccggcttctgcgggaagaacttcaactcctacaggagcaggggtcctacgttggagaggtggtcagagccatggataagaagaaagtgctggttaaagttcatcctgagggtaaattcgtagtggatgtagacaaaaacatcgacattaatgacgtgacgcctaattgcagagtagccctgcgcaacgacagttatacgctgcataagattctccccaacaaagttgatcctctggtcagtctgatgatggtggagaaagtcccggattctacttacgaaatgataggtgggctcgataagcagatcaaggagataaaggaagtcattgagctgcctgtcaaacaccccgagctttttgaggcgcttggaatcgctcaaccgaagggcgtactgctatacggaccccctggcacagggaaaacactgcttgcccgtgcagtagcccatcacacagactgcacgtttataagggtgtcgggttccgagctggtgcaaaaatttattggcgagggggcaagaatggttcgcgaactatttgtcatggctcgggagcatgccccatcgataatctttatggacgagattgactctatcgggagctctcggttagagggaggcagtggcggtgactcggaggtacagcgcacaatgttggaacttctgaaccagctcgacggatttgaggctacaaaaaatatcaaagtgattatggcaaccaacagaatcgatatcttggatagcgccctcctccgcccaggacggattgaccgcaaaatcgagtttcctccaccaaacgaggaggctcggttggatattttgaaaatccactcgaggaagatgaacctgacaagagggatcaacctcaggaagattgcagagcttatgcctggcgcttccggagccgaggtcaagggggtatgtactgaggcagggatgtatgccctacgtgagaggcgtgtgcatgtgactcaggaagacttcgaaatggctgtagcaaaggtgatgcagaaggatagcgaaaaaaacatgagcattaagaagctttggaagtag

SEQ ID NO: 236461 - DNA, 1212 bp, Artificial Sequence
  Description of Artificial Sequence: Synthetic coding sequence
atggccataccaggaatcccctacgagcggagactgctcattatggccgatccccgtgataaagcactccaggactaccggaaaaaattacttgagcacaaagagatcgacggccgactgaaagaactccgggagcagctcaaagagctaaccaaacagtatgaaaagagtgagaatgacctgaaggccctccagtctgtggggcagatcgtgggagaggttctgaagcaactcaccgaggaaaagttcatcgttaaggctaccaacggccctaggtatgtagtgggctgtcggagacagttggacaagagtaagttgaaaccagggacaagagtggcactggacatgaccactctcactataatgagatatctcccaagagaggtcgaccccctggtatataatatgagccacgaagaccctgggaatgtgtcctatagtgagatcggtggtctttctgaacagattcgtgagctcagggaggtgattgaacttccactgaccaatcctgagctattccagcgggtgggcattatcccgcctaagggttgcttgctttatggaccaccaggtacaggcaagaccctgcttgcacgtgccgtagcatcacaactggattgtaacttcctcaaagtggtatccagttccattgtagacaagtatattggagagagcgcacggctgattcgggagatgttcaattatgctcgagatcatcagccctgtatcatcttcatggacgaaattgatgctattggcggacggagattttcggaaggaactagcgcagatagagaaattcagagaactctgatggaacttctcaatcaaatggacggcttcgatactctacatcgcgtgaaaatgattatggctactaaccggcctgacaccctggatcccgctctgctgcggcctggacgcctcgatcgcaaaatacatattgatttgcccaacgaacaggccagactggacatcctgaagattcatgccggaccaattaccaaacatggagaaattgattacgaagccattgttaagctcagtgatggatttaacggcgctgacttacgcaacgtgtgtacagaggctggcatgttcgcaattcgagccgaccatgattttgtcgtccaagaagatttcatgaaggcagtccgcaaggtggcggacagcaagaaactcgagtctaagctggattacaaacccgtgtag

SEQ ID NO: 236462 - DNA, 933 bp, Artificial Sequence
  Description of Artificial Sequence: Synthetic coding sequence
atggataggctactgcgactcggcggaggtatgccaggactgggccagggtccgcctacagatgccccagcggtcgacactgccgaacaggtgtacatctccagcctcgcccttttgaagatgctgaagcacggcagagccggagtgccgatggaagtcatgggtttaatgctgggtgaattcgtggatgactacactgtgcgagtgatagatgtattcgccatgcctcagtctggcaccggggtttccgttgaagctgtcgatcctgtatttcaagcaaaaatgctggacatgctcaaacagacaggacgtccagagatggtggtcggatggtatcactcacatcccggattcgggtgttggctgtcaggtgtcgatattaatacccagcagagtttcgaggcgctatctgagagagccgtggccgttgttgtcgaccctatacagtcagtcaagggcaaagtcgttatagatgcctttcggctcataaatgccaatatgatggtgctgggtcatgagccgagacagaccacttctaacttgggacacctcaataaaccatcgattcaggccttaattcatgggcttaatagacactactacagtataacaattaactacaggaaaaacgagttggagcagaagatgctgctgaacctgcacaagaagtcctggatggaaggccttacccttcaggactactcagaacattgtaagcataacgagtcagtggttaaggagatgttggagctggccaagaattataacaaggcagtcgaggaagaagacaaaatgacgcctgagcaactggcaatcaaaaatgtcggcaaacaggacccaaagagacacttagaagagcacgtggacgtgctgatgacctcgaacattgttcagtgccttgccgctatgctcgataccgttgtgtttaagtag

SEQ ID NO: 236463 - DNA, 255 bp, Artificial Sequence
  Description of Artificial Sequence: Synthetic coding sequence
atggaccgactgctgaggctcggtggaggcatgcctggattgggccaaggcccaccgacagacgccccagccgtcgacacggccgagcaggtctatattagctctcttgcactcttgaagatgttaaaacacggcagagcaggtgtgcctatggaagtcatgggcttaatgttgggagaatttgtcgacgactatacagtgcgagtcattgatgtctttgcaatgccccagtctgggaccggagtgtctgtgtag

SEQ ID NO: 236464 - DNA, 2727 bp, Artificial Sequence
  Description of Artificial Sequence: Synthetic coding sequence
atggaagaagggggtcgcgacaaggccccagtccagccccagcaaagccccgctgcagccccaggaggaacggatgagaaaccatcaggtaaggaacgtagagatgcgggagacaaggacaaggagcaggagctgagcgaagaggataagcaactacaggacgaactagagatgcttgtcgaaaggctgggagaaaaggacacatccctgtatcggcctgcccttgaggagttaagaagacagatcagatcaagtaccacctccatgacctcagtgcctaagccactgaaattcctgcgtccccactatggtaaactgaaggagatctatgagaatatggctcctggggagaataagcgtttcgccgcagacatcatctcagtccttgccatgacaatgtctggagaaagagaatgcctcaagtatagactggtcgggtctcaggaggagctagcctcctggggccatgagtacgttcgacatttagccggagaagtggcaaaggaatggcaggaactcgatgacgcggaaaaagtgcagagggaacctctgctgacactggtgaaggagatcgtcccctacaatatggctcacaatgcagaacatgaagcctgcgatctcctcatggaaattgagcaggtcgacatgctggagaaggacatcgatgaaaacgcctacgccaaggtctgcttatatctaactagttgtgtaaattatgtgcccgagcctgaaaattccgctctactcagatgcgccctcggagtctttagaaaattctcgcgtttcccagaggcgctacgattagccttgatgctaaatgacatggaactggtcgaagatatatttacgagctgtaaagacgtagtcgtccagaagcagatggcttttatgctcggcagacacggggtgttcctcgagttatcagaggacgtggaggagtatgaagaccttaccgaaataatgagcaacgtgcaactgaacagcaatttccttgcgctagccagggagttagatatcatggagcctaaagtgcccgatgacatatataagacccatcttgagaataatagattcggcggatccggatcccaagttgactccgctcgaatgaacctggctagctcttttgtcaacggatttgtaaacgccgcattcggccaagacaagctcctcactgacgacggaaacaaatggctgtacaaaaacaaggaccatggaatgctgagcgctgccgcttccctgggtatgattctcctgtgggatgtcgacggaggtctgacacaaatagataagtatttatacagtagcgaggattatattaagagcggcgcattgctggcctgtggcatcgtgaatagcggcgtccggaacgagtgcgaccctgcactcgccctactttccgactatgtcttacataattcgaacacaatgagattgggctccattttcggactggggttggcatatgctggctccaacagagaagatgttcttacgctgcttctgcctgtgatgggggattcgaaaagctctatggaagttgcaggcgtcacggctctggcctgtggaatgatcgccgtcggatcctgcaacggggatgttactagcaccattcttcagactatcatggaaaagtctgaaactgagctgaaagacacctacgcacggtggctgcctctggggctaggcctcaaccacctcggaaaaggggaggctatcgaagccattctggcagcccttgaagtcgtcagcgaaccattcagatccttcgcgaatacccttgtagacgtttgtgcttatgccggatccgggaatgtgttgaaggtgcagcagttactgcatatatgctctgagcatttcgattccaaagaaaaagaggaggacaaagataagaaggagaagaaggacaaggacaaaaaggaggccccagctgatatgggggcacatcagggagtcgctgtgctgggtatagctctgatcgcgatgggagaagagatcggggctgaaatggccctgaggacatttggccacctgctgcgatatggagagcccacactgagacgcgcagtgcccttagcactggctttgatctccgtgagcaatcctaggcttaacatcctggatactctgtccaagttctctcatgacgctgatccggaggtgtcgtataactcgatatttgctatggggatggtgggttcaggaaccaacaacgcgagactcgccgctatgctcagacagctggctcagtaccatgcgaaagacccaaacaatctgttcatggtgcgtctggctcaagggctcacccatctcggaaaaggcacactgacgctgtgcccttatcattccgaccgacagttgatgtctcaggtggcagtcgccggtttgttgaccgtcctggtcagtttcctcgacgtacgaaacattattcttggtaagtcccactacgtcctctacggtctggttgccgctatgcagcccaggatgctggtgacattcgacgaagagctgcggccactgccagtatccgtccgcgtggggcaagctgtagatgtcgtgggacaggctgggaagcctaagaccattaccggctttcaaacacacacaactccagtcttgctggcccatggtgaacgggcagaactcgctacggaggaatttctgcctgtgacccctatcctggaaggctttgtaatccttcggaagaacccgaactacgatttatag

SEQ ID NO: 236465 - DNA, 1743 bp, Artificial Sequence
  Description of Artificial Sequence: Synthetic coding sequence
cagtgcacagcacagcagcaactactcggcttgagtagcggggctggccatcacggtgcccagctcatgctacagaaccctcccagagagcagcaagtgtggggccagtggctcagcggcggtctgtgcccacatgagcctgggctgctcttttgcgagtggttgtgtgagtgtagtttttgggacaaactgctcactgatgacggaaacaagtggctgtataaaaacaaagaccatggcatgctctccgccgctgcttcactaggtatgatcctgctgtgggatgtcgacggtgggttgactcagatcgacaagtacctttattcaagcgaagattatatcaagagcggcgcacttctggcttgtggcattgtgaatagcggcgtccgaaatgaatgcgacccagctctggccttactgagcgactacgtgctccataattcaaataccatgagactggggtctatctttggccttggcctggcatatgcgggttcgaaccgtgaggacgtgctcaccctgctgctgccagtgatgggagactctaaaagttctatggaggtggcaggagtcacagcactcgcctgtggaatgatagctgtgggttcttgcaacggggatgttaccagtactattttacagaccatcatggaaaaatcagagaccgagctgaaagacacatacgccaggtggctgccacttggtctcggcctgaaccatctgggaaagggagaagccatcgaagccatcttagctgccctcgaagtggtgtctgagcccttcagatccttcgcgaacaccctggtagacgtatgtgcctacgccggtagcggaaacgtactcaaggtgcagcagcttctgcacatttgctcagaacacttcgactccaaggagaaggaggaggacaaggacaaaaaggagaaaaaagataaagacaagaaggaagctcccgctgacatgggggctcatcagggggtagccgtgctgggcccactgctgctctggggcagacggctggtgcagcgctggcattatgagccctatcaccagcttcgatacggagaacctactctccggagagcagtgcctcttgcactggctttgatctcagtatccaaccctcgccttaatatcctggataccttgagcaaatttagccacgacgccgacccggaagtcagctacaactcaatattcgccatggggatggtaggcagcggcaccaacaatgctagactggccgcaatgctgaggcagctggcccaataccacgccaaagacccgaataatctgttcatggtgcgcttggcccaggggctcacacacctgggaaaaggtacacttactttatgcccttaccatagtgatcggcagctgatgtctcaggttgccgtggccggactgcttaccgtactggtgtcttttctagatgtgcgcaacataattctaggaaagagccactacgtgctctacggtctcgtggccgctatgcagcccaggatgctagttacatttgatgaagagctaagacccttgcctgtgagcgtcagggtaggacaggcagtggatgtcgtgggccaagccggaaaacccaagactatcaccggtttccagactcatactacccctgtactcctcgctcatggcgaacgcgcagaattggcaaccgaggaatttctgcccgtgactcccattcttgagggcttcgtattcggcaggactccaatcatgataagtaaatag

SEQ ID NO: 236466 - DNA, 2703 bp, Artificial Sequence
  Description of Artificial Sequence: Synthetic coding sequence
atggaagaagggggtagggacaaggccccagtgcagccccagcagagccccgcagccgctcctggtggcacagatgaaaagccttcaggcaaagacaaagaacaggaactttcggaggaggataagcagctgcaggacgagctggagatgctggttgaaaggctcggcgagaaggacacctccctgtacaggccggctctggaggaactgcgcaggcaaatccggtctagcacgacatcaatgacctcggtgcctaagccccttaaatttctgaggccgcactatggtaaattgaaagagatatacgaaaacatggcacctggagaaaacaagcggtttgctgccgacataatcagtgtgctggccatgaccatgagcggtgaacgagagtgcctcaaataccggctcgtcggtagtcaggaggaattagcgtcttgggggcacgaatacgttagacaccttgccggtgaggtggctaaagagtggcaggaactagacgacgccgaaaaggtgcaaagagaacctttgctcacgctcgtaaaagagattgtgccttacaatatggcacacaacgccgaacacgaggcttgtgacctccttatggagattgaacaggtggatatgttagaaaaagacattgacgaaaacgcttacgccaaagtgtgtctctacctgacaagctgtgtgaactatgttcccgagcccgagaactcagcccttctcagatgcgccctcggtgttttcaggaaatttagcaggttccctgaggctttgcggcttgcactgatgctaaatgatatggaactggtagaagacattttcacaagttgcaaggacgtcgtggtgcagaaacagatggcattcatgttaggaagacacggcgtcttcctggaattatccgaagacgtcgaggaatacgaagatctgacagaaataatgtctaatgtgcagctgaactctaactttctggctttggctagggaactggatattatggagccaaaggttccagatgatatctataagactcatttagaaaataatcggttcggcggaagcggtagtcaggtagactcagcccgaatgaaccttgccagttcatttgtgaacggttttgtcaacgctgcttttgggcaggacaaattactgactgatgatggcaacaagtggttgtacaagaacaaagaccatggcatgctgagtgcagccgcttcattgggcatgattttgctatgggatgtggacggtggccttacccaaattgataagtatttatactccagcgaagactatatcaagtccggcgcactgcttgcatgtggaatcgtcaactctggtgtaagaaatgagtgtgaccctgccctggctctgctgtctgactacgtgctccacaattcgaacaccatgcggctgggtagtatatttggtctgggactggcttacgccggtagcaatagagaagatgtcttgactctgctgctgcccgtcatgggcgacagtaaatccagcatggaagtggcgggtgtaaccgccctggcctgtggtatgatcgctgtcggatcatgtaatggtgatgtgacatcaaccatactgcaaaccattatggaaaaaagcgagaccgaactgaaggacacttatgccagatggctcccgctgggcctcggactgaaccatctggggaaaggcgaggccatagaagcaattctggccgctctggaggttgtaagcgaacctttcagatcattcgctaacactctggtcgatgtatgtgcctacgcgggaagtggaaacgtgctgaaagtacagcaacttctccacatctgctccgaacacttcgatagtaaagaaaaggaggaggataaggataagaaggagaagaaggataaagataagaaagaggccccagccgatatgggcgcacatcagggcgttgccgtgctgggtattgccctgatagccatgggagaggagattggtgcagagatggccctcagaactttcgggcacttgctgagatacggtgagcctacacttagaagggccgtacccctcgctctagcactcatttcggtgtctaatccgcgtctcaatattctggacaccctcagcaaattttcccatgatgccgatcctgaggtgagttacaactcaatatttgctatggggatggtgggctctgggaccaacaatgcacgcctggcagccatgctgaggcagctggcacaataccacgctaaagacccaaataacctgtttatggtaaggttagctcaaggactgacccacttggggaaagggacccttaccctctgcccataccattccgaccgccagctaatgtcacaggtggccgtggcgggtttactgacagtgcttgtcagtttcctcgacgtgcgtaatatcatactcggtaagtctcattacgtgctctacgggctggtggctgccatgcagcccagaatgttggttacctttgacgaggagttgcgccctttgcctgtgtccgtacgggtgggccaggccgtggacgtagtgggccaggctggtaaacccaaaaccattactggctttcagacacacactacgccggttcttttagcccacggtgaaagagccgagctggccaccgaagagttcctgcccgtgacacccattctggaggggttcgtgatcctccgcaagaatccaaactatgatctgtag

SEQ ID NO: 236467 - DNA, 552 bp, Artificial Sequence
  Description of Artificial Sequence: Synthetic coding sequence
atggatgcaagcccatcccccttcagcctgcctaaaaaactcaatgaactttctgcgaggaggggttctgatgaactgctgagctccggaatcatcaacggcccattcacgatgaactcatctaccccttccacggccaacggtaatgactctaaaaagtttaagagagatagaccaccctgcagcccttcgcgtgtgctccatttgagaaaaataccctgcgatgttacagaggctgagatcatctctctgggcctgccctttggaaaggtgactaaccttctaatgctgaagggcaaaagtcaagcattcctggaaatggcttccgaagaggccgctgtcacgatggtgaactattacaccccaatcacacctcacttacgtagccagcctgtttacatccagtactctaaccaccgcgagctgaagaccgacaacctgcctaaccaggcaagggcgcaggccgcactacaggctgtttcagccgtccagtcaggcagtcttgccctgtccggtggtccttcaaacgagggaaccgtcctccccggatag

SEQ ID NO: 236468 - DNA, 474 bp, Artificial Sequence
  Description of Artificial Sequence: Synthetic coding sequence
atggtaactagtcttgcctacacgcatcatggaaggcaatacttagcccaggagggcgtgatcgaccagattagcaacatcattgtgggagcagactcagatccgttcagcagtttctaccttccagggttcgttaagttcttcggaaatctggctgtcatggacagcccacagcagatctgcgaaagatatcccatttttgtcgaaaaggtctttgaaatgatcgagtcacaggaccccactatgattggtgtagccgttgatacagttggtatcctcggctctaatgtagagggtaaacaggttcttcagaagaccggatggtatgatctggccctgttcagagatatcttgatctttgatcggggaagtatctgtaagtttatctgctggtgggtgaactatatcgtagagacaatcctgtgggtcgctgtcctgctcactatgacattatatagctgcctgaagatatag

SEQ ID NO: 236469 - DNA, 1386 bp, Artificial Sequence
  Description of Artificial Sequence: Synthetic coding sequence
atggcagcccaggctttggccctcttgagggaggttgccagattggaggcgccattggaggagctgagagcgctgcatagtgtgctacaagccgtcccacttaacgagctgcgccaacaggctgccgagctgcgtctgggcccactttttagccttcttaacgagaaccacagagaaaaaacgacgctatgcgtgtctatcctggaaaggctactgcaagcaatggagccagtgcatgtggcacggaatctgagagttgacttgcagcggggattgattcatcctgatgacagcgttaagattcttaccctatcgcagataggccgaatcgtggagaattccgacgccgtgacagaaatccttaataacgctgagttattgaaacagattgtctattgtatcggtggggagaatctgtctgtggctaaagctctcattatagagatctcctcagtgagcccagaatcccttaattactgtaccacttcaggtctggtaactcaactgctacgggagctcacgggggaggatgttctcgtgcgggcaacctgcatagaaatggtgacgtcacttgcttatacgcatcacggacgacagtacctcgcccaggagggggtcattgatcagattagcaatatcatcgtaggcgctgacagcgaccctttctcgtccttttacttgcccggatttgtgaagtttttcggcaatcttgccgtgatggactcccctcagcagatctgcgagcgctatcccatttttgtggagaaagtgtttgagatgattgagagccaagatcctaccatgatcggagtggctgtcgataccgtggggattctgggctccaatgtggagggcaagcaggtcctacagaagactggtacccgctttgaacgtctcttgatgagaatcggacatcagagcaaaaatgcaccagtcgagctgaaaatacggtgtctggatgccatttctagcctcctgtatctgccgcctgagcagcagactgatgatctcctgaggatgactgagagctggttcagcagtttgtcacgagatccattggagctgttccggggaatctcaagccaaccgtttcccgaactgcactgtgcggctcttaaggtgtttaccgctatcgcaaatcaaccatgggctcagaagctgatgttcaacagcccaggcttcgtcgagtacgtagttgaccgcagtgtggagcacgacaaggcgtcaaaggatgcaaaatatgagttagttaaagccctggcgaattctaaaaccatcgcagaaatctttggtaatcctaattatttgcggctgaggacttacctgagcgaaggcccatactatgtcaaacccgtctctacaacagctgtggagggagccgagtag

SEQ ID NO: 236470 - DNA, 294 bp, Artificial Sequence
  Description of Artificial Sequence: Synthetic coding sequence
atgcgtataggccaccaatccaaaaatgccccagtcgagcttaaaatcagatgtttggacgccatttccagtctgctatatctccccccagagcaacaaacagacgacttgctgagaatgacggaaagttggtttagcagcctctcacgggacccgttggagctctttcgcggaatcagctcacagcctttccccgagttgcactgtgctgccctgaaagtctttaccggacggaaacacttacacctggaagagctggtgggagggaatcaggtaaagaacacagtggagtag

SEQ ID NO: 236471 - DNA, 510 bp, Artificial Sequence
  Description of Artificial Sequence: Synthetic coding sequence
atgatttgcctggtgctgacaatctttgccaatctctttcctgcagcttgcacgggtgctcacgagcgtacctttctggctgttaagccagatggggtgcagaggcgcctggtgggtgagatcgtcagacggtttgagcggaaaggatttaaactagtggccttgaagttggtacaggcttccgaagagctgcttcgggagcactacgccgaactgagagagcgcccattctacgggaggctggtaaaatacatggcaagtggaccagtagttgccatggtgtggcaagggctcgatgttgtgcgcacttcacgggctttaataggtgccaccaatcctgcagatgctcctccgggtacgataaggggcgatttctgcatcgaggtggggaagaaccttattcatgggtccgactctgttgagagcgcccgtcgagagatagcattatggtttcgagctgacgaactcctatgttgggaggactccgcaggccactggctgtacgagtag

SEQ ID NO: 236472 - DNA, 744 bp, Artificial Sequence
  Description of Artificial Sequence: Synthetic coding sequence
atgtatggcatgtttaaaaaagtgaacgccagagagcgcatcgttgggtggtaccacacgggacccaagttgcacaagaatgacatcgctataaatgaactgatgaagcgctattgccctaacagcgtattggtcattatcgacgtgaagcctaaagaccttggcttgccaacagaggcttacatctccgtggaggaagtgcacgacgatggtaccccaacttctaagacctttgagcatgtgaccagcgagattggcgctgaggaggccgaggaggtgggagtagagcacttgttgagagatattaaggatacaaccgtcggcacactgtctcaacgcatcacaaatcaggtccacggcttaaagggactgaacagtaaattactagatatccgttcctacctcgaaaaagtggcaactgggaagttacccatcaatcatcaaattatttatcagctgcaggatgttttcaacctcctgccagatgtatccctacaggaattcgttaaggcattttacctgaaaaccaatgatcagatggtagtggtgtatctggctagtctcatccgatcagtagtagccctccacaacctgattaacaacaagatcgcgaacagagacgccgaaaagaaagaaggacaggaaaaagaggagtccaaaaaagaccgaaaagaagacaaagagaaagacaaggacaaagagaaaagcgatgtcaagaaagaggagaagaaggagaaaaagtag

SEQ ID NO: 236473 - DNA, 624 bp, Artificial Sequence
  Description of Artificial Sequence: Synthetic coding sequence
atgtcagatgaagaagccagacaaagcggagggagtagccaggccggtgtggtgaccgtgtctgacgtacaggaactgatgaggagaaaggaggaaatcgaagcccagatcaaagctaattacgacgtcctcgaatctcagaagggaattggaatgaatgagcccctagtcgactgcgagggttaccctagatctgacgtagatctctatcaggtgaggactgctcgtcataacattatttgtctgcaaaacgaccacaaggccgtcatgaagcaggttgaggaagcgcttcaccagctccacgccagagacaaggagaagcaggcccgtgacatggccgaagcacacaaggaggccatgtccagaaagttgggtcagagtgagagccagggtcctccccgagcttttgcaaaggtgaactcgatctctcctggtagccccgctagtatcgcagggcttcaggtggacgacgagatcgtggaatttggcagtgttaacacacaaaatttccaaagccttcacaacatcggctctgtagtgcagcattccgagggggcacttgccccaacaatcctgctttcagtctcaatgaacttaacaacccccggaacaagtagtcgatag

SEQ ID NO: 236474 - DNA, 672 bp, Artificial Sequence
  Description of Artificial Sequence: Synthetic coding sequence
atgtcagatgaggaggccagacaatcaggaggctcatcgcaggcaggggtggttaccgtgtccgatgtgcaggagctgatgcggaggaaggaggagattgaggctcagataaaagccaattacgacgttctcgaaagccagaaagggattggaatgaatgaacccttagtggattgtgagggctatcctaggtcagacgtggacttgtatcaagtgcgaactgcccgacataacatcatctgcctacagaacgaccacaaagcggtgatgaagcaggtggaggaagcactgcatcaactccatgcaagagataaagaaaagcaggccagagacatggctgaggcccataaagaggccatgtccaggaaactcggccagtcagagagtcaggggcctccccgagctttcgcgaaggtgaactctattagtccgggaagtcctgcctccatagcaggtctccaagtggacgatgaaatcgtcgagttcggctccgtcaacacacaaaatttccagtccctccataatattggatcagtcgtgcaacattccgagggtaaacccttgaatgtcaccgtgatccgcaggggagaaaagcatcagctccgcctggtgcccacaagatgggctgggaaagggttactaggttgtaatataatcccactgcaacggtag

SEQ ID NO: 236475 - DNA, 411 bp, Artificial Sequence
  Description of Artificial Sequence: Synthetic coding sequence
atgctgctgaaactgaaggagaaagcttccctgacgctcgctgtcggtactcttccgttcccgagtcagttcaacttcgtgcccccagggagaatgtgtcgtgtagccggttggggacggaccggagtgcttaagcctggatcagacacgctgcaggaagtaaaactgcggctgatggatccacaggcatgtagtcatttcagggacttcgaccataacctgcagctctgcgtagggaacccgcgaaagaccaagagtgcatttaaaggcgactccggtggccctctcctttgtgcaggcgttgcccaggggatcgtgtcatacggacgtagcgatgcaaagcctccagccgtctttacacgcatatcccactacagaccatggattaatcagattctgcaggctaactag

SEQ ID NO: 236476 - DNA, 753 bp, Artificial Sequence
  Description of Artificial Sequence: Synthetic coding sequence
atggccatgcttcgtgttcaacccgaggcacaagctaaggtggacgtcttccgcgaggatctgtgtaccaaaactgaaaacctgctgggatcctatttcccaaaaaagatttctgaattggacgccttcctgaaggagccagcccttaacgaagccaatcttagcaatcttaaggcccctctggacatacctgtccccgaccctgtgaaggaaaaggagaaagaggaaaggaagaaacaacaggaaaaagaggataaagatgagaaaaagaagggtgaggatgaggacaaaggcccaccctgtggtcctgttaattgcaacgaaaaaattgtggtcctcctccagaggcttaagccagaaattaaggacgttatcgaacagcttaacctggtgacgacctggctgcagctccagattcccaggatcgaggacggcaataactttggagtcgctgtgcaagaaaaagtgttcgagttgatgactagcctccatacaaagctggaaggatttcatacccaaatttcgaagtatttttcagaacggggagacgcggttacaaaagccgctaagcaaccacatgtgggggactatagacagctcgtgcacgaactcgatgaagccgaatatagggacatcaggctcatggtgatggagatccgtaacgcttatgtcaggagacagggccaggggagaggaggtcagcggcagctaagccaggctacccatagcctgacccttcaagccaggggctag

SEQ ID NO: 236477 - DNA, 627 bp, Artificial Sequence
  Description of Artificial Sequence: Synthetic coding sequence
atgggtgaagtcgagatatctgctcttgcatatgttaagatgtgcctgcacgccgcaagatatccacacgctgcggtgaatggactattcttggctcccgcaccacgttctggggaatgcctatgccttacggactgcgtgcctctcttccattcccatctcgcccttagcgtgatgctcgaggttgcactcaaccaggtcgacgtgtggggagcccaggcgggactggtggtagcaggttactaccacgctaacgccgcagtgaacgaccagagccccggacctttagccctcaagattgccggacgcattgccgagtttttcccggatgctgtcctgatcatgctcgacaaccagaaactggtgcctcagcctcgggttccccctgtgattgtgctcgaaaaccagggtctaagatgggtccccaaggataaaaacttggtcatgtggagagactgggaggagagtcgccaaatggtcggcgcacttctggaggatagagctcatcagcatctggtggactttgattgccacctcgacgacatccgacaggactggacgaatcaaagacttaatacccagataacccagtgggtcggtcccactaacggcaatggaaacgcctag

SEQ ID NO: 236478 - DNA, 804 bp, Artificial Sequence
  Description of Artificial Sequence: Synthetic coding sequence
atggcatctctgttaaaagtggaccaggaggtgaaactaaaggtggactcttttagggaaaggattactagcgaggctgaagatttggtagcaaacttcttccctaaaaagctcctggagctggactcttttcttaaagagccgattctcaacatccacgacttaacgcagatccactctgatatgaacttgcctgttcctgatcccatcctgctgaccaatagccacgatggcctggatggtcccacttacaagaagcgtcgcttagacgagtgcgaggaggcttttcagggaacaaaagtgttcgtgatgccgaatgggatgctcaaatctaatcaacagctggttgacattatcgagaaggtcaaacctgagatcagacttctgatcgaaaagtgcaatacacctagcggaaaagggcctcatatatgtttcgacctgcaggtgaaaatgtgggttcagcttctgattccgcgaatcgaggacggcaacaattttggggtttcaatccaggaagagacagttgcggagctgcgcactgtggagtctgaggctgcatcgtatctcgaccagatctctagatactatataactcgcgcaaagctggtctccaagatcgccaagtatccacatgtcgaggactatcgacgaaccgttacagaaattgacgaaaaggagtacatctcgctgaggctgatcatctccgagctccgaaatcagtacgtcaccttgcacgatatgattctgaaaaatatcgagaagatcaagagacccaggtcctctaatgctgaaacattgtactag

SEQ ID NO: 236479 - DNA, 765 bp, Artificial Sequence
  Description of Artificial Sequence: Synthetic coding sequence
atggctagtctgcttaaagtagaccaggaggtaaagttaaaagtggatagcttccgcgaacgtattacttccgaagcagaggatctggtggccaatttctttccaaaaaaactcctggaacttgattcctttctgaaagagcctatcctgaacatacatgatttaacccagatccatagtgacatgaatttaccagtgcccgatcctattttgttgacgaattcgcacgatggcctggacggcccaacttacaagaaaagacggctggacgagtgcgaagaggctttccaggggaccaaggtttttgtcatgcctaatgggatgcttaagagcaatcagcagttggttgatatcatcgaaaaagtcaagccagagatccgtcttctcattgagaagtgcaatacagtcaagatgtgggtgcagctgctcatcccacggatcgaggacggcaacaacttcggagtgtccatacaggaagagaccgtagcggagctgcgcaccgttgaatccgaagccgcttcttaccttgaccagatctcgaggtactatattacacgcgcaaagttggtgtctaagattgcgaaataccctcacgtggaggactatcgccgaaccgtgacagaaatcgacgagaaagagtacatcagcttgcgactgattatcagcgagctgagaaatcaatatgtcaccctgcatgacatgatccttaagaatattgagaagatcaaaaggccacggtcttccaatgccgaaactctgtactag

SEQ ID NO: 236480 - DNA, 48 bp, Artificial Sequence
  Description of Artificial Sequence: Synthetic coding sequence
atggcatccctgctcaaggtggaccaggaagtgaaattaaagctgtag

SEQ ID NO: 236481 - DNA, 393 bp, Artificial Sequence
  Description of Artificial Sequence: Synthetic coding sequence
atggcatccctgctgaaggtggaccaggaggtaaagctgaaagtagattcttttagggagcgtatcacctcggaggccgaagatctcgtggcgaacttctttccaaaaaaactgctggagctggactcctttctcaaagaaccaattcttaatatccatgacttgacacagatccactccgacatgaacctccctgttcctgatccaatactacttacgaatagccatgacggactggacggacccacatataagaaaagacggctggatgaatgcgaggaggcatttcagggacaaaatgtgggaactgcacctgattcccaggacaggaggtggaagcagctgtggggcgtgcactcagggggaaactcgtgtagggctaaaaattgttag

SEQ ID NO: 236482 - DNA, 582 bp, Artificial Sequence
  Description of Artificial Sequence: Synthetic coding sequence
atgaacttacctgtgcctgatccaatactcctaactaattcccatgatgggctcgatggtccaacatataagaaaaggagattggacgaatgcgaagaagcttttcaggggacaaaagtcttcgtgatgccaaatggaatgttgaaaagtaaccaacagctcgtggacattattgaaaaagtgaaaccagaaatccgtttactaatcgagaagtgtaacaccgtgaagatgtgggtgcagctcctgattccccgtatcgaagacgggaacaacttcggcgtgagtattcaggaggaaacagtggccgaattgcgcaccgtggagtctgaagctgcaagttacttggaccagatatccaggtactacatcacaagagctaagctagtctctaaaattgcgaagtatccccatgttgaggactatagaagaaccgttaccgagatcgatgaaaaggagtatatatctctgcggttgatcatttcggaacttaggaatcagtacgtcacactgcatgatatgatactgaaaaatatcgagaagataaagaggcctagatctagcaacgccgaaacactgtattag

SEQ ID NO: 236483 - DNA, 5531 bp, Artificial Sequence
  Description of Artificial Sequence: Synthetic coding sequence
atggagcccgctgaaagggctggggtgggcgaacctccagaacctgggggacggccagagcccggtccacgcggtttcgtgccccagaaggagattgtttacaacaagcttttgccttatgcagaaaggctggatgctgagtccgatctacagctcgcgcagatcaaatgtaacttggggagggctgttcagctgcaggagctgtggcctggcggattattctggactcggaagctgagcacctacatccgactgtatggaaggaagttctctaaagaggaccatgtgctgttcatcaagctgctctatgaactcgtgtcaattccaaagcttgaaatctcaatgatgcagggctttgcccgtctactgataaacctgttaaaaaagaaggagttactttccagagccgacctggagctaccctggcgtcctctgtacgacatggtggagcgcattttatactctaaaacagagcatctaggactcaattggttccctaattctgtagaaaacattctgaaaactcttgtgaaatcatgccgtccctattttcctgccgatgccacagctgaaatgctggaagagtggagacccctgatgtgcccatttgacgttactatgcagaaggctattacgtacttcgagatctttttgcccacctcactgccgcctgagttacaccataagggcttcaaactctggttcgatgaacttattggactgtgggtatctgttcagaaccttccacagtgggaggggcagctggttaatctgttcgcccgactggctacagataatatcggctatattgactgggatccatatgtgccaaagattttcacccgaattctgcgaagcctgaatctgcctgtaggcagctctcaggttctcgtgccgcgattcctgactaatgcctacgacatagggcatgccgtcatatggattacagccatgatggggggaccatccaagttagtgcagaagcacctcgccggacttttcaattctattactagtttttaccatccctcaaacaatgggagatggctgaataagctcatgaaattgctgcagaggctgccaaatagtgtcgtaagaaggttgcaccgcgagaggtacaagaagccctcatggctgacccctgtgcccgattctcataagctcactgaccaagacgttacagacttcgtacagtgtatcattcagcccgtgctactagccatgttctcgaaaaccggctccctggaggcagcacaggctctccagaacctggcattgatgcggcctgaactggtgattcctccagtgctcgagcggacctatcccgcattagaaactctgaccgagccacaccaactgaccgccaccctgagctgcgtcataggcgttgctaggtccctcgtgagtggcggacgctggtttcctgaagggccaactcacatgctcccattactcatgcgtgcgctgccaggtgtggaccctaatgatttctctaagtgcatgatcaccttccagttcatcgctacgtttagtacattggtacccctggttgattgttcctccgtgttacaggagcggaatgacctcacagaggttgagcgcgagttatgctccgccaccgccgagttcgaagactttgtcctccaattcatggatcgctgcttcgggcttatcgagagttccaccctcgaacaaacacgtgaagagactgaaacggaaaaaatgacccacctcgaatccctggtggagctcggattatctagcactttctcaactatcttgacccagtgctccaaggagatatttatggttgccctccagaaggtgtttaacttctccacctctcacatttttgaaacaagagtcgcagggcgaatggtagcagatatgtgtagagcggctgtcaaatgctgtccggaggaatcactgaaactgttcgtgccccactgttgcagtgtaattacccagttaaccatgaacgatgatgtactgaatgatgaggaactcgacaaagaactgctatggaacctacagttgctcagtgaaataacaagagttgacggcagaaagctgctgctgtaccgggagcagctcgtgaaaatcctccagaggacactgcacctcacctgtaaacaagggtatactttgagttgcaatctgttgcatcacctgctaaggtctactaccctcatttacccgactgaatattgctccgtccctgggggtttcgacaagccaccaagtgagtacttccccatcaaggactggggcaaaccgggtgacctgtggaatctggggatccagtggcacgtaccatcatctgaagaagtcagcttcgctttctatctgctggactcattccttcagcctgagctggtcaagctccagcattgcggcgatgggaagctcgaaatgagccgggatgatatcttgcaatccttaaccatagtgcacaactgtcttatagggagtggcaatcttctccccccattaaagggggagcctgtcaccaacttggtgcctagcatggtcagcctggaggagacaaaactgtacacgggtctggaatacgacctcagccgcgagaatcatcgagaggtgatcgctaccgtgattcgcaagctgctgaaccatatcctggataattcagaggacgatacgaaaagtctgttcctcataataaaaattatcggagacctcctccagtttcaaggctcccacaaacacgagtttgatagccgctggaaatccttcaaccttgttaaaaagtccatggagaaccgtttgcacggcaaaaaacagcacataagagcgcttctgatagaccgggttatgctacagcacgagcttagaaccttgaccgtcgaggggtgtgaatacaaaaagattcatcaggacatgatcagggatctgctacgcttatccaccagcagctactcacaggtcaggaacaaagcacagcaaacgttttttgccgctttgggagcctataatttctgctgtagggacataattccgctcgtacttgaatttctccgacccgaccgccaaggggtgacacagcagcagtttaaaggagcgttatactgtctcttgggcaatcactccggagtgtgtctggcaaatctccacgactgggactgtatcgtacagacatggcccgcaatcgtcagcagcggcttatctcaagccatgagtctggaaaaaccttcgatcgtgcggctctttgacgacctggcagagaagattcacaggcagtacgagactatcgggcttgactttacaattccgaagagttgcgtagaaatcgctgaactacttcagcagtcaaagaatccaagtattaaccagatactgctctctcccgagaaaattaaagagggcataaagaggcagcaagaaaaaaatgcggatgctctgcggaactacgagaatcttgtagacactctactggacggagttgaacagagaaacctcccgtggaagtttgaacatatcggcatagggttgctctcattgttgttaagggacgatcgtgttttacccctgagagccattagattctttgtcgagaatctgaaccatgacgcaatcgtcgtgagaaagatggccatttctgccgtggctggaatcctgaagcagctcaaacggacgcacaagaagctcaccatcaatccgtgtgaaataagtggctgtcccaaaccaacgcaaataatcgccggagatagaccagataaccattggctacactatgactctaagacaatcccacgtaccaaaaaagagtgggaaagtagttgtttcgtcgagaaaacccattgggggtactatacatggcctaagaacatggtcgtgtacgcaggcgttgaggagcaacctaaacttgggagatctcgagaggatatgactgaggctgagcagatcatcttcgaccacttttcggatcccaagttcgttgaacagctgataacattcttgagtctggaggacagaaagggaaaagacaagtttaaccctcggaggttctgcttatttaaaggcatattcagaaactttgacgacgcgtttctccctgttctgaaaccacatctcgagcatctggttgccgatagtcatgaaagcacacagcggtgtgtggcagagattattgctggattaattagaggatcaaaacattggacattcgagaaagttgagaagctgtgggagctgttgtgccctcttctgcgtacagcattgtcgaatattactgtggagacctacaacgactggggcgcatgcattgccacctcttgcgagtccagggaccccaggaaactccactggctgttcgagttgcttctggagagccccctgtctggtgaaggcggatccttcgttgacgcatgccgcctctacgtgctgcaaggcggtttggcccagcaggaatggagagtccccgagttgctccacaggctgttaaagtacctcgagcccaagttgacccaagtgtacaagaacgttagggaacggataggcagcgtgctgacctacatcttcatgattgatgtttctctgccgaatacgacccctactataagtccgcatgtgcccgagttcaccgctaggattttagaaaaactgaaacctctgatggatgtcgacgaggagattcagaaccacgtaatggaagaaaacgggatcggggaggaggacgaacgcactcagggaataaagttgctgaagacaattctgaagtggctgatggcaagtgccggaagatccttcagcacagccgttactgaacagctacagctgctgccactcttctttaagatagcccctgtcgagaacgacaactcttacgatgagttaaaacgagacgctaagctatgtcttagccttatgagccaaggcctcctttacccccaccaagtgccgctcgtgctccaggttctcaagcagactgctaggtcatctagttggcatgccagatacacagtgcttacttatctacagaccatggtgttctacaacttattcattttcctgaacaacgaagatgcagtgaaagacatccgttggctggttatttctctcttggaggacgaacagctcgaagtccgcgagatggcggctaccactctttctggcctgttgcagtgtaatttcctgaccatggatagccctatgcaaattcatttcgaacagctctgtaagacgaaattgccaaaaaagagaaaacgggatcctggttccgtgggcgataccatcccatcagcggaacttgtaaaaaggcatgcgggtgtgctgggactcggcgcatgtgtgctctcttccccttacgatgtacctacttggatgcctcagctcctgatgaatttgtctgcccatttgaatgatccacaacctattgaaatgactgtgaaaaagaccttatcgaatttcaggcgcacccaccacgataactggcaggaacacaagcaacagtttacagacgaccagttgctcgtactgacggatctcctcgtcagcccttgttactacgccta

SEQ ID NO: 236484 - DNA, 2964 bp, Artificial Sequence
  Description of Artificial Sequence: Synthetic coding sequence
atgggagagaacctcgcaaaaaagattatgttttttctgctgacgattaaactgatcctaaatcacatccttgacaacagcgaggatgatacaaaatctctgttcctgatcataaaaataataggggacctccttcagttccaaggatcccataagcatgagttcgactctcggtggaaatcgtttaatctcgtgaagaaatccatggagaacaggctgcacggtaagaaacagcatatcagagccctactgatagaccgcgttatgctgcagcacgagctccgcacattgaccgtcgaaggctgtgagtataaaaagattcatcaagatatgattcgcgatctgttgcggctctctacttccagttattctcaggttagaaacaaggcacaacagacattctttgccgctcttggggcatataacttctgttgtagagacattatcccactcgtgctggagttcttaaggccggaccggcagggagtgacgcaacagcagttcaagggagccctgtactgcctccttggtaaccattccggtgtgtgcctagccaatctgcacgactgggactgcattgtccagacctggcccgctattgtatcgagcggcctgtcccaggccatgtctctcgaaaagccgtctatcgtccgccttttcgacgacttggccgaaaagattcaccgccagtatgaaacaattgggctagatttcacaatccctaagtcatgtgtagagatagctgaactgctgcaacagtctaaaaacccatcaattaaccagatcttgctgtctcccgaaaagatcaaagagggaatcaagaggcaacaggaaaagaacgccgacgccctacggaattacgagaatctggtggacactttgctcgatggtgtcgaacaacgcaacttgccctggaaattcgagcatatcggcatcggcttactcagtctactgctccgggacgacagagtgctgccactgcgcgcaatccggttcttcgttgaaaacctgaaccacgatgccattgtcgtgcggaaaatggccatatcagcagtggctggaatcctgaaacagctgaaaaggacgcacaaaaaattgacgatcaatccctgcgaaatttctggatgccctaaacccactcagataattgcaggcgatcggccagataatcactggctgcattatgatagtaaaacgattccacggacaaaaaaagagtgggaatcctcctgcttcgtggaaaagacacattgggggtactacacatggcccaagaacatggtcgtgtatgcgggagttgaagagcagccaaagctaggtcgatccagagaagatatgacagaggccgagcagataatcttcgatcatttctcggatcctaaattcgttgagcagctcattacattcctctccttggaagaccgaaaagggaaggacaaatttaatccgagacgcttctgccttttcaaagggatcttccgcaactttgacgatgcgttcctgcctgttttgaagccacatttggaacatctggtggccgatagtcatgagagcactcagagatgcgtggctgagatcattgccggattgatacgcggatccaaacactggacatttgaaaaagttgagaagctgtgggagttactctgtccactcctcagaacagccctgtctaatatcacagtcgagacatacaacgactggggcgcttgtattgccacgtcttgcgagagtagggatcctcgcaaactgcattggttgtttgagctactcctggagtcgccattaagcggcgagggagggagtttcgtggatgcctgtcggctctatgtgctgcaaggtggcctggcgcagcaagagtggcgagtgccggaactgctgcaccgtctgctgaagtatctggagcccaagttgacacaggtttataaaaatgtacgtgaacggatcggctcagtcctgacatacatctttatgatcgacgtgagtcttcctaacaccacacctactattagccctcacgtgcccgaatttacagcccgaatcttagagaaactaaagccgctgatggatgtggacgaggagatccagaatcacgtgatggaagagaatggtataggagaggaggacgagcgcactcagggcattaagctccttaagactatcctaaaatggttaatggctagcgctggccgatcctttagcaccgccgttacagagcaattacagcttctgcctttattctttaagatagcccctgtggagaatgataactcctacgatgaactgaaaagggacgccaagctgtgtctgagcctaatgtcccaaggtctcctgtatccacaccaggtgcctttggtgttgcaggtgctgaagcagacagcaaggtcctcatcatggcacgcgaggtacactgttttaacgtacctgcagactatggtgttctacaacttgtttatcttcttaaataatgaggacgctgtgaaagatatcagatggctagtgatttcactgcttgaagatgagcagttggaagtgcgcgaaatggccgctacaacactgtcagggctgctgcaatgtaactttttaacaatggatagccctatgcagatacattttgaacagttgtgcaagacgaagctccccaagaaacgcaagagggatccaggtagtgtaggcgatacaatcccttcggcagagctggtgaagcgccacgccggagtgcttggtctgggcgcatgcgttttgagcagcccatacgacgtccctacttggatgccccaactgttaatgaacttatcagcacacctcaacgaccctcagcccatagagatgactgtgaaaaaaaccttgtctaatttcagaaggacacaccatgacaactggcaagaacacaaacaacagttcaccgatgatcagttgcttgttttgaccgacttacttgtgtccccttgttattatgcttag

SEQ ID NO: 236485 - DNA, 867 bp, Artificial Sequence
  Description of Artificial Sequence: Synthetic coding sequence
atggctgccacgttttttggggaggtcgtcaaagccccttgcagggccggtacagaagacgaggaggaggaagaagaaggccgacgtgaaacgcccgaggaccgtgaagtgaggttgcagctcgccagaaagcgtgaagtacgcctgctgcggagacagacgaagacatcactggaagtaagcttgctcgagaaatatccatgctccaagttcataatagcaattgggaataatgccgtggcttttttatccagttttgtcatgaactctggtgtgtgggaggaggtaggatgtgccaaattgtggaatgagtggtgtagaactacagacacgacccacttatctagcactgaagctttctgcgtcttctaccatctgaagtcaaaccctagtgtcttcctgtgccagtgctcttgctacgtcgccgaggatcagcagtaccaatggctcgagaaggtgttcggtagctgcccacgcaaaaacatgcagataacaatcttgacttgccgccacgtgacagattataagacgtctgagtctacaggatccctccctagccccttcctaagggcccttaaaacacaaaactttaaggatagtgcttgctgtccactgcttgagcaaccaaacatcgtacacgaccttcccgcagccgtgttgtcctattgtcaggtctggaagatacctgccattttatacctctgctacaccgacgtcatgaaactggatctcattactgtggaagcattcaagccgatattgtcgacaaggtctctgaagggtctggtgaagaatattccacagtctacagagattttaaaaaagctgatgacgaccaatgaaatccaaagcaatatttacacatag

SEQ ID NO: 236486 - DNA, 804 bp, Artificial Sequence
  Description of Artificial Sequence: Synthetic coding sequence
atggcagcaactttcttcggggaagtggtcaaagccccatgcagggccggaaccgaggacgaagaagaggaggaggagggccgaagagaaacccccgaagaccgggaagttcgactacaactcgccaggaagcgagaggttagactgttgcgtaggcaaaccaaaactagtcttgaagtgagccttctggagaagtacccctgtagcaagttcattatcgccattggtaataatgctgttgcctttcttagctcatttgtgatgaatagtggagtatgggaagaggtgggttgcgccaagttgtggaatgaatggtgccggaccacagacactacccatctctccagcacagaggccttctgcgtattttaccacttgaaaagtaaccctagcgtgtttgggtcctgtccccgtaaaaatatgcaaatcaccatcttgacttgccgacacgtgactgactataaaacttctgaatccaccggaagcctacccagcccctttttgcgtgctctgaaaacccaaaactttaaggattctgcttgttgtcccttgcttgagcagccaaacattgtgcatgatctgcccgcagccgtcctgtcttactgtcaggtgtggaagattcccgcaatcctgtacttgtgctacacagacgttatgaagttagatttaattacagtcgaagcctttaaacccatcttgagcactcggtctttgaagggacttgtgaaaaatatccctcagagtacggagatccttaagaagctcatgacaactaacgagatccagtccaatatctatacgtag

SEQ ID NO: 236487 - DNA, 795 bp, Artificial Sequence
  Description of Artificial Sequence: Synthetic coding sequence
atgtttgtaccctgcggtgaaagcgcaccggacctggctgggttcactttattgatgccggcagtatctgttggcaacgttgggcaactggctatggacctcattatctcaacgctcaatatgagcaaaatcggttatttttatacagattgcttagtgcctatggtgggcaataatccttatgcaactaccgaaggaaactctaccgaacttagcattaatgctgaagtctactcgctgcccagccgcaagctcgttgctttgcagctgagatctattttcatcaaatacaagagcaaacccttctgtgaaaagctgttgagttgggtcaaatcttcggggtgtgccagagtcatagtcctctcctcttctcactcctatcagaggaatgatctccagctccgctcgacgccatttagatatttgctgacacctagcatgcagaagtcagtccagaataagatcaagtccctgaattgggaggaaatggagaaatcaagatgcatccctgaaatagacgacagtgagttttgtatccgtatcccagggggaggaatcacaaagactctgtacgatgaatcctgcagtaaggagatccaaatggctgtgctgctcaagtttgtgtccgagggcgacaacattcccgatgcccttggcctggtggaatatctgaatgaatggttgcaaattcttaagccactctccgacgaccccaccgtgagcgcctcccggtggaaaataccttcttcctggcgcctgctgttcggttctggtcttccaccggctctgttttag

SEQ ID NO: 236488 - DNA, 459 bp, Artificial Sequence
  Description of Artificial Sequence: Synthetic coding sequence
atgccggctgtgagcgttggtaacgtgggccagctggccatggacctcatcatttccaccctcaatatgtctaaaatcggctacttctacactgactgcctggttcccatggtgggtaacaacccatacgcaaccacagaagggaatagcaccgagctatcaatcaacgcagaagtgtactcgctgccgtccagaaagctggtggcactgcagcttcggagtatttttattaaatacaaatcaaagccattctgcgagaaactcctgagttgggttaagagttccggatgtgcaagagtgatcgttctgtcctcttcccactcttatcagagaaacgaccttcaactgagaagtacaccctttaggtatctgttgactccttctatgcagaaatcagttcagaataagatcaagagcctgaactgggaggagatggagaagggcgctttcctgaagtag

SEQ ID NO: 236489 - DNA, 792 bp, Artificial Sequence
  Description of Artificial Sequence: Synthetic coding sequence
atgttcagaaaccagtatgataacgacgttaccgtctggtcaccccagggcaggattcaccagatcgaatatgccatggaggccgtgaaacagggcagtgcaactgtcggtttaaagagcaagacacatgccgtgctggtggcgctcaagagagcccagtctgagcttgccgcacaccagaaaaagatcctccacgtcgataatcacattgggatcagcattgctgggctgactgcagacgccaggctgctctgcaatttcatgaggcaggagtgcctcgattctcgtttcgtgttcgataggccgctgccggtcagcaggctggtgtctctcattgggtcaaagactcagattcctacgcagaggtatggacggaggccctacggggtcggcctactgatcgccggatacgacgacatgggaccccatatctttcagacctgtccttccgctaattactttgactgtcgcgctatgagtataggggctagaagccagtctgctaggacctacctggaacgtcatatgagcgaatttatggagtgcaatctgaatgaacttgttaaacacgggctccgggctctgcgggagactctgcctgctgagcaggatctgaccaccaaaaatgtgtcaataggaattgtaggcaaggatttagagtttaccatatatgacgatgacgatgtgagcccctttttggaagggcttgaggaacgaccacagagaaaagcccagcctgctcaacccgctgatgagccagctgaaaaagccgacgaaccaatggagcactag

SEQ ID NO: 236490 - DNA, 792 bp, Artificial Sequence
  Description of Artificial Sequence: Synthetic coding sequence
atgttcagaaatcagtatgacaacgatgtgaccgtatggagtccacagggaagaatccatcagattgagtacgctatggaggccgtcaagcaggggtcagcgacagttggattaaagtcaaagacacatgctgttctagtggctctgaaaagggcccaaagcgagctcgctgcacatcagaagaagatcctgcacgtggataaccacatcggtatttctatcgcaggacttaccgctgacgcacgcttattatgtaattttatgcggcaagaatgtttggattcccgtttcgtttttgatcgtccgctccccgtatccaggcttgtatctttgatcgggtccaagacgcaaatcccaacccaacgctatggtcgcagaccttacggcgtgggcctcctcattgccggatatgatgacatgggccctcatatcttccagacttgtccttcagctaattatttcgactgcagagccatgtccattggggctaggagccagtctgccaggacttatctggaaaggcacatgagtgaattcatggagtgtaatctgaacgagttggttaagcatggactgagagctttgcgggaaactcttcccgcagagcaagatctgactactaagaacgtttccatcggaatagtcggcaaggacctggagttcacgatctatgacgacgacgacgtgtcaccattcctggaagggctggaagagaggcctcagcggaaagctcagccggcacaacctgccgacgagcccgctgaaaaggccgacgagcccatggagcactag

SEQ ID NO: 236491 - DNA, 810 bp, Artificial Sequence
  Description of Artificial Sequence: Synthetic coding sequence
atgcaattgtctaaggtaaaattccgaaaccagtacgacaacgatgttactgtctggtccccgcagggtcggatccaccaaatcgagtacgcaatggaggcagtcaagcagggctctgctaccgtcggtctcaaatctaaaacgcatgccgtgctcgtagctttgaagcgggctcagtcagagctcgccgcacatcagaaaaaaattctccatgtcgataatcacatcggtattagtatcgccggactgaccgcggacgctagactcctctgcaattttatgcgccaggaatgcctcgatagtcggtttgtattcgacaggccgctaccggtcagccggttggtgtccctgatcggctcaaaaacgcagatacctacccagcgatatgggagaagaccatacggtgtgggacttttgatagccggttatgacgatatggggccacacatatttcaaacatgtcccagcgccaactactttgactgtcgggcaatgtccatcggagcgagaagccaatctgcacgcacttatttggagcggcacatgagcgaattcatggaatgtaatttaaacgagctagtgaagcacggccttagggccctcagagaaactctgcccgctgaacaggatctcacaactaagaatgtctccatcggaattgttggtaaagatctggaattcaccatttatgatgacgacgatgtgagtccttttttggaagggctggaggaacgaccccaaaggaaagcacagcccgctcaaccagcagacgagccagcagagaaggcggatgagcccatggagcattag

SEQ ID NO: 236492 - DNA, 495 bp, Artificial Sequence
  Description of Artificial Sequence: Synthetic coding sequence
atgttcaggaaccaatatgataatgatgtcaccgtgtggagcccgcagggacgaatccaccagatcgagtacgcaatggaagcagtgaaacagggcagtgccactgtaggcctcaagtccaaaacacacgcagtgttagtggctctgaaaagggcacagtcagaactagcagcccaccaaaagaagattttgcacgtggataaccatattggtatatctatcgcgggattgactgcggatgccaggctgctgtgcaatttcatgagacaggaatgtctggattctcggtttgtgttcgataggccactcccagtcagccggctggttagcctgattggctctagcatcctgttcatgatatgggctctcaccttctcaaagccagtccacctgcttactattcttactgccgagccttgccctttggagcctgtaccaaatcagctggtgctaacgtggagggacatctgtcttaacctgtggtctgttatctag

SEQ ID NO: 236493 - DNA, 1014 bp, Artificial Sequence
  Description of Artificial Sequence: Synthetic coding sequence
atggatcaaaatgagcactctcactgggggcctcacgctaaaggccagtgtgcctcgcggtcagagctccgaatcatcttggtagggaagactggaactggtaagtcggccgctggtaactcaatactgcggaagcaagcttttgagagcaagttgggatcccagaccttaacaaagacctgttctaagtcacaagggtcttggggtaacagggaaattgtgataatcgatacaccggacatgttctcatggaaggaccactgcgaggcactctataaagaggtccaacggtgctacctgcttagcgcaccagggccacacgtgctgctgttggtcacccagttgggcaggtataccagccaggatcagcaggccgctcagcgcgtcaaggaaatttttggcgaggatgcaatggggcacacaatagtccttttcacccacaaggaggacctgaacggcggatccctcatggattatatgcacgacagtgataataaagccctcagcaaactcgtagccgcatgtggcggtcggatctgcgcctttaataacagggcagaggggtctaaccaggacgatcaggtaaaagaacttatggactgtatagaagaccttttgatggagaagaatggagatcattataccaacggcctctacagtttgatccaacgctccaaatgcggcccagtcggttccgacgaacgggtcaaggaatttaagcagagcctgataaagtacatggagactcagagatcttacacagccctcgcggaagcaaactgtttgaagggggctctcatcaagactcagttgtgtgttctgttttgtatccaactgtttttaagacttatcatcctctggctctgtattctgcatagcatgtgtaacctcttctgttgcttgctcttctccatgtgtaacctgttttgctccctgttgtttattatacctaaaaagcttatgatctttcttcgaaccgtcattagactcgaaaggaaaactccaaggctctag

SEQ ID NO: 236494 - DNA, 300 bp, Artificial Sequence
  Description of Artificial Sequence: Synthetic coding sequence
atgggacctgattaccgggttttggtgcaccgtgctagaaaacttgcccagcagtactacctggtctaccaggaacctattcctacggcccaactcgtgcagcgcgtcgctagcgtcatgcaggagtatacccagtctgggggagtgcgaccatttggcgtgagcctgctgatctgtggctggaatgagggtagaccttacttgtttcagagcgacccaagcggcgcttacttcgcctggaaggcaactgccatgggaaagaattatgtcaacggcaaaaccttcttggagaagcggtag

SEQ ID NO: 236495 - DNA, 465 bp, Artificial Sequence
  Description of Artificial Sequence: Synthetic coding sequence
atgctgtattgcgaagcggagtcccctcccaccgttgagaaggtaaaacccgcacgggagaactccgagacggatctggaaattgagggtgagcacgggcacctgggtgcagtccgagcagcaagtccccagaagcttgaaaaaagtggcttccaagagctctcttcccacagcttccctgagagcgcccttcgcatggcttgtgggggaaacgtggctgaaagacccgcacgtttttgtttggaatcctcaagtggactggcgggtgaaagctcttgcagcttcccaagactgagccccgcttccggtgcagtcccctcgaggcgacttgtgaagagtggtataaatacgcagacaaggttcagtaatctgttaaacgtttccacctggggtatcctctgtaatctttgtaatagtcccaggagtttcccgaagaagggctccaccgagcgggagcacctctag

SEQ ID NO: 236496 - DNA, 747 bp, Artificial Sequence
  Description of Artificial Sequence: Synthetic coding sequence
atgagctctatcggtacaggctatgatctgtcagcctctaccttcagccctgatgggagagtgttccaggtcgaatatgccatgaaagccgtggagaactcatccacggccatcgggatacgctgcaaggatggggttgtctttggagtggagaagttggtgctgtcgaaactgtatgaagaggggagcaacaagcggctttttaacgtagatcggcatgttggaatggcggtcgccggtctgcttgccgacgccaggagtctggctgatattgctcgcgaggaggccagcaactttagaagcaacttcggctataacatcccactgaagcacctggcagacagggttgcaatgtatgtgcacgcttatacgctgtacagtgcagtgcgtccctttggctgtagcgtaaacgacggagcccaattatatatgatcgatccttccggcgtctcctatggatactggggttgcgctattgggaaagccaggcaagcagccaagaccgagatcgagaagctccagatgaaagagatgacctgcagagatatcgtaaaggaagtagccaagatcatatatatcgtgcacgacgaggtcaaggataaggcgttcgagctcgaactgtcctgggtcggggaactgaccaacggcaggcacgaaatcgtccccaaagacattcgcgaggaggccgagaaatacgctaaggagagcctgaaggaggaagatgagtctgatgacgataacatgtag

SEQ ID NO: 236497 - DNA, 786 bp, Artificial Sequence
  Description of Artificial Sequence: Synthetic coding sequence
atgtcacgaagatacgattctcgcacaacaatcttcagtccggaaggtaggctctatcaggtggagtatgccatggaagcgatcggccacgctgggacttgcctgggaatcctggccaatgacggagttctgctggctgccgagcgccgaaacatccataaacttctggacgaagtcttttttagcgagaagatttacaaactcaacgaggatatggcatgctccgtagctggaataacttcagatgccaatgtgctcaccaacgaactgcgactgatcgcgcagcgctacctgctccagtaccaggagcctataccttgtgaacagctggttacagctttgtgtgatatcaaacaagcgtacacacagtttggcggaaaaaggccctttggcgtttcccttctttatataggttgggacaaacactacggcttccaactgtatcagagcgacccttccggaaattatgggggatggaaagctacatgcattggcaataacagcgcagctgccgtcagtatgctgaagcaagattataaggagggagagatgaccctaaagagtgctctggccctcgctatcaaggtactcaataagacaatggacgtcagcaaactgtctgcagagaaggtcgagattgccactctcacccgagagaacggtaagaccgtgattcgcgtgctaaaacaaaaggaagtggaacagcttatcaaaaagcacgaagaagaggaggccaaggcagagcgagagaaaaaggagaaagaacagaaggaaaaagacaagtag

SEQ ID NO: 236498 - DNA, 573 bp, Artificial Sequence
  Description of Artificial Sequence: Synthetic coding sequence
atggcatgctccgtggccggaataacttctgatgccaacgtgctcacaaatgagctgaggctcatcgctcagcgctatttactgcagtaccaggaaccgatcccatgcgagcagctggtgacagcactatgtgacattaagcaggcctacacacagttcggcggaaaacgtccatttggggtaagtctcctctacattgggtgggacaagcactacgggtttcaactataccagtccgatccttccgggaactatgggggatggaaggccacttgcatcggcaacaattccgcagcggctgtgagtatgttgaagcaagattataaagagggagagatgaccctgaagtctgcactcgccctggccatcaaggtactaaacaagaccatggacgtgtccaagctttcagccgagaaagtggagatcgccacactgacaagggagaatgggaagaccgtgattcgggtgctgaagcagaaggaggtggaacaattgatcaagaagcacgaggaagaggaggctaaggccgaaagagaaaagaaagagaaagaacaaaaggaaaaggacaagtag

SEQ ID NO: 236499 - DNA, 786 bp, Artificial Sequence
  Description of Artificial Sequence: Synthetic coding sequence
atgtcacggagatacgactcccgcaccaccatatttagccctgaagggaggctgtaccaggtcgagtacgctatggaagccattgggcatgcgggaacatgtttaggcattctagccaacgacggtgtcctgttagccgctgaaaggcgtaatatccacaagttgttagatgaagtgttttttagtgagaagatttacaagctgaatgaagacatggcttgtagcgtagcgggaataactagcgatgcaaatgttctgaccaacgaattgagactgatcgcacagcgctatctgcttcagtatcaggaacctatcccctgcgaacagctggtgacagccctttgcgacattaaacaagcctatacccagtttgggggaaagagaccatttggagtcagtctcctgtacatcggctgggacaaacactatggcttccaattatatcagagtgatccctctggaaactacggtggatggaaggccacttgtatcggaaacaacagtgccgcagccgtctccatgctcaagcaggattataaggagggcgagatgacacttaagtccgccctagctctagcgatcaaagtcctgaataagaccatggatgttagcaagttgtcagctgaaaaagtagaaatcgccacactcaccagagagaacggcaagacagttatacgcgtcctaaaacagaaggaggttgaacagttgattaaaaaacacgaggaggaggaggccaaagcggaaagagaaaagaaagaaaaggagcagaaagaaaaggataaatag

SEQ ID NO: 236500 - DNA, 666 bp, Artificial Sequence
  Description of Artificial Sequence: Synthetic coding sequence
atgtccaggaggtatgacagccgcactaccattttttctccggaggggagactataccaagtggaatacgctatggaggctataggacacgcaggcacttgcctcggcatacttgctaatgatggtgtgctgctggcagcggaaaggagaaatatacataaacttctcgacgaggtcttcttcagcgaaaagatctacaagctgaatgaggatatggcgtgtagtgtggctggtatcacctcagacgctaacgtgcttacaaacgagctgcgcctgattgcacagaggtacttactgcagtatcaggagccaatcccatgtgaacaattggtgacagccctgtgtgatatcaaacaggcttatactcagtttggaggcaaacgaccgtttggagttagcctgttgtacattggatgggataaacactacggctttcagctgtaccagtcagaccctagcggaaactacgggggatggaaggcaacttgtatcgggaataactcggcggctgctgtctctatgctgaaacaggattacaaggaaggtgagatgaccctgaagtccgccttagcgctcgcgattaaagtattgaacaagaccatggatgtgtccaagctgagcgccgagaaggtagagatcgccactttgactagggaaaatggatag

SEQ ID NO: 236501 - DNA, 630 bp, Artificial Sequence
  Description of Artificial Sequence: Synthetic coding sequence
atgagcaggcgctatgattcaagaacaaccatcttctcgcctgaagggagactttaccaggtcgagtacgctatggaagcgatcgggcatgcgggaacttgtcttggaatcctggcaaacgacggcgtgctgttggccgctgagcggaggaacatccacaaattactggacgaagtattttttagtgagaagatatacaagcttaacgaagatatggcctgttccgtcgctgggatcacatcagatgcaaacgtgctaactaatgaactgcgcctcatcgcgcagagatacctgttgcagtatcaggagcccataccctgtgaacaactagtgacagcgctatgcgacatcaaacaggcttatacccagtttggaggcaaacgcccatttggggtctcccttctctatattggttgggacaaacattacggatttcaactgtaccagagcgaccctagtggaaattacggcggatggaaggctacttgcattgggaacaactctgctgccgctgtgtcgatgctgaagcaagactataaggaaggggagatgaccctgaagtcggcactcgcactggcaatcaaagtgcttaataaaaccatggacgtctctaaattgtcggcagagtag

SEQ ID NO: 236502 - DNA, 693 bp, Artificial Sequence
  Description of Artificial Sequence: Synthetic coding sequence
atgtcccgtcgctatgacagccggacgactatcttcagcccagaggcagaacggaggaatatccataagttactcgacgaggttttctttagcgagaaaatttataaactgaacgaggacatggcatgttctgtggccggtattacctcagatgccaatgttctgacgaatgaactcagactcattgcacaacgctatctcctgcagtaccaggagccgattccatgcgagcagctggtcaccgcactgtgcgatatcaaacaggcttacacccagttcgggggaaaaaggccttttggagtgtcgctgctgtacattggatgggacaaacattacggcttccaactgtatcaaagcgatccttccggcaattatggtggatggaaggctacgtgtattgggaataattcagccgctgccgtttccatgcttaagcaggattataaggaaggggagatgaccctgaagtcagctcttgctctggcaataaaagtcctgaataaaactatggacgtgtctaagctctcagctgagaaagtggagatcgccaccctaactcgtgaaaacggtaagactgtaattcgagtgcttaaacagaaggaggtggagcagctgatcaagaaacacgaggaggaagaggccaaggcggaacgagaaaaaaaggaaaaagagcagaaagagaaagataaatag

SEQ ID NO: 236503 - DNA, 711 bp, Artificial Sequence
  Description of Artificial Sequence: Synthetic coding sequence
atgagccgcagatatgactccaggaccaccatctttagtccagaaggtaggttataccaggtggagtacgccatggaggcgattgggcatgccggtacatgtctcggtatcttggctaatgatggtgtactgctcgccgcagaacgcaggaatatccataagctacttgatgaagtgtttttttctgagaagatctacaaactaaatgaggacatggcctgtagcgtcgctgggatcacttctgacgccaatgtactgactaacgagctgaggttgattgcacagcgttacctactgcaataccaggagccaataccttgcgagcagctcgttaccgctctgtgcgacatcaagcaagcatacacacagttcggaggaaagcggccattcggtgtgagtctcctctacattgggtgggacaagcattatggtttccaactgtatcaatctgatccatcagggaattacggaggctggaaggccacttgtattggcaacaactcagcggctgcagtcagcatgttgaagcaggactacaaggaaggcgagatgacccttaagtccgccctggccctggctattaaggtgctgaataagactatggatgtatccaagctcagtgctgagaaagtggaaattgccactcttacaagggaaaacgggaagactgtaatacgcgtcctgaaacagaaggaggtggaacagttatag

SEQ ID NO: 236504 - DNA, 726 bp, Artificial Sequence
  Description of Artificial Sequence: Synthetic coding sequence
atgtttctgaccagaagcgagtacgacagaggagtgaatacattctctccagaggggcgattgtttcaggtagaatatgccatcgaggccattaaactggggagcactgctattggaattcagactagcgagggggtgtgtcttgccgtggaaaaaagaatcacatctccactgatggaacctagcagtatcgagaagatcgtggagatcgacgctcatataggctgcgccatgagcgggcttatagcagacgccaagactttgatcgataaagccagggtggagacccagaatcactggttcacctacaacgaaactatgactgtggaaagcgttacccaggccgttagcaatctggccctgcaatttggcgaggaggacgccgatccgggtgctatgagtcgacctttcggggtagcactacttttcgggggagtggacgagaagggtccacagctgtttcatatggacccctctgggacattcgtgcagtgcgacgcaagggccattggttccgcgagcgagggagcacaaagctctctgcaggaggtgtatcataagtcaatgacactgaaagaagcaattaaatccagcttgattatcctcaaacaggtgatggaggaaaaactgaatgccaccaacattgagctggctactgtacaacccggacaaaacttccatatgtttacgaaagaggaactagaagaagtcattaaggacatttag

SEQ ID NO: 236505 - DNA, 552 bp, Artificial Sequence
  Description of Artificial Sequence: Synthetic coding sequence
atggagccgtcaagtattgaaaagattgtggaaatagatgcccatatcggttgtgccatgtctgggctgattgcagacgccaaaacattaatcgacaaggccagggtggaaactcagaatcattggtttacctacaatgagaccatgacggtagaatctgtaactcaggcagtttctaacttagccctgcagttcggcgaggaggatgccgacccaggggcaatgagcaggccttttggcgtcgcccttctgttcggtggagtcgatgagaaaggaccccagctgttccacatggatccgtctgggaccttcgtccagtgtgacgctagagccatcggttccgcgagcgaaggagctcagtccagccttcaggaagtctaccacaagagcatgacgttgaaagaagccataaagagcagcctaatcatactgaagcaggttatggaagagaagttaaacgcaacaaatatcgaactggcaacagtccagcctggacagaactttcatatgttcacgaaggaagagctggaggaggtcatcaaggacatttag

SEQ ID NO: 236506 - DNA, 741 bp, Artificial Sequence
  Description of Artificial Sequence: Synthetic coding sequence
atgagcagaggtagttccgcaggatttgacagacacatcacgatcttttctcccgaggggaggctttatcaggttgaatacgcattcaaggcaattaaccaagggggactcacctcggttgcagtgcggggtaaagactgcgccgttattgtgactcagaagaaagttccagacaaactgctggattccagcacagtgactcatctatttaaaattaccgagaatatagggtgcgtaatgaccggcatgacggcagattcgcgatcgcaagttcagagggcgcgatacgaggccgcaaattggaagtataagtacgggtatgagatccccgtggatatgttatgtaagcgcatcgccgatataagtcaggtgtacacccagaacgccgagatgcggcctctgggttgctgcatgatcctcataggtatcgatgaggagcaagggccacaggtttacaaatgtgatccggcagggtactactgcgggttcaaggccacagctgctggcgtgaaacaaactgagtccacgtccttcttggaaaagaaagtgaagaaaaagttcgattggaccttcgaacaaacagttgagacagccatcacctgcctgtcgaccgtgctgagtatcgactttaagccctcagaaatcgaggtaggcgtcgttaccgtcgagaatcctaaatttcgaatccttactgaagcagagatagacgcccatctcgtggccttagcggagagggactag

SEQ ID NO: 236507 - DNA, 684 bp, Artificial Sequence
  Description of Artificial Sequence: Synthetic coding sequence
atggccggactgagaagggagtacgcctttaaagccattaaccagggaggcttgacctccgtggctgtgagaggcaaggactgcgcggtgattgtaacccaaaaaaaagtgcctgacaagcttttagactcttctactgtgactcatctgttcaagatcaccgaaaacatcggttgtgtcatgactggcatgaccgctgatagcagatcccaggttcagcgtgccaggtatgaagccgcaaattggaagtacaaatacggatacgaaattccagtggacatgctctgcaagcgtatagccgacattagccaggtgtacacacagaacgccgagatgcgccctctcggctgctgcatgatcctcattgggatcgatgaggagcagggacctcaggtgtataaatgtgatccagctgggtactactgtggttttaaggcaaccgctgccggagtaaagcagaccgagagcaccagttttctggaaaaaaaggttaagaaaaaatttgattggacattcgaacagaccgtcgagactgctattacctgtcttagtacagttctgagtatcgacttcaaaccatcagaaatcgaggtaggagtcgtaacagtggagaaccccaagttcagaattctcacagaggccgagattgacgcccatctggtggccctcgccgagcgggattag

SEQ ID NO: 236508 - DNA, 759 bp, Artificial Sequence
  Description of Artificial Sequence: Synthetic coding sequence
atgagccgtggctcttcagctgggtttgaccgccatattactatattttctcccgagggcagattgtaccaggtggaatacgccttcaaggctattaaccaaggaggtttaacaagcgtggccgtgcggggaaaggactgcgcagtgatcgttacacagaagaaggtgcccgacaagctgctggattcttctaccgtgactcaccttttcaagattaccgagaatatcggttgtgtaatgaccggcatgactgccgacagccggtctcaggttcagcgagctaggtacgaagccgctaactggaagtacaagtacggatacgagatcccagttgacatgctctgtaagcgtattgcggatatatcccaggtttacactcagaatgccgagatgcgtccacttggctgttggtcttttttgttcctcggtatgattctgatcgggattgacgaagagcagggaccccaggtgtacaagtgtgatccagccggttattattgtggattcaaggccacagcagctggcgtgaagcagaccgagtctacatctttcttagagaagaaagtgaagaagaagtttgactggacattcgagcagaccgtggaaacagctattacatgtctttccactgttctttccattgatttcaagccctctgagattgaggtgggggtcgtgacagtagagaatcctaaatttaggatactcacagaggctgaaattgatgctcatctggtggccctggccgagagggattag

SEQ ID NO: 236509 - DNA, 324 bp, Artificial Sequence
  Description of Artificial Sequence: Synthetic coding sequence
atgtcccggggtagctcagctggcttcgaccggcatatcaccatcttcagtccagagggcaggctgtaccaggtggagtacgctttcaaggcgattaatcagggtggcctcacgtccgtagctgtccggggaaaagattgtgcagtgatagtcacccagaaaaaggttcccgacaagcttctcgatagctccactgtgacacaccttttcaagattaccgaaaacattggctgtgtcatgacagggatgaccgtatctctttgtaggcctggctgttctgcctcatgggtgcaggcaattttggtgcctcagccaccccgatag

SEQ ID NO: 236510 - DNA, 447 bp, Artificial Sequence
  Description of Artificial Sequence: Synthetic coding sequence
atgtccaggggatcctccgccggattcgatagacacatcaccatctttagcccggaaggcaggctgtatcaagtagagtacgcattcaaggctatcaatcagggtggactgacttcagtcgccgttcgaggtaaggattgcgcagtgattgtcacacagaaaaaggtgcccgataaattgctggattcaagtacggtaacacacctattcaaaattacagaaaatatcggttgcgttatgacagggatgacagctgattcccgttcacaagtgcagcgtgcacgctacgaagctgccaactggaaatacaagtatggatacgagataccggtggatatgctttgcaagcgaatcgcggacatttcacaagtctatacccagaacgcggagatgagaccactagggtgttactgcaattatatgccggtgtactgctccataaattag

SEQ ID NO: 236511 - DNA, 504 bp, Artificial Sequence
  Description of Artificial Sequence: Synthetic coding sequence
atgacaggcatgaccgcggatagtaggtcacaggtacagcgggcaaggtacgaggccgctaattggaagtacaaatacgggtatgagatccctgtggatatgctttgcaagcggatagccgatatctcccaagtgtacacacaaaacgcggaaatgcgtcccctgggctgttgtatgatactcattgggattgacgaagagcagggacctcaggtctataagtgtgaccctgcaggctactactgtggatttaaagctacagcagcaggggtgaagcaaacagaatcaacttctttccttgagaagaaagttaagaaaaaatttgactggacttttgagcagaccgtggagacagccattacctgcctgagcaccgtcctgtcgatcgacttcaaaccctccgagatagaagtgggagtggtcactgttgaaaacccaaagttcaggatcctaactgaagccgaaatcgatgcccacttagtcgcactggccgaacgagactag

SEQ ID NO: 236512 - DNA, 612 bp, Artificial Sequence
  Description of Artificial Sequence: Synthetic coding sequence
atgagtcgagggtcatccgccggatttgatcggcacattacaattttttctcccgaagggcgactgtaccaggtggaatatgcatttaaagccatcaaccaggggggattaacttctgttgctgttcggggaaaagactgcgcggtgatcgtgacccagaaaaaggttcctgataagctgctggacagctccaccgtgactcacctgtttaaaatcactgagaacatcgggtgtgtcatgactggtatgaccgctgactcgcgctcccaggtccagcgcgctaggtacgaagcggctaattggaagtataagtatggatatgagatccccgtggatatgctgtgcaagcgaatcgctgacatctcccaagtatacactcagaacgccgagatgcgacctctcggatgctgcatgattcttatcggaattgatgaggagcaaggaccacaggtgtataaatgcgaccccgctggctattactgcggattcaaggccacggctgctggcgtgaaacagaccgaatctacttccttcctcgagaagaaggtaaaaaagaagttcgactggacgttcgagcagaccgtggaagattcctatcgaagccgcgattag

SEQ ID NO: 236513 - DNA, 450 bp, Artificial Sequence
  Description of Artificial Sequence: Synthetic coding sequence
atgtcttacgaccgcgctattacagtgttcagtcctgacggccacctcttccaggtggagtatgcgcaggaggctgttaagaagggaagtacagctgtgggtgtcaggggcagagatattgttgtcctcggcgtcgagaagaagtccgtcgctaagctccaagacgaacgcacagtacggaaaatatgcgccttggatgacaatgtttgtatggcgttcgctggtctgactgctgacgctaggattgtcatcaatcgggcacgtgtcgaatgccaatcgcacaggctgaccgtagaggatcctgtcacagtggagtatatcaccagatacatcgcatctttgaaacaagtcggcgcatgtcccttagcctgctcgcctctagccgcaggtcaaagccgcttgaggcacgggggttcctgccacgtgacatccggagagtcagaaaattag

SEQ ID NO: 236514 - DNA, 537 bp, Artificial Sequence
  Description of Artificial Sequence: Synthetic coding sequence
atggcgttcgcaggtctcactgccgatgcaaggatagtgatcaacagagctcgcgtggagtgccaatcacaccgtctgactgttgaggacccagtcaccgtggagtatatcacaagatatattgcctccttgaagcagagatacacacaatcgaacgggcgtagaccattcggcatatccgctcttatcgttggatttgatttcgacggtacacccaggctctatcagacagatccaagcggcacttatcacgcatggaaggcaaacgccataggtcgaggagccaaaagtgttcgggagttccttgaaaagaactacacagatgaggcaatagagacagacgatttgacaatcaagctcgttataaaggcactgctggaagtagtgcagagcgggggaaaaaacatagaactggctgtgatgagacgcgaccagtcgctcaaaattttgaatccagaggaaattgagaaatacgtggcagagattgaaaaggaaaaggaggaaaacgaaaagaaaaagcaaaaaaaagcgagttag

SEQ ID NO: 236515 - DNA, 747 bp, Artificial Sequence
  Description of Artificial Sequence: Synthetic coding sequence
atgtcatatgatagagccattaccgtgttttccccagacgggcatttattccaggttgagtacgcccaagaggccgtaaaaaaaggaagcaccgcagtgggcgttcgaggccgtgacatcgtggtcctcggggtagaaaagaagtccgttgccaagctccaggatgaacgcaccgtacgaaagatatgcgctcttgatgataacgtgtgcatggcctttgcgggtctcactgccgatgctagaattgttataaacagagcaagagtagagtgccagtcacatcggctaactgtagaggaccccgtgactgtagaatacatcaccaggtatattgccagcctgaaacagcgctacactcagtccaacggaaggcggccttttggtatctcggcccttatcgtgggctttgatttcgacggtacaccacgactgtaccagacagacccgagcgggacctaccacgcgtggaaggctaatgcaatcgggaggggggctaaatcagtccgcgagtttctcgagaaaaattataccgacgaagcaattgaaactgatgaccttacaatcaagctcgttataaaggctctcttggaagtagtccagagtggtggtaaaaatatcgaacttgccgtgatgcggagagaccagtcactgaagatattaaatccagaggaaatcgagaaatacgtggctgaaatagaaaaagagaaggaggagaatgagaagaaaaagcagaagaaagcatcctag

SEQ ID NO: 236516 - DNA, 564 bp, Artificial Sequence
  Description of Artificial Sequence: Synthetic coding sequence
tgactgaccgccgacgctcgaattgtgataaaccgggctagggtggaatgccagtctcatcggctgaccgtcgaagaccctgtaactgtcgagtacattacaaggtatattgctagcctaaagcagcggtatacccagtccaacggcaggagacctttcggcatctcagcgttaatagtcgggttcgatttcgacggaacccccaggttgtaccagactgatcccagtggcacttaccacgcatggaaagcgaacgctatcggtcgaggggctaagtccgtcagggaattccttgagaaaaattatactgatgaagctattgaaactgatgaccttacaatcaagttggtaataaaagccctgttagaggggaaggtcgtaaatgcacccgttttttgtcccttcaaagtagtccagtctggtggaaagaatattgagctggctgtgatgcgcagggaccagtcgctgaagatcctgaatcccgaggaaattgagaaatacgtggccgaaatcgagaaggaaaaagaagagaatgagaaaaaaaagcaaaagaaggcgtcttag

SEQ ID NO: 236517 - DNA, 726 bp, Artificial Sequence
  Description of Artificial Sequence: Synthetic coding sequence
atgctaagctcaaccgctatgtactctgccccaggcagggacttgggcatggagccccatcgggctgccggacctttacagctgcggttctctccgtacgtgttcaacggcggtactatcctagctatcgcgggtgaggacttcgccatcgttgccagcgacaccagactctccgagggcttttccattcacacacgcgattctccaaagtgttataaactgacagacaagacagtaatagggtgcagtggcttccatggagattgtcttaccctgacgaaaataattgaggctagattgaagatgtataaacactccaataacaaagccatgaccacaggcgcaattgccgcaatgctcagcacaattctctacagtcggaggttcttcccatactatgtgtataacattattggtgggcttgatgaagaaggtaagggagctgtgtactcatttgatcccgtgggttcataccagagagactcgtttaaagccggaggtagcgcctctgctatgctccaacctctgctcgataaccaggttggctttaaaaatatgcagaacgtggagcacgtgcctctgtcgctcgatcgggcaatgaggttggtcaaggacgtctttatctcagcggctgagcgcgatgtgtataccggcgacgcactgaggatctgcatcgttaccaaggaaggaattagggaggagaccgtgtcattgcggaaggactag

SEQ ID NO: 236518 - DNA, 591 bp, Artificial Sequence
  Description of Artificial Sequence: Synthetic coding sequence
cggagatcccgggctatgttgtcttccaccgccatgtactcagcaccgggtcgtgacctcgggatggagcctcaccgcgctgccggtcccctgcagctgagattttcgccatatgtttttaacggcggaaccatcctggccatcgctggagaggactttgctatagtcgccagcgatactcgcctgtctgaaggcttttccatccataccagagacagtccaaagtgctacaaactgacagataagacggtgatcggatgttcagggtttcacggagattgcttaaccctgactaagattatagaggctagactgaaaatgtataaacactctaataataaagccatgacgacgggcgctattgcggctatgctatcaactatcctctactccagaaggttcttcccatattatgtctacaacatcattggcggtctggatgaggagggtaagggagcggtgtactcatttgacccagtgggaagctaccagcgcgacagtttcaaggccggaggctccgcatcagccatgctccagcctttgctggacaatcagtatataagcagcaacagcgtgagcctgtgtgtgtag

SEQ ID NO: 236519 - DNA, 822 bp, Artificial Sequence
  Description of Artificial Sequence: Synthetic coding sequence
atgttgaaacctgctctggaaccccgtgggggtttttcttttgaaaactgtcagaggaacgcatctcttgaacgcgtgttgcctgggctgaaggtgccacatgctagaaagaccggcactacaatcgcagggctcgtctttcaagatggggtgattctgggtgcagacacccgggcaacaaacgattccgtcgttgcggataagtcctgtgagaaaatccacttcatagccccaaagatctactgttgcggagctggcgtggcagctgatgctgaaatgaccactcgaatggtggcatccaagatggagttgcatgccctgtcaactggacgcgaaccacgggtcgccacggtcacccgcattttgcggcagaccctttttcgctaccaaggccacgtgggtgcttcccttatcgttgggggagtggacctcactgggccacaactgtacggggtccacccacacgggagctactcaagactgcccttcacagctcttgggtccggtcaagacgccgcattggcggtccttgaagacagattccaaccgaatatgacactagaggccgctcagggtctgctggtcgaagcagtcactgccggaatacttggcgatttagggagcgggggaaacgtggacgcatgtgtgattacgaaaactggtgccaagctcttgagaactctgagcagtcctaccgaaccagtcaagcggagcggacgctatcatttcgtgccgggaaccaccgctgtattgacccaaactgtcaaacccctgacgctggaactggttgaggagaccgttcaggcgatggaggtggagtag

SEQ ID NO: 236520 - DNA, 903 bp, Artificial Sequence
  Description of Artificial Sequence: Synthetic coding sequence
atggcgcttcaggatgtgtgtaaatggcagtcccccgacacgcaggggccttcgccacatctgccgagagccggaggatgggccgtaccaagaggctgtgatccacaaacattcctgcaaatccatggcccacggctggcccacgggaccacaaccctcgcttttcgcttccgccatggggtcatcgcggctgctgacacccgatccagctgcggcagttacgtcgcatgccccgcatcttgtaaggtgatcccagtacatcaacatttgctcggtacaacgtccgggacctccgctgactgcgctacttggtaccgggtgcttcaaagggaattgcgcctcagggagcttcgagaagggcagcttccttctgtagcttcggcagctaaactcctgagtgccatgatgtctcaataccgaggactcgacttgtgcgtcgctactgctctctgtggctgggaccgcagcgggccagagctgttttacgtgtattctgacggcacaagactgcagggagacatctttagcgtgggcagcgggagtccatatgcctatggagtgctcgaccggggttacaggtatgatatgtctactcaggaggcgtatgcactggccagatgcgctgttgctcatgcaactcaccgagatgcctatagcggcggttcggtggacctcttccacgttcgggaaagtggatgggagcatgtgtccaggtcagatgcatgtgtgctgtacgtagaactccaaaagctccttgaacctgagcccgaagaagacgctagccatgcacacccagaaccagcaaccgctcatagagccgctgaggatcgggagctcagtgtcggtcccggtgaagttaccccaggggattcaagaatgccagccggaaccgaaaccgtgtag

SEQ ID NO: 236521 - DNA, 606 bp, Artificial Sequence
  Description of Artificial Sequence: Synthetic coding sequence
atggagtatctgatcggcattcaggggcctgattatgtcctggtcgcctcggacagggtcgctgcaagtaatattgtccagatgaaggatgaccatgacaagatgtttaagatgtctgaaaagatcctgctgctatgcgtgggcgaagccggtgacactgtacaatttgcggaatatatccaaaagaatgtccaactgtacaaaatgagaaatggctacgaactgtctcccaccgcagccgctaatttcaccagacggaatctggccgactgcctacggtcccgtaccccttatcacgtgaacctcctccttgcagggtacgacgaacatgagggacccgctctgtattacatggattacctcgctgcattggcaaaagctccctttgcagcccatggatacggagcttttctcaccctctcgatccttgatagatactatacacccacaatcagtcgggaacgtgcggtggaactgttgcggaagtgtcttgaggagctccagaagaggtttatcttaaatttgcccaccttttctgtgagaatcatagacaagaacggtattcatgacctggataacatatccttccccaaacaaggctcatag

SEQ ID NO: 236522 - DNA, 468 bp, Artificial Sequence
  Description of Artificial Sequence: Synthetic coding sequence
atggctagtctgaaatgctcaacggtggtgtgtgtcatctgtctggaaaagccgaagtataggtgtcctgcctgcagagtgccttactgcagcgtggtgtgttttcgaaagcacaaagagcagtgcaatcctgagacacggccagtggagaagaagatcaggtctgctcttcctaccaagacagtcaagcccgtggaaaataaggacgacgatgatagcatcgccgacttcctaaacagcgatgaggaagaagatcgcgtgtcactacagaatctgaagaatttaggcgaatccgcaaccttaagatctcttctcctgaaccctcacctcagacaactgatggtgaatttagatcagggagaggataaggcaaaattgatgagagcctacatgcaggagccgctttttgttgaatttgccgattgctgtctgggaatcgttgagccttctcagaatgaggaaagttag

SEQ ID NO: 236523 - DNA, 795 bp, Artificial Sequence
  Description of Artificial Sequence: Synthetic coding sequence
atggaggcatttctgggctccaggtccgggctatgggctgggggaccagcccctggccagttttataggattccttcaaccccggactctttcatggaccctgcctcagcactatatagggggccaattacaagaacgcagaaccctatggtgacgggaaccagtgtcttgggcgtcaagtttgaaggtggtgtagtgatagctgccgacatgctgggatcttacggctctctggctcgatttcgcaacattagcaggatcatgcgcgttaataattctaccatgctcggagcctctggcgactatgcagatttccagtatctcaaacaagtgctcggccaaatggttatcgatgaggaactgctgggagacggccactcctatagcccaagggcaattcatagctggctaacccgtgcaatgtacagcagacgcagtaaaatgaatcctctgtggaacaccatggttatcggcggttacgctgacggtgagtctttcctaggctatgtggacatgctgggagtggcctatgaggcgccttcacttgcaactggatatggggcttatctggctcagccactcttacgcgaagtcctggagaaacaaccggtgctgtcccagaccgaggcccgtgacctcgtagagaggtgtatgagagtgctttattatagggacgcacgctcctataatcgcttccagatcgcaaccgttaccgaaaagggggtggagatagaaggcccactctccactgaaacgaactgggacatagctcacatgattagtggcttcgaatag

SEQ ID NO: 236524 - DNA, 792 bp, Artificial Sequence
  Description of Artificial Sequence: Synthetic coding sequence
atggccctggcctcagtgctcgaacggccactgcccgttaatcagagggggttttttggactgggcggaagggccgacttgctcgatctgggccctggaagtttgtcagatggcctttcccttgcagccccagggtggggtgtccccgaagagccaggtatcgaaatgctacatggaacaaccacacttgcttttaaatttcgacacggagtaatcgtggccgcagactctcgcgcaactgctggagcctatattgcttcccagacagtaaagaaggtgattgagatcaacccatatctgttaggcaccatggctgggggtgcagcagactgctccttctgggaaaggctgttggcacgacagtgtcggatctatgagctgaggaataaggaacgaatttccgttgccgctgcatctaagctgctcgctaacatggtgtatcaatacaaaggcatgggacttagtatggggaccatgatatgcggttgggataagcgcggtcctggtctctattatgttgactccgaagggaaccggatctctggagcaactttctccgtggggtcaggctcggtttatgcttatggcgtaatggatagaggttattcctacgatctggaggtggagcaggcctacgatttggccagacgagcaatttatcaggctacgtaccgagatgcctattcgggcggagcagtaaacctgtatcacgtgcgagaagatgggtggattagggtgagttcagataacgtcgcagatctgcacgaaaagtacagtggaagcacaccctag

SEQ ID NO: 236525 - DNA, 483 bp, Artificial Sequence
  Description of Artificial Sequence: Synthetic coding sequence
atggctggcggagcagctgactgttccttttgggagcgcttactcgctcgtcagtgccggatttacgaattacggaataaggagcgaatttctgttgccgcagcctctaagctgctggccaatatggtctatcagtataagggaatgggattgtctatggggacaatgatatgtggctgggacaagcgcggtcctggtctgtattacgtcgattcagagggcaaccgcatctcaggggctacgttctcagttgggagtgggtctgtgtacgcctatggtgtgatggaccgtgggtatagttatgatctggaggtggaacaggcttacgacctagctaggagggcgatatatcaggccacatatagagacgcttactcagggggagccgtcaacttatatcatgtgagagaggatggatggatacgagtcagctcagataatgtcgccgacctacatgagaaatattcaggaagtaccccctag

SEQ ID NO: 236526 - DNA, 612 bp, Artificial Sequence
  Description of Artificial Sequence: Synthetic coding sequence
atggccctggcgtcagtgctcgagagacccctccccgtcaatcagcgcggattcttcggccttggagggagagctgatttgttggatctgggcccaggatctctgagtgatggactgtccctggcagctcctggctggggagtgcctgaggagccaggaatcgagatgttgcacggcacaacaaccttggcattcaaatttcgacacggagttattgtcgctgccgactcaagagcaactgccggagcatatatcgctagtcagaccgtaaaaaaggtcatcgagataaatccataccttctcgggaccatggccggtggagctgccgattgctctttttgggaacggcttctcgcgaggcagtgccgcatttacgaacttcgtaacaaggagcgaatctccgtggccgctgcctcaaaactgttagccaacatggtataccagtataaagggatggggctgtctatgggaaccatgatatgcggatgggataagcggggacccgtgtctgaggtcctctgcttaaaacccaagtccttcggcatgtacctcttctgcggatgcgctgagagaattggcaacatggcaaggcctttgttaagggggcagtag

SEQ ID NO: 236527 - DNA, 834 bp, Artificial Sequence
  Description of Artificial Sequence: Synthetic coding sequence
atggccgcagtgagcgtctatgctcctccagtgggcggattttcgtttgataactgtcggcgtaacgctgttttggaggctgattttgctaagaggggttacaaacttcctaaggtccggaagactggcacaaccatcgccggagtggtgtataaggatggtattgtccttggcgcagatactcgagctaccgagggcatggtggtggccgataagaattgctcaaagatccactttatctctcctaacatttactgctgtggggctggcacagccgctgatactgacatgacaacccagttaatctcgtcaaacctcgagcttcattcactgagcaccggccgactgcctcgggtggtgactgccaataggatgttgaagcagatgctgttcagataccaagggtacatcggggctgcactcgtcctcggaggtgtcgatgtcactgggccacacctatacagcatttatccacacgggagtacagacaaactgccatacgtcacgatgggctctggatctttagccgctatggcagtattcgaagacaagttccgaccggacatggaagaggaagaggctaaaaatctggtctcagaagccatcgctgccggaatctttaatgacctcggatccggatcaaatatcgacctgtgcgtgattagcaaaaataaactcgacttcttgcgcccttacacagtccctaataaaaaaggcaccaggctgggtaggtacagatgtgaaaaaggaactacagctgtccttaccgagaaaatcactccattagaaatcgaagtgctggaggagacggtccagacaatggacactagttag

SEQ ID NO: 236528 - DNA, 633 bp, Artificial Sequence
  Description of Artificial Sequence: Synthetic coding sequence
atggccgcagtgagcgtttacgctcccccagtgggagggttttcattcgataactgccggaggaatgccgtgcttgaggccgactttgccaaaagggggtacaagctgccaaaagtgagaaaaactggtaccacgattgcgggagtcgtgtacaaagacgggattgtgctcggcgcagatacccgggcaacagaggggatggtggttgcggacaagaactgtagtaagattcactttattagcccaaatatttattgctgcggggcaggaacggccgctgacaccgacatgaccacccagctcatcagctctaacctggaactccactccctctccactggcagattgccacgggtagttaccgcaaacagaatgctcaagcagatgcttttcaggtatcagggctatataggggctgccctcgtgctgggaggcgtggacgtaactggtccacatttgtactcaatctacccccacggatctacggacaagctgccgtatgtaacaatggtacattgcgaggaggagttgttcactgaaaacctgttcttcatcaggcaagcagaagtggtatcggaagaggcctggggcccatcattcgctatcagcctagctgtatttctggtcgcctag

SEQ ID NO: 236529 - DNA, 429 bp, Artificial Sequence
  Description of Artificial Sequence: Synthetic coding sequence
atggccgcagtgtcagtgtacgcaccccctgtcggcggattcagttttgataactgccgcaggaacgccgtcctggaggccgatttcgccaaacgaggctacaagctccctaaagtaaggaaaaccgggaccacgatagccggagttgtgtataaagatggaattgttctgggcgctgacactagagcaacagagggcatggtggtggcggataagaactgttccaagattcatttcatttcccccaacatttactgctgcggcgcagggacagcggctgacactgatatgactacccagcttataagcagcaacctggagctgcattccttgagcactgggagactacctcgggtggtgacggccaaccggatgcttaagcagatgctctttcgtttttggctgctcggtagtaatggttgcatatag

SEQ ID NO: 236530 - DNA, 819 bp, Artificial Sequence
  Description of Artificial Sequence: Synthetic coding sequence
atgctgatcggaaccccaactccaagggacacaacccccagctcctggctcacatctagccttttggtggaggccgctcctctggatgataccacactgcccacaccagtgagctcaggatgtcccggtctcgaaccaactgagtttttccagtctctagggggagatggtgaacggaacgtacagatcgagatggcccacgggactacgaccctagccttcaagttccagcacggtgtgattgccgcagtggacagtcgggcttctgccggtagctatatttccgccttacgggtgaacaaagtgatagagataaacccctacttacttggcaccatgagtgggtgtgctgccgattgtcagtactgggaaagactccttgctaaggagtgtaggctgtattatcttcggaacggggaaagaattagcgtaagcgcagcatcaaagctcctgagcaatatgatgtgccagtaccgagggatgggcttgtctatggggtcaatgatctgcgggtgggataagaaaggccctgggctctactatgttgacgaacacggcacacgcctctccggaaacatgttctctactggtagcggcaacacttacgcttacggtgtgatggacagcggttatagacctaacctctctcccgaagaagcctatgacctaggtcggcgtgctattgcctatgctacgcacagggacagctatagtggaggtgtagtcaacatgtaccatatgaaagaagacgggtgggtcaaagtggaatcaactgatgtcagcgacttgctgcatcaataccgcgaggcaaatcagtag

SEQ ID NO: 236531 - DNA, 831 bp, Artificial Sequence
  Description of Artificial Sequence: Synthetic coding sequence
atggcgctgctcgatgtgtgtggtgctcctagggggcagagacctgaatctgccctgcctgtagctgggagtggcagacgatctgatcctggccattacagtttttcgatgcgatcaccggagctggctttgccacgaggaatgcagcctaccgaattctttcagtcactggggggagatggagagaggaatgtccagattgagatggcccacggcacaaccaccctcgcgtttaaatttcagcatggagttattgccgctgtcgattcacgggcttctgcgggaagctacatcagcgccttaagagtcaacaaagtaatcgaaataaacccatatctgctgggaacaatgtccggatgcgccgcagattgtcagtactgggagaggttgctcgcaaaagaatgtagattgtactatctgaggaatggcgaaagaatctccgtctccgcagcctctaagctactgagtaatatgatgtgccagtatagggggatgggcctgtctatgggttccatgatttgcggatgggacaaaaagggacccggtctgtactacgtggatgaacatgggacccgcctgtccggaaacatgttttcgactggttctggtaacacctacgcctatggagtgatggacagcgggtatagacctaatctgtcccctgaagaggcctacgacctgggtagaagggcgatcgcctatgccactcaccgggattcatacagcggaggggtcgtgaatatgtaccacatgaaagaggacggctgggtcaaggttgagtccactgacgtgtcagaccttctccatcaatatcgtgaagctaatcagtag

SEQ ID NO: 236532 - DNA, 831 bp, Artificial Sequence
  Description of Artificial Sequence: Synthetic coding sequence
atggcactcctggacgtgtgtggggcacccagggggcagcggccagaaagtgccctgcctgtggccggtagtggaaggcgatcagacccaggccattatagcttttcaatgcgatcgccagagctggccctccccagagggatgcagcctactgaattttttcagagcttgggcggtgatggtgagaggaatgttcagatcgaaatggcacacggcacaactacattggcctttaagttccagcacggtgtaatcgccgctgtagattcccgggctagtgccggttcttatattagcgcgcttagagtgaataaagtgatcgagattaatccctacttgctgggtactatgagcggctgcgcagcagactgtcagtattgggaacggctcctggccaaggagtgcagactatattatctcaggaacggggaaagaatctccgtgagtgctgcctccaagttgctttctaatatgatgtgccagtaccgcggaatgggcctcagcatgggcagcatgatttgcggctgggacaaaaagggccctgggctttactatgtggacgaacacggcaccaggctgtctgggaatatgttttccactggctccgggaatacttacgcttacggggtgatggacagtggttatcgtccaaacctctcacccgaggaggcttacgacttgggacggagagcaattgcatacgccacccaccgtgattcttatagcggaggagttgttaacatgtaccacatgaaggaagatgggtgggtgaaagttgagtctacagacgtatcggacctgctgcatcagtatcgtgaggccaaccagtag

SEQ ID NO: 236533 - DNA, 819 bp, Artificial Sequence
  Description of Artificial Sequence: Synthetic coding sequence
atgcttattggtacgcccactcccagagacactaccccttcctcatggctcacttcaagcctgttggtcgaggcagcaccgctggatgacaccacgctgccgactccggtttctagcggctgtccgggacttgagcccactgaattcttccagagtctggggggtgatggagagcgcaacgtgcaaatcgagatggctcacggcacaaccacactggccttcaaatttcagcacggtgtcatcgccgctgttgactcccgcgctagtgctgggagctatatctctgccctccgggttaacaaagtcatcgagatcaatccatatctcctaggcactatgtccggttgtgctgcagattgtcagtactgggaacggcttttagcaaaagagtgcagactgtattacttgcgtaacggtgaacggataagcgtatccgctgccagtaaacttctgagtaacatgatgtgtcaatatcgtggcatgggactttccatgggttctatgatctgtggctgggacaagaaaggacccggactctactatgtagacgagcacggaacaaggctttcgggtaatatgttttctaccgggtccggaaatacttatgcctatggggtgatggactccgggtataggcccaatctgagtcctgaggaggcatatgatctggggagaagggctatcgcgtacgccacacatcgtgattcttactctggaggcgttgttaatatgtatcatatgaaggaggacggctgggtcaaagttgaatctactgacgtgtctgatctgcttcaccaatatcgggaagccaaccagtag

SEQ ID NO: 236534 - DNA, 759 bp, Artificial Sequence
  Description of Artificial Sequence: Synthetic coding sequence
atggcactccttgatgtttgcggcgcaccgaggggacagaggcccgaatctgccctacctgttgccggtagcgggagaagaagcgaccctggccattactcattctcaatgcggtcacccgagctcgccctgccacggggaatgcagcccaccgaattcttccaatctcttgggggtgacggagaacggaatgttcagatcgaaatggcacatggtacaacgacccttgcctttaagttccagcacggcgttatcgctgcagtcgactctcgtgcttccgccggaagttatataaactgtcagtattgggagagactattagcaaaggaatgcaggctgtactatctcaggaatggcgaacgcatcagcgtgtccgctgccagcaagctgctgagtaatatgatgtgccagtaccggggtatgggtctgagcatgggatccatgatctgtggctgggacaaaaagggacccggattgtactatgtggatgaacacgggacccggctcagcggtaacatgttctcaaccggctccggcaacacatacgcgtatggcgttatggactcaggctataggccaaatctctctccagaagaggcttacgaccttggtaggcgagcaatcgcctatgccacccacagagactcgtattcaggtggagtggtgaatatgtaccatatgaaggaggatggctgggttaaggtagaatccaccgatgtttccgacctcctccatcagtaccgcgaagctaaccagtag

SEQ ID NO: 236535 - DNA, 759 bp, Artificial Sequence
  Description of Artificial Sequence: Synthetic coding sequence
atggcactcctcgacgtctgcggtgctccccgtggccaaaggcccgagagcgcactcccggttgcaggtagcggtcgcaggtctgaccccggtcactacagtttttcaatgcggtctccagaacttgcattaccaagggggatgcaacctactgagttttttcaaagtctgggcggtgacggggaaagaaatgtgcagatcgaaatggctcatgggacaaccacgctggcctttaagtttcagcacggtgtgatcgccgctgttgacagcagggcatcagcaggcagctatataaattgccagtactgggagcggctcctcgcgaaagaatgtagattgtattacctgaggaacggcgagcgcatctctgtgagcgccgcttccaagttgctcagcaatatgatgtgtcagtacagggggatggggttatcaatgggcagtatgatctgcggctgggataaaaaagggccaggactgtactacgttgacgagcatggtaccaggctatcaggcaatatgttctccactggctccggcaatacttacgcctacggagttatggactcaggctatagacccaacctcagtcccgaagaggcatatgacctaggacggagggccatagcttacgccacacatcgcgacagctactctgggggtgtggtgaacatgtaccacatgaaggaggacggctgggttaaagttgagtccactgatgtgagtgatctgctgcatcagtaccgcgaagcaaaccagtag

SEQ ID NO: 236536 - DNA, 819 bp, Artificial Sequence
  Description of Artificial Sequence: Synthetic coding sequence
atgcttatcggtacgccaacccccagggatacaaccccatcttcctggctgacttcctcccttttggtggaggcggcaccacttgacgacaccaccctgcctacacccgtgtcaagtgggtgtccgggtcttgaacccactgagttcttccagtccctgggcggtgatggagagcgcaatgtccagatagaaatggcgcatggaacaacaactctcgcctttaagttccaacacggagtgatcgccgctgtagatagcagggcttccgctggctcctacattagtgcattgcgagtgaacaaggtgatcgaaataaacccgtacttgctgggcacaatgagcgggtgcgccgctgactgtcagtactgggagcgtttattggctaaagagtgtagactgtactacttacggaatggcgagagaattagcgtttcagctgccagtaaactgcttagcaacatgatgtgtcagtacagaggcatgggcctgagcatgggtagtatgatctgcggatgggataagaagggacctggattatattatgtggatgaacacgggacacgcctgtctggcaacatgtttagtaccggtagcggtaatacatacgcttacggagttatggactctggttacaggccgaacctctcacccgaggaggcctacgatttgggcaggcgcgctatcgcttacgctacacatagagatagctatagcggtggggtggtgaacatgtatcacatgaaagaggacggctgggtgaaagtggaaagtacggacgtgtccgatctcctgcaccagtatcgagaggccaatcaatag

SEQ ID NO: 236537 - DNA, 819 bp, Artificial Sequence
  Description of Artificial Sequence: Synthetic coding sequence
atgctgatagggacacctacacctcgagacacgactccttcttcatggttgactagctctctactcgtggaagcggcacccctcgatgatactactctcccaacccctgtgagcagcggatgtccgggattggagccaactgagtttttccagagcctcgggggagatggggagcgcaacgtccagattgagatggcccacggaaccaccaccttagcatttaagtttcagcacggagtcatagctgcagtggacagtcgtgctagcgcgggaagctatatttccgcccttagagtgaacaaggtcatcgaaattaatccatacttgctaggcacgatgtccggatgtgccgctgactgtcagtactgggagaggctgctggcaaaagaatgtcggctctattacctgagaaatggagagagaataagtgtcagtgccgctagcaagctgttaagcaacatgatgtgccaatacagaggcatgggtctgtcaatgggctccatgatctgtggctgggacaagaagggccctggcctctactacgtggacgagcacggcactaggctctctggcaacatgttctccacaggcagcggaaacacttacgcctacggtgtaatggattcagggtacaggcccaacctttctcccgaagaggcttacgatctgggaaggcgagccattgcctatgcaacccaccgagattcctatagcggaggtgtggtgaatatgtaccatatgaaggaggatgggtgggtgaaggtggagtccacagacgtctccgatctactccaccaatacagagaagcgaaccagtag

SEQ ID NO: 236538 - DNA, 831 bp, Artificial Sequence
  Description of Artificial Sequence: Synthetic coding sequence
atggctctattagatgtctgcggtgcacctcggggtcagagaccagaatccgctctgccggtcgcgggttccggccgaagatcggaccctggccactacagcttctcaatgcgttcccccgaactcgctttgcccaggggcatgcagcccactgagttctttcagtccctcggcggtgatggcgagaggaacgtgcagatcgagatggcccacggcaccaccacactcgcttttaagtttcagcatggtgtgattgccgctgtagattcacgggcaagtgctggtagctatatcagcgcactcagggtcaacaaggtaatcgaaatcaatccctatttgttaggaactatgtctgggtgcgccgcagattgccagtattgggaaagactgctagcgaaagagtgtaggctctattacttgagaaatggcgagaggatctccgtatcagcagcatctaaactcttgagtaacatgatgtgtcaataccggggaatggggttaagtatggggagtatgatctgtggttgggacaagaaaggcccaggtctctactacgtagacgagcatgggacccgcttgtccgggaatatgttttctacaggctctggaaatacctatgcctacggtgtgatggatagcggataccgacctaacctctcccccgaggaggcctacgacctcggcaggcgggcaatcgcttacgccacccacagggattcatattccggcggtgtcgtaaatatgtatcacatgaaggaagacggttgggtaaaggtagaatctactgacgtttcagacctcctgcatcagtatcgggaggccaatcagtag

SEQ ID NO: 236539 - DNA, 759 bp, Artificial Sequence
  Description of Artificial Sequence: Synthetic coding sequence
atggccttactcgacgtgtgcggggctccgagaggtcagcgaccagaatctgccctgcccgtggccggatcagggagaagaagcgatcccggacactattcatttagtatgcgctcaccggagctagctttgcccagggggatgcaacctaccgagttcttccagagcctcggtggtgacggagaacggaatgtacagatcgagatggctcacggaacaacgactctggcatttaaattccagcacggagttattgctgctgtagactccagggcctcggcgggttcttatattaactgccaatattgggagcggttactggccaaagagtgtcgcctttactatcttcggaatggtgagcgcattagcgtgtctgctgcatcaaaactcctgtccaatatgatgtgtcagtatagggggatggggctgtccatgggctcgatgatctgtgggtgggacaaaaagggccctggcctgtattacgtggacgagcatggcacccgcttgagcggaaacatgttttctacaggaagtgggaacacatacgcttacggcgttatggattcaggataccggcctaatttgtcacctgaggaagcatacgatcttggcaggcgtgccatcgcgtacgccacacaccgggactcctattctggcggagtggtgaatatgtaccacatgaaggaggacggctgggtgaaagtggagtccactgacgtgtcggatctgttgcaccaatatcgcgaagccaaccagtag

SEQ ID NO: 236540 - DNA, 759 bp, Artificial Sequence
  Description of Artificial Sequence: Synthetic coding sequence
atggcactccttgacgtctgtggagcccctcgcggacagagacccgaatcggctctccccgtcgccggtagtggcaggagatcggacccaggccactactcatttagtatgcgcagtcctgagctcgccctccctcgaggcatgcagcccactgaattcttccagtctctgggtggggatggggagcggaatgttcagatcgaaatggcccatggaacaacaactcttgcatttaaatttcagcatggtgtcatcgccgctgtggatagccgcgcatcggctgggagctatataaactgccagtattgggagagattgctcgcaaaggagtgtcgcctgtactatctgcgcaatggcgaacggattagcgttagtgccgcatctaagttactgagtaatatgatgtgtcagtacagaggcatggggctcagtatgggatccatgatttgcggttgggataaaaagggaccaggcctgtactacgtcgacgaacacggcacaaggctgtctggaaacatgttttccacaggatccggcaacacgtacgcatatggcgtcatggactctggatatcgcccaaatttgagccccgaagaagcctacgacctgggtaggagagcaattgcgtacgcaacccatcgagacagctatagtggaggagtggtgaacatgtaccatatgaaggaagacggttgggtgaaggttgagtctaccgacgtgtcagacctgcttcatcagtacagagaggctaaccagtag

SEQ ID NO: 236541 - DNA, 831 bp, Artificial Sequence
  Description of Artificial Sequence: Synthetic coding sequence
atggccctgctcgacgtatgcggtgctccgagaggtcagaggcccgagtccgccttaccggtcgccggttcaggtcggcgttctgatccagggcattactctttttctatgcgttcccctgagctggctttgcctcgcggtatgcagcctaccgagttcttccagtctctcgggggtgacggggaaagaaacgtccagatcgagatggcccacgggacaacgacactggcattcaagttccaacacggggtaattgctgccgtggactcccgagcctcagccggaagctatattagcgccttgcgggtgaacaaagtgattgaaatcaacccctatctgttgggcaccatgtcaggttgcgcagccgattgtcagtactgggaaaggttgctggccaaggagtgtcgcctctactacctgcggaacggggagcgcattagtgtctccgcggcttctaaactgctgagtaacatgatgtgccagtaccgcggaatggggctgtccatgggttcgatgatatgcgggtgggacaaaaaggggccagggctttattatgttgatgaacacggtacaaggctgtcaggtaatatgtttagcacaggaagcggaaatacgtacgcctacggggtaatggattcaggctacaggccgaacctgtcaccagaagaggcctacgacctggggagaagggccatagcctacgccactcacagggactcatacagtggcggagtggtgaacatgtaccacatgaaagaagatggctgggttaaagtagagtctacagacgttagcgacctgcttcatcagtatagggaagcaaaccaatag

SEQ ID NO: 236542 - DNA, 819 bp, Artificial Sequence
  Description of Artificial Sequence: Synthetic coding sequence
atgctaattggcactcctacccctagggataccaccccatctagttggttaacctctagcctcttggtcgaggcagccccactcgatgacaccaccctcccaacccccgtgtcatcagggtgcccagggctcgaacctactgaattttttcagtctctgggcggagacggcgaacgcaatgtccagattgagatggcacacggcaccaccacacttgcctttaaattccagcacggtgtgattgccgctgtggacagtcgggctagcgctgggtcatatatatcagcactgagagtaaacaaggtaatcgagatcaacccatacttgctgggcacaatgtcaggctgcgctgctgactgtcagtactgggagaggctcctggctaaagagtgtcgtctctattacctgaggaacggagagcggatctcagtgagcgcggcaagtaagctgttgagcaatatgatgtgtcagtaccgcggaatgggcttgtctatgggttctatgatatgtgggtgggataagaaaggccctggattatactacgtagacgagcatggcacccgcctcagcggaaatatgttttcgactggtagtgggaatacttatgcttatggggtgatggattcaggataccggcctaatttgagcccagaggaagcctatgacttggggaggagggccatcgcttatgccactcaccgtgattcttatagcggtggcgtggtaaacatgtatcacatgaaagaggatggatgggtgaaggttgaatccactgacgtatctgacttactacaccagtaccgggaagccaatcagtag

SEQ ID NO: 236543 - DNA, 819 bp, Artificial Sequence
  Description of Artificial Sequence: Synthetic coding sequence
atgttaataggtacgccaacacccagggacaccactccctcctcttggctcacatcttccctgctcgtggaagctgccccactggatgacacgactctgcctaccccggtgagtagtggatgcccaggtctggagcccaccgagtttttccaatctctaggtggtgacggagagcgaaatgtgcagattgagatggcccacggcactaccaccctcgccttcaaattccagcacggtgtcatagcagctgtcgattcaagagcttccgctggctcttacatctccgcactgagagtcaacaaggtgatcgagatcaacccatatttgctcggaaccatgtccggatgtgccgcagattgccagtactgggagcgcctgcttgcaaaggagtgccggctgtactacttgcgaaacggggagcgtataagcgtcagcgccgctagcaagctcttgagtaatatgatgtgtcaataccgcggaatggggctgtccatggggtcaatgatttgtggctgggacaagaagggtccagggctatactacgtggatgagcatggaactaggctatccggaaatatgttctccactgggtccggcaatacatacgcctacggtgttatggattccgggtacaggccaaacctgtccccagaggaggcctacgacttgggtaggcgcgcaatcgcgtatgctacgcaccgagattcatactccggtggggtcgtgaacatgtaccacatgaaggaggacgggtgggtcaaggtagaatctactgatgtgtccgacttgctacaccagtatcgtgaggctaatcagtag

SEQ ID NO: 236544 - DNA, 831 bp, Artificial Sequence
  Description of Artificial Sequence: Synthetic coding sequence
atggccctcctggacgtctgtggagcccctcggggacaacggccagaatccgcacttcctgtggccggttcgggaagacggtcggatccaggacattactctttcagtatgcgatctcccgagctggccttacccagaggcatgcagcccacagaattttttcaatcacttgggggtgatggtgagcgcaacgtgcagattgaaatggcgcatggtacgactacactagctttcaaattccaacatggagtgatagccgctgttgattcacgcgcttccgcgggaagctatatctcagcgttgagagtaaataaggtgatcgagatcaacccatatttattgggaaccatgagcggctgcgcagctgattgtcaatactgggagagattattggctaaggaatgcaggttatattatcttagaaacggagaaaggattagtgtcagcgcagctagcaagctcctctctaatatgatgtgtcaatatagaggcatgggcctgagtatgggatcgatgatttgcggctgggacaagaagggcccagggctttactacgtcgacgagcatggaaccagactctctggtaatatgtttagcaccggatcagggaatacgtacgcatacggggtcatggactccggttacaggccaaacctgtcccccgaggaggcctatgatctcggtcgacgcgcaattgcatacgccacccaccgggatagttacagtggcggagtcgtcaacatgtatcacatgaaagaagacgggtgggtgaaggtggaatctacggatgttagcgacttactgcaccagtaccgtgaggccaaccagtag

SEQ ID NO: 236545 - DNA, 819 bp, Artificial Sequence
  Description of Artificial Sequence: Synthetic coding sequence
atgctcattgggacgccaacccctcgcgacactacacccagcagttggttgacttcaagcttgttggtcgaagctgcgcctctggatgataccactctgccaactccagtttcaagcggctgtcctggcctggaacccacggagttctttcagagcctcggcggagatggcgagcgcaacgtgcagattgaaatggcccacggcacaaccacattggcatttaaatttcagcacggcgtgattgccgcagtcgatagccgggcatcagcagggtcctacatcagtgccctccgagttaacaaagtgatcgagattaatccctacctgctcggtaccatgtctggctgcgctgcagattgtcagtattgggaacgactccttgctaaggaatgccgattgtactacttgcgaaacggcgagaggatttcagtgtccgcagcaagtaaactgctgagcaatatgatgtgtcagtatcggggtatggggctgagcatggggtccatgatttgtggctgggataagaaaggcccaggcctctactacgtggatgagcacggcacaaggctgtcggggaatatgttcagcactgggagtgggaacacatacgcgtatggagtgatggattccggttacagacccaaccttagcccggaagaagcctacgacttggggagaagggcaatcgcctacgccacccacagggattcatacagtgggggagtggtaaacatgtatcatatgaaagaggacggctgggtgaaggtcgagtcgactgatgtgtccgatctgcttcaccagtacagggaggctaaccagtag

SEQ ID NO: 236546 - DNA, 831 bp, Artificial Sequence
  Description of Artificial Sequence: Synthetic coding sequence
atggctctgctcgatgtatgtggtgctcccagaggccaaagacctgagtctgctctccccgttgcagggagcgggaggcggagcgaccctggccattatagcttttctatgaggagtcccgaactggccctgcctcggggaatgaaaccaacagaattctttcaaagtttgggaggagacggggagcgaaatgtccagattgagatggctcacggcacaacaaccctggctttcaaatttcagcatggcgtgatagctgccgttgactctcgcgcttccgccggatcctacatcagcgccctgcgggtgaataaagtgatagagatcaatccatacctgctcggaacaatgagtggttgcgctgcggactgccagtactgggagagactgctggccaaagagtgccggttgtactacctgaggaatggagagagaattagcgtaagcgccgcttccaaactcctgtcaaatatgatgtgtcagtacagaggcatgggtctctctatggggtctatgatctgtggatgggacaagaagggccctggtctctactacgtcgacgagcatggtacgcggctgtcaggaaacatgtttagcacaggcagcggtaatacatacgcctatggagtcatggacagcggctaccgcccaaatttatctccagaggaggcttatgatctcgggaggcgggctatcgcatatgcaacacatcgggacagctacagcggaggagttgtcaatatgtaccacatgaaagaggatggatgggtgaaagttgaatccacagatgtttctgaccttcttcatcaataccgcgaagccaaccaatag

SEQ ID NO: 236547 - DNA, 759 bp, Artificial Sequence
  Description of Artificial Sequence: Synthetic coding sequence
atggccctcctggatgtctgcggcgcaccacgtggtcaacggcctgaatcagcattgcccgtggccggttctggccgtcgctctgacccgggtcattactcattctctatgcggagccctgagttggctctgcccaggggcatgcagcccactgaattcttccagagtcttggaggtgatggtgagagaaacgtgcagatcgagatggctcacggtactacaacattagctttcaagtttcagcacggcgtgattgccgctgtcgactcccgcgctagtgcgggtagttacataaattgccagtactgggaaaggctgctcgcaaaagagtgtcgactctattacttaaggaacggggaacgtatctctgtttctgcagcatcaaagttgctctccaatatgatgtgccaatacaggggcatgggcctttccatgggctcaatgatctgtggctgggacaaaaaaggaccaggtctctattatgtggacgagcatggaacgcgactttccggcaacatgttctccacaggatccgggaacacttatgcttatggggtaatggattctggatataggccaaatctcagcccagaggaagcttacgacttagggcgaagggcaatagcttatgctacgcaccgagactcatactccggcggtgtggtgaacatgtatcacatgaaagaggacgggtgggtcaaagtcgagagtacagacgtgagcgacctgctgcaccagtacagggaagccaatcagtag

SEQ ID NO: 236548 - DNA, 759 bp, Artificial Sequence
  Description of Artificial Sequence: Synthetic coding sequence
atggcactgttggatgtgtgcggcgctccacgtggccagcggcctgaaagcgctctgccggtcgcaggaagcgggagacgctccgaccctggccactacagcttctctatgaggtcacctgaactcgccctgcccagaggcatgcaaccgaccgagtttttccagtctctagggggagatggagagagaaatgtccagattgaaatggctcacggaacaaccactttggcctttaaatttcagcatggagtgattgcagctgttgatagtcgggcaagtgctggctcctacattaactgccagtactgggagaggttactggctaaggaatgtcgactgtactacctgcgcaatggagaacgtatctcagtgtcagccgcttccaagctcttgtcaaatatgatgtgccagtacagaggcatggggctgagtatgggaagcatgatctgcggttgggacaaaaagggcccaggcttgtattatgtcgacgaacacggtactcgcctgagtggaaacatgtttagtactggaagtggcaatacgtatgcctatggggtgatggacagcggatatcgtcctaatctcagcccagaggaagcctatgacctgggcaggagggcaatagcttatgccacccatcgcgattcatacagtgggggtgtggtgaacatgtatcacatgaaggaggacggctgggtgaaggtggaaagcactgacgtttctgatttactgcaccagtacagagaggccaaccagtag

SEQ ID NO: 236549 - DNA, 759 bp, Artificial Sequence
  Description of Artificial Sequence: Synthetic coding sequence
atggcccttctggacgtttgcggggcaccacgtgggcagaggcccgagtcagccttgccggtggccggtagtggtaggagatcggatccaggacactacagcttctcaatgcgcagtccagagcttgctctgccacgaggcatgaagcccactgaattcttccagtcccttggtggtgacggtgagaggaacgtccagatcgagatggcccacggcacaacaacccttgcttttaagtttcagcacggagtgatcgctgccgtagactctcgagccagtgctggcagctacattaattgccagtactgggagcgactgctggcaaaagagtgccgcttgtattatctgcgtaatggggaacggatctccgtgtcagcagcatctaaattactctcaaatatgatgtgtcagtaccgaggtatggggctttccatgggaagcatgatatgcgggtgggacaagaagggccctggattgtattatgttgatgaacatggtacccggctctcaggaaacatgtttagtacaggaagtgggaacacatatgcctacggcgttatggacagcggctaccggcctaacttatcccctgaggaggcatacgacctgggtcgtagagcaatagcctacgctactcatcgcgacagctatagcggcggtgtggtaaatatgtatcatatgaaggaagacggctgggtcaaagtcgagtcaaccgatgtaagcgatcttctccatcagtatcgcgaagccaatcagtag

SEQ ID NO: 236550 - DNA, 819 bp, Artificial Sequence
  Description of Artificial Sequence: Synthetic coding sequence
atgctgattgggacaccaactccgagagacactacacctagcagttggctgacgagctctctgttggtggaggccgctcctttggatgacacgactctcccaacgcccgtgagcagtggatgccctggtctggaaccaaccgagtttttccaaagcctcggaggggatggagagaggaacgtgcagattgagatggcccacggtaccactacgctggccttcaagtttcagcatggagtaatcgctgccgttgattcccgcgcaagtgcagggtcctatatcagtgcactgagagtaaacaaagtgattgagatcaacccctatttgcttggaacaatgtccggttgtgcagcagactgtcaatactgggagcggctccttgcgaaggaatgcaggctgtactatctgcgaaatggcgagagaatttctgtgagcgctgcgtcaaagctgctcagcaacatgatgtgccaatatcgaggaatgggcctgtcaatgggatccatgatctgcggatgggacaaaaaaggccctgggctatactatgttgatgaacacggaacaagattgtccggcaacatgtttagcaccggtagcggtaatacgtacgcctatggtgtcatggacagtggctataggcccaatctgagtcccgaggaagcttatgatctgggtcgaagagctattgcctacgctacacatcgggattcatacagcgggggagtcgtgaacatgtaccacatgaaggaggacgggtgggtcaaggttgaaagcaccgatgtgagcgacctgctgcatcagtatcgagaggctaaccagtag

SEQ ID NO: 236551 - DNA, 831 bp, Artificial Sequence
  Description of Artificial Sequence: Synthetic coding sequence
atggcactgttagatgtatgcggagcaccaagaggacagcggccagagagcgcgcttccagttgccggaagcgggaggcggagtgaccccggacactattcatttagtatgagatccccagaacttgccctgccgcgtggcatgcagcccacggaattctttcagtcactcggcggtgatggggagagaaatgtgcaaattgagatggcccatggcaccaccacactagcctttaagttccagcacggagttatcgccgctgttgactcccgcgcatctgccggaagctacatcagcgctctaagagtcaataaagtgatagagatcaacccctatctgctgggcacaatgagtgggtgcgcagccgactgccaatattgggagagactcctagctaaagagtgtaggttatactacctcaggaatggtgagcgtatatctgtgagcgctgcaagcaagttgctgtcaaacatgatgtgtcagtatcgaggcatgggcctgagcatgggtagcatgatctgcggttgggataagaagggacccggactgtactacgtggatgaacacggcactcggctttcaggaaatatgttttccacgggctccgggaatacctatgcatacggcgttatggattcagggtacagacccaatctgtcccccgaagaggcctacgacctggggcgaagggcgatcgcctacgccactcaccgtgattcttactctggcggagtggtgaacatgtaccacatgaaggaggatggctgggtgaaagtcgagagtaccgacgttagtgatctgttgcatcaatacagggaagccaaccagtag

SEQ ID NO: 236552 - DNA, 831 bp, Artificial Sequence
  Description of Artificial Sequence: Synthetic coding sequence
atggctcttttggacgtttgcggagctccccgaggtcagaggccggagtctgctctacccgtcgcgggatctggacgaagaagcgacccgggacactattccttttccatgaggagtccagagctggcattgccccgagggatgcagccaacagagtttttccagagtttagggggagatggcgaacgaaacgttcagatcgaaatggcacatgggacaactaccttggcttttaagtttcagcacggggttatcgccgcagtggatagccgggctagtgcaggttcctacatctctgccctgcgcgtgaacaaggtgattgagatcaatccatatctgctgggtactatgagcggatgcgccgctgattgccagtattgggagcgactactggcaaaagagtgtagactgtactatcttcgtaatggcgagagaatatccgttagtgcagccagcaagctgctgtccaacatgatgtgccagtatagagggatgggcctctccatgggcagcatgatttgcggttgggataagaagggtcccggtctgtattacgttgatgagcatggaacccggctcagtggaaacatgttcagcactggatccggaaacacatatgcatacggggtaatggactcagggtaccggccaaacctgtctccggaggaagcttatgatctggggcgaagagcaattgcctacgccactcatagagatagctattctggcggagttgtcaatatgtaccacatgaaagaagacgggtgggtcaaagtcgaatcgaccgatgtgtctgacttgttacaccaataccgcgaagccaaccagtag

SEQ ID NO: 236553 - DNA, 759 bp, Artificial Sequence
  Description of Artificial Sequence: Synthetic coding sequence
atggctctcctcgacgtttgtggagcaccaagaggacagcgcccagagtctgccctaccagtcgcaggttctggcaggaggagcgaccctgggcactactccttcagcatgagatcgcctgaactcgcccttccacgcggaatgcagccaacagagttctttcagtcattggggggagatggggagcggaatgtccagatcgagatggcccacggaacgaccaccctcgcgtttaagttccagcacggagtgatcgcagccgtcgattcccgcgcatctgctgggtcttacataaattgccagtactgggagcgtttgctcgccaaggagtgcagactttattacctgcgtaacggtgagaggatcagcgtgtcagccgcttcgaagctgctcagcaatatgatgtgccagtacagagggatgggtctcagcatgggttcaatgatctgtggctgggacaagaagggaccgggtctgtactatgtcgacgagcacggcaccaggctgtctggaaacatgttcagcactggctccggaaatacatacgcttacggcgtaatggattcaggctatcgtcccaatctgtctcccgaagaagcgtatgacctcgggagaagggccatagcatatgctactcatcgagactcgtattccggcggtgtcgttaatatgtaccatatgaaggaggacggatgggtaaaggtagaatctacggatgtctccgacctgctgcaccaataccgggaagccaatcaatag

SEQ ID NO: 236554 - DNA, 831 bp, Artificial Sequence
  Description of Artificial Sequence: Synthetic coding sequence
atggccctcctagacgtctgtggcgcacctcggggtcagagaccagagtccgctctgccagtagcaggaagtgggcgaaggagcgatccaggacattactccttctccatgcgctctcctgaactcgctctcccacgtgggatgcagcccacggagttctttcagagtctggggggtgacggggagaggaatgtgcagattgagatggcacacggcaccaccacgcttgcctttaagtttcagcatggggttattgcagcggtggacagtcgcgcatctgcgggttcatacatatctgccctcagggtcaataaagtaatcgagattaatccgtacctcctcggcaccatgagcggttgcgccgctgactgccaatactgggaacgtctcctggctaaagagtgtcggctgtattatttgaggaacggggagcgtattagcgtcagtgcggcatctaagttgctctctaacatgatgtgccaatacaggggaatgggattgagcatgggatccatgatatgcgggtgggacaaaaaaggacccggactttattacgttgatgagcatggtactcgcttaagcggaaacatgttctccaccgggagcggcaatacatacgcctatggagttatggactcgggctatagacccaatctcagtcccgaggaggcatacgacttagggcgtcgtgcgatcgcctatgccactcacagagatagctattcaggcggtgtcgttaatatgtatcacatgaaggaagacggttgggtgaaagtagagtctaccgatgtatcagatctactgcatcagtaccgcgaggctaaccagtag

SEQ ID NO: 236555 - DNA, 660 bp, Artificial Sequence
  Description of Artificial Sequence: Synthetic coding sequence
atgctgcgagcaggagcacctactggcgaccttccgagagccggagaagtccacactggaaccactatcatggctgtggaattcgatggcggtgtggtgatgggcagtgactcgcgtgtgagtgcaggcgaagctgtggtcaatcgggtgtttgataagttatctccattgcacgagcgaatatactgtgccctgagcgggagtgcggcagatgcccaagccgtagcagacatggccgcttatcagttagagcttcatgggattgagttagaagagcctcctctggtgctcgcagcagccaatgtcgtacggaatatctcttataagtatcgcgaggacctgagcgctcatcttatggtcgcgggatgggaccagagagaagggggtcaggtttatgggacactgggcggaatgctgacgaggcagccctttgctataggtggcagtgggtccactttcatatatggatatgtggatgcagcatataagcctgggatgagccccgaggaatgtcggagattcacgacagatgcgattgctctggcaatgtcgcgcgatggaagcagcggtggagtgatttatctcgttacaatcaccgccgcaggagtggaccaccgggttattttgggtaacgagctgcccaagttttatgacgaatag

SEQ ID NO: 236556 - DNA, 660 bp, Artificial Sequence
  Description of Artificial Sequence: Synthetic coding sequence
atgctccgtgctggggcacctactggcgacctccctcgcgctggcgaagtacacactgggactactatcatggctgtggagtttgatggcggtgtggtgatgggctctgatagccgggtctctgctggcgaggccgtggtgaaccgagtgttcgataaactgagtccacttcatgaaaggatatattgcgcactgtctgggtccgccgctgatgctcaggctgtcgcagacatggccgcatatcagctggaactgcacggcatcgagcttgaagaaccgccactggtcctggcagcagccaatgtggtgcggaacatctcgtacaagtatagagaagacttgtcagcccatcttatggttgcaggctgggaccagcgcgagggtggccaagtatatgggactctcggtggaatgttgaccagacagccatttgctatcggcggttctggaagcactttcatctacggttacgtagacgcagcgtacaagcccggtatgtcaccagaagaatgtagaaggttcaccactgacgccatcgcgctggccatgtccagggacgggtcctcaggcggtgtaatatatttggtcaccataaccgctgcgggtgtcgatcaccgcgtgattctcggaaatgaactacccaaattctacgacgaatag

SEQ ID NO: 236557 - DNA, 660 bp, Artificial Sequence
  Description of Artificial Sequence: Synthetic coding sequence
atgttacgagctggcgcaccaaccggagacctcccgagagcaggagaggtacacaccggaactaccatcatggccgtcgagttcgatggtggcgtcgtcatggggtccgacagtcgcgtgtcagcaggagaagctgtagttaatcgggtatttgacaaactgagccctctgcacgagcgtatctactgcgcgctctccggtagcgccgctgatgcacaagctgttgctgatatggctgcctaccagctcgaactgcacggaatcgagcttgaagagcctcctttagtcttggccgctgctaacgtagtaagaaatatctcttacaaatatcgggaggacctgtcagcacatttaatggtagctggttgggaccagcgagagggcggacaggtatatggtaccctcggaggcatgctgacacgccagccatttgcaatcggtgggtccgggagcacctttatctacggatacgtggatgcagcctacaagccagggatgagtcccgaggaatgtcggaggttcaccacagacgccatcgctctggccatgagccgcgatggatcttctggtggcgtgatctacctggttaccatcaccgccgctggagtagaccacagagtaatactcggaaatgaactgcctaaattctacgacgaatag

SEQ ID NO: 236558 - DNA, 591 bp, Artificial Sequence
  Description of Artificial Sequence: Synthetic coding sequence
atggcagtggagtttgatggaggagtagtcatgggctccgacagcagagtgagtgctggtgaggcggtagtgaacagggtgttcgataagttgagccctttgcacgagcgcatctactgcgccttaagcgggtcagcagccgacgcacaagcagtagctgacatggccgcttaccagctggaattgcacgggatcgagctcgaagaacctcctcttgtgctcgctgctgccaatgttgtgcggaacattagctataagtacagagaggacctgagtgcccacctcatggttgccggatgggaccagcgggaaggcggacaggtttacgggactctgggaggcatgttaacacgtcagccatttgccattggaggcagtggaagcacgttcatttacggttacgtagatgcggcatacaagccgggtatgagcccggaggagtgccgccgatttacgactgacgcaatcgcgctggccatgagccgggacggtagttctggaggagttatctatctggttacaatcactgccgctggcgtcgatcaccgggtgattctggggaacgagctaccgaagttctacgacgagtag

SEQ ID NO: 236559 - DNA, 537 bp, Artificial Sequence
  Description of Artificial Sequence: Synthetic coding sequence
atgcttcgggctggtgctcccaccggcgacttacccagggcgggtgaggtccatacagggacaacaataatggctgtggagttcgacggcggagtggtgatgggaagcgattctcgtgtatcggctgggatcgaactggaagaaccgcctttggtactggccgcagcaaacgtcgtgcggaacatttcttataaatatagagaagacctgagtgctcatctgatggtggccggatgggaccaaagggagggaggtcaggtgtatggcacgttgggagggatgctaaccaggcagcctttcgccataggaggatcaggctctacatttatatacggctacgtggacgcagcttacaaacccggtatgtctcccgaggagtgtagaaggttcaccacggacgctacttcgacaaagcgaagggtctgtgggtatttcctgaggacccagaagcgcgagaatcaaaaccagagggtccacgagtacatgtgtacaggggagagaagtttaagttctagccccctgctgtcctgctcctag

SEQ ID NO: 236560 - DNA, 591 bp, Artificial Sequence
  Description of Artificial Sequence: Synthetic coding sequence
atggccgtagagttcgacggaggagttgtgatggggtctgacagccgggtgagcgccggtgaggccgtcgtcaatcgtgtgtttgacaaactgagccccctgcacgaacggatatactgtgccctcagcggctccgccgctgatgcccaggccgttgcagacatggcggcttatcaactggaactgcacggcatagaacttgaagagcccccactggtgctggccgctgcgaacgtggtgcgcaacatctcttacaagtatcgcgaggacttgtccgctcacttgatggtcgcgggatgggatcagagggagggcggacaggtttacggcaccctcggtgggatgcttacacgccaacctttcgcgattgggggatccggatctaccttcatctatgggtatgtggatgcggcatacaagccagggatgtccccagaagagtgtcgaagatttacgaccgatgctattgccctcgcaatgtcacgagatggctctagtggcggagtcatctatctggtaacaatcaccgccgctggcgttgaccacagagtgatcctgggaaacgagctgcctaaattttacgatgagtag

SEQ ID NO: 236561 - DNA, 537 bp, Artificial Sequence
  Description of Artificial Sequence: Synthetic coding sequence
atgttacgtgccggtgcccctactggagacctccctagagctggagaggtccacaccggcaccactataatggcagtcgagtttgacggtggagtggtaatgggctcagatagcagggtcagcgcaggaattgaattggaggagcctcccctggtcttggcagctgctaatgtagtaaggaacatcagctataaatatagagaggacctaagcgcccacttgatggtcgctggctgggatcaacgggaagggggtcaggtctacgggaccctgggaggaatgctgactcggcagccgtttgcaatcgggggttcaggctccactttcatttatggttacgtggacgctgcttacaagcctggcatgtcccccgaggaatgtaggcgcttcacaacagatgctacttctaccaagcgtagagtctgtggatatttcctgcgcacacagaaaagagaaaatcagaaccaacgcgtgcacgagtacatgtgtaccggggaacgctctctgagttctagtcctctgttgtcttgttcttag

SEQ ID NO: 236562 - DNA, 591 bp, Artificial Sequence
  Description of Artificial Sequence: Synthetic coding sequence
atggccgtggagtttgacgggggagttgtcatgggatctgactcgagggtcagtgcaggcgaggctgttgttaatagagtgttcgataagttatcccccctgcacgagcggatctattgcgccctgtctgggtccgcggctgacgcacaggctgtggcagatatggccgcataccaactggagctccacggcatcgaactggaggaaccgcctctcgtacttgccgctgcaaatgtagtgcgcaatatcagttataagtacagagaggacctgagcgcccacctgatggtggccggatgggaccagcgggagggcggtcaggtgtacggaacgctgggcggtatgctgactcgacagcccttcgccattggcggatccggctctacctttatatacggttacgtggacgccgcatataagccaggtatgtcccccgaagaatgtcgcagattcacaacagacgccattgccctggccatgagcagggacggatcgtcaggcggagtgatataccttgtcacaatcacagcagcaggcgtcgaccacagagttatattgggaaacgagctcccgaagttctacgacgagtag

SEQ ID NO: 236563 - DNA, 537 bp, Artificial Sequence
  Description of Artificial Sequence: Synthetic coding sequence
atgctcagagccggagcccctaccggcgatctgccacgtgcgggagaggtgcacaccggtaccactataatggctgtagaattcgacgggggagtggtcatgggctctgactccagggtcagtgccggtattgagttggaggaaccacctttagtactggccgctgccaatgttgttcggaatataagttacaagtatcgcgaagacctcagtgctcaccttatggttgccggatgggatcagcgggagggtggccaagtctatggaaccctcggtggcatgcttacaagacagccattcgctatcggcggaagcggatccacattcatatacggatatgtcgatgctgcatataagcctgggatgtcccccgaggaatgccgccgtttcactacagatgcaacgtccacaaagcgaagggtctgcggctacttcctgaggacccagaaacgtgagaaccagaaccaacgggttcacgaatatatgtgtaccggcgaaagatcactttcttctagcccgctcctttcctgctcatag

SEQ ID NO: 236564 - DNA, 396 bp, Artificial Sequence
  Description of Artificial Sequence: Synthetic coding sequence
atggccgttgaatttgacgggggtgtggttatgggaagcgacagcagagtgagcgcgggtgaggcagtggtgaacagagttttcgacaaactgtcacccctacatgagaggatatactgtgcacttagcggctctgccgctgatgcccaggcggttgccgacatggcggcttaccaactcgagctccacggcatcgagctggaggaacctcctctggtgcttgccgcagcgaacgtggtgcgcaacatatcctacaaatacagagaggatctgtctgcccacttgatggtggcaggatgggaccagagagagggtggtcaggtatacggaacattggggggaatgctgacacggcagccttttgccattgggggatcgggtagcacttttatctag

SEQ ID NO: 236565 - DNA, 396 bp, Artificial Sequence
  Description of Artificial Sequence: Synthetic coding sequence
atggctgtggagttcgatggtggggtggttatgggctcagacagccgcgtgtccgctggagaagcagtggtcaacagggtatttgataaattgagcccactgcacgaaaggatctattgcgccctcagcgggagcgcggcagacgctcaggcggtagcggacatggctgcctatcagctcgagcttcacggcattgagttagaagagcctcccctggtactggccgcagctaatgtggttcggaatatatcctataaatatcgggaagacctctctgctcatcttatggtcgctggatgggaccagagggagggcggacaggtgtatgggaccctaggcggaatgctcacaagacagccttttgccataggcggatctggcagcactttcatctag

SEQ ID NO: 236566 - DNA, 396 bp, Artificial Sequence
  Description of Artificial Sequence: Synthetic coding sequence
atggccgtggagttcgatggtggcgtggtcatgggaagtgactccagggtatcagccggagaagccgtcgtcaaccgggtgttcgacaagctgtctcccctgcatgagagaatctattgcgcattaagtggttccgctgccgatgcacaagccgtggctgacatggcagcctaccagcttgagctccacggcatcgagttagaagagccaccccttgttctcgccgcagctaacgtggtccggaacatctcatacaaataccgagaagatctctcagcccacctcatggtcgctggctgggaccagagagaaggcggtcaagtttatggcacactcggcggtatgctaactcgccagccatttgcaattggcggtagtgggtcaacatttatttag

SEQ ID NO: 236567 - DNA, 396 bp, Artificial Sequence
  Description of Artificial Sequence: Synthetic coding sequence
atggcagtagaatttgacggcggagtggtcatgggatcagatagtcgagtgtccgcaggagaggctgtggttaatagagtgttcgacaaattgagccccctgcatgaacggatatactgcgccctcagtgggtccgcagctgacgctcaagccgtagccgacatggcggcatatcagcttgagctgcatgggatagagctcgaggagccccctttggtattggctgctgctaatgtggtaagaaatatcagctacaagtaccgggaagatctttccgcccacctgatggtggccggatgggatcagcgcgagggcggtcaggtctacggaacactaggaggcatgctgacccggcagcctttcgcaatcgggggttctggaagtacttttatttag

SEQ ID NO: 236568 - DNA, 537 bp, Artificial Sequence
  Description of Artificial Sequence: Synthetic coding sequence
atgttaagagcaggcgcacccacaggcgatctgcccagggccggagaggtgcacactgggactacgattatggcagttgagtttgatggaggggtagttatgggatctgactctcgggtgtctgcaggcattgagcttgaagaaccccctcttgtgctcgcagccgctaatgtggtacgaaacatcagttacaagtatcgagaagatttgtcagctcacctcatggtggccggatgggatcagcgagagggaggacaggtatacggtactcttggcggaatgctcacgagacagcctttcgcaatcggtggctcggggtctacctttatttacggttacgtggacgcggcatacaagccaggcatgagtccagaggagtgcagaagatttaccacagacgccacatctacgaagcgccgagtgtgtggctattttcttaggacgcagaaaagggagaaccagaatcaaagggtgcatgagtatatgtgcacttctgagcgctcactgtcttcctcccctttactgtcatgttcctag

SEQ ID NO: 236569 - DNA, 396 bp, Artificial Sequence
  Description of Artificial Sequence: Synthetic coding sequence
atggccgtcgagtttgacggaggtgttgtgatgggaagcgatagccgggtgagcgcaggggaagccgttgtaaacagagtgtttgacaaactgtctcctctgcatgagcacatttattgcgcattgtccggttctgccgcagacgctcaggcagtagcagatatggcagcctatcagttagaactgcatggcatcgagttggaagagcctcccttggtgcttgccgctgctaatgtggttaggaacatttcatataaatatcgagaagacctgagtgctcatctcatggtcgccggatgggaccaaagagaggggggtcaggtttacggaacgctgggcggaatgcttactagacagccatttgcgattggaggaagcggctctactttcatctag

SEQ ID NO: 236570 - DNA, 591 bp, Artificial Sequence
  Description of Artificial Sequence: Synthetic coding sequence
atggcagtcgagttcgacggcggagtcgtgatgggctccgacagccgggttagcgctggagaagctgtggtcaatagggtgtttgataagctgagcccccttcacgaaaggatatattgcgctttgagcgggagtgccgctgacgctcaggccgttgccgacatggctgcatatcagcttgagctgcatggcatcgaactggaggaaccgccactggtgctggccgctgccaatgtcgtcagaaatattagttacaagtaccgcgaggacctctcagcacatctaatggtcgctgggtgggaccagagagaaggtggtcaggtgtacggaacactgggcggtatgctgacaagacagccattcgcaatcggcggatccggatctacattcatctatggatatgttgacgcagcctacaaaccgggtatgtccccagaagagtgtcgcagatttaccaccgatgctatcgctctggcaatgtccagggatggaagttccggaggcgtcatatatctggtgaccattaccgcagcgggtgtagatcacagggtcatcctcgggaacgagttacctaagttttatgatgagtag

SEQ ID NO: 236571 - DNA, 660 bp, Artificial Sequence
  Description of Artificial Sequence: Synthetic coding sequence
atgctccgcgcaggggctccaaccggtgatttaccacgcgctggggaggtccacactgggacgaccatcatggccgtcgaatttgacgggggtgtcgtgatgggttccgacagcagagtttccgccggagaggctgttgtgaatcgcgtttttgataaactctcacctcttcacgaacgcatctactgtgccctcagcggaagcgcggcagacgcacaagctgtggccgatatggccgcttatcaactggagctgcacggaattgagttggaagaaccgcctctagtccttgccgcagcaaacgtcgtgaggaatatcagttataagtaccgagaggacctgtcagcacacttaatggtcgctggctgggatcagagggagggcggtcaagtatatgggaccctcggcggtatgctcaccaggcagcccttcgccatcggaggctcggggtccactttcatctacggctacgtagacgcagcctacaagcccggaatgagtccagaggaatgtaggcgattcacaactgatgctatagccctcgcaatgtcccgggatggctcatcaggcggagtcatctacttggtgaccataacagccgcaggggtggatcacagggtgattctgggtaacgaactccctaagttctacgatgagtag

SEQ ID NO: 236572 - DNA, 591 bp, Artificial Sequence
  Description of Artificial Sequence: Synthetic coding sequence
atggccgtggaattcgacggaggtgtggttatgggatcggactcacgggtaagcgccggagaagcagtcgtgaatcgagtgttcgataaactcagtccgcttcatgaacatatttactgcgcactgtccgggtccgctgccgacgctcaggccgtggcggacatggcggcatatcaactggaattgcacggcatcgagctggaggaaccgccactggtgttagccgctgccaatgtcgtaagaaatatatcttacaaatatcgggaggacctttctgcccacctgatggttgctgggtgggatcaaagagaggggggacaggtgtacggaactctgggcggaatgctcacaaggcagcccttcgctattggcggaagcggaagcaccttcatttacggttacgtggacgcagcctataaaccagggatgtcgccggaagaatgcaggaggttcaccacagacgccatcgctctggctatgagccgagatggaagtagcggcggtgtaatctacctggtaaccataaccgccgctggcgtcgatcacagagtcatcctgggcaatgagctacctaaattttacgatgagtag

SEQ ID NO: 236573 - DNA, 537 bp, Artificial Sequence
  Description of Artificial Sequence: Synthetic coding sequence
atgttgagagcgggtgctccgaccggagatcttccaagggctggtgaagttcataccggtacaactattatggcagtcgaatttgatgggggagtggtgatgggatcagatagccgggttagcgccggtattgagcttgaagagccccctctggtgttagcggctgccaatgtggtgcgcaacattagctacaagtacagggaagacctgtcagcccatctgatggtggctgggtgggatcaacgcgagggagggcaggtttatggaaccttgggcggaatgcttacccggcaacccttcgctatcggaggttcaggttctacattcatctacggttacgtggacgccgcatacaaacctgggatgagccccgaagaatgtagaaggttcactaccgacgcaacctctaccaaaaggagggtctgtggatatttcctgagaacccagaaacgagagaatcagaatcagcgcgtgcacgagtatatgtgtacatcggaaaggtctttgtcctcatcacctttactaagctgctcctag

SEQ ID NO: 236574 - DNA, 537 bp, Artificial Sequence
  Description of Artificial Sequence: Synthetic coding sequence
atgttaagggcaggtgcccctacaggggatctccctagggcgggagaggtacacaccggaaccaccatcatggcagtcgaattcgacgggggagtggtgatggggtcagattcccgggtctcagccggtatcgagcttgaagagccccctttggtcttggctgccgctaacgtggtcagaaatatcagctacaaataccgcgaggacctcagtgcccatctcatggtcgccggatgggaccagagagaaggaggtcaggtatacgggaccctcggtgggatgctgacacggcagccgttcgcaatcgggggtagcggctccacatttatctatggatacgtggatgctgcttacaagcctgggatgtcacctgaggagtgtcggagattcacgacagacgctacaagcaccaaacgaagggtgtgtgggtactttttgcgaacccagaaacgtgagaatcaaaatcagcgcgtccatgagtatatgtgtacaagcgagaggtctttgagtagtagtcctttgctcagctgttcttag

SEQ ID NO: 236575 - DNA, 660 bp, Artificial Sequence
  Description of Artificial Sequence: Synthetic coding sequence
atgctgcgcgcaggcgctcccactggagacctccccagagccggtgaggtgcatacaggcactacaattatggctgtggagtttgatgggggagttgtgatgggatccgactcaagagtgagcgctggcgaagccgtggtgaatagagtatttgataagctgtctccccttcatgagcacatctattgcgccctatctggttcagcagctgacgcccaggccgtggctgatatggccgcataccagctcgagctccacggcatcgaacttgaggagccgccactggtgctggctgctgctaacgtggtgcgcaacatcagttacaagtatcgcgaggacctgagcgctcatttaatggtcgccggatgggatcaacgcgagggcggtcaggtgtatggaacactaggaggcatgctcactcgccagcctttcgcgatcggaggtagtgggtcaactttcatctacgggtacgttgacgctgcttacaaacccggaatgtctcctgaggaatgcagacgatttaccaccgatgccatcgcccttgccatgagccgcgacggctcatccggaggggtgatttacttagttaccattactgctgccggagttgatcatcgcgtcattttgggcaatgagttgcccaaattttacgacgaatag

SEQ ID NO: 236576 - DNA, 591 bp, Artificial Sequence
  Description of Artificial Sequence: Synthetic coding sequence
atggcggtagagttcgatggaggcgtcgtcatgggatctgatagcagagtgagcgcgggagaggccgttgtgaaccgcgtgttcgataaattgtcacctctgcacgagcacatctattgtgcgctgtccgggagcgcagcagatgctcaagccgttgccgacatggccgcataccagttagagctgcatggaattgagcttgaggagccacccttggttctagctgctgccaacgtggtgagaaacatcagttataaatatcgggaggatttatctgcgcacctgatggtggccggttgggaccagagagaagggggacaggtgtacggcacactcggcggtatgttgacccggcagcccttcgctattgggggaagtggatctacattcatatatggttatgtggacgctgcctacaagccaggtatgagcccagaggaatgcagacgatttacaaccgacgccatcgccctcgcaatgtctagagacggatcaagcggcggtgttatttatctggtgactattaccgcggcaggagtggaccatagggttatcctcggaaacgagctgccgaagttttatgatgaatag

SEQ ID NO: 236577 - DNA, 660 bp, Artificial Sequence
  Description of Artificial Sequence: Synthetic coding sequence
atgttacgcgcaggggcacctaccggtgacctcccacgcgcaggagaggtgcataccggaacaacaattatggccgtggaatttgacggcggagtggtaatgggatccgactcccgcgtatccgccggagaagccgtcgtcaaccgagtcttcgataagctcagccccctacatgagcacatctactgtgctctgtccgggtccgccgctgacgcccaggctgtagccgacatggccgcttatcaacttgagctgcacggcatcgaactggaggaacctccactggtcttggcagccgctaatgttgtccggaacatcagctacaaatatagagaagatctgagcgcccacctgatggtggctggttgggatcaacgggagggcggacaggtttatggcacactagggggtatgctgacccgtcagccctttgctatcggaggcagtggaagtactttcatctacggctatgtcgatgctgcctacaaacctggcatgagtcctgaggagtgcaggcgtttcactaccgatgctattgccctggccatgtctagagatggttcctccggcggagttatatatttagtaaccataacggccgctggcgtggaccaccgcgtaattctgggaaacgagctccctaagttttatgatgaatag

SEQ ID NO: 236578 - DNA, 396 bp, Artificial Sequence
  Description of Artificial Sequence: Synthetic coding sequence
atggccgttgaatttgacggtggtgtggtgatgggaagcgacagccgcgtcagcgctggggaggccgtagtgaaccgggtgttcgataaactatctccactccatgaacgaatttactgtgccctatcgggcagcgctgcagatgcccaggctgtggctgatatggcagcttatcagctggagctccacggaattgagctggaggagccacctctggtattagccgctgccaacgttgtgcgtaacattagctacaaatatagagaggacttatccgcccacctcatggtcgcgggatgggaccagcgtgagggtgggcaagtttatgggacactcggaggaatgctgacgagacagccctttgcaattggcggatccggttctacatttatctag

SEQ ID NO: 236579 - DNA, 396 bp, Artificial Sequence
  Description of Artificial Sequence: Synthetic coding sequence
atggctgtagaattcgacgggggtgtagtgatggggagcgattctcgggtcagtgctggcgaggcggtggtcaaccgcgtctttgacaagttgagtcctctgcacgagcatatctattgtgctctctctgggagcgccgctgacgcacaggctgtggccgacatggccgcttatcagctcgaactgcatggcatcgagcttgaggagccaccactagtgttggcagcagccaacgtggtgcggaatatctcatacaagtatagggaggacctgtcagcacatctgatggtcgctggctgggatcagagggaaggcggacaggtttatggcacgcttggcggtatgctaactcgccaaccatttgccatcggaggctcaggatctacattcatctag

SEQ ID NO: 236580 - DNA, 591 bp, Artificial Sequence
  Description of Artificial Sequence: Synthetic coding sequence
atggccgtggagttcgacgggggtgtagtgatgggcagtgactcccgggtgagcgccggtgaagcggtcgtgaacagagtgttcgacaagctatcgccgctgcatgagcatatttactgcgcgctgtccggctcagccgcagatgctcaagctgttgctgacatggccgcataccagcttgaactgcatgggattgagctggaggagcccccactggtactagccgctgcaaacgtggttagaaacatttcctataaatatagggaggatttatcagctcatctgatggttgccggatgggatcagcgcgaaggcggacaagtatacgggacgttagggggaatgttaaccagacagccatttgctatcggcggtagcggcagtacctttatctacggctatgtagacgcagcttataagccaggaatgagtcctgaggaatgcaggcgctttacaaccgacgccatcgctctagctatgtcacgggacggcagctccgggggtgtaatttacctggtcactataacagccgctggagtcgaccatagggttatcttgggaaatgaactacccaagttctatgacgagtag

SEQ ID NO: 236581 - DNA, 660 bp, Artificial Sequence
  Description of Artificial Sequence: Synthetic coding sequence
atgctccgggcaggtgcccctacaggagacctgccacgcgcaggcgaagtgcatacaggcacaacaatcatggccgtcgagttcgacggcggagtggtcatgggctcggattctcgggtgagcgcgggagaggccgtagtcaatagagtgtttgataagctgtctccgctacatgagagaatctactgtgcactgtctggctcagccgcagacgcacaggcagtggctgacatggcagcctatcagcttgagttacacggcattgaactggaggaacctccacttgtcttagccgctgccaatgtggtccgcaatataagttacaaatatcgcgaggatctcagcgcccacctcatggtggccggatgggatcagcgggagggtggccaggtttatggaacactgggagggatgttaacgcgccagccttttgctatcgggggatctggctccaccttcatatatggatatgtggacgccgcatataagcctgggatgagtcccgaggagtgccggaggtttaccacagatgcaattgcgctcgctatgagcagagacggatcctccggaggtgtgatttacctggtcactattacagccgctggagtggatcatagagtcatccttggaaatgaactgcctaagttctacgatgaatag

SEQ ID NO: 236582 - DNA, 537 bp, Artificial Sequence
  Description of Artificial Sequence: Synthetic coding sequence
atgctcagggctggggcacccaccggcgacctccctcgggcaggagaggttcacaccggcactaccattatggctgtcgagttcgatggcggtgtggtcatgggaagtgatagtagagtatccgccggtatcgagcttgaggagcctcccctggtgctagctgccgctaatgtggtccgtaacatttcctataagtacagagaagacctcagcgcccaccttatggtcgccggttgggatcaaagggaggggggtcaggtctacggcacactagggggaatgttgacaagacagccattcgctatcggaggctctggctccactttcatctatggctatgtggacgccgcatataaaccgggaatgtcccctgaagaatgcaggcggtttaccacggatgcaaccagtacaaaacggcgagtctgcggctacttcctgcgcactcagaagcgggagaaccagaatcagcgcgtgcatgaatacatgtgcaccggcgaacgatctctgtccagttctccattgctgagctgctcttag

SEQ ID NO: 236583 - DNA, 537 bp, Artificial Sequence
  Description of Artificial Sequence: Synthetic coding sequence
atgttgagagcaggtgcacctacaggtgatctgcccagggctggagaggtacacactggtacaacaattatggccgtcgagtttgacggaggcgtggttatgggatcagactcaagagtgtcagcaggcatcgagctggaagaacccccactcgtgctggcagctgctaacgtggtacggaacatttcttataaatacagagaggatctaagcgctcacctgatggtagctggatgggatcagcgtgaaggaggtcaggtgtatggaaccctagggggtatgctgactcgtcagccgttcgctatcggcggatcagggtccacctttatttatggctacgtggatgccgcatataaacctggcatgtctcccgaggagtgtcgacggtttacaacggacgcgacaagtaccaagcggcgtgtttgcggctattttcttagaacccagaagcgggaaaatcagaatcagagagtccatgaatacatgtgcaccggggagcgatccttgagttcaagccccttgctgagttgctcttag

SEQ ID NO: 236584 - DNA, 591 bp, Artificial Sequence
  Description of Artificial Sequence: Synthetic coding sequence
atggccgttgagttcgatggcggagtcgtgatgggctcggactcaagggtgtccgctggggaggccgtcgtgaatcgggtgttcgataaattgtccccgttacatgaaaggatctattgtgccctgtctggctccgccgctgatgcacaggcggttgccgatatggcggcttatcagctggaattacatggcattgaactagaggagccaccacttgtgcttgcagcggcaaacgttgtgcgtaatattagttacaaatacagagaggatctatctgcccacctgatggtcgccggatgggatcagagggagggcggacaagtttacggaaccctgggcggaatgctgaccaggcagcccttcgccatcggcggatcaggatcaacctttatctacggttacgtcgatgccgcttacaaacccggaatgtcaccagaggaatgtcgtagattcacaacagacgccatcgccctcgccatgagccgggacggcagttctggaggtgtcatttatctggtgaccatcactgcagctggagtcgatcacagggtcatcctgggaaacgagctcccaaaattttacgacgagtag

SEQ ID NO: 236585 - DNA, 660 bp, Artificial Sequence
  Description of Artificial Sequence: Synthetic coding sequence
atgctgcgcgctggtgccccaaccggcgaccttcccagagctggcgaggtacacaccgggaccacaattatggccgttgaattcgacgggggtgtggtcatgggcagtgacagcagggtatctgccggagaagcagtggtaaatcgcgtgtttgacaagctgtccccactacacgaacacatatattgcgcccttagtggtagtgcggcagatgcacaggcagtggccgatatggctgcataccaactagagctgcatggtatcgaattggaagaaccccctctggttctcgctgcagcaaacgtggtgcgcaatatctcgtacaaatatcgcgaagatttatccgcccacctcatggtcgccggatgggaccagagggagggagggcaggtgtatggcacactaggtggcatgctgactaggcagccattcgctatcggtggatcgggtagtactttcatctacggttacgtggatgccgcttacaaacccggaatgagcccagaggagtgtcgaaggtttactaccgatgccatagccctggctatgtcccgggatgggtcctcaggcggagtcatctaccttgtaaccatcacggccgcaggcgtggaccatcgtgtgatcctgggcaatgaactgcctaagttttatgacgaatag

SEQ ID NO: 236586 - DNA, 465 bp, Artificial Sequence
  Description of Artificial Sequence: Synthetic coding sequence
atgcttagagccggtgctccgacaggggatctgcctagggctggagaggtacacactggaaccactattatggcggtcgagtttgatggtggtgtggtgatgggatccgactctcgtgtgagcgcgggtatcgagctggaggagccaccgcttgtcctggcagcagctaatgtggtgcgtaacatttcctacaagtatagggaggacctgtctgctcatctcatggtcgccggatgggaccagcgagagggtggtcaggtgtacggtactctgggcggaatgctgactaggcaaccattcgccatcgggggtagtggctcaacctttatctacgggtacgtcgatgcggcttataaaccgggtatgagtcctgaagaatgcaggcgattcactaccgacggaaaccagccgagtggacgagtccctggcgaaggttttgaaacgtgggaggggtcccggctgtag

SEQ ID NO: 236587 - DNA, 396 bp, Artificial Sequence
  Description of Artificial Sequence: Synthetic coding sequence
atggccgtggagtttgacggcggtgtggtgatgggatcggattctcgcgtgagcgctggcgaggcggtggtcaaccgggtgtttgataagctgagtcctctccatgagcatatatattgcgctttgagcggttctgctgcggacgctcaggctgtggctgacatggcagcgtaccagctggagctgcatgggattgagctggaggaacctcctcttgtgctggcggctgcaaatgtcgtaaggaacatctcatataaatatcgggaagatttgtcagcacatctgatggtagccggatgggatcagcgggaagggggtcaggtgtacggcaccctaggagggatgttgacaaggcaaccatttgcaattggaggttccggaagtacctttatttag

SEQ ID NO: 236588 - DNA, 465 bp, Artificial Sequence
  Description of Artificial Sequence: Synthetic coding sequence
atgctgagggctggggcaccaactggagacctgccccgtgccggtgaagtccataccggcacaacaattatggctgtggaatttgatgggggtgtggtaatgggctctgactctcgggtgtccgcaggcatcgagctggaagagcccccactcgtgctggcagccgcaaacgtcgtgagaaacatttcctacaagtaccgcgaagatctgtctgcccacttaatggtagcaggctgggaccagagagagggcggacaggtgtacggtaccctgggcggtatgctcaccaggcagccttttgccattggtggcagtggatctacctttatttacggatatgtggatgctgcttacaaaccagggatgagtcctgaagaatgcagaagattcaccactgatgggaatcagccaagcggcagagtgccaggcgaagggttcgagacttgggagggctcccggctgtag

SEQ ID NO: 236589 - DNA, 465 bp, Artificial Sequence
  Description of Artificial Sequence: Synthetic coding sequence
atgctgcgggctggtgcacctacgggagacctgcctagggccggagaagtccataccggtacaactataatggctgtcgagtttgatggcggagtggtgatgggctctgattccagggttagcgcgggaattgagcttgaggaaccccctctcgtcttagcggctgctaacgtcgtgaggaatatttcttataaataccgggaggatctgtctgcccacctcatggttgccggatgggaccaaagggaaggaggacaagtgtacggtacccttggtggcatgttaacacgtcagccattcgccattggagggtctggttctactttcatctacggctacgttgatgctgcatataaacctggtatgagccccgaggaatgcaggcgattcacaacggacggaaaccagccctctggcagagttcctggagagggctttgaaacgtgggagggctcccgattgtag

SEQ ID NO: 236590 - DNA, 465 bp, Artificial Sequence
  Description of Artificial Sequence: Synthetic coding sequence
atgcttcgcgcaggagcaccaacgggagatcttcctagggccggtgaggtccacacaggtaccactatcatggctgtcgagtttgacggcggagtagtaatggggagcgattccagggtaagtgccggaatagagctggaagaaccaccactcgttctggcggcagccaatgttgttaggaatatttcatataagtaccgggaggatctgtctgcccacttgatggtggcaggctgggaccagcgggagggaggtcaagtgtatggcaccttaggtggtatgctgacccggcaaccctttgccatagggggttccggcagcactttcatttacgggtacgttgatgctgcttataagccgggaatgagccctgaggagtgtcgccgattcaccacagatggcaaccaaccctcaggcagggtgccaggtgaggggttcgaaacctgggagggatctagactgtag

SEQ ID NO: 236591 - DNA, 465 bp, Artificial Sequence
  Description of Artificial Sequence: Synthetic coding sequence
atgctgagagccggtgcaccaaccggcgatctcccacgggctggtgaagtgcacacgggcactacaatcatggctgtggaatttgatgggggagtcgtgatggggtcagatagccgggtaagtgcgggaatagagctcgaggaacctccactcgtcctggccgctgcaaacgttgtgcgcaatatttcatacaagtatagagaggacctctctgctcaccttatggtggcaggatgggaccagcgggaagggggacaggtctacggcacgcttggtggaatgctgacacggcaaccatttgccattggcggaagcgggagtacatttatatatgggtacgtggacgccgcttacaaacccggaatgtcccccgaggaatgccgaaggtttacaacagatggtaatcagcctagtggacgggtgcctggcgaaggttttgagacctgggagggctctcggctttag

SEQ ID NO: 236592 - DNA, 465 bp, Artificial Sequence
  Description of Artificial Sequence: Synthetic coding sequence
atgcttcgggcaggcgctcctacaggtgatctccctcgcgcaggcgaggtccacaccggtaccacgattatggccgtggagttcgatgggggagtcgtgatgggctccgactcaagagtcagtgccggaatcgagctggaagagcctcccctggtgctggccgctgcaaatgtagtgcgaaatatcagctataaataccgcgaggacctgagtgcacatctcatggtggccggttgggaccagcgcgaaggaggccaggtttacggcacacttgggggtatgcttacgcgtcagccgttcgcaattgggggtagtggatcgacgttcatctacgggtatgtggatgcggcatataaacccggaatgtctccagaagaatgcagacggttcaccacagacggtaatcagcccagcggacgcgtccctggtgaagggttcgagacttgggagggctcaaggctgtag

SEQ ID NO: 236593 - DNA, 465 bp, Artificial Sequence
  Description of Artificial Sequence: Synthetic coding sequence
atgctgcgggctggagctcctaccggcgacttaccaagagctggagaagtgcacactggaaccactatcatggcagtcgagttcgatgggggtgtggtgatgggatcagatagcagagtgagcgccggaatcgaattggaggagccccctttggtgctggccgcagccaatgtggtgcgcaatattagctacaagtaccgagaagatctcagtgctcacctgatggtagcgggttgggatcagagggagggcggacaggtgtacgggactctgggtggcatgctgactcgccagccattcgccatcggtggttctggatctacattcatttacggttatgtagacgcggcatataaaccaggtatgagccctgaggagtgtcgcaggttcaccaccgacggcaaccaaccgtccggaagagtgccaggggagggttttgagacatgggaaggatcccggttgtag

SEQ ID NO: 236594 - DNA, 465 bp, Artificial Sequence
  Description of Artificial Sequence: Synthetic coding sequence
atgttacgggctggcgcaccaaccggagatctacccagagctggcgaggtgcacacaggtacaactatcatggcagtcgaattcgatggaggtgtggtgatggggagcgattcccgcgtcagcgccggtattgaactggaggaacctcctctcgtcctggcagcggctaacgtggtacggaacataagctacaaataccgcgaggacctgagcgcacatctgatggtggccggatgggatcagcgggagggtggccaggtgtatggaacccttgggggaatgttaacacggcaacccttcgcaatcggcggaagtggcagcacgttcatttacgggtacgttgacgcagcatacaagcctggaatgtcaccagaggaatgtcggaggtttaccacagacggaaaccagcctagtggtcgagtgcctggcgaaggctttgagacgtgggagggttcacgcctatag

SEQ ID NO: 236595 - DNA, 426 bp, Artificial Sequence
  Description of Artificial Sequence: Synthetic coding sequence
atgaatgcccgtgggttgggctctgagctgaaggactccatcccggtaactgagttgagcgcctctggccctttcgagtcacacgatttgcttagaaagggattctcctgtgtgaagaacgaacttctcccatcacacccattggagctctctgagaaaaactttcagctgaaccaagacaaaatgaactttagtacactacgcaacattcaagggttgtttgccccacttaagcttcagatggaattcaaggcagtacagcaggttcagaggttaccctttctgtcctcctctaatctgagcctggatgtcctccggggaaacgacgaaactatcggatttgaagacatcctaaacgatccaagtcagagcgaggttatgggcgaaccacaccttatggtcgagtacaaactcggactactgtag

SEQ ID NO: 236596 - DNA, 471 bp, Artificial Sequence
  Description of Artificial Sequence: Synthetic coding sequence
atgccaatggccggactcttgaagggactggtcaggcagcttgaacggttttccgttcagcaacaagcttctaagatgccccctaagggcaaatcaggctccggtaaggcaggcaagggtggagcagccagcggatccgacagcgccgacaaaaaagctcagggccctaagggcggaggtaatgccgtaaaggtgaggcacattctctgcgagaaacacggcaagatcatggaagcaatggagaaacttaaaagcggcatgcgatttaacgaggtagccgcacagtattctgaggacaaggcaagacagggcggagatctgggatggatgacgcggggatccatggtgggcccatttcaggaggcagctttcgctttaccagtcagtgggatggacaagccagtgtttaccgaccctcctgttaagactaagttcggttaccacataataatggtggaaggacgtaagtag

SEQ ID NO: 236597 - DNA, 402 bp, Artificial Sequence
  Description of Artificial Sequence: Synthetic coding sequence
atgccaatggccggtttgctgaaaggcttagtgaggcaactcgagaggttttcagttcagcaacaagccagtaaaatgcctccaaaaggaaaaagcggcagcgggaaagccggaaagggaggcgctgcctctggatccgactccgctgacaaaaaggcgcagggcccaaaaggcggtggcaatgctgtgaaagtcagacacatcctgtgcgaaaagcacggaaagattatggaggctatggagaaactgaagtctggcatgcggttcaatgaggtggctgcacagtactccgaggataaagcacgacagggcattcctagtctgcagcagcacgccggacatcatagagatctgagaagtactctaatctcgctggtgagctacttgcagaccaccccctag

SEQ ID NO: 236598 - DNA, 1062 bp, Artificial Sequence
  Description of Artificial Sequence: Synthetic coding sequence
atggcggctgccgaagctgcgaactgcattatggaggtgtcctgtggccaggctgagagctcagaaaaaccaaacgcagaggacatgacttcgaaggactattactttgacagctatgcccacttcgggatccacgaagagatgctgaaagacgaggtgagaacactgacctaccgtaacagtatgtttcataacaggcacctctttaaagacaaggtggtcctcgacgtcgggagtgggacaggtatattatgtatgttcgccgcaaaggcgggtgccaggaaggtcatcggcatcgaatgcagctcgatcagtgattacgccgtcaaaatcgtcaaggccaataagctagatcacgtcgtgaccataattaagggtaaggtcgaagaggtggagcttccagttgaaaaggtcgacataattatctcggagtggatgggctactgtttgttctacgagtcgatgctgaacactgtgctctatgctcgagacaaatggttggcccctgatggcctgatcttccctgaccgcgctacgctgtatgtgaccgctatagaggacagacagtataaagactacaagatccactggtgggagaatgtttacgggtttgatatgtcatgcattaaggacgtggccattaaggagccactggtggatgtcgtcgatcccaaacagttagtcacaaatgcttgcttgattaaagaggtcgacatatataccgtgaaagtggaagacctcaccttcactagtccattctgcctccaggtgaaaagaaacgattacgttcacgccctggttgcttacttcaacatcgagttcactcggtgccacaagcggaccggattcagcacctcccctgaaagtccttacacccattggaagcagacggtgttctacatggaggattacctgaccgtaaaaacaggtgaggagatatttggaaccatagggatgaggcccaacgccaaaaacaatcgggacctggacttcaccattgacctggactttaagggacaattgtgcgagctgtcctgctctacagattaccgtatgaggtag

SEQ ID NO: 236599 - DNA, 882 bp, Artificial Sequence
  Description of Artificial Sequence: Synthetic coding sequence
atggttggcgttgctgaggtttcctgcgggcaggccgagtccagcgaaaaaccaaacgccgaggatatgacatctaaagattattattttgacagctacgcacactttgggattcacgaggaaatgctaaaagatgaagtacgaacgctgacctaccgaaattccatgttccataatagacatctattcaaggacaaagttgtcctggatgtcggctcaggaactgggatcctgtgcatgtttgcagcaaaagctggcgctaggaaggttatcggaattgaatgctcctcgataagtgattacgctgtgaagatagtgaaggccaataaactggaccacgtggtgaccatcattaaagggaaggtagaggaggtggagttacccgtcgaaaaggtagatattattatcagtgagtggatggggtattgcttattctacgaatccatgttgaataccgtcctgtacgcaagggataaatggctggctcctgatgggctgattttccccgaccgggcaaccctttacgttactgcgattgaggacagacagtataaagactacaaaattcactggtgggaaaacgtctacgggttcgacatgtcttgtatcaaagacgtggccattaaggagccactggtggacgttgtcgatccaaagcaattagtgaccaacgcttgtctgatcaaggtcagggggtgggcatggccaggcgctccttgggtcgaaacaaaggagcgtccctcccccggtccaggcatgggcttgtgggggccagaatgctggcctgaggtctcggagccagacttacccgcaaggggaggcgctagagggcctggcaaaacccttcgtcccctgaacatattcgtgagcgcagctgtgtag

SEQ ID NO: 236600 - DNA, 1116 bp, Artificial Sequence
  Description of Artificial Sequence: Synthetic coding sequence
atggctgcagcagaggccgctaactgtataatggaaaacttcgtcgctaccctcgccaatggcatgtccctgcagcccccactcgaagaagtcagctgcggtcaagcagagagttccgagaaaccaaatgccgaagacatgacgtcaaaggactactatttcgatagctacgcccactttggcatccatgaggaaatgctgaaagacgaagtaaggaccttgacatatagaaacagcatgttccacaaccgccacctttttaaagacaaggtggtgttggacgtggggagtggcactggcatcttgtgtatgtttgcagccaaagccggtgccaggaaggttattggcatcgagtgctcaagcatctcagactatgctgtgaaaattgttaaggccaacaagctggaccatgtggtgactatcataaaggggaaagtggaggaagtcgagctccccgtagagaaagtggacattattatctccgaatggatgggctactgcctgttttatgagagcatgctcaatacagttctctatgccagagataagtggcttgcacccgatgggctgatctttccagatcgggcaactctgtacgtgactgccattgaagaccggcagtacaaagactataagattcattggtgggaaaatgtctatggcttcgatatgtcatgcattaaagacgtggccattaaagaacccttggtggatgtggttgatcccaagcagctcgtgaccaacgcctgcctcataaaggaggttgatatctatacagtgaaagtggaagacctcacatttacctcccccttctgtttacaagtcaagcgtaatgactatgttcacgccttagttgcttacttcaatatcgaatttacaaggtgccataagagaaccggcttcagcacatcacccgaaagcccatacacccactggaaacagaccgtcttttatatggaggattatctgacagtcaaaaccggggaggaaatctttggcacaatcggcatgcgccctaatgctaagaataacagagatctcgatttcaccatcgatctcgacttcaagggtcagttgtgtgaattatcatgctcaacagactacagaatgaggtag

SEQ ID NO: 236601 - DNA, 483 bp, Artificial Sequence
  Description of Artificial Sequence: Synthetic coding sequence
atgacaagcaaagattactactttgacagttatgcgcacttcgggattcacgaagagatgctaaaagatgaggtgcggaccctgacgtaccggaactcaatgttccacaatagacatctcttcaaggataaagtcgttttggatgtgggatcgggcactggaatcctgtgtatgttcgctgcaaaagccggagccaggaaggtgattggcatcgagtgcagcagtattagcgactacgctgttaaaatagttaaggctaataagttagaccatgttgttactatcatcaaaggcaaagtggaagaagtcgaattgcctgtcgagaaggtggatatcatcatttctgaatggatgggttattgccttttttacgagagcatgctaaatacagtactttatgccagagataaatggcttgctcctgatggcttgatctttcctgatagggccaccctgtatgttacggccattgaggatcgctag

SEQ ID NO: 236602 - DNA, 618 bp, Artificial Sequence
  Description of Artificial Sequence: Synthetic coding sequence
atgaccagcaaagattattatttcgatagttatgctcacttcggcatccacgaggaaatgctaaaagacgaggtgaggaccctcacgtacaggaactcaatgttccacaacagacatctgtttaaagataaagtcgtcctcgacgtcgggtccgggacgggtatcctgtgtatgttcgcggcaaaggcaggtgcgcgtaaagtcatcggtattgagtgcagttcaataagcgactatgctgttaagatcgtgaaggccaataagctcgatcatgtggtgactattattaaaggtaaggtcgaggaagtggagctgcccgtggagaaggtggatatcattatttctgagtggatgggatactgtttgttttatgaatcaatgctgaatacagtcctctatgcgagggataagtggctagcccctgacggattgatattccctgatcgggctactctctacgtcaccgctatcgaagaccggcagtacaaggactataaaattcactggtgggagaacgtgtacggatttgatatgtcttgcattaaagatgtcgcaatcaaagaaccgttggtcgatgtggtcgatccaaaacagctcgtcacaaatgcctgcctgtag

SEQ ID NO: 236603 - DNA, 483 bp, Artificial Sequence
  Description of Artificial Sequence: Synthetic coding sequence
atgaccagcaaagattattacttcgacagctatgcacactttggaattcatgaggaaatgttgaaggacgaggtgaggacccttacttaccgcaactcaatgttccacaataggcacctttttaaggataaggttgtcctcgacgtcggcagcggcaccggcatactttgcatgttcgctgccaaagctggggctcgcaaagtcataggcatcgagtgcagcagcatctctgattacgcggttaaaatcgtgaaagccaataagctggatcacgtggtgacaattataaagggaaaggtggaggaggtcgagttgcctgtagagaaggttgatattattatcagcgagtggatggggtactgcctgttctacgagagcatgttaaacacggtgctttatgcgagggataaatggctggcaccagatggactgatctttcctgacagagctactctctatgtgacagcaattgaagatcgctag

SEQ ID NO: 236604 - DNA, 630 bp, Artificial Sequence
  Description of Artificial Sequence: Synthetic coding sequence
atgacatccaaggactactatttcgactcatatgcccactttggcatacacgaggagatgttaaaagacgaagtgaggactctcacctacaggaactccatgtttcacaatagacacctttttaaagataaggtggtgctggacgttggatccggtactggaattttgtgcatgttcgccgctaaggccggagcaagaaaggtgattgggatagaatgctcctccatctccgactatgcagtgaagatcgtaaaagccaataagctcgaccatgttgttacaatcattaaggggaaggtggaagaggtcgagctaccagtcgagaaggttgatattatcatttctgaatggatggggtattgtctcttttacgaatccatgcttaacaccgtgctgtatgccagagataagtggctggccccagatggcctgatctttccggaccgggcaaccctgtacgttacagccattgaggaccgccagtataaggattataagattcattggtgggagaatgtctatggttttgatatgagctgcattaaggatgtggccataaaagaaccactggtggacgtggtcgacccgaagcagctggttaccaacgcctgcttgatcaaagttagatag

SEQ ID NO: 236605 - DNA, 687 bp, Artificial Sequence
  Description of Artificial Sequence: Synthetic coding sequence
atggcaacttccggagactgcccacggagtgaaagtcagggggaagagccagcggagtgctccgaggcgggactcctccaggagggagttcaaccggaagagttcgtggcaattgctgattacgctgcaaccgacgaaacacagttgagctttttacgcggagagaagattctgatcctgcggcagacaacggcagactggtggtggggagagagggcagggtgctgcggctatattcccgcaaatcatgttggaaagcacgttgacgaatacgaccctgaggacacctggcaggacgaggagtattttgggtcttacggcaccctgaaactgcatctcgagatgttggcagatcaacccagaacaaccaaataccacagcgtgatattgcagaacaaggaatctctgacagacaaggtcattcttgacgtcgggtgcggaaccgggataatcagcctgttctgcgctcactatgcccgtccacgtgccgtgtacgccgtggaagcatccgaaatggcccagcatactgggcagcttgtgctgcagaatggcttcgctgacataatcacggtgtaccaacagaaggttgaagatgtggtgctgcccgagaaagtggatgtgttggtgtcagagtggatggggacctgcttgttggtgggagagaaagtgtttcccatatggaggtag

SEQ ID NO: 236606 - DNA, 855 bp, Artificial Sequence
  Description of Artificial Sequence: Synthetic coding sequence
atggcaacctcaggcgactgcccccgaagcgagtcccagggcgaggaaccggctgagtgctcagaggccggactgctccaggaaggggtccagcctgaagaatttgttgctatagctgattacgcagccacagatgagactcagctgtcgtttctccgtggcgagaagatactgattttacgacagacaactgcggattggtggtggggagaaagagccggttgctgtggctacattccggcaaaccacgtgggtaagcatgttgatgagtatgacccagaagacacatggcaggatgaagagtattttggctcttatggcacgttgaaattacacctcgaaatgcttgcagaccagccacggaccacgaaataccatagcgtcatcttacaaaataaggagtctctgaccgacaaagtgattctggatgtggggtgcggaaccggcattatttccctcttctgtgcccactacgcacgcccacgcgctgtgtatgccgttgaggcaagtgaaatggcgcagcacactggccaactggttcttcagaatggctttgcagatataataactgtgtaccaacagaaggtcgaggacgttgtcttgcctgagaaggtggacgtccttgtctctgaatggatgggaacatgtctgctagcagcccctctcttgtcatgtaggattctcccgtgtacgtgcgcctctggccctctgcacgtgctgttagcctgctgtctgcccctgccctgcacatgcgcatctgtcccgctccacgtacttctggcctgctgccttcccgtactaagagccccacagcccagtgggctgcatctcagttggccaattttcctgctgtag

SEQ ID NO: 236607 - DNA, 1302 bp, Artificial Sequence
  Description of Artificial Sequence: Synthetic coding sequence
atggccacaagcggtgattgcccccgttccgagtcccagggcgaagagcccgctgagtgctctgaggcaggtctactccaagagggggtgcagccagaggaattcgtggccattgccgactacgcagcaactgacgaaacccagctgagctttcttaggggcgagaaaattctcattctgcggcagacaaccgccgattggtggtggggagagcgggctggttgctgtggctacatcccggctaatcacgttggcaaacatgttgatgagtatgatccagaggatacttggcaggatgaagaatattttggtagctatgggactttgaagcttcatctcgaaatgttagccgaccagcctcggactaccaagtatcattcggtgatactgcaaaacaaggagtcactgaccgacaaggtgattttagatgtggggtgcggcaccgggataataagtctgttctgcgcacattacgccaggccaagggccgtgtacgctgttgaggcaagcgagatggcacaacacaccggccagctggtgctgcaaaatgggttcgccgatataattaccgtgtatcagcagaaggtcgaggacgtggtattgcctgaaaaagtagacgtgctcgtcagcgaatggatgggaacctgcttgctgttcgaattcatgattgagtcaatcctctacgccagggacgcgtggcttaaggaggacggagtcatatggccaaccatggccgctctgcatctggtgccttgcagcgcagataaggattatcgctcaaaggtcttgttctgggacaatgcctacgagttcaacttgtctgcactcaagagtctcgctgtgaaggagtttttcagcaagcctaagtataaccatattctgaagcccgaggactgtctgtctgaaccctgcactatcctgcagctcgacatgcggaccgttcagatatcagatctcgagaccctgcgaggggagctaaggttcgacatccgtaaggcagggaccctgcatggtttcacagcttggttctctgtgcatttccaaagccttcaggagggccagccccctcaagtgttaagcacgggaccatttcaccccactactcattggaagcagaccctctttatgatggatgaccctgtgccagtgcatacaggcgacgtggtcacgggctcagtggtcctacagcgcaaccccgtgtggaggcgccatatgtcggtcgccctgagttgggccgttacttcacgtcaggatcccactagccagaaggtgggcgaaaaagtgttccctatctggaggtag

SEQ ID NO: 236608 - DNA, 486 bp, Artificial Sequence
  Description of Artificial Sequence: Synthetic coding sequence
atgttggccgaccagccgaggaccacgaaataccacagtgttattctgcaaaacaaggagtcgctccggattaaatcatcctggacctgggcagtcggactgggaagttctgtgtcttctgttcacaccatgcggggacttgaacgagtttacgcggtggaggcttccgagatggcccagcatactggacaactggttctgcagaatggattcgctgatatcattactgtgtatcagcagaaggtcgaagacgtggtgctgcccgagaaggtcgatgtattagtgtccgaatggatgggaacttgccttcttttcgaatttatgattgagagtattctgtatgcaagggacgcatggctgaaagaaacaggaagctttggccctccttggctgcgttgtactctctgtcccgctgtcttaataagaattattgtagcaagatgctccagcgggacaactcggacttcatctacatccgccctctag

SEQ ID NO: 236609 - DNA, 1302 bp, Artificial Sequence
  Description of Artificial Sequence: Synthetic coding sequence
atggcaacctccggggactgccctcgctcggagagccagggtgaggagccagcagagtgttccgaagccggacttctacaagaaggcgtacagcccgaggagtttgtggccattgcagactatgctgcaaccgacgagacccaattaagcttcctacggggtgagaaaatcctcatcctacgccagacaacagctgactggtggtggggcgaaagagcaggatgctgcggctacattcctgccaatcacgtgggtaagcatgtggatgagtacgatcccgaggacacttggcaggatgaggagtatttcggatcctacggaacattgaagctccatttggagatgctggcagaccagccacggaccaccaagtaccactcggttatacttcaaaacaaagagtctttaaccgataaggtgattctggatgtcggctgtgggactggcataataagccttttttgcgcacattacgcacggccaagggcagtttacgcagttgaggcctccgaaatggcccagcacacaggccagctcgtgctccagaacggattcgccgacatcatcaccgtgtaccagcagaaggtagaggatgtcgtgctgccagagaaggtggacgtgctcgtgtccgagtggatgggtacatgcctgctatttgaatttatgatagaatccatcctttacgcaagggacgcctggttaaaagaggacggcgtgatctggcctacaatggcggctctgcacttagtgccctgttccgcggataaggattatcgcagcaaggtgctgttttgggataatgcctatgagttcaaccttagcgctctgaagtcactggcggtaaaggaattttttagtaagccaaagtataatcacatcctcaagcccgaggactgtttgtcagagccctgcactatattgcagctcgacatgaggacggtccagattagtgacctggagactctcaggggcgaactccgatttgacatccggaaggccggtaccttacatggattcactgcgtggttttctgttcacttccagtctttgcaagaggggcagccgcctcaggtgctgtccacaggcccatttcaccccacaacgcactggaaacagacccttttcatgatggatgaccctgtgcctgtgcacaccggagacgttgtgaccggtagtgtggtcctgcagaggaatccagtctggaggcgccacatgtccgtggctctttcctgggccgtaactagcaggcaggacccaactagtcagaaagtcggggaaaaagtattccccatctggaggtag

SEQ ID NO: 236610 - DNA, 1302 bp, Artificial Sequence
  Description of Artificial Sequence: Synthetic coding sequence
atggccaccagtggagactgcccccgttcagagtcccaaggtgaggaacctgctgaatgctctgaagctggactgctgcaggaaggggtacagcctgaggagttcgtggccattgcagattatgctgctacagacgaaacacagctgtctttcctgagaggagagaaaatcctcatcttaagacagactactgccgattggtggtggggcgaacgcgctggttgttgtggctatattccagcaaatcatgtgggaaaacatgttgacgaatatgacccagaggatacttggcaggatgaggagtattttggaagttacgggacactcaagcttcatcttgaaatgctggcggatcagcctcgtacaactaagtatcatagcgtaatcctgcagaacaaagagtcccttactgacaaagtgatacttgatgtcgggtgcgggactgggatcatttctctgttctgtgcacattacgcacggcctcgcgcagtttatgccgtggaggcttctgaaatggcccagcacactgggcagctggtcctccagaacggattcgcagatatcatcaccgtctatcagcagaaagtggaagatgtggttcttccagaaaaagtcgacgtccttgtaagcgaatggatggggacttgtctgctctttgagttcatgatcgaatcgattctatatgcaagagatgcgtggctaaaagaggacggcgtgatctggccaactatggccgcactgcatctggtgccttgctccgccgacaaagattataggtcaaaggtgcttttctgggataacgcctatgaattcaatcttagcgccctaaagagcctggctgtaaaggaatttttctccaagccgaagtacaatcacatcctgaagccagaagactgtctgtcagaaccctgcacgattctccaactcgatatgagaactgtccaaataagcgatcttgaaaccctccgcggtgagctccgctttgatatccgaaaagctggaaccctccacgggtttacggcctggtttagcgttcattttcagagcctgcaagagggacagccgccacaagttttgtctacgggcccatttcatccaaccacacactggaaacagactctcttcatgatggacgatcccgtgccagttcatacaggcgatgtagtgactgggagtgtcgtgctgcagcggaatcccgtgtggcggcgtcacatgtcagtcgctcttagctgggctgtcacctctcgtcaagacccgactagccagaaggttggtgaaaaagtttttccgatttggcgctag

SEQ ID NO: 236611 - DNA, 996 bp, Artificial Sequence
  Description of Artificial Sequence: Synthetic coding sequence
atggccacaagtggagactgtcctaggtcagaatcccagggagaggagccagccgagtgctccgaggccggactgttgcaggagggcgttcagcctgaagagttcgtcgctattgccgactatgcagcaactgatgaaacacaactttctttcctgagaggggaaaagattctcattttaaggcagaccacggcagactggtggtggggcgaaagggccggatgttgcggctatattcctgcgaaccacgttggcaaacatgtggacgagtatgatcctgaggatacttggcaggacgaggaatactttggatcctacggaactctgaagctccatctcgaaatgctggctgatcagccacgaaccaccaaatatcattccgtaatcctgcagaacaaagagagtcttaccgacaaagtgatcctcgacgtgggatgtggtaccggcataatatcactgttctgcgcgcattatgctcggccaagagcggtctatgctgtggaagcaagcgaaatggcgcagcacactggtcagttggtgttgcagaacggctttgctgacattatcaccgtctaccaacagaaagtagaggacgttgtgctcccggaaaaggtggacgttcttgtctccgagtggatgggcacttgtttgttaactctgcggggtgaactcagattcgacatcaggaaggccggaactctccacggctttactgcctggttttctgtccattttcagagtctgcaggaaggccagccgcctcaagtcctgagcacagggccattccacccgacaacgcattggaaacagacactgtttatgatggacgacccggtcccagtgcacacaggcgacgtggtgactggtagtgtggttctacagcgaaatccagtctggaggagacacatgtctgtggctttgtcttgggcggttacctcacgccaggatcctacgagtcagaaagttggtgaaaaagtattccctatctggcggtag

SEQ ID NO: 236612 - DNA, 870 bp, Artificial Sequence
  Description of Artificial Sequence: Synthetic coding sequence
atggcaacatctggcgactgtcctcgctccgaaagccagggggaggaacctgcagagtgttctgaggccggactgctgcaggaaggggtccagccagaggagtttgtagcgattgccgattatgccgcaaccgacgaaacacaactgagcttcttaagaggggagaagatcctgatactacgccagacaacagctgactggtggtggggtgaacgggcagggtgctgtggatacattccggcaaatcatgtagggaagcacgtcgatgagtacgatcctgaagatacgtggcaggacgaagagtactttgggtcctatggaacactgaaactgcacctcgagatgcttgcggatcagcctcggactacgaagtaccacagtgtcattttgcagaataaagagagcctgactgataaggtcatcctggacgtcggctgcggtaccgggattatctcgcttttctgtgcccattacgctcggcctagggccgtgtatgccgtggaagcaagcgaaatggcgcagcataccggccagctggttctgcagaatggtttcgcagacattatcaccgtgtaccagcagaaggtggaggatgtcgtcctgcccgaaaaggtggacgttttggtttctgagtggatgggcacctgtttgctgtttgaattcatgatcgaatctatattatacgccagagacgcttggctaaaagaagacggagtgatatggccaaccatggctgcgttgcacctggtaccctgttccgctgacaaagactacaggtctaaggtgttgttttgggacaatgcctacgaatttaatctgagtgcccttaagctggagaagaagagcagcccttctggggatgatagttag

SEQ ID NO: 236613 - DNA, 906 bp, Artificial Sequence
  Description of Artificial Sequence: Synthetic coding sequence
atggccacctctggtgactgtcctcgttcggaatcccagggggaagagccagcagagtgctctgaagccggtctccttcaggagggcgtacagcccgaagaattcgtggccatcgccgactacgcggctacggatgagacccaactaagcttcctgcgcggagagaaaatcctgatactgcgccagaccactgcggattggtggtggggggagcgcgcagggtgctgcgggtacattcccgctaatcacgtggggaagcacgtcgacgagtacgatccggaagacacctggcaggatgaagaatactttggctcatatggtactttaaagctccatctggagatgttggccgaccagcccaggactacaaagtatcattccgttatcctccaaaacaaagaatcgctgaccgacaaggtgatccttgacgtcggttgtggaaccggaatcatttccctgttctgtgctcactacgctcggcctcgggcagtgtatgccgttgaggcaagcgagatggctcaacacactggacaactcgtgcttcagaatggctttgccgacataattactgtataccagcagaaagttgaagacgtggtgcttccagagaaggttgacgtcctggttagtgaatggatgggcacatgcttactgcatcacaccctggaagccgatgccgtacacgatgggagaccgtccccgtgcccctacagacgtcgaggacacggatttagctgtgtggctgaaaaaccgagcgtggagaaggctcatgtgtgcggtagcgagttaggttgccactttcagacccggcctcacatctctaaaagctggcggaagagtctgccccacctagaaatgaccgttgatgctctcttcgggaaacagtgtgcttacttggaagggtag

SEQ ID NO: 236614 - DNA, 951 bp, Artificial Sequence
  Description of Artificial Sequence: Synthetic coding sequence
atgatcgctgaccgcgtccgcactgacgcgtatcgcctgggcattttacgcaactgggctgcgctgcgcggtaaaacggtcctggatgtgggcgcagggactggcattctgagcattttctgcgctcaagctggcgcaaggagggtctacgctgtggaagcctccgctatatggcagcaggcacgcgaggtggtgaggtttaacggcctcgaagaccgggtgcacgtgcttcctgggcctgtcgagactgtcgagctccccgaacaggtggatgccatagttagcgagtggatgggatacggtctcctgcacgaaagcatgcttagctccgtattacacgctagaactaagtggctgaaagagggtgggctgcttctcccggctagcgccgagttgttcattgctcccatctccgaccagatgcttgagtggaggcttggcttctggtcgcaggttaaacaacattacggtgtcgacatgtcgtgcctggaagggttcgccaccaggtgccttatgggccactctgagatcgttgtgcagggcctgtccggtgaggatgtgctggctcgtccacagaggttcgcccaactcgaactgtcgcgcgctggtcttgaacaggaactcgaagctggggtgggaggccgatttagatgcagctgttatggaagcgcgcctatgcacggatttgcaatttggttccaggtaactttcccgggaggtgagtcagaaaaaccgctggtgctctcgacgagccctttccatcccgcaacacactggaagcaggcacttctgtacctgaatgagcctgtccaggtggagcaggatacagacgtcagcggcgaaataactctcctccccagccgggataacccccgaaggctgcgggtcctcttgcgctacaaggtgggagatcaggaggaaaagacaaaggacttcgcaatggaagactag

SEQ ID NO: 236615 - DNA, 1128 bp, Artificial Sequence
  Description of Artificial Sequence: Synthetic coding sequence
atgtctcaacctaaaaaaagaaaattggaatccgggggaggcggtgaggggggagaggggactgaggaggaagacggagctgaaagagaggccgcacttgaacgaccacggagaactaaacgcgaaagagaccagctgtactacgagtgctacagtgacgttagcgttcacgaggaaatgattgcagatcgcgtaagaacagatgcttatcggcttggtattctgaggaactgggcagctttaagaggcaaaaccgtgctggacgtgggtgccggtactggtatcctgtcgattttctgcgctcaagccggagccagacgcgtctatgccgtggaagccagcgcgatatggcagcaggcacgagaagtcgtacgcttcaacggactggaggacagagtccacgtcttaccagggcctgttgaaaccgtggagctgccggaacaggtggatgcaattgtgtctgagtggatgggatacggcttgcttcacgagtctatgttgtccagtgtcttacacgctcgtactaaatggctgaaagaagggggactcctccttccagccagtgccgaactgttcattgcccctatctccgaccagatgttggagtggaggctgggcttttggtctcaggttaaacagcattacggggtcgatatgtcttgtcttgaaggattcgccactcggtgtttgatgggtcactctgagattgtggtccagggcttaagcggagaggatgtcctggccaggcctcaacgttttgcccagctggagttgtcacgggctgggttagaacaggagctggaggcgggagtcgggggaagatttcgttgttcttgttacggctcagctccgatgcatggatttgctatctggtttcaggtgacgtttcctgggggtgagagcgagaagcctctggtgctgagtactagtcctttccaccccgctacccattggaagcaagcactgttgtatctgaacgagccagtgcaggtggagcaagatacggacgtgtctggagagatcactctacttccgagccgtgataaccctcgccgactgagggtgttattgcgatataaagtgggtgatcaggaggagaagaccaaagactttgcaatggaggattag

SEQ ID NO: 236616 - DNA, 936 bp, Artificial Sequence
  Description of Artificial Sequence: Synthetic coding sequence
atggcaaggagtggcaggagaccttggtccgatccaggaggactgtcaggagctgtgcaacgggctgggggtccgggtgctaggcctgccggaacctcgggggactgcagagtggccggaacagggggatgccacagggaaagagtagacggcctccggacccccgctagggtccacgctgaattgcgaccgcctagagcaaatcaggtggccgagggaggcagatccagccccgcaggcctgcggcgagccctgcattctccacatcaaagacccgatgcaggcatggctccgggacttctcgagcccggagaagcagctctgtggtgcggccacgagctgcctggcggactgcgtcatgcactgagtcatggcccactgggcgacaggtgtgcaggaatagtacgcaggggacgcgcaggtcccgctgccgcactgtgcagtgccagggcattaccgaggcgactgggggctggggctggcggtcgcagtggtcgtgcactgcctctgcagctgctatggctgggagcccatgcttggctatgtcacctcgtgccaggggacctgccttggaggggagtcggcgaaactcccggtgctgttcatcttgcgttctcaccgggacactcgctggagactggggcaccactgcccgaacgagccggagcttctggtgcacgccacggacgctttcgcagggaccacgcagccgctctccccggacagccaccgtctccagctcgtgcagcagctttacagtccgggaggcccggtggtgaagatcagcgcctctgtcacggcggtcttagtgtagccttctccccgagttatctacctaagcagccagatcttcgtggtagaggagttgccagaagcgaggggaaggggcgaagtcatgtgcaagtggggggaatctcgcctcctttcccatcttag

SEQ ID NO: 236617 - DNA, 2532 bp, Artificial Sequence
  Description of Artificial Sequence: Synthetic coding sequence
atggcgaagcctctgacagatagtgagaaaaggaaacagatatcggtgcggggactggcgggtctgggggacgtggccgaggtaagaaagtcctttaacagacacctgcactttacactggttaaggacaggaacgtcgctacaccacgcgactacttcttcgctttagcccacactgtaagagaccaccttgtgggtagatggatccggactcaacagcattactacgaaagagaccctaagagaatatattacctgagcctggagttctacatgggaaggaccctgcaaaacacaatggtaaaccttgggctgcagaatgcctgcgacgaggcgatttaccagttagggctggatctagaagaacttgaggaaatcgaggaagatgcaggcctaggcaatggcggtctgggacgcctggcagcctgctttctcgattcgatggcgaccttggggcttgccgcatacggctacggaatccgctacgagtttgggattttcaaccaaaagatagtgaatggctggcaggtggaagaggcagacgactggctgaggtacggcaatccatgggagaaggctcgccctgagtatatgctgcccgttcacttttatggcagagtggaacatacacctgacggggttaagtggctcgatactcaggtggtcctcgcaatgccatacgatactcccgtcccaggttataagaataacacagtgaacactatgcgcctgtggtccgccaaggcccctaacgactttaaactccaggactttaacgtgggcgattacatcgaggcagtgctcgaccggaatcttgccgagaacatttctagggtgctgtacccaaacgacaacttcttcgaaggcaaggaactgaggcttaaacaggaatacttcgtggtggccgctacgctccaggacattatccgacggttcaagtcaagtaaatttggttgtagagatcctgttagaacatgcttcgagacgttccccgataaagtagcaatacaactgaatgatactcatcctgcgcttagcatcccagagctcatgcgtatcctggtggacgtggaaaaggtcgattgggacaaggcatgggagatcacgaaaaagacatgtgcatatacaaatcataccgtattgcctgaggccctggaaagatggccagttagtatgttcgagaaactgctccccaggcacctcgaaatcatatacgcaatcaaccagagacacctcgaccacgtggcggctttgtttcccggagatgtcgaccgtctgagacgcatgtcagttattgaggagggagactgcaaaaggatcaatatggcccatctgtgtgtgataggttcccacgcggtaaacggagtggcaaggatccatagcgaaattgtaaagcagtcagtgttcaaggacttctacgagttggagcctgaaaagtttcaaaataaaactaacggtatcaccccaaggagatggctgctcctctgcaaccccggtctcgctgacacaattgttgagaagatcggcgaggagttcctgactgacctctcacagctgaagaagctgctcccattggtttcagacgaggtgtttattcgcgacgttgccaaggtgaagcaggagaataaattaaaattttcagcattcctggaaaaagagtataaggtgaagatcaacccgtctagcatgttcgacgtccacgtcaagaggatccatgaatacaagcgccaactcctcaactgtttgcacgtggtgacgctgtataatcgcataaagcgagacccagctaaagcctttgtcccacgaaccgtaatgattggcggtaaagccgctcctggttaccacatggccaagctaatcatcaagttggtcacaagcatcggggatgtagtgaatcacgatccagtggttggcgacaggctcaaagtgattttcctggaaaattatcgggtcagtctggccgagaaggtgatcccagcagccgatctgtcacagcaaatctcaaccgccggaacagaagcctcaggcacaggcaatatgaagttcatgctcaacggcgcactgacaataggcactatggatggcgcaaatgtcgaaatggcagaggaagccggagcagagaatttattcatattcggattgagagttgaagatgtggaggctttagacagaaaagggtacaatgccagagaatactatgatcacctgcccgaattgaaacaagccgtcgaccagatttccagcgggttcttttctcccaaagagcctgactgctttaaggatatagtgaatatgctaatgcaccatgatcgtttcaaggtgttcgcggattatgaagcctacatgcagtgccaggcccaagtggaccagttgtacagaaatcccaaagaatggacaaaaaaagtgatccggaatattgcttgtagtgggaaattcagctcagaccgcaccattactgagtacgccagggagatttggggcgtggaaccgagcgatctgcagatccctccgccaaacatacccagggattag

SEQ ID NO: 236618 - DNA, 717 bp, Artificial Sequence
  Description of Artificial Sequence: Synthetic coding sequence
atgctcactaccttgctacccattcttctgctatctggatgggctttttgtagccaggacgcatccgacggtctgcaaaggttgcatatgttacaaatctcatatttccgagatccatatcacgtttggtatcaggggaacgcctccttgggaggccatcttacccatgtgctggaggggcctgatactaatactactatcatacagctgcagcccctgcaagagccagagagctgggccagaactcagagcggcctccagtcatacctcctccagttccacggcctggtccgcttagtgcaccaggaacgcacactagcattcccccttactattaggtgttttctgggctgcgagctccctccagaaggaagccgagcacacgttttcttcgaagtagccgtcaacggcagttccttcgtgtcttttcgaccagagcgcgctttgtggcaggcagacacccaagtcacaagcggagtggtgacctttacgctgcagcagctcaacgcttacaataggaccagatatgagctgagggaattcctagaagatacttgcgtgcagtacgtccagaaacacattagcgccgagaacaccaaggggtctcagaccagccggtcgtatacctccctcgtgctaggagtgctggtcggttctttcatcatcgccggagtcgctgtcggcattttcttgtgcaccggcggacggcgatgctag

SEQ ID NO: 236619 - DNA, 4551 bp, Artificial Sequence
  Description of Artificial Sequence: Synthetic coding sequence
atggataaccaacaggacaaagcaattgtggcaagcgctaatggagagaatactctgattaacggcgtgaaggagaacgattccgaggatcaggacgtggcgatgaagagctttgctgctttagaagcggcagcgccaattcagccaacgccagttgctcagaaagagactttgatgtaccctcgcggactgcttcctcttccatcaaaaaaaccttgcatgcagtcaccacctagcccacttggcctgatcgaggctcccgaacatgcggctaatagcgcatcggtgaacgctatttccctgacttctgggattgctaaaggattaaacacctggtctctcccgaacgagtgtgaaaaggctccgttcgctatcatggagcctgccggtatgtcagccctgaatggtgactgtttaatgcagccgagtcggacctgcctggggtgctttatggaatccaaggatgcagtagaccctgagccaggaatcagcctgaaagtgggtgaccttaatcgagattatgaaacctgcgcagtgtcagatattggcattcagtgcattaacgccggagagaatatgaagtatggagagcagctgctatcagaccagttgcttgggttcccgctgcataaatcaagagccggagatcgaagagagaccgaaaaacctgacatcgatttagaagatcccgcacagaaaagttactatgaggcactcttgcttgacaagtgcaatactgaggaggctctactcgcgaactccaaccaggattggggttatttcgaaacattcatcagtgagtcaaaaatagagttgctagacttgtgcagcaaaaatgagctcagtgtaaacctgttctctgaagaggacgttgacaattatatgttcgatgacgatgagtcaaccctcggcagtgatgtgtgctcactgaagatcagatacgagtcgtttcaggacaatgtcagagataagactacactgctaatgcaagaagacgctcaattcaatttcttcccttctgtgttcaccacatgtcctaagcgtgaatccaaatccggagctctcaagcagtcctctgactttagccagtttaaggtccccgacgtgtcaattatctggggcgaagaggataagaatctggacaagaaaaaaggcaaagaagagggccaggaggataagggggtggagaagaaggatggcaaagataacggggagaagcctgccctcaacaagccctgtagtgggacagaagtcgagcagctaaagaatcccaagcagggccatttggcaaatagtctggagactagtgggagtttttcagacgactcatcctttatcgagattagctatgatgctatgggtgagattaaggattgcagtcggtacatggcccgtgacaccaactctggaagtagcagtagccagcagaattatgggttgcgcgctaaacgtaaagttagatacagcgaggactatctgtacgacgtggacagcttggagggggagaaggtgaacgagcggaaggagtggttacccgtaggctcaaaggaagaagatgacgatgaatggtgccccaaaaagcggagaaaagtgacaaggaaagaaccccctgtgatcataaagtatatcataataaaccgtttcaaaggtgagaaaaacatgttagtgaagctgggcaaagtcgatgcaagcgagaccaccgtgaatttgtcagaaaatcagctgaacaaatacgccaagctagccccattgaaaggattctggcagaagaagaaaaaacagaggaataccaatacggattccattaaaacaccgttcagccagaagcagtccttcgagcccggaagttttgaagtgtcctttttgccaccagctcggaaacgcaagtcaaaattgggcaatagacatcgtatccagagaatccctagcatcgagattagtgcctcatctaagcagattagtctgtgcaatgatcagcgtcacgcaagtaaccacaaggaggatggtggtttgaagggcaccctcaaatcagccccactcggcgctccttcctgcgctaatggctctcacctgaacgacattaccgggccagactctgtgaaagtcaaagcccaggacactgagttcaagggaccggaacggaaggtcctcaacaaaatcaaatttaagtccgaggcacgtctcaagtctaaaaaagttaaggctgctggccaggagtctaagcccatcgtgcaaatgagcccgctgctggagaaccagtctagtaaagctaacctcaagaatgaggtaataccaggaactagcaattccagtcgcctgtccgaatttcacgaggccaaggctgcaaagtcttcgacattcctgcctactacgtgcagtagcgaaatgccactctcgtctgctaatgtgacgaccaacattccggttatacctgggggttatctgcagactctgttggacgcctctgatctgagtaacaacactagtatctcttatttctctcaccattccccggaacagaacgaaggaagcctgactcagacggaaaaatctttcgtgcctctccagcccacccaagattgcgtgctgactagcagctctgatagcgaactccagcagtcaagtcacaatttcaaaatggagtcatcaaactaccgaaacgtgtggcccaacaaggcaacaagtggaactcaggagttcatggccgaggtgagccgagaaattgctccaacgcagtcttccgagttcggcgcttctcaggtggtatccatggaaaacaatctcacccctactacttacaatcctatttgtttaaattcgggaggatctaattgcaataaggtcctgtacgatagtatgcaggacacacagttgccaagcgatgacagctaccagctgtgccattttaacaacggtgagatctgttttccgttccagcagggtccagtgaacatggatgacggaagactcttcagttttgacagcatggcacctcttagcgtgtcctcttcaaactattgttcactcagcctcaagagctgtgagaaagatggcgatgacgatattactgatgacttcctcgctcattgtagtccgaagttggtgatacagcaaagcatagacgagattgctcctttgaaagaatcaacagacctgttggacatttctaatttcacgcctgacaagtttcgccatagtagcctctccgaaatgagtcctccagataccccttctctgtcaccccagataaccagatgcgagtctatgaaaacactgggcaccttgaagggctttcaggagggtgtgccaggtccgttagattcagtagaaaaaattaaatgggactgctcaaccctctccaggcaggtgcagatggaggatggattcaccttgaacaatcaccagtttcagttccatatgttcaacgacgaggatagcgtgtctctgcttcaaaaaaacccatgtttgtccacgttcaacgatccctccggccagattagcactaataacaaagtgtcaaagagccggaagaaatcaagtcccagtaaatctggggcaatgaaccagtccagctcccagaaaaacacaagaaagaagtccctcaaggggaacaataaggggattgaaaaacctcctgggaaaaatagtcggcaggtgcccaaatccactaaaaaggggaagtatatggccgctattaacggagagaagatgcagatcggtattggacgtggaggatcacagactaacaccattagcagtaccggtaagacgctggccgagtgcatccagcacggaggccctatggcatccatgaaaatgcccagccaaaaagggctgtcaggcgactgggctctgggaaaggaaagttcacccggatggagcgacatgtcaatgggcacaaacacaaattctcttctggatgatgatcaaagagagttccaggagccctcttatattctcagcaatatcgcatccggcatggctgatgtgcaacggttcatgatggcttctatcgagcctctgtgggagcccatggagcaccacggcgatcctaacattttctatagccctgagtccaactccctaaagctgaagactttgaagatcctggcaggaacaccgcaagagagcaaaaagaagatcaattccggctctcagggcgctactaagaaccatcgctcaattaagggagtgtccaaatcaaacggcaaaacagctatcggcgatcccggaagagctaacatgcctggttataacgaagactcaaggtctacgttttttgacaaaaaatattccaacatgagcacactgggcaacaatggcccaacccacaagaagctttacagacacaaaagttccagtaaagctctacgcgatgaaaagtgcaaaggaaaacacatggaacgtgagcaagtgcataaggatgagagcggcacagcctctttcgaaaagctacgggactccgactataacctgttgaaggcagagacaactttttgggttctccctgtgtttgaggaagaaacacgaatctttcaaaaggacatctac

SEQ ID NO: 236620 - DNA, 1008 bp, Artificial Sequence
  Description of Artificial Sequence: Synthetic coding sequence
atgtgggccacactacctctgttatgcgctggggcttggttgctcggggttccagtatgtggtgctgccgagctgtgcgtgaattccttagagaaattccacttcaagtcatggatgtcaaagcacaggaaaacctatagtacggaagagtaccatcaccgcttgcagacatttgcttctaactggcgtaagatcaatgcccacaacaatggcaatcacaccttcaagatggccttgaaccagttctccgacatgtcattcgccgaaattaagcacaaatacctgtggtctgagccgcaaaattgttccgcaaccaaatccaactatctgcggggtacaggcccttacccacccagcgtagattggaggaagaaaggaaatttcgtcagccccgtgaagaatcagggcgcatgtggcagctgctggacattcagcaccaccggcgcattagaaagcgccatcgcaattgccacaggcaagatgttgtcactggccgagcagcaactcgtggattgtgcccaggactttaataaccacggatgccaggggggtctaccttcacaagcctttgaatatattctttataacaagggcattatgggcgaggatacctacccctaccaaggcaaggacggatactgcaagttccagccgggaaaagctatcggctttgtgaaagacgtcgccaacattaccatttatgatgaagaggctatggtggaggctgttgcactgtacaacccagtgagtttcgccttcgaggttacgcaggacttcatgatgtatagaacaggcatctacagctcaacaagctgccacaaaacgcccgataaagtgaatcacgccgtgctcgccgtaggatatggagagaagaatggcataccctattggattgtgaagaacagctggggccctcagtggggcatgaacggatacttcctcattgaacgcggaaagaatatgtgtggattggccgcatgcgcgtcctatcccatcccattagtgtag

SEQ ID NO: 236621 - DNA, 5655 bp, Artificial Sequence
  Description of Artificial Sequence: Synthetic coding sequence
atgcactgcactaaccctgccctgatctttctgatagacgagcttagcccagagcagcacaatctatccttgtacagcatggaactggtgctaaagaagtcgaccgggcattctgctgctcaggtcgccctgacggaaacagcaccagggtctcagcattcatcgcctctgcacgttactgctcccccttcagccaccacatttgatacggcttttttcaaccagggtaagcagaccaagtctacggcggatcctagcatcttcgttgctacctatgtctcagtgacttcaaaggaggtcgcggtcaacgatgatgagatggacaatttcctgcctgacacccactggacaactcccaggatggtgagccctatccaatatatcaccgtgtctcctcctggcctgcctcgcgaggctctggagcctatgctcacgcccagtctgccaatggtaagcctgcaggacgaagaagttactagtgggtggcagaacacaacccgtcaaccggcagcatacgcggagtctgcaagccatttccatacatttaggtccgctttccgcactagtgagggcatcgtgcccaccccaggtaggaatttagttctgtatccgactgatgcttacagccatctctcaagtcgaaccttgcccgagattgtcgcttcgctgacagaaggggtggaaaccacgctgttcctcagctcacgttccctgatgcctcagccgttgggcgacgggatcactatccccctgccttccctgggcgaggtgagtcagccaccagaggaagtgtgggccacaagtgcagataggtacaccgatgtgacaacagtgctaagtcagtcgttggaggaaacaatctcccccagaacatacccaacggtaacggccagtcacgccgctctggcattttcccgcacccatagcccgttgttgtcaactccacttgccttcgcaagctccgcctcacctaccgacgtcagttctaacccattcttgccttccgactcctccaaaaccagcgaacttcattcaaatagcgccttgccagggcctgtcgacaacacccacatcctgagtccggtcagcagcttccgcccatacacctggtgtgcagcctgcaccgtcccatcaccccaacaggttctagcgacctccttaatggagaaggatgtaggctcgggggatggtgccgaaacactctgcatgactgtccttgaagagagctctatttccctgatgtcttcggtggtggctgatttttctgaatttgaggaggatcctcaggtgtttaatacactgttcccctcaagaccgattgtccccctgtctagtaggtcaatggagattagtgagacctcagttggcatctctgcagaggtcgacatgtcttcagtaacgacaacccaggtgcccccagcacacggtcgtttatccgtgccagcctccctggaccccacggctggctccctctctgttgccgaaacgcaagtgacaccgtcctccgtcacaacagcattcttcagcgtcatcacgtcaatcctgctcgactctagcttttcagtgatcgcaaataaaaacacgccctccctggcagttcgggatccttctgtgtttaccccttacagcttggtgccatccgtggaatcgagccttttttccgaccaggaacgcagttcgttcagcgagcacaagccgagaggcgcacttgatttcgcgagttcattcttttctacgcctcctcttgagctctcaggctccatctcctccccctccgaggctcctgcctccctgtccctgatgccgtccgatctatctccctttactagccagtcatttagcccactcgtagaaacctttaccctgtttgatagctccgacttgcagagcagccagctttcgttaccctcctctacaaacttggagttcagccaattacagcccagctctgaattgcccttaaacaccatcatgctgctgccaagccgctctgaagttagcccctggtcaagctttccgagcgactctctcgaatttgtggaagcttccacagtgtccctaacagactccgaagcccacttcactagtgcttttattgagactacgtcctacctagaatctagtctcatatcccatgagagcgccgtgaccgccctcgtccccccagggtctgagagctttgacatcctcactgccggtatccaagcgacaagcccgctcaccacagtgcataccacccccattctgacggagtcaagcctgttttcgacactcaccccgccagatgaccaaatatccgcccttgatgggcacgtgtctgttttggcttcgttcagtaaggccattcccacggggacagtacttatcactgatgcatacctcccatctggctcctcctttgtctccgaggccacccccttcccactgccaaccgagctaactgtcgtaggtccttcactcacgccaacagaggtgcctctgaatacttctacagaagtttctacaacttcaaccggtgccgctacaggcggaccgttggatagtacccttatgggggatgcagcttctcagtctcccccagaaagcagcgcagcccctcctctccccagtcttaggccggttaccgcgtttacattggaagccaccgtggatacaccaactctggcaacagcgaaaccgccttatgtgtgtgacatcactgttcctgacgcctacctcattaccacagtcctcgcgcgtagagcagtgcaggagtatatcatcactgcaataaaagaagtgctacggatacacttcaatagggcggtcgaactgaaggtgtatgaactttttacggactttacattcctggtcacatccggcccattcgtgtacaccgctatatcagtgataaacgttctgataaactcaaaactggtaagagatcagacccccctgatcctctctgtcaagccgagctttctcgtgccagagagtcgctttcaggtccaaacggtgctccaattcgtgccaccaagtgtcgacactgggttttgcaactttacgcagagaatagagaagggcctcatgaccgcattgttcgaggtgcgtaagcatcatcagggcacatacaacctgaccgtgcaaattctgaatataaccatttcctcgagtcgcgtcactccgagacgtggaccggtcaacatcatcttcgctgttaaaagtactcagggattcctgaatgggtcagaggtatctgagcttttaagaaatctcagcgtcgtagagttcagcttctacctcggctacccggtcctgcaaatcgccgaaccatttcagtatccccagttgaatctaagtcaactcctcaagtctagctgggtgagaaccgtgctgttgggcgtcatggagaagcagctccaaaacgaagtgtttcaggccgagatggagcgcaaactggctcagctgctcagtgaagtgtccactaggcgccgaatgtggaggcgggcaaccgtggccgctggcaactccgtggtgcaggttgtaaacgtgtctaggttggaaggagatgataatccggttcagctgatctactttgtcgaggatcaggatggggagaggttgtccgctgtgaagtcttctgatctgattaacaaaatggatttgcaaagagccgcaattattctcggctaccgtatccagggagtgatagcccagcctgtagatcgagttaagagaccatcccctgagtcacagtcaaataatttgtgggttattgttggggttgtgataccggttctcgtggtcatggttatagtggtcattctgtactggaaactgtgccgtaccgacaagctcgactttcagccagacactgttgcaaacatccaacaaaggcaaaagctgcaaatcccctctgtgaagggcttcgactttgccaagcagcacctcggtcagcataataaggatgacatacttattatacatgaaccggctccccttcctgggcctttaaaggaccacaccaccccaagcgagaacggggacgtgccaagtccaaaatctaagattccaagtaagaacgtgaggcacagagggcgtgtctctccgtctgatgccgattccaccgtatctgaagagagttcagagagagatgccggagacaagacacccggtgctgtcaacgacgggaggtcccacagggccccacagtccggcccaccactgccgtcctcaggcaatgagcagcacagctccgcatcaatcttcgagcatgtggatcgcatctcacggccaccagaggcttcccggagagtgccctcaaagatacagctaattgctatgcagcccatcccagcacccccagtccagcgcccaagccctgcagaccgcgtcgccgagagtaataaaatcaataaagagatacagacggccctaaggcataagtctgagattgaacatcatcgcaacaagatcaggttgagagcgaaacggagaggccattacgagttcccggtggtggacgatttgtctagcggcgataccaaagaacgacaccgcgtgtataggcgagcgcagatgcagatagataagattttggaccccacagcgtcagtgccatccgtgttcatagaacccaggaaaagcagccgcataaaaagaagccccaagcctaggcggaaacaccaggtcaacggatgtccagctgacgccgagaaagatcggttgattacaactgattcggatggaacctataggagaccacctggggtgcacaacagtgcctacataggctgcccgtccgaccctgacctgccggctgatgtccaaaccccgagttctgtggagctcggacgataccccgcactgccattcccggcaagtcagtatatccccccacaaccctctattgaggaggccaggcagactatgcactctctgttggatgacgccttcgcattagtcgcaccatcctcccagcccgcatccaccgccggtgttgggcctggggtaccaccgggactaccggctaattccacccccagccaggaggagcgacgtgccactcaatggggtagtttctactcccctgctcagacagctaacaacccttgtagccgttacgaggattatggtatgacccctccgacaggcccacttccacgacctggtttcggtccagggctgttgcagagcaccgaactggtgcccccagaccctcagcaacctcaggcctcggcagaagctcccttcgctgccaggggaatctattctgaggaaatgcccagtgttgcacgtccacgacccgtagggggaacaaccgggtcccagatccagcatcttactcaggtgggcattgcctctcgcattggggcacaaccagttgagataccacctagtagagggagccagtacggcggtcctgggtggccttcatacggcgaggatgaggccggacgcagagaggcggtaccccgaacttctggaagggaaccctctgccccttccggtaatcttccccaccgtggtttgcagggaccgggtttgggctacccaacttcatccacagaggaccttcagcccggtcacagtagtgcaagtcttattaaggccattagagaagagctgctcaggttgagtcagaagcagagtactgtacagaacttccattcttat

SEQ ID NO: 236622 - DNA, 1236 bp, Artificial Sequence
  Description of Artificial Sequence: Synthetic coding sequence
atggaaactcccgaggtacctgtcggttctctgattgacttcggcccagaggcccctacaagctcccccctcgaggcacccccaccggtgttacaggacggcgatggctcactgggagacggcgcttcagaatcggaaaccactgaaagcgctgactcggagaatgatatgggcgagtccccctcccacccttcttgggaccaggaccggagatctagctcaaacgagtccttcagcagtaatcagtctacagaaagcacccaagacgaagagacactcgcattgagggactttatgcgcggatacgtggaaaaaattttttccggcggagaggacctggaccaggaggaaaaagcaaagtttggagaatactgctcatccgagaacggaaagggtagggaatggtttgcgaggtacgtttctgcccagcgatgcaatagtaaatgtgtgagcgaggcgactttctatcgcctggtgcagagtttcgctgtggtgctattcgaatgccaccagatggacgatttcggtcctgccaagaatctgatgactatgtgttttacctattaccacattgggaaaccccagcttctgcccccagagtctcgcgaaaaacccgctggatccattgattcctacttgaaatctgcgaactcatggcttgctgagaagaaagacatagctgaaagattactcaaaaacacaagcgcacggaccgagaacgttaaagggttttttggagggctcgagacgaagctcaagggtccactggccaggcggaacgaggaagacgagaacaaaccacaggaaaagaggccgagggctgtcactgcctattctcccgaagatgaaaaaaaaggagagaagatctatctttatacccatctcaagcagcagccgatctggcacactctgaggttctggaacgctgccttttttgacgccgtgcattgcgagaggacgaagcgcagcccaacgacccgaggcgatgctggcgaggaggaagaaaaaagggagaagtggtgccacatgacccaggaggaaagagatgattctctaagattcaatgaaaacattacattcggccagctgggcacatttacgcacaatatgctggcttttggtctgaataagaagttatgcaatgattttctaaagaagcaggccgtcattgggaaccttgatgaagaacagtataagttgctctccgaccatatcgagcagatggctacagagtag

SEQ ID NO: 236623 - DNA, 15018 bp, Artificial Sequence
  Description of Artificial Sequence: Synthetic coding sequence
atggaccagcgaaaaaacgaatcaatagtgccttctattacacagctcgaggatttcctcacagaacacaacagcaatgtcgtatggctgctcgttgccacaatcctgagttgcggatggattatttacctcacctactacaattcccgtaatgtcggtctgattctgacactggtgctcaacagactctataagcatggctatatccatattggcagtttctccttctctgttctgagcgggaaggtcatggtgagagagatctattacatcaccgaagacatgagcatccgcattcaggatggcttcattatcttcaggtggtggaagatgtacaacccaaagcaaaaacagcatgaccctaaggcagaaacccgactctacattactgtgaatgactttgaatttcacgtgtataatcgatctgacctatacggtaggcttcaggagctgttcggtctggagcctactattatccccccaaagaaggacgacgataaaactcgcgagatcggacgcactagaactcagtctaagattgaaagggtgaaagtgaagaccgagtcgcaagatccgactagttcatggagatctctgatcccggttatcaaggtgaacgtcagtaccggtaggcttgcattcgggaaccactaccagccacagactctttgcatcaatttcgatgacgcatttctgacttacacaaccaaaccaccaagctcgcatcttgatcagtttatgcacattgtcaaaggaaagctcgaaaatgtgagagtgatgctcgtgcctagtccccgttacgtagggctgcagaacgatgagccacccaggctgatgggggaaggattcgtggtgatgcagagcaacgacgtggatatctactattatatggatgagccaggactggtgcccgaagagactgaggaaaacattgagggggagatgtctagcgaagactgcaagctacaggacctgcccccatgctggggcttagatatcgtctgcggcaaagggactgattttaattatggaccctgggccgaccgccagcgtgattgcctgtggaaattcttcttcccgccagattaccaggtcctgaaagtctctgaaatagcccaaccaggcaggccacgccagattctggcattcgagctcagaatgaacattatcgccgatgccacaattgacttgctgttcacaaagaatcgagaaaccaatgcggtacacgttaatgtcggggctggctcttacctggaaatcaatattccaatgactgttgaggagaatggatacacgcccgcaatcaagggccagttattgcacgtagacgcgaccacgagcatgcagtaccgcacactactggaggcggagatgttggccttccacatcaatgcctcatacccgagaatctggaacatgccacaaacctggcagtgcgagctggaggtgtataaagcgacatatcacttcatcttcgcccagaagaatttttttaccgacttaatacaggactggtcttcagattcacccccagacatcttctcattcgttccatatacatggaatttcaagatcatgttccatcagtttgaaatgatctgggcagctaatcagcataattggatcgattgctctactaagcagcaggagaatgtgtacctggccgcttgtggagagaccctgaatatcgacttttccctgccatttacagacttcgtgcctgccacttgtaacaccaaattctcattaaggggcgaggatgttgatctacacttgtttcttcccgactgtcatccatccaagtacagtctttttatgctcgtgaagaattgtcatccaaataagatgatccacgacacaggtatccccgctgaatgccagtccgggcaaaaaaccgtcaaaccaaaatggcggaatgttacccaggaaaagagcggatgggtggaatgttggaccgtgccttccgtcatgctgacaattgactacacatggcaccccatctatccgcagaaggcagatgagcaactcaaacaaagtctgagcgagatggaggaaactatgctatccgtcctgagacctagccagaaaacaagcgatagagtggtgagttcaccatccacaagcagtcggcctcccattgatccaagtgagctaccgccagacaagctccatgtggaaatggagctttcccctgatagtcaaattaccctgtacggcccactgcttaacgcctttttgtgcattaaggaaaactatttcggagaagacgatatgtacatggacttcgaggaggtgataagcagccctgtcctgtccctcagcacctcttcttcaagcggatggaccgccgtgggaatggagaacgacaagaaagagaacgaaggctctgccaagagcatacatccgctggctctgagaccatgggatattaccgtcctggtcaacttgtacaaagttcatggcagactcccagtccacgggaccaccgacggacctgaatgtccaactgccttcctggagagactgtgctttgaaatgaaaaagggctttagagagacaatgttacaacttatcctgtcacccctaaatgtattcgttagcgacaattaccagcagcgtcctccagtggatgaggtgttacgtgaagggcatattaacctgtccggattacaactccgggcacacgcaatgttttcagctgagggcttacctttaggatcagacagtttggagtatgcctggctgattgacgttcaggcaggaagcctgactgctaaggtgacggcaccccaattagcctgcttactggagtggggtcaaacttttgtgttccatgttgtgtgtcgagaatatgaactggagagacctaaatctgtgatcatttgtcagcacggtattgaccggcgtttttgtgagtctaagttatcctgtatcccaggtccctgccccacatcagatgatctgaaatacacaatgatccgactggccgtcgatggcgcagatatctacatcgtggaacatggctgcgctaccaacattaaaatgggagcaatcagagtcgcgaattgcaacttacataatcagtccgttggagagggaatctccgccgcaatccaggacttccaggtcagacagtacattgagcaattgaataactgcaggatcggattacagcccgctgtactgaggagggcgtattggctggaagccggatcagcgaatctgggcctgatcaccgttgacatcgccttggctgctgaccaccattctaagcatgaagctcagcgacactttctggagactcacgatgcgagaaccaagaggctgtggttcctctggcccgacgacatcctgaagaataaacgctgtcgaaataagtgtggatgcttagggggatgccgcttcttcggcggtaccgtgaccggtttagactttttcaagctggaagaactgactccgagctcctctagtgcctttagtagcacatctgcagagtctgatatgtactacggacagtcccttcttcagcctggggagtggattattaccaaagagattccaaagataattgacgggaatgtgaacgggatgaagagaaaagagtgggagaataagtctgtaggcattgaagtggaacgcaaaacacagcacctgagcctgcaggtgcctcttcggtctcactcatctagcagcagttccgaggaaaatagtagtagctcagcagcccagcctttgttggcgggagagaaagaaagcccgtcgagtgttgcggatgatcacctcgtccagaaggaattcctgcacggcaccaagagggatgacgggcaagcctctatcccaaccgagatttcaggcaactcacctgtatcacccaacacccaagacaagtcagtgggacagagcccacttagatctcccctgaaacgtcaggcgtcagtttgctcaaccaggcttggtagtactaagtctcttacggcagctttttatggcgacaaacagccagtgaccgtgggagtgcaattcagtagcgacgtttctcggagtgacgagaacgtgttggattcccccaaacagaggagatcatttggctcatttccttataccccaagtgccgacagcaattcattccatcagtaccggagtatggacagctccatgtcgatggcagatagcgaggcatacttttccgccgcagaagaatttgagccaataagttccgatgagggcccaggaacttatccgggtagaaagaaaaaaaaaaaacagactcaacagatcgattattctaggggctccatataccactctgtcgaaggcccactcactgggcacggggaatcaatccaggattctaggacactgcctttcaaaacacatccctcccaggctagtttcgtgagtgcactgggaggagaggacgacgtgatcgagcacttgtatattgtggagggagaaaagacagtcgagagcgagcagatcacgccacagcagccagtgatgaattgctatcagacttatctgacacaatttcaggtaataaactggagcgtgaaacaccccaccaacaagaggaccagcaaaagtagcctgcatcgaccgttggacttggatacaccaacctcagaggaatcctcttcttcctttgaacaacttagtgtgcctacctttaaggtcatcaagcagggcctcacagctaattctttattggaccgcggaatgcagttatctggatcaacttccaatacgccctatactccactcgagaagaaactcgccgacaatacggacgatgaaaccctcaccgaggagtggacactggaccagccggtttcccagaccagaaccaccgcaattgtggaggtcaaaggcaccgtggatatcgttcttacaccactcgtcgctgaagcattggacagatatattgaggctatggtccactgcgcatccacccggcacccggctgctatcgtagacgacctgcatgctaaggtcctccgggaggccgtgcaaaactctaagaccaccttcagtgaaaacctatcctctaagcaggacatacgcggaacaaagactgaacagtctacaatcggaacgacgaatcaagggcaggctcagacaaatctcacaatgaaacaggataatgtcaccatcaagggactgcagacaaacgtgagcatcccaaaagtcaacctatgcctcctccaggcaagcgttgaggaaagccctacaacagctcctagtagaagcgtcacccatgtgtcactggtggctctgtgtttcgaccggattgctacacaggttcgtatgaacaggggcgtcgtggaagagactagcaataatgcggaaccaggaagaacctctaacttcgatcggtacgtgcacgccacgaaaatgcagccccagtcaagtgggtcccttcggtccaacgccggtgcagaaaagggaaaggaaattgcggctaagctgaatatccatcgtgtccacggtcagcttcgaggattggataccacggatatcggtacctgcgccatcacggccatcccatttgaaaaaagcaaggtgctgttcacattagaagagctggacgaattcacattcgtcgacgagacagaccaacaggccgtccctgatgtgacccggattgggccttcccaggagaaatggggttggattatgtttgaatgtggcctggagaatctgacaatcaagggcggtcggcagtcgggggctgtcttgtataactcatttggaattatgggcaaagctagcgatacggagcgcggaggagtgctcaccagcaacaatagctcagactctcctactggttctggttacaacaccgatgtgtcagatgacaaccttccttgtgatcggacctcccccagctcagacctcaatggaaattcagtctcagacgaacaggatgagggcgtcgagtctgatgacctcaagaaggatctgccactgatgccccctccccctgacagttgttctatgaagttgacaattaaggaaatatggttttccttcgcggctcccaccaatgtacgtagccatacacatgcctttagccgccaactgaatctgctgtctactgccactccggcagtgggcgcatggctagtcccaatagatcagcttaaaagtagcttaaacaagctggagaccgaaggtaccctgcggatttgtgcggtcatggggtgtatcatgaccgaagcgctggaaaataaatccgttcatttcccgctccgctctaagtataatcggctcaccaaagtcgctcggttcctgcaagagaatccctcttgtttgctgtgtaatatccttcaccactacctgcaccaggccaattacagcatcattgatgacgccacgatgtccgatggactgccagccctggttaccctgaaaaagggactggtggcactcgcaaggcagtggatgaagttcatcgtggttacgccagcttttaagggggtgtccctccatcggcctgcacagccacttaagccacagattgcgatggaccatgaacacgaggacgggcttgggttagataatggcggagggctgcaaagcgatacatcagccgatggtgctgaatttgaatttgacgccgctacagtatcagagcacaccatgcttctcgagggcaccgctaaccgccctccgcctggcagtagcgggccagtgacaggcgcagagattatgcgcaagctgtcgaaaacccatacccactccgattcagcattgaagatcaaaggcatccacccctatcattctttaagctatacctccggcgacactgccactgacagccccgtccacgtggggcgagcaggcatgcctgtcaaggatagccctaggaaggagtccctgctttcctacctgacaggatcattcccctccttacataatctgctggagggcactccacagaggtcttctgctgccgtgaaaagctctagtctgacccgcaccggcaacaccgtggcgaccgacatgctgtcagaacacccattactttcagaaccctcaagcgtgagcttctacaactggatgtcaaacgccgtgggcaatagaggtagtgtgcttcaggagtctccggtcacaaaatcggggcacaactccctgcctacaggtgtcgcccctaatctacccacaattccaagtgcttccgacttcaacaccgtcctgtcttccgaccagaatacactggacggcacccattctcagcactccacgtcacaggatgatgtcgctggtgtggaagaagcaaaccaaggtttccctgctgtgcagctcgctgatgcccaagtggtgtttaaacccctgctgtcacacaccggcattcagtcccaggacactatgccattctgctatcgcatgtacttcggagagcacctgagtttctcaggcaccctggattgcctgagggcagacatagttgactcggatactgctaaagaaaggaagggtaaacgagctcggaggcagggacacgtcaacttacccccactggaatttaaaccggctttgatgctggggacattttcgatctccgcggtggttatggagaagtctgtgtgcacaccgcagaattccaccagcgcgctttctttccatgacttgtccaaacggtactacaatacatttcactgtaactttaccataagctgtcagagcatcagccagcatgtagacatggcattggtcagactcatccaccagtttagcaccatgatagacgacatcaaagcaacccagactgatattaaactgtcccgttacactgcgggttctgcatcccctaccccaacattcaagacccggaaacaccgggactttagatcatcggatttctcaagatctagccggggttctctgaacggcggaaaccgtgtgaacaatgctaaaaacaaacggacaaacaacgagaacaataaaaaagaatcacggaataagaactccctaggcaggtcggagcgtaggacctcgaaagtgtccagaaagggatctaaggacgtagtcgatcacatgaccatccatatggacgatagcgacagcattacagttagcgagcagagtgagccatccgccgagtgttggcagaacatgtataagctcctcaatttctactcccttattagtgaccccactggaatactggagaaaagctcagaaacattcgggcctgccggagtccgctccccaactgaaccgacttgcaaggtggtgtttgaaaacgagcaggacaactccagtctgactaaaactcagcgaaaacgatcgcttgtgacctctgagccacagcacgtcaccctcattgtgttcgggattgggatggtgaatcgcacccacctggaagccgacatcggaggtctgaccatggagtccgaattaaaacggatccacggatctttcacactcaaagagaagatgaaggacgttctacaccagaagatgactgagacttgcgccaccgcccacattggtggcgttaacattgtgctcctagaggggatcacacccaacattcagttagaagactttcccaccagccccaccagcacggcaaagcaggagtttctgacagttgtaaaatgttccatcgcaaagtcacaggccctgtattctgcccagagagggctgaaaacgaacaatgcggctgtctttaaagtcggcgcaatttcgatcaacatccctcaacacccagccaccctgcattcaatgatggtcagatctagtcatcagctcagtaaacagatctcagatctgatcagacagccctctaccgctccacagcccgtcaaggaggatatcgccacccctttacctagcgaaaagacccccaccagcgtcaatcagaccccagtcgagacgaatgaatttccccagctgccagagggcctggaaaagaaaccaatcgtgctgaagtttagcgctatgctcgacggaatcgctattggtgctgccctcctgccctctcttaaagctgaatacaaaatgggtcgcatgcgaagccacggcatgaccggtgcacagacacggttcaccttcgaactgcccaaccatcggctgagattcacgtctaaggtatccgccaccgatatgtctacaatccccccaagcgctagtcttaacttgccgcctgtgaccatgagcgggaaatacataatggaagagcacgacagctattccgaccaagtgtggtcgatcgacgaacttccctctaagcagggctattatctgcagggtaactacttgcgctgcgtagccgaggtgggatcgtttgagcataacctcactaccgatctgctgaaccatctggtgtttgtgcagaaagtatttatgaaggaggtgaatgaagtcatccagaaagtgtctggcggagaacagcctatcccactttggaacgagcacgacggaacagcagatggcgataagccgaaaatactgctttactccttaaacctgcaattcaagggcattcaggtcaccgcaactacaccaagcatgagagcagtaaggttcgagaccggcctcatcgaactggaactgtcgaatcgtcttcagactaaggctagtcctggaagctcctcttatctgaagctctttggcaagtgccaggtagacctaaacctagctttagggcagatcgtgaagcaccaggtatatgaggaggcaggctctgactttcatcaagtggcatacttcaaaactagaattggcttgcgcaacgccctcagggaggagatatcaggatcttccgatcgagaggccgttttgataactttgaatcggcctatcgtgtacgcacaacctgttgcctttgacagggctgttctcttttggctgaactacaaagccgcttatgataactggaacgaacagcggatggcgctgcataaggatatacacatggctaccaaagaagtggtggacatgctgccagggatccagcagacaagtgctcaagcctttggcacactcttcctccagctcacagtaaatgatcttggaatctgtctaccaatcaccaatacagctcagtcaaaccatactggagatttggatactgggagtgctttggtgctaacaatcgaatcaacattgattactgcatgttcttcggaatcattggtcagtaaggggcatttcaagaatttttgcattagatttgccgacgggttcgagacatcatgggatgactggaaaccagagatccacggagacctcgttatgaacgcttgcgtcgtccccgacggcacctacgaggtgtgcagcaggacaacgggtcaagccgcagccgaaagcagctccgctgggacatggacactgaacgtgctctggaaaatgtgtggtatcgatgtccatatggacccaaatattggcaagcgactgaacgctctcggtaataccttgaccactctgactggagaagaggacattgatgacatcgccgacctcaacagcgtgaacattgcggacctctcagacgaagatgaagtcgacacaatgtccccaactattcacacagaggcaacagactatcgcagacaggccgcttctgcctcacagccaggagagcttcggggtcgcaaaatcatgaaacgcattgttgacatacgcgagcttaacgagcaggcgaaggtgattgacgacctgaagaagctgggcgcttccgaggggactatcaaccaagagatacagcggtaccaacagctggaaagcgtggccgtgaatgacatccgcagagatgtccgcaaaaagttgaggcgctcctccatgagggccgctagtctgaaagacaaatggggcctgagctataaacccagctatagccgttccaagtcaatatcagccagtggtcggcctcccctgaagaggatggagcgggctagcagtagggtcggtgaaacagaggagctccctgagataagagtcgacgctgcctccccaggtccgagggtgactttcaacatccaggacacgtttccagaagaaacagaactggatctgctttcggtgaccatcgagggaccatcccattatagctccaattcagagggcagttgctcagtattctctagccctaagactcccggtggcttctcccctggaatccctttccaaaccgaggagggcaggagggatgatagcctgtcttcaacatccgaagattctgaaaaagacgagaaagatgaggaccacgagcgcgagcggttttatatttaccggaagccgtcccacacctcccgcaagaaagccaccgggttcgccgcagtccaccagctgtttaccgaaaggtggcccacgactcctgtgaacaggagtctgagcggcactgctactgagagaaacatcgactttgaactagacatccgagtggagattgactcaggtaagtgcgtgctccacccaaccacgctgctccaggagcacgatgatataagcctgcggagaagttatgaccggagcagcagatcactcgatcaggactccccaagcaagaagaagaaatttcaaaccaattacgccagtactacacacctaatgaccggcaagaaagtgccgtcttccttgcaaactaaaccatcagacctagaaaccacagtgttttacatccctggcgtggacgtcaaattgcactacaatagcaagacgcttaaaacagaatccccaaatgcgtcacggggtagctctttacccaggactctgtctaaggagagcaaattgtacggtatgaaggattccgccacgtccccccctagccctccactgccgtctactgtacagagtaaaaccaataccttactgccaccacagcctccacccatcccggcagcaaaaggaaaggggtcaggcggtgtcaagaccgctaagctctatgcatgggtagcactgcagtctttaccagaagaaatggtgatatctccttgccttctggactttttggagaaggcactcgagacgattcccattactcccgtagaacggaattacactgccgtatcctcccaggacgaagacatgggccattttgagattccggacccgatggaagaatcaacaacatctttagtgtcaagtagcactagtgcttattccagtttcccagtcgacgtagtcgtctatgtacgtgttcagccgagtcagattaaatttagttgccttcctgtctcgcgggtggaatgtatgctcaagctgccctctctggatctagtcttttcctctaacagaggcgaacttgagacgctcgggaccacctatccggcagaaacgctgtctcctggtggaaacgccacccagagtggtaccaaaacatcagcctcaaagactggaatccctggctcaagcgggctggggagtccgctgggaagaagtcgacattccagttcacagtccgaccttacaagctcctcatcctccagttctgggcttagcttcaccgcctgtatgagcgacttttctctatatgttttccacccatacggtgctgggaaacagaagaccgctgtatccgggttgaccccaggctctggcggtctgggtaatgtcgatgaagaacccacctctgtgaccgggagaaaagatagtctctctattaacctggagttcgtgaaggtgtccctgagtaggattagacgcagtggaggagccagcttctttgagagccagagcgtatcaaagagcgcatccaagatggacacaactctcattaatatcagcgccgtctgcgacatcgggtccgcctcgttcaaatatgatatgcgcaggttatccgagatcctcgcctttcctcgcgcttggtaccgccgaagtattgccagacggcttttcttgggggaccagacaatcaatttgcctacatccgggccaggaaccccagactcgattgagggcgtcagtcagcacctctccccagaaagtagccggaaggcgtactgtaaaacctgggagcagccatcccagtccgcctcttttacgcatatgcctcagagcccaaacgtgttcaatgaacatatgaccaattccaccatgagccccggaaccgtgggacagtccctgaaaagcccagccagtattcgctcccgttccgtgtccgattcttcagtgccacgacgtgactcgctgtctaagacttcaacgccatttaacaaaagtaataaagcggctagtcagcagggcacaccatgggagacactggtggtgtttgcaattaacctaaaacaactgaatgtgcagatgaatatgtcaaacgtcatgggcaatacaacctggactacaagcggacttaaaagccagggccgtctgagcgtgggttctaacagagatcgagagatttctatgtccgtcgggcttggcagaagtcagctggatagcaaggggggagtcgtcggaggcaccatcgatgtgaatgctctggagatggtggctcacatctccgaacaccctaatcagcagccgtcccacaagattcagatcaccatgggtagtaccgaggctcgcgttgattatatgggaagcagcatcttgatgggcattttttccaatgccgacctcaaacttcaggatgaatggaaggtaaatctgtataataccttggacagcagtattacagataaaagtgagatcttcgtgcatggggacctgaagtgggacatttttcaagtgatgatttctcggtcaaccacaccagatctgatcaaaataggaatgaagttgcaggagttttttactcaacagttcgacaccagcaagcgagcactatcgacttggggaccagtcccctatctgccgcctaagacaatgacatccaatctggagaaaagctcgcaggaacagctgcttgatgcagctcatcatagacactggcccggagtattgaaagtggtgtctggatgccacatttccctgtttcaaatccctcttcctgaggacggaatgcagttcggcggatccatgtcactgcatggcaatcacatgacgctggcttgtttccatggacccaatttccgaagcaagagttgggccctgtttcatttagaagagccaaatatcgcattctggacagaagctcagaagatctgggaggatggatcgtctgaccactccacatacatcgttcagaccctggactttcacctcggacataatacaatggtaaccaaaccctgcggggcactggagtcacccatggctacaattaccaaaatcaccagacgaaggcatgagaaccctcctcatggcgtagcaagtgtgaaggaatggttcaattatgtcaccgccacaaggaatgaggagctgaacctgctgcgtaatgtggacgccaacaataccgaaaacagcacaaccgtgaagaattcttccctgctgtctgggttcagaggtggtagctcttacaatcacgaaacagaaacaatcttcgcattgcctcgcatgcagctcgactttaaaagcattcacgtccaggaaccccaggagcctagtctccaggatgctagccttaagcccaaagttgagtgcagtgtcgtcactgaattcaccgatcacatctgcgttactatggacgctgagctgataatgttcctgcacgacctcgtgagcgcctatctgaaagagaaggaaaaagcaatctttcctccccgtattctttccacccggcctggtcagaagtctcccatcattattcacgatgacaattctagtgataaggacagggaagattccattacctatacgacagtggactggcgcgacttcatgtgcaatacctggcatctcgaacccactttgcgcctcattagctggactggccgaaagatcgaccctgtaggtgtcgactacatccttcaaaagctggggttccatcatgctcgtacaactatcccaaaatggctgcagcgcggtgttatggaccctctcgacaaagtgttaagtgtactcatcaagaaactgggcacagccttgcaggatgagaaagagaaaaaaggcaaggacaaggaagagcactaa

SEQ ID NO: 236624 - DNA, 1287 bp, Artificial Sequence
  Description of Artificial Sequence: Synthetic coding sequence
atgggtggcctgttttctcggtggagaactaagccttcaacggtggaggtattagagtctatagacaaggagattcaggcgctggaggagttccgggagaaaaatcaacgactccagaagctatgggtcggcaggcttatcctatattcatcagtcctgtatcttttcacgtgtctgatcgtttacttgtggtatcttcccgacgagttcaccgccaggcttgctatgaccctgcccttctttgcatttcctctcattatttggtctatccggaccgtcattatcttctttttctcaaaacgaacagagcggaataacgaggcccttgatgatctgaaatcccagaggaaaaaaatccttgaagaggtcatggagaaagagacctacaaaactgcaaaactcattctcgagcgctttgacccagacagcaaaaaggccaaagaatgtgaaccaccgagcgctggggctgctgtgaccgcaaggcctggccaagagatcagacagcgcaccgccgctcaacggaacctgtcccccacgcctgcaagccctaatcagggtccccctcctcaggtgcccgtatcacctgggcctccaaaagatagtagcgcacccggtggaccacctgaaagaacggttaccccagcactctcgagtaacgtcctgcctaggcatcttgggtcgcctgccacatccgtgccaggcatgggactccaccctccagggcctcccctcgctaggcctatcttacctagagaacgcggtgccctggataggatcgtggagtacctcgttggggacgggccacaaaaccgctacgccttgatctgccagcagtgctttagccacaacgggatggctctcaaagaagagttcgagtatatcgcatttaggtgcgcttattgctttttcctgaatcctgctcgcaaaacgcgacctcaggcccctagactgccggagttttcctttgagaagcggcaggtcgttgaagggtcctcgtctgtgggaccactgccctctggttcggtactgagtagcgataatcagttcaacgaagaatccctggaacacgatgttttagatgataacacagagcagacagatgataaaatccctgccaccgaacagacgaatcaagtgatcgagaaggcaagcgattctgaggagcctgaggaaaaacaggaaaccgagaatgaggaggcctcagttatcgagactaactccacagtccctggggcagactctatccctgatcctgagctatcaggcgaatctctgacggccgaatag

SEQ ID NO: 236625 - DNA, 2718 bp, Artificial Sequence
  Description of Artificial Sequence: Synthetic coding sequence
atggacagtaccgcttgtctcaagagcctattgctcaccgtctcacaatataaagcagttaagtccgaggctaacgccacgcagctgctgcgtcacctcgaggtcatcagcggtcagaaactgacgcggctctttacctccaaccagatcttgacctcagagtgcctgtcgtgtctcgtcgagctgctggaagatcctaacatcagcgcatcccttatcctttctattatagggctgcttagtcagctcgctgtggacattgagactcgcgattgtttacagaatacgtataatttaaactctgttcttgctggagtcgtgtgcaggtccagccataccgactccgtgtttctgcaatgtatacaactgctgcagaagctcacttataatgtcaagatcttctacagcggagcgaacattgacgagcttatcacgttcttgatcgaccatatccagtctagcgaggacgagctgaagatgccctgtctgggacttttggccaacttgtgcagacacaacctgagcgttcaaacgcacataaagactctgtcaaacgtcaagtcattttatcgcacattgatcaccttactcgcacattctagcttaacagtggtggtcttcgcgctttcaatcttgagctcactcacactgaacgaggaggttggggagaaacttttccatgccaggaacatccatcagaccttccaactgatattcaacattcttattaacggtgatggcacgctcacccgtaagtactcggtggacctcctgatggacctgctaaagaaccctaaaattgccgactatttgaccaggtacgaacatttctcatcttgcctgcatcaggtgcttggactactgaatgggaaagacccggactccagctctaaagtgctggagctgctgttggcattttgttcagttacccaactgcgccacatgctgacgcagatgatgttcgagcaatcccccccagggtcagcaacactcggatctcacacaaagtgtctggagccaacggttgctctcctgaggtggctgtctcagcccttggatggctcggagaactgctcagttttggctctcgagctgtttaaagaaatttttgaggacgtgatcgacgcagctaactgctcctcagctgatagattcgtaacacttctgctccccactatcctggatcaactccagtttactgagcagaatctcgacgaagcgttgacaagaaagaagtgtgaaagaattgcaaaagctattgaggtactactcaccctctgcggtgatgatacactgaaaatgcacatcgccaagatccttacaacagtaaaatgtacgacactgatagagcagcagttcacgtacgggaaaatcgacctcggcttcgggaccaaggtcgccgattcagagctgtgtaagctggctgcagacgttatcctgaagactctcgacctcattaataaactcaaacctctcgtccccggtatggaggtgtccttttataaaattcttcaggaccccagactgattacccccctggcctttgcgctgacgtcagataatagggaacaggttcagtcggggctcagaattctactggaggctgccccactccctgattttcccgctctagtgctgggagagagcatcgcagccaacaatgcttacagacagcaggaaaccgaacatatccccaggaagatgccctggcagtcttctaatcacagctttcctaccagtattaaatgtctgacaccccatctgaaagacggagtgcccggactgaatatcgaggaactgatcgagaagctgcaatcaggaatggttgtgaaagaccaaatatgcgacgtcaggattagcgacattatggatgtttacgagatgaaactgagtactctggcatctaaggaatcacgcctgcaagatcttctcgagactaaagcgttagctctagcacaggcagatcgattaatcgcccagcacaggtgccagaggacgcaggctgagacggaagccaggacgctcgcaagcatgctgcgcgaagtagaacggaagaacgaagagttgtccgtgctccttaaagcccagcaagttgagagcgagcgggcacagagtgacatagaacacttgtttcagcacaatagaaagctagaaagtgtcgccgaggaacacgaaattctgacgaaatcttacatggagttgctgcagaggaacgagtccaccgagaaaaagaacaaggatctccagatcacctgtgactccctgaacaagcagattgaaacagttaagaaacttaatgaaagcctcaaggaacagaatgagaagagcattgcccaactgattgagaaagaggaacaaagaaaagaggtgcagaaccagctggtcgatagggaacacaaactggccaaccttcatcagaagaccaaagttcaagaagaaaaaataaagaccctgcagaaagaaagagaggacaaagaggaaacgatcgacatccttcgtaaggagctgtcaaggaccgaacagattcgtaaggagttgtcaataaaggcatccagcctggaggtccagaaagcccaactggaaggacgtctcgaggagaaggaatcgctggtgaagctgcagcaggaggagctcaacaagcattctcacatgattgccatgattcacagcctctctgggggaaaaatcaaccccgaaacagtaaatctctcaatttag

SEQ ID NO: 236626 - DNA, 2370 bp, Artificial Sequence
  Description of Artificial Sequence: Synthetic coding sequence
atgctggagggaaactatcaggtaatgttaaaatctggcacaaacattctgtactggcgaaccacagggattctcatgggcagtaaggctgtgaagccagtactagttaagaatatcaccatagaaggggttgcctacaccagcgaatgctttccatgtaaacccggaaccttctcaaacaaacccggtagcttcaactgccaggtgtgcccacgcaacacttactctgagaagggcgcaaaggagtgcattaggtgcaaggatgattcacagttcagcgaagagggcagcagcgagtgcactgaaaggcccccatgtactacgaaggattactttcaaatacacaccccttgtgatgaagaaggaaagacacaaatcatgtacaagtggatagaacccaagatatgccgcgaggatctgaccgacgccatccgcttgcctccatctggtgagaaaaaagattgtcctccatgcaatccaggattctacaataatggcagtagctcctgtcacccatgtcccccaggtacattttccgacggaactaaggagtgcagaccgtgtcccgctgggacggaacccgcacttggattcgagtacaaatggtggaatgttctgcctggaaacatgaaaacctcttgtttcaacgttggaaacagcaaatgcgatggcatgaacgggtgggaagtcgctggagaccatatccaatctggcgctggagggtccgataacgactatctgatcctgaacctgcacatccccggattcaaacctcccacatcaatgacaggggctacgggcagcgagctgggcagaataaccttcgtgtttgaaaccctctgctccgccgattgtgtcctttacttcatggttgacatcaatagaaaatctaccaacgtcgtggaatcttggggtggcaccaaagagaaacaggcatacacacacattatctttaagaacgctacctttacttttacctgggcgtttcagcgcaccaatcaggggcaagataacagacgattcataaacgacatggtaaagatatattcgatcaccgccacaaatgccgtagacggggtcgccagttcttgcagagcatgcgctctgggctctgagcaatctgggtcatcatgcgtgccatgtccacccggacattatattgaaaaggagaccaaccaatgtaaagagtgtccccctgacacgtatttatcaatacatcaggtatacggtaaggaagcctgcatcccctgtgggccagggtccaagaataaccaggaccattcggtttgctattctgactgtttcttttatcacgaaaaggaaaaccagtctctccactacgactttagcaacctctcttcagttggcagcttaatgaatggtccctccttcactagcaagggcacaaaatatttccatttttttaacatatcactgtgcgggcatgaaggcaaaaagatggcactgtgtaccaataacatcaccgactttacagttaaggagatagtggctgggtccgatgattatactaatctcgtcggcgcattcgtgtgccagagtaccataattccatcagaatcaaaagggttccgggcagcactgtcatctcagtcaatcatactggcagatacattcattggcgtgacagtggagacaaccctcaagaacattaatatcaaagaggacatgtttccagtccctacaagtcaaatcccggacgtgcattttttttataaaagttctacggctacaacaagttgtatcaatgggcgttctactgctgtgaagatgcggtgtaaccctaccaagtctggcgctggcgtcattagcgtgccaagtaaatgcccagccggtacatgcgatggctgtacgttttacttcctttgggaaagcgcagaagcatgtcctctgtgtactgaacacgatttccacgagatagaaggcgcatgcaaacggggtttccaagagacactttatgtctggaatgagccaaaatggtgcatcaagggcattagcctccccgagaagaaacttgccacctgtgagaccgtcgacttctggctgaaagtaggtgcaggggtgggcgcatttacggccgttttgctggtagccttgacttgctacttctggaagaagaatcaaaagctggaatataagtattccaagcttgtaatgaccacgaactcaaaagagtgtgagctgcctgctgccgacagctgtgccatcatggaaggcgaggataacgaggaggaagtagtgtactctaataaacagtctctcctgggtaagctcaaaagcctggctacgaaggaaaaggaggaccactttgagtccgttcaacttaaaacctctcgttcgcccaatatttag

SEQ ID NO: 236627 - DNA, 336 bp, Artificial Sequence
  Description of Artificial Sequence: Synthetic coding sequence
atggtgcgaaccaaggctgatagcgtgccagggacctaccgcaaggttgtcgccgctagagctccgcgtaaagtccttgggtctagcacatcagccactaacagtacgtctgttagcagccggaaagctgagaacaagtatgccggaggaaacccagtgtgcgtaagacccacacctaaatggcagaagggcattggtgagttctttaggttgtcaccaaaggattcagagaaagagaatcagatcccagaggaggccggttcttctgggctgggcaaagccaagaggaaggcttgcccattgcaaccagatcacacaaacgatgagaaggagtag

SEQ ID NO: 236628 - DNA, 2772 bp, Artificial Sequence
  Description of Artificial Sequence: Synthetic coding sequence
atgagccaatttaagcgacagcgcataaacccattacccggaggaaggaacttttcaggtactgccagtacctctttactgggcccaccgccagggcttctgacccctccggtagctactgagctcagccaaaatgcgcgacacttacagggaggcgaaaagcagcgtgtgttcacaggtatcgtcacaagcctccacgattactttggagttgtcgatgaagaggtattctttcagttgagcgtggtgaaaggacgtctaccccagctaggcgaaaaagtgctcgtgaaggctgcatacaatcccggacaggcagtaccctggaatgctgtgaaggtgcagacgctcagtaatcaaccactgctcaagtcgccagcgccacccttactgcacgtggcggctttggggcagaagcagggcattttaggtgctcagccgcagcttatctttcagcctcaccgaatcccacctctgttcccccagaagcctctgagcctctttcagacgagccatacattacacctgagtcacctaaacagatttcccgcacgcggacctcatggcagactcgatcagggcaggagcgacgattacgattcaaaaaagaggaaacagcgtgccggaggggagccatggggggcaaagaaacccagacacgatttaccgccatatagagtccacctgactccctacactgtggactctccgatctgcgattttcttgagctccagcgacgctatcgttccctgctggtgcccagcgactttctgagcgtccacctcagctggcttagcgccttccccctgtcccagcccttctcacttcatcacccaagccgcatccaggtttcgtcagaaaaggaggcagcaccggatgccggtgccgagcccattacagctgattctgaccctgcttatagttcgaaggttcttctcctgtcgtcccctggactcgaggagctgtacaggtgctgtatgctctttgttgatgatatggctgagcccagggagacaccagagcaccccttaaagcagatcaagttcctgctgggcaggaaggaggaggaagccgtcctagtggggggagaatggagcccatccctcgacggactggatccccaggcggaccctcaagtactggtgcggacggccatccggtgcgcacaggcacagaccggtatagatctgtctggctgcacaaaatggtggcggttcgccgaatttcaatacttgcagccagggccaccgagaaggttgcagacagtcgttgtgtatctgcctgacgtgtggacaatcatgcccacgttggaggagtgggaggccctgtgtcaacagaaggccgcagaagcagcccctcccacacaggaggcccaaggcgaaacagaaccaacagagcaagcccctgacgccctcgagcaggctgcagatacctcccggaggaacgctgaaacccctgaagcaacaacacagcaggaaaccgacacggacctgccggaggcgccaccacctcccctagagcccgcagtcatcgcgagaccgggatgcgttaatttaagcctgcatggtatcgtcgaagaccggcgtcccaaggagaggatttctttcgaggtcatggtgctcgccgagctctttctggagatgctccagcgagattttgggtacagagtgtacaaaatgctacttagcttgcccgaaaaggtggtatctccacctgagcctgagaaggaagaagccgctaaggaggaggccacaaaggaggaagaggctattaaagaagaagttgtcaaagagcctaaggacgaggcccagaatgaaggtccagccaccgagtcggaagccccactgaaggaagacggactgttgccaaagccactctcctccggcggagaggaggaggagaagccgcgaggcgaagcctcagaagatctctgtgagatggcactcgaccctgagttgttactgctccgagatgacggggaggaggagttcgccggagcgaaactcgaagactcagaggtgcgcagtgtggccagcaaccagtccgagatggaattttcttcactgcaagacatgcctaaagagctggacccctccgcagtgctacccctcgactgtctcttggcattcgtgttttttgacgccaactggtgcggttacctacatcgtagagacctggagaggatactgctcacccttgggatacgtctgtccgccgagcaggccaaacagctggtaagtcgagtcgtcacacagaatatatgccaatatagaagcctgcagtactcaagacaggaggggttggatggcggattgcccgaggaagtcctgtttgggaacctggacttactgccacccccaggtaagagcaccaagcccggagcagccccaacggagcataaagccttagtgtctcacaatggctccctcattaacgtcggttccctgttgcaaagggccgaacaacaagactccggtagactgtatctcgaaaacaaaatccacactctggaactgaagcttgaagagtcccataacagattttctgcgacagaagttacaaacaaaaccctggcagccgaaatgcaggagctgcgggtgagattagctgaagctgaggaaaccgcgcgaacggctgaaaggcaaaaatcacagctgcagcgtctccttcaggaattgcgcaggcgtcttactcccctgcagctggagatacagagagtggtggaaaaagcggatagctgggtcgaaaaagaggagcccgcaccatccaactag

SEQ ID NO: 236629 - DNA, 3480 bp, Artificial Sequence
  Description of Artificial Sequence: Synthetic coding sequence
atgttggattttctggccgagaacaacttgtgtggacaagccatcctcagaatcgtttcttgtggtaatgctataattgcagagctcctccgactgtctgaatttatccccgctgtgtttcgattgaaggatcgggctgaccagcagaagtacggcgacattatatttgacttcagctatttcaaaggacctgagctctgggagagtaaactggacgctaagccagaacttcaagatctggatgaggagttccgcgagaacaacattgaaatcgtgacaagattttacttggctttccaatctgttcacaaatacatcgttgatctgaacagatatctggacgatctgaacgagggagtgtatattcagcaaacccttgagactgttctgttgaacgaagacggtaagcagttactctgtgaggcactgtacctgtacggtgtgatgcttttagtgatcgatcaaaagatcgaaggtgaagtgagagaaagaatgttagtgtcttactacaggtactcggccgctagatcgtcagctgactcgaatatggacgatatttgtaagctcctgcgctctactggttactccagccaaccaggggctaagcgcccttccaactaccccgaaagctattttcagcgcgttccaattaacgagtcattcataagtatggtaatcggacgtctcaggtctgatgacatatataaccaagtctccgcataccctttaccggagcacaggtcaacagcacttgctaatcaggccgctatgttgtatgtgattttatacttcgagcctagcattctacacacccatcaggccaagatgagggaaattgtcgacaaatacttccccgataattgggtgatctccatttacatgggaattacagtcaatctggttgatgcttgggagccctacaaggctgccaaaacagcattaaacaacacactggacctatccaatgttcgcgagcaagcatctaggtacgcaactgtaagtgaaagagttcatgcccaggtgcagcaatttctcaaagagggatacctcagagaagaaatggtgctggataacatccccaagctgttaaattgtctcagggattgcaatgtggctatccgctggctgatgttacatacagctgattctgcctgtgatcctaataacaagaggctacgccagataaaagatcagatcctgaccgatagcaggtacaatcctcgcatcttgttccagctcctgcttgacacagcgcaatttgaattcattttgaaagaaatgttcaagcagatgttgtcagaaaaacagacaaagtgggagcattacaagaaagagggatccgaacgcatgaccgagctggccgatgtgtttagtggtgtcaaaccgctgacacgtgtagagaagaatgagaatctccaagcctggttccgcgagatatctaagcagatcttaagtttaaattatgacgattcaacagctgcaggacgcaagaccgtgcagttgatccaggctctggaggaggttcaggagttccatcagctggagtcaaaccttcaggtgtgccagttcctcgccgacacaaggaagtttctccatcagatgatcagaactatcaatatcaaggaagaggtgttgattaccatgcagatcgttggagacctttctttcgcgtggcagctgatagacagctttacttccataatgcaggaatcaattcgagtgaatccaagtatggtcacaaaacttcgcgctacattcttaaaactagccagtgcattggacctcccactacttcggattaatcaggcaaactctcccgacctcctgagcgtcagccaatattattctggagagctcgtgagctacgtgaggaaggtgctgcagattattccggagtccatgtttacttccctccttaagatcattaagttgcagacacatgacatcattgaggtgcctaccaggctggacaaagataagctgcgtgactacgcccagctcggccctaggtacgaggtggctaaactgacacacgccatcagcatctttactgaggggatcctgatgatgaaaaccactttggttgggattattaaagtggatccgaagcagctgctcgaagatgggatcagaaaagagctggtgaaacgggtggcctttgctttgcacagaggactcatcttcaaccctcgcgctaaaccaagcgaactcatgcccaaactgaaggagctgggcgcaactatggacgggtttcatcggtcatttgagtatatccaggactacgtgaacatatacggtttgaagatttggcaggaagaggtttcccgtattataaattacaacgtagaacaggaatgcaataattttctgcgcaccaaaatccaagattggcagtcgatgtaccagtctacgcatataccgattccgaaattcacccctgtggatgagtctgtcacttttatcggccgtctttgtagagaaattctgcggatcaccgacccaaagatgacatgtcacattgaccagctcaacacatggtacgatatgaagacacaccaggaagtcacttcatcacggctcttttcggaaattcagaccaccctgggaacgttcggcctcaatggtctggaccgcctactgtgcttcatgatcgtaaaggaattacagaatttcctatcaatgttccaaaaaataattctcagagatcgcaccgtgcaggacactctgaaaacgttgatgaacgcggtgtcgccattgaaaagtattgtggctaatagtaacaaaatctacttctctgccatcgcaaagacacagaagatttggacagcttacctggaggctattatgaaagtgggacagatgcagatcctgcggcaacagatcgccaacgagttgaattactcttgtcgatttgactccaagcatctcgccgctgccttagaaaatttgaataaagctttgcttgcagatatcgaggctcattaccaggacccatctctgccctaccccaaggaagacaacaccctcctgtatgaaattacagcgtatctcgaagcggctgggatccacaacccactaaacaagatctatattacgacgaaaagactgccctatttccctattgtaaatttcctgttcttaatcgcccagctcccaaaactccagtacaataaaaatttgggtatggtctgccgtaagcccaccgaccccgtggactggcctcctctggtattaggacttctcaccttactgaagcagtttcactcaagatatactgaacaatttctggctctgataggccagtttatctgcagtacggttgagcagtgcacctcacaaaaaataccagagattcctgccgatgtcgttggcgcactgctctttttggaagactacgtccggtataccaagctgcccaggcgagtcgcggaagcacatgttccaaactttatttttgacgagttccggacggtactctag

SEQ ID NO: 236630 - DNA, 2424 bp, Artificial Sequence
  Description of Artificial Sequence: Synthetic coding sequence
atgttctccgccggtgctgagtccctgctgcaccaggcgagggagattcaagatgaggagttgaagaagttctgttcccgaatctgtaagttgcttcaggccgaagatctcggcccagataccttagatagccttcagaggttgtttctgattatctccgccacgaaatatagccgtcggctcgagaagacatgtgtggacctgctgcaagcaacactggggctccctgcctgcccggaacagcttcaggtgctgtgtgcagccatcctccgcgaaatgagcccctctgattccctcagccttgcctgggatcacacccagaacagtcggcaactgagcctggtagctagtgtgctgctggcccagggcgatagaaatgaggaagtacgcgctgtgggacagggggtcctgcgcgctcttgaaagccggcaaccggaaggccctagcctacgccatctgctgcccgtgatggccaaggtggtggtcctgagtccaggaaccctgcaggaagaccaggcaacactgctgtcaaaacgcctggtggattggttgcgctacgcctcacttcagcagggattacctcactccgggggatttttttctacccctcgcgcacgccagcccggaccagttaccgaggttgatggtgctgttgccaccgatttctttacagtgcttagcagcgggcatcgcttcaccgatgaccagtggcttaacgtacaggctttttctatgctcagagcctggctcctgcactcgggtccagagggaccaggaactctggataccgacgaccggagcgagcaggagggcagtacgctcagcgtcattagcgctacatctagcgctggccgtctgctccccccacgagagaggctgcgggaagtggcctttgagtattgccaaaggttaatagagcagagtaaccgccgagccctccgtaaaggggactccgacttgcagaaggcgtgcctggttgaggctgtgttggttcttgatgtgctatgcaggcaagatccttcattcctgtatagatcgcttagttgcctgaaggccctccacggcagagtgcgcggtgatccagcttctgtaagggtgttactacccctggcccacttttttctgtctcacggcgaagctgcggcagtcgattccgaggctgtatatcagcacctctttacaagaatccccgtcgagcagttccactctccaatgctcgcattcgaattcattcagttttgccgcgacaacttgcacctgttctcaggacacctttccacactgaggctgagcttccccaacctatttaaatttctggcctggaacagcccaccactgacttctgaattcgtggctctgctgccagccctggttgacgcaggaactgcccttgaaatgttgcatgccctgctcgacctgccgtgcttgacggctgtcctagatctgcagctgcgtagcgctccagcagcctcagagaggcctctatgggacacttcgttgcgtgccccttcatgtctggaggcttttcgggatccacagttccagggactgttccagtatttgctccggcctaaggctagtggcgcaaccgaaagactggcccctctgcatcagttgctgcagcccatggccggatgcgctagggttgcccagtgcgcacaggctgtacccactctgttacaggcgttttttagcgctgtgacacaggttgcggacggctcgctaatcaaccaactggccttgctccttctcggccgtagcgattccctgtaccctgcccctggctacgccgctggggtccatagcgtgctctcttcgcagttcctcgctctttgcacgctcaagccatcactggtggtcgagctggcacgagatcttcttgagttcctggggagcgtgaatggtctttgcagccgggcaagcctggtgaccagtgtagtctgggccataggagagtacctctccgtgacatacgatagacgatgcactgtggagcagatcaacaagttttttgaagcgctcgaggccctgctattcgaagtgactcagtgtaggccgtcggctgccctcccacgctgtcccccacaggttgtcactgttctcatgacaacattaacgaagctggcttccagatcccaggatttgatacccagggcgtctttactgctttctaagatgaggaccctggcacacagtccggcaacttcgtctactcactccgaagaaggcgcagaggccattaggacaagagccacagaattgctgaccctgttgaagatgccctcagtggcccaattcgttctaaccccctcaacagaagtttgctcacctagataccatcgtgatgcgaatacagccctgccccttgccttgcggacagtgtcacgtctggtggagagagaagcgggactgatgccaggctag

SEQ ID NO: 236631 - DNA, 4086 bp, Artificial Sequence
  Description of Artificial Sequence: Synthetic coding sequence
atgggtgcagccggtcgacaagattttctgtttaaggccatgctgacgatttcctggttgacactgacgtgtttccccggtgcaacaagtaccgtcgcagctggatgtcctgatcaaagccctgaactgcaaccatggaatccagggcatgaccaggaccatcacgtgcacattgggcagggtaagaccttgctactgacgagttccgccaccgtttacagcattcacatttcagagggtggaaaactggtgattaaagaccacgacgagccaatcgtgctgcggacgcgccacatcctgatcgacaacgggggtgagctacacgctgggtccgctctgtgtccatttcaaggaaattttaccatcattctgtatgggagggccgatgagggcatccagccagacccatattacggactaaaatatatcggagtgggaaaggggggtgcgcttgaattacatgggcagaaaaagctcagctggacttttttgaataagaccctccaccctggcggtatggccgaaggcggatacttttttgagcgctcgtggggacataggggcgtgatcgtgcatgtgatagaccctaaatctggcactgtgatccatagcgaccgattcgacacgtacaggagcaagaaagaaagcgagcgccttgttcagtacctcaacgcagttcccgatggcagaatcctttctgtggccgtgaacgatgaaggaagccgaaatcttgacgacatggcacgcaaggccatgacgaagctaggttcaaaacacttcctccatctgggtttccggcacccctggtcatttctgaccgtgaaaggaaacccttccagctctgtggaggatcatattgagtaccatggccacagaggcagtgctgccgctagggtttttaaactgttccagaccgagcacggcgaatatttcaatgtatccctgtcctccgaatgggttcaggacgttgagtggacagaatggttcgatcacgataaggtctcccagactaagggcggtgagaaaattagtgatctgtggaaagctcatccgggaaagatctgcaatagaccaatagacatacaggctacaacgatggacggcgtcaacttatccacggaagtggtatacaagaagggtcaggattacaggtttgcatgttatgacaggggccgagcatgcaggagttatagagtccggttcctgtgtggcaagcctgtaaggccaaaactgactgtgacaatcgatactaacgttaatagtacaatcctgaatctggaggataatgtccagagctggaagccaggggacacgctggttattgcctccaccgactattccatgtaccaggccgaagagtttcaggttctgccttgtcgctcctgcgctcccaaccaggtgaaggtggccggtaagcccatgtaccttcacattggcgaggagattgacggggttgacatgagagcagaagtagggcttctgtccagaaacatcatagtaatgggggagatggaagataaatgctatccttacagaaatcacatttgcaatttctttgatttcgatacattcggcggtcatatcaagtttgccttgggctttaaagccgcacatctagaaggcactgaactgaaacatatggggcagcagctggtcggacagtaccctatccacttccacctcgcgggagacgtcgacgagcggggagggtacgacccccctacgtacatacgggatctttcgattcaccacacgttctctagatgtgtcaccgtgcacggtagcaatggcctcctgattaaggacgtggtcggatataattctctgggccattgcttttttacggaagatggacctgaagagaggaacaccttcgatcactgtctcggactgctggtgaaatcagggacgcttctcccctctgatcgcgactcaaagatgtgtaagatgatcaccgaggactcataccccggatatattccaaagccccgtcaagactgtaacgcggtctctacgttttggatggcaaaccccaataataacttaatcaactgcgctgctgcaggctccgaagagactggcttttggttcatatttcaccacgtgcccaccggtccctctgtggggatgtattcccctggatattccgagcatattccactaggcaagttttacaataatagagctcactccaattatcgagctggcatgatcatagacaatggcgtaaagactactgaagcttctgcgaaagataagcgcccatttttaagcataattagcgcgcgatatagcccgcaccaggacgcagaccctttgaaacccagggagccggcaatcatccgccacttcattgcctataagaaccaggaccacggggcatggttgcgcggaggagatgtctggctcgattcctgccgattcgcggacaacggcatcgggttgaccctggcttctggaggcacatttccatacgacgacgggtcgaagcaggagattaaaaactccctgtttgtcggcgagagtggcaatgtaggcacagagatgatggacaatcggatctggggacccggtggcttagatcactccgggaggactctcccgatagggcagaatttcccgatcagaggcattcagttgtacgatgggcctatcaacattcagaactgtacatttaggaagtttgtggctctggaggggcgtcatactagcgccctggccttccgcctcaacaatgcatggcagtcatgcccccataataatgtcaccggcattgcctttgaagatgtgcccatcacttctcgggtcttcttcggagagcccggaccctggttcaaccaattggatatggacggcgataaaaccagcgtgtttcacgacgtcgacggcagcgtgtcagaatatcccggtagttatctcacaaaaaatgacaattggctggttcgccaccctgattgtataaacgttcccgactggcgtggcgctatttgttcaggatgctacgcccagatgtatatccaggcctacaagacaagcaatctacggatgaagattataaaaaacgactttccaagccacccgctgtatctagagggagcactgacacgtagtacgcactatcagcagtatcaacctgttgttactctgcaaaaggggtacaccatccattgggaccaaaccgctccggctgagctcgcaatatggctcattaacttcaacaagggagactggattcgtgtggggctgtgctaccctagaggcaccactttctcaatactgagcgacgttcacaaccgcctactgaaacaaaccagcaaaactggcgtgttcgtgaggacgctgcaaatggacaaggtagagcagagctatcccggacggtcacactactactgggatgaagatagcggactgctgtttctgaagctgaaagcgcaaaatgagagggagaagttcgccttttgctctatgaagggttgtgagaggattaaaattaaggctctcattcctaagaacgccggagtaagcgattgcacagctactgcatatcctaagttcaccgagagagctgttgtggatgttcctatgcccaagaagttatttgggagtcaactcaagaccaaagatcattttttggaggtgaaaatggagagcagtaagcagcactttttccatttatggaatgactttgcctatattgaggtcgatggcaagaaatacccaagttccgaagatggcattcaggtagtggttattgatgggaaccagggcagagtcgtgtcccacacatcctttaggaacagtatccttcagggaatcccttggcaattgttcaattatgtagccacgatcccagataactccatcgtgcttatggcatctaaaggacggtatgtatccaggggtccttggacaagggtcctcgagaaactcggtgccgaccgcggactgaaactgaaggagcagatggcgtttgttgggtttaagggatcctttcgccctatctgggtcacattagatacagaggaccacaaagccaaaatcttccaagtcgtccctattccagttgtgaaaaaaaaaaagctgtag

SEQ ID NO: 236632 - DNA, 1866 bp, Artificial Sequence
  Description of Artificial Sequence: Synthetic coding sequence
atggctaatgtgccatgggctgaagtttgtgagaagtttcaagccgcactggccctgtctagagtcgagttgcataagaacccagaaaaagagccttataagagcaaatatagcgctagggctcttttggaagaggtgaaggcattgctcggcccagcaccagaggacgaagatgagcgacccgaggccgaggatggaccaggcgcaggcgatcacgcactggggttgccagctgaggtcgtggaacctgagggccctgtagcccagcgggcagtgagactggctgttatagagtttcacctgggagtgaaccacatagacaccgaggaactctcggctggagaggaacacctcgtgaagtgtttgaggctgttgagaagatatcgattaagccacgattgtatcagtctctgcatccaggcacaaaacaacctgggcatcctgtggagtgagcgggaggagattgaaaccgcccaggcctatctggagagctccgaggcgctatacaatcagtacatgaaggaggtgggctccccccctctcgatccgactgaacggttcctgccagaggaggagaaactgactgagcaggagcggtccaaaagattcgagaaggtctatacccacaacctgtattatctggcccaagtctaccaacacctagaaatgttcgaaaaagctgcccactactgtcacagtacactgaagcggcaactggagcacaatgcctatcatcccatcgaatgggcaattaacgccgctaccctctcccagttctacataaacaagctctgctttatggaggcacggcactgtctgagtgcagcgaacgtgatcttcggacagacaggaaaaataagtgccacagaggatactcccgaagcagagggggaggtacccgaactctatcatcagcgcaaaggagagattgccagatgttggattaaatactgcttgactctgatgcaaaacgcccagctcagtatgcaggacaatattggcgagctcgatcttgataagcaaagcgaactccgcgctcttcgaaagaaagaacttgacgaagaagagagcatcaggaagaaggctgtgcagttcgggaccggagagctttgcgacgctatatccgctgtggaagaaaaagtgagctacctgcgtccccttgacttcgaagaggcccgagagctgtttctcctcgggcaacactacgtttttgaggcgaaagagttctttcaaatcgacggttatgtgacagaccatatcgaagtggtgcaggaccactccgctctgtttaaagtcctggctttctttgagactgacatggagcggaggtgtaaaatgcataagagaagaatcgcaatgctggagcctctgactgttgacctgaaccctcaatattatttgctggtcaacagacaaatacagttcgaaattgcacacgcttactacgatatgatggaccttaaggtcgctattgctgacagactaagggatccggattcgcatattgtgaagaagataaataacctgaacaaatccgccctgaaatactatcagctgttcctggactctctacgagatcctaacaaagtgtttcccgagcatataggagaggacgtgctacgccctgccatgttagcaaagttcagagttgctcggctctatggaaagataattaccgctgacccaaaaaaagagctcgagaacctggcgaccagtttagagcactataaattcatagtggattactgcgaaaaacatccagaggcagcgcaggaaatcgaggtggagcttgagctgtctaaggaaatggtaagcctgctccccaccaaaatggaaaggttccgaaccaagatggctctcacctag

SEQ ID NO: 236633 - DNA, 4550 bp, Artificial Sequence
  Description of Artificial Sequence: Synthetic coding sequence
atggacaatcagcaggacaaagccatcgtggcttccgctaacggcgaaaataccctcatcaatggcgtgaaggagaacgactccgaggaccaggacgttgccatgaaatctttcgcagctctagaagcagccgctcccattcagcctactcccgtcgctcagaaggagaccctgatgtatcccagaggactgctccccctgccatcaaaaaaaccttgcatgcagagccccccaagccctttgggcctcatagaagctcctgaacacgccgctaatagcgcctcggtaaacgcgatttcactgacaagcggtatcgctaaggggctgaatacctggtctctcccgaatgagtgtgaaaaggccccttttgcaatcatggaacctgccggtatgtctgccctgaacggcgactgcctcatgcagccctccagaacatgtttaggttgttttatggagagcaaggatgcagtggatccagagccaggtatttccctgaaggttggagatctcaaccgcgactacgagacttgcgccgtcagcgacatcgggatacagtgcattaatgctggtgagaacatgaagtatggggagcaacttcttagtgaccagctgttggggttcccactgcataagtctcgggcaggggaccgcagggagaccgagaagcccgacatcgatctcgaggaccctgcccagaaatcatactacgaggccctactgctggacaaatgtaatacagaggaggccctcctcgcaaatagcaatcaggattggggatattttgagaccttcattagtgagtcaaaaatagaactgctagatctctgtagcaaaaatgagctgtccgtcaacctatttagtgaagaagatgttgacaactacatgttcgatgacgacgaatccaccttaggaagcgatgtgtgttccctgaaaatccggtacgagtccttccaagacaacgtgagagataaaaccacgcttttaatgcaggaggacgcacaattcaacttcttcccatcggtttttacaacctgcccaaagcgggagtcaaaatccggggctctcaaacagagtagcgatttcagccagttcaaggtacctgacgtgtccataatctggggcgaggaagacaaaaatttggataaaaaaaaaggcaaagaagaaggacaggaagacaagggggtggaaaagaaggatggtaaagacaacggggaaaagcctgcgcttaacaaaccttgtagcggaacagaggtggagcagcttaagaatcccaagcagggccatctggccaactctctcgaaacttccggatcattttctgatgactctagttttattgaaatttcatacgacgctatgggagagatcaaggattgcagtaggtatatggccagagatacgaatagtgggtcaagcagctctcagcaaaactacggcctgagggccaaacggaaagtaaggtactccgaggactacctttacgatgttgatagcctagagggggagaaggtcaacgagagaaaagaatggttgccagttggatccaaagaggaagatgacgacgagtggtgtcccaagaagaggcgaaaggtaactcgaaaggagccacccgtgatcataaaatacataatcattaataggttcaaaggagagaagaacatgctagtgaaactcggcaaggtggatgcttccgagactactgtaaacttgagcgaaaatcaattgaacaagtatgctaagctagcccctttgaagggtttctggcagaagaagaaaaagcagcgcaacaccaacaccgattctatcaagacacctttctcacagaagcagtcctttgaaccagggtcgttcgaggtttcttttctccccccagctcgcaagcggaaatccaagctcggcaataggcatcgcatccagcgcatcccaagcattgaaatctccgcttcgagtaaacagattagcctgtgtaatgaccagaggcacgccagtaatcataaggaggatggcggactgaaaggcacattaaagtcagctcccctcggtgctcccagttgcgcaaatggaagccacttaaatgatattaccggtcccgattcagttaaagtgaaagctcaggacactgagttcaaggggcctgagagaaaagtactgaacaaaattaaatttaaatctgaggccaggcttaagtctaagaaagtaaaagccgctggccaggaatcaaagcctatagtccaaatgtcgcccttgcttgagaaccagagtagtaaggccaacctgaaaaatgaggtgatacctggtactagcaatagcagcagactcagcgaattccacgaggcaaaggcggcaaaaagcagcacctttttgcccacaacttgcagcagcgaaatgccactgtcatctgccaatgtaacaacgaatatcccagtaatacctggcggataccttcagaccttgctggatgcaagcgacctctccaacaacacgagcatctcctacttttcccatcacagtcctgagcaaaacgaggggagtctgactcaaactgaaaagtctttcgtgcccttgcaacctacccaggattgtgtgctgacttctagctcagactccgagttgcagcagagctcccataactttaagatggaatcatcaaactataggaacgtttggcctaacaaggccacaagtggcacccaggagtttatggcagaggtctcccgggagatcgcgcctacccaaagttctgaatttggtgcgtcacaggtggtgagtatggagaacaacttgacccccacgacatacaatcccatctgcctaaatagcggcggttccaactgtaataaagtcctatacgattcaatgcaggatactcagctcccttccgatgacagctaccagctatgtcattttaacaacggcgagatctgttttccattccagcaggggcctgtgaatatggacgacgggaggctcttctccttcgactccatggccccactctcggtgtccagttcgaactactgcagcctgtctcttaaatcatgcgagaaggacggggacgacgacattacagacgacttcctggctcactgtagcccaaaactggttattcagcagagcatcgacgaaattgctcccctgaaagaatcaaccgacctgctcgacatctccaacttcacccccgataagtttaggcactcctctttaagtgagatgtcacccccagataccccgagcctaagtccacagatcacccgctgtgaaagcatgaaaaccctaggcacgctcaaggggttccaggaaggcgtgccgggtccactggattcagtcgagaaaattaaatgggactgtagtacactgagccggcaggtccagatggaggatggattcacgttgaacaatcaccagtttcagtttcacatgtttaatgatgaagattccgtgtccctgcttcagaagaacccttgtctgtccacatttaacgacccttccggacaaatctctacaaacaataaggtgagtaagtcgcgaaaaaagagcagcccttcaaagtcaggggctatgaaccagtcttcctctcagaaaaacactagaaagaaaagtctgaagggcaacaacaaaggcattgagaagccgcctggcaaaaattcacgtcaggtgcctaaatcaacaaagaaggggaaatacatggcggctatcaatggagaaaagatgcagatcggtatcggcaggggtgggagccagactaatactatctcgtccaccggcaaaactctcgccgagtgcatacaacacggagggccaatggcatccatgaaaatgccctcgcagaaagggctgagcggggactgggccctaggaaaagaatcatcgccaggatggagcgacatgtctatgggaacgaacaccaactcgctgctcgatgatgaccagcgggagtttcaggagccatcctacatcctcagcaacatcgcaagtggaatggccgatgtgcagcgattcatgatggcctctattgagcctctctgggagcctatggagcaccacggggaccccaatatattttactcccctgagagcaatagcctgaaattgaaaactcttaagattctcgcaggcactcctcaggaaagcaagaaaaaaatcaatagtgggtcacaaggggctactaagaatcaccgcagcataaagggagtctctaagtccaatggtaagacggctattggagaccctggtagagctaacatgcctggatacaatgaggattcacggagcacgttcttcgataagaaatattccaacatgtcaaccttagggaacaatgggcctacccataaaaagctctataggcataaaagctcctctaaggccctcagggacgagaagtgcaagggaaagcacatggaacgcgaacaagtgcataaagacgagtcaggtacagcgtctttcgagaagcttcgggacagtgattacaacctgctgaaggccgaaaccactttctgggtgctccctgtctttgaggaggagacaaggatctttcaaaaggacatcta

SEQ ID NO: 236634 - DNA, 4080 bp, Artificial Sequence
  Description of Artificial Sequence: Synthetic coding sequence
atgtattcagtcgaggacctgctcataagtcatggctacaaactttcaagggacccccctgcttccagagaagataatccaaaggggagacaggcagcccgaaccggcacacgggcaggccaagggttacagaacggtcatgaagatggccctgccgctctggctcataggaagacatccgccggaaagggccacgtgtctgactctgaatcccgccgttctacaccgcgaggtcacggggagcctcagtccaccagcgcaagccgcacctcggaagccggattctgcaatcagcccccttccgcttggtcatcccatccgccaaccggaaacgaccaggcctatagaaggcgcggaaggcaggaagctagatcccagaagcctagggagcatgagaatctggaggcacggggaatggctcaggctcatagccttccagtgcacgtcagggaagggccttgggaggtaggtggaagatccgagcatgtgatgaagaagccagtttgggaagaggaacttcgcatgtccgggcctgctaagtggcaaaacgtgagcctggaaagctggaaccaaccaagaaaactcggacgccaaatgtccgatggggatggagagcgactgttccaagatttatacccctttatccaaggagagcacgtgctcaactcccagaacaaggggaagagtaggtcgctgccgagagttttatccccagagagcttatcctgcaccgaaatccctatcccactgaatgagcggcacagccctaagatgccaccttacccacctacttgtgccccaaacctcgatagcacacgtaactcggagaagagcggctgctctgcaccgttcccccgacctaagtttggaaggccgctgaagcctccaagctatagctcccatcagcaaagtcggggaggggcagatagctctgatagccaggacagccaacagatggacgcgtacgtgcccagacatgaattgtgcctttccgaccctggcctggagccacccgtttacgtgccaccgccttcatacaggtccccccctcagaatattccgaacccatatctggaggatactgtccctataaacgtgtgtggcggacactcgcaacaacagtctcctacagaaaaggccggtgcttccgggcaaccaccatcagggcctcctggtacaggaaatgaatatggcgtgtccccaaggctcccacaaggactgccggctcaccctcggccagtgacagcatatgatggtttcgtgcagtatattcctttcgacgatcccaggctacggcacttcaaactggctcagccacaggggttctgtgaggacatcaaactcgacgataagtcttacaattcaagccccgtgactgcacaggaaccagcccacgggggaatgcagcctgacggggctatctggaatccacagagcctgatcccaccatcgggggatgaacggggactagtgttggccgactcgtctccacggtggctttggggacagccaccaggcgacggcgagaacagcggattgccgaatcagcgcgatcgctgtgtggctcggggacagtggcccgacgtacggggaagtcagcacggccacaccggaaggcaagttagcagtccctactcgcagggcgaatctacctgtgagacacagacaaaacttaagaaatttcagacaggaactcggacaaagaagtctagcaagaagaaaatgaacgaaacaattttttgcctcgtgtccatccccgtgaagtcagaatctcacctccccgaccgggatatggacaacaacgacctgaagccatcagccgaccagaaaaacggatctgataagtctcccgctcttcaagagcagagtttactgtcaatgtcatccacagatctagagctgcaggcattaacagggagcatgggtgggagaacagagttccagaagcaggatttgggagagccagaagaggaccgccagacaaatgacttatctttcatccacctcaccaagcaccgggagctgaagcactctggctcctggccgggtcatagataccgcgaccagcagacacagactagtttctcggaggaaccccagtcttctcagctgctccccggtgctaaactgggcggtccgagtcgggcagctcttagcccgaagtgctcagacccagccgcttctgaggcccagacgcacaccgcatttcctacaggtgaccataagcaacgtccgagcgccaggaacctcaagggacacagaagcctgagtccatctagcaactccgcttttagtaggaccagcctttctgtcgatcaggcccctactcccaaggccggaaggagtcagccctgcgtcgacgttcacggcctcggagctcacccaggcccaaagagagaagttgtgaagggagagcccaccggaccctgcaattcaaagcagctctttggccagttcctcctaaagccggtgagccggagaccttgggacctcatctcccagctggaatctttcaataaggagttacaagaggaggaggaaagttctagcagctcatcttcctcttcatcatcttcggaagagtctgaagccgagccacagcaggagaatagggctcactgccgccaagaggacgtgggttttagagggaactccccggaaatgcgagtcgagccacagcccagaatgtgggtgcccgaatctcctgtatgccgtagtggcagaggggagagtaaatctgagtcctggagcgaagagcttcagccaggccaccccagggcctggccgccaagcccaggcaggttccgggtggaggaagggggtggtgctccgttttgcagtgccgacgggtcaacttctgctgagaaaagacatctagaagttagtaacggaatggatgagctggccggatctccgttcccagtgacaagaatgtctagcaggagttcagacgccaaaccgttaccagcgtcctaccctgcagagcctagggagccccaggagtcccccaagataacctccgcatttagctccgttaagccatccgaggccgtgccaagaaaatttgactcaggcggagaacggggagcgggtctgccgctgtcccttagcaataagaaccggggtctgtcagcccctgacctgcgctccgtgggtctgactccaggtcaagaacagggcgcttcagaactggaaggctccctgggggaggccagtactatagagataccacctggtgaaagcctgcaggcaagggcggctagaatcctgggtattgaggtcgctgtggaatccctgctgcccggaataagaagggcaggccagaaccagcctgcagagcctgacgcctccgcctgcaccccggagtctcctcaagaagagctgttgagccgtcccgcacctgcggatgtccccagggtcagcactgatgcattctatggcagacgtaaatgcggctggaccaaatctcctctcttcgtcggtgatcgggatagtgcccgtcgcgctccccaggcctttgagcactctgacgtggatggggtggtcacatccacggatccggttcctgagccagaaccgagcccgctcgagtcaaaatttttcgaacagaaggatgtggaaaccaagccgccattcaggagcaccctattccacttcgtagagaggactccgagcgttgctgggagcgagaagcgtttgcgcagcccgtcaaaagtgattgagagcctgcaggaaaagctcgcgtcacctccgagacgagctgacccggacagattgatgcggatgaaagaagtcagctcggtctcccgaatgcgagtgctgagcttcaggaatgccgacagccaggaagatgcagaagagttgaaagcaacaacacggggacaagctggtctgccaggaggacttgtgtcccctggctccggcgatcgtgcccaacgcctgggacattcactgagtgtgagcaaggactcgatatcacgtgaggagaaagagcacccggctgcgcagaaagagaaatcaatggatcaggacttctggtgccctgacagttatgacccatcgcgagtcgagagagtttag

SEQ ID NO: 236635 - DNA, 3219 bp, Artificial Sequence
  Description of Artificial Sequence: Synthetic coding sequence
atggcccctcctactggcgtcttgtccagtttgctgttgctggtgactatcgcaggctgcgcacgcaagcagtgttccgagggtcgaacctactcgaacgccgtcatatcccccaacttggaaacaactcgaattatgcgggtatcacacacttttcctgtggtggattgcacagcagcctgttgtgacttgagcagctgcgatctagcctggtggttcgagggcagatgctatttggtctcctgcccccacaaggaaaattgcgagccaaagaagatgggcccaattaggagttatttgactttcgtcttgaggcccgttcaacgacctgcacagctccttgactatggagacatgatgctgaaccgtggaagcccgagtgggatttggggcgatagcccagaggatatccggaaggatctgactttcctgggcaaagactgggggctggaagagatgtcggaatattctgacgactaccgtgagctggagaaggatctgctacagccatcgggcaagcaggaaccgcgaggatctgctgagtacaccgattggggtcttttgcctggctcagaaggcgcatttaattcatccgtcggggatagtcctgccgtgcctgccgaaacgcagcaggatccagaattgcattaccttaacgaatccgcctcgactccagccccaaagttacccgagcggtccgtactgctgccattgccaacaacaccctcttcaggggaggtgttggagaaggaaaaggcaagccaactccaggaacaatccagtaactctagtggcaaggaggtcctaatgcccagtcattcactgccaccagctagcttggagctgagttccgtgaccgtggagaagtctccagtgctgacggttacccccggttccaccgagcacagcatccctactcctccgacatcagcagccccaagtgaaagcacccccagcgaactacccatctcccccacaactgccccaagaaccgtgaaggagctgacagtgtctgctggcgataacctgatcattacgcttcctgataatgaggtcgaattaaaagccttcgtggcacccgctcctccagtggaaactacatataactacgagtggaatcttattagccatcctacagattaccagggcgaaattaagcaaggacacaaacaaaccctgaatctgagccagctgagcgtcggactgtatgtattcaaggtgacggtgagctccgaaaacgcctttggggagggttttgtgaatgttactgttaagcccgcaaggagggtgaatctccctccagttgcggtcgtttccccacagcttcaggagctcactctgcccctgacttcagccctgatagacggctctcagtcaaccgatgacaccgagatcgtgagctaccactgggaggaaatcaatggaccatttattgaagagaagactagtgtggatagtccagtgctgaggctgtcaaatctggaccctggcaattactcgtttcgactgaccgtcaccgactccgacggcgctaccaatagcaccaccgccgctcttattgtgaacaacgctgtcgactatcccccagtcgctaatgccggacccaatcatactatcacgctgcctcagaactctattactctgaacgggaaccaaagcagcgatgaccatcagatcgtgctgtatgaatggtcgctggggcctggatctgaaggcaagcacgtggtaatgcagggagtgcagaccccatacctgcatctgtctgctatgcaggagggagattatacattccagttgaaggtgacggacagctccaggcagcagtcaacagccgtggtaacagttatagtgcagccagaaaataatagaccccctgttgccgttgctggcccagataaggagctgattttcccagtggagtctgccacgctggacggcagctctagctcggatgaccacggtattgtgttctaccactgggaacatgtgagaggcccttctgccgttgagatggagaatattgacaaggctatcgccaccgtcacgggcctgcaggtcggaacgtatcacttccgactgacagtgaaggatcaacagggcctgagctcaacctcaacactcaccgtcgcagtgaagaaggagaataatagtccacccagggctcgggctgggggtcggcacgtccttgtgctaccaaataactcaatcaccttggatggttctcggtcaacagacgatcagaggatcgtgtcttatctttggatccgagatgggcaatctccggctgccggtgatgttattgacggcagcgatcatagcgttgctttgcaattaacgaatctggtggagggtgtttacacattccatttgagggtaaccgacagtcagggggcatctgacacagacactgcaacagtcgaagtgcagcctgatcccaggaaatctggattggtcgagcttactttgcaggtaggcgtgggccagctcactgaacagaggaaagatacactcgtgcgccagctggctgtcctcttaaatgtgttagacagcgatatcaaggtgcagaagattcgggcacatagtgacctatctacggtaatcgtattttacgtccagtcccggccacccttcaaggtcctcaaagccgcagaggtggcacgaaacctgcacatgaggctgtctaaggagaaggcggatttcttactgtttaaggtgctcagggtagacaccgccggttgtctgctcaaatgcagcgggcacggccactgtgaccctttgacaaagcggtgcatctgcagccatctgtggatggagaacctgatacagcgctacatatgggatggagaaagcaactgtgagtggtctatcttctacgtgaccgttcttgcattcactttgatcgtgctcaccggcggttttacatggctgtgtatctgctgttgtaagagacagaagcgtacaaagatcagaaagaagacgaagtacaccattctagataacatggatgaacaggagcgcatggagcttcgcccaaaatatggcatcaaacatcgaagtactgagcacaattcctccctgatggtcagcgagtccgagttcgatagcgaccaggacactatcttctctagggagaagatggagcggggtaaccccaaggtgtcgatgaatggctctatccgcaatggcgctagcttttcatattgttctaaggatagatag

SEQ ID NO: 236636 - DNA, 918 bp, Artificial Sequence
  Description of Artificial Sequence: Synthetic coding sequence
tctcagctgcctgtgcgtgccgaggagcgtaccgaatcatgtctttggggatgttgggcatcctctcgggtaagaaggacgtcggacgcttgttcctcacctctggctacttctcgctcagcacgatcctgtggagtgctgaccgcacctgtcaagggtgcctcctcatcactggttgttaagctcgccgacacggaccgggagcgtgctttgcggagaatgcaacaaatggctggacacctaggggcatttcatccagcacctttacctctcggagcttgcggggcttacaccacggctatactgcaacaccaggccgctctactggccgctgcacagggcccaggcctcggtcccgtggcggctgtcgccgcacagatgcagcatgtagccgcattctcattggtggctgccccactactacccgcagcggcagctaattcgccacctgggtctggtcccggaacgctccctggcttgccagctcctatcggcgttaatggctttggacctctgacaccacagactaatggacagcccggatcggataccctgtataacaacggcctgtccccttaccctgctcagagtcctggcgtagcagacccactccagcaggcgtacgcgggtatgcatcactacgcaggacccgaggggtgcaatctgtttatctatcacctcccgcaggagttcggcgacgcagaattgattcagacctttctgcctttcggcgctgtggtctctgcaaaggtgttcgttgatcgggctactaaccagtccaagtgctttggcttcgtgtcctttgacaaccccacttctgcgcagacagccattcaggccatgaacggattccagattggaatgaagagacttaaagttcagttgaaacgcccaaaagatgctaaccgcccatattag

SEQ ID NO: 236637 - DNA, 198 bp, Artificial Sequence
  Description of Artificial Sequence: Synthetic coding sequence
atggtccggaccaaggccgactctgttcccggaacctaccgaaaggtcgtcgcagccagagctccgaggaaggtgttgggttcatcaacttcagctaccaactcgacgtcagtatccagcagaaaagaacacgttctgtgtaacttgattactcagatgatgaagaagaatcgtactttctccttcattttcgaatag
